United States Patent 12,590,386 (RECOMBINANT POLYCLONAL PROTEINS AND METHODS OF USE THEREOF) - sequence listing, part 4

SEQ ID NO: 85565 - protein, 9 aa, Homo sapiens
  light chain complementarity determining region 3 for antibody 42783
QQSYSSPFT

SEQ ID NO: 85566 - protein, 16 aa, Homo sapiens
  heavy chain complementarity determining region 3 for antibody 42783
ARYYYGSGSYSDVFDI

SEQ ID NO: 85567 - protein, 9 aa, Homo sapiens
  light chain complementarity determining region 3 for antibody 42784
QQSYSSLYT

SEQ ID NO: 85568 - protein, 15 aa, Homo sapiens
  heavy chain complementarity determining region 3 for antibody 42784
AKDLVPVGTTWAFDF

SEQ ID NO: 85569 - protein, 10 aa, Homo sapiens
  light chain complementarity determining region 3 for antibody 42785
QQSYSPSMYT

SEQ ID NO: 85570 - protein, 17 aa, Homo sapiens
  heavy chain complementarity determining region 3 for antibody 42785
ARETAQVGIEYWRYLDL

SEQ ID NO: 85571 - protein, 9 aa, Homo sapiens
  light chain complementarity determining region 3 for antibody 42786
QQSYSPPFT

SEQ ID NO: 85572 - protein, 14 aa, Homo sapiens
  heavy chain complementarity determining region 3 for antibody 42786
ASSYDTSGYSAMDV

SEQ ID NO: 85573 - protein, 9 aa, Homo sapiens
  light chain complementarity determining region 3 for antibody 42787
QQSYSPPFT

SEQ ID NO: 85574 - protein, 15 aa, Homo sapiens
  heavy chain complementarity determining region 3 for antibody 42787
ARDLSGVDTEGGFDS

SEQ ID NO: 85575 - protein, 9 aa, Homo sapiens
  light chain complementarity determining region 3 for antibody 42788
QQSYSKPWT

SEQ ID NO: 85576 - protein, 14 aa, Homo sapiens
  heavy chain complementarity determining region 3 for antibody 42788
ARDLSSGTYRRFDP

SEQ ID NO: 85577 - protein, 9 aa, Homo sapiens
  light chain complementarity determining region 3 for antibody 42789
QQSYSIPRT

SEQ ID NO: 85578 - protein, 17 aa, Homo sapiens
  heavy chain complementarity determining region 3 for antibody 42789
VRGVTMIVVGLSNWFDP

SEQ ID NO: 85579 - protein, 10 aa, Homo sapiens
  light chain complementarity determining region 3 for antibody 42790
QQSYSGSALT

SEQ ID NO: 85580 - protein, 15 aa, Homo sapiens
  heavy chain complementarity determining region 3 for antibody 42790
VRPLLEQSLKYYLDQ

SEQ ID NO: 85581 - protein, 9 aa, Homo sapiens
  light chain complementarity determining region 3 for antibody 42791
QQSYSAPRT

SEQ ID NO: 85582 - protein, 10 aa, Homo sapiens
  heavy chain complementarity determining region 3 for antibody 42791
ARGGGYYMDY

SEQ ID NO: 85583 - protein, 10 aa, Homo sapiens
  light chain complementarity determining region 3 for antibody 42792
QQSYRIPGLT

SEQ ID NO: 85584 - protein, 11 aa, Homo sapiens
  heavy chain complementarity determining region 3 for antibody 42792
ARDNNFWQPDY

SEQ ID NO: 85585 - protein, 10 aa, Homo sapiens
  light chain complementarity determining region 3 for antibody 42793
QQSYNTPPWT

SEQ ID NO: 85586 - protein, 12 aa, Homo sapiens
  heavy chain complementarity determining region 3 for antibody 42793
ARVSPVRGVIEY

SEQ ID NO: 85587 - protein, 9 aa, Homo sapiens
  light chain complementarity determining region 3 for antibody 42794
QQSSTTPWT

SEQ ID NO: 85588 - protein, 18 aa, Homo sapiens
  heavy chain complementarity determining region 3 for antibody 42794
VKVAYCVGDCKWGGTLDY

SEQ ID NO: 85589 - protein, 9 aa, Homo sapiens
  light chain complementarity determining region 3 for antibody 42795
QQSSSTPWT

SEQ ID NO: 85590 - protein, 18 aa, Homo sapiens
  heavy chain complementarity determining region 3 for antibody 42795
VKVAYCVGDCKWGGTLDY

SEQ ID NO: 85591 - protein, 9 aa, Homo sapiens
  light chain complementarity determining region 3 for antibody 42796
QQSSSIPYT

SEQ ID NO: 85592 - protein, 13 aa, Homo sapiens
  heavy chain complementarity determining region 3 for antibody 42796
SRMTWHTPLMFDY

SEQ ID NO: 85593 - protein, 8 aa, Homo sapiens
  light chain complementarity determining region 3 for antibody 42797
QQSSDWLT

SEQ ID NO: 85594 - protein, 12 aa, Homo sapiens
  heavy chain complementarity determining region 3 for antibody 42797
ARTQWHTMSVDY

SEQ ID NO: 85595 - protein, 9 aa, Homo sapiens
  light chain complementarity determining region 3 for antibody 42798
QQSNDTPFT

SEQ ID NO: 85596 - protein, 12 aa, Homo sapiens
  heavy chain complementarity determining region 3 for antibody 42798
ARDGTGTGGFDY

SEQ ID NO: 85597 - protein, 9 aa, Homo sapiens
  light chain complementarity determining region 3 for antibody 42799
QQSHTTPPT

SEQ ID NO: 85598 - protein, 18 aa, Homo sapiens
  heavy chain complementarity determining region 3 for antibody 42799
VQLSGYCRDHGYCPPFAY

SEQ ID NO: 85599 - protein, 9 aa, Homo sapiens
  light chain complementarity determining region 3 for antibody 42800
QQSHGTPVT

SEQ ID NO: 85600 - protein, 22 aa, Homo sapiens
  heavy chain complementarity determining region 3 for antibody 42800
GRGFRHYERSSYFSWGGEYYQD

SEQ ID NO: 85601 - protein, 9 aa, Homo sapiens
  light chain complementarity determining region 3 for antibody 42801
QQSGSSPWT

SEQ ID NO: 85602 - protein, 12 aa, Homo sapiens
  heavy chain complementarity determining region 3 for antibody 42801
ATRAQIFGVLNY

SEQ ID NO: 85603 - protein, 9 aa, Homo sapiens
  light chain complementarity determining region 3 for antibody 42802
QQSFSTRYT

SEQ ID NO: 85604 - protein, 14 aa, Homo sapiens
  heavy chain complementarity determining region 3 for antibody 42802
ARIVVHSGSLSYDY

SEQ ID NO: 85605 - protein, 9 aa, Homo sapiens
  light chain complementarity determining region 3 for antibody 42803
QQSFSGPRT

SEQ ID NO: 85606 - protein, 21 aa, Homo sapiens
  heavy chain complementarity determining region 3 for antibody 42803
ARWGDCTGSNCYKYYYYGLDV

SEQ ID NO: 85607 - protein, 9 aa, Homo sapiens
  light chain complementarity determining region 3 for antibody 42804
QQSFNTPFT

SEQ ID NO: 85608 - protein, 10 aa, Homo sapiens
  heavy chain complementarity determining region 3 for antibody 42804
ARDTDTAFGV

SEQ ID NO: 85609 - protein, 9 aa, Homo sapiens
  light chain complementarity determining region 3 for antibody 42805
QQSFDTPWT

SEQ ID NO: 85610 - protein, 16 aa, Homo sapiens
  heavy chain complementarity determining region 3 for antibody 42805
ARGFGDSFRRAGIFDY

SEQ ID NO: 85611 - protein, 9 aa, Homo sapiens
  light chain complementarity determining region 3 for antibody 42806
QQSFATPRS

SEQ ID NO: 85612 - protein, 12 aa, Homo sapiens
  heavy chain complementarity determining region 3 for antibody 42806
ARQEDIVAPFDY

SEQ ID NO: 85613 - protein, 9 aa, Homo sapiens
  light chain complementarity determining region 3 for antibody 42807
QQSDTLPYT

SEQ ID NO: 85614 - protein, 11 aa, Homo sapiens
  heavy chain complementarity determining region 3 for antibody 42807
ARATMIEGIDY

SEQ ID NO: 85615 - protein, 9 aa, Homo sapiens
  light chain complementarity determining region 3 for antibody 42808
QQSDSTPYT

SEQ ID NO: 85616 - protein, 11 aa, Homo sapiens
  heavy chain complementarity determining region 3 for antibody 42808
ERHTHNGGHDY

SEQ ID NO: 85617 - protein, 9 aa, Homo sapiens
  light chain complementarity determining region 3 for antibody 42809
QQSDSPPLT

SEQ ID NO: 85618 - protein, 14 aa, Homo sapiens
  heavy chain complementarity determining region 3 for antibody 42809
ARDSQWLVQYGMDV

SEQ ID NO: 85619 - protein, 9 aa, Homo sapiens
  light chain complementarity determining region 3 for antibody 42810
QQSDSFPYT

SEQ ID NO: 85620 - protein, 17 aa, Homo sapiens
  heavy chain complementarity determining region 3 for antibody 42810
AREDYDSDVDEYRGLDV

SEQ ID NO: 85621 - protein, 8 aa, Homo sapiens
  light chain complementarity determining region 3 for antibody 42811
QQRSNWYT

SEQ ID NO: 85622 - protein, 17 aa, Homo sapiens
  heavy chain complementarity determining region 3 for antibody 42811
ATHLRKMATEELDAFEI

SEQ ID NO: 85623 - protein, 8 aa, Homo sapiens
  light chain complementarity determining region 3 for antibody 42812
QQRSNWPT

SEQ ID NO: 85624 - protein, 15 aa, Homo sapiens
  heavy chain complementarity determining region 3 for antibody 42812
ARVLVGFGELLGFDL

SEQ ID NO: 85625 - protein, 10 aa, Homo sapiens
  light chain complementarity determining region 3 for antibody 42813
QQRSNWPPLT

SEQ ID NO: 85626 - protein, 10 aa, Homo sapiens
  heavy chain complementarity determining region 3 for antibody 42813
ARDYTMTFDY

SEQ ID NO: 85627 - protein, 11 aa, Homo sapiens
  light chain complementarity determining region 3 for antibody 42814
QQRSNWPPILT

SEQ ID NO: 85628 - protein, 21 aa, Homo sapiens
  heavy chain complementarity determining region 3 for antibody 42814
ARHDPDNRQGGDTFAYNYFDQ

SEQ ID NO: 85629 - protein, 10 aa, Homo sapiens
  light chain complementarity determining region 3 for antibody 42815
QQRSNWPPGA

SEQ ID NO: 85630 - protein, 13 aa, Homo sapiens
  heavy chain complementarity determining region 3 for antibody 42815
TREGYNYGLAFDY

SEQ ID NO: 85631 - protein, 9 aa, Homo sapiens
  light chain complementarity determining region 3 for antibody 42816
QQRSNWPLT

SEQ ID NO: 85632 - protein, 20 aa, Homo sapiens
  heavy chain complementarity determining region 3 for antibody 42816
ARDNGLIPMVRGVMNNYFDY

SEQ ID NO: 85633 - protein, 10 aa, Homo sapiens
  light chain complementarity determining region 3 for antibody 42817
QQRSKWPLVT

SEQ ID NO: 85634 - protein, 14 aa, Homo sapiens
  heavy chain complementarity determining region 3 for antibody 42817
ARDLGCGDGVCSDH

SEQ ID NO: 85635 - protein, 8 aa, Homo sapiens
  light chain complementarity determining region 3 for antibody 42818
QQRSHWWT

SEQ ID NO: 85636 - protein, 12 aa, Homo sapiens
  heavy chain complementarity determining region 3 for antibody 42818
ARLRLRNKWFDP

SEQ ID NO: 85637 - protein, 10 aa, Homo sapiens
  light chain complementarity determining region 3 for antibody 42819
QQRSHWPPWT

SEQ ID NO: 85638 - protein, 14 aa, Homo sapiens
  heavy chain complementarity determining region 3 for antibody 42819
VRDIFPDFGDHGDY

SEQ ID NO: 85639 - protein, 9 aa, Homo sapiens
  light chain complementarity determining region 3 for antibody 42820
QQRSGWPFT

SEQ ID NO: 85640 - protein, 15 aa, Homo sapiens
  heavy chain complementarity determining region 3 for antibody 42820
AREGYYGSGRGGSDN

SEQ ID NO: 85641 - protein, 9 aa, Homo sapiens
  light chain complementarity determining region 3 for antibody 42821
QQRNNWRST

SEQ ID NO: 85642 - protein, 17 aa, Homo sapiens
  heavy chain complementarity determining region 3 for antibody 42821
ARDSGYSSGWGSGPFDI

SEQ ID NO: 85643 - protein, 8 aa, Homo sapiens
  light chain complementarity determining region 3 for antibody 42822
QQRNNWPT

SEQ ID NO: 85644 - protein, 17 aa, Homo sapiens
  heavy chain complementarity determining region 3 for antibody 42822
ARDNRHLFGTGSSYFDS

SEQ ID NO: 85645 - protein, 11 aa, Homo sapiens
  light chain complementarity determining region 3 for antibody 42823
QQRNNFPAEYT

SEQ ID NO: 85646 - protein, 15 aa, Homo sapiens
  heavy chain complementarity determining region 3 for antibody 42823
AREGVERLTMSAFDL

SEQ ID NO: 85647 - protein, 9 aa, Homo sapiens
  light chain complementarity determining region 3 for antibody 42824
QQRDNWPLT

SEQ ID NO: 85648 - protein, 14 aa, Homo sapiens
  heavy chain complementarity determining region 3 for antibody 42824
GRVGGKGNYGHIYD

SEQ ID NO: 85649 - protein, 9 aa, Homo sapiens
  light chain complementarity determining region 3 for antibody 42825
QQNYSPPVT

SEQ ID NO: 85650 - protein, 17 aa, Homo sapiens
  heavy chain complementarity determining region 3 for antibody 42825
ARDLISTPYYYYYGMDV

SEQ ID NO: 85651 - protein, 9 aa, Homo sapiens
  light chain complementarity determining region 3 for antibody 42826
QQLNSYPYT

SEQ ID NO: 85652 - protein, 15 aa, Homo sapiens
  heavy chain complementarity determining region 3 for antibody 42826
ARDGGVNDDSGHYYV

SEQ ID NO: 85653 - protein, 9 aa, Homo sapiens
  light chain complementarity determining region 3 for antibody 42827
QQLNSYPIT

SEQ ID NO: 85654 - protein, 13 aa, Homo sapiens
  heavy chain complementarity determining region 3 for antibody 42827
ARSEFAVDTIFDH

SEQ ID NO: 85655 - protein, 10 aa, Homo sapiens
  light chain complementarity determining region 3 for antibody 42828
QQLNSDPLST

SEQ ID NO: 85656 - protein, 20 aa, Homo sapiens
  heavy chain complementarity determining region 3 for antibody 42828
ARDLSLIESPGEYVYYGMDV

SEQ ID NO: 85657 - protein, 9 aa, Homo sapiens
  light chain complementarity determining region 3 for antibody 42829
QQLKSYPLT

SEQ ID NO: 85658 - protein, 13 aa, Homo sapiens
  heavy chain complementarity determining region 3 for antibody 42829
ASDLATVVTRRYY

SEQ ID NO: 85659 - protein, 9 aa, Homo sapiens
  light chain complementarity determining region 3 for antibody 42830
QQLHRHPAT

SEQ ID NO: 85660 - protein, 18 aa, Homo sapiens
  heavy chain complementarity determining region 3 for antibody 42830
ARGSPGIAVPATETAFDI

SEQ ID NO: 85661 - protein, 9 aa, Homo sapiens
  light chain complementarity determining region 3 for antibody 42831
QQKSAAPVT

SEQ ID NO: 85662 - protein, 17 aa, Homo sapiens
  heavy chain complementarity determining region 3 for antibody 42831
ARPVLRGSYGATDAFEL

SEQ ID NO: 85663 - protein, 9 aa, Homo sapiens
  light chain complementarity determining region 3 for antibody 42832
QQHSSYPLT

SEQ ID NO: 85664 - protein, 17 aa, Homo sapiens
  heavy chain complementarity determining region 3 for antibody 42832
ARLNRITTGDPHNWFDP

SEQ ID NO: 85665 - protein, 8 aa, Homo sapiens
  light chain complementarity determining region 3 for antibody 42833
QQHSDLIT

SEQ ID NO: 85666 - protein, 18 aa, Homo sapiens
  heavy chain complementarity determining region 3 for antibody 42833
AKGPVGSCSSRKCYHFDS

SEQ ID NO: 85667 - protein, 9 aa, Homo sapiens
  light chain complementarity determining region 3 for antibody 42834
QQHDSLPQT

SEQ ID NO: 85668 - protein, 13 aa, Homo sapiens
  heavy chain complementarity determining region 3 for antibody 42834
ARDQGKGSGWYDY

SEQ ID NO: 85669 - protein, 9 aa, Homo sapiens
  light chain complementarity determining region 3 for antibody 42835
QQHDSLPPT

SEQ ID NO: 85670 - protein, 9 aa, Homo sapiens
  heavy chain complementarity determining region 3 for antibody 42835
TRGAGTLDY

SEQ ID NO: 85671 - protein, 9 aa, Homo sapiens
  light chain complementarity determining region 3 for antibody 42836
QQGYTPPRT

SEQ ID NO: 85672 - protein, 12 aa, Homo sapiens
  heavy chain complementarity determining region 3 for antibody 42836
ATEFYDSSGLRY

SEQ ID NO: 85673 - protein, 9 aa, Homo sapiens
  light chain complementarity determining region 3 for antibody 42837
QQGYSTPLT

SEQ ID NO: 85674 - protein, 15 aa, Homo sapiens
  heavy chain complementarity determining region 3 for antibody 42837
ARAQVIWGQLYYFDF

SEQ ID NO: 85675 - protein, 9 aa, Homo sapiens
  light chain complementarity determining region 3 for antibody 42838
QQGYSPPQT

SEQ ID NO: 85676 - protein, 22 aa, Homo sapiens
  heavy chain complementarity determining region 3 for antibody 42838
ARSPPRDYDTSGNYLGVYYFDY

SEQ ID NO: 85677 - protein, 9 aa, Homo sapiens
  light chain complementarity determining region 3 for antibody 42839
QQGYITPYT

SEQ ID NO: 85678 - protein, 21 aa, Homo sapiens
  heavy chain complementarity determining region 3 for antibody 42839
AVLAGVEVKTGGPRWYNWFDP

SEQ ID NO: 85679 - protein, 9 aa, Homo sapiens
  light chain complementarity determining region 3 for antibody 42840
QQGYFTGIT

SEQ ID NO: 85680 - protein, 18 aa, Homo sapiens
  heavy chain complementarity determining region 3 for antibody 42840
ARDIMEGWSGSYGYGMDV

SEQ ID NO: 85681 - protein, 9 aa, Homo sapiens
  light chain complementarity determining region 3 for antibody 42841
QQFKTYPFT

SEQ ID NO: 85682 - protein, 14 aa, Homo sapiens
  heavy chain complementarity determining region 3 for antibody 42841
AKAKDSSGYHVFDY

SEQ ID NO: 85683 - protein, 9 aa, Homo sapiens
  light chain complementarity determining region 3 for antibody 42842
QQDGRSPRT

SEQ ID NO: 85684 - protein, 15 aa, Homo sapiens
  heavy chain complementarity determining region 3 for antibody 42842
AKDGEFCGSNCYFGS

SEQ ID NO: 85685 - protein, 9 aa, Homo sapiens
  light chain complementarity determining region 3 for antibody 42843
QQCHILPVT

SEQ ID NO: 85686 - protein, 23 aa, Homo sapiens
  heavy chain complementarity determining region 3 for antibody 42843
TRDFRSSETYLSSGPAGGDAFDI

SEQ ID NO: 85687 - protein, 9 aa, Homo sapiens
  light chain complementarity determining region 3 for antibody 42844
QQCENLPYT

SEQ ID NO: 85688 - protein, 15 aa, Homo sapiens
  heavy chain complementarity determining region 3 for antibody 42844
VRGRRGYYRRRHFDL

SEQ ID NO: 85689 - protein, 10 aa, Homo sapiens
  light chain complementarity determining region 3 for antibody 42845
QQCANLPPYT

SEQ ID NO: 85690 - protein, 13 aa, Homo sapiens
  heavy chain complementarity determining region 3 for antibody 42845
ARSFDILTAYLES

SEQ ID NO: 85691 - protein, 9 aa, Homo sapiens
  light chain complementarity determining region 3 for antibody 42846
QQAYNFPRT

SEQ ID NO: 85692 - protein, 11 aa, Homo sapiens
  heavy chain complementarity determining region 3 for antibody 42846
ASAPNFYYFDF

SEQ ID NO: 85693 - protein, 10 aa, Homo sapiens
  light chain complementarity determining region 3 for antibody 42847
QQATSLPPWP

SEQ ID NO: 85694 - protein, 20 aa, Homo sapiens
  heavy chain complementarity determining region 3 for antibody 42847
ARELSYTLFGVVITTHARDL

SEQ ID NO: 85695 - protein, 9 aa, Homo sapiens
  light chain complementarity determining region 3 for antibody 42848
QQANSFPYT

SEQ ID NO: 85696 - protein, 18 aa, Homo sapiens
  heavy chain complementarity determining region 3 for antibody 42848
ARDLGRWELYDYYYAMDV

SEQ ID NO: 85697 - protein, 9 aa, Homo sapiens
  light chain complementarity determining region 3 for antibody 42849
QQANSFPYS

SEQ ID NO: 85698 - protein, 11 aa, Homo sapiens
  heavy chain complementarity determining region 3 for antibody 42849
ARSSSAAVADH

SEQ ID NO: 85699 - protein, 10 aa, Homo sapiens
  light chain complementarity determining region 3 for antibody 42850
QQANSFPPAT

SEQ ID NO: 85700 - protein, 10 aa, Homo sapiens
  heavy chain complementarity determining region 3 for antibody 42850
ARSGPGAFDI

SEQ ID NO: 85701 - protein, 9 aa, Homo sapiens
  light chain complementarity determining region 3 for antibody 42851
QQANNYPYT

SEQ ID NO: 85702 - protein, 10 aa, Homo sapiens
  heavy chain complementarity determining region 3 for antibody 42851
ARDRGGVYDY

SEQ ID NO: 85703 - protein, 9 aa, Homo sapiens
  light chain complementarity determining region 3 for antibody 42852
QQANNFPTT

SEQ ID NO: 85704 - protein, 18 aa, Homo sapiens
  heavy chain complementarity determining region 3 for antibody 42852
ARDSDYYGSGSYYWRFDP

SEQ ID NO: 85705 - protein, 9 aa, Homo sapiens
  light chain complementarity determining region 3 for antibody 42853
QQAKSVPGT

SEQ ID NO: 85706 - protein, 21 aa, Homo sapiens
  heavy chain complementarity determining region 3 for antibody 42853
ARVICTSPNCYGQLGAGWFDP

SEQ ID NO: 85707 - protein, 9 aa, Homo sapiens
  light chain complementarity determining region 3 for antibody 42854
QQAKSFPLT

SEQ ID NO: 85708 - protein, 12 aa, Homo sapiens
  heavy chain complementarity determining region 3 for antibody 42854
ARDPNRGTRADY

SEQ ID NO: 85709 - protein, 9 aa, Homo sapiens
  light chain complementarity determining region 3 for antibody 42855
QQAHSYPWT

SEQ ID NO: 85710 - protein, 10 aa, Homo sapiens
  heavy chain complementarity determining region 3 for antibody 42855
ARDPNSGAYF

SEQ ID NO: 85711 - protein, 9 aa, Homo sapiens
  light chain complementarity determining region 3 for antibody 42856
QNYNSAPYT

SEQ ID NO: 85712 - protein, 14 aa, Homo sapiens
  heavy chain complementarity determining region 3 for antibody 42856
AKDHPSNGWPALDH

SEQ ID NO: 85713 - protein, 9 aa, Homo sapiens
  light chain complementarity determining region 3 for antibody 42857
QLSENSRYT

SEQ ID NO: 85714 - protein, 14 aa, Homo sapiens
  heavy chain complementarity determining region 3 for antibody 42857
ARGGLYFDSSGYDY

SEQ ID NO: 85715 - protein, 9 aa, Homo sapiens
  light chain complementarity determining region 3 for antibody 42858
QKYNSVPLT

SEQ ID NO: 85716 - protein, 14 aa, Homo sapiens
  heavy chain complementarity determining region 3 for antibody 42858
VRTYYHDTSGPFDY

SEQ ID NO: 85717 - protein, 9 aa, Homo sapiens
  light chain complementarity determining region 3 for antibody 42859
QKYNSAPWT

SEQ ID NO: 85718 - protein, 16 aa, Homo sapiens
  heavy chain complementarity determining region 3 for antibody 42859
ARRSPMLDRAGYYFDD

SEQ ID NO: 85719 - protein, 10 aa, Homo sapiens
  light chain complementarity determining region 3 for antibody 42860
QKYNSAPPWT

SEQ ID NO: 85720 - protein, 12 aa, Homo sapiens
  heavy chain complementarity determining region 3 for antibody 42860
ARDAPSMVPFDP

SEQ ID NO: 85721 - protein, 9 aa, Homo sapiens
  light chain complementarity determining region 3 for antibody 42861
QKYNSAPLT

SEQ ID NO: 85722 - protein, 24 aa, Homo sapiens
  heavy chain complementarity determining region 3 for antibody 42861
ARGSLSFYYDSSGYYYAPEDAYDI

SEQ ID NO: 85723 - protein, 9 aa, Homo sapiens
  light chain complementarity determining region 3 for antibody 42862
QKYNSAPFT

SEQ ID NO: 85724 - protein, 15 aa, Homo sapiens
  heavy chain complementarity determining region 3 for antibody 42862
ARIGYYDLLTGYYSP

SEQ ID NO: 85725 - protein, 9 aa, Homo sapiens
  light chain complementarity determining region 3 for antibody 42863
QKYNSAPFT

SEQ ID NO: 85726 - protein, 17 aa, Homo sapiens
  heavy chain complementarity determining region 3 for antibody 42863
AKDQESEEWLRFGDFDY

SEQ ID NO: 85727 - protein, 9 aa, Homo sapiens
  light chain complementarity determining region 3 for antibody 42864
QKYNSALFT

SEQ ID NO: 85728 - protein, 16 aa, Homo sapiens
  heavy chain complementarity determining region 3 for antibody 42864
ARHPVAVVGTLVPLDY

SEQ ID NO: 85729 - protein, 6 aa, Homo sapiens
  light chain complementarity determining region 3 for antibody 42865
QKYNRA

SEQ ID NO: 85730 - protein, 14 aa, Homo sapiens
  heavy chain complementarity determining region 3 for antibody 42865
ARVGCTSDTNCSDY

SEQ ID NO: 85731 - protein, 9 aa, Homo sapiens
  light chain complementarity determining region 3 for antibody 42866
QKYNNAPWT

SEQ ID NO: 85732 - protein, 12 aa, Homo sapiens
  heavy chain complementarity determining region 3 for antibody 42866
AREEVAGTTIGP

SEQ ID NO: 85733 - protein, 9 aa, Homo sapiens
  light chain complementarity determining region 3 for antibody 42867
QKYDTYPWT

SEQ ID NO: 85734 - protein, 11 aa, Homo sapiens
  heavy chain complementarity determining region 3 for antibody 42867
ASTVVAQGFYY

SEQ ID NO: 85735 - protein, 9 aa, Homo sapiens
  light chain complementarity determining region 3 for antibody 42868
QKYDSARLA

SEQ ID NO: 85736 - protein, 13 aa, Homo sapiens
  heavy chain complementarity determining region 3 for antibody 42868
AIDFVRGWYVFDF

SEQ ID NO: 85737 - protein, 9 aa, Homo sapiens
  light chain complementarity determining region 3 for antibody 42869
QHYYTYPPT

SEQ ID NO: 85738 - protein, 14 aa, Homo sapiens
  heavy chain complementarity determining region 3 for antibody 42869
AIKKGGDELEPFDP

SEQ ID NO: 85739 - protein, 9 aa, Homo sapiens
  light chain complementarity determining region 3 for antibody 42870
QHYSSYVFT

SEQ ID NO: 85740 - protein, 15 aa, Homo sapiens
  heavy chain complementarity determining region 3 for antibody 42870
ARMTVGGSGGSCLDY

SEQ ID NO: 85741 - protein, 11 aa, Homo sapiens
  light chain complementarity determining region 3 for antibody 42871
QHYSDSPPEYT

SEQ ID NO: 85742 - protein, 13 aa, Homo sapiens
  heavy chain complementarity determining region 3 for antibody 42871
ARESGPNSRGFDF

SEQ ID NO: 85743 - protein, 11 aa, Homo sapiens
  light chain complementarity determining region 3 for antibody 42872
QHYNDNSPGFT

SEQ ID NO: 85744 - protein, 16 aa, Homo sapiens
  heavy chain complementarity determining region 3 for antibody 42872
ARGCNNGVCYMDSFDI

SEQ ID NO: 85745 - protein, 9 aa, Homo sapiens
  light chain complementarity determining region 3 for antibody 42873
QHYGNSRFT

SEQ ID NO: 85746 - protein, 10 aa, Homo sapiens
  heavy chain complementarity determining region 3 for antibody 42873
AKSLDFWLDD

SEQ ID NO: 85747 - protein, 9 aa, Homo sapiens
  light chain complementarity determining region 3 for antibody 42874
QHYGNSLWA

SEQ ID NO: 85748 - protein, 17 aa, Homo sapiens
  heavy chain complementarity determining region 3 for antibody 42874
ARDGYCSSTSCYDPSDH

SEQ ID NO: 85749 - protein, 9 aa, Homo sapiens
  light chain complementarity determining region 3 for antibody 42875
QHYGDSPRT

SEQ ID NO: 85750 - protein, 13 aa, Homo sapiens
  heavy chain complementarity determining region 3 for antibody 42875
ARGLTAYHGAFDI

SEQ ID NO: 85751 - protein, 9 aa, Homo sapiens
  light chain complementarity determining region 3 for antibody 42876
QHYDSSPIT

SEQ ID NO: 85752 - protein, 18 aa, Homo sapiens
  heavy chain complementarity determining region 3 for antibody 42876
TRLRILYSGESMSGSSDY

SEQ ID NO: 85753 - protein, 11 aa, Homo sapiens
  light chain complementarity determining region 3 for antibody 42877
QHRTNWPPSLT

SEQ ID NO: 85754 - protein, 11 aa, Homo sapiens
  heavy chain complementarity determining region 3 for antibody 42877
ASGGPVAGIRI

SEQ ID NO: 85755 - protein, 9 aa, Homo sapiens
  light chain complementarity determining region 3 for antibody 42878
QHRSNWPLT

SEQ ID NO: 85756 - protein, 15 aa, Homo sapiens
  heavy chain complementarity determining region 3 for antibody 42878
AKGGGTGYYGGAFDP

SEQ ID NO: 85757 - protein, 9 aa, Homo sapiens
  light chain complementarity determining region 3 for antibody 42879
QHPKSYPFT

SEQ ID NO: 85758 - protein, 15 aa, Homo sapiens
  heavy chain complementarity determining region 3 for antibody 42879
ARLGIVVAERGYFDH

SEQ ID NO: 85759 - protein, 10 aa, Homo sapiens
  light chain complementarity determining region 3 for antibody 42880
QHLNSYSPLT

SEQ ID NO: 85760 - protein, 15 aa, Homo sapiens
  heavy chain complementarity determining region 3 for antibody 42880
ATVSLGWLRFRGLDI

SEQ ID NO: 85761 - protein, 9 aa, Homo sapiens
  light chain complementarity determining region 3 for antibody 42881
QEYNSFFRT

SEQ ID NO: 85762 - protein, 11 aa, Homo sapiens
  heavy chain complementarity determining region 3 for antibody 42881
ARRGVTPALDI

SEQ ID NO: 85763 - protein, 9 aa, Homo sapiens
  light chain complementarity determining region 3 for antibody 42882
MQVLQTPQT

SEQ ID NO: 85764 - protein, 4 aa, Homo sapiens
  heavy chain complementarity determining region 3 for antibody 42882
GMDV

SEQ ID NO: 85765 - protein, 8 aa, Homo sapiens
  light chain complementarity determining region 3 for antibody 42883
MQGTHWYT

SEQ ID NO: 85766 - protein, 12 aa, Homo sapiens
  heavy chain complementarity determining region 3 for antibody 42883
ARLQPVDDAYDI

SEQ ID NO: 85767 - protein, 9 aa, Homo sapiens
  light chain complementarity determining region 3 for antibody 42884
MQGTHWPYT

SEQ ID NO: 85768 - protein, 19 aa, Homo sapiens
  heavy chain complementarity determining region 3 for antibody 42884
ARSPAVMWSGDHMYNYFDP

SEQ ID NO: 85769 - protein, 9 aa, Homo sapiens
  light chain complementarity determining region 3 for antibody 42885
MQGTHWPYT

SEQ ID NO: 85770 - protein, 11 aa, Homo sapiens
  heavy chain complementarity determining region 3 for antibody 42885
ARAGDPGAVDI

SEQ ID NO: 85771 - protein, 10 aa, Homo sapiens
  light chain complementarity determining region 3 for antibody 42886
MQGTHWPPYT

SEQ ID NO: 85772 - protein, 8 aa, Homo sapiens
  heavy chain complementarity determining region 3 for antibody 42886
ARGNGYSA

SEQ ID NO: 85773 - protein, 10 aa, Homo sapiens
  light chain complementarity determining region 3 for antibody 42887
MQGTHWPPYT

SEQ ID NO: 85774 - protein, 15 aa, Homo sapiens
  heavy chain complementarity determining region 3 for antibody 42887
AKSTVTTMSGGHVDS

SEQ ID NO: 85775 - protein, 9 aa, Homo sapiens
  light chain complementarity determining region 3 for antibody 42888
MQGLQTPWT

SEQ ID NO: 85776 - protein, 14 aa, Homo sapiens
  heavy chain complementarity determining region 3 for antibody 42888
AREDSTGGYYGMDV

SEQ ID NO: 85777 - protein, 9 aa, Homo sapiens
  light chain complementarity determining region 3 for antibody 42889
MQGKNWPYI

SEQ ID NO: 85778 - protein, 11 aa, Homo sapiens
  heavy chain complementarity determining region 3 for antibody 42889
ARVGDWNDLEY

SEQ ID NO: 85779 - protein, 9 aa, Homo sapiens
  light chain complementarity determining region 3 for antibody 42890
MQGIEWPRT

SEQ ID NO: 85780 - protein, 9 aa, Homo sapiens
  heavy chain complementarity determining region 3 for antibody 42890
GTGFGESEQ

SEQ ID NO: 85781 - protein, 11 aa, Homo sapiens
  light chain complementarity determining region 3 for antibody 42891
MQATLWPPGVT

SEQ ID NO: 85782 - protein, 16 aa, Homo sapiens
  heavy chain complementarity determining region 3 for antibody 42891
ARDGGVGVDTTMVFDY

SEQ ID NO: 85783 - protein, 9 aa, Homo sapiens
  light chain complementarity determining region 3 for antibody 42892
MQATHWPGT

SEQ ID NO: 85784 - protein, 17 aa, Homo sapiens
  heavy chain complementarity determining region 3 for antibody 42892
ARQGQRTAYFGNFPYEY

SEQ ID NO: 85785 - protein, 9 aa, Homo sapiens
  light chain complementarity determining region 3 for antibody 42893
MQALQTVLT

SEQ ID NO: 85786 - protein, 15 aa, Homo sapiens
  heavy chain complementarity determining region 3 for antibody 42893
ARGLGTMIRGVIRDQ

SEQ ID NO: 85787 - protein, 9 aa, Homo sapiens
  light chain complementarity determining region 3 for antibody 42894
MQALQTPYT

SEQ ID NO: 85788 - protein, 16 aa, Homo sapiens
  heavy chain complementarity determining region 3 for antibody 42894
ARVFVVVTWAVHYFDY

SEQ ID NO: 85789 - protein, 9 aa, Homo sapiens
  light chain complementarity determining region 3 for antibody 42895
MQALQTPYT

SEQ ID NO: 85790 - protein, 14 aa, Homo sapiens
  heavy chain complementarity determining region 3 for antibody 42895
ARLEIVEIPPGKNN

SEQ ID NO: 85791 - protein, 9 aa, Homo sapiens
  light chain complementarity determining region 3 for antibody 42896
MQALQTPWT

SEQ ID NO: 85792 - protein, 14 aa, Homo sapiens
  heavy chain complementarity determining region 3 for antibody 42896
ARSKWAAPGTPPEY

SEQ ID NO: 85793 - protein, 9 aa, Homo sapiens
  light chain complementarity determining region 3 for antibody 42897
MQALQTPPT

SEQ ID NO: 85794 - protein, 15 aa, Homo sapiens
  heavy chain complementarity determining region 3 for antibody 42897
ARRFGSSWYGGALDH

SEQ ID NO: 85795 - protein, 9 aa, Homo sapiens
  light chain complementarity determining region 3 for antibody 42898
MQALQTPLT

SEQ ID NO: 85796 - protein, 12 aa, Homo sapiens
  heavy chain complementarity determining region 3 for antibody 42898
VKDSDQKWELLD

SEQ ID NO: 85797 - protein, 9 aa, Homo sapiens
  light chain complementarity determining region 3 for antibody 42899
MQALQTPIT

SEQ ID NO: 85798 - protein, 15 aa, Homo sapiens
  heavy chain complementarity determining region 3 for antibody 42899
ARLGLYGSSWYTFDP

SEQ ID NO: 85799 - protein, 9 aa, Homo sapiens
  light chain complementarity determining region 3 for antibody 42900
MQALQTPIT

SEQ ID NO: 85800 - protein, 20 aa, Homo sapiens
  heavy chain complementarity determining region 3 for antibody 42900
ARDPINTSWRQLYIFYGMDV

SEQ ID NO: 85801 - protein, 9 aa, Homo sapiens
  light chain complementarity determining region 3 for antibody 42901
MQALQTLFT

SEQ ID NO: 85802 - protein, 15 aa, Homo sapiens
  heavy chain complementarity determining region 3 for antibody 42901
AALGRYGSENYGTDY

SEQ ID NO: 85803 - protein, 10 aa, Homo sapiens
  light chain complementarity determining region 3 for antibody 42902
MQALQSGGIT

SEQ ID NO: 85804 - protein, 18 aa, Homo sapiens
  heavy chain complementarity determining region 3 for antibody 42902
ARRGGPGYHDWYQGFLHP

SEQ ID NO: 85805 - protein, 9 aa, Homo sapiens
  light chain complementarity determining region 3 for antibody 42903
MQALKTPPT

SEQ ID NO: 85806 - protein, 16 aa, Homo sapiens
  heavy chain complementarity determining region 3 for antibody 42903
VRGLDTAMITAENFAF

SEQ ID NO: 85807 - protein, 9 aa, Homo sapiens
  light chain complementarity determining region 3 for antibody 42904
LRYTNSLWT

SEQ ID NO: 85808 - protein, 12 aa, Homo sapiens
  heavy chain complementarity determining region 3 for antibody 42904
ARTLLVGGSSGW

SEQ ID NO: 85809 - protein, 9 aa, Homo sapiens
  light chain complementarity determining region 3 for antibody 42905
LQYNTYPRT

SEQ ID NO: 85810 - protein, 12 aa, Homo sapiens
  heavy chain complementarity determining region 3 for antibody 42905
ARGKGPNTSMDY

SEQ ID NO: 85811 - protein, 9 aa, Homo sapiens
  light chain complementarity determining region 3 for antibody 42906
LQYKSYPWT

SEQ ID NO: 85812 - protein, 17 aa, Homo sapiens
  heavy chain complementarity determining region 3 for antibody 42906
ARGDYIPAADTLGWFDP

SEQ ID NO: 85813 - protein, 9 aa, Homo sapiens
  light chain complementarity determining region 3 for antibody 42907
LQYDIFPYT

SEQ ID NO: 85814 - protein, 11 aa, Homo sapiens
  heavy chain complementarity determining region 3 for antibody 42907
VRLFPTTEEDF

SEQ ID NO: 85815 - protein, 10 aa, Homo sapiens
  light chain complementarity determining region 3 for antibody 42908
LQSHSSPFFT

SEQ ID NO: 85816 - protein, 15 aa, Homo sapiens
  heavy chain complementarity determining region 3 for antibody 42908
ARDRDSRYSSGDLDY

SEQ ID NO: 85817 - protein, 9 aa, Homo sapiens
  light chain complementarity determining region 3 for antibody 42909
LQNYDYPWT

SEQ ID NO: 85818 - protein, 10 aa, Homo sapiens
  heavy chain complementarity determining region 3 for antibody 42909
AKSSPAPMKA

SEQ ID NO: 85819 - protein, 9 aa, Homo sapiens
  light chain complementarity determining region 3 for antibody 42910
LQHSSFPFT

SEQ ID NO: 85820 - protein, 17 aa, Homo sapiens
  heavy chain complementarity determining region 3 for antibody 42910
VRDRGGYFYQHDDAFHI

SEQ ID NO: 85821 - protein, 9 aa, Homo sapiens
  light chain complementarity determining region 3 for antibody 42911
LQHNSYPRT

SEQ ID NO: 85822 - protein, 24 aa, Homo sapiens
  heavy chain complementarity determining region 3 for antibody 42911
ARDTTDTVTGRRHPGKAHYYVMDV

SEQ ID NO: 85823 - protein, 9 aa, Homo sapiens
  light chain complementarity determining region 3 for antibody 42912
LQHNSYPRT

SEQ ID NO: 85824 - protein, 8 aa, Homo sapiens
  heavy chain complementarity determining region 3 for antibody 42912
AKGDWCDS

SEQ ID NO: 85825 - protein, 9 aa, Homo sapiens
  light chain complementarity determining region 3 for antibody 42913
LQHNSFPQT

SEQ ID NO: 85826 - protein, 10 aa, Homo sapiens
  heavy chain complementarity determining region 3 for antibody 42913
AKGDGWLPDS

SEQ ID NO: 85827 - protein, 9 aa, Homo sapiens
  light chain complementarity determining region 3 for antibody 42914
LQHNGFPPT

SEQ ID NO: 85828 - protein, 20 aa, Homo sapiens
  heavy chain complementarity determining region 3 for antibody 42914
ARGPRTSYLYDSSDLDAFDI

SEQ ID NO: 85829 - protein, 9 aa, Homo sapiens
  light chain complementarity determining region 3 for antibody 42915
LQHKSDPRT

SEQ ID NO: 85830 - protein, 15 aa, Homo sapiens
  heavy chain complementarity determining region 3 for antibody 42915
TRNSAVPTAADNFDC

SEQ ID NO: 85831 - protein, 10 aa, Homo sapiens
  light chain complementarity determining region 3 for antibody 42916
LQGTHWPPPT

SEQ ID NO: 85832 - protein, 11 aa, Homo sapiens
  heavy chain complementarity determining region 3 for antibody 42916
ARGGYLQNLDA

SEQ ID NO: 85833 - protein, 9 aa, Homo sapiens
  light chain complementarity determining region 3 for antibody 42917
LQDYSYPWT

SEQ ID NO: 85834 - protein, 15 aa, Homo sapiens
  heavy chain complementarity determining region 3 for antibody 42917
VREFRHDGDYEQFDQ

SEQ ID NO: 85835 - protein, 9 aa, Homo sapiens
  light chain complementarity determining region 3 for antibody 42918
LQDYNYPWT

SEQ ID NO: 85836 - protein, 18 aa, Homo sapiens
  heavy chain complementarity determining region 3 for antibody 42918
ARERGLYGSGSVGPLFDI

SEQ ID NO: 85837 - protein, 9 aa, Homo sapiens
  light chain complementarity determining region 3 for antibody 42919
LQDYNYPRT

SEQ ID NO: 85838 - protein, 18 aa, Homo sapiens
  heavy chain complementarity determining region 3 for antibody 42919
ARDSTYYDSSAYYDRFDY

SEQ ID NO: 85839 - protein, 9 aa, Homo sapiens
  light chain complementarity determining region 3 for antibody 42920
LQDYDYPFT

SEQ ID NO: 85840 - protein, 17 aa, Homo sapiens
  heavy chain complementarity determining region 3 for antibody 42920
AREGAVAGTSRFNWFDP

SEQ ID NO: 85841 - protein, 9 aa, Homo sapiens
  light chain complementarity determining region 3 for antibody 42921
LQAYSVPPT

SEQ ID NO: 85842 - protein, 16 aa, Homo sapiens
  heavy chain complementarity determining region 3 for antibody 42921
ARILAMPFGSQYYIDS

SEQ ID NO: 85843 - protein, 9 aa, Homo sapiens
  light chain complementarity determining region 3 for antibody 42922
LHYGSSLFT

SEQ ID NO: 85844 - protein, 23 aa, Homo sapiens
  heavy chain complementarity determining region 3 for antibody 42922
AKIHRASMFYDAGGYVTQGWFDP

SEQ ID NO: 85845 - protein, 9 aa, Homo sapiens
  light chain complementarity determining region 3 for antibody 42923
LHYDSFPYT

SEQ ID NO: 85846 - protein, 11 aa, Homo sapiens
  heavy chain complementarity determining region 3 for antibody 42923
ARDRGSGWYAY

SEQ ID NO: 85847 - protein, 7 aa, Homo sapiens
  light chain complementarity determining region 3 for antibody 42924
HTNRPHT

SEQ ID NO: 85848 - protein, 13 aa, Homo sapiens
  heavy chain complementarity determining region 3 for antibody 42924
ARNSGSYPNWFDP

SEQ ID NO: 85849 - protein, 9 aa, Homo sapiens
  light chain complementarity determining region 3 for antibody 42925
HQYYTTPYT

SEQ ID NO: 85850 - protein, 17 aa, Homo sapiens
  heavy chain complementarity determining region 3 for antibody 42925
AGDSRPYNEYTGRAFDI

SEQ ID NO: 85851 - protein, 10 aa, Homo sapiens
  light chain complementarity determining region 3 for antibody 42926
HQYTRSPPWT

SEQ ID NO: 85852 - protein, 16 aa, Homo sapiens
  heavy chain complementarity determining region 3 for antibody 42926
ARLRGSRDTAMVNFDC

SEQ ID NO: 85853 - protein, 9 aa, Homo sapiens
  light chain complementarity determining region 3 for antibody 42927
HQYGTSPWT

SEQ ID NO: 85854 - protein, 11 aa, Homo sapiens
  heavy chain complementarity determining region 3 for antibody 42927
AISNYFYGLGV

SEQ ID NO: 85855 - protein, 10 aa, Homo sapiens
  light chain complementarity determining region 3 for antibody 42928
HQYGGSPPWT

SEQ ID NO: 85856 - protein, 16 aa, Homo sapiens
  heavy chain complementarity determining region 3 for antibody 42928
ARRQWVRGLFRGGLDY

SEQ ID NO: 85857 - protein, 9 aa, Homo sapiens
  light chain complementarity determining region 3 for antibody 42929
HQTYSPPFT

SEQ ID NO: 85858 - protein, 14 aa, Homo sapiens
  heavy chain complementarity determining region 3 for antibody 42929
ARGRDTSGYSGLDD

SEQ ID NO: 85859 - protein, 9 aa, Homo sapiens
  light chain complementarity determining region 3 for antibody 42930
HQSSSFPLS

SEQ ID NO: 85860 - protein, 12 aa, Homo sapiens
  heavy chain complementarity determining region 3 for antibody 42930
VRGYNTDDAFDV

SEQ ID NO: 85861 - protein, 10 aa, Homo sapiens
  light chain complementarity determining region 3 for antibody 42931
HQRSNWPMYT

SEQ ID NO: 85862 - protein, 17 aa, Homo sapiens
  heavy chain complementarity determining region 3 for antibody 42931
ARVGRLTDDYYSNGMDV

SEQ ID NO: 85863 - protein, 9 aa, Homo sapiens
  light chain complementarity determining region 3 for antibody 42932
HQGYGTPLT

SEQ ID NO: 85864 - protein, 15 aa, Homo sapiens
  heavy chain complementarity determining region 3 for antibody 42932
ARAQVIWGQLYYFDS

SEQ ID NO: 85865 - protein, 10 aa, Homo sapiens
  light chain complementarity determining region 3 for antibody 42933
HQFNSYRMYT

SEQ ID NO: 85866 - protein, 15 aa, Homo sapiens
  heavy chain complementarity determining region 3 for antibody 42933
AKGHPMVPVGNVFDI

SEQ ID NO: 85867 - protein, 9 aa, Homo sapiens
  light chain complementarity determining region 3 for antibody 42934
HHYGTSPRS

SEQ ID NO: 85868 - protein, 18 aa, Homo sapiens
  heavy chain complementarity determining region 3 for antibody 42934
AREVPDKRPSNSNPYADV

SEQ ID NO: 85869 - protein, 8 aa, Homo sapiens
  light chain complementarity determining region 3 for antibody 42935
QYYGSSPT

SEQ ID NO: 85870 - protein, 9 aa, Homo sapiens
  heavy chain complementarity determining region 3 for antibody 42935
ARGYDAFDY

SEQ ID NO: 85871 - protein, 9 aa, Homo sapiens
  light chain complementarity determining region 3 for antibody 42936
QVYGYYPLT

SEQ ID NO: 85872 - protein, 13 aa, Homo sapiens
  heavy chain complementarity determining region 3 for antibody 42936
ARNHIVSDGLMDY

SEQ ID NO: 85873 - protein, 10 aa, Homo sapiens
  light chain complementarity determining region 3 for antibody 42937
QTYNSALPLT

SEQ ID NO: 85874 - protein, 14 aa, Homo sapiens
  heavy chain complementarity determining region 3 for antibody 42937
AKDIYGYYYYGMDV

SEQ ID NO: 85875 - protein, 9 aa, Homo sapiens
  light chain complementarity determining region 3 for antibody 42938
QRYNSYFYT

SEQ ID NO: 85876 - protein, 13 aa, Homo sapiens
  heavy chain complementarity determining region 3 for antibody 42938
ARTIAAAGIQFDH

SEQ ID NO: 85877 - protein, 9 aa, Homo sapiens
  light chain complementarity determining region 3 for antibody 42939
QRYNSWPWT

SEQ ID NO: 85878 - protein, 19 aa, Homo sapiens
  heavy chain complementarity determining region 3 for antibody 42939
VKVQMESRGYTYGRAPGDY

SEQ ID NO: 85879 - protein, 9 aa, Homo sapiens
  light chain complementarity determining region 3 for antibody 42940
QRQNSAPLT

SEQ ID NO: 85880 - protein, 10 aa, Homo sapiens
  heavy chain complementarity determining region 3 for antibody 42940
ARDEGYFGTW

SEQ ID NO: 85881 - protein, 9 aa, Homo sapiens
  light chain complementarity determining region 3 for antibody 42941
QQYYSYPLT

SEQ ID NO: 85882 - protein, 14 aa, Homo sapiens
  heavy chain complementarity determining region 3 for antibody 42941
ARDPGEGLNNGMDV

SEQ ID NO: 85883 - protein, 9 aa, Homo sapiens
  light chain complementarity determining region 3 for antibody 42942
QQYYSTPIT

SEQ ID NO: 85884 - protein, 13 aa, Homo sapiens
  heavy chain complementarity determining region 3 for antibody 42942
VRGYRFAPLVWVH

SEQ ID NO: 85885 - protein, 9 aa, Homo sapiens
  light chain complementarity determining region 3 for antibody 42943
QQYYSSPWT

SEQ ID NO: 85886 - protein, 17 aa, Homo sapiens
  heavy chain complementarity determining region 3 for antibody 42943
ARGRIWAAVVTASWFDP

SEQ ID NO: 85887 - protein, 9 aa, Homo sapiens
  light chain complementarity determining region 3 for antibody 42944
QQYYNYSYT

SEQ ID NO: 85888 - protein, 13 aa, Homo sapiens
  heavy chain complementarity determining region 3 for antibody 42944
ARGKYESSGYKEN

SEQ ID NO: 85889 - protein, 8 aa, Homo sapiens
  light chain complementarity determining region 3 for antibody 42945
QQYSYYRT

SEQ ID NO: 85890 - protein, 20 aa, Homo sapiens
  heavy chain complementarity determining region 3 for antibody 42945
ARDGHKNYYDSNGYLGYFDA

SEQ ID NO: 85891 - protein, 9 aa, Homo sapiens
  light chain complementarity determining region 3 for antibody 42946
QQYSTYPWT

SEQ ID NO: 85892 - protein, 14 aa, Homo sapiens
  heavy chain complementarity determining region 3 for antibody 42946
AEVNWDYTGPEGDF

SEQ ID NO: 85893 - protein, 9 aa, Homo sapiens
  light chain complementarity determining region 3 for antibody 42947
QQYSTSFPS

SEQ ID NO: 85894 - protein, 14 aa, Homo sapiens
  heavy chain complementarity determining region 3 for antibody 42947
ARGASGWHPGAFII

SEQ ID NO: 85895 - protein, 8 aa, Homo sapiens
  light chain complementarity determining region 3 for antibody 42948
QQYSSYWT

SEQ ID NO: 85896 - protein, 16 aa, Homo sapiens
  heavy chain complementarity determining region 3 for antibody 42948
VREGLKREDGYKNFDY

SEQ ID NO: 85897 - protein, 9 aa, Homo sapiens
  light chain complementarity determining region 3 for antibody 42949
QQYSSYPLT

SEQ ID NO: 85898 - protein, 13 aa, Homo sapiens
  heavy chain complementarity determining region 3 for antibody 42949
AREASGKYYTFDL

SEQ ID NO: 85899 - protein, 9 aa, Homo sapiens
  light chain complementarity determining region 3 for antibody 42950
QQYSSTPQT

SEQ ID NO: 85900 - protein, 15 aa, Homo sapiens
  heavy chain complementarity determining region 3 for antibody 42950
ARDRFTVGTSGGMDV

SEQ ID NO: 85901 - protein, 9 aa, Homo sapiens
  light chain complementarity determining region 3 for antibody 42951
QQYSSLPLT

SEQ ID NO: 85902 - protein, 16 aa, Homo sapiens
  heavy chain complementarity determining region 3 for antibody 42951
ARRPFEAVGKPGRFDS

SEQ ID NO: 85903 - protein, 9 aa, Homo sapiens
  light chain complementarity determining region 3 for antibody 42952
QQYSRSPQT

SEQ ID NO: 85904 - protein, 21 aa, Homo sapiens
  heavy chain complementarity determining region 3 for antibody 42952
ARVTVRVPSTTGFGEYYGLDV

SEQ ID NO: 85905 - protein, 10 aa, Homo sapiens
  light chain complementarity determining region 3 for antibody 42953
QQYSRSLPWT

SEQ ID NO: 85906 - protein, 14 aa, Homo sapiens
  heavy chain complementarity determining region 3 for antibody 42953
ARGNLEPTMRFFDH

SEQ ID NO: 85907 - protein, 9 aa, Homo sapiens
  light chain complementarity determining region 3 for antibody 42954
QQYNTYSRT

SEQ ID NO: 85908 - protein, 21 aa, Homo sapiens
  heavy chain complementarity determining region 3 for antibody 42954
ARDLSHRPGRCPDGHCYPLDI

SEQ ID NO: 85909 - protein, 9 aa, Homo sapiens
  light chain complementarity determining region 3 for antibody 42955
QQYNTYPLT

SEQ ID NO: 85910 - protein, 10 aa, Homo sapiens
  heavy chain complementarity determining region 3 for antibody 42955
VKGVPADWGI

SEQ ID NO: 85911 - protein, 9 aa, Homo sapiens
  light chain complementarity determining region 3 for antibody 42956
QQYNSYSRT

SEQ ID NO: 85912 - protein, 14 aa, Homo sapiens
  heavy chain complementarity determining region 3 for antibody 42956
AKYRGFGDSSSEYD

SEQ ID NO: 85913 - protein, 10 aa, Homo sapiens
  light chain complementarity determining region 3 for antibody 42957
QQYNSYSPKI

SEQ ID NO: 85914 - protein, 17 aa, Homo sapiens
  heavy chain complementarity determining region 3 for antibody 42957
ARGHDANVFGLGYGMDV

SEQ ID NO: 85915 - protein, 10 aa, Homo sapiens
  light chain complementarity determining region 3 for antibody 42958
QQYNSYSMYT

SEQ ID NO: 85916 - protein, 24 aa, Homo sapiens
  heavy chain complementarity determining region 3 for antibody 42958
ARGLVYSIVEEPPAGQSPAAGVQH

SEQ ID NO: 85917 - protein, 9 aa, Homo sapiens
  light chain complementarity determining region 3 for antibody 42959
QQYNSYPWT

SEQ ID NO: 85918 - protein, 12 aa, Homo sapiens
  heavy chain complementarity determining region 3 for antibody 42959
ARAFAIGYTFDF

SEQ ID NO: 85919 - protein, 9 aa, Homo sapiens
  light chain complementarity determining region 3 for antibody 42960
QQYNSYPRT

SEQ ID NO: 85920 - protein, 13 aa, Homo sapiens
  heavy chain complementarity determining region 3 for antibody 42960
ASGYASSWRPFFY

SEQ ID NO: 85921 - protein, 9 aa, Homo sapiens
  light chain complementarity determining region 3 for antibody 42961
QQYNSYPPT

SEQ ID NO: 85922 - protein, 17 aa, Homo sapiens
  heavy chain complementarity determining region 3 for antibody 42961
AYGDRIPEGGTMWLHDY

SEQ ID NO: 85923 - protein, 9 aa, Homo sapiens
  light chain complementarity determining region 3 for antibody 42962
QQYNSYPLT

SEQ ID NO: 85924 - protein, 15 aa, Homo sapiens
  heavy chain complementarity determining region 3 for antibody 42962
AFLRGIRSSWYHFDY

SEQ ID NO: 85925 - protein, 9 aa, Homo sapiens
  light chain complementarity determining region 3 for antibody 42963
QQYNSSPYT

SEQ ID NO: 85926 - protein, 11 aa, Homo sapiens
  heavy chain complementarity determining region 3 for antibody 42963
TRVSYFRGWYY

SEQ ID NO: 85927 - protein, 9 aa, Homo sapiens
  light chain complementarity determining region 3 for antibody 42964
QQYNSFSWT

SEQ ID NO: 85928 - protein, 26 aa, Homo sapiens
  heavy chain complementarity determining region 3 for antibody 42964
ARAKGAQCDSNSCYEDNHRFYYAMDV

SEQ ID NO: 85929 - protein, 8 aa, Homo sapiens
  light chain complementarity determining region 3 for antibody 42965
QQYNNYGT

SEQ ID NO: 85930 - protein, 22 aa, Homo sapiens
  heavy chain complementarity determining region 3 for antibody 42965
ATGGNLRRGIAVAGYLRYNFDY

SEQ ID NO: 85931 - protein, 9 aa, Homo sapiens
  light chain complementarity determining region 3 for antibody 42966
QQYNNWPWT

SEQ ID NO: 85932 - protein, 18 aa, Homo sapiens
  heavy chain complementarity determining region 3 for antibody 42966
ARGARFLPWFSSKPYFDF

SEQ ID NO: 85933 - protein, 9 aa, Homo sapiens
  light chain complementarity determining region 3 for antibody 42967
QQYNNWPRT

SEQ ID NO: 85934 - protein, 16 aa, Homo sapiens
  heavy chain complementarity determining region 3 for antibody 42967
AILISGARKTAEYFQH

SEQ ID NO: 85935 - protein, 10 aa, Homo sapiens
  light chain complementarity determining region 3 for antibody 42968
QQYNNWPPLT

SEQ ID NO: 85936 - protein, 14 aa, Homo sapiens
  heavy chain complementarity determining region 3 for antibody 42968
AKSRWAAPGTPPAN

SEQ ID NO: 85937 - protein, 9 aa, Homo sapiens
  light chain complementarity determining region 3 for antibody 42969
QQYNGYPLT

SEQ ID NO: 85938 - protein, 12 aa, Homo sapiens
  heavy chain complementarity determining region 3 for antibody 42969
ARAGNYGGYIRN

SEQ ID NO: 85939 - protein, 9 aa, Homo sapiens
  light chain complementarity determining region 3 for antibody 42970
QQYNDYRYS

SEQ ID NO: 85940 - protein, 14 aa, Homo sapiens
  heavy chain complementarity determining region 3 for antibody 42970
ARLFSSASRRVFDP

SEQ ID NO: 85941 - protein, 9 aa, Homo sapiens
  light chain complementarity determining region 3 for antibody 42971
QQYNAYPWM

SEQ ID NO: 85942 - protein, 19 aa, Homo sapiens
  heavy chain complementarity determining region 3 for antibody 42971
ARGRTPGIALPGSRHYFDF

SEQ ID NO: 85943 - protein, 8 aa, Homo sapiens
  light chain complementarity determining region 3 for antibody 42972
QQYKSYWT

SEQ ID NO: 85944 - protein, 14 aa, Homo sapiens
  heavy chain complementarity determining region 3 for antibody 42972
GRDQSRAGPTTFDL

SEQ ID NO: 85945 - protein, 9 aa, Homo sapiens
  light chain complementarity determining region 3 for antibody 42973
QQYKSYLFT

SEQ ID NO: 85946 - protein, 14 aa, Homo sapiens
  heavy chain complementarity determining region 3 for antibody 42973
ARGSTNDYGSNAQH

SEQ ID NO: 85947 - protein, 9 aa, Homo sapiens
  light chain complementarity determining region 3 for antibody 42974
QQYKSWPLT

SEQ ID NO: 85948 - protein, 17 aa, Homo sapiens
  heavy chain complementarity determining region 3 for antibody 42974
ARACGAGGGWHCGVFDD

SEQ ID NO: 85949 - protein, 9 aa, Homo sapiens
  light chain complementarity determining region 3 for antibody 42975
QQYKDYSGS

SEQ ID NO: 85950 - protein, 11 aa, Homo sapiens
  heavy chain complementarity determining region 3 for antibody 42975
ARRNDYGDYTK

SEQ ID NO: 85951 - protein, 9 aa, Homo sapiens
  light chain complementarity determining region 3 for antibody 42976
QQYHSYPLT

SEQ ID NO: 85952 - protein, 16 aa, Homo sapiens
  heavy chain complementarity determining region 3 for antibody 42976
ARAYYFGSGIYPFIDF

SEQ ID NO: 85953 - protein, 8 aa, Homo sapiens
  light chain complementarity determining region 3 for antibody 42977
QQYHRVPT

SEQ ID NO: 85954 - protein, 16 aa, Homo sapiens
  heavy chain complementarity determining region 3 for antibody 42977
ARGRGSFYDILGWFDP

SEQ ID NO: 85955 - protein, 9 aa, Homo sapiens
  light chain complementarity determining region 3 for antibody 42978
QQYHDYPLT

SEQ ID NO: 85956 - protein, 10 aa, Homo sapiens
  heavy chain complementarity determining region 3 for antibody 42978
ARFPSDCPDY

SEQ ID NO: 85957 - protein, 9 aa, Homo sapiens
  light chain complementarity determining region 3 for antibody 42979
QQYGVSPVT

SEQ ID NO: 85958 - protein, 11 aa, Homo sapiens
  heavy chain complementarity determining region 3 for antibody 42979
ARVLRSWIFDL

SEQ ID NO: 85959 - protein, 11 aa, Homo sapiens
  light chain complementarity determining region 3 for antibody 42980
QQYGTSPPGYS

SEQ ID NO: 85960 - protein, 12 aa, Homo sapiens
  heavy chain complementarity determining region 3 for antibody 42980
ATSSSHKRSFDE

SEQ ID NO: 85961 - protein, 9 aa, Homo sapiens
  light chain complementarity determining region 3 for antibody 42981
QQYGTLPFT

SEQ ID NO: 85962 - protein, 7 aa, Homo sapiens
  heavy chain complementarity determining region 3 for antibody 42981
QCLLAGH

SEQ ID NO: 85963 - protein, 10 aa, Homo sapiens
  light chain complementarity determining region 3 for antibody 42982
QQYGSTSGYT

SEQ ID NO: 85964 - protein, 13 aa, Homo sapiens
  heavy chain complementarity determining region 3 for antibody 42982
ARQRGWIPDAFDI

SEQ ID NO: 85965 - protein, 9 aa, Homo sapiens
  light chain complementarity determining region 3 for antibody 42983
QQYGSTPLT

SEQ ID NO: 85966 - protein, 17 aa, Homo sapiens
  heavy chain complementarity determining region 3 for antibody 42983
ARDVSYTSRYHYWYFDL

SEQ ID NO: 85967 - protein, 8 aa, Homo sapiens
  light chain complementarity determining region 3 for antibody 42984
QQYGSSRN

SEQ ID NO: 85968 - protein, 21 aa, Homo sapiens
  heavy chain complementarity determining region 3 for antibody 42984
ARWKGQVSSDWDRDFYPPVDY

SEQ ID NO: 85969 - protein, 9 aa, Homo sapiens
  light chain complementarity determining region 3 for antibody 42985
QQYGSSPWS

SEQ ID NO: 85970 - protein, 17 aa, Homo sapiens
  heavy chain complementarity determining region 3 for antibody 42985
ARDDSGYGRRYLSAFDI

SEQ ID NO: 85971 - protein, 9 aa, Homo sapiens
  light chain complementarity determining region 3 for antibody 42986
QQYGSSPTT

SEQ ID NO: 85972 - protein, 10 aa, Homo sapiens
  heavy chain complementarity determining region 3 for antibody 42986
ARYYYGYFDY

SEQ ID NO: 85973 - protein, 10 aa, Homo sapiens
  light chain complementarity determining region 3 for antibody 42987
QQYGSSPRYT

SEQ ID NO: 85974 - protein, 10 aa, Homo sapiens
  heavy chain complementarity determining region 3 for antibody 42987
AKYSWHRSDY

SEQ ID NO: 85975 - protein, 9 aa, Homo sapiens
  light chain complementarity determining region 3 for antibody 42988
QQYGSSPRT

SEQ ID NO: 85976 - protein, 16 aa, Homo sapiens
  heavy chain complementarity determining region 3 for antibody 42988
AKDLRKLGSGWRFMDV

SEQ ID NO: 85977 - protein, 9 aa, Homo sapiens
  light chain complementarity determining region 3 for antibody 42989
QQYGSSPRT

SEQ ID NO: 85978 - protein, 19 aa, Homo sapiens
  heavy chain complementarity determining region 3 for antibody 42989
AKDLRHIVYSSGCCDTFDI

SEQ ID NO: 85979 - protein, 11 aa, Homo sapiens
  light chain complementarity determining region 3 for antibody 42990
QQYGSSPRALT

SEQ ID NO: 85980 - protein, 9 aa, Homo sapiens
  heavy chain complementarity determining region 3 for antibody 42990
ASGYQVLKT

SEQ ID NO: 85981 - protein, 9 aa, Homo sapiens
  light chain complementarity determining region 3 for antibody 42991
QQYGSSPQT

SEQ ID NO: 85982 - protein, 14 aa, Homo sapiens
  heavy chain complementarity determining region 3 for antibody 42991
ARAAPEYEWLVPDY

SEQ ID NO: 85983 - protein, 9 aa, Homo sapiens
  light chain complementarity determining region 3 for antibody 42992
QQYGSSPQT

SEQ ID NO: 85984 - protein, 15 aa, Homo sapiens
  heavy chain complementarity determining region 3 for antibody 42992
AKKSVAGTSKWYFDL

SEQ ID NO: 85985 - protein, 9 aa, Homo sapiens
  light chain complementarity determining region 3 for antibody 42993
QQYGSSPFT

SEQ ID NO: 85986 - protein, 15 aa, Homo sapiens
  heavy chain complementarity determining region 3 for antibody 42993
ARQRGQRASAGYFDS

SEQ ID NO: 85987 - protein, 8 aa, Homo sapiens
  light chain complementarity determining region 3 for antibody 42994
QQYGSSLT

SEQ ID NO: 85988 - protein, 17 aa, Homo sapiens
  heavy chain complementarity determining region 3 for antibody 42994
ARGGDGYNFLGFWYFDL

SEQ ID NO: 85989 - protein, 9 aa, Homo sapiens
  light chain complementarity determining region 3 for antibody 42995
QQYGSQPYT

SEQ ID NO: 85990 - protein, 13 aa, Homo sapiens
  heavy chain complementarity determining region 3 for antibody 42995
ARVAVPGMGYFQH

SEQ ID NO: 85991 - protein, 9 aa, Homo sapiens
  light chain complementarity determining region 3 for antibody 42996
QQYGSAPQT

SEQ ID NO: 85992 - protein, 9 aa, Homo sapiens
  heavy chain complementarity determining region 3 for antibody 42996
VVVVAGQVN

SEQ ID NO: 85993 - protein, 8 aa, Homo sapiens
  light chain complementarity determining region 3 for antibody 42997
QQYGRSPV

SEQ ID NO: 85994 - protein, 17 aa, Homo sapiens
  heavy chain complementarity determining region 3 for antibody 42997
ASQYYYDSGAYKDAFDI

SEQ ID NO: 85995 - protein, 9 aa, Homo sapiens
  light chain complementarity determining region 3 for antibody 42998
QQYGNSPRT

SEQ ID NO: 85996 - protein, 22 aa, Homo sapiens
  heavy chain complementarity determining region 3 for antibody 42998
ARDPGPSLQFLEWLDGEDAFDI

SEQ ID NO: 85997 - protein, 9 aa, Homo sapiens
  light chain complementarity determining region 3 for antibody 42999
QQYGISPFT

SEQ ID NO: 85998 - protein, 13 aa, Homo sapiens
  heavy chain complementarity determining region 3 for antibody 42999
ARDPYGSGSCWDY

SEQ ID NO: 85999 - protein, 9 aa, Homo sapiens
  light chain complementarity determining region 3 for antibody 43000
QQYGGSPRT

SEQ ID NO: 86000 - protein, 18 aa, Homo sapiens
  heavy chain complementarity determining region 3 for antibody 43000
AAYHIEVVVDGDPDAFHI

SEQ ID NO: 86001 - protein, 9 aa, Homo sapiens
  light chain complementarity determining region 3 for antibody 43001
QQYGGSPLT

SEQ ID NO: 86002 - protein, 14 aa, Homo sapiens
  heavy chain complementarity determining region 3 for antibody 43001
ARSLGSEHSYGMDV

SEQ ID NO: 86003 - protein, 8 aa, Homo sapiens
  light chain complementarity determining region 3 for antibody 43002
QQYGGSHT

SEQ ID NO: 86004 - protein, 9 aa, Homo sapiens
  heavy chain complementarity determining region 3 for antibody 43002
ARWNEGSDY

SEQ ID NO: 86005 - protein, 9 aa, Homo sapiens
  light chain complementarity determining region 3 for antibody 43003
QQYGFSPNT

SEQ ID NO: 86006 - protein, 21 aa, Homo sapiens
  heavy chain complementarity determining region 3 for antibody 43003
ARRMHQQPVFNSGVASWVFQY

SEQ ID NO: 86007 - protein, 10 aa, Homo sapiens
  light chain complementarity determining region 3 for antibody 43004
QQYGDSPPWT

SEQ ID NO: 86008 - protein, 14 aa, Homo sapiens
  heavy chain complementarity determining region 3 for antibody 43004
ARHPGSSWVSGLVY

SEQ ID NO: 86009 - protein, 9 aa, Homo sapiens
  light chain complementarity determining region 3 for antibody 43005
QQYFVYSGT

SEQ ID NO: 86010 - protein, 18 aa, Homo sapiens
  heavy chain complementarity determining region 3 for antibody 43005
AKDPGQYSNYPKRGWFDP

SEQ ID NO: 86011 - protein, 9 aa, Homo sapiens
  light chain complementarity determining region 3 for antibody 43006
QQYDTRPVT

SEQ ID NO: 86012 - protein, 17 aa, Homo sapiens
  heavy chain complementarity determining region 3 for antibody 43006
ARGRAWSLSMFRGVFDY

SEQ ID NO: 86013 - protein, 9 aa, Homo sapiens
  light chain complementarity determining region 3 for antibody 43007
QQYDSYSYT

SEQ ID NO: 86014 - protein, 21 aa, Homo sapiens
  heavy chain complementarity determining region 3 for antibody 43007
ARTYYYDMTRGSRTTLYQLDQ

SEQ ID NO: 86015 - protein, 9 aa, Homo sapiens
  light chain complementarity determining region 3 for antibody 43008
QQYDSFPWT

SEQ ID NO: 86016 - protein, 13 aa, Homo sapiens
  heavy chain complementarity determining region 3 for antibody 43008
VHSRLWFAEKIDV

SEQ ID NO: 86017 - protein, 9 aa, Homo sapiens
  light chain complementarity determining region 3 for antibody 43009
QQYDPSSET

SEQ ID NO: 86018 - protein, 25 aa, Homo sapiens
  heavy chain complementarity determining region 3 for antibody 43009
ARGLRARRDVGYFERLLVPHDALDV

SEQ ID NO: 86019 - protein, 9 aa, Homo sapiens
  light chain complementarity determining region 3 for antibody 43010
QQYDNWPYI

SEQ ID NO: 86020 - protein, 16 aa, Homo sapiens
  heavy chain complementarity determining region 3 for antibody 43010
ARAETDWGASWYFFDS

SEQ ID NO: 86021 - protein, 10 aa, Homo sapiens
  light chain complementarity determining region 3 for antibody 43011
QQYDNWPPLT

SEQ ID NO: 86022 - protein, 17 aa, Homo sapiens
  heavy chain complementarity determining region 3 for antibody 43011
ARIYTGREDYVDEAFDI

SEQ ID NO: 86023 - protein, 11 aa, Homo sapiens
  light chain complementarity determining region 3 for antibody 43012
QQYDNLPPLFT

SEQ ID NO: 86024 - protein, 26 aa, Homo sapiens
  heavy chain complementarity determining region 3 for antibody 43012
ARGGHCSGTSNGHCPLFSNGGYGMDV

SEQ ID NO: 86025 - protein, 10 aa, Homo sapiens
  light chain complementarity determining region 3 for antibody 43013
QQYDNLPMYT

SEQ ID NO: 86026 - protein, 16 aa, Homo sapiens
  heavy chain complementarity determining region 3 for antibody 43013
ARQTGYYSDNGGAFDI

SEQ ID NO: 86027 - protein, 10 aa, Homo sapiens
  light chain complementarity determining region 3 for antibody 43014
QQYDNLPGFT

SEQ ID NO: 86028 - protein, 19 aa, Homo sapiens
  heavy chain complementarity determining region 3 for antibody 43014
ASAGGSSLFRTTWSYQFDY

SEQ ID NO: 86029 - protein, 10 aa, Homo sapiens
  light chain complementarity determining region 3 for antibody 43015
QQYDNHPPST

SEQ ID NO: 86030 - protein, 18 aa, Homo sapiens
  heavy chain complementarity determining region 3 for antibody 43015
ARARAAVDYVYYYYGLGV

SEQ ID NO: 86031 - protein, 10 aa, Homo sapiens
  light chain complementarity determining region 3 for antibody 43016
QQYDHRPPII

SEQ ID NO: 86032 - protein, 14 aa, Homo sapiens
  heavy chain complementarity determining region 3 for antibody 43016
ARLGHYYDSSGLGY

SEQ ID NO: 86033 - protein, 9 aa, Homo sapiens
  light chain complementarity determining region 3 for antibody 43017
QQYAMSPLT

SEQ ID NO: 86034 - protein, 15 aa, Homo sapiens
  heavy chain complementarity determining region 3 for antibody 43017
ATARTGFSSTWYLAS

SEQ ID NO: 86035 - protein, 9 aa, Homo sapiens
  light chain complementarity determining region 3 for antibody 43018
QQYAHSPLT

SEQ ID NO: 86036 - protein, 10 aa, Homo sapiens
  heavy chain complementarity determining region 3 for antibody 43018
TTGGGWLVDY

SEQ ID NO: 86037 - protein, 9 aa, Homo sapiens
  light chain complementarity determining region 3 for antibody 43019
QQVNNVPLT

SEQ ID NO: 86038 - protein, 17 aa, Homo sapiens
  heavy chain complementarity determining region 3 for antibody 43019
AKGASVRGVIPDNLLKD

SEQ ID NO: 86039 - protein, 9 aa, Homo sapiens
  light chain complementarity determining region 3 for antibody 43020
QQVGGFPRT

SEQ ID NO: 86040 - protein, 16 aa, Homo sapiens
  heavy chain complementarity determining region 3 for antibody 43020
ARGRTRGASLGMATAY

SEQ ID NO: 86041 - protein, 10 aa, Homo sapiens
  light chain complementarity determining region 3 for antibody 43021
QQTYSTPQVT

SEQ ID NO: 86042 - protein, 17 aa, Homo sapiens
  heavy chain complementarity determining region 3 for antibody 43021
ARIEDYYDSRRSDAFDI

SEQ ID NO: 86043 - protein, 9 aa, Homo sapiens
  light chain complementarity determining region 3 for antibody 43022
QQTYSPPQT

SEQ ID NO: 86044 - protein, 24 aa, Homo sapiens
  heavy chain complementarity determining region 3 for antibody 43022
ARGSLEWYYDSSGYYYAPGDALDI

SEQ ID NO: 86045 - protein, 9 aa, Homo sapiens
  light chain complementarity determining region 3 for antibody 43023
QQTYSPPFT

SEQ ID NO: 86046 - protein, 19 aa, Homo sapiens
  heavy chain complementarity determining region 3 for antibody 43023
ARDMDGRYPDSSGPGMFDP

SEQ ID NO: 86047 - protein, 9 aa, Homo sapiens
  light chain complementarity determining region 3 for antibody 43024
QQTYSPPFT

SEQ ID NO: 86048 - protein, 14 aa, Homo sapiens
  heavy chain complementarity determining region 3 for antibody 43024
AKARDTSGYSGLDQ

SEQ ID NO: 86049 - protein, 9 aa, Homo sapiens
  light chain complementarity determining region 3 for antibody 43025
QQTYRTLET

SEQ ID NO: 86050 - protein, 17 aa, Homo sapiens
  heavy chain complementarity determining region 3 for antibody 43025
ARPTIMGATSSYYGTDV

SEQ ID NO: 86051 - protein, 9 aa, Homo sapiens
  light chain complementarity determining region 3 for antibody 43026
QQTYDTPQT

SEQ ID NO: 86052 - protein, 19 aa, Homo sapiens
  heavy chain complementarity determining region 3 for antibody 43026
ARSRVRGELRSFDPDGFAI

SEQ ID NO: 86053 - protein, 9 aa, Homo sapiens
  light chain complementarity determining region 3 for antibody 43027
QQTQIFPWT

SEQ ID NO: 86054 - protein, 15 aa, Homo sapiens
  heavy chain complementarity determining region 3 for antibody 43027
ARVGFGSGAYYMFDY

SEQ ID NO: 86055 - protein, 9 aa, Homo sapiens
  light chain complementarity determining region 3 for antibody 43028
QQTNSFSWT

SEQ ID NO: 86056 - protein, 17 aa, Homo sapiens
  heavy chain complementarity determining region 3 for antibody 43028
ARGEWRWAVVGEYGLDV

SEQ ID NO: 86057 - protein, 9 aa, Homo sapiens
  light chain complementarity determining region 3 for antibody 43029
QQTNSFPLT

SEQ ID NO: 86058 - protein, 18 aa, Homo sapiens
  heavy chain complementarity determining region 3 for antibody 43029
AKRDLSVSGTYYTNWFDS

SEQ ID NO: 86059 - protein, 9 aa, Homo sapiens
  light chain complementarity determining region 3 for antibody 43030
QQSYTNLVT

SEQ ID NO: 86060 - protein, 18 aa, Homo sapiens
  heavy chain complementarity determining region 3 for antibody 43030
ARREILQLPGDPVDAFDV

SEQ ID NO: 86061 - protein, 9 aa, Homo sapiens
  light chain complementarity determining region 3 for antibody 43031
QQSYSTPYT

SEQ ID NO: 86062 - protein, 9 aa, Homo sapiens
  heavy chain complementarity determining region 3 for antibody 43031
ARGVRPLVS

SEQ ID NO: 86063 - protein, 9 aa, Homo sapiens
  light chain complementarity determining region 3 for antibody 43032
QQSYSTPYT

SEQ ID NO: 86064 - protein, 13 aa, Homo sapiens
  heavy chain complementarity determining region 3 for antibody 43032
ARGPLGSSGYYHN

SEQ ID NO: 86065 - protein, 9 aa, Homo sapiens
  light chain complementarity determining region 3 for antibody 43033
QQSYSTPYT

SEQ ID NO: 86066 - protein, 10 aa, Homo sapiens
  heavy chain complementarity determining region 3 for antibody 43033
ARDRRPLARD

SEQ ID NO: 86067 - protein, 9 aa, Homo sapiens
  light chain complementarity determining region 3 for antibody 43034
QQSYSTPYT

SEQ ID NO: 86068 - protein, 21 aa, Homo sapiens
  heavy chain complementarity determining region 3 for antibody 43034
AHREIVLPPSFTPQPSDAFDV

SEQ ID NO: 86069 - protein, 9 aa, Homo sapiens
  light chain complementarity determining region 3 for antibody 43035
QQSYSTPRT

SEQ ID NO: 86070 - protein, 17 aa, Homo sapiens
  heavy chain complementarity determining region 3 for antibody 43035
ARAGFKSYYDSSGYYDY

SEQ ID NO: 86071 - protein, 9 aa, Homo sapiens
  light chain complementarity determining region 3 for antibody 43036
QQSYSTPQT

SEQ ID NO: 86072 - protein, 8 aa, Homo sapiens
  heavy chain complementarity determining region 3 for antibody 43036
ASGWAVAS

SEQ ID NO: 86073 - protein, 10 aa, Homo sapiens
  light chain complementarity determining region 3 for antibody 43037
QQSYSTPPYT

SEQ ID NO: 86074 - protein, 9 aa, Homo sapiens
  heavy chain complementarity determining region 3 for antibody 43037
ARHHAGFDF

SEQ ID NO: 86075 - protein, 10 aa, Homo sapiens
  light chain complementarity determining region 3 for antibody 43038
QQSYSTPPYT

SEQ ID NO: 86076 - protein, 22 aa, Homo sapiens
  heavy chain complementarity determining region 3 for antibody 43038
AKYAVSTADYSGPIGYHGAFDI

SEQ ID NO: 86077 - protein, 10 aa, Homo sapiens
  light chain complementarity determining region 3 for antibody 43039
QQSYSTPPVT

SEQ ID NO: 86078 - protein, 15 aa, Homo sapiens
  heavy chain complementarity determining region 3 for antibody 43039
AREYRSSRYRRRFDY

SEQ ID NO: 86079 - protein, 9 aa, Homo sapiens
  light chain complementarity determining region 3 for antibody 43040
QQSYSTPLT

SEQ ID NO: 86080 - protein, 14 aa, Homo sapiens
  heavy chain complementarity determining region 3 for antibody 43040
ARVFRFLDWDAFDI

SEQ ID NO: 86081 - protein, 9 aa, Homo sapiens
  light chain complementarity determining region 3 for antibody 43041
QQSYSTLFT

SEQ ID NO: 86082 - protein, 19 aa, Homo sapiens
  heavy chain complementarity determining region 3 for antibody 43041
ARLGTQLVFQRGPKYYFDF

SEQ ID NO: 86083 - protein, 9 aa, Homo sapiens
  light chain complementarity determining region 3 for antibody 43042
QQSYSTLFT

SEQ ID NO: 86084 - protein, 16 aa, Homo sapiens
  heavy chain complementarity determining region 3 for antibody 43042
ARDQTGHRGYYDRNDY

SEQ ID NO: 86085 - protein, 9 aa, Homo sapiens
  light chain complementarity determining region 3 for antibody 43043
QQSYSTFYS

SEQ ID NO: 86086 - protein, 16 aa, Homo sapiens
  heavy chain complementarity determining region 3 for antibody 43043
ARRRRDRRGYPGAFDM

SEQ ID NO: 86087 - protein, 9 aa, Homo sapiens
  light chain complementarity determining region 3 for antibody 43044
QQSYSSSIT

SEQ ID NO: 86088 - protein, 23 aa, Homo sapiens
  heavy chain complementarity determining region 3 for antibody 43044
AKVGKMAAAGLTPQKYYYYGMDV

SEQ ID NO: 86089 - protein, 9 aa, Homo sapiens
  light chain complementarity determining region 3 for antibody 43045
QQSYSSPYS

SEQ ID NO: 86090 - protein, 18 aa, Homo sapiens
  heavy chain complementarity determining region 3 for antibody 43045
VRRAIKTSGWTVVYYFDY

SEQ ID NO: 86091 - protein, 9 aa, Homo sapiens
  light chain complementarity determining region 3 for antibody 43046
QQSYSSPWT

SEQ ID NO: 86092 - protein, 11 aa, Homo sapiens
  heavy chain complementarity determining region 3 for antibody 43046
ARMTGGWYVES

SEQ ID NO: 86093 - protein, 8 aa, Homo sapiens
  light chain complementarity determining region 3 for antibody 43047
QQSYSSPT

SEQ ID NO: 86094 - protein, 18 aa, Homo sapiens
  heavy chain complementarity determining region 3 for antibody 43047
ACRVTMIRDPTWKNWFDP

SEQ ID NO: 86095 - protein, 9 aa, Homo sapiens
  light chain complementarity determining region 3 for antibody 43048
QQSYSNPRT

SEQ ID NO: 86096 - protein, 13 aa, Homo sapiens
  heavy chain complementarity determining region 3 for antibody 43048
ARGYYGSGNAFDI

SEQ ID NO: 86097 - protein, 10 aa, Homo sapiens
  light chain complementarity determining region 3 for antibody 43049
QQSYSNFPIT

SEQ ID NO: 86098 - protein, 17 aa, Homo sapiens
  heavy chain complementarity determining region 3 for antibody 43049
ARARLHNGIYSPPDFDA

SEQ ID NO: 86099 - protein, 9 aa, Homo sapiens
  light chain complementarity determining region 3 for antibody 43050
QQSYSMLYT

SEQ ID NO: 86100 - protein, 19 aa, Homo sapiens
  heavy chain complementarity determining region 3 for antibody 43050
AREDDRYDNNVYSWLGFDY

SEQ ID NO: 86101 - protein, 9 aa, Homo sapiens
  light chain complementarity determining region 3 for antibody 43051
QQSYSAPLT

SEQ ID NO: 86102 - protein, 14 aa, Homo sapiens
  heavy chain complementarity determining region 3 for antibody 43051
AKCRDTSGYSGFDL

SEQ ID NO: 86103 - protein, 9 aa, Homo sapiens
  light chain complementarity determining region 3 for antibody 43052
QQSYNSHPS

SEQ ID NO: 86104 - protein, 22 aa, Homo sapiens
  heavy chain complementarity determining region 3 for antibody 43052
TTYGRLQAMVRGVPSLYWFFDL

SEQ ID NO: 86105 - protein, 10 aa, Homo sapiens
  light chain complementarity determining region 3 for antibody 43053
QQSYITPPWT

SEQ ID NO: 86106 - protein, 14 aa, Homo sapiens
  heavy chain complementarity determining region 3 for antibody 43053
ARAMVTGTDYSFDH

SEQ ID NO: 86107 - protein, 10 aa, Homo sapiens
  light chain complementarity determining region 3 for antibody 43054
QQSYGSPRFT

SEQ ID NO: 86108 - protein, 13 aa, Homo sapiens
  heavy chain complementarity determining region 3 for antibody 43054
TGLLFHGSGFFDN

SEQ ID NO: 86109 - protein, 10 aa, Homo sapiens
  light chain complementarity determining region 3 for antibody 43055
QQSYDTLMYT

SEQ ID NO: 86110 - protein, 14 aa, Homo sapiens
  heavy chain complementarity determining region 3 for antibody 43055
AREGITVTTSWFAP

SEQ ID NO: 86111 - protein, 9 aa, Homo sapiens
  light chain complementarity determining region 3 for antibody 43056
QQSSTSILT

SEQ ID NO: 86112 - protein, 18 aa, Homo sapiens
  heavy chain complementarity determining region 3 for antibody 43056
AKSGRRDSSGFLVNWFDP

SEQ ID NO: 86113 - protein, 9 aa, Homo sapiens
  light chain complementarity determining region 3 for antibody 43057
QQSSSTVYT

SEQ ID NO: 86114 - protein, 18 aa, Homo sapiens
  heavy chain complementarity determining region 3 for antibody 43057
ARDQFSIAAAGTSNWFDP

SEQ ID NO: 86115 - protein, 9 aa, Homo sapiens
  light chain complementarity determining region 3 for antibody 43058
QQSNLTPFI

SEQ ID NO: 86116 - protein, 14 aa, Homo sapiens
  heavy chain complementarity determining region 3 for antibody 43058
VSENGGTMSWVPDS

SEQ ID NO: 86117 - protein, 9 aa, Homo sapiens
  light chain complementarity determining region 3 for antibody 43059
QQSKSNPFT

SEQ ID NO: 86118 - protein, 14 aa, Homo sapiens
  heavy chain complementarity determining region 3 for antibody 43059
VRGRDTSGFSALEY

SEQ ID NO: 86119 - protein, 9 aa, Homo sapiens
  light chain complementarity determining region 3 for antibody 43060
QQSHTTPWT

SEQ ID NO: 86120 - protein, 15 aa, Homo sapiens
  heavy chain complementarity determining region 3 for antibody 43060
ARNNGGIIWYRAFDI

SEQ ID NO: 86121 - protein, 9 aa, Homo sapiens
  light chain complementarity determining region 3 for antibody 43061
QQSHSTPLT

SEQ ID NO: 86122 - protein, 16 aa, Homo sapiens
  heavy chain complementarity determining region 3 for antibody 43061
ARGPKSMNYYFYGMDV

SEQ ID NO: 86123 - protein, 9 aa, Homo sapiens
  light chain complementarity determining region 3 for antibody 43062
QQSHSTPIT

SEQ ID NO: 86124 - protein, 14 aa, Homo sapiens
  heavy chain complementarity determining region 3 for antibody 43062
ARGQTNSWNGWFDP

SEQ ID NO: 86125 - protein, 9 aa, Homo sapiens
  light chain complementarity determining region 3 for antibody 43063
QQSGTAPRT

SEQ ID NO: 86126 - protein, 17 aa, Homo sapiens
  heavy chain complementarity determining region 3 for antibody 43063
AKDVHSRQGYYYYGMDV

SEQ ID NO: 86127 - protein, 9 aa, Homo sapiens
  light chain complementarity determining region 3 for antibody 43064
QQSFTNPPT

SEQ ID NO: 86128 - protein, 18 aa, Homo sapiens
  heavy chain complementarity determining region 3 for antibody 43064
AREKDVSVGYVSYNWFDP

SEQ ID NO: 86129 - protein, 9 aa, Homo sapiens
  light chain complementarity determining region 3 for antibody 43065
QQSFTIPRT

SEQ ID NO: 86130 - protein, 14 aa, Homo sapiens
  heavy chain complementarity determining region 3 for antibody 43065
IALSTFGGVIVKKY

SEQ ID NO: 86131 - protein, 9 aa, Homo sapiens
  light chain complementarity determining region 3 for antibody 43066
QQSFSISLT

SEQ ID NO: 86132 - protein, 18 aa, Homo sapiens
  heavy chain complementarity determining region 3 for antibody 43066
ARMVYHYGSGSYHNWFDP

SEQ ID NO: 86133 - protein, 9 aa, Homo sapiens
  light chain complementarity determining region 3 for antibody 43067
QQSFSAPYT

SEQ ID NO: 86134 - protein, 16 aa, Homo sapiens
  heavy chain complementarity determining region 3 for antibody 43067
ARDYFALSPVPVSFVS

SEQ ID NO: 86135 - protein, 9 aa, Homo sapiens
  light chain complementarity determining region 3 for antibody 43068
QQSFGVPLT

SEQ ID NO: 86136 - protein, 16 aa, Homo sapiens
  heavy chain complementarity determining region 3 for antibody 43068
IRDHYYESNGGYIPQH

SEQ ID NO: 86137 - protein, 9 aa, Homo sapiens
  light chain complementarity determining region 3 for antibody 43069
QQSFDIPPT

SEQ ID NO: 86138 - protein, 16 aa, Homo sapiens
  heavy chain complementarity determining region 3 for antibody 43069
ARRYDYVWGKGGSFDI

SEQ ID NO: 86139 - protein, 9 aa, Homo sapiens
  light chain complementarity determining region 3 for antibody 43070
QQSENLPLT

SEQ ID NO: 86140 - protein, 22 aa, Homo sapiens
  heavy chain complementarity determining region 3 for antibody 43070
AKNLFAHRLLPGLLWFGDLSGS

SEQ ID NO: 86141 - protein, 8 aa, Homo sapiens
  light chain complementarity determining region 3 for antibody 43071
QQRTSWPT

SEQ ID NO: 86142 - protein, 11 aa, Homo sapiens
  heavy chain complementarity determining region 3 for antibody 43071
ARGHYYYGLEV

SEQ ID NO: 86143 - protein, 11 aa, Homo sapiens
  light chain complementarity determining region 3 for antibody 43072
QQRTDWPPEFT

SEQ ID NO: 86144 - protein, 11 aa, Homo sapiens
  heavy chain complementarity determining region 3 for antibody 43072
VRLESLDAFEV

SEQ ID NO: 86145 - protein, 9 aa, Homo sapiens
  light chain complementarity determining region 3 for antibody 43073
QQRSSWPRT

SEQ ID NO: 86146 - protein, 24 aa, Homo sapiens
  heavy chain complementarity determining region 3 for antibody 43073
AGGTRLTRKTLVAPRRHYNSPMDV

SEQ ID NO: 86147 - protein, 8 aa, Homo sapiens
  light chain complementarity determining region 3 for antibody 43074
QQRSNWYT

SEQ ID NO: 86148 - protein, 15 aa, Homo sapiens
  heavy chain complementarity determining region 3 for antibody 43074
RTISAGESDFDFFEY

SEQ ID NO: 86149 - protein, 9 aa, Homo sapiens
  light chain complementarity determining region 3 for antibody 43075
QQRSNWPWT

SEQ ID NO: 86150 - protein, 13 aa, Homo sapiens
  heavy chain complementarity determining region 3 for antibody 43075
ATESGSYYGGLDY

SEQ ID NO: 86151 - protein, 10 aa, Homo sapiens
  light chain complementarity determining region 3 for antibody 43076
QQRSNWPTLT

SEQ ID NO: 86152 - protein, 14 aa, Homo sapiens
  heavy chain complementarity determining region 3 for antibody 43076
AKDVEFWSGYYGDY

SEQ ID NO: 86153 - protein, 9 aa, Homo sapiens
  light chain complementarity determining region 3 for antibody 43077
QQRSNWPST

SEQ ID NO: 86154 - protein, 16 aa, Homo sapiens
  heavy chain complementarity determining region 3 for antibody 43077
ARDFKRSGWSLGEFDY

SEQ ID NO: 86155 - protein, 10 aa, Homo sapiens
  light chain complementarity determining region 3 for antibody 43078
QQRSNWPPYT

SEQ ID NO: 86156 - protein, 17 aa, Homo sapiens
  heavy chain complementarity determining region 3 for antibody 43078
ARSGLMGPTPVSWYFDF

SEQ ID NO: 86157 - protein, 10 aa, Homo sapiens
  light chain complementarity determining region 3 for antibody 43079
QQRSNWPPLT

SEQ ID NO: 86158 - protein, 18 aa, Homo sapiens
  heavy chain complementarity determining region 3 for antibody 43079
VKGGTYYYRSGPPSPALY

SEQ ID NO: 86159 - protein, 11 aa, Homo sapiens
  light chain complementarity determining region 3 for antibody 43080
QQRSNWPPKWM

SEQ ID NO: 86160 - protein, 18 aa, Homo sapiens
  heavy chain complementarity determining region 3 for antibody 43080
TRDRDDPLNGFGISVFDL

SEQ ID NO: 86161 - protein, 9 aa, Homo sapiens
  light chain complementarity determining region 3 for antibody 43081
QQRSNWPLT

SEQ ID NO: 86162 - protein, 11 aa, Homo sapiens
  heavy chain complementarity determining region 3 for antibody 43081
ARDLHSTVTTL

SEQ ID NO: 86163 - protein, 9 aa, Homo sapiens
  light chain complementarity determining region 3 for antibody 43082
QQRSNWPIT

SEQ ID NO: 86164 - protein, 14 aa, Homo sapiens
  heavy chain complementarity determining region 3 for antibody 43082
ARARQTSVTNRFDY

SEQ ID NO: 86165 - protein, 9 aa, Homo sapiens
  light chain complementarity determining region 3 for antibody 43083
QQRSNWLRT

SEQ ID NO: 86166 - protein, 16 aa, Homo sapiens
  heavy chain complementarity determining region 3 for antibody 43083
ARLFHSGWPDTNPLDS

SEQ ID NO: 86167 - protein, 10 aa, Homo sapiens
  light chain complementarity determining region 3 for antibody 43084
QQRSKWPPLT

SEQ ID NO: 86168 - protein, 9 aa, Homo sapiens
  heavy chain complementarity determining region 3 for antibody 43084
ARVDVYFDY

SEQ ID NO: 86169 - protein, 8 aa, Homo sapiens
  light chain complementarity determining region 3 for antibody 43085
QQRSDWPT

SEQ ID NO: 86170 - protein, 14 aa, Homo sapiens
  heavy chain complementarity determining region 3 for antibody 43085
VKDLYGGNSLWFDP

SEQ ID NO: 86171 - protein, 9 aa, Homo sapiens
  light chain complementarity determining region 3 for antibody 43086
QQRRDWPLT

SEQ ID NO: 86172 - protein, 22 aa, Homo sapiens
  heavy chain complementarity determining region 3 for antibody 43086
VRQEGRYFHGGNGFYVSETFHH

SEQ ID NO: 86173 - protein, 9 aa, Homo sapiens
  light chain complementarity determining region 3 for antibody 43087
QQRNKRPHT

SEQ ID NO: 86174 - protein, 12 aa, Homo sapiens
  heavy chain complementarity determining region 3 for antibody 43087
ARDLGVGKYFDH

SEQ ID NO: 86175 - protein, 9 aa, Homo sapiens
  light chain complementarity determining region 3 for antibody 43088
QQRDNWPYT

SEQ ID NO: 86176 - protein, 12 aa, Homo sapiens
  heavy chain complementarity determining region 3 for antibody 43088
VKRWGAAADIDS

SEQ ID NO: 86177 - protein, 9 aa, Homo sapiens
  light chain complementarity determining region 3 for antibody 43089
QQRDHWPYT

SEQ ID NO: 86178 - protein, 15 aa, Homo sapiens
  heavy chain complementarity determining region 3 for antibody 43089
VKDYGYFGSGGTSGH

SEQ ID NO: 86179 - protein, 8 aa, Homo sapiens
  light chain complementarity determining region 3 for antibody 43090
QQRANWVT

SEQ ID NO: 86180 - protein, 19 aa, Homo sapiens
  heavy chain complementarity determining region 3 for antibody 43090
TRQGGYANIGYYYYYGMDV

SEQ ID NO: 86181 - protein, 9 aa, Homo sapiens
  light chain complementarity determining region 3 for antibody 43091
QQLNSYPRT

SEQ ID NO: 86182 - protein, 14 aa, Homo sapiens
  heavy chain complementarity determining region 3 for antibody 43091
ARLDEATTGNYFDH

SEQ ID NO: 86183 - protein, 9 aa, Homo sapiens
  light chain complementarity determining region 3 for antibody 43092
QQLNSYPPI

SEQ ID NO: 86184 - protein, 11 aa, Homo sapiens
  heavy chain complementarity determining region 3 for antibody 43092
VRGGTIGLGGY

SEQ ID NO: 86185 - protein, 9 aa, Homo sapiens
  light chain complementarity determining region 3 for antibody 43093
QQLNSYPLT

SEQ ID NO: 86186 - protein, 15 aa, Homo sapiens
  heavy chain complementarity determining region 3 for antibody 43093
AREFVAAGTKYFFDS

SEQ ID NO: 86187 - protein, 9 aa, Homo sapiens
  light chain complementarity determining region 3 for antibody 43094
QQLNNYPHT

SEQ ID NO: 86188 - protein, 26 aa, Homo sapiens
  heavy chain complementarity determining region 3 for antibody 43094
ARGSRGYSYDTNNSRRLQYYNYGMDV

SEQ ID NO: 86189 - protein, 9 aa, Homo sapiens
  light chain complementarity determining region 3 for antibody 43095
QQLNEYPPT

SEQ ID NO: 86190 - protein, 15 aa, Homo sapiens
  heavy chain complementarity determining region 3 for antibody 43095
ARARVPDRMLYAFDI

SEQ ID NO: 86191 - protein, 9 aa, Homo sapiens
  light chain complementarity determining region 3 for antibody 43096
QQLHAYPHT

SEQ ID NO: 86192 - protein, 12 aa, Homo sapiens
  heavy chain complementarity determining region 3 for antibody 43096
TREADFSGGYDY

SEQ ID NO: 86193 - protein, 9 aa, Homo sapiens
  light chain complementarity determining region 3 for antibody 43097
QQLDNYPIT

SEQ ID NO: 86194 - protein, 12 aa, Homo sapiens
  heavy chain complementarity determining region 3 for antibody 43097
VKDGDTDYYLDV

SEQ ID NO: 86195 - protein, 9 aa, Homo sapiens
  light chain complementarity determining region 3 for antibody 43098
QQISSTPYT

SEQ ID NO: 86196 - protein, 12 aa, Homo sapiens
  heavy chain complementarity determining region 3 for antibody 43098
VRESGDHQEADY

SEQ ID NO: 86197 - protein, 9 aa, Homo sapiens
  light chain complementarity determining region 3 for antibody 43099
QQHKSYLMP

SEQ ID NO: 86198 - protein, 16 aa, Homo sapiens
  heavy chain complementarity determining region 3 for antibody 43099
VTHRIEGQSTGGPFDS

SEQ ID NO: 86199 - protein, 9 aa, Homo sapiens
  light chain complementarity determining region 3 for antibody 43100
QQHGTSPFT

SEQ ID NO: 86200 - protein, 14 aa, Homo sapiens
  heavy chain complementarity determining region 3 for antibody 43100
ARKAGYSSYWAFDC

SEQ ID NO: 86201 - protein, 9 aa, Homo sapiens
  light chain complementarity determining region 3 for antibody 43101
QQHGSSPYT

SEQ ID NO: 86202 - protein, 10 aa, Homo sapiens
  heavy chain complementarity determining region 3 for antibody 43101
ATGLNWYFDL

SEQ ID NO: 86203 - protein, 8 aa, Homo sapiens
  light chain complementarity determining region 3 for antibody 43102
QQHGNSHT

SEQ ID NO: 86204 - protein, 9 aa, Homo sapiens
  heavy chain complementarity determining region 3 for antibody 43102
ARWNEGSDY

SEQ ID NO: 86205 - protein, 10 aa, Homo sapiens
  light chain complementarity determining region 3 for antibody 43103
QQGYTMPVLT

SEQ ID NO: 86206 - protein, 16 aa, Homo sapiens
  heavy chain complementarity determining region 3 for antibody 43103
ARIPRDSVVTWDFFDY

SEQ ID NO: 86207 - protein, 9 aa, Homo sapiens
  light chain complementarity determining region 3 for antibody 43104
QQGYRTPLI

SEQ ID NO: 86208 - protein, 17 aa, Homo sapiens
  heavy chain complementarity determining region 3 for antibody 43104
AGEQLWLLSGVGGVFDM

SEQ ID NO: 86209 - protein, 9 aa, Homo sapiens
  light chain complementarity determining region 3 for antibody 43105
QQGYNTPFT

SEQ ID NO: 86210 - protein, 15 aa, Homo sapiens
  heavy chain complementarity determining region 3 for antibody 43105
ARHDGSGYSYAPDEI

SEQ ID NO: 86211 - protein, 10 aa, Homo sapiens
  light chain complementarity determining region 3 for antibody 43106
QQGNSFPRIT

SEQ ID NO: 86212 - protein, 18 aa, Homo sapiens
  heavy chain complementarity determining region 3 for antibody 43106
ARGFPTIFGAVIRPHFDN

SEQ ID NO: 86213 - protein, 9 aa, Homo sapiens
  light chain complementarity determining region 3 for antibody 43107
QQGNSFPFT

SEQ ID NO: 86214 - protein, 15 aa, Homo sapiens
  heavy chain complementarity determining region 3 for antibody 43107
ARVDIFMATGWYFDL

SEQ ID NO: 86215 - protein, 9 aa, Homo sapiens
  light chain complementarity determining region 3 for antibody 43108
QQGLSFPLT

SEQ ID NO: 86216 - protein, 20 aa, Homo sapiens
  heavy chain complementarity determining region 3 for antibody 43108
TTVCSWYMAPPSSSYYGVAV

SEQ ID NO: 86217 - protein, 8 aa, Homo sapiens
  light chain complementarity determining region 3 for antibody 43109
QQGFSVFT

SEQ ID NO: 86218 - protein, 11 aa, Homo sapiens
  heavy chain complementarity determining region 3 for antibody 43109
ARDRGPNTLDY

SEQ ID NO: 86219 - protein, 9 aa, Homo sapiens
  light chain complementarity determining region 3 for antibody 43110
QQFQSYFPT

SEQ ID NO: 86220 - protein, 11 aa, Homo sapiens
  heavy chain complementarity determining region 3 for antibody 43110
ARRAVAGHFDN

SEQ ID NO: 86221 - protein, 9 aa, Homo sapiens
  light chain complementarity determining region 3 for antibody 43111
QQFNSYPWT

SEQ ID NO: 86222 - protein, 6 aa, Homo sapiens
  heavy chain complementarity determining region 3 for antibody 43111
ARHPDY

SEQ ID NO: 86223 - protein, 9 aa, Homo sapiens
  light chain complementarity determining region 3 for antibody 43112
QQFKSSPYT

SEQ ID NO: 86224 - protein, 18 aa, Homo sapiens
  heavy chain complementarity determining region 3 for antibody 43112
ALFRQTFDSGTYYPHLEK

SEQ ID NO: 86225 - protein, 9 aa, Homo sapiens
  light chain complementarity determining region 3 for antibody 43113
QQFKNFPLT

SEQ ID NO: 86226 - protein, 15 aa, Homo sapiens
  heavy chain complementarity determining region 3 for antibody 43113
AKVMTGHTIDCHFDY

SEQ ID NO: 86227 - protein, 9 aa, Homo sapiens
  light chain complementarity determining region 3 for antibody 43114
QQFGNSPWT

SEQ ID NO: 86228 - protein, 10 aa, Homo sapiens
  heavy chain complementarity determining region 3 for antibody 43114
ARISKWFGGT

SEQ ID NO: 86229 - protein, 8 aa, Homo sapiens
  light chain complementarity determining region 3 for antibody 43115
QQFDKGVT

SEQ ID NO: 86230 - protein, 21 aa, Homo sapiens
  heavy chain complementarity determining region 3 for antibody 43115
ARVKVAAGHKANTYYYNAMDV

SEQ ID NO: 86231 - protein, 9 aa, Homo sapiens
  light chain complementarity determining region 3 for antibody 43116
QQFAGSPTT

SEQ ID NO: 86232 - protein, 14 aa, Homo sapiens
  heavy chain complementarity determining region 3 for antibody 43116
AKEVDSLGYPVLTN

SEQ ID NO: 86233 - protein, 9 aa, Homo sapiens
  light chain complementarity determining region 3 for antibody 43117
QQCDSFPVT

SEQ ID NO: 86234 - protein, 14 aa, Homo sapiens
  heavy chain complementarity determining region 3 for antibody 43117
ARPNFRYGYDAIDF

SEQ ID NO: 86235 - protein, 8 aa, Homo sapiens
  light chain complementarity determining region 3 for antibody 43118
QQAYSFTS

SEQ ID NO: 86236 - protein, 17 aa, Homo sapiens
  heavy chain complementarity determining region 3 for antibody 43118
ARDPAYSMVRAQGALDI

SEQ ID NO: 86237 - protein, 9 aa, Homo sapiens
  light chain complementarity determining region 3 for antibody 43119
QQAYIFPLT

SEQ ID NO: 86238 - protein, 24 aa, Homo sapiens
  heavy chain complementarity determining region 3 for antibody 43119
ARDRDGSGGASLPRTRYYYYGMHV

SEQ ID NO: 86239 - protein, 9 aa, Homo sapiens
  light chain complementarity determining region 3 for antibody 43120
QQAYGFPYT

SEQ ID NO: 86240 - protein, 9 aa, Homo sapiens
  heavy chain complementarity determining region 3 for antibody 43120
AKDRYHLEH

SEQ ID NO: 86241 - protein, 9 aa, Homo sapiens
  light chain complementarity determining region 3 for antibody 43121
QQANSFPYT

SEQ ID NO: 86242 - protein, 14 aa, Homo sapiens
  heavy chain complementarity determining region 3 for antibody 43121
SRGSDSGGYEQFDS

SEQ ID NO: 86243 - protein, 9 aa, Homo sapiens
  light chain complementarity determining region 3 for antibody 43122
QQANSFPLT

SEQ ID NO: 86244 - protein, 10 aa, Homo sapiens
  heavy chain complementarity determining region 3 for antibody 43122
ARVGEIWGDY

SEQ ID NO: 86245 - protein, 9 aa, Homo sapiens
  light chain complementarity determining region 3 for antibody 43123
QQANSFPLT

SEQ ID NO: 86246 - protein, 20 aa, Homo sapiens
  heavy chain complementarity determining region 3 for antibody 43123
ARDLPRASVLVRGIIGGCDS

SEQ ID NO: 86247 - protein, 9 aa, Homo sapiens
  light chain complementarity determining region 3 for antibody 43124
QQANSFPLT

SEQ ID NO: 86248 - protein, 18 aa, Homo sapiens
  heavy chain complementarity determining region 3 for antibody 43124
AFTHTLEYCGGDCYSYAY

SEQ ID NO: 86249 - protein, 9 aa, Homo sapiens
  light chain complementarity determining region 3 for antibody 43125
QQANSFPFT

SEQ ID NO: 86250 - protein, 11 aa, Homo sapiens
  heavy chain complementarity determining region 3 for antibody 43125
ARYAYGPYFDS

SEQ ID NO: 86251 - protein, 9 aa, Homo sapiens
  light chain complementarity determining region 3 for antibody 43126
QNYDTAPLT

SEQ ID NO: 86252 - protein, 14 aa, Homo sapiens
  heavy chain complementarity determining region 3 for antibody 43126
ARVWLSGSYDWLDP

SEQ ID NO: 86253 - protein, 11 aa, Homo sapiens
  light chain complementarity determining region 3 for antibody 43127
QLRQERSNWLT

SEQ ID NO: 86254 - protein, 15 aa, Homo sapiens
  heavy chain complementarity determining region 3 for antibody 43127
ARGGYSSGWYYWFDP

SEQ ID NO: 86255 - protein, 11 aa, Homo sapiens
  light chain complementarity determining region 3 for antibody 43128
QLRQEGTNWLT

SEQ ID NO: 86256 - protein, 15 aa, Homo sapiens
  heavy chain complementarity determining region 3 for antibody 43128
ARGGYSSGWYYWFDP

SEQ ID NO: 86257 - protein, 9 aa, Homo sapiens
  light chain complementarity determining region 3 for antibody 43129
QKYSSAPWT

SEQ ID NO: 86258 - protein, 18 aa, Homo sapiens
  heavy chain complementarity determining region 3 for antibody 43129
AKWGRGYSSGPSYYGMDV

SEQ ID NO: 86259 - protein, 9 aa, Homo sapiens
  light chain complementarity determining region 3 for antibody 43130
QKYNSVPFT

SEQ ID NO: 86260 - protein, 14 aa, Homo sapiens
  heavy chain complementarity determining region 3 for antibody 43130
AREVAGPGPQPLDY

SEQ ID NO: 86261 - protein, 9 aa, Homo sapiens
  light chain complementarity determining region 3 for antibody 43131
QKYNSVPFT

SEQ ID NO: 86262 - protein, 14 aa, Homo sapiens
  heavy chain complementarity determining region 3 for antibody 43131
AREIAGPGPQPLDY

SEQ ID NO: 86263 - protein, 9 aa, Homo sapiens
  light chain complementarity determining region 3 for antibody 43132
QKYNSAPYT

SEQ ID NO: 86264 - protein, 15 aa, Homo sapiens
  heavy chain complementarity determining region 3 for antibody 43132
TRPYSGYDPRDIFDI

SEQ ID NO: 86265 - protein, 9 aa, Homo sapiens
  light chain complementarity determining region 3 for antibody 43133
QKYNSAPRT

SEQ ID NO: 86266 - protein, 15 aa, Homo sapiens
  heavy chain complementarity determining region 3 for antibody 43133
ARDAAGSDGYYGLDV

SEQ ID NO: 86267 - protein, 9 aa, Homo sapiens
  light chain complementarity determining region 3 for antibody 43134
QKYNSAPLT

SEQ ID NO: 86268 - protein, 15 aa, Homo sapiens
  heavy chain complementarity determining region 3 for antibody 43134
ARDLGLGTYLRPPNF

SEQ ID NO: 86269 - protein, 9 aa, Homo sapiens
  light chain complementarity determining region 3 for antibody 43135
QKYNDAPLT

SEQ ID NO: 86270 - protein, 21 aa, Homo sapiens
  heavy chain complementarity determining region 3 for antibody 43135
AKDLHHLNTARPSDQAGGLDY

SEQ ID NO: 86271 - protein, 9 aa, Homo sapiens
  light chain complementarity determining region 3 for antibody 43136
QHYYNYSNS

SEQ ID NO: 86272 - protein, 22 aa, Homo sapiens
  heavy chain complementarity determining region 3 for antibody 43136
ARGGCGSCYTFPPFFYYYGMDA

SEQ ID NO: 86273 - protein, 11 aa, Homo sapiens
  light chain complementarity determining region 3 for antibody 43137
QHYNYLSPLFT

SEQ ID NO: 86274 - protein, 12 aa, Homo sapiens
  heavy chain complementarity determining region 3 for antibody 43137
ARGIAADAEFDY

SEQ ID NO: 86275 - protein, 9 aa, Homo sapiens
  light chain complementarity determining region 3 for antibody 43138
QHYNGYPYT

SEQ ID NO: 86276 - protein, 19 aa, Homo sapiens
  heavy chain complementarity determining region 3 for antibody 43138
ARPTSQSSAWYRGTEGLDY

SEQ ID NO: 86277 - protein, 8 aa, Homo sapiens
  light chain complementarity determining region 3 for antibody 43139
QHYIDWPT

SEQ ID NO: 86278 - protein, 16 aa, Homo sapiens
  heavy chain complementarity determining region 3 for antibody 43139
VRAAPNCGSDCFRFDH

SEQ ID NO: 86279 - protein, 8 aa, Homo sapiens
  light chain complementarity determining region 3 for antibody 43140
QHRSDWPT

SEQ ID NO: 86280 - protein, 12 aa, Homo sapiens
  heavy chain complementarity determining region 3 for antibody 43140
VRQSPQNWFYDL

SEQ ID NO: 86281 - protein, 9 aa, Homo sapiens
  light chain complementarity determining region 3 for antibody 43141
QHRNSWPYT

SEQ ID NO: 86282 - protein, 15 aa, Homo sapiens
  heavy chain complementarity determining region 3 for antibody 43141
AKEGYYADGSGYCPN

SEQ ID NO: 86283 - protein, 7 aa, Homo sapiens
  light chain complementarity determining region 3 for antibody 43142
QHLSSFT

SEQ ID NO: 86284 - protein, 19 aa, Homo sapiens
  heavy chain complementarity determining region 3 for antibody 43142
ARRPFGGDGTQTDYYGMDV

SEQ ID NO: 86285 - protein, 11 aa, Homo sapiens
  light chain complementarity determining region 3 for antibody 43143
QHFDNWPPELT

SEQ ID NO: 86286 - protein, 21 aa, Homo sapiens
  heavy chain complementarity determining region 3 for antibody 43143
ARVGTAVVGGVNMGPAGQLDV

SEQ ID NO: 86287 - protein, 9 aa, Homo sapiens
  light chain complementarity determining region 3 for antibody 43144
QESYKAPLT

SEQ ID NO: 86288 - protein, 13 aa, Homo sapiens
  heavy chain complementarity determining region 3 for antibody 43144
ARWVVDGSYYFDH

SEQ ID NO: 86289 - protein, 7 aa, Homo sapiens
  light chain complementarity determining region 3 for antibody 43145
QELETYA

SEQ ID NO: 86290 - protein, 17 aa, Homo sapiens
  heavy chain complementarity determining region 3 for antibody 43145
VKDMGPLFGSGLDAFDV

SEQ ID NO: 86291 - protein, 9 aa, Homo sapiens
  light chain complementarity determining region 3 for antibody 43146
MQTLQTPGT

SEQ ID NO: 86292 - protein, 18 aa, Homo sapiens
  heavy chain complementarity determining region 3 for antibody 43146
AASGRYFFQDSGPLGFAY

SEQ ID NO: 86293 - protein, 8 aa, Homo sapiens
  light chain complementarity determining region 3 for antibody 43147
MQGTYWPT

SEQ ID NO: 86294 - protein, 11 aa, Homo sapiens
  heavy chain complementarity determining region 3 for antibody 43147
ARDAMPNNADY

SEQ ID NO: 86295 - protein, 9 aa, Homo sapiens
  light chain complementarity determining region 3 for antibody 43148
MQGTHWRRT

SEQ ID NO: 86296 - protein, 9 aa, Homo sapiens
  heavy chain complementarity determining region 3 for antibody 43148
ARGGAWFDY

SEQ ID NO: 86297 - protein, 9 aa, Homo sapiens
  light chain complementarity determining region 3 for antibody 43149
MQGTHWPWT

SEQ ID NO: 86298 - protein, 15 aa, Homo sapiens
  heavy chain complementarity determining region 3 for antibody 43149
ARHSQSGTYTSNYDY

SEQ ID NO: 86299 - protein, 9 aa, Homo sapiens
  light chain complementarity determining region 3 for antibody 43150
MQGTHWPWT

SEQ ID NO: 86300 - protein, 12 aa, Homo sapiens
  heavy chain complementarity determining region 3 for antibody 43150
ARGPLISSAGNH

SEQ ID NO: 86301 - protein, 9 aa, Homo sapiens
  light chain complementarity determining region 3 for antibody 43151
MQGTHWPIT

SEQ ID NO: 86302 - protein, 13 aa, Homo sapiens
  heavy chain complementarity determining region 3 for antibody 43151
ARGGDCGGDCFAG

SEQ ID NO: 86303 - protein, 9 aa, Homo sapiens
  light chain complementarity determining region 3 for antibody 43152
MQGTHWPFT

SEQ ID NO: 86304 - protein, 11 aa, Homo sapiens
  heavy chain complementarity determining region 3 for antibody 43152
TRIMRGDDRVY

SEQ ID NO: 86305 - protein, 9 aa, Homo sapiens
  light chain complementarity determining region 3 for antibody 43153
MQGTHWPFT

SEQ ID NO: 86306 - protein, 19 aa, Homo sapiens
  heavy chain complementarity determining region 3 for antibody 43153
ARTLITMVRGVIIHNWFDP

SEQ ID NO: 86307 - protein, 9 aa, Homo sapiens
  light chain complementarity determining region 3 for antibody 43154
MQGTHREIT

SEQ ID NO: 86308 - protein, 17 aa, Homo sapiens
  heavy chain complementarity determining region 3 for antibody 43154
ARDERQAAAGAEYYFDY

SEQ ID NO: 86309 - protein, 9 aa, Homo sapiens
  light chain complementarity determining region 3 for antibody 43155
MQGLQTPYT

SEQ ID NO: 86310 - protein, 10 aa, Homo sapiens
  heavy chain complementarity determining region 3 for antibody 43155
ARDLGTGGAY

SEQ ID NO: 86311 - protein, 9 aa, Homo sapiens
  light chain complementarity determining region 3 for antibody 43156
MQGLQTPPD

SEQ ID NO: 86312 - protein, 17 aa, Homo sapiens
  heavy chain complementarity determining region 3 for antibody 43156
ARRWGPRDVAVAATRDY

SEQ ID NO: 86313 - protein, 10 aa, Homo sapiens
  light chain complementarity determining region 3 for antibody 43157
MQGLQTPLIT

SEQ ID NO: 86314 - protein, 15 aa, Homo sapiens
  heavy chain complementarity determining region 3 for antibody 43157
ARGAGVEVGRWAFEY

SEQ ID NO: 86315 - protein, 9 aa, Homo sapiens
  light chain complementarity determining region 3 for antibody 43158
MQGLQAPPT

SEQ ID NO: 86316 - protein, 14 aa, Homo sapiens
  heavy chain complementarity determining region 3 for antibody 43158
AKDLKVDGVWDIDY

SEQ ID NO: 86317 - protein, 9 aa, Homo sapiens
  light chain complementarity determining region 3 for antibody 43159
MQGLHTPKT

SEQ ID NO: 86318 - protein, 26 aa, Homo sapiens
  heavy chain complementarity determining region 3 for antibody 43159
ARAKGAQCDSNSCYEDNHRFYYAMDV

SEQ ID NO: 86319 - protein, 8 aa, Homo sapiens
  light chain complementarity determining region 3 for antibody 43160
MQDLQTPT

SEQ ID NO: 86320 - protein, 11 aa, Homo sapiens
  heavy chain complementarity determining region 3 for antibody 43160
VRVAIVAAKAA

SEQ ID NO: 86321 - protein, 8 aa, Homo sapiens
  light chain complementarity determining region 3 for antibody 43161
MQALRAPT

SEQ ID NO: 86322 - protein, 16 aa, Homo sapiens
  heavy chain complementarity determining region 3 for antibody 43161
ARHPLFLDNSGYSTDY

SEQ ID NO: 86323 - protein, 9 aa, Homo sapiens
  light chain complementarity determining region 3 for antibody 43162
MQALQTPWT

SEQ ID NO: 86324 - protein, 16 aa, Homo sapiens
  heavy chain complementarity determining region 3 for antibody 43162
AREFGDYFRRAGTFDY

SEQ ID NO: 86325 - protein, 9 aa, Homo sapiens
  light chain complementarity determining region 3 for antibody 43163
MQALQTPWA

SEQ ID NO: 86326 - protein, 10 aa, Homo sapiens
  heavy chain complementarity determining region 3 for antibody 43163
TRSKGYGMDV

SEQ ID NO: 86327 - protein, 9 aa, Homo sapiens
  light chain complementarity determining region 3 for antibody 43164
MQALQTPRT

SEQ ID NO: 86328 - protein, 11 aa, Homo sapiens
  heavy chain complementarity determining region 3 for antibody 43164
GVVVTPDYVDY

SEQ ID NO: 86329 - protein, 9 aa, Homo sapiens
  light chain complementarity determining region 3 for antibody 43165
MQALQTPQT

SEQ ID NO: 86330 - protein, 18 aa, Homo sapiens
  heavy chain complementarity determining region 3 for antibody 43165
ASGYSYGFFGQKLVALDY

SEQ ID NO: 86331 - protein, 9 aa, Homo sapiens
  light chain complementarity determining region 3 for antibody 43166
LRYTINTGT

SEQ ID NO: 86332 - protein, 12 aa, Homo sapiens
  heavy chain complementarity determining region 3 for antibody 43166
GRAVAVSGHFDI

SEQ ID NO: 86333 - protein, 9 aa, Homo sapiens
  light chain complementarity determining region 3 for antibody 43167
LQYHTFPLT

SEQ ID NO: 86334 - protein, 18 aa, Homo sapiens
  heavy chain complementarity determining region 3 for antibody 43167
ARKHSRSSKTAITDVFDL

SEQ ID NO: 86335 - protein, 9 aa, Homo sapiens
  light chain complementarity determining region 3 for antibody 43168
LQYDNLSWT

SEQ ID NO: 86336 - protein, 10 aa, Homo sapiens
  heavy chain complementarity determining region 3 for antibody 43168
TRERLGVLDF

SEQ ID NO: 86337 - protein, 9 aa, Homo sapiens
  light chain complementarity determining region 3 for antibody 43169
LQLNSYPIT

SEQ ID NO: 86338 - protein, 20 aa, Homo sapiens
  heavy chain complementarity determining region 3 for antibody 43169
ARRGVGKGENYFDSSGYADY

SEQ ID NO: 86339 - protein, 10 aa, Homo sapiens
  light chain complementarity determining region 3 for antibody 43170
LQHSSYPRRT

SEQ ID NO: 86340 - protein, 17 aa, Homo sapiens
  heavy chain complementarity determining region 3 for antibody 43170
ARDPLTTYYESGGEFDY

SEQ ID NO: 86341 - protein, 9 aa, Homo sapiens
  light chain complementarity determining region 3 for antibody 43171
LQHNYYPRT

SEQ ID NO: 86342 - protein, 19 aa, Homo sapiens
  heavy chain complementarity determining region 3 for antibody 43171
ATGDYYDSSGYHPEEIFGI

SEQ ID NO: 86343 - protein, 9 aa, Homo sapiens
  light chain complementarity determining region 3 for antibody 43172
LQHNTYPRT

SEQ ID NO: 86344 - protein, 12 aa, Homo sapiens
  heavy chain complementarity determining region 3 for antibody 43172
ANGRSTLTAFTY

SEQ ID NO: 86345 - protein, 9 aa, Homo sapiens
  light chain complementarity determining region 3 for antibody 43173
LQHNSYSYT

SEQ ID NO: 86346 - protein, 15 aa, Homo sapiens
  heavy chain complementarity determining region 3 for antibody 43173
ARREAAGTLANSIDV

SEQ ID NO: 86347 - protein, 9 aa, Homo sapiens
  light chain complementarity determining region 3 for antibody 43174
LQHNSYSWT

SEQ ID NO: 86348 - protein, 13 aa, Homo sapiens
  heavy chain complementarity determining region 3 for antibody 43174
ARMEPGSSLSFDH

SEQ ID NO: 86349 - protein, 9 aa, Homo sapiens
  light chain complementarity determining region 3 for antibody 43175
LQHNSYPWT

SEQ ID NO: 86350 - protein, 16 aa, Homo sapiens
  heavy chain complementarity determining region 3 for antibody 43175
ARVAISFIGPGGSLDY

SEQ ID NO: 86351 - protein, 9 aa, Homo sapiens
  light chain complementarity determining region 3 for antibody 43176
LQHNSYPWT

SEQ ID NO: 86352 - protein, 20 aa, Homo sapiens
  heavy chain complementarity determining region 3 for antibody 43176
ARSPGGWDILTTYYTNNFDP

SEQ ID NO: 86353 - protein, 9 aa, Homo sapiens
  light chain complementarity determining region 3 for antibody 43177
LQHNSYPWT

SEQ ID NO: 86354 - protein, 15 aa, Homo sapiens
  heavy chain complementarity determining region 3 for antibody 43177
AREGGTGPGSVSLGY

SEQ ID NO: 86355 - protein, 9 aa, Homo sapiens
  light chain complementarity determining region 3 for antibody 43178
LQHNSYPLT

SEQ ID NO: 86356 - protein, 13 aa, Homo sapiens
  heavy chain complementarity determining region 3 for antibody 43178
ARLYLDVVATTDY

SEQ ID NO: 86357 - protein, 10 aa, Homo sapiens
  light chain complementarity determining region 3 for antibody 43179
LQGTQWPPWT

SEQ ID NO: 86358 - protein, 11 aa, Homo sapiens
  heavy chain complementarity determining region 3 for antibody 43179
VRDHPGIGIDY

SEQ ID NO: 86359 - protein, 9 aa, Homo sapiens
  light chain complementarity determining region 3 for antibody 43180
LQGTHWPPT

SEQ ID NO: 86360 - protein, 11 aa, Homo sapiens
  heavy chain complementarity determining region 3 for antibody 43180
ATGPQVTMPQD

SEQ ID NO: 86361 - protein, 9 aa, Homo sapiens
  light chain complementarity determining region 3 for antibody 43181
LQDYTYPRT

SEQ ID NO: 86362 - protein, 11 aa, Homo sapiens
  heavy chain complementarity determining region 3 for antibody 43181
ARGRLRDGYKD

SEQ ID NO: 86363 - protein, 9 aa, Homo sapiens
  light chain complementarity determining region 3 for antibody 43182
LQDHSYPRT

SEQ ID NO: 86364 - protein, 18 aa, Homo sapiens
  heavy chain complementarity determining region 3 for antibody 43182
VRDAEVVEEGIVFDRFDA

SEQ ID NO: 86365 - protein, 10 aa, Homo sapiens
  light chain complementarity determining region 3 for antibody 43183
HQYTALTGLT

SEQ ID NO: 86366 - protein, 11 aa, Homo sapiens
  heavy chain complementarity determining region 3 for antibody 43183
ARNAGWIHLKH

SEQ ID NO: 86367 - protein, 9 aa, Homo sapiens
  light chain complementarity determining region 3 for antibody 43184
HQYSSYPYT

SEQ ID NO: 86368 - protein, 21 aa, Homo sapiens
  heavy chain complementarity determining region 3 for antibody 43184
ARDRCTNGVCYPSYFYYGMDV

SEQ ID NO: 86369 - protein, 9 aa, Homo sapiens
  light chain complementarity determining region 3 for antibody 43185
HQYGTSPRT

SEQ ID NO: 86370 - protein, 14 aa, Homo sapiens
  heavy chain complementarity determining region 3 for antibody 43185
ARGGLHGSWYYFDH

SEQ ID NO: 86371 - protein, 9 aa, Homo sapiens
  light chain complementarity determining region 3 for antibody 43186
HQYGSSPGT

SEQ ID NO: 86372 - protein, 14 aa, Homo sapiens
  heavy chain complementarity determining region 3 for antibody 43186
ARDQAGYSSGWLDS

SEQ ID NO: 86373 - protein, 9 aa, Homo sapiens
  light chain complementarity determining region 3 for antibody 43187
HQYGASPWT

SEQ ID NO: 86374 - protein, 15 aa, Homo sapiens
  heavy chain complementarity determining region 3 for antibody 43187
VRQSFGPASQGYIQD

SEQ ID NO: 86375 - protein, 9 aa, Homo sapiens
  light chain complementarity determining region 3 for antibody 43188
HQSSSLPHT

SEQ ID NO: 86376 - protein, 14 aa, Homo sapiens
  heavy chain complementarity determining region 3 for antibody 43188
ATGGGSGFFWYFDL

SEQ ID NO: 86377 - protein, 9 aa, Homo sapiens
  light chain complementarity determining region 3 for antibody 43189
HFRSHWLHT

SEQ ID NO: 86378 - protein, 13 aa, Homo sapiens
  heavy chain complementarity determining region 3 for antibody 43189
AKDLSSGSFVPDS

SEQ ID NO: 86379 - protein, 9 aa, Homo sapiens
  light chain complementarity determining region 3 for antibody 43190
EQSYNTPIT

SEQ ID NO: 86380 - protein, 20 aa, Homo sapiens
  heavy chain complementarity determining region 3 for antibody 43190
ARDPTSYHSGTYYNREGFDS

SEQ ID NO: 86381 - protein, 8 aa, Homo sapiens
  light chain complementarity determining region 3 for antibody 43191
QVGHTPPL

SEQ ID NO: 86382 - protein, 14 aa, Homo sapiens
  heavy chain complementarity determining region 3 for antibody 43191
ARAEFGHDYWPFDL

SEQ ID NO: 86383 - protein, 11 aa, Homo sapiens
  light chain complementarity determining region 3 for antibody 43192
QRYDGSPPLYT

SEQ ID NO: 86384 - protein, 14 aa, Homo sapiens
  heavy chain complementarity determining region 3 for antibody 43192
ARGLDFWMNGWFDP

SEQ ID NO: 86385 - protein, 9 aa, Homo sapiens
  light chain complementarity determining region 3 for antibody 43193
QQYYTTPWT

SEQ ID NO: 86386 - protein, 13 aa, Homo sapiens
  heavy chain complementarity determining region 3 for antibody 43193
ARLAAMGYWWFDP

SEQ ID NO: 86387 - protein, 9 aa, Homo sapiens
  light chain complementarity determining region 3 for antibody 43194
QQYYSYPWT

SEQ ID NO: 86388 - protein, 12 aa, Homo sapiens
  heavy chain complementarity determining region 3 for antibody 43194
ARFTIFGNSFHM

SEQ ID NO: 86389 - protein, 9 aa, Homo sapiens
  light chain complementarity determining region 3 for antibody 43195
QQYYSSPYT

SEQ ID NO: 86390 - protein, 12 aa, Homo sapiens
  heavy chain complementarity determining region 3 for antibody 43195
VRGVEKAAIWGY

SEQ ID NO: 86391 - protein, 8 aa, Homo sapiens
  light chain complementarity determining region 3 for antibody 43196
QQYYGTPT

SEQ ID NO: 86392 - protein, 19 aa, Homo sapiens
  heavy chain complementarity determining region 3 for antibody 43196
AREVLLWRGDPTPRGGMDV

SEQ ID NO: 86393 - protein, 8 aa, Homo sapiens
  light chain complementarity determining region 3 for antibody 43197
QQYSTFST

SEQ ID NO: 86394 - protein, 13 aa, Homo sapiens
  heavy chain complementarity determining region 3 for antibody 43197
ARDATMGFDAFDM

SEQ ID NO: 86395 - protein, 9 aa, Homo sapiens
  light chain complementarity determining region 3 for antibody 43198
QQYSTFSRT

SEQ ID NO: 86396 - protein, 27 aa, Homo sapiens
  heavy chain complementarity determining region 3 for antibody 43198
ARVSTGPGSMWESGGRRGPYTLGAFNL

SEQ ID NO: 86397 - protein, 8 aa, Homo sapiens
  light chain complementarity determining region 3 for antibody 43199
QQYSSYWT

SEQ ID NO: 86398 - protein, 13 aa, Homo sapiens
  heavy chain complementarity determining region 3 for antibody 43199
ARGGTEVAGVIDN

SEQ ID NO: 86399 - protein, 9 aa, Homo sapiens
  light chain complementarity determining region 3 for antibody 43200
QQYSSYPYT

SEQ ID NO: 86400 - protein, 28 aa, Homo sapiens
  heavy chain complementarity determining region 3 for antibody 43200
GRDCRIDDVGFDFWSGEDTPPEKFQVDI

SEQ ID NO: 86401 - protein, 9 aa, Homo sapiens
  light chain complementarity determining region 3 for antibody 43201
QQYSSHRAT

SEQ ID NO: 86402 - protein, 13 aa, Homo sapiens
  heavy chain complementarity determining region 3 for antibody 43201
AREGYYGSGEFDL

SEQ ID NO: 86403 - protein, 9 aa, Homo sapiens
  light chain complementarity determining region 3 for antibody 43202
QQYSNYPYT

SEQ ID NO: 86404 - protein, 17 aa, Homo sapiens
  heavy chain complementarity determining region 3 for antibody 43202
ARRGHRDSRGYYRDFDY

SEQ ID NO: 86405 - protein, 9 aa, Homo sapiens
  light chain complementarity determining region 3 for antibody 43203
QQYSGSLWT

SEQ ID NO: 86406 - protein, 21 aa, Homo sapiens
  heavy chain complementarity determining region 3 for antibody 43203
ARADIVVVTGTSAFEADGFDI

SEQ ID NO: 86407 - protein, 8 aa, Homo sapiens
  light chain complementarity determining region 3 for antibody 43204
QQYNTYWT

SEQ ID NO: 86408 - protein, 13 aa, Homo sapiens
  heavy chain complementarity determining region 3 for antibody 43204
ARDLDGSGFRGDY

SEQ ID NO: 86409 - protein, 9 aa, Homo sapiens
  light chain complementarity determining region 3 for antibody 43205
QQYNTYSWT

SEQ ID NO: 86410 - protein, 14 aa, Homo sapiens
  heavy chain complementarity determining region 3 for antibody 43205
ARHWSDYSVPLISR

SEQ ID NO: 86411 - protein, 9 aa, Homo sapiens
  light chain complementarity determining region 3 for antibody 43206
QQYNTYPLT

SEQ ID NO: 86412 - protein, 11 aa, Homo sapiens
  heavy chain complementarity determining region 3 for antibody 43206
ARVNGGGGFSD

SEQ ID NO: 86413 - protein, 9 aa, Homo sapiens
  light chain complementarity determining region 3 for antibody 43207
QQYNTSAWT

SEQ ID NO: 86414 - protein, 16 aa, Homo sapiens
  heavy chain complementarity determining region 3 for antibody 43207
ARGIPSRYSSSWAPDY

SEQ ID NO: 86415 - protein, 9 aa, Homo sapiens
  light chain complementarity determining region 3 for antibody 43208
QQYNTDPWT

SEQ ID NO: 86416 - protein, 14 aa, Homo sapiens
  heavy chain complementarity determining region 3 for antibody 43208
ATYTINDYYYGMDI

SEQ ID NO: 86417 - protein, 9 aa, Homo sapiens
  light chain complementarity determining region 3 for antibody 43209
QQYNSYTWT

SEQ ID NO: 86418 - protein, 17 aa, Homo sapiens
  heavy chain complementarity determining region 3 for antibody 43209
AKDVHSRQGYYYYGMDV

SEQ ID NO: 86419 - protein, 9 aa, Homo sapiens
  light chain complementarity determining region 3 for antibody 43210
QQYNSYSWT

SEQ ID NO: 86420 - protein, 17 aa, Homo sapiens
  heavy chain complementarity determining region 3 for antibody 43210
TTHLETDSVTYYHLLDY

SEQ ID NO: 86421 - protein, 9 aa, Homo sapiens
  light chain complementarity determining region 3 for antibody 43211
QQYNSYSWT

SEQ ID NO: 86422 - protein, 13 aa, Homo sapiens
  heavy chain complementarity determining region 3 for antibody 43211
ARLNKWLAHHFDY

SEQ ID NO: 86423 - protein, 9 aa, Homo sapiens
  light chain complementarity determining region 3 for antibody 43212
QQYNSYSWT

SEQ ID NO: 86424 - protein, 18 aa, Homo sapiens
  heavy chain complementarity determining region 3 for antibody 43212
ARGSHCSGGSCYVGAFDI

SEQ ID NO: 86425 - protein, 9 aa, Homo sapiens
  light chain complementarity determining region 3 for antibody 43213
QQYNSYSWT

SEQ ID NO: 86426 - protein, 11 aa, Homo sapiens
  heavy chain complementarity determining region 3 for antibody 43213
ARDRHEVGLCY

SEQ ID NO: 86427 - protein, 9 aa, Homo sapiens
  light chain complementarity determining region 3 for antibody 43214
QQYNSYSWT

SEQ ID NO: 86428 - protein, 11 aa, Homo sapiens
  heavy chain complementarity determining region 3 for antibody 43214
AGAHRLEGFTR

SEQ ID NO: 86429 - protein, 8 aa, Homo sapiens
  light chain complementarity determining region 3 for antibody 43215
QQYNSYST

SEQ ID NO: 86430 - protein, 11 aa, Homo sapiens
  heavy chain complementarity determining region 3 for antibody 43215
ASTGRRRWVDY

SEQ ID NO: 86431 - protein, 8 aa, Homo sapiens
  light chain complementarity determining region 3 for antibody 43216
QQYNSYST

SEQ ID NO: 86432 - protein, 20 aa, Homo sapiens
  heavy chain complementarity determining region 3 for antibody 43216
AAAAYYDTNGHSPTNDAFDI

SEQ ID NO: 86433 - protein, 10 aa, Homo sapiens
  light chain complementarity determining region 3 for antibody 43217
QQYNSYSSIT

SEQ ID NO: 86434 - protein, 16 aa, Homo sapiens
  heavy chain complementarity determining region 3 for antibody 43217
ARASSWKYDTSGHYYF

SEQ ID NO: 86435 - protein, 9 aa, Homo sapiens
  light chain complementarity determining region 3 for antibody 43218
QQYNSYSRT

SEQ ID NO: 86436 - protein, 16 aa, Homo sapiens
  heavy chain complementarity determining region 3 for antibody 43218
ARGFGGQQLGETDLDY

SEQ ID NO: 86437 - protein, 9 aa, Homo sapiens
  light chain complementarity determining region 3 for antibody 43219
QQYNSYSLT

SEQ ID NO: 86438 - protein, 11 aa, Homo sapiens
  heavy chain complementarity determining region 3 for antibody 43219
ARRNPLEYFDL

SEQ ID NO: 86439 - protein, 10 aa, Homo sapiens
  light chain complementarity determining region 3 for antibody 43220
QQYNSYSAWT

SEQ ID NO: 86440 - protein, 13 aa, Homo sapiens
  heavy chain complementarity determining region 3 for antibody 43220
ARDATYGGYSFGY

SEQ ID NO: 86441 - protein, 8 aa, Homo sapiens
  light chain complementarity determining region 3 for antibody 43221
QQYNSYRT

SEQ ID NO: 86442 - protein, 15 aa, Homo sapiens
  heavy chain complementarity determining region 3 for antibody 43221
ATGGIAVGGNYAMDV

SEQ ID NO: 86443 - protein, 9 aa, Homo sapiens
  light chain complementarity determining region 3 for antibody 43222
QQYNSYPYT

SEQ ID NO: 86444 - protein, 19 aa, Homo sapiens
  heavy chain complementarity determining region 3 for antibody 43222
ARPTYCAGDCRPAHWYFDL

SEQ ID NO: 86445 - protein, 9 aa, Homo sapiens
  light chain complementarity determining region 3 for antibody 43223
QQYNSYPWT

SEQ ID NO: 86446 - protein, 16 aa, Homo sapiens
  heavy chain complementarity determining region 3 for antibody 43223
ARRYCSNSVMCHPFDH

SEQ ID NO: 86447 - protein, 9 aa, Homo sapiens
  light chain complementarity determining region 3 for antibody 43224
QQYNSYPWT

SEQ ID NO: 86448 - protein, 19 aa, Homo sapiens
  heavy chain complementarity determining region 3 for antibody 43224
ARAGSAVAGIGILRHGMDV

SEQ ID NO: 86449 - protein, 9 aa, Homo sapiens
  light chain complementarity determining region 3 for antibody 43225
QQYNSYPRT

SEQ ID NO: 86450 - protein, 20 aa, Homo sapiens
  heavy chain complementarity determining region 3 for antibody 43225
ARERDLLTGYTEEGYFGMDV

SEQ ID NO: 86451 - protein, 9 aa, Homo sapiens
  light chain complementarity determining region 3 for antibody 43226
QQYNSYPLT

SEQ ID NO: 86452 - protein, 11 aa, Homo sapiens
  heavy chain complementarity determining region 3 for antibody 43226
ARGWRDNSFDY

SEQ ID NO: 86453 - protein, 9 aa, Homo sapiens
  light chain complementarity determining region 3 for antibody 43227
QQYNSFPWT

SEQ ID NO: 86454 - protein, 11 aa, Homo sapiens
  heavy chain complementarity determining region 3 for antibody 43227
TRRENIYGIRY

SEQ ID NO: 86455 - protein, 9 aa, Homo sapiens
  light chain complementarity determining region 3 for antibody 43228
QQYNSFPVT

SEQ ID NO: 86456 - protein, 13 aa, Homo sapiens
  heavy chain complementarity determining region 3 for antibody 43228
ARVALGRPAYFDY

SEQ ID NO: 86457 - protein, 9 aa, Homo sapiens
  light chain complementarity determining region 3 for antibody 43229
QQYNSFPLT

SEQ ID NO: 86458 - protein, 18 aa, Homo sapiens
  heavy chain complementarity determining region 3 for antibody 43229
ATLDYCSSGSCYLLNEDY

SEQ ID NO: 86459 - protein, 9 aa, Homo sapiens
  light chain complementarity determining region 3 for antibody 43230
QQYNRFPLT

SEQ ID NO: 86460 - protein, 16 aa, Homo sapiens
  heavy chain complementarity determining region 3 for antibody 43230
ARGGFWFGESGSSDGF

SEQ ID NO: 86461 - protein, 10 aa, Homo sapiens [sequence omitted]

SEQ ID NO: 86462 - protein, 11 aa, Homo sapiens
  heavy chain complementarity determining region 3 for antibody 43231
IREKLGGHFDF

SEQ ID NO: 86463 - protein, 9 aa, Homo sapiens
  light chain complementarity determining region 3 for antibody 43232
QQYNNWPPT

SEQ ID NO: 86464 - protein, 15 aa, Homo sapiens
  heavy chain complementarity determining region 3 for antibody 43232
ARDVHSTWTYWYFDL

SEQ ID NO: 86465 - protein, 9 aa, Homo sapiens
  light chain complementarity determining region 3 for antibody 43233
QQYNKWPRT

SEQ ID NO: 86466 - protein, 22 aa, Homo sapiens
  heavy chain complementarity determining region 3 for antibody 43233
AREGLFGYCTTTSCYMHFGMDV

SEQ ID NO: 86467 - protein, 10 aa, Homo sapiens
  light chain complementarity determining region 3 for antibody 43234
QQYNKWPPYT

SEQ ID NO: 86468 - protein, 15 aa, Homo sapiens
  heavy chain complementarity determining region 3 for antibody 43234
ARAYSSGWYADYFDC

SEQ ID NO: 86469 - protein, 9 aa, Homo sapiens
  light chain complementarity determining region 3 for antibody 43235
QQYNKWPLT

SEQ ID NO: 86470 - protein, 14 aa, Homo sapiens
  heavy chain complementarity determining region 3 for antibody 43235
ARGHAVAATAWFDL

SEQ ID NO: 86471 - protein, 9 aa, Homo sapiens
  light chain complementarity determining region 3 for antibody 43236
QQYNGASRT

SEQ ID NO: 86472 - protein, 15 aa, Homo sapiens
  heavy chain complementarity determining region 3 for antibody 43236
TRDWLGIWFGEFGED

SEQ ID NO: 86473 - protein, 9 aa, Homo sapiens
  light chain complementarity determining region 3 for antibody 43237
QQYNEWPLT

SEQ ID NO: 86474 - protein, 17 aa, Homo sapiens
  heavy chain complementarity determining region 3 for antibody 43237
AIAEGWDNYKGVDAFDV

SEQ ID NO: 86475 - protein, 9 aa, Homo sapiens
  light chain complementarity determining region 3 for antibody 43238
QQYNDYPYT

SEQ ID NO: 86476 - protein, 15 aa, Homo sapiens
  heavy chain complementarity determining region 3 for antibody 43238
ARDRGTIAGAGTFDS

SEQ ID NO: 86477 - protein, 9 aa, Homo sapiens
  light chain complementarity determining region 3 for antibody 43239
QQYNAYPYT

SEQ ID NO: 86478 - protein, 19 aa, Homo sapiens
  heavy chain complementarity determining region 3 for antibody 43239
ARDRLDCSTSVCASGWFDP

SEQ ID NO: 86479 - protein, 11 aa, Homo sapiens
  light chain complementarity determining region 3 for antibody 43240
QQYKTYSAGLT

SEQ ID NO: 86480 - protein, 12 aa, Homo sapiens
  heavy chain complementarity determining region 3 for antibody 43240
AKPLPASAYFDY

SEQ ID NO: 86481 - protein, 9 aa, Homo sapiens
  light chain complementarity determining region 3 for antibody 43241
QQYKSYSRT

SEQ ID NO: 86482 - protein, 13 aa, Homo sapiens
  heavy chain complementarity determining region 3 for antibody 43241
AGGFSSSWTLLEY

SEQ ID NO: 86483 - protein, 9 aa, Homo sapiens
  light chain complementarity determining region 3 for antibody 43242
QQYKSYSNT

SEQ ID NO: 86484 - protein, 14 aa, Homo sapiens
  heavy chain complementarity determining region 3 for antibody 43242
ASYVDIVATSYFDY

SEQ ID NO: 86485 - protein, 9 aa, Homo sapiens
  light chain complementarity determining region 3 for antibody 43243
QQYKSYSLT

SEQ ID NO: 86486 - protein, 17 aa, Homo sapiens
  heavy chain complementarity determining region 3 for antibody 43243
AKDALDYADYGQYYFGS

SEQ ID NO: 86487 - protein, 9 aa, Homo sapiens
  light chain complementarity determining region 3 for antibody 43244
QQYKSYPWT

SEQ ID NO: 86488 - protein, 10 aa, Homo sapiens
  heavy chain complementarity determining region 3 for antibody 43244
ARDSGYGIEC

SEQ ID NO: 86489 - protein, 8 aa, Homo sapiens
  light chain complementarity determining region 3 for antibody 43245
QQYHSRRT

SEQ ID NO: 86490 - protein, 9 aa, Homo sapiens
  heavy chain complementarity determining region 3 for antibody 43245
ATGGRTYQR

SEQ ID NO: 86491 - protein, 9 aa, Homo sapiens
  light chain complementarity determining region 3 for antibody 43246
QQYHSFSYT

SEQ ID NO: 86492 - protein, 10 aa, Homo sapiens
  heavy chain complementarity determining region 3 for antibody 43246
ATGTSVGAKF

SEQ ID NO: 86493 - protein, 9 aa, Homo sapiens
  light chain complementarity determining region 3 for antibody 43247
QQYHNYPII

SEQ ID NO: 86494 - protein, 16 aa, Homo sapiens
  heavy chain complementarity determining region 3 for antibody 43247
ARSAEGAVIPRWFGEF

SEQ ID NO: 86495 - protein, 8 aa, Homo sapiens
  light chain complementarity determining region 3 for antibody 43248
QQYGTSWT

SEQ ID NO: 86496 - protein, 21 aa, Homo sapiens
  heavy chain complementarity determining region 3 for antibody 43248
GRQRNFEGDSGFKFPEGYFDL

SEQ ID NO: 86497 - protein, 9 aa, Homo sapiens
  light chain complementarity determining region 3 for antibody 43249
QQYGTSPLT

SEQ ID NO: 86498 - protein, 20 aa, Homo sapiens
  heavy chain complementarity determining region 3 for antibody 43249
AKDSNAYGITLGGLIGSFDS

SEQ ID NO: 86499 - protein, 9 aa, Homo sapiens
  light chain complementarity determining region 3 for antibody 43250
QQYGTSPET

SEQ ID NO: 86500 - protein, 9 aa, Homo sapiens
  heavy chain complementarity determining region 3 for antibody 43250
FVTNGGDLK

SEQ ID NO: 86501 - protein, 10 aa, Homo sapiens
  light chain complementarity determining region 3 for antibody 43251
QQYGTSLLYS

SEQ ID NO: 86502 - protein, 14 aa, Homo sapiens
  heavy chain complementarity determining region 3 for antibody 43251
TTDRPYTGMVTFDY

SEQ ID NO: 86503 - protein, 9 aa, Homo sapiens
  light chain complementarity determining region 3 for antibody 43252
QQYGSTPLT

SEQ ID NO: 86504 - protein, 22 aa, Homo sapiens
  heavy chain complementarity determining region 3 for antibody 43252
ARGGVVVEILATALPTHESFDI

SEQ ID NO: 86505 - protein, 10 aa, Homo sapiens
  light chain complementarity determining region 3 for antibody 43253
QQYGSTPEWT

SEQ ID NO: 86506 - protein, 12 aa, Homo sapiens
  heavy chain complementarity determining region 3 for antibody 43253
VRDGMHNGNHDF

SEQ ID NO: 86507 - protein, 9 aa, Homo sapiens
  light chain complementarity determining region 3 for antibody 43254
QQYGSSSLT

SEQ ID NO: 86508 - protein, 13 aa, Homo sapiens
  heavy chain complementarity determining region 3 for antibody 43254
ATESGSYYGGLDY

SEQ ID NO: 86509 - protein, 9 aa, Homo sapiens
  light chain complementarity determining region 3 for antibody 43255
QQYGSSSIT

SEQ ID NO: 86510 - protein, 13 aa, Homo sapiens
  heavy chain complementarity determining region 3 for antibody 43255
VKEFFLVFDAFDV

SEQ ID NO: 86511 - protein, 9 aa, Homo sapiens
  light chain complementarity determining region 3 for antibody 43256
QQYGSSPYT

SEQ ID NO: 86512 - protein, 12 aa, Homo sapiens
  heavy chain complementarity determining region 3 for antibody 43256
ARESPAGTFFDH

SEQ ID NO: 86513 - protein, 9 aa, Homo sapiens
  light chain complementarity determining region 3 for antibody 43257
QQYGSSPYT

SEQ ID NO: 86514 - protein, 10 aa, Homo sapiens
  heavy chain complementarity determining region 3 for antibody 43257
ARDLGTGGAY

SEQ ID NO: 86515 - protein, 9 aa, Homo sapiens
  light chain complementarity determining region 3 for antibody 43258
QQYGSSPYT

SEQ ID NO: 86516 - protein, 15 aa, Homo sapiens
  heavy chain complementarity determining region 3 for antibody 43258
AKWVEYSISGGYFDY

SEQ ID NO: 86517 - protein, 8 aa, Homo sapiens
  light chain complementarity determining region 3 for antibody 43259
QQYGSSPT

SEQ ID NO: 86518 - protein, 27 aa, Homo sapiens
  heavy chain complementarity determining region 3 for antibody 43259
ARSHASRGVLSWGGPDAVHTPHDPYDI

SEQ ID NO: 86519 - protein, 10 aa, Homo sapiens
  light chain complementarity determining region 3 for antibody 43260
QQYGSSPRYT

SEQ ID NO: 86520 - protein, 17 aa, Homo sapiens
  heavy chain complementarity determining region 3 for antibody 43260
VKHQEASTNWVRYALDM

SEQ ID NO: 86521 - protein, 9 aa, Homo sapiens
  light chain complementarity determining region 3 for antibody 43261
QQYGSSPRT

SEQ ID NO: 86522 - protein, 16 aa, Homo sapiens
  heavy chain complementarity determining region 3 for antibody 43261
ARWSTGDQKSVYGLDV

SEQ ID NO: 86523 - protein, 9 aa, Homo sapiens
  light chain complementarity determining region 3 for antibody 43262
QQYGSSPRT

SEQ ID NO: 86524 - protein, 13 aa, Homo sapiens
  heavy chain complementarity determining region 3 for antibody 43262
ARTGRVAGVEGAH

SEQ ID NO: 86525 - protein, 10 aa, Homo sapiens
  light chain complementarity determining region 3 for antibody 43263
QQYGSSPPIT

SEQ ID NO: 86526 - protein, 13 aa, Homo sapiens
  heavy chain complementarity determining region 3 for antibody 43263
AHMTHPNYGDFDH

SEQ ID NO: 86527 - protein, 10 aa, Homo sapiens
  light chain complementarity determining region 3 for antibody 43264
QQYGSSPPFT

SEQ ID NO: 86528 - protein, 15 aa, Homo sapiens
  heavy chain complementarity determining region 3 for antibody 43264
VHSGSAYYNLDAFDI

SEQ ID NO: 86529 - protein, 10 aa, Homo sapiens
  light chain complementarity determining region 3 for antibody 43265
QQYGSSPLYT

SEQ ID NO: 86530 - protein, 9 aa, Homo sapiens
  heavy chain complementarity determining region 3 for antibody 43265
VRDTQSSSN

SEQ ID NO: 86531 - protein, 9 aa, Homo sapiens
  light chain complementarity determining region 3 for antibody 43266
QQYGSSPLT

SEQ ID NO: 86532 - protein, 12 aa, Homo sapiens
  heavy chain complementarity determining region 3 for antibody 43266
ARHPDHHPAFDL

SEQ ID NO: 86533 - protein, 9 aa, Homo sapiens
  light chain complementarity determining region 3 for antibody 43267
QQYGSSPIT

SEQ ID NO: 86534 - protein, 14 aa, Homo sapiens
  heavy chain complementarity determining region 3 for antibody 43267
ARDYSWDYYGDFDY

SEQ ID NO: 86535 - protein, 9 aa, Homo sapiens
  light chain complementarity determining region 3 for antibody 43268
QQYGSSPFT

SEQ ID NO: 86536 - protein, 10 aa, Homo sapiens
  heavy chain complementarity determining region 3 for antibody 43268
LYMSDAWGEH

SEQ ID NO: 86537 - protein, 7 aa, Homo sapiens
  light chain complementarity determining region 3 for antibody 43269
QQYGSSH

SEQ ID NO: 86538 - protein, 19 aa, Homo sapiens
  heavy chain complementarity determining region 3 for antibody 43269
AAFRVPRRSGSYYIGGFDY

SEQ ID NO: 86539 - protein, 9 aa, Homo sapiens
  light chain complementarity determining region 3 for antibody 43270
QQYGSLLVT

SEQ ID NO: 86540 - protein, 14 aa, Homo sapiens
  heavy chain complementarity determining region 3 for antibody 43270
ARPSTMGVRDGYDV

SEQ ID NO: 86541 - protein, 9 aa, Homo sapiens
  light chain complementarity determining region 3 for antibody 43271
QQYGRSPLT

SEQ ID NO: 86542 - protein, 15 aa, Homo sapiens
  heavy chain complementarity determining region 3 for antibody 43271
ARGPGVLAVKGVFDH

SEQ ID NO: 86543 - protein, 8 aa, Homo sapiens
  light chain complementarity determining region 3 for antibody 43272
QQYGRSLT

SEQ ID NO: 86544 - protein, 19 aa, Homo sapiens
  heavy chain complementarity determining region 3 for antibody 43272
ARSPGGGVAEAGSWAYFDH

SEQ ID NO: 86545 - protein, 8 aa, Homo sapiens
  light chain complementarity determining region 3 for antibody 43273
QQYGPRVA

SEQ ID NO: 86546 - protein, 14 aa, Homo sapiens
  heavy chain complementarity determining region 3 for antibody 43273
ARGLRVRGPFLAGY

SEQ ID NO: 86547 - protein, 10 aa, Homo sapiens
  light chain complementarity determining region 3 for antibody 43274
QQYGGSPRYT

SEQ ID NO: 86548 - protein, 16 aa, Homo sapiens
  heavy chain complementarity determining region 3 for antibody 43274
TRVMWLRGIVTPAFDY

SEQ ID NO: 86549 - protein, 10 aa, Homo sapiens
  light chain complementarity determining region 3 for antibody 43275
QQYGGSPLVT

SEQ ID NO: 86550 - protein, 21 aa, Homo sapiens
  heavy chain complementarity determining region 3 for antibody 43275
ARDSTVVRGAPSHFSYYCLDV

SEQ ID NO: 86551 - protein, 9 aa, Homo sapiens
  light chain complementarity determining region 3 for antibody 43276
QQYGGLPLT

SEQ ID NO: 86552 - protein, 10 aa, Homo sapiens
  heavy chain complementarity determining region 3 for antibody 43276
STIAAAGKGC

SEQ ID NO: 86553 - protein, 9 aa, Homo sapiens
  light chain complementarity determining region 3 for antibody 43277
QQYGDIPPS

SEQ ID NO: 86554 - protein, 13 aa, Homo sapiens
  heavy chain complementarity determining region 3 for antibody 43277
AREGPNYFGSGSP

SEQ ID NO: 86555 - protein, 8 aa, Homo sapiens
  light chain complementarity determining region 3 for antibody 43278
QQYFSYCT

SEQ ID NO: 86556 - protein, 18 aa, Homo sapiens
  heavy chain complementarity determining region 3 for antibody 43278
ARGFVEYYDSSGYPLFDQ

SEQ ID NO: 86557 - protein, 8 aa, Homo sapiens
  light chain complementarity determining region 3 for antibody 43279
QQYESYVT

SEQ ID NO: 86558 - protein, 16 aa, Homo sapiens
  heavy chain complementarity determining region 3 for antibody 43279
AKYESYRGGPYDAFDL

SEQ ID NO: 86559 - protein, 9 aa, Homo sapiens
  light chain complementarity determining region 3 for antibody 43280
QQYDTSPYT

SEQ ID NO: 86560 - protein, 17 aa, Homo sapiens
  heavy chain complementarity determining region 3 for antibody 43280
ARDGPLGSIWPFYFFDY

SEQ ID NO: 86561 - protein, 9 aa, Homo sapiens
  light chain complementarity determining region 3 for antibody 43281
QQYDSYPWT

SEQ ID NO: 86562 - protein, 14 aa, Homo sapiens
  heavy chain complementarity determining region 3 for antibody 43281
ASGVAAAGRDWVAP

SEQ ID NO: 86563 - protein, 9 aa, Homo sapiens
  light chain complementarity determining region 3 for antibody 43282
QQYDSSPRT

SEQ ID NO: 86564 - protein, 13 aa, Homo sapiens
  heavy chain complementarity determining region 3 for antibody 43282
ARSLFAIHDFLDY

SEQ ID NO: 86565 - protein, 8 aa, Homo sapiens
  light chain complementarity determining region 3 for antibody 43283
QQYDSLWT

SEQ ID NO: 86566 - protein, 15 aa, Homo sapiens
  heavy chain complementarity determining region 3 for antibody 43283
AKDRGLEWLRWYLDY

SEQ ID NO: 86567 - protein, 10 aa, Homo sapiens
  light chain complementarity determining region 3 for antibody 43284
QQYDSLPPLT

SEQ ID NO: 86568 - protein, 12 aa, Homo sapiens
  heavy chain complementarity determining region 3 for antibody 43284
ARYNWARGGFDY

SEQ ID NO: 86569 - protein, 9 aa, Homo sapiens
  light chain complementarity determining region 3 for antibody 43285
QQYDSLPIT

SEQ ID NO: 86570 - protein, 20 aa, Homo sapiens
  heavy chain complementarity determining region 3 for antibody 43285
VTLRRERQQVVPGLRDPFDI

SEQ ID NO: 86571 - protein, 9 aa, Homo sapiens
  light chain complementarity determining region 3 for antibody 43286
QQYDSFSRT

SEQ ID NO: 86572 - protein, 15 aa, Homo sapiens
  heavy chain complementarity determining region 3 for antibody 43286
AKDSGYSSALDAFDI

SEQ ID NO: 86573 - protein, 9 aa, Homo sapiens
  light chain complementarity determining region 3 for antibody 43287
QQYDRSPYT

SEQ ID NO: 86574 - protein, 9 aa, Homo sapiens
  heavy chain complementarity determining region 3 for antibody 43287
ARGGGSLGL

SEQ ID NO: 86575 - protein, 9 aa, Homo sapiens
  light chain complementarity determining region 3 for antibody 43288
QQYDNWPPV

SEQ ID NO: 86576 - protein, 19 aa, Homo sapiens
  heavy chain complementarity determining region 3 for antibody 43288
AHRSRFMEWPRGGYHAIDF

SEQ ID NO: 86577 - protein, 9 aa, Homo sapiens
  light chain complementarity determining region 3 for antibody 43289
QQYDNWPIT

SEQ ID NO: 86578 - protein, 14 aa, Homo sapiens
  heavy chain complementarity determining region 3 for antibody 43289
ARGRGELSLEEFDY

SEQ ID NO: 86579 - protein, 9 aa, Homo sapiens
  light chain complementarity determining region 3 for antibody 43290
QQYDNLSLT

SEQ ID NO: 86580 - protein, 21 aa, Homo sapiens
  heavy chain complementarity determining region 3 for antibody 43290
AHCRDSPGSGSIWHIVEAFDI

SEQ ID NO: 86581 - protein, 9 aa, Homo sapiens
  light chain complementarity determining region 3 for antibody 43291
QQYDNLPYT

SEQ ID NO: 86582 - protein, 17 aa, Homo sapiens
  heavy chain complementarity determining region 3 for antibody 43291
AAHHYDSRGYYYAAFDI

SEQ ID NO: 86583 - protein, 9 aa, Homo sapiens
  light chain complementarity determining region 3 for antibody 43292
QQYDNLPPV

SEQ ID NO: 86584 - protein, 16 aa, Homo sapiens
  heavy chain complementarity determining region 3 for antibody 43292
ARDWAFGGGRSYYFDY

SEQ ID NO: 86585 - protein, 9 aa, Homo sapiens
  light chain complementarity determining region 3 for antibody 43293
QQYDNLPPT

SEQ ID NO: 86586 - protein, 15 aa, Homo sapiens
  heavy chain complementarity determining region 3 for antibody 43293
ARAPSGTSSPHHFDH

SEQ ID NO: 86587 - protein, 9 aa, Homo sapiens
  light chain complementarity determining region 3 for antibody 43294
QQYDNLPLT

SEQ ID NO: 86588 - protein, 13 aa, Homo sapiens
  heavy chain complementarity determining region 3 for antibody 43294
ARDGRVEVMVLDF

SEQ ID NO: 86589 - protein, 11 aa, Homo sapiens
  light chain complementarity determining region 3 for antibody 43295
QQYDNLPLMYT

SEQ ID NO: 86590 - protein, 16 aa, Homo sapiens
  heavy chain complementarity determining region 3 for antibody 43295
ARQPLAGKDFYYGMDV

SEQ ID NO: 86591 - protein, 10 aa, Homo sapiens
  light chain complementarity determining region 3 for antibody 43296
QQYDNLPLFT

SEQ ID NO: 86592 - protein, 5 aa, Homo sapiens
  heavy chain complementarity determining region 3 for antibody 43296
TNLVD

SEQ ID NO: 86593 - protein, 9 aa, Homo sapiens
  light chain complementarity determining region 3 for antibody 43297
QQYDILPIT

SEQ ID NO: 86594 - protein, 20 aa, Homo sapiens
  heavy chain complementarity determining region 3 for antibody 43297
VTLRRERQQVVPGLRDPFDI

SEQ ID NO: 86595 - protein, 9 aa, Homo sapiens
  light chain complementarity determining region 3 for antibody 43298
QQYDDLPRT

SEQ ID NO: 86596 - protein, 15 aa, Homo sapiens
  heavy chain complementarity determining region 3 for antibody 43298
ATNRDTAAAADYFDY

SEQ ID NO: 86597 - protein, 9 aa, Homo sapiens
  light chain complementarity determining region 3 for antibody 43299
QQYCSSPRT

SEQ ID NO: 86598 - protein, 11 aa, Homo sapiens
  heavy chain complementarity determining region 3 for antibody 43299
ARGDRWGGAEF

SEQ ID NO: 86599 - protein, 8 aa, Homo sapiens
  light chain complementarity determining region 3 for antibody 43300
QQYASSTT

SEQ ID NO: 86600 - protein, 16 aa, Homo sapiens
  heavy chain complementarity determining region 3 for antibody 43300
ASHKLIRGIIFYNFDY

SEQ ID NO: 86601 - protein, 9 aa, Homo sapiens
  light chain complementarity determining region 3 for antibody 43301
QQYASSPPT

SEQ ID NO: 86602 - protein, 18 aa, Homo sapiens
  heavy chain complementarity determining region 3 for antibody 43301
ATRADNCGGACYYWYFDL

SEQ ID NO: 86603 - protein, 9 aa, Homo sapiens
  light chain complementarity determining region 3 for antibody 43302
QQYARSPLT

SEQ ID NO: 86604 - protein, 14 aa, Homo sapiens
  heavy chain complementarity determining region 3 for antibody 43302
VKTPRGYPLFHFDY

SEQ ID NO: 86605 - protein, 9 aa, Homo sapiens
  light chain complementarity determining region 3 for antibody 43303
QQYADSPIT

SEQ ID NO: 86606 - protein, 14 aa, Homo sapiens
  heavy chain complementarity determining region 3 for antibody 43303
AKGELPNFDWLLNS

SEQ ID NO: 86607 - protein, 9 aa, Homo sapiens
  light chain complementarity determining region 3 for antibody 43304
QQVNNYPFT

SEQ ID NO: 86608 - protein, 15 aa, Homo sapiens
  heavy chain complementarity determining region 3 for antibody 43304
ARDGWIAATGSFFDY

SEQ ID NO: 86609 - protein, 9 aa, Homo sapiens
  light chain complementarity determining region 3 for antibody 43305
QQTYTIPLT

SEQ ID NO: 86610 - protein, 15 aa, Homo sapiens
  heavy chain complementarity determining region 3 for antibody 43305
ARDGDFYTGWEELDH

SEQ ID NO: 86611 - protein, 11 aa, Homo sapiens
  light chain complementarity determining region 3 for antibody 43306
QQTYSPPRVFS

SEQ ID NO: 86612 - protein, 18 aa, Homo sapiens
  heavy chain complementarity determining region 3 for antibody 43306
ARQVATTMGGHVYWYFGL

SEQ ID NO: 86613 - protein, 10 aa, Homo sapiens
  light chain complementarity determining region 3 for antibody 43307
QQTYSLPPIT

SEQ ID NO: 86614 - protein, 11 aa, Homo sapiens
  heavy chain complementarity determining region 3 for antibody 43307
TRNSDSGGPGC

SEQ ID NO: 86615 - protein, 9 aa, Homo sapiens
  light chain complementarity determining region 3 for antibody 43308
QQTYSIPHT

SEQ ID NO: 86616 - protein, 15 aa, Homo sapiens
  heavy chain complementarity determining region 3 for antibody 43308
ARRGAFDWLSDAFDI

SEQ ID NO: 86617 - protein, 9 aa, Homo sapiens
  light chain complementarity determining region 3 for antibody 43309
QQTYRTPHT

SEQ ID NO: 86618 - protein, 12 aa, Homo sapiens
  heavy chain complementarity determining region 3 for antibody 43309
ASGTITGWYHRY

SEQ ID NO: 86619 - protein, 10 aa, Homo sapiens
  light chain complementarity determining region 3 for antibody 43310
QQTYNTPRVT

SEQ ID NO: 86620 - protein, 11 aa, Homo sapiens
  heavy chain complementarity determining region 3 for antibody 43310
ASTGRRRWVDY

SEQ ID NO: 86621 - protein, 9 aa, Homo sapiens
  light chain complementarity determining region 3 for antibody 43311
QQTYNTPQT

SEQ ID NO: 86622 - protein, 19 aa, Homo sapiens
  heavy chain complementarity determining region 3 for antibody 43311
ARLVLTRSSDILTGYSSDS

SEQ ID NO: 86623 - protein, 9 aa, Homo sapiens
  light chain complementarity determining region 3 for antibody 43312
QQTYNLPYT

SEQ ID NO: 86624 - protein, 18 aa, Homo sapiens
  heavy chain complementarity determining region 3 for antibody 43312
ARVGTYIEDLATRRDFDF

SEQ ID NO: 86625 - protein, 9 aa, Homo sapiens
  light chain complementarity determining region 3 for antibody 43313
QQTKTFPYT

SEQ ID NO: 86626 - protein, 17 aa, Homo sapiens
  heavy chain complementarity determining region 3 for antibody 43313
AKSSSVYSRGWYGGSDH

SEQ ID NO: 86627 - protein, 10 aa, Homo sapiens
  light chain complementarity determining region 3 for antibody 43314
QQTFSTSPIT

SEQ ID NO: 86628 - protein, 16 aa, Homo sapiens
  heavy chain complementarity determining region 3 for antibody 43314
ARQGPWTSVVTPHFDH

SEQ ID NO: 86629 - protein, 9 aa, Homo sapiens
  light chain complementarity determining region 3 for antibody 43315
QQSYTTPHT

SEQ ID NO: 86630 - protein, 11 aa, Homo sapiens
  heavy chain complementarity determining region 3 for antibody 43315
ARVQSGYWYDS

SEQ ID NO: 86631 - protein, 9 aa, Homo sapiens
  light chain complementarity determining region 3 for antibody 43316
QQSYTNPWT

SEQ ID NO: 86632 - protein, 18 aa, Homo sapiens
  heavy chain complementarity determining region 3 for antibody 43316
ARFGFGESLRSPPRRGDF

SEQ ID NO: 86633 - protein, 9 aa, Homo sapiens
  light chain complementarity determining region 3 for antibody 43317
QQSYSTWWT

SEQ ID NO: 86634 - protein, 13 aa, Homo sapiens
  heavy chain complementarity determining region 3 for antibody 43317
VRTTMLASGWFDH

SEQ ID NO: 86635 - protein, 9 aa, Homo sapiens
  light chain complementarity determining region 3 for antibody 43318
QQSYSTRWT

SEQ ID NO: 86636 - protein, 14 aa, Homo sapiens
  heavy chain complementarity determining region 3 for antibody 43318
AKTSDSSGYSRFHF

SEQ ID NO: 86637 - protein, 9 aa, Homo sapiens
  light chain complementarity determining region 3 for antibody 43319
QQSYSTPYT

SEQ ID NO: 86638 - protein, 16 aa, Homo sapiens
  heavy chain complementarity determining region 3 for antibody 43319
ARAKWDRGLAVAGFDY

SEQ ID NO: 86639 - protein, 9 aa, Homo sapiens
  light chain complementarity determining region 3 for antibody 43320
QQSYSTPWT

SEQ ID NO: 86640 - protein, 15 aa, Homo sapiens
  heavy chain complementarity determining region 3 for antibody 43320
ARVESVAGSREYFHH

SEQ ID NO: 86641 - protein, 9 aa, Homo sapiens
  light chain complementarity determining region 3 for antibody 43321
QQSYSTPWK

SEQ ID NO: 86642 - protein, 21 aa, Homo sapiens
  heavy chain complementarity determining region 3 for antibody 43321
TRDKGEGADFRYGYSFGAFDI

SEQ ID NO: 86643 - protein, 9 aa, Homo sapiens
  light chain complementarity determining region 3 for antibody 43322
QQSYSTPST

SEQ ID NO: 86644 - protein, 23 aa, Homo sapiens
  heavy chain complementarity determining region 3 for antibody 43322
ARASGVLRFSEWLLFRDHYYFDY

SEQ ID NO: 86645 - protein, 9 aa, Homo sapiens
  light chain complementarity determining region 3 for antibody 43323
QQSYSTPRT

SEQ ID NO: 86646 - protein, 18 aa, Homo sapiens
  heavy chain complementarity determining region 3 for antibody 43323
SREPLLWFGGHPGEYFQH

SEQ ID NO: 86647 - protein, 10 aa, Homo sapiens
  light chain complementarity determining region 3 for antibody 43324
QQSYSTPRFT

SEQ ID NO: 86648 - protein, 17 aa, Homo sapiens
  heavy chain complementarity determining region 3 for antibody 43324
AKDPGDIIMVVAAVGDS

SEQ ID NO: 86649 - protein, 9 aa, Homo sapiens
  light chain complementarity determining region 3 for antibody 43325
QQSYSTPQT

SEQ ID NO: 86650 - protein, 21 aa, Homo sapiens
  heavy chain complementarity determining region 3 for antibody 43325
ARHDPDNRQGGDTFAYNYFDQ

SEQ ID NO: 86651 - protein, 10 aa, Homo sapiens
  light chain complementarity determining region 3 for antibody 43326
QQSYSTPPRT

SEQ ID NO: 86652 - protein, 26 aa, Homo sapiens
  heavy chain complementarity determining region 3 for antibody 43326
ARDYRPYYYDSSGPITGGDYYYGMDV

SEQ ID NO: 86653 - protein, 10 aa, Homo sapiens
  light chain complementarity determining region 3 for antibody 43327
QQSYSTPPFT

SEQ ID NO: 86654 - protein, 18 aa, Homo sapiens
  heavy chain complementarity determining region 3 for antibody 43327
ARLDIVVLSGGEARWFDP

SEQ ID NO: 86655 - protein, 10 aa, Homo sapiens
  light chain complementarity determining region 3 for antibody 43328
QQSYSTPLYT

SEQ ID NO: 86656 - protein, 17 aa, Homo sapiens
  heavy chain complementarity determining region 3 for antibody 43328
ATRFYDILTTPVDYFDY

SEQ ID NO: 86657 - protein, 9 aa, Homo sapiens
  light chain complementarity determining region 3 for antibody 43329
QQSYSTPLT

SEQ ID NO: 86658 - protein, 16 aa, Homo sapiens
  heavy chain complementarity determining region 3 for antibody 43329
ARVYSTVTTQALGVDY

SEQ ID NO: 86659 - protein, 8 aa, Homo sapiens
  light chain complementarity determining region 3 for antibody 43330
QQSYSTLT

SEQ ID NO: 86660 - protein, 15 aa, Homo sapiens
  heavy chain complementarity determining region 3 for antibody 43330
ARVADSGPASYYFDY

SEQ ID NO: 86661 - protein, 9 aa, Homo sapiens
  light chain complementarity determining region 3 for antibody 43331
QQSYSPVWT

SEQ ID NO: 86662 - protein, 19 aa, Homo sapiens
  heavy chain complementarity determining region 3 for antibody 43331
ARPSGGGHFDFWGQGILNF

SEQ ID NO: 86663 - protein, 8 aa, Homo sapiens
  light chain complementarity determining region 3 for antibody 43332
QQSYSNPG

SEQ ID NO: 86664 - protein, 12 aa, Homo sapiens
  heavy chain complementarity determining region 3 for antibody 43332
LRIQLWYDAFDI

SEQ ID NO: 86665 - protein, 10 aa, Homo sapiens
  light chain complementarity determining region 3 for antibody 43333
QQSYSNLLFT

SEQ ID NO: 86666 - protein, 20 aa, Homo sapiens
  heavy chain complementarity determining region 3 for antibody 43333
VKDNRGYDSGPHYYYYGLDV

SEQ ID NO: 86667 - protein, 9 aa, Homo sapiens
  light chain complementarity determining region 3 for antibody 43334
QQSYSLPRT

SEQ ID NO: 86668 - protein, 18 aa, Homo sapiens
  heavy chain complementarity determining region 3 for antibody 43334
ARGHYFDSSGYLHPAFDY

SEQ ID NO: 86669 - protein, 9 aa, Homo sapiens
  light chain complementarity determining region 3 for antibody 43335
QQSYSFPYT

SEQ ID NO: 86670 - protein, 9 aa, Homo sapiens
  heavy chain complementarity determining region 3 for antibody 43335
AIGGDRLEN

SEQ ID NO: 86671 - protein, 10 aa, Homo sapiens
  light chain complementarity determining region 3 for antibody 43336
QQSYSAPQVT

SEQ ID NO: 86672 - protein, 19 aa, Homo sapiens
  heavy chain complementarity determining region 3 for antibody 43336
ARVRITMIRGIIITYAFDI

SEQ ID NO: 86673 - protein, 10 aa, Homo sapiens
  light chain complementarity determining region 3 for antibody 43337
QQSYSAPPYT

SEQ ID NO: 86674 - protein, 12 aa, Homo sapiens
  heavy chain complementarity determining region 3 for antibody 43337
AREGSMTYYFDF

SEQ ID NO: 86675 - protein, 10 aa, Homo sapiens
  light chain complementarity determining region 3 for antibody 43338
QQSYRTLMYT

SEQ ID NO: 86676 - protein, 13 aa, Homo sapiens
  heavy chain complementarity determining region 3 for antibody 43338
ARHSSNSYLPLDY

SEQ ID NO: 86677 - protein, 9 aa, Homo sapiens
  light chain complementarity determining region 3 for antibody 43339
QQSYNYPLT

SEQ ID NO: 86678 - protein, 22 aa, Homo sapiens
  heavy chain complementarity determining region 3 for antibody 43339
ARRRPSGRTTFRQGGRQGAFDI

SEQ ID NO: 86679 - protein, 9 aa, Homo sapiens
  light chain complementarity determining region 3 for antibody 43340
QQSYNNSPT

SEQ ID NO: 86680 - protein, 21 aa, Homo sapiens
  heavy chain complementarity determining region 3 for antibody 43340
AKRTDHHYHSSGYQYRSVFDM

SEQ ID NO: 86681 - protein, 9 aa, Homo sapiens
  light chain complementarity determining region 3 for antibody 43341
QQSYGSPLT

SEQ ID NO: 86682 - protein, 17 aa, Homo sapiens
  heavy chain complementarity determining region 3 for antibody 43341
ARGLIVVVIGAFKTFDP

SEQ ID NO: 86683 - protein, 10 aa, Homo sapiens
  light chain complementarity determining region 3 for antibody 43342
QQSYDTLMYT

SEQ ID NO: 86684 - protein, 13 aa, Homo sapiens
  heavy chain complementarity determining region 3 for antibody 43342
TRARRDGFVYFDS

SEQ ID NO: 86685 - protein, 9 aa, Homo sapiens
  light chain complementarity determining region 3 for antibody 43343
QQSSNFIRT

SEQ ID NO: 86686 - protein, 17 aa, Homo sapiens
  heavy chain complementarity determining region 3 for antibody 43343
ARDREEWRVVAPYYSDY

SEQ ID NO: 86687 - protein, 8 aa, Homo sapiens
  light chain complementarity determining region 3 for antibody 43344
QQSSGTRT

SEQ ID NO: 86688 - protein, 15 aa, Homo sapiens
  heavy chain complementarity determining region 3 for antibody 43344
ARDLAYGDSFNYFDS

SEQ ID NO: 86689 - protein, 9 aa, Homo sapiens
  light chain complementarity determining region 3 for antibody 43345
QQSNSLPRT

SEQ ID NO: 86690 - protein, 14 aa, Homo sapiens
  heavy chain complementarity determining region 3 for antibody 43345
ARERDVARRGALDI

SEQ ID NO: 86691 - protein, 9 aa, Homo sapiens
  light chain complementarity determining region 3 for antibody 43346
QQSKDSPFT

SEQ ID NO: 86692 - protein, 14 aa, Homo sapiens
  heavy chain complementarity determining region 3 for antibody 43346
ARDRFRAGVADFEY

SEQ ID NO: 86693 - protein, 9 aa, Homo sapiens
  light chain complementarity determining region 3 for antibody 43347
QQSHTSPFN

SEQ ID NO: 86694 - protein, 12 aa, Homo sapiens
  heavy chain complementarity determining region 3 for antibody 43347
ARFGPPPAAATI

SEQ ID NO: 86695 - protein, 9 aa, Homo sapiens
  light chain complementarity determining region 3 for antibody 43348
QQSHSIPYT

SEQ ID NO: 86696 - protein, 13 aa, Homo sapiens
  heavy chain complementarity determining region 3 for antibody 43348
ARSRYTYATLLDY

SEQ ID NO: 86697 - protein, 9 aa, Homo sapiens
  light chain complementarity determining region 3 for antibody 43349
QQSHSFPYT

SEQ ID NO: 86698 - protein, 13 aa, Homo sapiens
  heavy chain complementarity determining region 3 for antibody 43349
ARLPDYIGWPFDD

SEQ ID NO: 86699 - protein, 9 aa, Homo sapiens
  light chain complementarity determining region 3 for antibody 43350
QQSHRTPST

SEQ ID NO: 86700 - protein, 18 aa, Homo sapiens
  heavy chain complementarity determining region 3 for antibody 43350
VRGSRWRLGELSALSFDF

SEQ ID NO: 86701 - protein, 9 aa, Homo sapiens
  light chain complementarity determining region 3 for antibody 43351
QQSGSSPWT

SEQ ID NO: 86702 - protein, 19 aa, Homo sapiens
  heavy chain complementarity determining region 3 for antibody 43351
ARDRPYGDHAPYFYSGMDV

SEQ ID NO: 86703 - protein, 9 aa, Homo sapiens
  light chain complementarity determining region 3 for antibody 43352
QQSFTAQWT

SEQ ID NO: 86704 - protein, 9 aa, Homo sapiens
  heavy chain complementarity determining region 3 for antibody 43352
ARADRGRSW

SEQ ID NO: 86705 - protein, 8 aa, Homo sapiens
  light chain complementarity determining region 3 for antibody 43353
QQSFSSVS

SEQ ID NO: 86706 - protein, 16 aa, Homo sapiens
  heavy chain complementarity determining region 3 for antibody 43353
ATSNVVEPLAVHTFDI

SEQ ID NO: 86707 - protein, 9 aa, Homo sapiens
  light chain complementarity determining region 3 for antibody 43354
QQSFSSPWT

SEQ ID NO: 86708 - protein, 11 aa, Homo sapiens
  heavy chain complementarity determining region 3 for antibody 43354
ARNSGFDSLDY

SEQ ID NO: 86709 - protein, 9 aa, Homo sapiens
  light chain complementarity determining region 3 for antibody 43355
QQSFSIPRT

SEQ ID NO: 86710 - protein, 12 aa, Homo sapiens
  heavy chain complementarity determining region 3 for antibody 43355
ARGRGTADYFDY

SEQ ID NO: 86711 - protein, 8 aa, Homo sapiens
  light chain complementarity determining region 3 for antibody 43356
QQSFDMRT

SEQ ID NO: 86712 - protein, 17 aa, Homo sapiens
  heavy chain complementarity determining region 3 for antibody 43356
ARDRDGAVTNHQYGMDV

SEQ ID NO: 86713 - protein, 9 aa, Homo sapiens
  light chain complementarity determining region 3 for antibody 43357
QQRVNWPLT

SEQ ID NO: 86714 - protein, 11 aa, Homo sapiens
  heavy chain complementarity determining region 3 for antibody 43357
VREYHGGSFDY

SEQ ID NO: 86715 - protein, 8 aa, Homo sapiens
  light chain complementarity determining region 3 for antibody 43358
QQRTNGLT

SEQ ID NO: 86716 - protein, 16 aa, Homo sapiens
  heavy chain complementarity determining region 3 for antibody 43358
TTRTMPHRDYGDYIDY

SEQ ID NO: 86717 - protein, 9 aa, Homo sapiens
  light chain complementarity determining region 3 for antibody 43359
QQRSSWPLT

SEQ ID NO: 86718 - protein, 18 aa, Homo sapiens
  heavy chain complementarity determining region 3 for antibody 43359
AGPLGYCSGGSCHKEFDL

SEQ ID NO: 86719 - protein, 8 aa, Homo sapiens
  light chain complementarity determining region 3 for antibody 43360
QQRSNWYP

SEQ ID NO: 86720 - protein, 14 aa, Homo sapiens
  heavy chain complementarity determining region 3 for antibody 43360
AREADYYYNSCLDY

SEQ ID NO: 86721 - protein, 9 aa, Homo sapiens
  light chain complementarity determining region 3 for antibody 43361
QQRSNWRGT

SEQ ID NO: 86722 - protein, 13 aa, Homo sapiens
  heavy chain complementarity determining region 3 for antibody 43361
ARKGDQKSSAYDI

SEQ ID NO: 86723 - protein, 10 aa, Homo sapiens
  light chain complementarity determining region 3 for antibody 43362
QQRSNWPRGT

SEQ ID NO: 86724 - protein, 11 aa, Homo sapiens
  heavy chain complementarity determining region 3 for antibody 43362
ARDAHLGLNDY

SEQ ID NO: 86725 - protein, 9 aa, Homo sapiens
  light chain complementarity determining region 3 for antibody 43363
QQRSNWPPT

SEQ ID NO: 86726 - protein, 16 aa, Homo sapiens
  heavy chain complementarity determining region 3 for antibody 43363
ATDLTARAVVVTDLQV

SEQ ID NO: 86727 - protein, 9 aa, Homo sapiens
  light chain complementarity determining region 3 for antibody 43364
QQRSNWLYT

SEQ ID NO: 86728 - protein, 9 aa, Homo sapiens
  heavy chain complementarity determining region 3 for antibody 43364
ARLGAGLRF

SEQ ID NO: 86729 - protein, 10 aa, Homo sapiens
  light chain complementarity determining region 3 for antibody 43365
QQRRNWPPYT

SEQ ID NO: 86730 - protein, 16 aa, Homo sapiens
  heavy chain complementarity determining region 3 for antibody 43365
ARISGGYNPVDDAFDI

SEQ ID NO: 86731 - protein, 11 aa, Homo sapiens
  light chain complementarity determining region 3 for antibody 43366
QQRQESTNWLN

SEQ ID NO: 86732 - protein, 16 aa, Homo sapiens
  heavy chain complementarity determining region 3 for antibody 43366
ARDPAYCTGTNCYVDY

SEQ ID NO: 86733 - protein, 11 aa, Homo sapiens
  light chain complementarity determining region 3 for antibody 43367
QQRQERTNWLN

SEQ ID NO: 86734 - protein, 15 aa, Homo sapiens
  heavy chain complementarity determining region 3 for antibody 43367
ARGGYSSNWYWWFDP

SEQ ID NO: 86735 - protein, 9 aa, Homo sapiens
  light chain complementarity determining region 3 for antibody 43368
QQRNNWSFT

SEQ ID NO: 86736 - protein, 16 aa, Homo sapiens
  heavy chain complementarity determining region 3 for antibody 43368
ARIILTGYYKGWYFDL

SEQ ID NO: 86737 - protein, 10 aa, Homo sapiens
  light chain complementarity determining region 3 for antibody 43369
QQRNNWPPYT

SEQ ID NO: 86738 - protein, 11 aa, Homo sapiens
  heavy chain complementarity determining region 3 for antibody 43369
ARDWSSGSFDP

SEQ ID NO: 86739 - protein, 10 aa, Homo sapiens
  light chain complementarity determining region 3 for antibody 43370
QQRKYWPPIT

SEQ ID NO: 86740 - protein, 15 aa, Homo sapiens
  heavy chain complementarity determining region 3 for antibody 43370
AKVMTGHTIDCHFDY

SEQ ID NO: 86741 - protein, 9 aa, Homo sapiens
  light chain complementarity determining region 3 for antibody 43371
QQLNTYPRT

SEQ ID NO: 86742 - protein, 15 aa, Homo sapiens
  heavy chain complementarity determining region 3 for antibody 43371
AREHYDILTGSHIDF

SEQ ID NO: 86743 - protein, 9 aa, Homo sapiens
  light chain complementarity determining region 3 for antibody 43372
QQLNSYPVT

SEQ ID NO: 86744 - protein, 21 aa, Homo sapiens
  heavy chain complementarity determining region 3 for antibody 43372
ARHDPDNRQGGDTFAYNYFDQ

SEQ ID NO: 86745 - protein, 8 aa, Homo sapiens
  light chain complementarity determining region 3 for antibody 43373
QQLNSYPT

SEQ ID NO: 86746 - protein, 13 aa, Homo sapiens
  heavy chain complementarity determining region 3 for antibody 43373
ARHVYTMVTPFDY

SEQ ID NO: 86747 - protein, 9 aa, Homo sapiens
  light chain complementarity determining region 3 for antibody 43374
QQLNSYPLT

SEQ ID NO: 86748 - protein, 14 aa, Homo sapiens
  heavy chain complementarity determining region 3 for antibody 43374
ARRYCTGGTCPFQY

SEQ ID NO: 86749 - protein, 9 aa, Homo sapiens
  light chain complementarity determining region 3 for antibody 43375
QQLNSYPHT

SEQ ID NO: 86750 - protein, 19 aa, Homo sapiens
  heavy chain complementarity determining region 3 for antibody 43375
ARGTAVAGVSDYYYYGMDV

SEQ ID NO: 86751 - protein, 9 aa, Homo sapiens
  light chain complementarity determining region 3 for antibody 43376
QQLNSYPHI

SEQ ID NO: 86752 - protein, 13 aa, Homo sapiens
  heavy chain complementarity determining region 3 for antibody 43376
ARRASGYYWALDY

SEQ ID NO: 86753 - protein, 9 aa, Homo sapiens
  light chain complementarity determining region 3 for antibody 43377
QQLNSYLFS

SEQ ID NO: 86754 - protein, 18 aa, Homo sapiens
  heavy chain complementarity determining region 3 for antibody 43377
ARVWGELLSYYYSFGMDV

SEQ ID NO: 86755 - protein, 9 aa, Homo sapiens
  light chain complementarity determining region 3 for antibody 43378
QQLDAYPLV

SEQ ID NO: 86756 - protein, 25 aa, Homo sapiens
  heavy chain complementarity determining region 3 for antibody 43378
ARDSGYSSSWYHGPLPQHDNYGVDV

SEQ ID NO: 86757 - protein, 9 aa, Homo sapiens
  light chain complementarity determining region 3 for antibody 43379
QQIYSSPLT

SEQ ID NO: 86758 - protein, 15 aa, Homo sapiens
  heavy chain complementarity determining region 3 for antibody 43379
ARHVFYDSIDDAFEV

SEQ ID NO: 86759 - protein, 8 aa, Homo sapiens
  light chain complementarity determining region 3 for antibody 43380
QQHDNLSS

SEQ ID NO: 86760 - protein, 14 aa, Homo sapiens
  heavy chain complementarity determining region 3 for antibody 43380
ARSSGGGYSFTFEY

SEQ ID NO: 86761 - protein, 9 aa, Homo sapiens
  light chain complementarity determining region 3 for antibody 43381
QQGYSTPLT

SEQ ID NO: 86762 - protein, 20 aa, Homo sapiens
  heavy chain complementarity determining region 3 for antibody 43381
VKGLGLERIAAAARENWSDP

SEQ ID NO: 86763 - protein, 9 aa, Homo sapiens
  light chain complementarity determining region 3 for antibody 43382
QQFNVYPFT

SEQ ID NO: 86764 - protein, 11 aa, Homo sapiens
  heavy chain complementarity determining region 3 for antibody 43382
AKSYGSGAWDY

SEQ ID NO: 86765 - protein, 9 aa, Homo sapiens
  light chain complementarity determining region 3 for antibody 43383
QQFNEYPVT

SEQ ID NO: 86766 - protein, 18 aa, Homo sapiens
  heavy chain complementarity determining region 3 for antibody 43383
ARGPHCSGATCYSQYFDY

SEQ ID NO: 86767 - protein, 9 aa, Homo sapiens
  light chain complementarity determining region 3 for antibody 43384
QQFKIYPFT

SEQ ID NO: 86768 - protein, 14 aa, Homo sapiens
  heavy chain complementarity determining region 3 for antibody 43384
AKAKDSSGYHSLDY

SEQ ID NO: 86769 - protein, 9 aa, Homo sapiens
  light chain complementarity determining region 3 for antibody 43385
QQFDAYPFT

SEQ ID NO: 86770 - protein, 16 aa, Homo sapiens
  heavy chain complementarity determining region 3 for antibody 43385
ARHSDYAGRGRGHLQF

SEQ ID NO: 86771 - protein, 9 aa, Homo sapiens
  light chain complementarity determining region 3 for antibody 43386
QQDGSSPWT

SEQ ID NO: 86772 - protein, 17 aa, Homo sapiens
  heavy chain complementarity determining region 3 for antibody 43386
ARGGAYYDSSGYDQFDY

SEQ ID NO: 86773 - protein, 9 aa, Homo sapiens
  light chain complementarity determining region 3 for antibody 43387
QQCYSAPYT

SEQ ID NO: 86774 - protein, 18 aa, Homo sapiens
  heavy chain complementarity determining region 3 for antibody 43387
ARDRFNSRRLVRWAFLGS

SEQ ID NO: 86775 - protein, 8 aa, Homo sapiens
  light chain complementarity determining region 3 for antibody 43388
QQCASSIT

SEQ ID NO: 86776 - protein, 12 aa, Homo sapiens
  heavy chain complementarity determining region 3 for antibody 43388
ARIRWHIAAFDY

SEQ ID NO: 86777 - protein, 9 aa, Homo sapiens
  light chain complementarity determining region 3 for antibody 43389
QQANSLPLT

SEQ ID NO: 86778 - protein, 18 aa, Homo sapiens
  heavy chain complementarity determining region 3 for antibody 43389
ARDLLYGDSYDRSGYNDY

SEQ ID NO: 86779 - protein, 10 aa, Homo sapiens
  light chain complementarity determining region 3 for antibody 43390
QQANSFPQIT

SEQ ID NO: 86780 - protein, 14 aa, Homo sapiens
  heavy chain complementarity determining region 3 for antibody 43390
ASGPVRGVIYYFDY

SEQ ID NO: 86781 - protein, 9 aa, Homo sapiens
  light chain complementarity determining region 3 for antibody 43391
QQANSFPLS

SEQ ID NO: 86782 - protein, 20 aa, Homo sapiens
  heavy chain complementarity determining region 3 for antibody 43391
ARDVPPPTGRYVLRGDAFDF

SEQ ID NO: 86783 - protein, 9 aa, Homo sapiens
  light chain complementarity determining region 3 for antibody 43392
QQAKSYPLT

SEQ ID NO: 86784 - protein, 20 aa, Homo sapiens
  heavy chain complementarity determining region 3 for antibody 43392
ARGDGYFDSGSYPHRRWFDP

SEQ ID NO: 86785 - protein, 9 aa, Homo sapiens
  light chain complementarity determining region 3 for antibody 43393
QQAKSLPLT

SEQ ID NO: 86786 - protein, 8 aa, Homo sapiens
  heavy chain complementarity determining region 3 for antibody 43393
ARRNWFDP

SEQ ID NO: 86787 - protein, 9 aa, Homo sapiens
  light chain complementarity determining region 3 for antibody 43394
QQAITFPLT

SEQ ID NO: 86788 - protein, 8 aa, Homo sapiens
  heavy chain complementarity determining region 3 for antibody 43394
TGHGSDSS

SEQ ID NO: 86789 - protein, 9 aa, Homo sapiens
  light chain complementarity determining region 3 for antibody 43395
QQADSFPHT

SEQ ID NO: 86790 - protein, 16 aa, Homo sapiens
  heavy chain complementarity determining region 3 for antibody 43395
ARILRGNNNWSWYFDL

SEQ ID NO: 86791 - protein, 9 aa, Homo sapiens
  light chain complementarity determining region 3 for antibody 43396
QQADSFPFT

SEQ ID NO: 86792 - protein, 17 aa, Homo sapiens
  heavy chain complementarity determining region 3 for antibody 43396
ARGYFPDTSGYYYPPGE

SEQ ID NO: 86793 - protein, 9 aa, Homo sapiens
  light chain complementarity determining region 3 for antibody 43397
QNYNTGSWR

SEQ ID NO: 86794 - protein, 18 aa, Homo sapiens
  heavy chain complementarity determining region 3 for antibody 43397
ARDCGDDCQVTSHWYFDF

SEQ ID NO: 86795 - protein, 10 aa, Homo sapiens
  light chain complementarity determining region 3 for antibody 43398
QLFGGSPLYT

SEQ ID NO: 86796 - protein, 18 aa, Homo sapiens
  heavy chain complementarity determining region 3 for antibody 43398
AREKDVFVGYVSYNWFDP

SEQ ID NO: 86797 - protein, 9 aa, Homo sapiens
  light chain complementarity determining region 3 for antibody 43399
QKYSNAPFT

SEQ ID NO: 86798 - protein, 15 aa, Homo sapiens
  heavy chain complementarity determining region 3 for antibody 43399
ARDSQYSFFQGLGSS

SEQ ID NO: 86799 - protein, 9 aa, Homo sapiens
  light chain complementarity determining region 3 for antibody 43400
QKYNVAPLT

SEQ ID NO: 86800 - protein, 14 aa, Homo sapiens
  heavy chain complementarity determining region 3 for antibody 43400
ARDRDTTKSSRFDP

SEQ ID NO: 86801 - protein, 9 aa, Homo sapiens
  light chain complementarity determining region 3 for antibody 43401
QKYNSAPWT

SEQ ID NO: 86802 - protein, 20 aa, Homo sapiens
  heavy chain complementarity determining region 3 for antibody 43401
ARGPHIVVLTSIPWRWSLGL

SEQ ID NO: 86803 - protein, 10 aa, Homo sapiens
  light chain complementarity determining region 3 for antibody 43402
QKYNSAPPWT

SEQ ID NO: 86804 - protein, 15 aa, Homo sapiens
  heavy chain complementarity determining region 3 for antibody 43402
ASAPRITPRRGAFDL

SEQ ID NO: 86805 - protein, 13 aa, Homo sapiens
  light chain complementarity determining region 3 for antibody 43403
QKYNSAPMPPMYT

SEQ ID NO: 86806 - protein, 14 aa, Homo sapiens
  heavy chain complementarity determining region 3 for antibody 43403
ARRGYCAGGSCYDY

SEQ ID NO: 86807 - protein, 9 aa, Homo sapiens
  light chain complementarity determining region 3 for antibody 43404
QKYNSAPLA

SEQ ID NO: 86808 - protein, 11 aa, Homo sapiens
  heavy chain complementarity determining region 3 for antibody 43404
ARGDLWSAFDI

SEQ ID NO: 86809 - protein, 9 aa, Homo sapiens
  light chain complementarity determining region 3 for antibody 43405
QKYNGDHFT

SEQ ID NO: 86810 - protein, 16 aa, Homo sapiens
  heavy chain complementarity determining region 3 for antibody 43405
VRFDDILTGVPHPFEY

SEQ ID NO: 86811 - protein, 9 aa, Homo sapiens
  light chain complementarity determining region 3 for antibody 43406
QKYKSAPLT

SEQ ID NO: 86812 - protein, 15 aa, Homo sapiens
  heavy chain complementarity determining region 3 for antibody 43406
AKGRESGWYGGDFDY

SEQ ID NO: 86813 - protein, 9 aa, Homo sapiens
  light chain complementarity determining region 3 for antibody 43407
QKYDSAPFT

SEQ ID NO: 86814 - protein, 18 aa, Homo sapiens
  heavy chain complementarity determining region 3 for antibody 43407
VQGGYCRGGNCYPTLNEN

SEQ ID NO: 86815 - protein, 9 aa, Homo sapiens
  light chain complementarity determining region 3 for antibody 43408
QKYDRVPFT

SEQ ID NO: 86816 - protein, 13 aa, Homo sapiens
  heavy chain complementarity determining region 3 for antibody 43408
ARQTARLERREDY

SEQ ID NO: 86817 - protein, 9 aa, Homo sapiens
  light chain complementarity determining region 3 for antibody 43409
QKYDRAPLT

SEQ ID NO: 86818 - protein, 10 aa, Homo sapiens
  heavy chain complementarity determining region 3 for antibody 43409
ARDEGYFGTS

SEQ ID NO: 86819 - protein, 9 aa, Homo sapiens
  light chain complementarity determining region 3 for antibody 43410
QHYNTYVPT

SEQ ID NO: 86820 - protein, 15 aa, Homo sapiens
  heavy chain complementarity determining region 3 for antibody 43410
ASGSDTSSWIGPSDY

SEQ ID NO: 86821 - protein, 10 aa, Homo sapiens
  light chain complementarity determining region 3 for antibody 43411
QHYNSISTWT

SEQ ID NO: 86822 - protein, 11 aa, Homo sapiens
  heavy chain complementarity determining region 3 for antibody 43411
ARNPGHWYFDL

SEQ ID NO: 86823 - protein, 9 aa, Homo sapiens
  light chain complementarity determining region 3 for antibody 43412
QHYNNIPWT

SEQ ID NO: 86824 - protein, 14 aa, Homo sapiens
  heavy chain complementarity determining region 3 for antibody 43412
ARIMGKFGTYRLDS

SEQ ID NO: 86825 - protein, 9 aa, Homo sapiens
  light chain complementarity determining region 3 for antibody 43413
QHYHNYPLA

SEQ ID NO: 86826 - protein, 17 aa, Homo sapiens
  heavy chain complementarity determining region 3 for antibody 43413
ARGGDSSASSGPVAFDV

SEQ ID NO: 86827 - protein, 10 aa, Homo sapiens
  light chain complementarity determining region 3 for antibody 43414
QHYGSSPPYT

SEQ ID NO: 86828 - protein, 20 aa, Homo sapiens
  heavy chain complementarity determining region 3 for antibody 43414
ATRWGVPEAVRGQIRDAFDI

SEQ ID NO: 86829 - protein, 10 aa, Homo sapiens
  light chain complementarity determining region 3 for antibody 43415
QHYGSSLMYT

SEQ ID NO: 86830 - protein, 14 aa, Homo sapiens
  heavy chain complementarity determining region 3 for antibody 43415
TTDRPHTGMVTFDF

SEQ ID NO: 86831 - protein, 9 aa, Homo sapiens
  light chain complementarity determining region 3 for antibody 43416
QHYGRSPYT

SEQ ID NO: 86832 - protein, 13 aa, Homo sapiens
  heavy chain complementarity determining region 3 for antibody 43416
ARRRIAAAGDFMN

SEQ ID NO: 86833 - protein, 9 aa, Homo sapiens
  light chain complementarity determining region 3 for antibody 43417
QHYGNSQGT

SEQ ID NO: 86834 - protein, 13 aa, Homo sapiens
  heavy chain complementarity determining region 3 for antibody 43417
AGHSGNYPGSFDY

SEQ ID NO: 86835 - protein, 11 aa, Homo sapiens
  light chain complementarity determining region 3 for antibody 43418
QHYDSSSAKYT

SEQ ID NO: 86836 - protein, 9 aa, Homo sapiens
  heavy chain complementarity determining region 3 for antibody 43418
ARGAGEFDY

SEQ ID NO: 86837 - protein, 9 aa, Homo sapiens
  light chain complementarity determining region 3 for antibody 43419
QHSYNTPWT

SEQ ID NO: 86838 - protein, 15 aa, Homo sapiens
  heavy chain complementarity determining region 3 for antibody 43419
ATVFDSGYAGVGLDV

SEQ ID NO: 86839 - protein, 10 aa, Homo sapiens
  light chain complementarity determining region 3 for antibody 43420
QHLNTYPPVT

SEQ ID NO: 86840 - protein, 15 aa, Homo sapiens
  heavy chain complementarity determining region 3 for antibody 43420
AKDFRPHIQRGGLDY

SEQ ID NO: 86841 - protein, 9 aa, Homo sapiens
  light chain complementarity determining region 3 for antibody 43421
QHFHNLPWT

SEQ ID NO: 86842 - protein, 12 aa, Homo sapiens
  heavy chain complementarity determining region 3 for antibody 43421
ASNPSQTGAFDV

SEQ ID NO: 86843 - protein, 9 aa, Homo sapiens
  light chain complementarity determining region 3 for antibody 43422
QHFGNSPLT

SEQ ID NO: 86844 - protein, 11 aa, Homo sapiens
  heavy chain complementarity determining region 3 for antibody 43422
AGKPTGTPFDY

SEQ ID NO: 86845 - protein, 9 aa, Homo sapiens
  light chain complementarity determining region 3 for antibody 43423
QEYGGSPFT

SEQ ID NO: 86846 - protein, 15 aa, Homo sapiens
  heavy chain complementarity determining region 3 for antibody 43423
ARPDCGAITCYVLLF

SEQ ID NO: 86847 - protein, 10 aa, Homo sapiens
  light chain complementarity determining region 3 for antibody 43424
QESDSGQMIT

SEQ ID NO: 86848 - protein, 20 aa, Homo sapiens
  heavy chain complementarity determining region 3 for antibody 43424
AKGPDVSGKSAYPYYYGLDV

SEQ ID NO: 86849 - protein, 10 aa, Homo sapiens
  light chain complementarity determining region 3 for antibody 43425
QCRDEWPPVI

SEQ ID NO: 86850 - protein, 17 aa, Homo sapiens
  heavy chain complementarity determining region 3 for antibody 43425
TTDDTFDYGDYDDAFDI

SEQ ID NO: 86851 - protein, 9 aa, Homo sapiens
  light chain complementarity determining region 3 for antibody 43426
MQSLQTLIT

SEQ ID NO: 86852 - protein, 14 aa, Homo sapiens
  heavy chain complementarity determining region 3 for antibody 43426
AREFYVAGTRWFDP

SEQ ID NO: 86853 - protein, 9 aa, Homo sapiens
  light chain complementarity determining region 3 for antibody 43427
MQPLQIPRT

SEQ ID NO: 86854 - protein, 14 aa, Homo sapiens
  heavy chain complementarity determining region 3 for antibody 43427
ARGDGSDYYLPLAY

SEQ ID NO: 86855 - protein, 9 aa, Homo sapiens
  light chain complementarity determining region 3 for antibody 43428
MQGVHWPGT

SEQ ID NO: 86856 - protein, 12 aa, Homo sapiens
  heavy chain complementarity determining region 3 for antibody 43428
AKGPHIAAGGTL

SEQ ID NO: 86857 - protein, 8 aa, Homo sapiens
  light chain complementarity determining region 3 for antibody 43429
MQGTYRGT

SEQ ID NO: 86858 - protein, 11 aa, Homo sapiens
  heavy chain complementarity determining region 3 for antibody 43429
ARDLHSTVTTL

SEQ ID NO: 86859 - protein, 10 aa, Homo sapiens
  light chain complementarity determining region 3 for antibody 43430
MQGTHWSGDI

SEQ ID NO: 86860 - protein, 13 aa, Homo sapiens
  heavy chain complementarity determining region 3 for antibody 43430
VRDAGPRNINFDY

SEQ ID NO: 86861 - protein, 9 aa, Homo sapiens
  light chain complementarity determining region 3 for antibody 43431
MQGTHWPYT

SEQ ID NO: 86862 - protein, 11 aa, Homo sapiens
  heavy chain complementarity determining region 3 for antibody 43431
VRDGESGGAHY

SEQ ID NO: 86863 - protein, 9 aa, Homo sapiens
  light chain complementarity determining region 3 for antibody 43432
MQGTHWPWT

SEQ ID NO: 86864 - protein, 11 aa, Homo sapiens
  heavy chain complementarity determining region 3 for antibody 43432
ARVFYYSPLDP

SEQ ID NO: 86865 - protein, 8 aa, Homo sapiens
  light chain complementarity determining region 3 for antibody 43433
MQGTHWPS

SEQ ID NO: 86866 - protein, 18 aa, Homo sapiens
  heavy chain complementarity determining region 3 for antibody 43433
ARAGYTWNDEPYYYGMDV

SEQ ID NO: 86867 - protein, 10 aa, Homo sapiens
  light chain complementarity determining region 3 for antibody 43434
MQGTHWPPWT

SEQ ID NO: 86868 - protein, 17 aa, Homo sapiens
  heavy chain complementarity determining region 3 for antibody 43434
VRDGYTASGRRNAPGAN

SEQ ID NO: 86869 - protein, 9 aa, Homo sapiens
  light chain complementarity determining region 3 for antibody 43435
MQGTHWPPT

SEQ ID NO: 86870 - protein, 15 aa, Homo sapiens
  heavy chain complementarity determining region 3 for antibody 43435
ARDPATVDERNWYDP

SEQ ID NO: 86871 - protein, 9 aa, Homo sapiens
  light chain complementarity determining region 3 for antibody 43436
MQGTHWPPT

SEQ ID NO: 86872 - protein, 14 aa, Homo sapiens
  heavy chain complementarity determining region 3 for antibody 43436
ARDEGQVGATSPAH

SEQ ID NO: 86873 - protein, 9 aa, Homo sapiens
  light chain complementarity determining region 3 for antibody 43437
MQGTHWPFT

SEQ ID NO: 86874 - protein, 19 aa, Homo sapiens
  heavy chain complementarity determining region 3 for antibody 43437
VRDWGPRYSNGYYFSDPHS

SEQ ID NO: 86875 - protein, 9 aa, Homo sapiens
  light chain complementarity determining region 3 for antibody 43438
MQGTHWLPT

SEQ ID NO: 86876 - protein, 15 aa, Homo sapiens
  heavy chain complementarity determining region 3 for antibody 43438
ARLGGSGSDSHSIAY

SEQ ID NO: 86877 - protein, 8 aa, Homo sapiens
  light chain complementarity determining region 3 for antibody 43439
MQGTHWHT

SEQ ID NO: 86878 - protein, 11 aa, Homo sapiens
  heavy chain complementarity determining region 3 for antibody 43439
ARLDFGESVDY

SEQ ID NO: 86879 - protein, 9 aa, Homo sapiens
  light chain complementarity determining region 3 for antibody 43440
MQGTHREIT

SEQ ID NO: 86880 - protein, 17 aa, Homo sapiens
  heavy chain complementarity determining region 3 for antibody 43440
ARDERQAADGAEYYFDY

SEQ ID NO: 86881 - protein, 9 aa, Homo sapiens
  light chain complementarity determining region 3 for antibody 43441
MQGSHWPLT

SEQ ID NO: 86882 - protein, 10 aa, Homo sapiens
  heavy chain complementarity determining region 3 for antibody 43441
ARDVWGMAGS

SEQ ID NO: 86883 - protein, 10 aa, Homo sapiens
  light chain complementarity determining region 3 for antibody 43442
MQAVQTPGVT

SEQ ID NO: 86884 - protein, 17 aa, Homo sapiens
  heavy chain complementarity determining region 3 for antibody 43442
VKAAYYYDATTYYTHHY

SEQ ID NO: 86885 - protein, 9 aa, Homo sapiens
  light chain complementarity determining region 3 for antibody 43443
MQATHWPHT

SEQ ID NO: 86886 - protein, 8 aa, Homo sapiens
  heavy chain complementarity determining region 3 for antibody 43443
ASGGWAGF

SEQ ID NO: 86887 - protein, 9 aa, Homo sapiens
  light chain complementarity determining region 3 for antibody 43444
MQARQTPFT

SEQ ID NO: 86888 - protein, 15 aa, Homo sapiens
  heavy chain complementarity determining region 3 for antibody 43444
AKGSDVYYDFWSGYE

SEQ ID NO: 86889 - protein, 9 aa, Homo sapiens
  light chain complementarity determining region 3 for antibody 43445
MQAQQIPRS

SEQ ID NO: 86890 - protein, 10 aa, Homo sapiens
  heavy chain complementarity determining region 3 for antibody 43445
AREFRNAFDF

SEQ ID NO: 86891 - protein, 9 aa, Homo sapiens
  light chain complementarity determining region 3 for antibody 43446
MQALQTSYT

SEQ ID NO: 86892 - protein, 14 aa, Homo sapiens
  heavy chain complementarity determining region 3 for antibody 43446
ARFRHFDNRGYFDH

SEQ ID NO: 86893 - protein, 9 aa, Homo sapiens
  light chain complementarity determining region 3 for antibody 43447
MQALQTPWT

SEQ ID NO: 86894 - protein, 12 aa, Homo sapiens
  heavy chain complementarity determining region 3 for antibody 43447
VRQSPQNWFFDL

SEQ ID NO: 86895 - protein, 9 aa, Homo sapiens
  light chain complementarity determining region 3 for antibody 43448
MQALQTPWT

SEQ ID NO: 86896 - protein, 11 aa, Homo sapiens
  heavy chain complementarity determining region 3 for antibody 43448
ASSRDRYYFDY

SEQ ID NO: 86897 - protein, 9 aa, Homo sapiens
  light chain complementarity determining region 3 for antibody 43449
MQALQTPRT

SEQ ID NO: 86898 - protein, 21 aa, Homo sapiens
  heavy chain complementarity determining region 3 for antibody 43449
VRGSGTIFGVVITLGADGFDV

SEQ ID NO: 86899 - protein, 9 aa, Homo sapiens
  light chain complementarity determining region 3 for antibody 43450
MQALQTPRT

SEQ ID NO: 86900 - protein, 30 aa, Homo sapiens
  heavy chain complementarity determining region 3 for antibody 43450
ARGLTRPLNFINKFGSGTNMPQPEVEWFDP

SEQ ID NO: 86901 - protein, 9 aa, Homo sapiens
  light chain complementarity determining region 3 for antibody 43451
MQALQTPRT

SEQ ID NO: 86902 - protein, 11 aa, Homo sapiens
  heavy chain complementarity determining region 3 for antibody 43451
ARDLWKSGLDY

SEQ ID NO: 86903 - protein, 9 aa, Homo sapiens
  light chain complementarity determining region 3 for antibody 43452
MQALQTPQT

SEQ ID NO: 86904 - protein, 19 aa, Homo sapiens
  heavy chain complementarity determining region 3 for antibody 43452
ASAGGSSLFRTTWSYQFDY

SEQ ID NO: 86905 - protein, 9 aa, Homo sapiens
  light chain complementarity determining region 3 for antibody 43453
MQALQTPLT

SEQ ID NO: 86906 - protein, 14 aa, Homo sapiens
  heavy chain complementarity determining region 3 for antibody 43453
ARGSSSIGIRYFDS

SEQ ID NO: 86907 - protein, 9 aa, Homo sapiens
  light chain complementarity determining region 3 for antibody 43454
MQALQTPIT

SEQ ID NO: 86908 - protein, 14 aa, Homo sapiens
  heavy chain complementarity determining region 3 for antibody 43454
ARSRYCGGDCYLDY

SEQ ID NO: 86909 - protein, 9 aa, Homo sapiens
  light chain complementarity determining region 3 for antibody 43455
MQALQIPPT

SEQ ID NO: 86910 - protein, 18 aa, Homo sapiens
  heavy chain complementarity determining region 3 for antibody 43455
AREKGVCDSTRCYFPFDY

SEQ ID NO: 86911 - protein, 9 aa, Homo sapiens
  light chain complementarity determining region 3 for antibody 43456
MQALQAPFT

SEQ ID NO: 86912 - protein, 11 aa, Homo sapiens
  heavy chain complementarity determining region 3 for antibody 43456
ARESLGHSFDI

SEQ ID NO: 86913 - protein, 9 aa, Homo sapiens
  light chain complementarity determining region 3 for antibody 43457
MEAVQPLPT

SEQ ID NO: 86914 - protein, 16 aa, Homo sapiens
  heavy chain complementarity determining region 3 for antibody 43457
ARGNYCSGGTCFSPDF

SEQ ID NO: 86915 - protein, 9 aa, Homo sapiens
  light chain complementarity determining region 3 for antibody 43458
LQSYDLPYT

SEQ ID NO: 86916 - protein, 20 aa, Homo sapiens
  heavy chain complementarity determining region 3 for antibody 43458
TRAQSSSGHYYVAAPYYFVY

SEQ ID NO: 86917 - protein, 9 aa, Homo sapiens
  light chain complementarity determining region 3 for antibody 43459
LQHYIYPRT

SEQ ID NO: 86918 - protein, 17 aa, Homo sapiens
  heavy chain complementarity determining region 3 for antibody 43459
ATETVMADAGFSWSFDY

SEQ ID NO: 86919 - protein, 9 aa, Homo sapiens
  light chain complementarity determining region 3 for antibody 43460
LQHNSYPYT

SEQ ID NO: 86920 - protein, 15 aa, Homo sapiens
  heavy chain complementarity determining region 3 for antibody 43460
ARLYPVSGLSDWSDY

SEQ ID NO: 86921 - protein, 9 aa, Homo sapiens
  light chain complementarity determining region 3 for antibody 43461
LQHNSYPRT

SEQ ID NO: 86922 - protein, 13 aa, Homo sapiens
  heavy chain complementarity determining region 3 for antibody 43461
ARGGGGDCCGLDY

SEQ ID NO: 86923 - protein, 9 aa, Homo sapiens
  light chain complementarity determining region 3 for antibody 43462
LQDYNYPRT

SEQ ID NO: 86924 - protein, 19 aa, Homo sapiens
  heavy chain complementarity determining region 3 for antibody 43462
ARDVDYFYDETRAWDAYDV

SEQ ID NO: 86925 - protein, 9 aa, Homo sapiens
  light chain complementarity determining region 3 for antibody 43463
LQDYNFPRM

SEQ ID NO: 86926 - protein, 9 aa, Homo sapiens
  heavy chain complementarity determining region 3 for antibody 43463
AKGWQCPEF

SEQ ID NO: 86927 - protein, 9 aa, Homo sapiens
  light chain complementarity determining region 3 for antibody 43464
LQDYDYPRT

SEQ ID NO: 86928 - protein, 12 aa, Homo sapiens
  heavy chain complementarity determining region 3 for antibody 43464
VTDGPQEKPFSS

SEQ ID NO: 86929 - protein, 9 aa, Homo sapiens
  light chain complementarity determining region 3 for antibody 43465
LQDYAYPRT

SEQ ID NO: 86930 - protein, 26 aa, Homo sapiens
  heavy chain complementarity determining region 3 for antibody 43465
ARDEVPSSSGFYPGPVRPDYYYGMDA

SEQ ID NO: 86931 - protein, 9 aa, Homo sapiens
  light chain complementarity determining region 3 for antibody 43466
LPYGRSQFT

SEQ ID NO: 86932 - protein, 11 aa, Homo sapiens
  heavy chain complementarity determining region 3 for antibody 43466
ARHGGATTLDY

SEQ ID NO: 86933 - protein, 9 aa, Homo sapiens
  light chain complementarity determining region 3 for antibody 43467
LHEYNYPVS

SEQ ID NO: 86934 - protein, 14 aa, Homo sapiens
  heavy chain complementarity determining region 3 for antibody 43467
ASEVRIAARGNLLH

SEQ ID NO: 86935 - protein, 9 aa, Homo sapiens
  light chain complementarity determining region 3 for antibody 43468
HQYVTSPRT

SEQ ID NO: 86936 - protein, 17 aa, Homo sapiens
  heavy chain complementarity determining region 3 for antibody 43468
ATKGKTYGSGTYYPFDY

SEQ ID NO: 86937 - protein, 9 aa, Homo sapiens
  light chain complementarity determining region 3 for antibody 43469
HQYSTYPIT

SEQ ID NO: 86938 - protein, 15 aa, Homo sapiens
  heavy chain complementarity determining region 3 for antibody 43469
ATGGGIVGAVRVFDF

SEQ ID NO: 86939 - protein, 9 aa, Homo sapiens
  light chain complementarity determining region 3 for antibody 43470
HQYHTYPWT

SEQ ID NO: 86940 - protein, 22 aa, Homo sapiens
  heavy chain complementarity determining region 3 for antibody 43470
AHFGCKSDYCLITFADLYFFDY

SEQ ID NO: 86941 - protein, 9 aa, Homo sapiens
  light chain complementarity determining region 3 for antibody 43471
HQSRSFPWA

SEQ ID NO: 86942 - protein, 15 aa, Homo sapiens
  heavy chain complementarity determining region 3 for antibody 43471
ARELNSGSYFGSFQY

SEQ ID NO: 86943 - protein, 9 aa, Homo sapiens
  light chain complementarity determining region 3 for antibody 43472
EQSYSTPHT

SEQ ID NO: 86944 - protein, 17 aa, Homo sapiens
  heavy chain complementarity determining region 3 for antibody 43472
ARDSSRYNSGWYSPIDY

SEQ ID NO: 86945 - protein, 9 aa, Homo sapiens
  light chain complementarity determining region 3 for antibody 43473
YQHDSFPLT

SEQ ID NO: 86946 - protein, 15 aa, Homo sapiens
  heavy chain complementarity determining region 3 for antibody 43473
VRDVRSGSSGDYFDY

SEQ ID NO: 86947 - protein, 9 aa, Homo sapiens
  light chain complementarity determining region 3 for antibody 43474
TQLTHWPWT

SEQ ID NO: 86948 - protein, 15 aa, Homo sapiens
  heavy chain complementarity determining region 3 for antibody 43474
ARDSPPRASGNDHIP

SEQ ID NO: 86949 - protein, 9 aa, Homo sapiens
  light chain complementarity determining region 3 for antibody 43475
RQYHSYPIT

SEQ ID NO: 86950 - protein, 14 aa, Homo sapiens
  heavy chain complementarity determining region 3 for antibody 43475
ARVPTGGGSYHYDY

SEQ ID NO: 86951 - protein, 9 aa, Homo sapiens
  light chain complementarity determining region 3 for antibody 43476
RHYGPSQDS

SEQ ID NO: 86952 - protein, 18 aa, Homo sapiens
  heavy chain complementarity determining region 3 for antibody 43476
ASMDWRYYGSGSRPEDDY

SEQ ID NO: 86953 - protein, 9 aa, Homo sapiens
  light chain complementarity determining region 3 for antibody 43477
QRYNTLPVT

SEQ ID NO: 86954 - protein, 14 aa, Homo sapiens
  heavy chain complementarity determining region 3 for antibody 43477
VATSTLIVAHYFDY

SEQ ID NO: 86955 - protein, 9 aa, Homo sapiens
  light chain complementarity determining region 3 for antibody 43478
QRYNSGPIT

SEQ ID NO: 86956 - protein, 7 aa, Homo sapiens
  heavy chain complementarity determining region 3 for antibody 43478
VARGGGV

SEQ ID NO: 86957 - protein, 8 aa, Homo sapiens
  light chain complementarity determining region 3 for antibody 43479
QRAYNGAT

SEQ ID NO: 86958 - protein, 15 aa, Homo sapiens
  heavy chain complementarity determining region 3 for antibody 43479
ARDRYDGSYGGTFDI

SEQ ID NO: 86959 - protein, 9 aa, Homo sapiens
  light chain complementarity determining region 3 for antibody 43480
QQYYTTPYT

SEQ ID NO: 86960 - protein, 17 aa, Homo sapiens
  heavy chain complementarity determining region 3 for antibody 43480
AGDSRPYNEYTGRAFDI

SEQ ID NO: 86961 - protein, 10 aa, Homo sapiens
  light chain complementarity determining region 3 for antibody 43481
QQYYTTPPGT

SEQ ID NO: 86962 - protein, 12 aa, Homo sapiens
  heavy chain complementarity determining region 3 for antibody 43481
ARARDQQEDLGY

SEQ ID NO: 86963 - protein, 11 aa, Homo sapiens
  light chain complementarity determining region 3 for antibody 43482
QQYYTSPPGYT

SEQ ID NO: 86964 - protein, 14 aa, Homo sapiens
  heavy chain complementarity determining region 3 for antibody 43482
ARCTSSSRKRSFDQ

SEQ ID NO: 86965 - protein, 9 aa, Homo sapiens
  light chain complementarity determining region 3 for antibody 43483
QQYYSYPFT

SEQ ID NO: 86966 - protein, 16 aa, Homo sapiens
  heavy chain complementarity determining region 3 for antibody 43483
ARDRPRDSSAQSAFFF

SEQ ID NO: 86967 - protein, 9 aa, Homo sapiens
  light chain complementarity determining region 3 for antibody 43484
QQYYSTPWT

SEQ ID NO: 86968 - protein, 23 aa, Homo sapiens
  heavy chain complementarity determining region 3 for antibody 43484
AAGRRRTEVVMVRTVTLNSPLDY

SEQ ID NO: 86969 - protein, 9 aa, Homo sapiens
  light chain complementarity determining region 3 for antibody 43485
QQYYSFPLT

SEQ ID NO: 86970 - protein, 13 aa, Homo sapiens
  heavy chain complementarity determining region 3 for antibody 43485
ARRSSDLTGHFDY

SEQ ID NO: 86971 - protein, 9 aa, Homo sapiens
  light chain complementarity determining region 3 for antibody 43486
QQYYSDPRT

SEQ ID NO: 86972 - protein, 20 aa, Homo sapiens
  heavy chain complementarity determining region 3 for antibody 43486
ARIAQPWYSSGWYPSSHYDY

SEQ ID NO: 86973 - protein, 9 aa, Homo sapiens
  light chain complementarity determining region 3 for antibody 43487
QQYYNPPFT

SEQ ID NO: 86974 - protein, 18 aa, Homo sapiens
  heavy chain complementarity determining region 3 for antibody 43487
ARHSEDTSSWFGHNWFDA

SEQ ID NO: 86975 - protein, 9 aa, Homo sapiens
  light chain complementarity determining region 3 for antibody 43488
QQYSTYSWT

SEQ ID NO: 86976 - protein, 11 aa, Homo sapiens
  heavy chain complementarity determining region 3 for antibody 43488
VCGSYLDGIDY

SEQ ID NO: 86977 - protein, 9 aa, Homo sapiens
  light chain complementarity determining region 3 for antibody 43489
QQYSTYPWT

SEQ ID NO: 86978 - protein, 15 aa, Homo sapiens
  heavy chain complementarity determining region 3 for antibody 43489
AKDGEFCGSNCYFGS

SEQ ID NO: 86979 - protein, 8 aa, Homo sapiens
  light chain complementarity determining region 3 for antibody 43490
QQYSSYST

SEQ ID NO: 86980 - protein, 14 aa, Homo sapiens
  heavy chain complementarity determining region 3 for antibody 43490
ARDSHRGSGSYYDY

SEQ ID NO: 86981 - protein, 9 aa, Homo sapiens
  light chain complementarity determining region 3 for antibody 43491
QQYSSYPYT

SEQ ID NO: 86982 - protein, 12 aa, Homo sapiens
  heavy chain complementarity determining region 3 for antibody 43491
TRDKGPGNYFDY

SEQ ID NO: 86983 - protein, 9 aa, Homo sapiens
  light chain complementarity determining region 3 for antibody 43492
QQYSSYPWT

SEQ ID NO: 86984 - protein, 12 aa, Homo sapiens
  heavy chain complementarity determining region 3 for antibody 43492
AKVNWPDSGNDS

SEQ ID NO: 86985 - protein, 10 aa, Homo sapiens
  light chain complementarity determining region 3 for antibody 43493
QQYSSSRALT

SEQ ID NO: 86986 - protein, 21 aa, Homo sapiens
  heavy chain complementarity determining region 3 for antibody 43493
AHALSYDFWNGYYDTSNWFDP

SEQ ID NO: 86987 - protein, 9 aa, Homo sapiens
  light chain complementarity determining region 3 for antibody 43494
QQYSSLSRT

SEQ ID NO: 86988 - protein, 17 aa, Homo sapiens
  heavy chain complementarity determining region 3 for antibody 43494
VREDGCSGGSCRLYFDL

SEQ ID NO: 86989 - protein, 9 aa, Homo sapiens
  light chain complementarity determining region 3 for antibody 43495
QQYSSIPLT

SEQ ID NO: 86990 - protein, 14 aa, Homo sapiens
  heavy chain complementarity determining region 3 for antibody 43495
ARSPRTTMPPPWDY

SEQ ID NO: 86991 - protein, 9 aa, Homo sapiens
  light chain complementarity determining region 3 for antibody 43496
QQYSNWPWT

SEQ ID NO: 86992 - protein, 14 aa, Homo sapiens
  heavy chain complementarity determining region 3 for antibody 43496
ARDYYHDTSGHFDY

SEQ ID NO: 86993 - protein, 9 aa, Homo sapiens
  light chain complementarity determining region 3 for antibody 43497
QQYSDFLWT

SEQ ID NO: 86994 - protein, 11 aa, Homo sapiens
  heavy chain complementarity determining region 3 for antibody 43497
AVHDGWLSPSY

SEQ ID NO: 86995 - protein, 9 aa, Homo sapiens
  light chain complementarity determining region 3 for antibody 43498
QQYRSYSPT

SEQ ID NO: 86996 - protein, 18 aa, Homo sapiens
  heavy chain complementarity determining region 3 for antibody 43498
ARDRMVRGIIINPNYCDY

SEQ ID NO: 86997 - protein, 9 aa, Homo sapiens
  light chain complementarity determining region 3 for antibody 43499
QQYRSLPYT

SEQ ID NO: 86998 - protein, 24 aa, Homo sapiens
  heavy chain complementarity determining region 3 for antibody 43499
TTDLVVVTATTHNPLHEGPADSDY

SEQ ID NO: 86999 - protein, 8 aa, Homo sapiens
  light chain complementarity determining region 3 for antibody 43500
QQYNTYWT

SEQ ID NO: 87000 - protein, 12 aa, Homo sapiens
  heavy chain complementarity determining region 3 for antibody 43500
ARGLSKLRLFDY

SEQ ID NO: 87001 - protein, 9 aa, Homo sapiens
  light chain complementarity determining region 3 for antibody 43501
QQYNTYSRT

SEQ ID NO: 87002 - protein, 14 aa, Homo sapiens
  heavy chain complementarity determining region 3 for antibody 43501
ARDRESSWYPHLDS

SEQ ID NO: 87003 - protein, 9 aa, Homo sapiens
  light chain complementarity determining region 3 for antibody 43502
QQYNTYPRT

SEQ ID NO: 87004 - protein, 20 aa, Homo sapiens
  heavy chain complementarity determining region 3 for antibody 43502
VREGGILRFLEWSHYGYSAL

SEQ ID NO: 87005 - protein, 9 aa, Homo sapiens
  light chain complementarity determining region 3 for antibody 43503
QQYNTYLYT

SEQ ID NO: 87006 - protein, 13 aa, Homo sapiens
  heavy chain complementarity determining region 3 for antibody 43503
TKSLGALTTFFDY

SEQ ID NO: 87007 - protein, 9 aa, Homo sapiens
  light chain complementarity determining region 3 for antibody 43504
QQYNSYYRT

SEQ ID NO: 87008 - protein, 13 aa, Homo sapiens
  heavy chain complementarity determining region 3 for antibody 43504
ARDDGEYDSTFVY

SEQ ID NO: 87009 - protein, 7 aa, Homo sapiens
  light chain complementarity determining region 3 for antibody 43505
QQYNSYT

SEQ ID NO: 87010 - protein, 12 aa, Homo sapiens
  heavy chain complementarity determining region 3 for antibody 43505
ASRKDAYTSLDF

SEQ ID NO: 87011 - protein, 9 aa, Homo sapiens
  light chain complementarity determining region 3 for antibody 43506
QQYNSYSYT

SEQ ID NO: 87012 - protein, 13 aa, Homo sapiens
  heavy chain complementarity determining region 3 for antibody 43506
ARLPSRKQQLVRD

SEQ ID NO: 87013 - protein, 9 aa, Homo sapiens
  light chain complementarity determining region 3 for antibody 43507
QQYNSYSWT

SEQ ID NO: 87014 - protein, 14 aa, Homo sapiens
  heavy chain complementarity determining region 3 for antibody 43507
ARIYGSGSYSVFDY

SEQ ID NO: 87015 - protein, 9 aa, Homo sapiens
  light chain complementarity determining region 3 for antibody 43508
QQYNSYSWT

SEQ ID NO: 87016 - protein, 13 aa, Homo sapiens
  heavy chain complementarity determining region 3 for antibody 43508
ARDAGQHYDQFDC

SEQ ID NO: 87017 - protein, 9 aa, Homo sapiens
  light chain complementarity determining region 3 for antibody 43509
QQYNSYSRT

SEQ ID NO: 87018 - protein, 17 aa, Homo sapiens
  heavy chain complementarity determining region 3 for antibody 43509
AKDVHSRQGYYYYGMDV

SEQ ID NO: 87019 - protein, 10 aa, Homo sapiens
  light chain complementarity determining region 3 for antibody 43510
QQYNSYSPYT

SEQ ID NO: 87020 - protein, 8 aa, Homo sapiens
  heavy chain complementarity determining region 3 for antibody 43510
ASNVDQGY

SEQ ID NO: 87021 - protein, 10 aa, Homo sapiens
  light chain complementarity determining region 3 for antibody 43511
QQYNSYSPYT

SEQ ID NO: 87022 - protein, 12 aa, Homo sapiens
  heavy chain complementarity determining region 3 for antibody 43511
ARGLWFAEGFDP

SEQ ID NO: 87023 - protein, 9 aa, Homo sapiens
  light chain complementarity determining region 3 for antibody 43512
QQYNSYSGT

SEQ ID NO: 87024 - protein, 21 aa, Homo sapiens
  heavy chain complementarity determining region 3 for antibody 43512
ARRTDPLTYCGGDCFKDAFDI

SEQ ID NO: 87025 - protein, 9 aa, Homo sapiens
  light chain complementarity determining region 3 for antibody 43513
QQYNSYPYT

SEQ ID NO: 87026 - protein, 21 aa, Homo sapiens
  heavy chain complementarity determining region 3 for antibody 43513
AKDNPRRSMVAAGYHFYGMDV

SEQ ID NO: 87027 - protein, 9 aa, Homo sapiens
  light chain complementarity determining region 3 for antibody 43514
QQYNSYPWT

SEQ ID NO: 87028 - protein, 16 aa, Homo sapiens
  heavy chain complementarity determining region 3 for antibody 43514
AKIVEASSSWYSALAD

SEQ ID NO: 87029 - protein, 9 aa, Homo sapiens
  light chain complementarity determining region 3 for antibody 43515
QQYNSYPVP

SEQ ID NO: 87030 - protein, 20 aa, Homo sapiens
  heavy chain complementarity determining region 3 for antibody 43515
ASGGYSGSPGLYYYYYAMAV

SEQ ID NO: 87031 - protein, 9 aa, Homo sapiens
  light chain complementarity determining region 3 for antibody 43516
QQYNSYPRT

SEQ ID NO: 87032 - protein, 17 aa, Homo sapiens
  heavy chain complementarity determining region 3 for antibody 43516
ARDPVFRSMVRGVIPGY

SEQ ID NO: 87033 - protein, 10 aa, Homo sapiens
  light chain complementarity determining region 3 for antibody 43517
QQYNSYPRNT

SEQ ID NO: 87034 - protein, 17 aa, Homo sapiens
  heavy chain complementarity determining region 3 for antibody 43517
AKDRTGSSGLYGELFDY

SEQ ID NO: 87035 - protein, 9 aa, Homo sapiens
  light chain complementarity determining region 3 for antibody 43518
QQYNSYPPT

SEQ ID NO: 87036 - protein, 13 aa, Homo sapiens
  heavy chain complementarity determining region 3 for antibody 43518
ARRDFGSSWPFGS

SEQ ID NO: 87037 - protein, 9 aa, Homo sapiens
  light chain complementarity determining region 3 for antibody 43519
QQYNSYPLT

SEQ ID NO: 87038 - protein, 16 aa, Homo sapiens
  heavy chain complementarity determining region 3 for antibody 43519
ARRGWLGGTYSDPFDY

SEQ ID NO: 87039 - protein, 9 aa, Homo sapiens
  light chain complementarity determining region 3 for antibody 43520
QQYNSYPLT

SEQ ID NO: 87040 - protein, 16 aa, Homo sapiens
  heavy chain complementarity determining region 3 for antibody 43520
AKDRGSWGNFFGSGDY

SEQ ID NO: 87041 - protein, 9 aa, Homo sapiens
  light chain complementarity determining region 3 for antibody 43521
QQYNSYPIT

SEQ ID NO: 87042 - protein, 15 aa, Homo sapiens
  heavy chain complementarity determining region 3 for antibody 43521
ARVEYCITTSCHCGD

SEQ ID NO: 87043 - protein, 8 aa, Homo sapiens
  light chain complementarity determining region 3 for antibody 43522
QQYNSQWT

SEQ ID NO: 87044 - protein, 17 aa, Homo sapiens
  heavy chain complementarity determining region 3 for antibody 43522
AKETYCSGTGCYGLFDP

SEQ ID NO: 87045 - protein, 9 aa, Homo sapiens
  light chain complementarity determining region 3 for antibody 43523
QQYNSNPYT

SEQ ID NO: 87046 - protein, 14 aa, Homo sapiens
  heavy chain complementarity determining region 3 for antibody 43523
AKDLDRNIPMVIDW

SEQ ID NO: 87047 - protein, 8 aa, Homo sapiens
  light chain complementarity determining region 3 for antibody 43524
QQYNSLYT

SEQ ID NO: 87048 - protein, 20 aa, Homo sapiens
  heavy chain complementarity determining region 3 for antibody 43524
VTTAPDIEVTVGVPRARRPQ

SEQ ID NO: 87049 - protein, 8 aa, Homo sapiens
  light chain complementarity determining region 3 for antibody 43525
QQYNSLWT

SEQ ID NO: 87050 - protein, 14 aa, Homo sapiens
  heavy chain complementarity determining region 3 for antibody 43525
ASGLNRDGYKYFDF

SEQ ID NO: 87051 - protein, 8 aa, Homo sapiens
  light chain complementarity determining region 3 for antibody 43526
QQYNSFWT

SEQ ID NO: 87052 - protein, 11 aa, Homo sapiens
  heavy chain complementarity determining region 3 for antibody 43526
AREETPVGMDV

SEQ ID NO: 87053 - protein, 8 aa, Homo sapiens
  light chain complementarity determining region 3 for antibody 43527
QQYNRYWT

SEQ ID NO: 87054 - protein, 14 aa, Homo sapiens
  heavy chain complementarity determining region 3 for antibody 43527
AHGRREGNTRIFDQ

SEQ ID NO: 87055 - protein, 9 aa, Homo sapiens
  light chain complementarity determining region 3 for antibody 43528
QQYNRYPYT

SEQ ID NO: 87056 - protein, 16 aa, Homo sapiens
  heavy chain complementarity determining region 3 for antibody 43528
ARLTESSGYHDEGSDI

SEQ ID NO: 87057 - protein, 10 aa, Homo sapiens
  light chain complementarity determining region 3 for antibody 43529
QQYNNYSPAT

SEQ ID NO: 87058 - protein, 19 aa, Homo sapiens
  heavy chain complementarity determining region 3 for antibody 43529
ARESEFSYDNSGYLRPFDY

SEQ ID NO: 87059 - protein, 9 aa, Homo sapiens
  light chain complementarity determining region 3 for antibody 43530
QQYNNYPKT

SEQ ID NO: 87060 - protein, 15 aa, Homo sapiens
  heavy chain complementarity determining region 3 for antibody 43530
ARMRRQNQWLGEDDY

SEQ ID NO: 87061 - protein, 9 aa, Homo sapiens
  light chain complementarity determining region 3 for antibody 43531
QQYNNWPWT

SEQ ID NO: 87062 - protein, 9 aa, Homo sapiens
  heavy chain complementarity determining region 3 for antibody 43531
ARGYGDSDY

SEQ ID NO: 87063 - protein, 10 aa, Homo sapiens
  light chain complementarity determining region 3 for antibody 43532
QQYNNWPLLT

SEQ ID NO: 87064 - protein, 19 aa, Homo sapiens
  heavy chain complementarity determining region 3 for antibody 43532
AKDYEAGRMVRGVVTFFDY

SEQ ID NO: 87065 - protein, 9 aa, Homo sapiens
  light chain complementarity determining region 3 for antibody 43533
QQYNNFYRT

SEQ ID NO: 87066 - protein, 16 aa, Homo sapiens
  heavy chain complementarity determining region 3 for antibody 43533
AIVVGNVAAAGEYFQQ

SEQ ID NO: 87067 - protein, 9 aa, Homo sapiens
  light chain complementarity determining region 3 for antibody 43534
QQYNIYPRT

SEQ ID NO: 87068 - protein, 16 aa, Homo sapiens
  heavy chain complementarity determining region 3 for antibody 43534
ARDLGYLSFQSYYFDS

SEQ ID NO: 87069 - protein, 9 aa, Homo sapiens
  light chain complementarity determining region 3 for antibody 43535
QQYNGWPRT

SEQ ID NO: 87070 - protein, 16 aa, Homo sapiens
  heavy chain complementarity determining region 3 for antibody 43535
APAYFSSVRSLGWFDP

SEQ ID NO: 87071 - protein, 11 aa, Homo sapiens
  light chain complementarity determining region 3 for antibody 43536
QQYHVSFPTWT

SEQ ID NO: 87072 - protein, 13 aa, Homo sapiens
  heavy chain complementarity determining region 3 for antibody 43536
AADDYMAYEDFNY

SEQ ID NO: 87073 - protein, 9 aa, Homo sapiens
  light chain complementarity determining region 3 for antibody 43537
QQYHTSPWT

SEQ ID NO: 87074 - protein, 14 aa, Homo sapiens
  heavy chain complementarity determining region 3 for antibody 43537
ARPESRGLDWYFDL

SEQ ID NO: 87075 - protein, 9 aa, Homo sapiens
  light chain complementarity determining region 3 for antibody 43538
QQYHSTLRT

SEQ ID NO: 87076 - protein, 14 aa, Homo sapiens
  heavy chain complementarity determining region 3 for antibody 43538
VRDLSGTFFGVLDY

SEQ ID NO: 87077 - protein, 9 aa, Homo sapiens
  light chain complementarity determining region 3 for antibody 43539
QQYHRSPIT

SEQ ID NO: 87078 - protein, 11 aa, Homo sapiens
  heavy chain complementarity determining region 3 for antibody 43539
ARGGSYSPLFL

SEQ ID NO: 87079 - protein, 9 aa, Homo sapiens
  light chain complementarity determining region 3 for antibody 43540
QQYHNLPYT

SEQ ID NO: 87080 - protein, 16 aa, Homo sapiens
  heavy chain complementarity determining region 3 for antibody 43540
AKAEPPSAAWPWYFDL

SEQ ID NO: 87081 - protein, 9 aa, Homo sapiens
  light chain complementarity determining region 3 for antibody 43541
QQYHLLPPV

SEQ ID NO: 87082 - protein, 12 aa, Homo sapiens
  heavy chain complementarity determining region 3 for antibody 43541
SRPPTGSQYRDY

SEQ ID NO: 87083 - protein, 9 aa, Homo sapiens
  light chain complementarity determining region 3 for antibody 43542
QQYGYSPFA

SEQ ID NO: 87084 - protein, 16 aa, Homo sapiens
  heavy chain complementarity determining region 3 for antibody 43542
AKTSRGAVTGTPYFNY

SEQ ID NO: 87085 - protein, 9 aa, Homo sapiens
  light chain complementarity determining region 3 for antibody 43543
QQYGTSPYT

SEQ ID NO: 87086 - protein, 19 aa, Homo sapiens
  heavy chain complementarity determining region 3 for antibody 43543
IRETIAVAGGQMVTYGLDV

SEQ ID NO: 87087 - protein, 9 aa, Homo sapiens
  light chain complementarity determining region 3 for antibody 43544
QQYGTSPST

SEQ ID NO: 87088 - protein, 9 aa, Homo sapiens
  heavy chain complementarity determining region 3 for antibody 43544
ARGAGSLSY

SEQ ID NO: 87089 - protein, 9 aa, Homo sapiens
  light chain complementarity determining region 3 for antibody 43545
QQYGSSPYT

SEQ ID NO: 87090 - protein, 14 aa, Homo sapiens
  heavy chain complementarity determining region 3 for antibody 43545
ASPLDYGDYNRLDY

SEQ ID NO: 87091 - protein, 9 aa, Homo sapiens
  light chain complementarity determining region 3 for antibody 43546
QQYGSSPYT

SEQ ID NO: 87092 - protein, 18 aa, Homo sapiens
  heavy chain complementarity determining region 3 for antibody 43546
ARGSISVVWGVKQNWFDP

SEQ ID NO: 87093 - protein, 9 aa, Homo sapiens
  light chain complementarity determining region 3 for antibody 43547
QQYGSSPYT

SEQ ID NO: 87094 - protein, 14 aa, Homo sapiens
  heavy chain complementarity determining region 3 for antibody 43547
ARESTLVWGAPLDY

SEQ ID NO: 87095 - protein, 9 aa, Homo sapiens
  light chain complementarity determining region 3 for antibody 43548
QQYGSSPWT

SEQ ID NO: 87096 - protein, 14 aa, Homo sapiens
  heavy chain complementarity determining region 3 for antibody 43548
AHGRREGNTRIFDQ

SEQ ID NO: 87097 - protein, 10 aa, Homo sapiens
  light chain complementarity determining region 3 for antibody 43549
QQYGSSPRWT

SEQ ID NO: 87098 - protein, 18 aa, Homo sapiens
  heavy chain complementarity determining region 3 for antibody 43549
ARCVNEGKCADSGHATNI

SEQ ID NO: 87099 - protein, 9 aa, Homo sapiens
  light chain complementarity determining region 3 for antibody 43550
QQYGSSPRT

SEQ ID NO: 87100 - protein, 14 aa, Homo sapiens
  heavy chain complementarity determining region 3 for antibody 43550
ASPFRNWNDDAFDI

SEQ ID NO: 87101 - protein, 9 aa, Homo sapiens
  light chain complementarity determining region 3 for antibody 43551
QQYGSSPRT

SEQ ID NO: 87102 - protein, 15 aa, Homo sapiens
  heavy chain complementarity determining region 3 for antibody 43551
ARSPGVFGVTKGFDM

SEQ ID NO: 87103 - protein, 9 aa, Homo sapiens
  light chain complementarity determining region 3 for antibody 43552
QQYGSSPRT

SEQ ID NO: 87104 - protein, 14 aa, Homo sapiens
  heavy chain complementarity determining region 3 for antibody 43552
AKVPYGDYANAFDI

SEQ ID NO: 87105 - protein, 9 aa, Homo sapiens
  light chain complementarity determining region 3 for antibody 43553
QQYGSSPQT

SEQ ID NO: 87106 - protein, 12 aa, Homo sapiens
  heavy chain complementarity determining region 3 for antibody 43553
ASWHHTSRFFDY

SEQ ID NO: 87107 - protein, 9 aa, Homo sapiens
  light chain complementarity determining region 3 for antibody 43554
QQYGSSPQA

SEQ ID NO: 87108 - protein, 16 aa, Homo sapiens
  heavy chain complementarity determining region 3 for antibody 43554
ARDREGFRYGLDASDI

SEQ ID NO: 87109 - protein, 10 aa, Homo sapiens
  light chain complementarity determining region 3 for antibody 43555
QQYGSSPLWA

SEQ ID NO: 87110 - protein, 13 aa, Homo sapiens
  heavy chain complementarity determining region 3 for antibody 43555
TRGAVEPTTWVDF

SEQ ID NO: 87111 - protein, 9 aa, Homo sapiens
  light chain complementarity determining region 3 for antibody 43556
QQYGSSPLT

SEQ ID NO: 87112 - protein, 17 aa, Homo sapiens
  heavy chain complementarity determining region 3 for antibody 43556
ARFSMIVVAMGLDTFDI

SEQ ID NO: 87113 - protein, 9 aa, Homo sapiens
  light chain complementarity determining region 3 for antibody 43557
QQYGSSPLT

SEQ ID NO: 87114 - protein, 14 aa, Homo sapiens
  heavy chain complementarity determining region 3 for antibody 43557
ARAAGEGVWTGFDY

SEQ ID NO: 87115 - protein, 9 aa, Homo sapiens
  light chain complementarity determining region 3 for antibody 43558
QQYGSSPIT

SEQ ID NO: 87116 - protein, 10 aa, Homo sapiens
  heavy chain complementarity determining region 3 for antibody 43558
ASGDFTGFHY

SEQ ID NO: 87117 - protein, 10 aa, Homo sapiens
  light chain complementarity determining region 3 for antibody 43559
QQYGSSPGYT

SEQ ID NO: 87118 - protein, 11 aa, Homo sapiens
  heavy chain complementarity determining region 3 for antibody 43559
TRGVGSYPFDQ

SEQ ID NO: 87119 - protein, 9 aa, Homo sapiens
  light chain complementarity determining region 3 for antibody 43560
QQYGSSHIT

SEQ ID NO: 87120 - protein, 19 aa, Homo sapiens
  heavy chain complementarity determining region 3 for antibody 43560
AKDLRHIVYSSGCCDTFDI

SEQ ID NO: 87121 - protein, 9 aa, Homo sapiens
  light chain complementarity determining region 3 for antibody 43561
QQYGSPLWT

SEQ ID NO: 87122 - protein, 13 aa, Homo sapiens
  heavy chain complementarity determining region 3 for antibody 43561
ARDGGGGYNPIDF

SEQ ID NO: 87123 - protein, 8 aa, Homo sapiens
  light chain complementarity determining region 3 for antibody 43562
QQYGSNRS

SEQ ID NO: 87124 - protein, 21 aa, Homo sapiens
  heavy chain complementarity determining region 3 for antibody 43562
ARPGGDGDSDDGAIGVGSFDI

SEQ ID NO: 87125 - protein, 8 aa, Homo sapiens
  light chain complementarity determining region 3 for antibody 43563
QQYGSKSP

SEQ ID NO: 87126 - protein, 18 aa, Homo sapiens
  heavy chain complementarity determining region 3 for antibody 43563
TRDGRGYGDYGFIWYFDL

SEQ ID NO: 87127 - protein, 9 aa, Homo sapiens
  light chain complementarity determining region 3 for antibody 43564
QQYGRSPWT

SEQ ID NO: 87128 - protein, 12 aa, Homo sapiens
  heavy chain complementarity determining region 3 for antibody 43564
AQSVTAMRPFHS

SEQ ID NO: 87129 - protein, 9 aa, Homo sapiens
  light chain complementarity determining region 3 for antibody 43565
QQYGNSPRT

SEQ ID NO: 87130 - protein, 14 aa, Homo sapiens
  heavy chain complementarity determining region 3 for antibody 43565
ARDSGYYGTGSFFF

SEQ ID NO: 87131 - protein, 10 aa, Homo sapiens
  light chain complementarity determining region 3 for antibody 43566
QQYGNSPLFT

SEQ ID NO: 87132 - protein, 14 aa, Homo sapiens
  heavy chain complementarity determining region 3 for antibody 43566
AREREVIGAGYFDY

SEQ ID NO: 87133 - protein, 9 aa, Homo sapiens
  light chain complementarity determining region 3 for antibody 43567
QQYGNSPFT

SEQ ID NO: 87134 - protein, 16 aa, Homo sapiens
  heavy chain complementarity determining region 3 for antibody 43567
ASRHSSSWNGRGLFEI

SEQ ID NO: 87135 - protein, 8 aa, Homo sapiens
  light chain complementarity determining region 3 for antibody 43568
QQYGNSAT

SEQ ID NO: 87136 - protein, 13 aa, Homo sapiens
  heavy chain complementarity determining region 3 for antibody 43568
AKILVVAQWCFDL

SEQ ID NO: 87137 - protein, 10 aa, Homo sapiens
  light chain complementarity determining region 3 for antibody 43569
QQYGGSPSIT

SEQ ID NO: 87138 - protein, 14 aa, Homo sapiens
  heavy chain complementarity determining region 3 for antibody 43569
ARRSGTSWGYAFDI

SEQ ID NO: 87139 - protein, 9 aa, Homo sapiens
  light chain complementarity determining region 3 for antibody 43570
QQYGGSPNT

SEQ ID NO: 87140 - protein, 13 aa, Homo sapiens
  heavy chain complementarity determining region 3 for antibody 43570
ALGGGGDYWYFDL

SEQ ID NO: 87141 - protein, 10 aa, Homo sapiens
  light chain complementarity determining region 3 for antibody 43571
QQYFDWATWT

SEQ ID NO: 87142 - protein, 11 aa, Homo sapiens
  heavy chain complementarity determining region 3 for antibody 43571
ASSSRWPIFDY

SEQ ID NO: 87143 - protein, 9 aa, Homo sapiens
  light chain complementarity determining region 3 for antibody 43572
QQYETLPVT

SEQ ID NO: 87144 - protein, 14 aa, Homo sapiens
  heavy chain complementarity determining region 3 for antibody 43572
ARTRSMFVRGPFDS

SEQ ID NO: 87145 - protein, 9 aa, Homo sapiens
  light chain complementarity determining region 3 for antibody 43573
QQYEDYPYT

SEQ ID NO: 87146 - protein, 23 aa, Homo sapiens
  heavy chain complementarity determining region 3 for antibody 43573
ARDLSPVLSHFDNSGSSPDAFDM

SEQ ID NO: 87147 - protein, 9 aa, Homo sapiens
  light chain complementarity determining region 3 for antibody 43574
QQYDTSSWT

SEQ ID NO: 87148 - protein, 14 aa, Homo sapiens
  heavy chain complementarity determining region 3 for antibody 43574
ATAYDTSGYAPFDS

SEQ ID NO: 87149 - protein, 9 aa, Homo sapiens
  light chain complementarity determining region 3 for antibody 43575
QQYDTSPRT

SEQ ID NO: 87150 - protein, 13 aa, Homo sapiens
  heavy chain complementarity determining region 3 for antibody 43575
ATDLGGSNSNFDA

SEQ ID NO: 87151 - protein, 9 aa, Homo sapiens
  light chain complementarity determining region 3 for antibody 43576
QQYDTSPPT

SEQ ID NO: 87152 - protein, 14 aa, Homo sapiens
  heavy chain complementarity determining region 3 for antibody 43576
ARGRQLGTGWYFDV

SEQ ID NO: 87153 - protein, 9 aa, Homo sapiens
  light chain complementarity determining region 3 for antibody 43577
QQYDSYPYT

SEQ ID NO: 87154 - protein, 24 aa, Homo sapiens
  heavy chain complementarity determining region 3 for antibody 43577
ARRKPYYESVWGRSRYFREPVFDR

SEQ ID NO: 87155 - protein, 9 aa, Homo sapiens
  light chain complementarity determining region 3 for antibody 43578
QQYDSYPLS

SEQ ID NO: 87156 - protein, 14 aa, Homo sapiens
  heavy chain complementarity determining region 3 for antibody 43578
ARLGCFRDHYGMDV

SEQ ID NO: 87157 - protein, 9 aa, Homo sapiens
  light chain complementarity determining region 3 for antibody 43579
QQYDSVPLT

SEQ ID NO: 87158 - protein, 15 aa, Homo sapiens
  heavy chain complementarity determining region 3 for antibody 43579
RLYGSGSYYNGYFDY

SEQ ID NO: 87159 - protein, 9 aa, Homo sapiens
  light chain complementarity determining region 3 for antibody 43580
QQYDSSPLT

SEQ ID NO: 87160 - protein, 18 aa, Homo sapiens
  heavy chain complementarity determining region 3 for antibody 43580
ARSSGYSGYDPSLDALDV

SEQ ID NO: 87161 - protein, 9 aa, Homo sapiens
  light chain complementarity determining region 3 for antibody 43581
QQYDSLSVT

SEQ ID NO: 87162 - protein, 15 aa, Homo sapiens
  heavy chain complementarity determining region 3 for antibody 43581
ATDNTSPSEVGVFES

SEQ ID NO: 87163 - protein, 8 aa, Homo sapiens
  light chain complementarity determining region 3 for antibody 43582
QQYDQWPT

SEQ ID NO: 87164 - protein, 12 aa, Homo sapiens
  heavy chain complementarity determining region 3 for antibody 43582
GRGLVGTTTLDN

SEQ ID NO: 87165 - protein, 9 aa, Homo sapiens
  light chain complementarity determining region 3 for antibody 43583
QQYDNPMYT

SEQ ID NO: 87166 - protein, 19 aa, Homo sapiens
  heavy chain complementarity determining region 3 for antibody 43583
ARGWGGADYNLMVVEVFDS

SEQ ID NO: 87167 - protein, 9 aa, Homo sapiens
  light chain complementarity determining region 3 for antibody 43584
QQYDNLVVT

SEQ ID NO: 87168 - protein, 19 aa, Homo sapiens
  heavy chain complementarity determining region 3 for antibody 43584
ARSPAQYCSGGTCYSPFDY

SEQ ID NO: 87169 - protein, 10 aa, Homo sapiens
  light chain complementarity determining region 3 for antibody 43585
QQYDNLPSYT

SEQ ID NO: 87170 - protein, 21 aa, Homo sapiens
  heavy chain complementarity determining region 3 for antibody 43585
ARVGPVGYCSGGSCYSVAFDI

SEQ ID NO: 87171 - protein, 10 aa, Homo sapiens
  light chain complementarity determining region 3 for antibody 43586
QQYDNLPSFT

SEQ ID NO: 87172 - protein, 10 aa, Homo sapiens
  heavy chain complementarity determining region 3 for antibody 43586
ASGGGYTFSD

SEQ ID NO: 87173 - protein, 10 aa, Homo sapiens
  light chain complementarity determining region 3 for antibody 43587
QQYDNLPPWT

SEQ ID NO: 87174 - protein, 19 aa, Homo sapiens
  heavy chain complementarity determining region 3 for antibody 43587
ARGGLRGSGWYKLNYYFDY

SEQ ID NO: 87175 - protein, 11 aa, Homo sapiens
  light chain complementarity determining region 3 for antibody 43588
QQYDNLPPTWT

SEQ ID NO: 87176 - protein, 18 aa, Homo sapiens
  heavy chain complementarity determining region 3 for antibody 43588
ARDLTENRRSLTGLAMDV

SEQ ID NO: 87177 - protein, 10 aa, Homo sapiens
  light chain complementarity determining region 3 for antibody 43589
QQYDNLPMYT

SEQ ID NO: 87178 - protein, 22 aa, Homo sapiens
  heavy chain complementarity determining region 3 for antibody 43589
ARVGPKRRAYTTYNSPYNWFDP

SEQ ID NO: 87179 - protein, 9 aa, Homo sapiens
  light chain complementarity determining region 3 for antibody 43590
QQYDNLPLT

SEQ ID NO: 87180 - protein, 17 aa, Homo sapiens
  heavy chain complementarity determining region 3 for antibody 43590
TRERPGTTRRGDGYFDY

SEQ ID NO: 87181 - protein, 9 aa, Homo sapiens
  light chain complementarity determining region 3 for antibody 43591
QQYDNLPLT

SEQ ID NO: 87182 - protein, 16 aa, Homo sapiens
  heavy chain complementarity determining region 3 for antibody 43591
AKVQPRYSLNYSPFDH

SEQ ID NO: 87183 - protein, 9 aa, Homo sapiens
  light chain complementarity determining region 3 for antibody 43592
QQYDNLPLT

SEQ ID NO: 87184 - protein, 13 aa, Homo sapiens
  heavy chain complementarity determining region 3 for antibody 43592
AKDTMHSSGRFDY

SEQ ID NO: 87185 - protein, 7 aa, Homo sapiens
  light chain complementarity determining region 3 for antibody 43593
QQYDNLP

SEQ ID NO: 87186 - protein, 9 aa, Homo sapiens
  heavy chain complementarity determining region 3 for antibody 43593
ARGGTTFDY

SEQ ID NO: 87187 - protein, 8 aa, Homo sapiens
  light chain complementarity determining region 3 for antibody 43594
QQYDNLLT

SEQ ID NO: 87188 - protein, 20 aa, Homo sapiens
  heavy chain complementarity determining region 3 for antibody 43594
ARPRPHFGDYIMGDYYGMDV

SEQ ID NO: 87189 - protein, 8 aa, Homo sapiens
  light chain complementarity determining region 3 for antibody 43595
QQYDNLLS

SEQ ID NO: 87190 - protein, 15 aa, Homo sapiens
  heavy chain complementarity determining region 3 for antibody 43595
ARVAHDYVPWGPFDP

SEQ ID NO: 87191 - protein, 9 aa, Homo sapiens
  light chain complementarity determining region 3 for antibody 43596
QQYDFYPLT

SEQ ID NO: 87192 - protein, 11 aa, Homo sapiens
  heavy chain complementarity determining region 3 for antibody 43596
VGSEHEDPFHY

SEQ ID NO: 87193 - protein, 9 aa, Homo sapiens
  light chain complementarity determining region 3 for antibody 43597
QQYDDLPLT

SEQ ID NO: 87194 - protein, 12 aa, Homo sapiens
  heavy chain complementarity determining region 3 for antibody 43597
ARGAGYTKPFDD

SEQ ID NO: 87195 - protein, 12 aa, Homo sapiens
  light chain complementarity determining region 3 for antibody 43598
QQYATSPPWPWT

SEQ ID NO: 87196 - protein, 14 aa, Homo sapiens
  heavy chain complementarity determining region 3 for antibody 43598
ARGGTSGYNNQLDY

SEQ ID NO: 87197 - protein, 9 aa, Homo sapiens
  light chain complementarity determining region 3 for antibody 43599
QQYASYPYT

SEQ ID NO: 87198 - protein, 12 aa, Homo sapiens
  heavy chain complementarity determining region 3 for antibody 43599
VRQDGDYTPFDS

SEQ ID NO: 87199 - protein, 9 aa, Homo sapiens
  light chain complementarity determining region 3 for antibody 43600
QQYASSPVT

SEQ ID NO: 87200 - protein, 20 aa, Homo sapiens
  heavy chain complementarity determining region 3 for antibody 43600
ARDLHPMFSSGWYLSKALEY

SEQ ID NO: 87201 - protein, 9 aa, Homo sapiens
  light chain complementarity determining region 3 for antibody 43601
QQYAATPET

SEQ ID NO: 87202 - protein, 16 aa, Homo sapiens
  heavy chain complementarity determining region 3 for antibody 43601
ARTPVRREYNYGHFDS

SEQ ID NO: 87203 - protein, 9 aa, Homo sapiens
  light chain complementarity determining region 3 for antibody 43602
QQVYNFPLT

SEQ ID NO: 87204 - protein, 15 aa, Homo sapiens
  heavy chain complementarity determining region 3 for antibody 43602
AGDPWGYSSESRFDY

SEQ ID NO: 87205 - protein, 9 aa, Homo sapiens
  light chain complementarity determining region 3 for antibody 43603
QQTYSTLWT

SEQ ID NO: 87206 - protein, 18 aa, Homo sapiens
  heavy chain complementarity determining region 3 for antibody 43603
VIHGSYGVRLGELALLDS

SEQ ID NO: 87207 - protein, 9 aa, Homo sapiens
  light chain complementarity determining region 3 for antibody 43604
QQTYSTLGT

SEQ ID NO: 87208 - protein, 15 aa, Homo sapiens
  heavy chain complementarity determining region 3 for antibody 43604
AKDRVGYSGYDAFDI

SEQ ID NO: 87209 - protein, 9 aa, Homo sapiens
  light chain complementarity determining region 3 for antibody 43605
QQTYSNPYT

SEQ ID NO: 87210 - protein, 14 aa, Homo sapiens
  heavy chain complementarity determining region 3 for antibody 43605
ATALTAYSGYDLDH

SEQ ID NO: 87211 - protein, 9 aa, Homo sapiens
  light chain complementarity determining region 3 for antibody 43606
QQTYSAPPT

SEQ ID NO: 87212 - protein, 12 aa, Homo sapiens
  heavy chain complementarity determining region 3 for antibody 43606
VRDFWQHLVPTN

SEQ ID NO: 87213 - protein, 9 aa, Homo sapiens
  light chain complementarity determining region 3 for antibody 43607
QQTYSAPFT

SEQ ID NO: 87214 - protein, 16 aa, Homo sapiens
  heavy chain complementarity determining region 3 for antibody 43607
AKDLIPFTMVRGSLDY

SEQ ID NO: 87215 - protein, 9 aa, Homo sapiens
  light chain complementarity determining region 3 for antibody 43608
QQTNSFPLT

SEQ ID NO: 87216 - protein, 10 aa, Homo sapiens
  heavy chain complementarity determining region 3 for antibody 43608
AIAADGILDY

SEQ ID NO: 87217 - protein, 10 aa, Homo sapiens
  light chain complementarity determining region 3 for antibody 43609
QQSYTTPRIT

SEQ ID NO: 87218 - protein, 15 aa, Homo sapiens
  heavy chain complementarity determining region 3 for antibody 43609
ASLGWTAAAGDVFDI

SEQ ID NO: 87219 - protein, 9 aa, Homo sapiens
  light chain complementarity determining region 3 for antibody 43610
QQSYTTPIT

SEQ ID NO: 87220 - protein, 17 aa, Homo sapiens
  heavy chain complementarity determining region 3 for antibody 43610
ARACGAGGGWHCGVFDD

SEQ ID NO: 87221 - protein, 9 aa, Homo sapiens
  light chain complementarity determining region 3 for antibody 43611
QQSYTSPWT

SEQ ID NO: 87222 - protein, 16 aa, Homo sapiens
  heavy chain complementarity determining region 3 for antibody 43611
ARDNLVAGSDYYGLDV

SEQ ID NO: 87223 - protein, 9 aa, Homo sapiens
  light chain complementarity determining region 3 for antibody 43612
QQSYSTVWS

SEQ ID NO: 87224 - protein, 17 aa, Homo sapiens
  heavy chain complementarity determining region 3 for antibody 43612
ASAACAGGSCYSIGIEY

SEQ ID NO: 87225 - protein, 9 aa, Homo sapiens
  light chain complementarity determining region 3 for antibody 43613
QQSYSTPYT

SEQ ID NO: 87226 - protein, 17 aa, Homo sapiens
  heavy chain complementarity determining region 3 for antibody 43613
ARHSGSGNNWQFTRFDL

SEQ ID NO: 87227 - protein, 9 aa, Homo sapiens
  light chain complementarity determining region 3 for antibody 43614
QQSYSTPYT

SEQ ID NO: 87228 - protein, 16 aa, Homo sapiens
  heavy chain complementarity determining region 3 for antibody 43614
ARGRDYGGNSLRSFDY

SEQ ID NO: 87229 - protein, 9 aa, Homo sapiens
  light chain complementarity determining region 3 for antibody 43615
QQSYSTPYT

SEQ ID NO: 87230 - protein, 9 aa, Homo sapiens
  heavy chain complementarity determining region 3 for antibody 43615
ARGLRPLDS

SEQ ID NO: 87231 - protein, 9 aa, Homo sapiens
  light chain complementarity determining region 3 for antibody 43616
QQSYSTPYT

SEQ ID NO: 87232 - protein, 13 aa, Homo sapiens
  heavy chain complementarity determining region 3 for antibody 43616
ARECQPPPYYYDY

SEQ ID NO: 87233 - protein, 9 aa, Homo sapiens
  light chain complementarity determining region 3 for antibody 43617
QQSYSTPYT

SEQ ID NO: 87234 - protein, 12 aa, Homo sapiens
  heavy chain complementarity determining region 3 for antibody 43617
AMERSGTYVITD

SEQ ID NO: 87235 - protein, 9 aa, Homo sapiens
  light chain complementarity determining region 3 for antibody 43618
QQSYSTPWT

SEQ ID NO: 87236 - protein, 10 aa, Homo sapiens
  heavy chain complementarity determining region 3 for antibody 43618
ARGPSMMISE

SEQ ID NO: 87237 - protein, 9 aa, Homo sapiens
  light chain complementarity determining region 3 for antibody 43619
QQSYSTPPT

SEQ ID NO: 87238 - protein, 14 aa, Homo sapiens
  heavy chain complementarity determining region 3 for antibody 43619
AREMATITFGALDV

SEQ ID NO: 87239 - protein, 10 aa, Homo sapiens
  light chain complementarity determining region 3 for antibody 43620
QQSYSTPMYT

SEQ ID NO: 87240 - protein, 14 aa, Homo sapiens
  heavy chain complementarity determining region 3 for antibody 43620
ARRRRLGGSYYFDV

SEQ ID NO: 87241 - protein, 10 aa, Homo sapiens
  light chain complementarity determining region 3 for antibody 43621
QQSYSTPMYT

SEQ ID NO: 87242 - protein, 15 aa, Homo sapiens
  heavy chain complementarity determining region 3 for antibody 43621
AREGVDRLTISAFDV

SEQ ID NO: 87243 - protein, 9 aa, Homo sapiens
  light chain complementarity determining region 3 for antibody 43622
QQSYSTPLT

SEQ ID NO: 87244 - protein, 15 aa, Homo sapiens
  heavy chain complementarity determining region 3 for antibody 43622
ASHAGYTYTPRAMDV

SEQ ID NO: 87245 - protein, 9 aa, Homo sapiens
  light chain complementarity determining region 3 for antibody 43623
QQSYSTPLS

SEQ ID NO: 87246 - protein, 20 aa, Homo sapiens
  heavy chain complementarity determining region 3 for antibody 43623
AHRVPNYYDSSGYYEYYFDY

SEQ ID NO: 87247 - protein, 9 aa, Homo sapiens
  light chain complementarity determining region 3 for antibody 43624
QQSYSTPIT

SEQ ID NO: 87248 - protein, 17 aa, Homo sapiens
  heavy chain complementarity determining region 3 for antibody 43624
ARGGYGSPTYYHNGIDV

SEQ ID NO: 87249 - protein, 9 aa, Homo sapiens
  light chain complementarity determining region 3 for antibody 43625
QQSYSTPIT

SEQ ID NO: 87250 - protein, 14 aa, Homo sapiens
  heavy chain complementarity determining region 3 for antibody 43625
ALAGYGSSAMTFDY

SEQ ID NO: 87251 - protein, 9 aa, Homo sapiens
  light chain complementarity determining region 3 for antibody 43626
QQSYSTPFS

SEQ ID NO: 87252 - protein, 10 aa, Homo sapiens
  heavy chain complementarity determining region 3 for antibody 43626
ARHKQWLVHY

SEQ ID NO: 87253 - protein, 8 aa, Homo sapiens
  light chain complementarity determining region 3 for antibody 43627
QQSYSTLT

SEQ ID NO: 87254 - protein, 20 aa, Homo sapiens
  heavy chain complementarity determining region 3 for antibody 43627
ARDGSPGEGAIVATTGRFDL

SEQ ID NO: 87255 - protein, 10 aa, Homo sapiens
  light chain complementarity determining region 3 for antibody 43628
QQSYSTLLLT

SEQ ID NO: 87256 - protein, 10 aa, Homo sapiens
  heavy chain complementarity determining region 3 for antibody 43628
ATHNGFRFEY

SEQ ID NO: 87257 - protein, 9 aa, Homo sapiens
  light chain complementarity determining region 3 for antibody 43629
QQSYSTLFT

SEQ ID NO: 87258 - protein, 20 aa, Homo sapiens
  heavy chain complementarity determining region 3 for antibody 43629
ARSTYYASGSTYRLRFYFDS

SEQ ID NO: 87259 - protein, 9 aa, Homo sapiens
  light chain complementarity determining region 3 for antibody 43630
QQSYSSPYT

SEQ ID NO: 87260 - protein, 15 aa, Homo sapiens
  heavy chain complementarity determining region 3 for antibody 43630
AKLPQSGYYLPDFDY

SEQ ID NO: 87261 - protein, 9 aa, Homo sapiens
  light chain complementarity determining region 3 for antibody 43631
QQSYSSPFT

SEQ ID NO: 87262 - protein, 13 aa, Homo sapiens
  heavy chain complementarity determining region 3 for antibody 43631
TRGVRFLDYGMDV

SEQ ID NO: 87263 - protein, 10 aa, Homo sapiens
  light chain complementarity determining region 3 for antibody 43632
QQSYSPPVYT

SEQ ID NO: 87264 - protein, 19 aa, Homo sapiens
  heavy chain complementarity determining region 3 for antibody 43632
VRGRDDFWSGNYFIHAMDV

SEQ ID NO: 87265 - protein, 9 aa, Homo sapiens
  light chain complementarity determining region 3 for antibody 43633
QQSYSLPLT

SEQ ID NO: 87266 - protein, 13 aa, Homo sapiens
  heavy chain complementarity determining region 3 for antibody 43633
AKARTGDSHHFDS

SEQ ID NO: 87267 - protein, 8 aa, Homo sapiens
  light chain complementarity determining region 3 for antibody 43634
QQSYSLFT

SEQ ID NO: 87268 - protein, 17 aa, Homo sapiens
  heavy chain complementarity determining region 3 for antibody 43634
ARGWFGELFSVPNWFDP

SEQ ID NO: 87269 - protein, 9 aa, Homo sapiens
  light chain complementarity determining region 3 for antibody 43635
QQSYSIPLT

SEQ ID NO: 87270 - protein, 14 aa, Homo sapiens
  heavy chain complementarity determining region 3 for antibody 43635
ARSSDTSGYSSKLT

SEQ ID NO: 87271 - protein, 10 aa, Homo sapiens
  light chain complementarity determining region 3 for antibody 43636
QQSYSGSALT

SEQ ID NO: 87272 - protein, 15 aa, Homo sapiens
  heavy chain complementarity determining region 3 for antibody 43636
ARLWGTNNFYYGLDV

SEQ ID NO: 87273 - protein, 9 aa, Homo sapiens
  light chain complementarity determining region 3 for antibody 43637
QQSYSAPWT

SEQ ID NO: 87274 - protein, 11 aa, Homo sapiens
  heavy chain complementarity determining region 3 for antibody 43637
ARGRGATYFDL

SEQ ID NO: 87275 - protein, 10 aa, Homo sapiens
  light chain complementarity determining region 3 for antibody 43638
QQSYSAPQFT

SEQ ID NO: 87276 - protein, 14 aa, Homo sapiens
  heavy chain complementarity determining region 3 for antibody 43638
ARVYGDYDLDHFDY

SEQ ID NO: 87277 - protein, 9 aa, Homo sapiens
  light chain complementarity determining region 3 for antibody 43639
QQSYSAPLT

SEQ ID NO: 87278 - protein, 14 aa, Homo sapiens
  heavy chain complementarity determining region 3 for antibody 43639
AKRDLTVTTRPFDY

SEQ ID NO: 87279 - protein, 9 aa, Homo sapiens
  light chain complementarity determining region 3 for antibody 43640
QQSYRTPLT

SEQ ID NO: 87280 - protein, 21 aa, Homo sapiens
  heavy chain complementarity determining region 3 for antibody 43640
ASHVDVVATTPHEYYYYAMDV

SEQ ID NO: 87281 - protein, 9 aa, Homo sapiens
  light chain complementarity determining region 3 for antibody 43641
QQSYNTPWT

SEQ ID NO: 87282 - protein, 18 aa, Homo sapiens
  heavy chain complementarity determining region 3 for antibody 43641
AREKWPYDDSGFYAVFDY

SEQ ID NO: 87283 - protein, 9 aa, Homo sapiens
  light chain complementarity determining region 3 for antibody 43642
QQSYNTPRT

SEQ ID NO: 87284 - protein, 13 aa, Homo sapiens
  heavy chain complementarity determining region 3 for antibody 43642
AVVPVEGTPMPDY

SEQ ID NO: 87285 - protein, 9 aa, Homo sapiens
  light chain complementarity determining region 3 for antibody 43643
QQSSAAPVT

SEQ ID NO: 87286 - protein, 17 aa, Homo sapiens
  heavy chain complementarity determining region 3 for antibody 43643
ARPVLRGSYGGVDAFDL

SEQ ID NO: 87287 - protein, 9 aa, Homo sapiens
  light chain complementarity determining region 3 for antibody 43644
QQSKTLPLT

SEQ ID NO: 87288 - protein, 12 aa, Homo sapiens
  heavy chain complementarity determining region 3 for antibody 43644
VRDQAHTTFFDY

SEQ ID NO: 87289 - protein, 9 aa, Homo sapiens
  light chain complementarity determining region 3 for antibody 43645
QQSHTHPWT

SEQ ID NO: 87290 - protein, 17 aa, Homo sapiens
  heavy chain complementarity determining region 3 for antibody 43645
ARVRHLGSRLQLKFFDY

SEQ ID NO: 87291 - protein, 10 aa, Homo sapiens
  light chain complementarity determining region 3 for antibody 43646
QQSHSPPPVT

SEQ ID NO: 87292 - protein, 15 aa, Homo sapiens
  heavy chain complementarity determining region 3 for antibody 43646
ARRSRQVQKIDAFDI

SEQ ID NO: 87293 - protein, 9 aa, Homo sapiens
  light chain complementarity determining region 3 for antibody 43647
QQSHSIPWT

SEQ ID NO: 87294 - protein, 14 aa, Homo sapiens
  heavy chain complementarity determining region 3 for antibody 43647
ARHPPIYDIPWFDP

SEQ ID NO: 87295 - protein, 9 aa, Homo sapiens
  light chain complementarity determining region 3 for antibody 43648
QQSHITPIT

SEQ ID NO: 87296 - protein, 15 aa, Homo sapiens
  heavy chain complementarity determining region 3 for antibody 43648
ARLNQGYIASAAFDY

SEQ ID NO: 87297 - protein, 10 aa, Homo sapiens
  light chain complementarity determining region 3 for antibody 43649
QQSFSTPLYT

SEQ ID NO: 87298 - protein, 15 aa, Homo sapiens
  heavy chain complementarity determining region 3 for antibody 43649
ARGYRGTNYEQWFDP

SEQ ID NO: 87299 - protein, 9 aa, Homo sapiens
  light chain complementarity determining region 3 for antibody 43650
QQSFSSPLT

SEQ ID NO: 87300 - protein, 20 aa, Homo sapiens
  heavy chain complementarity determining region 3 for antibody 43650
VRGDYVWGSYRYPGRYYFDF

SEQ ID NO: 87301 - protein, 9 aa, Homo sapiens
  light chain complementarity determining region 3 for antibody 43651
QQSFSFPRT

SEQ ID NO: 87302 - protein, 18 aa, Homo sapiens
  heavy chain complementarity determining region 3 for antibody 43651
ARRLVVASTTPHRDCFDV

SEQ ID NO: 87303 - protein, 9 aa, Homo sapiens
  light chain complementarity determining region 3 for antibody 43652
QQSFRTPPT

SEQ ID NO: 87304 - protein, 18 aa, Homo sapiens
  heavy chain complementarity determining region 3 for antibody 43652
AREGDYFVSGTSYNIFDY

SEQ ID NO: 87305 - protein, 9 aa, Homo sapiens
  light chain complementarity determining region 3 for antibody 43653
QQSDSAPLT

SEQ ID NO: 87306 - protein, 10 aa, Homo sapiens
  heavy chain complementarity determining region 3 for antibody 43653
ASGLGWESGY

SEQ ID NO: 87307 - protein, 10 aa, Homo sapiens
  light chain complementarity determining region 3 for antibody 43654
QQSDSAKMIT

SEQ ID NO: 87308 - protein, 20 aa, Homo sapiens
  heavy chain complementarity determining region 3 for antibody 43654
ARGPDVSGKSAYPYYYGLDV

SEQ ID NO: 87309 - protein, 9 aa, Homo sapiens
  light chain complementarity determining region 3 for antibody 43655
QQRYTWPIT

SEQ ID NO: 87310 - protein, 14 aa, Homo sapiens
  heavy chain complementarity determining region 3 for antibody 43655
ARDRRWGGYRQLDY

SEQ ID NO: 87311 - protein, 10 aa, Homo sapiens
  light chain complementarity determining region 3 for antibody 43656
QQRYNWPPYT

SEQ ID NO: 87312 - protein, 16 aa, Homo sapiens
  heavy chain complementarity determining region 3 for antibody 43656
ATGSLGGGWYFPYLQH

SEQ ID NO: 87313 - protein, 9 aa, Homo sapiens
  light chain complementarity determining region 3 for antibody 43657
QQRTDWPLT

SEQ ID NO: 87314 - protein, 17 aa, Homo sapiens
  heavy chain complementarity determining region 3 for antibody 43657
ARGAHVSRTLTQLLFEY

SEQ ID NO: 87315 - protein, 7 aa, Homo sapiens
  light chain complementarity determining region 3 for antibody 43658
QQRSNWT

SEQ ID NO: 87316 - protein, 18 aa, Homo sapiens
  heavy chain complementarity determining region 3 for antibody 43658
ARDIADEETDYYYYGMDV

SEQ ID NO: 87317 - protein, 9 aa, Homo sapiens
  light chain complementarity determining region 3 for antibody 43659
QQRSNWPWT

SEQ ID NO: 87318 - protein, 10 aa, Homo sapiens
  heavy chain complementarity determining region 3 for antibody 43659
ARDNYHSIDY

SEQ ID NO: 87319 - protein, 9 aa, Homo sapiens
  light chain complementarity determining region 3 for antibody 43660
QQRSNWPVT

SEQ ID NO: 87320 - protein, 17 aa, Homo sapiens
  heavy chain complementarity determining region 3 for antibody 43660
AAGYHSKSFFADDAFDL

SEQ ID NO: 87321 - protein, 11 aa, Homo sapiens
  light chain complementarity determining region 3 for antibody 43661
QQRSNWPPEYS

SEQ ID NO: 87322 - protein, 14 aa, Homo sapiens
  heavy chain complementarity determining region 3 for antibody 43661
AKVGYSASWNHFDH

SEQ ID NO: 87323 - protein, 9 aa, Homo sapiens
  light chain complementarity determining region 3 for antibody 43662
QQRSNWPNT

SEQ ID NO: 87324 - protein, 16 aa, Homo sapiens
  heavy chain complementarity determining region 3 for antibody 43662
ARDVWNGSGSPGWFDP

SEQ ID NO: 87325 - protein, 9 aa, Homo sapiens
  light chain complementarity determining region 3 for antibody 43663
QQRSNWLLT

SEQ ID NO: 87326 - protein, 19 aa, Homo sapiens
  heavy chain complementarity determining region 3 for antibody 43663
ARDMSLWFDSRGFSGAFDY

SEQ ID NO: 87327 - protein, 8 aa, Homo sapiens
  light chain complementarity determining region 3 for antibody 43664
QQRSNSLT

SEQ ID NO: 87328 - protein, 21 aa, Homo sapiens
  heavy chain complementarity determining region 3 for antibody 43664
ARDLMLLWFGELPENYWYFDL

SEQ ID NO: 87329 - protein, 10 aa, Homo sapiens
  light chain complementarity determining region 3 for antibody 43665
QQRSKRPGVT

SEQ ID NO: 87330 - protein, 13 aa, Homo sapiens
  heavy chain complementarity determining region 3 for antibody 43665
ARDHWDKIAVAAR

SEQ ID NO: 87331 - protein, 10 aa, Homo sapiens
  light chain complementarity determining region 3 for antibody 43666
QQRRTWPAIT

SEQ ID NO: 87332 - protein, 10 aa, Homo sapiens
  heavy chain complementarity determining region 3 for antibody 43666
ARDSGATVTP

SEQ ID NO: 87333 - protein, 11 aa, Homo sapiens
  light chain complementarity determining region 3 for antibody 43667
QQRRNWPPEYT

SEQ ID NO: 87334 - protein, 22 aa, Homo sapiens
  heavy chain complementarity determining region 3 for antibody 43667
VHQPLRITMLRGVPYHYYGMDV

SEQ ID NO: 87335 - protein, 9 aa, Homo sapiens
  light chain complementarity determining region 3 for antibody 43668
QQRRNWPIT

SEQ ID NO: 87336 - protein, 18 aa, Homo sapiens
  heavy chain complementarity determining region 3 for antibody 43668
ARAVTYYDILTNTNWFDP

SEQ ID NO: 87337 - protein, 9 aa, Homo sapiens
  light chain complementarity determining region 3 for antibody 43669
QQRGDWPLT

SEQ ID NO: 87338 - protein, 17 aa, Homo sapiens
  heavy chain complementarity determining region 3 for antibody 43669
ARGLNDYVTNYLYGMDV

SEQ ID NO: 87339 - protein, 9 aa, Homo sapiens
  light chain complementarity determining region 3 for antibody 43670
QQQTRYSNT

SEQ ID NO: 87340 - protein, 14 aa, Homo sapiens
  heavy chain complementarity determining region 3 for antibody 43670
ARDLRKWEVVGLEY

SEQ ID NO: 87341 - protein, 9 aa, Homo sapiens
  light chain complementarity determining region 3 for antibody 43671
QQLSSYPLT

SEQ ID NO: 87342 - protein, 15 aa, Homo sapiens
  heavy chain complementarity determining region 3 for antibody 43671
VKVSYYGSGPFYFDD

SEQ ID NO: 87343 - protein, 9 aa, Homo sapiens
  light chain complementarity determining region 3 for antibody 43672
QQLNSYPYS

SEQ ID NO: 87344 - protein, 14 aa, Homo sapiens
  heavy chain complementarity determining region 3 for antibody 43672
ATDLVVGGSNAFHV

SEQ ID NO: 87345 - protein, 9 aa, Homo sapiens
  light chain complementarity determining region 3 for antibody 43673
QQLNSYPRT

SEQ ID NO: 87346 - protein, 11 aa, Homo sapiens
  heavy chain complementarity determining region 3 for antibody 43673
ARGDYGDYLVY

SEQ ID NO: 87347 - protein, 9 aa, Homo sapiens
  light chain complementarity determining region 3 for antibody 43674
QQLNSYPLT

SEQ ID NO: 87348 - protein, 21 aa, Homo sapiens
  heavy chain complementarity determining region 3 for antibody 43674
ARGFLRGAVVREPTLRGWFDP

SEQ ID NO: 87349 - protein, 9 aa, Homo sapiens
  light chain complementarity determining region 3 for antibody 43675
QQLNSYPFT

SEQ ID NO: 87350 - protein, 14 aa, Homo sapiens
  heavy chain complementarity determining region 3 for antibody 43675
ASRKQMIMWGYFDS

SEQ ID NO: 87351 - protein, 9 aa, Homo sapiens
  light chain complementarity determining region 3 for antibody 43676
QQHYSFPLT

SEQ ID NO: 87352 - protein, 17 aa, Homo sapiens
  heavy chain complementarity determining region 3 for antibody 43676
ARHGSGLVVLFLNYFDV

SEQ ID NO: 87353 - protein, 9 aa, Homo sapiens
  light chain complementarity determining region 3 for antibody 43677
QQHSSYPRT

SEQ ID NO: 87354 - protein, 18 aa, Homo sapiens
  heavy chain complementarity determining region 3 for antibody 43677
ATDPPRLVGAKEYDSFDV

SEQ ID NO: 87355 - protein, 9 aa, Homo sapiens
  light chain complementarity determining region 3 for antibody 43678
QQHDTLPLT

SEQ ID NO: 87356 - protein, 14 aa, Homo sapiens
  heavy chain complementarity determining region 3 for antibody 43678
ARGVAVAGTRWFDP

SEQ ID NO: 87357 - protein, 9 aa, Homo sapiens
  light chain complementarity determining region 3 for antibody 43679
QQHDSYPYT

SEQ ID NO: 87358 - protein, 18 aa, Homo sapiens
  heavy chain complementarity determining region 3 for antibody 43679
AREAKFDSSDFQTDAFDI

SEQ ID NO: 87359 - protein, 9 aa, Homo sapiens
  light chain complementarity determining region 3 for antibody 43680
QQGYRPPFI

SEQ ID NO: 87360 - protein, 15 aa, Homo sapiens
  heavy chain complementarity determining region 3 for antibody 43680
ARGLWGLRMGDLYPP

SEQ ID NO: 87361 - protein, 9 aa, Homo sapiens
  light chain complementarity determining region 3 for antibody 43681
QQGNSFPIT

SEQ ID NO: 87362 - protein, 18 aa, Homo sapiens
  heavy chain complementarity determining region 3 for antibody 43681
ASTYHSIGPLLPSYGMDV

SEQ ID NO: 87363 - protein, 10 aa, Homo sapiens
  light chain complementarity determining region 3 for antibody 43682
QQGFSAPLYT

SEQ ID NO: 87364 - protein, 14 aa, Homo sapiens
  heavy chain complementarity determining region 3 for antibody 43682
ATGGQWDLSAAFDI

SEQ ID NO: 87365 - protein, 9 aa, Homo sapiens
  light chain complementarity determining region 3 for antibody 43683
QQGFGTPKT

SEQ ID NO: 87366 - protein, 11 aa, Homo sapiens
  heavy chain complementarity determining region 3 for antibody 43683
ARDRWGNGFDV

SEQ ID NO: 87367 - protein, 10 aa, Homo sapiens
  light chain complementarity determining region 3 for antibody 43684
QQFSKWPPLT

SEQ ID NO: 87368 - protein, 16 aa, Homo sapiens
  heavy chain complementarity determining region 3 for antibody 43684
ARDLWVCNSGACYSAY

SEQ ID NO: 87369 - protein, 9 aa, Homo sapiens
  light chain complementarity determining region 3 for antibody 43685
QQFNSYPRT

SEQ ID NO: 87370 - protein, 15 aa, Homo sapiens
  heavy chain complementarity determining region 3 for antibody 43685
ARGFGYGSGSWYFDY

SEQ ID NO: 87371 - protein, 9 aa, Homo sapiens
  light chain complementarity determining region 3 for antibody 43686
QQFNNYPYT

SEQ ID NO: 87372 - protein, 15 aa, Homo sapiens
  heavy chain complementarity determining region 3 for antibody 43686
ARDRKDADYDDAFDV

SEQ ID NO: 87373 - protein, 9 aa, Homo sapiens
  light chain complementarity determining region 3 for antibody 43687
QQFGHSPWT

SEQ ID NO: 87374 - protein, 15 aa, Homo sapiens
  heavy chain complementarity determining region 3 for antibody 43687
ARGDYDVLTGYKFDA

SEQ ID NO: 87375 - protein, 9 aa, Homo sapiens
  light chain complementarity determining region 3 for antibody 43688
QQFDDIPYT

SEQ ID NO: 87376 - protein, 20 aa, Homo sapiens
  heavy chain complementarity determining region 3 for antibody 43688
VKDWNAYGITFGGVIGTFDC

SEQ ID NO: 87377 - protein, 9 aa, Homo sapiens
  light chain complementarity determining region 3 for antibody 43689
QQCYTFPVT

SEQ ID NO: 87378 - protein, 16 aa, Homo sapiens
  heavy chain complementarity determining region 3 for antibody 43689
TRLYFDSWSGYYFLDS

SEQ ID NO: 87379 - protein, 9 aa, Homo sapiens
  light chain complementarity determining region 3 for antibody 43690
QQCNSYSLT

SEQ ID NO: 87380 - protein, 16 aa, Homo sapiens
  heavy chain complementarity determining region 3 for antibody 43690
ARGHRGFGELSLSLDY

SEQ ID NO: 87381 - protein, 9 aa, Homo sapiens
  light chain complementarity determining region 3 for antibody 43691
QQCDVLPLT

SEQ ID NO: 87382 - protein, 15 aa, Homo sapiens
  heavy chain complementarity determining region 3 for antibody 43691
ARDRSFLTGIGGAGY

SEQ ID NO: 87383 - protein, 9 aa, Homo sapiens
  light chain complementarity determining region 3 for antibody 43692
QQASSSPWT

SEQ ID NO: 87384 - protein, 16 aa, Homo sapiens
  heavy chain complementarity determining region 3 for antibody 43692
AHRGRFTGDLGNYFDF

SEQ ID NO: 87385 - protein, 9 aa, Homo sapiens
  light chain complementarity determining region 3 for antibody 43693
QQASSFPRT

SEQ ID NO: 87386 - protein, 18 aa, Homo sapiens
  heavy chain complementarity determining region 3 for antibody 43693
ARDLLYGDSYDSSGYYDW

SEQ ID NO: 87387 - protein, 9 aa, Homo sapiens
  light chain complementarity determining region 3 for antibody 43694
QQASSFPLT

SEQ ID NO: 87388 - protein, 12 aa, Homo sapiens
  heavy chain complementarity determining region 3 for antibody 43694
ARSIAAADAMDY

SEQ ID NO: 87389 - protein, 8 aa, Homo sapiens
  light chain complementarity determining region 3 for antibody 43695
QQANSFPT

SEQ ID NO: 87390 - protein, 11 aa, Homo sapiens
  heavy chain complementarity determining region 3 for antibody 43695
ARGVGSYPFDS

SEQ ID NO: 87391 - protein, 9 aa, Homo sapiens
  light chain complementarity determining region 3 for antibody 43696
QQANSFPRT

SEQ ID NO: 87392 - protein, 14 aa, Homo sapiens
  heavy chain complementarity determining region 3 for antibody 43696
ARDKYYGPGRAYGY

SEQ ID NO: 87393 - protein, 11 aa, Homo sapiens
  light chain complementarity determining region 3 for antibody 43697
QQANSFPPRLT

SEQ ID NO: 87394 - protein, 11 aa, Homo sapiens
  heavy chain complementarity determining region 3 for antibody 43697
STWFFLSDVDV

SEQ ID NO: 87395 - protein, 9 aa, Homo sapiens
  light chain complementarity determining region 3 for antibody 43698
QQANSFPLT

SEQ ID NO: 87396 - protein, 16 aa, Homo sapiens
  heavy chain complementarity determining region 3 for antibody 43698
AVDFGDPVQWDGAFDY

SEQ ID NO: 87397 - protein, 9 aa, Homo sapiens
  light chain complementarity determining region 3 for antibody 43699
QQANSFPLT

SEQ ID NO: 87398 - protein, 21 aa, Homo sapiens
  heavy chain complementarity determining region 3 for antibody 43699
ARKEAAELRLWFGESQSPLDS

SEQ ID NO: 87399 - protein, 9 aa, Homo sapiens
  light chain complementarity determining region 3 for antibody 43700
QQANSFPLT

SEQ ID NO: 87400 - protein, 14 aa, Homo sapiens
  heavy chain complementarity determining region 3 for antibody 43700
ARDRYGGYVGVYDS

SEQ ID NO: 87401 - protein, 9 aa, Homo sapiens
  light chain complementarity determining region 3 for antibody 43701
QQAIALPLS

SEQ ID NO: 87402 - protein, 24 aa, Homo sapiens
  heavy chain complementarity determining region 3 for antibody 43701
ARDRPVGRFYGSRMESNQYQGLDV

SEQ ID NO: 87403 - protein, 6 aa, Homo sapiens
  light chain complementarity determining region 3 for antibody 43702
QNYNNY

SEQ ID NO: 87404 - protein, 11 aa, Homo sapiens
  heavy chain complementarity determining region 3 for antibody 43702
VRGQWLEPIEY

SEQ ID NO: 87405 - protein, 9 aa, Homo sapiens
  light chain complementarity determining region 3 for antibody 43703
QNYDSAPRT

SEQ ID NO: 87406 - protein, 13 aa, Homo sapiens
  heavy chain complementarity determining region 3 for antibody 43703
ARDAGQHYDQFDC

SEQ ID NO: 87407 - protein, 9 aa, Homo sapiens
  light chain complementarity determining region 3 for antibody 43704
QLYNNRLFT

SEQ ID NO: 87408 - protein, 13 aa, Homo sapiens
  heavy chain complementarity determining region 3 for antibody 43704
VALSGSYYSRADF

SEQ ID NO: 87409 - protein, 9 aa, Homo sapiens
  light chain complementarity determining region 3 for antibody 43705
QLSGSSTRT

SEQ ID NO: 87410 - protein, 16 aa, Homo sapiens
  heavy chain complementarity determining region 3 for antibody 43705
TKDACSSTRCDIPFDS

SEQ ID NO: 87411 - protein, 11 aa, Homo sapiens
  light chain complementarity determining region 3 for antibody 43706
QLRSNWPPRYT

SEQ ID NO: 87412 - protein, 18 aa, Homo sapiens
  heavy chain complementarity determining region 3 for antibody 43706
ATRARPFGMVLLGDDFDI

SEQ ID NO: 87413 - protein, 9 aa, Homo sapiens
  light chain complementarity determining region 3 for antibody 43707
QKYNSFPLT

SEQ ID NO: 87414 - protein, 11 aa, Homo sapiens
  heavy chain complementarity determining region 3 for antibody 43707
ASNHYEGWIDS

SEQ ID NO: 87415 - protein, 9 aa, Homo sapiens
  light chain complementarity determining region 3 for antibody 43708
QKYNSASWT

SEQ ID NO: 87416 - protein, 16 aa, Homo sapiens
  heavy chain complementarity determining region 3 for antibody 43708
GRDGDLGSGGRSGLDV

SEQ ID NO: 87417 - protein, 10 aa, Homo sapiens
  light chain complementarity determining region 3 for antibody 43709
QKYNSARGWT

SEQ ID NO: 87418 - protein, 12 aa, Homo sapiens
  heavy chain complementarity determining region 3 for antibody 43709
ARQDALGTYPPD

SEQ ID NO: 87419 - protein, 9 aa, Homo sapiens
  light chain complementarity determining region 3 for antibody 43710
QKYNSAPRT

SEQ ID NO: 87420 - protein, 11 aa, Homo sapiens
  heavy chain complementarity determining region 3 for antibody 43710
AIMHVTEAFDF

SEQ ID NO: 87421 - protein, 8 aa, Homo sapiens
  light chain complementarity determining region 3 for antibody 43711
QKYNSAPP

SEQ ID NO: 87422 - protein, 23 aa, Homo sapiens
  heavy chain complementarity determining region 3 for antibody 43711
ARIGGPRRFHDILTGRNHDSFDI

SEQ ID NO: 87423 - protein, 9 aa, Homo sapiens
  light chain complementarity determining region 3 for antibody 43712
QKYNSAPLT

SEQ ID NO: 87424 - protein, 11 aa, Homo sapiens
  heavy chain complementarity determining region 3 for antibody 43712
ARTMVTTQFDS

SEQ ID NO: 87425 - protein, 10 aa, Homo sapiens
  light chain complementarity determining region 3 for antibody 43713
QKYNSALTWT

SEQ ID NO: 87426 - protein, 15 aa, Homo sapiens
  heavy chain complementarity determining region 3 for antibody 43713
ARDSQYRASWVGFDP

SEQ ID NO: 87427 - protein, 8 aa, Homo sapiens
  light chain complementarity determining region 3 for antibody 43714
QKYNSAFS

SEQ ID NO: 87428 - protein, 18 aa, Homo sapiens
  heavy chain complementarity determining region 3 for antibody 43714
ARDLFSFYYNISYYEADC

SEQ ID NO: 87429 - protein, 9 aa, Homo sapiens
  light chain complementarity determining region 3 for antibody 43715
QKFDSLPLT

SEQ ID NO: 87430 - protein, 15 aa, Homo sapiens
  heavy chain complementarity determining region 3 for antibody 43715
ATYGYLNSWFQAFDT

SEQ ID NO: 87431 - protein, 8 aa, Homo sapiens
  light chain complementarity determining region 3 for antibody 43716
QHYTSYLS

SEQ ID NO: 87432 - protein, 16 aa, Homo sapiens
  heavy chain complementarity determining region 3 for antibody 43716
ARHEVYGITQLLPTGY

SEQ ID NO: 87433 - protein, 9 aa, Homo sapiens
  light chain complementarity determining region 3 for antibody 43717
QHYSTYPPT

SEQ ID NO: 87434 - protein, 16 aa, Homo sapiens
  heavy chain complementarity determining region 3 for antibody 43717
AREGYDIDAFNHGLDV

SEQ ID NO: 87435 - protein, 9 aa, Homo sapiens
  light chain complementarity determining region 3 for antibody 43718
QHYNGAPWT

SEQ ID NO: 87436 - protein, 12 aa, Homo sapiens
  heavy chain complementarity determining region 3 for antibody 43718
AMLLEGMGGVGA

SEQ ID NO: 87437 - protein, 9 aa, Homo sapiens
  light chain complementarity determining region 3 for antibody 43719
QHYKSYPLT

SEQ ID NO: 87438 - protein, 13 aa, Homo sapiens
  heavy chain complementarity determining region 3 for antibody 43719
TRARGSDNSYCEY

SEQ ID NO: 87439 - protein, 10 aa, Homo sapiens
  light chain complementarity determining region 3 for antibody 43720
QHYGSSSLYT

SEQ ID NO: 87440 - protein, 13 aa, Homo sapiens
  heavy chain complementarity determining region 3 for antibody 43720
ARHKRPGNNWFDP

SEQ ID NO: 87441 - protein, 10 aa, Homo sapiens
  light chain complementarity determining region 3 for antibody 43721
QHYGSSPRYI

SEQ ID NO: 87442 - protein, 10 aa, Homo sapiens
  heavy chain complementarity determining region 3 for antibody 43721
ARVATYYFDF

SEQ ID NO: 87443 - protein, 9 aa, Homo sapiens
  light chain complementarity determining region 3 for antibody 43722
QHYGSSPLT

SEQ ID NO: 87444 - protein, 19 aa, Homo sapiens
  heavy chain complementarity determining region 3 for antibody 43722
ARGPSVIAPRVQDHWYFDL

SEQ ID NO: 87445 - protein, 10 aa, Homo sapiens
  light chain complementarity determining region 3 for antibody 43723
QHYGSPPPLT

SEQ ID NO: 87446 - protein, 10 aa, Homo sapiens
  heavy chain complementarity determining region 3 for antibody 43723
GRDSDGQWLL

SEQ ID NO: 87447 - protein, 9 aa, Homo sapiens
  light chain complementarity determining region 3 for antibody 43724
QHYDNTQAT

SEQ ID NO: 87448 - protein, 13 aa, Homo sapiens
  heavy chain complementarity determining region 3 for antibody 43724
ARHLGYGDFVFKL

SEQ ID NO: 87449 - protein, 9 aa, Homo sapiens
  light chain complementarity determining region 3 for antibody 43725
QHYDGLPVT

SEQ ID NO: 87450 - protein, 15 aa, Homo sapiens
  heavy chain complementarity determining region 3 for antibody 43725
ARDQDEAVPGRSFDH

SEQ ID NO: 87451 - protein, 9 aa, Homo sapiens
  light chain complementarity determining region 3 for antibody 43726
QHSYSNPPT

SEQ ID NO: 87452 - protein, 18 aa, Homo sapiens
  heavy chain complementarity determining region 3 for antibody 43726
AREVDFHDSRAFYNAFDS

SEQ ID NO: 87453 - protein, 9 aa, Homo sapiens
  light chain complementarity determining region 3 for antibody 43727
QHRSNWPPT

SEQ ID NO: 87454 - protein, 17 aa, Homo sapiens
  heavy chain complementarity determining region 3 for antibody 43727
AREGGYCIGGGCRWFDL

SEQ ID NO: 87455 - protein, 9 aa, Homo sapiens
  light chain complementarity determining region 3 for antibody 43728
QHNYNPPFT

SEQ ID NO: 87456 - protein, 13 aa, Homo sapiens
  heavy chain complementarity determining region 3 for antibody 43728
VRGRNYDRDGFDP

SEQ ID NO: 87457 - protein, 9 aa, Homo sapiens
  light chain complementarity determining region 3 for antibody 43729
QHLYEYPLT

SEQ ID NO: 87458 - protein, 13 aa, Homo sapiens
  heavy chain complementarity determining region 3 for antibody 43729
VRDPKSNVYYGDR

SEQ ID NO: 87459 - protein, 10 aa, Homo sapiens
  light chain complementarity determining region 3 for antibody 43730
QEYNNWPPPT

SEQ ID NO: 87460 - protein, 17 aa, Homo sapiens
  heavy chain complementarity determining region 3 for antibody 43730
ARDPDIAAAGTGSAFDI

SEQ ID NO: 87461 - protein, 10 aa, Homo sapiens
  light chain complementarity determining region 3 for antibody 43731
QESHSHPRYT

SEQ ID NO: 87462 - protein, 11 aa, Homo sapiens
  heavy chain complementarity determining region 3 for antibody 43731
AKVGWAYAMDV

SEQ ID NO: 87463 - protein, 9 aa, Homo sapiens
  light chain complementarity determining region 3 for antibody 43732
MYTLQTQLS

SEQ ID NO: 87464 - protein, 24 aa, Homo sapiens
  heavy chain complementarity determining region 3 for antibody 43732
ARAVGCDGTNCHAAWGFYYYALDV

SEQ ID NO: 87465 - protein, 9 aa, Homo sapiens
  light chain complementarity determining region 3 for antibody 43733
MQTVQTPGT

SEQ ID NO: 87466 - protein, 16 aa, Homo sapiens
  heavy chain complementarity determining region 3 for antibody 43733
ARDQQLWGIRPRGFDS

SEQ ID NO: 87467 - protein, 9 aa, Homo sapiens
  light chain complementarity determining region 3 for antibody 43734
MQSRQSPRT

SEQ ID NO: 87468 - protein, 13 aa, Homo sapiens
  heavy chain complementarity determining region 3 for antibody 43734
AAALDLWSAHLEV

SEQ ID NO: 87469 - protein, 8 aa, Homo sapiens
  light chain complementarity determining region 3 for antibody 43735
MQSLQTHT

SEQ ID NO: 87470 - protein, 10 aa, Homo sapiens
  heavy chain complementarity determining region 3 for antibody 43735
AREDFWRLDL

SEQ ID NO: 87471 - protein, 9 aa, Homo sapiens
  light chain complementarity determining region 3 for antibody 43736
MQNLQTPFT

SEQ ID NO: 87472 - protein, 15 aa, Homo sapiens
  heavy chain complementarity determining region 3 for antibody 43736
SRGYSRWGGLYGFDI

SEQ ID NO: 87473 - protein, 10 aa, Homo sapiens
  light chain complementarity determining region 3 for antibody 43737
MQGTHWPPYT

SEQ ID NO: 87474 - protein, 13 aa, Homo sapiens
  heavy chain complementarity determining region 3 for antibody 43737
ARGGAAAGKAFDF

SEQ ID NO: 87475 - protein, 9 aa, Homo sapiens
  light chain complementarity determining region 3 for antibody 43738
MQGTHWPHT

SEQ ID NO: 87476 - protein, 14 aa, Homo sapiens
  heavy chain complementarity determining region 3 for antibody 43738
ARLGCFRDHYGMDV

SEQ ID NO: 87477 - protein, 9 aa, Homo sapiens
  light chain complementarity determining region 3 for antibody 43739
MQGTHWPHT

SEQ ID NO: 87478 - protein, 15 aa, Homo sapiens
  heavy chain complementarity determining region 3 for antibody 43739
AKAQVIWGQLYYFES

SEQ ID NO: 87479 - protein, 8 aa, Homo sapiens
  light chain complementarity determining region 3 for antibody 43740
MQGTHRYT

SEQ ID NO: 87480 - protein, 17 aa, Homo sapiens
  heavy chain complementarity determining region 3 for antibody 43740
ARDADYDYVLGSYRFDY

SEQ ID NO: 87481 - protein, 9 aa, Homo sapiens
  light chain complementarity determining region 3 for antibody 43741
MQGLQTPYT

SEQ ID NO: 87482 - protein, 19 aa, Homo sapiens
  heavy chain complementarity determining region 3 for antibody 43741
ARDLKQNTLFGVIPYYIDY

SEQ ID NO: 87483 - protein, 9 aa, Homo sapiens
  light chain complementarity determining region 3 for antibody 43742
MQGAHWPVT

SEQ ID NO: 87484 - protein, 21 aa, Homo sapiens
  heavy chain complementarity determining region 3 for antibody 43742
ARDAPTRPFFWFGELSPNFDH

SEQ ID NO: 87485 - protein, 11 aa, Homo sapiens
  light chain complementarity determining region 3 for antibody 43743
MQGAHWPPPLT

SEQ ID NO: 87486 - protein, 8 aa, Homo sapiens
  heavy chain complementarity determining region 3 for antibody 43743
AMESGGDY

SEQ ID NO: 87487 - protein, 8 aa, Homo sapiens
  light chain complementarity determining region 3 for antibody 43744
MQATHWLS

SEQ ID NO: 87488 - protein, 10 aa, Homo sapiens
  heavy chain complementarity determining region 3 for antibody 43744
AKPGYNSDWS

SEQ ID NO: 87489 - protein, 9 aa, Homo sapiens
  light chain complementarity determining region 3 for antibody 43745
MQALQTPYT

SEQ ID NO: 87490 - protein, 14 aa, Homo sapiens
  heavy chain complementarity determining region 3 for antibody 43745
ARHFSGGTAYYFDH

SEQ ID NO: 87491 - protein, 9 aa, Homo sapiens
  light chain complementarity determining region 3 for antibody 43746
MQALQTPRT

SEQ ID NO: 87492 - protein, 11 aa, Homo sapiens
  heavy chain complementarity determining region 3 for antibody 43746
AGDIYRGAPFY

SEQ ID NO: 87493 - protein, 9 aa, Homo sapiens
  light chain complementarity determining region 3 for antibody 43747
MQALQTPPT

SEQ ID NO: 87494 - protein, 16 aa, Homo sapiens
  heavy chain complementarity determining region 3 for antibody 43747
GVSPGVYCRGASCLSS

SEQ ID NO: 87495 - protein, 9 aa, Homo sapiens
  light chain complementarity determining region 3 for antibody 43748
MQALQTPPT

SEQ ID NO: 87496 - protein, 17 aa, Homo sapiens
  heavy chain complementarity determining region 3 for antibody 43748
ARVDMGRELLNYYGMDV

SEQ ID NO: 87497 - protein, 10 aa, Homo sapiens
  light chain complementarity determining region 3 for antibody 43749
MQALQTPGVT

SEQ ID NO: 87498 - protein, 17 aa, Homo sapiens
  heavy chain complementarity determining region 3 for antibody 43749
VKAAYLHDGTTYYTHHY

SEQ ID NO: 87499 - protein, 9 aa, Homo sapiens
  light chain complementarity determining region 3 for antibody 43750
MQALQTPGT

SEQ ID NO: 87500 - protein, 12 aa, Homo sapiens
  heavy chain complementarity determining region 3 for antibody 43750
ARFIVGATGADF

SEQ ID NO: 87501 - protein, 9 aa, Homo sapiens
  light chain complementarity determining region 3 for antibody 43751
MQALQTPFT

SEQ ID NO: 87502 - protein, 12 aa, Homo sapiens
  heavy chain complementarity determining region 3 for antibody 43751
ARVAHLGRGFHY

SEQ ID NO: 87503 - protein, 8 aa, Homo sapiens
  light chain complementarity determining region 3 for antibody 43752
MQALQIFT

SEQ ID NO: 87504 - protein, 20 aa, Homo sapiens
  heavy chain complementarity determining region 3 for antibody 43752
ARATLVVSGSKRNYYYGLDV

SEQ ID NO: 87505 - protein, 9 aa, Homo sapiens
  light chain complementarity determining region 3 for antibody 43753
MQALHIPYT

SEQ ID NO: 87506 - protein, 20 aa, Homo sapiens
  heavy chain complementarity determining region 3 for antibody 43753
ARWASRGITVVRRVPGTFDS

SEQ ID NO: 87507 - protein, 11 aa, Homo sapiens
  light chain complementarity determining region 3 for antibody 43754
MHGTHWPPMYT

SEQ ID NO: 87508 - protein, 7 aa, Homo sapiens
  heavy chain complementarity determining region 3 for antibody 43754
MTPAGSD

SEQ ID NO: 87509 - protein, 9 aa, Homo sapiens
  light chain complementarity determining region 3 for antibody 43755
MHALQIPIT

SEQ ID NO: 87510 - protein, 16 aa, Homo sapiens
  heavy chain complementarity determining region 3 for antibody 43755
ARYYYESSGYSHWFDP

SEQ ID NO: 87511 - protein, 9 aa, Homo sapiens
  light chain complementarity determining region 3 for antibody 43756
LQYNEFPYI

SEQ ID NO: 87512 - protein, 13 aa, Homo sapiens
  heavy chain complementarity determining region 3 for antibody 43756
ARSPYSSGWYPDL

SEQ ID NO: 87513 - protein, 9 aa, Homo sapiens
  light chain complementarity determining region 3 for antibody 43757
LQYHTYPPT

SEQ ID NO: 87514 - protein, 24 aa, Homo sapiens
  heavy chain complementarity determining region 3 for antibody 43757
AMTDRGEEGVRGGIGGNYYYAMDV

SEQ ID NO: 87515 - protein, 9 aa, Homo sapiens
  light chain complementarity determining region 3 for antibody 43758
LQYHSYPWT

SEQ ID NO: 87516 - protein, 15 aa, Homo sapiens
  heavy chain complementarity determining region 3 for antibody 43758
ARPTPESATYRGMDV

SEQ ID NO: 87517 - protein, 10 aa, Homo sapiens
  light chain complementarity determining region 3 for antibody 43759
LQVNSNPPFT

SEQ ID NO: 87518 - protein, 19 aa, Homo sapiens
  heavy chain complementarity determining region 3 for antibody 43759
ATGGAPSSVWNFPWYYLDY

SEQ ID NO: 87519 - protein, 9 aa, Homo sapiens
  light chain complementarity determining region 3 for antibody 43760
LQTYGNLFA

SEQ ID NO: 87520 - protein, 13 aa, Homo sapiens
  heavy chain complementarity determining region 3 for antibody 43760
TTGVSATHDAFDF

SEQ ID NO: 87521 - protein, 9 aa, Homo sapiens
  light chain complementarity determining region 3 for antibody 43761
LQPLLTPPA

SEQ ID NO: 87522 - protein, 13 aa, Homo sapiens
  heavy chain complementarity determining region 3 for antibody 43761
ARAPDTADDPFDI

SEQ ID NO: 87523 - protein, 9 aa, Homo sapiens
  light chain complementarity determining region 3 for antibody 43762
LQHYSYPFT

SEQ ID NO: 87524 - protein, 15 aa, Homo sapiens
  heavy chain complementarity determining region 3 for antibody 43762
VKWSCSATTCYPGDV

SEQ ID NO: 87525 - protein, 9 aa, Homo sapiens
  light chain complementarity determining region 3 for antibody 43763
LQHSTYPHT

SEQ ID NO: 87526 - protein, 21 aa, Homo sapiens
  heavy chain complementarity determining region 3 for antibody 43763
ARVKDDPLRFVESLSVGFLDY

SEQ ID NO: 87527 - protein, 9 aa, Homo sapiens
  light chain complementarity determining region 3 for antibody 43764
LQHSAYPLT

SEQ ID NO: 87528 - protein, 16 aa, Homo sapiens
  heavy chain complementarity determining region 3 for antibody 43764
AREDIPFRLGGGPPVD

SEQ ID NO: 87529 - protein, 9 aa, Homo sapiens
  light chain complementarity determining region 3 for antibody 43765
LQHNSYPRT

SEQ ID NO: 87530 - protein, 18 aa, Homo sapiens
  heavy chain complementarity determining region 3 for antibody 43765
ATKGYTVGGSGYYVAFDY

SEQ ID NO: 87531 - protein, 9 aa, Homo sapiens
  light chain complementarity determining region 3 for antibody 43766
LQHNSYPRT

SEQ ID NO: 87532 - protein, 13 aa, Homo sapiens
  heavy chain complementarity determining region 3 for antibody 43766
AREVSGYFSYFGL

SEQ ID NO: 87533 - protein, 9 aa, Homo sapiens
  light chain complementarity determining region 3 for antibody 43767
LQHNSNSLT

SEQ ID NO: 87534 - protein, 19 aa, Homo sapiens
  heavy chain complementarity determining region 3 for antibody 43767
ARDRGYCGSDSCLLYGFDV

SEQ ID NO: 87535 - protein, 9 aa, Homo sapiens
  light chain complementarity determining region 3 for antibody 43768
LQHKSFPLS

SEQ ID NO: 87536 - protein, 16 aa, Homo sapiens
  heavy chain complementarity determining region 3 for antibody 43768
ARVLTTVETPLLAFDV

SEQ ID NO: 87537 - protein, 9 aa, Homo sapiens
  light chain complementarity determining region 3 for antibody 43769
LQHESSPYT

SEQ ID NO: 87538 - protein, 16 aa, Homo sapiens
  heavy chain complementarity determining region 3 for antibody 43769
ARDGGHSYGSGLAFDI

SEQ ID NO: 87539 - protein, 9 aa, Homo sapiens
  light chain complementarity determining region 3 for antibody 43770
LQFQNVPLT

SEQ ID NO: 87540 - protein, 18 aa, Homo sapiens
  heavy chain complementarity determining region 3 for antibody 43770
IRGGRDSRGPLGYYNLGV

SEQ ID NO: 87541 - protein, 9 aa, Homo sapiens
  light chain complementarity determining region 3 for antibody 43771
LQDYSYPYT

SEQ ID NO: 87542 - protein, 15 aa, Homo sapiens
  heavy chain complementarity determining region 3 for antibody 43771
ARDRLVGTGKVAFDI

SEQ ID NO: 87543 - protein, 9 aa, Homo sapiens
  light chain complementarity determining region 3 for antibody 43772
LQDYNYPRT

SEQ ID NO: 87544 - protein, 12 aa, Homo sapiens
  heavy chain complementarity determining region 3 for antibody 43772
ARYNWVAWHFDF

SEQ ID NO: 87545 - protein, 9 aa, Homo sapiens
  light chain complementarity determining region 3 for antibody 43773
LQDYDYPYT

SEQ ID NO: 87546 - protein, 17 aa, Homo sapiens
  heavy chain complementarity determining region 3 for antibody 43773
ARVVRKWGTSVAGDFDS

SEQ ID NO: 87547 - protein, 9 aa, Homo sapiens
  light chain complementarity determining region 3 for antibody 43774
LQDHNYPIT

SEQ ID NO: 87548 - protein, 14 aa, Homo sapiens
  heavy chain complementarity determining region 3 for antibody 43774
ATLEGSAAAVVGDY

SEQ ID NO: 87549 - protein, 9 aa, Homo sapiens
  light chain complementarity determining region 3 for antibody 43775
KQALQTPYT

SEQ ID NO: 87550 - protein, 11 aa, Homo sapiens
  heavy chain complementarity determining region 3 for antibody 43775
ARRGLGDAFDV

SEQ ID NO: 87551 - protein, 9 aa, Homo sapiens
  light chain complementarity determining region 3 for antibody 43776
HQYSTSQGT

SEQ ID NO: 87552 - protein, 21 aa, Homo sapiens
  heavy chain complementarity determining region 3 for antibody 43776
ARGGRYFYHNTSYSYDFWFDP

SEQ ID NO: 87553 - protein, 10 aa, Homo sapiens
  light chain complementarity determining region 3 for antibody 43777
HQYNSYSPWT

SEQ ID NO: 87554 - protein, 17 aa, Homo sapiens
  heavy chain complementarity determining region 3 for antibody 43777
ANHPKGMSTNGLRPFDL

SEQ ID NO: 87555 - protein, 8 aa, Homo sapiens
  light chain complementarity determining region 3 for antibody 43778
HQYGSAIT

SEQ ID NO: 87556 - protein, 14 aa, Homo sapiens
  heavy chain complementarity determining region 3 for antibody 43778
ARWRHVGVLYYFDL

SEQ ID NO: 87557 - protein, 9 aa, Homo sapiens
  light chain complementarity determining region 3 for antibody 43779
HQYGRSPWT

SEQ ID NO: 87558 - protein, 13 aa, Homo sapiens
  heavy chain complementarity determining region 3 for antibody 43779
ARKKSLVAYTMDV

SEQ ID NO: 87559 - protein, 9 aa, Homo sapiens
  light chain complementarity determining region 3 for antibody 43780
HQYGNSPPT

SEQ ID NO: 87560 - protein, 15 aa, Homo sapiens
  heavy chain complementarity determining region 3 for antibody 43780
ARRISDDSGYHYADH

SEQ ID NO: 87561 - protein, 9 aa, Homo sapiens
  light chain complementarity determining region 3 for antibody 43781
HQTGSLPYT

SEQ ID NO: 87562 - protein, 15 aa, Homo sapiens
  heavy chain complementarity determining region 3 for antibody 43781
AKGDSGYESLGDFDY

SEQ ID NO: 87563 - protein, 9 aa, Homo sapiens
  light chain complementarity determining region 3 for antibody 43782
HQRSNWPPT

SEQ ID NO: 87564 - protein, 16 aa, Homo sapiens
  heavy chain complementarity determining region 3 for antibody 43782
ARNDYYASASHPLPDY

SEQ ID NO: 87565 - protein, 9 aa, Homo sapiens
  light chain complementarity determining region 3 for antibody 43783
HQRSEWPLT

SEQ ID NO: 87566 - protein, 18 aa, Homo sapiens
  heavy chain complementarity determining region 3 for antibody 43783
ARRRRHAADVAQNNWLDP

SEQ ID NO: 87567 - protein, 9 aa, Homo sapiens
  light chain complementarity determining region 3 for antibody 43784
HQRSDWPET

SEQ ID NO: 87568 - protein, 9 aa, Homo sapiens
  heavy chain complementarity determining region 3 for antibody 43784
ASGDYAFDL

SEQ ID NO: 87569 - protein, 9 aa, Homo sapiens
  light chain complementarity determining region 3 for antibody 43785
EQINSYPLT

SEQ ID NO: 87570 - protein, 13 aa, Homo sapiens
  heavy chain complementarity determining region 3 for antibody 43785
ARGGYNYFPHLDP

SEQ ID NO: 87571 - protein, 8 aa, Homo sapiens
  light chain complementarity determining region 3 for antibody 43786
VQALQSPT

SEQ ID NO: 87572 - protein, 13 aa, Homo sapiens
  heavy chain complementarity determining region 3 for antibody 43786
ARAPDSSGCPWDV

SEQ ID NO: 87573 - protein, 9 aa, Homo sapiens
  light chain complementarity determining region 3 for antibody 43787
RQSYTTPWT

SEQ ID NO: 87574 - protein, 12 aa, Homo sapiens
  heavy chain complementarity determining region 3 for antibody 43787
SRDPLSSNGPDY

SEQ ID NO: 87575 - protein, 9 aa, Homo sapiens
  light chain complementarity determining region 3 for antibody 43788
RQSYITPST

SEQ ID NO: 87576 - protein, 13 aa, Homo sapiens
  heavy chain complementarity determining region 3 for antibody 43788
AADEAGEDWYFEL

SEQ ID NO: 87577 - protein, 10 aa, Homo sapiens
  light chain complementarity determining region 3 for antibody 43789
QYYETSRGFT

SEQ ID NO: 87578 - protein, 9 aa, Homo sapiens
  heavy chain complementarity determining region 3 for antibody 43789
ARGSGWLHL

SEQ ID NO: 87579 - protein, 9 aa, Homo sapiens
  light chain complementarity determining region 3 for antibody 43790
QYYDILSGT

SEQ ID NO: 87580 - protein, 16 aa, Homo sapiens
  heavy chain complementarity determining region 3 for antibody 43790
ARDVWARWLLMGYFDY

SEQ ID NO: 87581 - protein, 9 aa, Homo sapiens
  light chain complementarity determining region 3 for antibody 43791
QYMNGTPLP

SEQ ID NO: 87582 - protein, 22 aa, Homo sapiens
  heavy chain complementarity determining region 3 for antibody 43791
ARSIKMIRGVQDGTTYDHGMDI

SEQ ID NO: 87583 - protein, 10 aa, Homo sapiens
  light chain complementarity determining region 3 for antibody 43792
QRYNSYPTWT

SEQ ID NO: 87584 - protein, 12 aa, Homo sapiens
  heavy chain complementarity determining region 3 for antibody 43792
ARVPPGAVPFDY

SEQ ID NO: 87585 - protein, 6 aa, Homo sapiens
  light chain complementarity determining region 3 for antibody 43793
QRYNGR

SEQ ID NO: 87586 - protein, 13 aa, Homo sapiens
  heavy chain complementarity determining region 3 for antibody 43793
ARDFAPDSVALAY

SEQ ID NO: 87587 - protein, 9 aa, Homo sapiens
  light chain complementarity determining region 3 for antibody 43794
QRYDGPPRT

SEQ ID NO: 87588 - protein, 14 aa, Homo sapiens
  heavy chain complementarity determining region 3 for antibody 43794
VKGVLAIPNTALGQ

SEQ ID NO: 87589 - protein, 9 aa, Homo sapiens
  light chain complementarity determining region 3 for antibody 43795
QRQNSAPFT

SEQ ID NO: 87590 - protein, 10 aa, Homo sapiens
  heavy chain complementarity determining region 3 for antibody 43795
ARDEGYFGTS

SEQ ID NO: 87591 - protein, 9 aa, Homo sapiens
  light chain complementarity determining region 3 for antibody 43796
QQYYSYPLT

SEQ ID NO: 87592 - protein, 10 aa, Homo sapiens
  heavy chain complementarity determining region 3 for antibody 43796
AKDTNYVIDY

SEQ ID NO: 87593 - protein, 9 aa, Homo sapiens
  light chain complementarity determining region 3 for antibody 43797
QQYYSYPLS

SEQ ID NO: 87594 - protein, 14 aa, Homo sapiens
  heavy chain complementarity determining region 3 for antibody 43797
AKDRHYSGYDDFDY

SEQ ID NO: 87595 - protein, 9 aa, Homo sapiens
  light chain complementarity determining region 3 for antibody 43798
QQYYSTPWT

SEQ ID NO: 87596 - protein, 12 aa, Homo sapiens
  heavy chain complementarity determining region 3 for antibody 43798
ARCRSYVNWFDP

SEQ ID NO: 87597 - protein, 9 aa, Homo sapiens
  light chain complementarity determining region 3 for antibody 43799
QQYYSSPFT

SEQ ID NO: 87598 - protein, 13 aa, Homo sapiens
  heavy chain complementarity determining region 3 for antibody 43799
ARGRNYDRDGLDP

SEQ ID NO: 87599 - protein, 9 aa, Homo sapiens
  light chain complementarity determining region 3 for antibody 43800
QQYYSLSFT

SEQ ID NO: 87600 - protein, 16 aa, Homo sapiens
  heavy chain complementarity determining region 3 for antibody 43800
ARDMARRSLGATAADY

SEQ ID NO: 87601 - protein, 9 aa, Homo sapiens
  light chain complementarity determining region 3 for antibody 43801
QQYYSKVLT

SEQ ID NO: 87602 - protein, 11 aa, Homo sapiens
  heavy chain complementarity determining region 3 for antibody 43801
VRVAHGDYFDY

SEQ ID NO: 87603 - protein, 8 aa, Homo sapiens
  light chain complementarity determining region 3 for antibody 43802
QQYYSCCT

SEQ ID NO: 87604 - protein, 14 aa, Homo sapiens
  heavy chain complementarity determining region 3 for antibody 43802
ARYTPIHGGYYFDY

SEQ ID NO: 87605 - protein, 9 aa, Homo sapiens
  light chain complementarity determining region 3 for antibody 43803
QQYYRSPDT

SEQ ID NO: 87606 - protein, 12 aa, Homo sapiens
  heavy chain complementarity determining region 3 for antibody 43803
ARLQPVDDAYDI

SEQ ID NO: 87607 - protein, 8 aa, Homo sapiens
  light chain complementarity determining region 3 for antibody 43804
QQYYNAVT

SEQ ID NO: 87608 - protein, 14 aa, Homo sapiens
  heavy chain complementarity determining region 3 for antibody 43804
AHKAAYATVRYFDY

SEQ ID NO: 87609 - protein, 9 aa, Homo sapiens
  light chain complementarity determining region 3 for antibody 43805
QQYYGTPWT

SEQ ID NO: 87610 - protein, 14 aa, Homo sapiens
  heavy chain complementarity determining region 3 for antibody 43805
VRGPYFGSGTYMVH

SEQ ID NO: 87611 - protein, 9 aa, Homo sapiens
  light chain complementarity determining region 3 for antibody 43806
QQYYDYPHT

SEQ ID NO: 87612 - protein, 13 aa, Homo sapiens
  heavy chain complementarity determining region 3 for antibody 43806
AKRNHPSGGSSDY

SEQ ID NO: 87613 - protein, 9 aa, Homo sapiens
  light chain complementarity determining region 3 for antibody 43807
QQYVSSPWT

SEQ ID NO: 87614 - protein, 14 aa, Homo sapiens
  heavy chain complementarity determining region 3 for antibody 43807
ASDPPGRYYGTFDL

SEQ ID NO: 87615 - protein, 8 aa, Homo sapiens
  light chain complementarity determining region 3 for antibody 43808
QQYVKSLT

SEQ ID NO: 87616 - protein, 15 aa, Homo sapiens
  heavy chain complementarity determining region 3 for antibody 43808
ARDDGNYYGSGSLDY

SEQ ID NO: 87617 - protein, 7 aa, Homo sapiens
  light chain complementarity determining region 3 for antibody 43809
QQYVGKM

SEQ ID NO: 87618 - protein, 13 aa, Homo sapiens
  heavy chain complementarity determining region 3 for antibody 43809
ARHDRTGLNFFDP

SEQ ID NO: 87619 - protein, 8 aa, Homo sapiens
  light chain complementarity determining region 3 for antibody 43810
QQYVFPFT

SEQ ID NO: 87620 - protein, 12 aa, Homo sapiens
  heavy chain complementarity determining region 3 for antibody 43810
ARAHSARWYAAY

SEQ ID NO: 87621 - protein, 9 aa, Homo sapiens
  light chain complementarity determining region 3 for antibody 43811
QQYTYWPKT

SEQ ID NO: 87622 - protein, 9 aa, Homo sapiens
  heavy chain complementarity determining region 3 for antibody 43811
ARGSSCPDY

SEQ ID NO: 87623 - protein, 8 aa, Homo sapiens
  light chain complementarity determining region 3 for antibody 43812
QQYSVYWT

SEQ ID NO: 87624 - protein, 17 aa, Homo sapiens
  heavy chain complementarity determining region 3 for antibody 43812
ASGAYDSGNKKTPGFDH

SEQ ID NO: 87625 - protein, 10 aa, Homo sapiens
  light chain complementarity determining region 3 for antibody 43813
QQYSTYAEFT

SEQ ID NO: 87626 - protein, 11 aa, Homo sapiens
  heavy chain complementarity determining region 3 for antibody 43813
ARTWGDYPFDS

SEQ ID NO: 87627 - protein, 10 aa, Homo sapiens
  light chain complementarity determining region 3 for antibody 43814
QQYSSYSPLT

SEQ ID NO: 87628 - protein, 14 aa, Homo sapiens
  heavy chain complementarity determining region 3 for antibody 43814
ARGPIEGAATPLDY

SEQ ID NO: 87629 - protein, 10 aa, Homo sapiens
  light chain complementarity determining region 3 for antibody 43815
QQYSSWPFLT

SEQ ID NO: 87630 - protein, 13 aa, Homo sapiens
  heavy chain complementarity determining region 3 for antibody 43815
ARLGPLSFGYLDS

SEQ ID NO: 87631 - protein, 10 aa, Homo sapiens
  light chain complementarity determining region 3 for antibody 43816
QQYSSSVPWT

SEQ ID NO: 87632 - protein, 16 aa, Homo sapiens
  heavy chain complementarity determining region 3 for antibody 43816
ARRQWVRGLFRGGLDS

SEQ ID NO: 87633 - protein, 9 aa, Homo sapiens
  light chain complementarity determining region 3 for antibody 43817
QQYSSSSRT

SEQ ID NO: 87634 - protein, 16 aa, Homo sapiens
  heavy chain complementarity determining region 3 for antibody 43817
AKGPCGDGGCYGRESE

SEQ ID NO: 87635 - protein, 10 aa, Homo sapiens
  light chain complementarity determining region 3 for antibody 43818
QQYSSSRALT

SEQ ID NO: 87636 - protein, 12 aa, Homo sapiens
  heavy chain complementarity determining region 3 for antibody 43818
ARDSFWGWGLAD

SEQ ID NO: 87637 - protein, 9 aa, Homo sapiens
  light chain complementarity determining region 3 for antibody 43819
QQYSSSLWT

SEQ ID NO: 87638 - protein, 19 aa, Homo sapiens
  heavy chain complementarity determining region 3 for antibody 43819
ARDDFHSDSSGGYFRFFDP

SEQ ID NO: 87639 - protein, 8 aa, Homo sapiens
  light chain complementarity determining region 3 for antibody 43820
QQYSSLWT

SEQ ID NO: 87640 - protein, 20 aa, Homo sapiens
  heavy chain complementarity determining region 3 for antibody 43820
ARPSEDALRWGLQGDWHYDL

SEQ ID NO: 87641 - protein, 8 aa, Homo sapiens
  light chain complementarity determining region 3 for antibody 43821
QQYSRHYT

SEQ ID NO: 87642 - protein, 15 aa, Homo sapiens
  heavy chain complementarity determining region 3 for antibody 43821
AREGYNNFWDGFWFH

SEQ ID NO: 87643 - protein, 9 aa, Homo sapiens
  light chain complementarity determining region 3 for antibody 43822
QQYSNTPYT

SEQ ID NO: 87644 - protein, 14 aa, Homo sapiens
  heavy chain complementarity determining region 3 for antibody 43822
ARGGRLATADKFDF

SEQ ID NO: 87645 - protein, 8 aa, Homo sapiens
  light chain complementarity determining region 3 for antibody 43823
QQYSLYWA

SEQ ID NO: 87646 - protein, 15 aa, Homo sapiens
  heavy chain complementarity determining region 3 for antibody 43823
ARAVPDYGDYGYFDY

SEQ ID NO: 87647 - protein, 9 aa, Homo sapiens
  light chain complementarity determining region 3 for antibody 43824
QQYRVLPRT

SEQ ID NO: 87648 - protein, 10 aa, Homo sapiens
  heavy chain complementarity determining region 3 for antibody 43824
ARDTYGYFDY

SEQ ID NO: 87649 - protein, 8 aa, Homo sapiens
  light chain complementarity determining region 3 for antibody 43825
QQYRNLFS

SEQ ID NO: 87650 - protein, 11 aa, Homo sapiens
  heavy chain complementarity determining region 3 for antibody 43825
AREGRGYAFDI

SEQ ID NO: 87651 - protein, 9 aa, Homo sapiens
  light chain complementarity determining region 3 for antibody 43826
QQYNTYSSA

SEQ ID NO: 87652 - protein, 11 aa, Homo sapiens
  heavy chain complementarity determining region 3 for antibody 43826
ARRTFLRGYGI

SEQ ID NO: 87653 - protein, 9 aa, Homo sapiens
  light chain complementarity determining region 3 for antibody 43827
QQYNTYSGA

SEQ ID NO: 87654 - protein, 13 aa, Homo sapiens
  heavy chain complementarity determining region 3 for antibody 43827
ARVRNGGLSYFDY

SEQ ID NO: 87655 - protein, 10 aa, Homo sapiens
  light chain complementarity determining region 3 for antibody 43828
QQYNTWPPLT

SEQ ID NO: 87656 - protein, 14 aa, Homo sapiens
  heavy chain complementarity determining region 3 for antibody 43828
ARSMWAAPGTPPAS

SEQ ID NO: 87657 - protein, 8 aa, Homo sapiens
  light chain complementarity determining region 3 for antibody 43829
QQYNTHST

SEQ ID NO: 87658 - protein, 13 aa, Homo sapiens
  heavy chain complementarity determining region 3 for antibody 43829
AGHQQTWGGLISP

SEQ ID NO: 87659 - protein, 9 aa, Homo sapiens
  light chain complementarity determining region 3 for antibody 43830
QQYNSYSRT

SEQ ID NO: 87660 - protein, 9 aa, Homo sapiens
  heavy chain complementarity determining region 3 for antibody 43830
GRDYPGTPV

SEQ ID NO: 87661 - protein, 9 aa, Homo sapiens
  light chain complementarity determining region 3 for antibody 43831
QQYNSYSRT

SEQ ID NO: 87662 - protein, 19 aa, Homo sapiens
  heavy chain complementarity determining region 3 for antibody 43831
ARHEKYCSGGSCHPAYFNY

SEQ ID NO: 87663 - protein, 9 aa, Homo sapiens
  light chain complementarity determining region 3 for antibody 43832
QQYNSYSPV

SEQ ID NO: 87664 - protein, 16 aa, Homo sapiens
  heavy chain complementarity determining region 3 for antibody 43832
ARSKQVIPAARGAFDI

SEQ ID NO: 87665 - protein, 8 aa, Homo sapiens
  light chain complementarity determining region 3 for antibody 43833
QQYNSYRT

SEQ ID NO: 87666 - protein, 9 aa, Homo sapiens
  heavy chain complementarity determining region 3 for antibody 43833
ARGHYGLED

SEQ ID NO: 87667 - protein, 9 aa, Homo sapiens
  light chain complementarity determining region 3 for antibody 43834
QQYNSYPWT

SEQ ID NO: 87668 - protein, 15 aa, Homo sapiens
  heavy chain complementarity determining region 3 for antibody 43834
SRAGSRLLRFHAFDI

SEQ ID NO: 87669 - protein, 8 aa, Homo sapiens
  light chain complementarity determining region 3 for antibody 43835
QQYNSYPS

SEQ ID NO: 87670 - protein, 17 aa, Homo sapiens
  heavy chain complementarity determining region 3 for antibody 43835
VHSGYYYDSSAYYYPDY

SEQ ID NO: 87671 - protein, 9 aa, Homo sapiens
  light chain complementarity determining region 3 for antibody 43836
QQYNSYPLT

SEQ ID NO: 87672 - protein, 16 aa, Homo sapiens
  heavy chain complementarity determining region 3 for antibody 43836
ARAAYSSDWTPLFFDY

SEQ ID NO: 87673 - protein, 9 aa, Homo sapiens
  light chain complementarity determining region 3 for antibody 43837
QQYNSYPIT

SEQ ID NO: 87674 - protein, 14 aa, Homo sapiens
  heavy chain complementarity determining region 3 for antibody 43837
ARFVRSPYRPYFDY

SEQ ID NO: 87675 - protein, 9 aa, Homo sapiens
  light chain complementarity determining region 3 for antibody 43838
QQYNSYPFT

SEQ ID NO: 87676 - protein, 19 aa, Homo sapiens
  heavy chain complementarity determining region 3 for antibody 43838
VRESPGEDRLPALLDGFDI

SEQ ID NO: 87677 - protein, 9 aa, Homo sapiens
  light chain complementarity determining region 3 for antibody 43839
QQYNSYLFT

SEQ ID NO: 87678 - protein, 16 aa, Homo sapiens
  heavy chain complementarity determining region 3 for antibody 43839
ARMQPIRLGAPDAFDI

SEQ ID NO: 87679 - protein, 9 aa, Homo sapiens
  light chain complementarity determining region 3 for antibody 43840
QQYNSYAYT

SEQ ID NO: 87680 - protein, 16 aa, Homo sapiens
  heavy chain complementarity determining region 3 for antibody 43840
ARGGGLTVGAPDAFDI

SEQ ID NO: 87681 - protein, 9 aa, Homo sapiens
  light chain complementarity determining region 3 for antibody 43841
QQYNSWPRT

SEQ ID NO: 87682 - protein, 13 aa, Homo sapiens
  heavy chain complementarity determining region 3 for antibody 43841
ARSYTYGLRAFDY

SEQ ID NO: 87683 - protein, 9 aa, Homo sapiens
  light chain complementarity determining region 3 for antibody 43842
QQYNSHPRT

SEQ ID NO: 87684 - protein, 15 aa, Homo sapiens
  heavy chain complementarity determining region 3 for antibody 43842
ARDSIAVAGKDAFDI

SEQ ID NO: 87685 - protein, 8 aa, Homo sapiens
  light chain complementarity determining region 3 for antibody 43843
QQYNSFST

SEQ ID NO: 87686 - protein, 13 aa, Homo sapiens
  heavy chain complementarity determining region 3 for antibody 43843
ARGRGSGNDAFDF

SEQ ID NO: 87687 - protein, 10 aa, Homo sapiens
  light chain complementarity determining region 3 for antibody 43844
QQYNNWPPYT

SEQ ID NO: 87688 - protein, 15 aa, Homo sapiens
  heavy chain complementarity determining region 3 for antibody 43844
AKGPYFDWFMRYFDY

SEQ ID NO: 87689 - protein, 10 aa, Homo sapiens [sequence omitted]

SEQ ID NO: 87690 - protein, 10 aa, Homo sapiens
  heavy chain complementarity determining region 3 for antibody 43845
ARRAMGEFDS

SEQ ID NO: 87691 - protein, 10 aa, Homo sapiens [sequence omitted]

SEQ ID NO: 87692 - protein, 18 aa, Homo sapiens
  heavy chain complementarity determining region 3 for antibody 43846
ARGGPMVRGVVGGVAFDL

SEQ ID NO: 87693 - protein, 10 aa, Homo sapiens [sequence omitted]

SEQ ID NO: 87694 - protein, 14 aa, Homo sapiens
  heavy chain complementarity determining region 3 for antibody 43847
ARDLRETMAGEFAF

SEQ ID NO: 87695 - protein, 9 aa, Homo sapiens
  light chain complementarity determining region 3 for antibody 43848
QQYNNWPLT

SEQ ID NO: 87696 - protein, 15 aa, Homo sapiens
  heavy chain complementarity determining region 3 for antibody 43848
AKVPYHGSGSAIFGI

SEQ ID NO: 87697 - protein, 9 aa, Homo sapiens
  light chain complementarity determining region 3 for antibody 43849
QQYNLYPLT

SEQ ID NO: 87698 - protein, 16 aa, Homo sapiens
  heavy chain complementarity determining region 3 for antibody 43849
ARHRAEQSLGNDAFEI

SEQ ID NO: 87699 - protein, 8 aa, Homo sapiens
  light chain complementarity determining region 3 for antibody 43850
QQYNDYST

SEQ ID NO: 87700 - protein, 23 aa, Homo sapiens
  heavy chain complementarity determining region 3 for antibody 43850
ARGEGIGGSAGFFHYYYYYGMDV

SEQ ID NO: 87701 - protein, 8 aa, Homo sapiens
  light chain complementarity determining region 3 for antibody 43851
QQYNDYST

SEQ ID NO: 87702 - protein, 17 aa, Homo sapiens
  heavy chain complementarity determining region 3 for antibody 43851
ARAVGYYDSSGYRYFDY

SEQ ID NO: 87703 - protein, 10 aa, Homo sapiens
  light chain complementarity determining region 3 for antibody 43852
QQYNAYSGET

SEQ ID NO: 87704 - protein, 15 aa, Homo sapiens
  heavy chain complementarity determining region 3 for antibody 43852
ARSPGRFGLTDYFDY

SEQ ID NO: 87705 - protein, 8 aa, Homo sapiens
  light chain complementarity determining region 3 for antibody 43853
QQYKTYPS

SEQ ID NO: 87706 - protein, 19 aa, Homo sapiens
  heavy chain complementarity determining region 3 for antibody 43853
VRVDPNWGPNSPRFWYFDL

SEQ ID NO: 87707 - protein, 9 aa, Homo sapiens
  light chain complementarity determining region 3 for antibody 43854
QQYKSYSYT

SEQ ID NO: 87708 - protein, 13 aa, Homo sapiens
  heavy chain complementarity determining region 3 for antibody 43854
ARARDSYNLYFDY

SEQ ID NO: 87709 - protein, 9 aa, Homo sapiens
  light chain complementarity determining region 3 for antibody 43855
QQYKSYSSS

SEQ ID NO: 87710 - protein, 22 aa, Homo sapiens
  heavy chain complementarity determining region 3 for antibody 43855
VTDRVFSRGTNGGTYYPGVLIE

SEQ ID NO: 87711 - protein, 9 aa, Homo sapiens
  light chain complementarity determining region 3 for antibody 43856
QQYKSYPLT

SEQ ID NO: 87712 - protein, 14 aa, Homo sapiens
  heavy chain complementarity determining region 3 for antibody 43856
ARDGGRDGYSNPDY

SEQ ID NO: 87713 - protein, 9 aa, Homo sapiens
  light chain complementarity determining region 3 for antibody 43857
QQYKSFPLT

SEQ ID NO: 87714 - protein, 12 aa, Homo sapiens
  heavy chain complementarity determining region 3 for antibody 43857
TRSPRGDYFFEY

SEQ ID NO: 87715 - protein, 9 aa, Homo sapiens
  light chain complementarity determining region 3 for antibody 43858
QQYKNYPLT

SEQ ID NO: 87716 - protein, 12 aa, Homo sapiens
  heavy chain complementarity determining region 3 for antibody 43858
ATGPTVTTGFDF

SEQ ID NO: 87717 - protein, 8 aa, Homo sapiens
  light chain complementarity determining region 3 for antibody 43859
QQYHTYWT

SEQ ID NO: 87718 - protein, 15 aa, Homo sapiens
  heavy chain complementarity determining region 3 for antibody 43859
ARLKPGILPNDAFDI

SEQ ID NO: 87719 - protein, 9 aa, Homo sapiens
  light chain complementarity determining region 3 for antibody 43860
QQYHSYTWT

SEQ ID NO: 87720 - protein, 20 aa, Homo sapiens
  heavy chain complementarity determining region 3 for antibody 43860
ARGEHIVVLTSSMGSFVMDV

SEQ ID NO: 87721 - protein, 9 aa, Homo sapiens
  light chain complementarity determining region 3 for antibody 43861
QQYHSNPPT

SEQ ID NO: 87722 - protein, 18 aa, Homo sapiens
  heavy chain complementarity determining region 3 for antibody 43861
AKSSVEYMVRGGVDSFDI

SEQ ID NO: 87723 - protein, 9 aa, Homo sapiens
  light chain complementarity determining region 3 for antibody 43862
QQYHNLPIT

SEQ ID NO: 87724 - protein, 19 aa, Homo sapiens
  heavy chain complementarity determining region 3 for antibody 43862
AGKFDYETGVYSPEYHFDS

SEQ ID NO: 87725 - protein, 8 aa, Homo sapiens
  light chain complementarity determining region 3 for antibody 43863
QQYHHYIT

SEQ ID NO: 87726 - protein, 18 aa, Homo sapiens
  heavy chain complementarity determining region 3 for antibody 43863
ARTYGSGTRKELYSGMDV

SEQ ID NO: 87727 - protein, 8 aa, Homo sapiens
  light chain complementarity determining region 3 for antibody 43864
QQYHDLHS

SEQ ID NO: 87728 - protein, 13 aa, Homo sapiens
  heavy chain complementarity determining region 3 for antibody 43864
ARQSAWFLGAFDI

SEQ ID NO: 87729 - protein, 9 aa, Homo sapiens
  light chain complementarity determining region 3 for antibody 43865
QQYGYPPYT

SEQ ID NO: 87730 - protein, 18 aa, Homo sapiens
  heavy chain complementarity determining region 3 for antibody 43865
ARAYPFISIWYAYDAFDV

SEQ ID NO: 87731 - protein, 8 aa, Homo sapiens
  light chain complementarity determining region 3 for antibody 43866
QQYGTSPT

SEQ ID NO: 87732 - protein, 15 aa, Homo sapiens
  heavy chain complementarity determining region 3 for antibody 43866
ARASSGQNSSWFYDY

SEQ ID NO: 87733 - protein, 8 aa, Homo sapiens
  light chain complementarity determining region 3 for antibody 43867
QQYGTSPT

SEQ ID NO: 87734 - protein, 16 aa, Homo sapiens
  heavy chain complementarity determining region 3 for antibody 43867
AKAGDSSSWFSTYFDS

SEQ ID NO: 87735 - protein, 9 aa, Homo sapiens
  light chain complementarity determining region 3 for antibody 43868
QQYGTSPLT

SEQ ID NO: 87736 - protein, 13 aa, Homo sapiens
  heavy chain complementarity determining region 3 for antibody 43868
ARVDRGWYEGFDL

SEQ ID NO: 87737 - protein, 9 aa, Homo sapiens
  light chain complementarity determining region 3 for antibody 43869
QQYGSSSRA

SEQ ID NO: 87738 - protein, 18 aa, Homo sapiens
  heavy chain complementarity determining region 3 for antibody 43869
ARLGVGLVVPVAIGGMDV

SEQ ID NO: 87739 - protein, 9 aa, Homo sapiens
  light chain complementarity determining region 3 for antibody 43870
QQYGSSQWT

SEQ ID NO: 87740 - protein, 26 aa, Homo sapiens
  heavy chain complementarity determining region 3 for antibody 43870
ARDHFLGEYDDEDNIYSPGFPTGMDV

SEQ ID NO: 87741 - protein, 9 aa, Homo sapiens
  light chain complementarity determining region 3 for antibody 43871
QQYGSSPYT

SEQ ID NO: 87742 - protein, 10 aa, Homo sapiens
  heavy chain complementarity determining region 3 for antibody 43871
ARSSSGWYLY

SEQ ID NO: 87743 - protein, 9 aa, Homo sapiens
  light chain complementarity determining region 3 for antibody 43872
QQYGSSPYT

SEQ ID NO: 87744 - protein, 11 aa, Homo sapiens
  heavy chain complementarity determining region 3 for antibody 43872
ARFYYASGFDS

SEQ ID NO: 87745 - protein, 9 aa, Homo sapiens
  light chain complementarity determining region 3 for antibody 43873
QQYGSSPYT

SEQ ID NO: 87746 - protein, 16 aa, Homo sapiens
  heavy chain complementarity determining region 3 for antibody 43873
ARDQSGGWQRLGGFDP

SEQ ID NO: 87747 - protein, 9 aa, Homo sapiens
  light chain complementarity determining region 3 for antibody 43874
QQYGSSPWT

SEQ ID NO: 87748 - protein, 13 aa, Homo sapiens
  heavy chain complementarity determining region 3 for antibody 43874
ARAEGIVGATIDY

SEQ ID NO: 87749 - protein, 9 aa, Homo sapiens
  light chain complementarity determining region 3 for antibody 43875
QQYGSSPRT

SEQ ID NO: 87750 - protein, 18 aa, Homo sapiens
  heavy chain complementarity determining region 3 for antibody 43875
ARVFTEVKGLTTIGGFDY

SEQ ID NO: 87751 - protein, 9 aa, Homo sapiens
  light chain complementarity determining region 3 for antibody 43876
QQYGSSPRT

SEQ ID NO: 87752 - protein, 20 aa, Homo sapiens
  heavy chain complementarity determining region 3 for antibody 43876
ARTSRCGAGDCFYYYYAMDV

SEQ ID NO: 87753 - protein, 10 aa, Homo sapiens
  light chain complementarity determining region 3 for antibody 43877
QQYGSSPPYT

SEQ ID NO: 87754 - protein, 15 aa, Homo sapiens
  heavy chain complementarity determining region 3 for antibody 43877
ARRQFTGNYHDAYYL

SEQ ID NO: 87755 - protein, 10 aa, Homo sapiens
  light chain complementarity determining region 3 for antibody 43878
QQYGSSPPWT

SEQ ID NO: 87756 - protein, 15 aa, Homo sapiens
  heavy chain complementarity determining region 3 for antibody 43878
ARDSFDGSYSGSFDY

SEQ ID NO: 87757 - protein, 11 aa, Homo sapiens
  light chain complementarity determining region 3 for antibody 43879
QQYGSSPPMYT

SEQ ID NO: 87758 - protein, 11 aa, Homo sapiens
  heavy chain complementarity determining region 3 for antibody 43879
ARSDGAVAGGH

SEQ ID NO: 87759 - protein, 10 aa, Homo sapiens
  light chain complementarity determining region 3 for antibody 43880
QQYGSSPLYI

SEQ ID NO: 87760 - protein, 11 aa, Homo sapiens
  heavy chain complementarity determining region 3 for antibody 43880
ARGSTLRYFDQ

SEQ ID NO: 87761 - protein, 9 aa, Homo sapiens
  light chain complementarity determining region 3 for antibody 43881
QQYGSSPLT

SEQ ID NO: 87762 - protein, 10 aa, Homo sapiens
  heavy chain complementarity determining region 3 for antibody 43881
AMEFYSWFDS

SEQ ID NO: 87763 - protein, 9 aa, Homo sapiens
  light chain complementarity determining region 3 for antibody 43882
QQYGSSPGT

SEQ ID NO: 87764 - protein, 22 aa, Homo sapiens
  heavy chain complementarity determining region 3 for antibody 43882
ARGEYSNHGSDYLWLTAEYFQN

SEQ ID NO: 87765 - protein, 9 aa, Homo sapiens
  light chain complementarity determining region 3 for antibody 43883
QQYGSSPFT

SEQ ID NO: 87766 - protein, 15 aa, Homo sapiens
  heavy chain complementarity determining region 3 for antibody 43883
ARDPDCGSVSCYYAY

SEQ ID NO: 87767 - protein, 8 aa, Homo sapiens
  light chain complementarity determining region 3 for antibody 43884
QQYGSSFT

SEQ ID NO: 87768 - protein, 15 aa, Homo sapiens
  heavy chain complementarity determining region 3 for antibody 43884
TTGDLYYQEENYFDY

SEQ ID NO: 87769 - protein, 8 aa, Homo sapiens
  light chain complementarity determining region 3 for antibody 43885
QQYGSSAT

SEQ ID NO: 87770 - protein, 23 aa, Homo sapiens
  heavy chain complementarity determining region 3 for antibody 43885
ARENYKVLLWMRDKKPRRGGMDV

SEQ ID NO: 87771 - protein, 9 aa, Homo sapiens
  light chain complementarity determining region 3 for antibody 43886
QQYGSFPYS

SEQ ID NO: 87772 - protein, 17 aa, Homo sapiens
  heavy chain complementarity determining region 3 for antibody 43886
AREAFDSDVDDFHGLDV

SEQ ID NO: 87773 - protein, 9 aa, Homo sapiens
  light chain complementarity determining region 3 for antibody 43887
QQYGRSPRP

SEQ ID NO: 87774 - protein, 15 aa, Homo sapiens
  heavy chain complementarity determining region 3 for antibody 43887
AKDGEFCGSNCYFGS

SEQ ID NO: 87775 - protein, 9 aa, Homo sapiens
  light chain complementarity determining region 3 for antibody 43888
QQYGRSPGT

SEQ ID NO: 87776 - protein, 22 aa, Homo sapiens
  heavy chain complementarity determining region 3 for antibody 43888
ARGEYSYDGSDYLWLEVEYFQH

SEQ ID NO: 87777 - protein, 9 aa, Homo sapiens
  light chain complementarity determining region 3 for antibody 43889
QQYGNSSYT

SEQ ID NO: 87778 - protein, 14 aa, Homo sapiens
  heavy chain complementarity determining region 3 for antibody 43889
ATWGKTPMAGYGDF

SEQ ID NO: 87779 - protein, 9 aa, Homo sapiens
  light chain complementarity determining region 3 for antibody 43890
QQYGNSPYT

SEQ ID NO: 87780 - protein, 14 aa, Homo sapiens
  heavy chain complementarity determining region 3 for antibody 43890
AKRDGAYYGHGFDY

SEQ ID NO: 87781 - protein, 10 aa, Homo sapiens
  light chain complementarity determining region 3 for antibody 43891
QQYGNSPLYT

SEQ ID NO: 87782 - protein, 20 aa, Homo sapiens
  heavy chain complementarity determining region 3 for antibody 43891
ARDMEWLATFQMSYYNALDV

SEQ ID NO: 87783 - protein, 9 aa, Homo sapiens
  light chain complementarity determining region 3 for antibody 43892
QQYGNSAIS

SEQ ID NO: 87784 - protein, 9 aa, Homo sapiens
  heavy chain complementarity determining region 3 for antibody 43892
GLFSGGRDY

SEQ ID NO: 87785 - protein, 9 aa, Homo sapiens
  light chain complementarity determining region 3 for antibody 43893
QQYGISPQT

SEQ ID NO: 87786 - protein, 18 aa, Homo sapiens
  heavy chain complementarity determining region 3 for antibody 43893
ARPQVYDSSDRYLYYFDF

SEQ ID NO: 87787 - protein, 9 aa, Homo sapiens
  light chain complementarity determining region 3 for antibody 43894
QQYGGSPLT

SEQ ID NO: 87788 - protein, 15 aa, Homo sapiens
  heavy chain complementarity determining region 3 for antibody 43894
ARVQWEWLTNPPFDS

SEQ ID NO: 87789 - protein, 10 aa, Homo sapiens
  light chain complementarity determining region 3 for antibody 43895
QQYGGSIPLT

SEQ ID NO: 87790 - protein, 12 aa, Homo sapiens
  heavy chain complementarity determining region 3 for antibody 43895
MRVLDSRSAGFH

SEQ ID NO: 87791 - protein, 9 aa, Homo sapiens
  light chain complementarity determining region 3 for antibody 43896
QQYGDSPWT

SEQ ID NO: 87792 - protein, 13 aa, Homo sapiens
  heavy chain complementarity determining region 3 for antibody 43896
ARPFVPGFSGYAH

SEQ ID NO: 87793 - protein, 9 aa, Homo sapiens
  light chain complementarity determining region 3 for antibody 43897
QQYGDSPIT

SEQ ID NO: 87794 - protein, 13 aa, Homo sapiens
  heavy chain complementarity determining region 3 for antibody 43897
ARSQLLNLDAFDF

SEQ ID NO: 87795 - protein, 9 aa, Homo sapiens
  light chain complementarity determining region 3 for antibody 43898
QQYGDSPAT

SEQ ID NO: 87796 - protein, 20 aa, Homo sapiens
  heavy chain complementarity determining region 3 for antibody 43898
ARSYSSGWYEDGDYYYALGG

SEQ ID NO: 87797 - protein, 9 aa, Homo sapiens
  light chain complementarity determining region 3 for antibody 43899
QQYGDSLFT

SEQ ID NO: 87798 - protein, 18 aa, Homo sapiens
  heavy chain complementarity determining region 3 for antibody 43899
ARVPRQTMVGATRYYFDY

SEQ ID NO: 87799 - protein, 9 aa, Homo sapiens
  light chain complementarity determining region 3 for antibody 43900
QQYGASPWA

SEQ ID NO: 87800 - protein, 11 aa, Homo sapiens
  heavy chain complementarity determining region 3 for antibody 43900
ARKGFQAPLDV

SEQ ID NO: 87801 - protein, 10 aa, Homo sapiens
  light chain complementarity determining region 3 for antibody 43901
QQYETYSEDT

SEQ ID NO: 87802 - protein, 18 aa, Homo sapiens
  heavy chain complementarity determining region 3 for antibody 43901
ARGKGGRGSTWFPYYFDN

SEQ ID NO: 87803 - protein, 9 aa, Homo sapiens
  light chain complementarity determining region 3 for antibody 43902
QQYENVPLT

SEQ ID NO: 87804 - protein, 17 aa, Homo sapiens
  heavy chain complementarity determining region 3 for antibody 43902
VRGSWQWMVPDVYSVDY

SEQ ID NO: 87805 - protein, 9 aa, Homo sapiens
  light chain complementarity determining region 3 for antibody 43903
QQYENSLWT

SEQ ID NO: 87806 - protein, 12 aa, Homo sapiens
  heavy chain complementarity determining region 3 for antibody 43903
ARDFGFYQAPVS

SEQ ID NO: 87807 - protein, 9 aa, Homo sapiens
  light chain complementarity determining region 3 for antibody 43904
QQYDTYSYT

SEQ ID NO: 87808 - protein, 16 aa, Homo sapiens
  heavy chain complementarity determining region 3 for antibody 43904
ARLSKLVPGSKNGFDI

SEQ ID NO: 87809 - protein, 9 aa, Homo sapiens
  light chain complementarity determining region 3 for antibody 43905
QQYDSYSWT

SEQ ID NO: 87810 - protein, 16 aa, Homo sapiens
  heavy chain complementarity determining region 3 for antibody 43905
AKGGRLGELFSPAFQH

SEQ ID NO: 87811 - protein, 11 aa, Homo sapiens
  light chain complementarity determining region 3 for antibody 43906
QQYDSFSPRIS

SEQ ID NO: 87812 - protein, 21 aa, Homo sapiens
  heavy chain complementarity determining region 3 for antibody 43906
ARLSEVLVPASRQQYFYGFDV

SEQ ID NO: 87813 - protein, 8 aa, Homo sapiens
  light chain complementarity determining region 3 for antibody 43907
QQYDRYPS

SEQ ID NO: 87814 - protein, 15 aa, Homo sapiens
  heavy chain complementarity determining region 3 for antibody 43907
AKRGDDGRYPGYFDL

SEQ ID NO: 87815 - protein, 9 aa, Homo sapiens
  light chain complementarity determining region 3 for antibody 43908
QQYDNSPRT

SEQ ID NO: 87816 - protein, 21 aa, Homo sapiens
  heavy chain complementarity determining region 3 for antibody 43908
SRESEYFDILTTSWTVDGFDI

SEQ ID NO: 87817 - protein, 9 aa, Homo sapiens
  light chain complementarity determining region 3 for antibody 43909
QQYDNLPPG

SEQ ID NO: 87818 - protein, 10 aa, Homo sapiens
  heavy chain complementarity determining region 3 for antibody 43909
AREVRGNTDF

SEQ ID NO: 87819 - protein, 9 aa, Homo sapiens
  light chain complementarity determining region 3 for antibody 43910
QQYDNLPLT

SEQ ID NO: 87820 - protein, 15 aa, Homo sapiens
  heavy chain complementarity determining region 3 for antibody 43910
ARTLDTSGWYWYFDL

SEQ ID NO: 87821 - protein, 9 aa, Homo sapiens
  light chain complementarity determining region 3 for antibody 43911
QQYDNIPRT

SEQ ID NO: 87822 - protein, 15 aa, Homo sapiens
  heavy chain complementarity determining region 3 for antibody 43911
AKDGYSGNYWGRGDF

SEQ ID NO: 87823 - protein, 9 aa, Homo sapiens
  light chain complementarity determining region 3 for antibody 43912
QQYDLLPPT

SEQ ID NO: 87824 - protein, 21 aa, Homo sapiens
  heavy chain complementarity determining region 3 for antibody 43912
ARGLHIVVVTSILRGFWYFGL

SEQ ID NO: 87825 - protein, 9 aa, Homo sapiens
  light chain complementarity determining region 3 for antibody 43913
QQYDGSSYS

SEQ ID NO: 87826 - protein, 15 aa, Homo sapiens
  heavy chain complementarity determining region 3 for antibody 43913
ARRKDLDWPLGALDL

SEQ ID NO: 87827 - protein, 9 aa, Homo sapiens
  light chain complementarity determining region 3 for antibody 43914
QQYDDVPLT

SEQ ID NO: 87828 - protein, 15 aa, Homo sapiens
  heavy chain complementarity determining region 3 for antibody 43914
GRHRHIVLVTTGMDV

SEQ ID NO: 87829 - protein, 9 aa, Homo sapiens
  light chain complementarity determining region 3 for antibody 43915
QQYDDLPYT

SEQ ID NO: 87830 - protein, 12 aa, Homo sapiens
  heavy chain complementarity determining region 3 for antibody 43915
GRDGAGRRRIDA

SEQ ID NO: 87831 - protein, 9 aa, Homo sapiens
  light chain complementarity determining region 3 for antibody 43916
QQYANSPGT

SEQ ID NO: 87832 - protein, 22 aa, Homo sapiens
  heavy chain complementarity determining region 3 for antibody 43916
AGGEYSYDGSDYLWLPAEYFQH

SEQ ID NO: 87833 - protein, 9 aa, Homo sapiens
  light chain complementarity determining region 3 for antibody 43917
QQVKDYPIT

SEQ ID NO: 87834 - protein, 16 aa, Homo sapiens
  heavy chain complementarity determining region 3 for antibody 43917
ARVVAKSVLAQPPNDY

SEQ ID NO: 87835 - protein, 11 aa, Homo sapiens
  light chain complementarity determining region 3 for antibody 43918
QQVDYFPPRWA

SEQ ID NO: 87836 - protein, 14 aa, Homo sapiens
  heavy chain complementarity determining region 3 for antibody 43918
ARGRQLGTGWYFDV

SEQ ID NO: 87837 - protein, 10 aa, Homo sapiens
  light chain complementarity determining region 3 for antibody 43919
QQTYTTPRVT

SEQ ID NO: 87838 - protein, 17 aa, Homo sapiens
  heavy chain complementarity determining region 3 for antibody 43919
ARALLYGYRGHYAAFDV

SEQ ID NO: 87839 - protein, 9 aa, Homo sapiens
  light chain complementarity determining region 3 for antibody 43920
QQTYSTTWT

SEQ ID NO: 87840 - protein, 13 aa, Homo sapiens
  heavy chain complementarity determining region 3 for antibody 43920
ATFRRYSSLRRIF

SEQ ID NO: 87841 - protein, 9 aa, Homo sapiens
  light chain complementarity determining region 3 for antibody 43921
QQTYSDSLT

SEQ ID NO: 87842 - protein, 19 aa, Homo sapiens
  heavy chain complementarity determining region 3 for antibody 43921
AHRGNYYDSSGYLNDAFDI

SEQ ID NO: 87843 - protein, 9 aa, Homo sapiens
  light chain complementarity determining region 3 for antibody 43922
QQTYRTPLT

SEQ ID NO: 87844 - protein, 16 aa, Homo sapiens
  heavy chain complementarity determining region 3 for antibody 43922
ARLRQRVIRRWYGLDV

SEQ ID NO: 87845 - protein, 9 aa, Homo sapiens
  light chain complementarity determining region 3 for antibody 43923
QQSYTTVLA

SEQ ID NO: 87846 - protein, 16 aa, Homo sapiens
  heavy chain complementarity determining region 3 for antibody 43923
TRDRPQWDTCSDEVPI

SEQ ID NO: 87847 - protein, 9 aa, Homo sapiens
  light chain complementarity determining region 3 for antibody 43924
QQSYTTPNT

SEQ ID NO: 87848 - protein, 17 aa, Homo sapiens
  heavy chain complementarity determining region 3 for antibody 43924
ARARQQFGELSSNYFDY

SEQ ID NO: 87849 - protein, 9 aa, Homo sapiens
  light chain complementarity determining region 3 for antibody 43925
QQSYTTPLT

SEQ ID NO: 87850 - protein, 17 aa, Homo sapiens
  heavy chain complementarity determining region 3 for antibody 43925
AKDLIWNGDGYFYGMDV

SEQ ID NO: 87851 - protein, 9 aa, Homo sapiens
  light chain complementarity determining region 3 for antibody 43926
QQSYTNPFT

SEQ ID NO: 87852 - protein, 15 aa, Homo sapiens
  heavy chain complementarity determining region 3 for antibody 43926
ARSAEAVSGPAAFDS

SEQ ID NO: 87853 - protein, 9 aa, Homo sapiens
  light chain complementarity determining region 3 for antibody 43927
QQSYSVPLS

SEQ ID NO: 87854 - protein, 14 aa, Homo sapiens
  heavy chain complementarity determining region 3 for antibody 43927
ARHDYGDYLSGIDY

SEQ ID NO: 87855 - protein, 9 aa, Homo sapiens
  light chain complementarity determining region 3 for antibody 43928
QQSYSTPYT

SEQ ID NO: 87856 - protein, 18 aa, Homo sapiens
  heavy chain complementarity determining region 3 for antibody 43928
ARDTFPGDRTPSTHHSDC

SEQ ID NO: 87857 - protein, 9 aa, Homo sapiens
  light chain complementarity determining region 3 for antibody 43929
QQSYSTPYT

SEQ ID NO: 87858 - protein, 10 aa, Homo sapiens
  heavy chain complementarity determining region 3 for antibody 43929
ARDFYGSIDY

SEQ ID NO: 87859 - protein, 9 aa, Homo sapiens
  light chain complementarity determining region 3 for antibody 43930
QQSYSTPYT

SEQ ID NO: 87860 - protein, 10 aa, Homo sapiens
  heavy chain complementarity determining region 3 for antibody 43930
ARASGHSLDY

SEQ ID NO: 87861 - protein, 8 aa, Homo sapiens
  light chain complementarity determining region 3 for antibody 43931
QQSYSTPT

SEQ ID NO: 87862 - protein, 19 aa, Homo sapiens
  heavy chain complementarity determining region 3 for antibody 43931
SRGAHISAVVALTPHGFDF

SEQ ID NO: 87863 - protein, 9 aa, Homo sapiens
  light chain complementarity determining region 3 for antibody 43932
QQSYSTPRT

SEQ ID NO: 87864 - protein, 18 aa, Homo sapiens
  heavy chain complementarity determining region 3 for antibody 43932
ARDIRRGIAAAGYWYFDL

SEQ ID NO: 87865 - protein, 9 aa, Homo sapiens
  light chain complementarity determining region 3 for antibody 43933
QQSYSTPRT

SEQ ID NO: 87866 - protein, 15 aa, Homo sapiens
  heavy chain complementarity determining region 3 for antibody 43933
ARAQVIWGQLYYFDY

SEQ ID NO: 87867 - protein, 9 aa, Homo sapiens
  light chain complementarity determining region 3 for antibody 43934
QQSYSTPRT

SEQ ID NO: 87868 - protein, 18 aa, Homo sapiens
  heavy chain complementarity determining region 3 for antibody 43934
AHATRVPGTRAGIYYFDY

SEQ ID NO: 87869 - protein, 9 aa, Homo sapiens
  light chain complementarity determining region 3 for antibody 43935
QQSYSTPPT

SEQ ID NO: 87870 - protein, 17 aa, Homo sapiens
  heavy chain complementarity determining region 3 for antibody 43935
TKDIMAIFGVAPTSFDY

SEQ ID NO: 87871 - protein, 9 aa, Homo sapiens
  light chain complementarity determining region 3 for antibody 43936
QQSYSTPPT

SEQ ID NO: 87872 - protein, 11 aa, Homo sapiens
  heavy chain complementarity determining region 3 for antibody 43936
TGERAGTIVDY

SEQ ID NO: 87873 - protein, 9 aa, Homo sapiens
  light chain complementarity determining region 3 for antibody 43937
QQSYSTPPT

SEQ ID NO: 87874 - protein, 16 aa, Homo sapiens
  heavy chain complementarity determining region 3 for antibody 43937
ARGDQLLYRPLPHFDY

SEQ ID NO: 87875 - protein, 9 aa, Homo sapiens
  light chain complementarity determining region 3 for antibody 43938
QQSYSTPPT

SEQ ID NO: 87876 - protein, 20 aa, Homo sapiens
  heavy chain complementarity determining region 3 for antibody 43938
ARDPFLEGNFDWPYQGAFDI

SEQ ID NO: 87877 - protein, 9 aa, Homo sapiens
  light chain complementarity determining region 3 for antibody 43939
QQSYSTPPT

SEQ ID NO: 87878 - protein, 10 aa, Homo sapiens
  heavy chain complementarity determining region 3 for antibody 43939
AHSHGMDFDY

SEQ ID NO: 87879 - protein, 9 aa, Homo sapiens
  light chain complementarity determining region 3 for antibody 43940
QQSYSTPLT

SEQ ID NO: 87880 - protein, 12 aa, Homo sapiens
  heavy chain complementarity determining region 3 for antibody 43940
TRVGTLWTGESN

SEQ ID NO: 87881 - protein, 9 aa, Homo sapiens
  light chain complementarity determining region 3 for antibody 43941
QQSYSTPLA

SEQ ID NO: 87882 - protein, 13 aa, Homo sapiens
  heavy chain complementarity determining region 3 for antibody 43941
AREVQVAGTGVVS

SEQ ID NO: 87883 - protein, 8 aa, Homo sapiens
  light chain complementarity determining region 3 for antibody 43942
QQSYSTPF

SEQ ID NO: 87884 - protein, 17 aa, Homo sapiens
  heavy chain complementarity determining region 3 for antibody 43942
AGLSSRLGDGSPSLFDY

SEQ ID NO: 87885 - protein, 9 aa, Homo sapiens
  light chain complementarity determining region 3 for antibody 43943
QQSYSSPWT

SEQ ID NO: 87886 - protein, 18 aa, Homo sapiens
  heavy chain complementarity determining region 3 for antibody 43943
ARGGESKSGWDQVAYLED

SEQ ID NO: 87887 - protein, 10 aa, Homo sapiens
  light chain complementarity determining region 3 for antibody 43944
QQSYSSPPYT

SEQ ID NO: 87888 - protein, 18 aa, Homo sapiens
  heavy chain complementarity determining region 3 for antibody 43944
AKDRTLYSSGLTTENFDH

SEQ ID NO: 87889 - protein, 10 aa, Homo sapiens
  light chain complementarity determining region 3 for antibody 43945
QQSYSSPGLS

SEQ ID NO: 87890 - protein, 17 aa, Homo sapiens
  heavy chain complementarity determining region 3 for antibody 43945
AKDQGASAVTGPRFFVY

SEQ ID NO: 87891 - protein, 9 aa, Homo sapiens
  light chain complementarity determining region 3 for antibody 43946
QQSYSSPFT

SEQ ID NO: 87892 - protein, 14 aa, Homo sapiens
  heavy chain complementarity determining region 3 for antibody 43946
ARGRDTSGYSGVDY

SEQ ID NO: 87893 - protein, 9 aa, Homo sapiens
  light chain complementarity determining region 3 for antibody 43947
QQSYSSLWT

SEQ ID NO: 87894 - protein, 12 aa, Homo sapiens
  heavy chain complementarity determining region 3 for antibody 43947
ARGGLASKRVDY

SEQ ID NO: 87895 - protein, 9 aa, Homo sapiens
  light chain complementarity determining region 3 for antibody 43948
QQSYSPPLT

SEQ ID NO: 87896 - protein, 15 aa, Homo sapiens
  heavy chain complementarity determining region 3 for antibody 43948
VTIIGSGTYRRGLNS

SEQ ID NO: 87897 - protein, 9 aa, Homo sapiens
  light chain complementarity determining region 3 for antibody 43949
QQSYSIPYT

SEQ ID NO: 87898 - protein, 18 aa, Homo sapiens
  heavy chain complementarity determining region 3 for antibody 43949
ARISGRRDSSGWALWFDP

SEQ ID NO: 87899 - protein, 9 aa, Homo sapiens
  light chain complementarity determining region 3 for antibody 43950
QQSYSIPRT

SEQ ID NO: 87900 - protein, 14 aa, Homo sapiens
  heavy chain complementarity determining region 3 for antibody 43950
ARGRIAGAADPLDY

SEQ ID NO: 87901 - protein, 9 aa, Homo sapiens
  light chain complementarity determining region 3 for antibody 43951
QQSYSFPFT

SEQ ID NO: 87902 - protein, 12 aa, Homo sapiens
  heavy chain complementarity determining region 3 for antibody 43951
ATGGAPQGYYAH

SEQ ID NO: 87903 - protein, 8 aa, Homo sapiens
  light chain complementarity determining region 3 for antibody 43952
QQSYSAWT

SEQ ID NO: 87904 - protein, 16 aa, Homo sapiens
  heavy chain complementarity determining region 3 for antibody 43952
ATEKEVTVRGPLTFDD

SEQ ID NO: 87905 - protein, 9 aa, Homo sapiens
  light chain complementarity determining region 3 for antibody 43953
QQSYRTPIT

SEQ ID NO: 87906 - protein, 19 aa, Homo sapiens
  heavy chain complementarity determining region 3 for antibody 43953
ARGFYDSWGDEYYYHTMDV

SEQ ID NO: 87907 - protein, 9 aa, Homo sapiens
  light chain complementarity determining region 3 for antibody 43954
QQSYRTPHT

SEQ ID NO: 87908 - protein, 14 aa, Homo sapiens
  heavy chain complementarity determining region 3 for antibody 43954
ATPRRDGYPMELDY

SEQ ID NO: 87909 - protein, 9 aa, Homo sapiens
  light chain complementarity determining region 3 for antibody 43955
QQSYRLLWT

SEQ ID NO: 87910 - protein, 13 aa, Homo sapiens
  heavy chain complementarity determining region 3 for antibody 43955
ASRPFHFGKVLDV

SEQ ID NO: 87911 - protein, 9 aa, Homo sapiens
  light chain complementarity determining region 3 for antibody 43956
QQSYITPHT

SEQ ID NO: 87912 - protein, 11 aa, Homo sapiens
  heavy chain complementarity determining region 3 for antibody 43956
ARVRSGYYYDY

SEQ ID NO: 87913 - protein, 10 aa, Homo sapiens
  light chain complementarity determining region 3 for antibody 43957
QQSYIPPTFT

SEQ ID NO: 87914 - protein, 17 aa, Homo sapiens
  heavy chain complementarity determining region 3 for antibody 43957
ARPAYSGQRPERYGMDV

SEQ ID NO: 87915 - protein, 9 aa, Homo sapiens
  light chain complementarity determining region 3 for antibody 43958
QQSYGRPLT

SEQ ID NO: 87916 - protein, 17 aa, Homo sapiens
  heavy chain complementarity determining region 3 for antibody 43958
AREGVCSGGRCYSGLDY

SEQ ID NO: 87917 - protein, 9 aa, Homo sapiens
  light chain complementarity determining region 3 for antibody 43959
QQSYATPCT

SEQ ID NO: 87918 - protein, 15 aa, Homo sapiens
  heavy chain complementarity determining region 3 for antibody 43959
ARDGVVDFWSGYLNY

SEQ ID NO: 87919 - protein, 9 aa, Homo sapiens
  light chain complementarity determining region 3 for antibody 43960
QQSSYFPLT

SEQ ID NO: 87920 - protein, 16 aa, Homo sapiens
  heavy chain complementarity determining region 3 for antibody 43960
AREYPAGESSGFYFDY

SEQ ID NO: 87921 - protein, 9 aa, Homo sapiens
  light chain complementarity determining region 3 for antibody 43961
QQSSTAPLT

SEQ ID NO: 87922 - protein, 16 aa, Homo sapiens
  heavy chain complementarity determining region 3 for antibody 43961
ARSKSRAVEVEATFDI

SEQ ID NO: 87923 - protein, 9 aa, Homo sapiens
  light chain complementarity determining region 3 for antibody 43962
QQSSSSPHT

SEQ ID NO: 87924 - protein, 18 aa, Homo sapiens
  heavy chain complementarity determining region 3 for antibody 43962
ARRTQKITIGGVIVVLDY

SEQ ID NO: 87925 - protein, 9 aa, Homo sapiens
  light chain complementarity determining region 3 for antibody 43963
QQSFTNTRT

SEQ ID NO: 87926 - protein, 17 aa, Homo sapiens
  heavy chain complementarity determining region 3 for antibody 43963
VRLQSGRLATTTEAFDV

SEQ ID NO: 87927 - protein, 9 aa, Homo sapiens
  light chain complementarity determining region 3 for antibody 43964
QQSFRTPYT

SEQ ID NO: 87928 - protein, 14 aa, Homo sapiens
  heavy chain complementarity determining region 3 for antibody 43964
ARGGGRGYYSSVDD

SEQ ID NO: 87929 - protein, 9 aa, Homo sapiens
  light chain complementarity determining region 3 for antibody 43965
QQSFNNPPT

SEQ ID NO: 87930 - protein, 15 aa, Homo sapiens
  heavy chain complementarity determining region 3 for antibody 43965
ASWGYDSSGQRYFDY

SEQ ID NO: 87931 - protein, 9 aa, Homo sapiens
  light chain complementarity determining region 3 for antibody 43966
QQSFGVPLT

SEQ ID NO: 87932 - protein, 16 aa, Homo sapiens
  heavy chain complementarity determining region 3 for antibody 43966
IRDHYYESNGDYIPQH

SEQ ID NO: 87933 - protein, 9 aa, Homo sapiens
  light chain complementarity determining region 3 for antibody 43967
QQSATTPRT

SEQ ID NO: 87934 - protein, 15 aa, Homo sapiens
  heavy chain complementarity determining region 3 for antibody 43967
ARGKYFYSSADYFDH

SEQ ID NO: 87935 - protein, 10 aa, Homo sapiens
  light chain complementarity determining region 3 for antibody 43968
QQRYNWPPFT

SEQ ID NO: 87936 - protein, 14 aa, Homo sapiens
  heavy chain complementarity determining region 3 for antibody 43968
ARLEIVVIPPAKNR

SEQ ID NO: 87937 - protein, 9 aa, Homo sapiens
  light chain complementarity determining region 3 for antibody 43969
QQRTNWPLT

SEQ ID NO: 87938 - protein, 12 aa, Homo sapiens
  heavy chain complementarity determining region 3 for antibody 43969
ARDRAGDYVFEV

SEQ ID NO: 87939 - protein, 11 aa, Homo sapiens
  light chain complementarity determining region 3 for antibody 43970
QQRTNWPIMYT

SEQ ID NO: 87940 - protein, 14 aa, Homo sapiens
  heavy chain complementarity determining region 3 for antibody 43970
VKCLGYDPGYGMDV

SEQ ID NO: 87941 - protein, 8 aa, Homo sapiens
  light chain complementarity determining region 3 for antibody 43971
QQRSTWWT

SEQ ID NO: 87942 - protein, 17 aa, Homo sapiens
  heavy chain complementarity determining region 3 for antibody 43971
AKDVHSRQGYYYYGMDV

SEQ ID NO: 87943 - protein, 8 aa, Homo sapiens
  light chain complementarity determining region 3 for antibody 43972
QQRSTGLT

SEQ ID NO: 87944 - protein, 13 aa, Homo sapiens
  heavy chain complementarity determining region 3 for antibody 43972
AREPNGPLNAFDL

SEQ ID NO: 87945 - protein, 10 aa, Homo sapiens
  light chain complementarity determining region 3 for antibody 43973
QQRSSWPPIT

SEQ ID NO: 87946 - protein, 18 aa, Homo sapiens
  heavy chain complementarity determining region 3 for antibody 43973
ARVYGDFEGAYYYYGMDV

SEQ ID NO: 87947 - protein, 10 aa, Homo sapiens
  light chain complementarity determining region 3 for antibody 43974
QQRSNWPRGT

SEQ ID NO: 87948 - protein, 5 aa, Homo sapiens
  heavy chain complementarity determining region 3 for antibody 43974
AREDV

SEQ ID NO: 87949 - protein, 11 aa, Homo sapiens
  light chain complementarity determining region 3 for antibody 43975
QQRSNWPPTWT

SEQ ID NO: 87950 - protein, 11 aa, Homo sapiens
  heavy chain complementarity determining region 3 for antibody 43975
ARVGDWNDLEY

SEQ ID NO: 87951 - protein, 10 aa, Homo sapiens
  light chain complementarity determining region 3 for antibody 43976
QQRSNWPPLT

SEQ ID NO: 87952 - protein, 13 aa, Homo sapiens
  heavy chain complementarity determining region 3 for antibody 43976
VHMGYSSSWPFDF

SEQ ID NO: 87953 - protein, 11 aa, Homo sapiens
  light chain complementarity determining region 3 for antibody 43977
QQRSNWPPEWT

SEQ ID NO: 87954 - protein, 16 aa, Homo sapiens
  heavy chain complementarity determining region 3 for antibody 43977
ARWWAVAGNKYWYLDL

SEQ ID NO: 87955 - protein, 11 aa, Homo sapiens
  light chain complementarity determining region 3 for antibody 43978
QQRSNWPLSIT

SEQ ID NO: 87956 - protein, 10 aa, Homo sapiens
  heavy chain complementarity determining region 3 for antibody 43978
ARGFKGHLGY

SEQ ID NO: 87957 - protein, 8 aa, Homo sapiens
  light chain complementarity determining region 3 for antibody 43979
QQRSNWLT

SEQ ID NO: 87958 - protein, 11 aa, Homo sapiens
  heavy chain complementarity determining region 3 for antibody 43979
AYGDPGRFLDY

SEQ ID NO: 87959 - protein, 8 aa, Homo sapiens
  light chain complementarity determining region 3 for antibody 43980
QQRSNWLS

SEQ ID NO: 87960 - protein, 18 aa, Homo sapiens
  heavy chain complementarity determining region 3 for antibody 43980
AIIPTYEFDTTSAYSPDS

SEQ ID NO: 87961 - protein, 10 aa, Homo sapiens
  light chain complementarity determining region 3 for antibody 43981
QQRSDWLPLT

SEQ ID NO: 87962 - protein, 15 aa, Homo sapiens
  heavy chain complementarity determining region 3 for antibody 43981
AREIGIDYDESERDY

SEQ ID NO: 87963 - protein, 9 aa, Homo sapiens
  light chain complementarity determining region 3 for antibody 43982
QQRNNWPLT

SEQ ID NO: 87964 - protein, 10 aa, Homo sapiens
  heavy chain complementarity determining region 3 for antibody 43982
ARDAGEPLDY

SEQ ID NO: 87965 - protein, 10 aa, Homo sapiens
  light chain complementarity determining region 3 for antibody 43983
QQRGNWPPLT

SEQ ID NO: 87966 - protein, 16 aa, Homo sapiens
  heavy chain complementarity determining region 3 for antibody 43983
ARDHFAFVPQNHYFDH

SEQ ID NO: 87967 - protein, 10 aa, Homo sapiens
  light chain complementarity determining region 3 for antibody 43984
QQNSRSPRYT

SEQ ID NO: 87968 - protein, 10 aa, Homo sapiens
  heavy chain complementarity determining region 3 for antibody 43984
TRWGPTGFDF

SEQ ID NO: 87969 - protein, 9 aa, Homo sapiens
  light chain complementarity determining region 3 for antibody 43985
QQNHSPPRT

SEQ ID NO: 87970 - protein, 13 aa, Homo sapiens
  heavy chain complementarity determining region 3 for antibody 43985
VREDGGDHYGLDV

SEQ ID NO: 87971 - protein, 9 aa, Homo sapiens
  light chain complementarity determining region 3 for antibody 43986
QQLNSYPRT

SEQ ID NO: 87972 - protein, 16 aa, Homo sapiens
  heavy chain complementarity determining region 3 for antibody 43986
AKRLGPVGTPGTFFDS

SEQ ID NO: 87973 - protein, 7 aa, Homo sapiens
  light chain complementarity determining region 3 for antibody 43987
QQLNRYR

SEQ ID NO: 87974 - protein, 12 aa, Homo sapiens
  heavy chain complementarity determining region 3 for antibody 43987
ARVLTAKGAFDM

SEQ ID NO: 87975 - protein, 9 aa, Homo sapiens
  light chain complementarity determining region 3 for antibody 43988
QQLKSYPRT

SEQ ID NO: 87976 - protein, 17 aa, Homo sapiens
  heavy chain complementarity determining region 3 for antibody 43988
ARDRDSTAWSPLGWFDP

SEQ ID NO: 87977 - protein, 9 aa, Homo sapiens
  light chain complementarity determining region 3 for antibody 43989
QQLHAYPLT

SEQ ID NO: 87978 - protein, 14 aa, Homo sapiens
  heavy chain complementarity determining region 3 for antibody 43989
ARRRRFSGVYYFDL

SEQ ID NO: 87979 - protein, 9 aa, Homo sapiens
  light chain complementarity determining region 3 for antibody 43990
QQINSYPLT

SEQ ID NO: 87980 - protein, 20 aa, Homo sapiens
  heavy chain complementarity determining region 3 for antibody 43990
ARSGSYGSGSYDFSPAWFDP

SEQ ID NO: 87981 - protein, 9 aa, Homo sapiens
  light chain complementarity determining region 3 for antibody 43991
QQHNTWPST

SEQ ID NO: 87982 - protein, 14 aa, Homo sapiens
  heavy chain complementarity determining region 3 for antibody 43991
VSDLLTMTTVTTNY

SEQ ID NO: 87983 - protein, 9 aa, Homo sapiens
  light chain complementarity determining region 3 for antibody 43992
QQHNSYPWT

SEQ ID NO: 87984 - protein, 15 aa, Homo sapiens
  heavy chain complementarity determining region 3 for antibody 43992
VRLNVDNTGYYGMDV

SEQ ID NO: 87985 - protein, 9 aa, Homo sapiens
  light chain complementarity determining region 3 for antibody 43993
QQHNSYPLT

SEQ ID NO: 87986 - protein, 16 aa, Homo sapiens
  heavy chain complementarity determining region 3 for antibody 43993
ARGGRWFGESGSSDGF

SEQ ID NO: 87987 - protein, 9 aa, Homo sapiens
  light chain complementarity determining region 3 for antibody 43994
QQFKSYPLT

SEQ ID NO: 87988 - protein, 13 aa, Homo sapiens
  heavy chain complementarity determining region 3 for antibody 43994
ATDLATGRGKDDY

SEQ ID NO: 87989 - protein, 11 aa, Homo sapiens
  light chain complementarity determining region 3 for antibody 43995
QQFGNPPPLYT

SEQ ID NO: 87990 - protein, 11 aa, Homo sapiens
  heavy chain complementarity determining region 3 for antibody 43995
ATYGDYLSFDY

SEQ ID NO: 87991 - protein, 8 aa, Homo sapiens
  light chain complementarity determining region 3 for antibody 43996
QQFDNLPT

SEQ ID NO: 87992 - protein, 10 aa, Homo sapiens
  heavy chain complementarity determining region 3 for antibody 43996
VTKWGDDFDY

SEQ ID NO: 87993 - protein, 9 aa, Homo sapiens
  light chain complementarity determining region 3 for antibody 43997
QQFATSSVT

SEQ ID NO: 87994 - protein, 12 aa, Homo sapiens
  heavy chain complementarity determining region 3 for antibody 43997
ARDAGQYSYCDH

SEQ ID NO: 87995 - protein, 9 aa, Homo sapiens
  light chain complementarity determining region 3 for antibody 43998
QQDDGLTLT

SEQ ID NO: 87996 - protein, 12 aa, Homo sapiens
  heavy chain complementarity determining region 3 for antibody 43998
ARALWPSNAFDV

SEQ ID NO: 87997 - protein, 9 aa, Homo sapiens
  light chain complementarity determining region 3 for antibody 43999
QQCGTSPIT

SEQ ID NO: 87998 - protein, 15 aa, Homo sapiens
  heavy chain complementarity determining region 3 for antibody 43999
ARDLSGVDTEGGFDS

SEQ ID NO: 87999 - protein, 10 aa, Homo sapiens
  light chain complementarity determining region 3 for antibody 44000
QQCDNVPRFT

SEQ ID NO: 88000 - protein, 15 aa, Homo sapiens
  heavy chain complementarity determining region 3 for antibody 44000
ARDFTMIRGVDAFDI

SEQ ID NO: 88001 - protein, 9 aa, Homo sapiens
  light chain complementarity determining region 3 for antibody 44001
QQAYGHPYT

SEQ ID NO: 88002 - protein, 13 aa, Homo sapiens
  heavy chain complementarity determining region 3 for antibody 44001
ARGRTYDRLPYDV

SEQ ID NO: 88003 - protein, 9 aa, Homo sapiens
  light chain complementarity determining region 3 for antibody 44002
QQASSLPFT

SEQ ID NO: 88004 - protein, 17 aa, Homo sapiens
  heavy chain complementarity determining region 3 for antibody 44002
AKDGSGVAATRYWFFAL

SEQ ID NO: 88005 - protein, 9 aa, Homo sapiens
  light chain complementarity determining region 3 for antibody 44003
QQASSFPVT

SEQ ID NO: 88006 - protein, 18 aa, Homo sapiens
  heavy chain complementarity determining region 3 for antibody 44003
ASRFTGGKLGATDHWFGP

SEQ ID NO: 88007 - protein, 9 aa, Homo sapiens
  light chain complementarity determining region 3 for antibody 44004
QQANSFPFT

SEQ ID NO: 88008 - protein, 21 aa, Homo sapiens
  heavy chain complementarity determining region 3 for antibody 44004
AKVLAPSIPTIVSVTEDAFHL

SEQ ID NO: 88009 - protein, 9 aa, Homo sapiens
  light chain complementarity determining region 3 for antibody 44005
QQAKSFSLT

SEQ ID NO: 88010 - protein, 20 aa, Homo sapiens
  heavy chain complementarity determining region 3 for antibody 44005
VRTRVREGVAGHFHHYAMDV

SEQ ID NO: 88011 - protein, 9 aa, Homo sapiens
  light chain complementarity determining region 3 for antibody 44006
QQAHSYPWT

SEQ ID NO: 88012 - protein, 16 aa, Homo sapiens
  heavy chain complementarity determining region 3 for antibody 44006
ARGCFGPSCFSTYFDY

SEQ ID NO: 88013 - protein, 9 aa, Homo sapiens
  light chain complementarity determining region 3 for antibody 44007
QQAHATLLT

SEQ ID NO: 88014 - protein, 19 aa, Homo sapiens
  heavy chain complementarity determining region 3 for antibody 44007
ARSRNYEFWRGYAHGYLDL

SEQ ID NO: 88015 - protein, 9 aa, Homo sapiens
  light chain complementarity determining region 3 for antibody 44008
QQAEDFPLT

SEQ ID NO: 88016 - protein, 17 aa, Homo sapiens
  heavy chain complementarity determining region 3 for antibody 44008
AKVQTSRFLEWLSYFDA

SEQ ID NO: 88017 - protein, 8 aa, Homo sapiens
  light chain complementarity determining region 3 for antibody 44009
QNYGSSGT

SEQ ID NO: 88018 - protein, 18 aa, Homo sapiens
  heavy chain complementarity determining region 3 for antibody 44009
TTGPPGARMVGASTPFHY

SEQ ID NO: 88019 - protein, 9 aa, Homo sapiens
  light chain complementarity determining region 3 for antibody 44010
QKYYSALLT

SEQ ID NO: 88020 - protein, 17 aa, Homo sapiens
  heavy chain complementarity determining region 3 for antibody 44010
ARDRHYYGSGNYYPFDY

SEQ ID NO: 88021 - protein, 9 aa, Homo sapiens
  light chain complementarity determining region 3 for antibody 44011
QKYNSVPRT

SEQ ID NO: 88022 - protein, 13 aa, Homo sapiens
  heavy chain complementarity determining region 3 for antibody 44011
GRGGQLAATGIDY

SEQ ID NO: 88023 - protein, 9 aa, Homo sapiens
  light chain complementarity determining region 3 for antibody 44012
QKYNSASFI

SEQ ID NO: 88024 - protein, 14 aa, Homo sapiens
  heavy chain complementarity determining region 3 for antibody 44012
ARQQGSSSSRYFDY

SEQ ID NO: 88025 - protein, 11 aa, Homo sapiens
  light chain complementarity determining region 3 for antibody 44013
QKYGTAPPGIA

SEQ ID NO: 88026 - protein, 12 aa, Homo sapiens
  heavy chain complementarity determining region 3 for antibody 44013
AKKIGNFDVFDV

SEQ ID NO: 88027 - protein, 9 aa, Homo sapiens
  light chain complementarity determining region 3 for antibody 44014
QKYDNAPFT

SEQ ID NO: 88028 - protein, 15 aa, Homo sapiens
  heavy chain complementarity determining region 3 for antibody 44014
ARRAYRSGWYTFWDY

SEQ ID NO: 88029 - protein, 9 aa, Homo sapiens
  light chain complementarity determining region 3 for antibody 44015
QKLDSFPWT

SEQ ID NO: 88030 - protein, 13 aa, Homo sapiens
  heavy chain complementarity determining region 3 for antibody 44015
AAGTRTGYFGLDV

SEQ ID NO: 88031 - protein, 9 aa, Homo sapiens
  light chain complementarity determining region 3 for antibody 44016
QKGDGLPFT

SEQ ID NO: 88032 - protein, 15 aa, Homo sapiens
  heavy chain complementarity determining region 3 for antibody 44016
AREAFDIAGHYRADY

SEQ ID NO: 88033 - protein, 9 aa, Homo sapiens
  light chain complementarity determining region 3 for antibody 44017
QHYNTYPYT

SEQ ID NO: 88034 - protein, 21 aa, Homo sapiens
  heavy chain complementarity determining region 3 for antibody 44017
ARHREPGERAIEIYKGYGMDV

SEQ ID NO: 88035 - protein, 9 aa, Homo sapiens
  light chain complementarity determining region 3 for antibody 44018
QHYDSFPLT

SEQ ID NO: 88036 - protein, 12 aa, Homo sapiens
  heavy chain complementarity determining region 3 for antibody 44018
VKSGHSYSHFDD

SEQ ID NO: 88037 - protein, 9 aa, Homo sapiens
  light chain complementarity determining region 3 for antibody 44019
QHYATAPWT

SEQ ID NO: 88038 - protein, 18 aa, Homo sapiens
  heavy chain complementarity determining region 3 for antibody 44019
ATLPYSSIWYLRRDAVDV

SEQ ID NO: 88039 - protein, 9 aa, Homo sapiens
  light chain complementarity determining region 3 for antibody 44020
QHTYNTPWT

SEQ ID NO: 88040 - protein, 12 aa, Homo sapiens
  heavy chain complementarity determining region 3 for antibody 44020
AREARASDGFDV

SEQ ID NO: 88041 - protein, 9 aa, Homo sapiens
  light chain complementarity determining region 3 for antibody 44021
QHSYTNPPT

SEQ ID NO: 88042 - protein, 14 aa, Homo sapiens
  heavy chain complementarity determining region 3 for antibody 44021
ARLEIVVIPPAKNR

SEQ ID NO: 88043 - protein, 9 aa, Homo sapiens
  light chain complementarity determining region 3 for antibody 44022
QHSYSIPWT

SEQ ID NO: 88044 - protein, 13 aa, Homo sapiens
  heavy chain complementarity determining region 3 for antibody 44022
ANHIVVVTAPFDY

SEQ ID NO: 88045 - protein, 10 aa, Homo sapiens
  light chain complementarity determining region 3 for antibody 44023
QHLNGYPSFT

SEQ ID NO: 88046 - protein, 21 aa, Homo sapiens
  heavy chain complementarity determining region 3 for antibody 44023
ARDVDYYGSRGSPLRWGYFDY

SEQ ID NO: 88047 - protein, 10 aa, Homo sapiens
  light chain complementarity determining region 3 for antibody 44024
QHFNNWPPWT

SEQ ID NO: 88048 - protein, 12 aa, Homo sapiens
  heavy chain complementarity determining region 3 for antibody 44024
AKTVRERKELDH

SEQ ID NO: 88049 - protein, 9 aa, Homo sapiens
  light chain complementarity determining region 3 for antibody 44025
QHFIPPSWT

SEQ ID NO: 88050 - protein, 12 aa, Homo sapiens
  heavy chain complementarity determining region 3 for antibody 44025
AMYLAGMSGVGS

SEQ ID NO: 88051 - protein, 7 aa, Homo sapiens
  light chain complementarity determining region 3 for antibody 44026
QEYNSYN

SEQ ID NO: 88052 - protein, 12 aa, Homo sapiens
  heavy chain complementarity determining region 3 for antibody 44026
ASRKDAYTSLDV

SEQ ID NO: 88053 - protein, 11 aa, Homo sapiens
  light chain complementarity determining region 3 for antibody 44027
QERNSWPRGLT

SEQ ID NO: 88054 - protein, 12 aa, Homo sapiens
  heavy chain complementarity determining region 3 for antibody 44027
MAPGGRGWTKDY

SEQ ID NO: 88055 - protein, 9 aa, Homo sapiens
  light chain complementarity determining region 3 for antibody 44028
MQVLQTPIT

SEQ ID NO: 88056 - protein, 10 aa, Homo sapiens
  heavy chain complementarity determining region 3 for antibody 44028
ARKDLIYFNP

SEQ ID NO: 88057 - protein, 9 aa, Homo sapiens
  light chain complementarity determining region 3 for antibody 44029
MQVLEIPVT

SEQ ID NO: 88058 - protein, 23 aa, Homo sapiens
  heavy chain complementarity determining region 3 for antibody 44029
ARDPSASYGYDSPLKYYYYGADV

SEQ ID NO: 88059 - protein, 9 aa, Homo sapiens
  light chain complementarity determining region 3 for antibody 44030
MQTLQTPVT

SEQ ID NO: 88060 - protein, 15 aa, Homo sapiens
  heavy chain complementarity determining region 3 for antibody 44030
ARSRWDLVFRRPFHI

SEQ ID NO: 88061 - protein, 9 aa, Homo sapiens
  light chain complementarity determining region 3 for antibody 44031
MQTLHLPYT

SEQ ID NO: 88062 - protein, 18 aa, Homo sapiens
  heavy chain complementarity determining region 3 for antibody 44031
TEQDPSSGKYYKWGTFHI

SEQ ID NO: 88063 - protein, 9 aa, Homo sapiens
  light chain complementarity determining region 3 for antibody 44032
MQSLEVPYT

SEQ ID NO: 88064 - protein, 12 aa, Homo sapiens
  heavy chain complementarity determining region 3 for antibody 44032
VRRGNDNSYFDL

SEQ ID NO: 88065 - protein, 9 aa, Homo sapiens
  light chain complementarity determining region 3 for antibody 44033
MQPLQTPLT

SEQ ID NO: 88066 - protein, 11 aa, Homo sapiens
  heavy chain complementarity determining region 3 for antibody 44033
ARERLWFGESV

SEQ ID NO: 88067 - protein, 9 aa, Homo sapiens
  light chain complementarity determining region 3 for antibody 44034
MQHTRWPHT

SEQ ID NO: 88068 - protein, 15 aa, Homo sapiens
  heavy chain complementarity determining region 3 for antibody 44034
ARDGSTSTEAHGMDV

SEQ ID NO: 88069 - protein, 9 aa, Homo sapiens
  light chain complementarity determining region 3 for antibody 44035
MQGVDRGRT

SEQ ID NO: 88070 - protein, 12 aa, Homo sapiens
  heavy chain complementarity determining region 3 for antibody 44035
ATLGVRWDHFDY

SEQ ID NO: 88071 - protein, 11 aa, Homo sapiens
  light chain complementarity determining region 3 for antibody 44036
MQGTYWPHSYS

SEQ ID NO: 88072 - protein, 16 aa, Homo sapiens
  heavy chain complementarity determining region 3 for antibody 44036
ARGIFYYDSGGSPFDY

SEQ ID NO: 88073 - protein, 9 aa, Homo sapiens
  light chain complementarity determining region 3 for antibody 44037
MQGTHWPRT

SEQ ID NO: 88074 - protein, 8 aa, Homo sapiens
  heavy chain complementarity determining region 3 for antibody 44037
ARSAYCDS

SEQ ID NO: 88075 - protein, 9 aa, Homo sapiens
  light chain complementarity determining region 3 for antibody 44038
MQGTHWPRT

SEQ ID NO: 88076 - protein, 24 aa, Homo sapiens
  heavy chain complementarity determining region 3 for antibody 44038
ARGSLMFYYDGSGYYYAPGDAFEI

SEQ ID NO: 88077 - protein, 10 aa, Homo sapiens
  light chain complementarity determining region 3 for antibody 44039
MQGTHWPPYT

SEQ ID NO: 88078 - protein, 11 aa, Homo sapiens
  heavy chain complementarity determining region 3 for antibody 44039
AREVTPAGFDY

SEQ ID NO: 88079 - protein, 10 aa, Homo sapiens
  light chain complementarity determining region 3 for antibody 44040
MQGTHWPPVT

SEQ ID NO: 88080 - protein, 18 aa, Homo sapiens
  heavy chain complementarity determining region 3 for antibody 44040
ARDQSRQLVRDYYYNMDL

SEQ ID NO: 88081 - protein, 8 aa, Homo sapiens
  light chain complementarity determining region 3 for antibody 44041
MQGTHPLT

SEQ ID NO: 88082 - protein, 18 aa, Homo sapiens
  heavy chain complementarity determining region 3 for antibody 44041
AKGSKAYCSGVRCYPLDN

SEQ ID NO: 88083 - protein, 10 aa, Homo sapiens
  light chain complementarity determining region 3 for antibody 44042
MQGSYWPPYT

SEQ ID NO: 88084 - protein, 13 aa, Homo sapiens
  heavy chain complementarity determining region 3 for antibody 44042
VRDGDSSSWNFDY

SEQ ID NO: 88085 - protein, 9 aa, Homo sapiens
  light chain complementarity determining region 3 for antibody 44043
MQGRQSPRT

SEQ ID NO: 88086 - protein, 13 aa, Homo sapiens
  heavy chain complementarity determining region 3 for antibody 44043
AAALDLWSAHLEV

SEQ ID NO: 88087 - protein, 9 aa, Homo sapiens
  light chain complementarity determining region 3 for antibody 44044
MQGLRTPWT

SEQ ID NO: 88088 - protein, 14 aa, Homo sapiens
  heavy chain complementarity determining region 3 for antibody 44044
AREDSAGGYYGMDV

SEQ ID NO: 88089 - protein, 9 aa, Homo sapiens
  light chain complementarity determining region 3 for antibody 44045
MQGLQTPYA

SEQ ID NO: 88090 - protein, 13 aa, Homo sapiens
  heavy chain complementarity determining region 3 for antibody 44045
TSGHESDNISPPY

SEQ ID NO: 88091 - protein, 9 aa, Homo sapiens
  light chain complementarity determining region 3 for antibody 44046
MQGLQTPWT

SEQ ID NO: 88092 - protein, 14 aa, Homo sapiens
  heavy chain complementarity determining region 3 for antibody 44046
ARGRGFTAYAPEGY

SEQ ID NO: 88093 - protein, 9 aa, Homo sapiens
  light chain complementarity determining region 3 for antibody 44047
MQGLQTPPT

SEQ ID NO: 88094 - protein, 12 aa, Homo sapiens
  heavy chain complementarity determining region 3 for antibody 44047
AHNGAARGDLDS

SEQ ID NO: 88095 - protein, 9 aa, Homo sapiens
  light chain complementarity determining region 3 for antibody 44048
MQGLQSPPT

SEQ ID NO: 88096 - protein, 14 aa, Homo sapiens
  heavy chain complementarity determining region 3 for antibody 44048
ARGGDSSTWYEFDY

SEQ ID NO: 88097 - protein, 9 aa, Homo sapiens
  light chain complementarity determining region 3 for antibody 44049
MQALQTPWT

SEQ ID NO: 88098 - protein, 15 aa, Homo sapiens
  heavy chain complementarity determining region 3 for antibody 44049
AKDRGDAYSYDAFDI

SEQ ID NO: 88099 - protein, 8 aa, Homo sapiens
  light chain complementarity determining region 3 for antibody 44050
MQALQTPT

SEQ ID NO: 88100 - protein, 16 aa, Homo sapiens
  heavy chain complementarity determining region 3 for antibody 44050
ARAEKGRKYYYYGMDV

SEQ ID NO: 88101 - protein, 9 aa, Homo sapiens
  light chain complementarity determining region 3 for antibody 44051
MQALQTPRT

SEQ ID NO: 88102 - protein, 30 aa, Homo sapiens
  heavy chain complementarity determining region 3 for antibody 44051
ARGLTRTLNFMDKFGSGFNLPQPEVDWFDP

SEQ ID NO: 88103 - protein, 9 aa, Homo sapiens
  light chain complementarity determining region 3 for antibody 44052
MQALQTPRT

SEQ ID NO: 88104 - protein, 14 aa, Homo sapiens
  heavy chain complementarity determining region 3 for antibody 44052
ARDRDSSSWRVFDY

SEQ ID NO: 88105 - protein, 9 aa, Homo sapiens
  light chain complementarity determining region 3 for antibody 44053
MQALQTPPA

SEQ ID NO: 88106 - protein, 27 aa, Homo sapiens
  heavy chain complementarity determining region 3 for antibody 44053
ARDKFFDYDFWSGYHRFHVSDYYGMDV

SEQ ID NO: 88107 - protein, 9 aa, Homo sapiens
  light chain complementarity determining region 3 for antibody 44054
MQALQTPLT

SEQ ID NO: 88108 - protein, 13 aa, Homo sapiens
  heavy chain complementarity determining region 3 for antibody 44054
ARDLGEGAVPDES

SEQ ID NO: 88109 - protein, 10 aa, Homo sapiens
  light chain complementarity determining region 3 for antibody 44055
MQALQTPGVT

SEQ ID NO: 88110 - protein, 17 aa, Homo sapiens
  heavy chain complementarity determining region 3 for antibody 44055
VKGAIDHDSTTFYTHHY

SEQ ID NO: 88111 - protein, 8 aa, Homo sapiens
  light chain complementarity determining region 3 for antibody 44056
MQALQAFT

SEQ ID NO: 88112 - protein, 13 aa, Homo sapiens
  heavy chain complementarity determining region 3 for antibody 44056
ARSTGPYYYGLDV

SEQ ID NO: 88113 - protein, 9 aa, Homo sapiens
  light chain complementarity determining region 3 for antibody 44057
MQALKPPLT

SEQ ID NO: 88114 - protein, 14 aa, Homo sapiens
  heavy chain complementarity determining region 3 for antibody 44057
VRALSRGGRHDFDS

SEQ ID NO: 88115 - protein, 9 aa, Homo sapiens
  light chain complementarity determining region 3 for antibody 44058
MHALQTPWT

SEQ ID NO: 88116 - protein, 17 aa, Homo sapiens
  heavy chain complementarity determining region 3 for antibody 44058
VRVRDPMVRGTYDAFDL

SEQ ID NO: 88117 - protein, 9 aa, Homo sapiens
  light chain complementarity determining region 3 for antibody 44059
MHALKTPFT

SEQ ID NO: 88118 - protein, 11 aa, Homo sapiens
  heavy chain complementarity determining region 3 for antibody 44059
ATTYQMGIPHY

SEQ ID NO: 88119 - protein, 9 aa, Homo sapiens
  light chain complementarity determining region 3 for antibody 44060
LQYNSFSYT

SEQ ID NO: 88120 - protein, 13 aa, Homo sapiens
  heavy chain complementarity determining region 3 for antibody 44060
SRFPGGSTPTYDH

SEQ ID NO: 88121 - protein, 9 aa, Homo sapiens
  light chain complementarity determining region 3 for antibody 44061
LQYNNYPFT

SEQ ID NO: 88122 - protein, 21 aa, Homo sapiens
  heavy chain complementarity determining region 3 for antibody 44061
ARAPLGYCTGGTCNFGEYFQQ

SEQ ID NO: 88123 - protein, 9 aa, Homo sapiens
  light chain complementarity determining region 3 for antibody 44062
LQYDSLPRT

SEQ ID NO: 88124 - protein, 20 aa, Homo sapiens
  heavy chain complementarity determining region 3 for antibody 44062
ARSPPHPYDFLSGNEQGLDV

SEQ ID NO: 88125 - protein, 9 aa, Homo sapiens
  light chain complementarity determining region 3 for antibody 44063
LQYDNLPVT

SEQ ID NO: 88126 - protein, 16 aa, Homo sapiens
  heavy chain complementarity determining region 3 for antibody 44063
ARVQVKTGDGRPNFDY

SEQ ID NO: 88127 - protein, 9 aa, Homo sapiens
  light chain complementarity determining region 3 for antibody 44064
LQTYTYPHT

SEQ ID NO: 88128 - protein, 20 aa, Homo sapiens
  heavy chain complementarity determining region 3 for antibody 44064
AREGGILRFLDASKSYGMNV

SEQ ID NO: 88129 - protein, 9 aa, Homo sapiens
  light chain complementarity determining region 3 for antibody 44065
LQTYTSVFT

SEQ ID NO: 88130 - protein, 14 aa, Homo sapiens
  heavy chain complementarity determining region 3 for antibody 44065
VNLGHLEAADAVDY

SEQ ID NO: 88131 - protein, 9 aa, Homo sapiens
  light chain complementarity determining region 3 for antibody 44066
LQTYSATWT

SEQ ID NO: 88132 - protein, 12 aa, Homo sapiens
  heavy chain complementarity determining region 3 for antibody 44066
ARTSTSSYTLDV

SEQ ID NO: 88133 - protein, 10 aa, Homo sapiens
  light chain complementarity determining region 3 for antibody 44067
LQSYSSPFFT

SEQ ID NO: 88134 - protein, 17 aa, Homo sapiens
  heavy chain complementarity determining region 3 for antibody 44067
AKDVHSRQGYYYYGMDV

SEQ ID NO: 88135 - protein, 9 aa, Homo sapiens
  light chain complementarity determining region 3 for antibody 44068
LQLDSYPIT

SEQ ID NO: 88136 - protein, 16 aa, Homo sapiens
  heavy chain complementarity determining region 3 for antibody 44068
ARSRVGSSYDPYYFDS

SEQ ID NO: 88137 - protein, 9 aa, Homo sapiens
  light chain complementarity determining region 3 for antibody 44069
LQHNTYPHT

SEQ ID NO: 88138 - protein, 15 aa, Homo sapiens
  heavy chain complementarity determining region 3 for antibody 44069
GRLLGDWELPRGNDY

SEQ ID NO: 88139 - protein, 9 aa, Homo sapiens
  light chain complementarity determining region 3 for antibody 44070
LQHNSYPLT

SEQ ID NO: 88140 - protein, 20 aa, Homo sapiens
  heavy chain complementarity determining region 3 for antibody 44070
ARGEHVVVVTSFRGSQGINS

SEQ ID NO: 88141 - protein, 9 aa, Homo sapiens
  light chain complementarity determining region 3 for antibody 44071
LQHDGYPLT

SEQ ID NO: 88142 - protein, 23 aa, Homo sapiens
  heavy chain complementarity determining region 3 for antibody 44071
ARGRGLRTFYYDSSGLRAEYFQF

SEQ ID NO: 88143 - protein, 9 aa, Homo sapiens
  light chain complementarity determining region 3 for antibody 44072
LQGTHWPPT

SEQ ID NO: 88144 - protein, 12 aa, Homo sapiens
  heavy chain complementarity determining region 3 for antibody 44072
ARDFGPVVTLAS

SEQ ID NO: 88145 - protein, 9 aa, Homo sapiens
  light chain complementarity determining region 3 for antibody 44073
LQDYTYPVS

SEQ ID NO: 88146 - protein, 15 aa, Homo sapiens
  heavy chain complementarity determining region 3 for antibody 44073
ARVTRYGQTWETYDY

SEQ ID NO: 88147 - protein, 9 aa, Homo sapiens
  light chain complementarity determining region 3 for antibody 44074
LQDYSYPWT

SEQ ID NO: 88148 - protein, 15 aa, Homo sapiens
  heavy chain complementarity determining region 3 for antibody 44074
ARVRFPHGGMSYFDN

SEQ ID NO: 88149 - protein, 9 aa, Homo sapiens
  light chain complementarity determining region 3 for antibody 44075
LQDYDYPRT

SEQ ID NO: 88150 - protein, 20 aa, Homo sapiens
  heavy chain complementarity determining region 3 for antibody 44075
ARLHRYCSGGHCYSPGSFDV

SEQ ID NO: 88151 - protein, 9 aa, Homo sapiens
  light chain complementarity determining region 3 for antibody 44076
LQCDTHPWT

SEQ ID NO: 88152 - protein, 11 aa, Homo sapiens
  heavy chain complementarity determining region 3 for antibody 44076
ARGIAGVGFDH

SEQ ID NO: 88153 - protein, 9 aa, Homo sapiens
  light chain complementarity determining region 3 for antibody 44077
LHYGNSRWT

SEQ ID NO: 88154 - protein, 13 aa, Homo sapiens
  heavy chain complementarity determining region 3 for antibody 44077
AREKNMVRGRLDY

SEQ ID NO: 88155 - protein, 8 aa, Homo sapiens
  light chain complementarity determining region 3 for antibody 44078
LEGTHSHT

SEQ ID NO: 88156 - protein, 11 aa, Homo sapiens
  heavy chain complementarity determining region 3 for antibody 44078
ARDPGWGAFDV

SEQ ID NO: 88157 - protein, 9 aa, Homo sapiens
  light chain complementarity determining region 3 for antibody 44079
HQYNIYSGT

SEQ ID NO: 88158 - protein, 16 aa, Homo sapiens
  heavy chain complementarity determining region 3 for antibody 44079
ARNGRTCSGGICSCDY

SEQ ID NO: 88159 - protein, 9 aa, Homo sapiens
  light chain complementarity determining region 3 for antibody 44080
HQSSRIPRT

SEQ ID NO: 88160 - protein, 15 aa, Homo sapiens
  heavy chain complementarity determining region 3 for antibody 44080
AREEGIPYAIRHLDC

SEQ ID NO: 88161 - protein, 9 aa, Homo sapiens
  light chain complementarity determining region 3 for antibody 44081
HQGYSTPFT

SEQ ID NO: 88162 - protein, 15 aa, Homo sapiens
  heavy chain complementarity determining region 3 for antibody 44081
AKAQLIWGQLYYFES

SEQ ID NO: 88163 - protein, 8 aa, Homo sapiens
  light chain complementarity determining region 3 for antibody 44082
HQCSDWLS

SEQ ID NO: 88164 - protein, 12 aa, Homo sapiens
  heavy chain complementarity determining region 3 for antibody 44082
VRSNWNLMTPDY

SEQ ID NO: 88165 - protein, 8 aa, Homo sapiens
  light chain complementarity determining region 3 for antibody 44083
HQCSDWLS

SEQ ID NO: 88166 - protein, 12 aa, Homo sapiens
  heavy chain complementarity determining region 3 for antibody 44083
ARSNWNLMTPDY

SEQ ID NO: 88167 - protein, 8 aa, Homo sapiens
  light chain complementarity determining region 3 for antibody 44084
HQCSDWLS

SEQ ID NO: 88168 - protein, 12 aa, Homo sapiens
  heavy chain complementarity determining region 3 for antibody 44084
ARSNWELMTPDY

SEQ ID NO: 88169 - protein, 9 aa, Homo sapiens
  light chain complementarity determining region 3 for antibody 44085
HHYVRSPLS

SEQ ID NO: 88170 - protein, 14 aa, Homo sapiens
  heavy chain complementarity determining region 3 for antibody 44085
ATRLVATTKTPFDY

SEQ ID NO: 88171 - protein, 9 aa, Homo sapiens
  light chain complementarity determining region 3 for antibody 44086
HHYVRSPLS

SEQ ID NO: 88172 - protein, 14 aa, Homo sapiens
  heavy chain complementarity determining region 3 for antibody 44086
ASRIVAPTKTPFEF

SEQ ID NO: 88173 - protein, 9 aa, Homo sapiens
  light chain complementarity determining region 3 for antibody 44087
HHYGSSPRT

SEQ ID NO: 88174 - protein, 17 aa, Homo sapiens
  heavy chain complementarity determining region 3 for antibody 44087
ARDDPIAQWLRLGPLDS

SEQ ID NO: 88175 - protein, 8 aa, Homo sapiens
  light chain complementarity determining region 3 for antibody 44088
HAYYSSPT

SEQ ID NO: 88176 - protein, 13 aa, Homo sapiens
  heavy chain complementarity determining region 3 for antibody 44088
ARDLPSNKGWFDP

SEQ ID NO: 88177 - protein, 10 aa, Homo sapiens
  light chain complementarity determining region 3 for antibody 44089
QRYGSSPMYT

SEQ ID NO: 88178 - protein, 13 aa, Homo sapiens
  heavy chain complementarity determining region 3 for antibody 44089
ARYNLEYYDAFDL

SEQ ID NO: 88179 - protein, 10 aa, Homo sapiens
  light chain complementarity determining region 3 for antibody 44090
QRTYNAPPLT

SEQ ID NO: 88180 - protein, 14 aa, Homo sapiens
  heavy chain complementarity determining region 3 for antibody 44090
AREREVIGAGYFDY

SEQ ID NO: 88181 - protein, 10 aa, Homo sapiens
  light chain complementarity determining region 3 for antibody 44091
QRLNTYPLLT

SEQ ID NO: 88182 - protein, 17 aa, Homo sapiens
  heavy chain complementarity determining region 3 for antibody 44091
AKDIFFGIAVAGTAFDI

SEQ ID NO: 88183 - protein, 10 aa, Homo sapiens
  light chain complementarity determining region 3 for antibody 44092
QRHGRSPPYT

SEQ ID NO: 88184 - protein, 15 aa, Homo sapiens
  heavy chain complementarity determining region 3 for antibody 44092
ARDQWLLLPGGFFDS

SEQ ID NO: 88185 - protein, 8 aa, Homo sapiens
  light chain complementarity determining region 3 for antibody 44093
QQYYSSKT

SEQ ID NO: 88186 - protein, 14 aa, Homo sapiens
  heavy chain complementarity determining region 3 for antibody 44093
AKDGPFYGDYSLDP

SEQ ID NO: 88187 - protein, 9 aa, Homo sapiens
  light chain complementarity determining region 3 for antibody 44094
QQYYRTPYT

SEQ ID NO: 88188 - protein, 11 aa, Homo sapiens
  heavy chain complementarity determining region 3 for antibody 44094
ARNTLTAYIDY

SEQ ID NO: 88189 - protein, 8 aa, Homo sapiens
  light chain complementarity determining region 3 for antibody 44095
QQYYRLFT

SEQ ID NO: 88190 - protein, 14 aa, Homo sapiens
  heavy chain complementarity determining region 3 for antibody 44095
ATSLGWCDGGSCFD

SEQ ID NO: 88191 - protein, 9 aa, Homo sapiens
  light chain complementarity determining region 3 for antibody 44096
QQYYAYPLT

SEQ ID NO: 88192 - protein, 16 aa, Homo sapiens
  heavy chain complementarity determining region 3 for antibody 44096
AKDSHHGYSGYDALDF

SEQ ID NO: 88193 - protein, 9 aa, Homo sapiens
  light chain complementarity determining region 3 for antibody 44097
QQYVSSPWT

SEQ ID NO: 88194 - protein, 14 aa, Homo sapiens
  heavy chain complementarity determining region 3 for antibody 44097
TSDPFGHYYGTFTI

SEQ ID NO: 88195 - protein, 9 aa, Homo sapiens
  light chain complementarity determining region 3 for antibody 44098
QQYVASPYT

SEQ ID NO: 88196 - protein, 10 aa, Homo sapiens
  heavy chain complementarity determining region 3 for antibody 44098
ARGGFVGMDY

SEQ ID NO: 88197 - protein, 9 aa, Homo sapiens
  light chain complementarity determining region 3 for antibody 44099
QQYTTYPLT

SEQ ID NO: 88198 - protein, 13 aa, Homo sapiens
  heavy chain complementarity determining region 3 for antibody 44099
TRGFSHGNDAFDI

SEQ ID NO: 88199 - protein, 9 aa, Homo sapiens
  light chain complementarity determining region 3 for antibody 44100
QQYTDSPRT

SEQ ID NO: 88200 - protein, 13 aa, Homo sapiens
  heavy chain complementarity determining region 3 for antibody 44100
ARAIATDYGLGEH

SEQ ID NO: 88201 - protein, 9 aa, Homo sapiens
  light chain complementarity determining region 3 for antibody 44101
QQYSSYSRT

SEQ ID NO: 88202 - protein, 14 aa, Homo sapiens
  heavy chain complementarity determining region 3 for antibody 44101
ARHFYGDYSGVGNY

SEQ ID NO: 88203 - protein, 10 aa, Homo sapiens
  light chain complementarity determining region 3 for antibody 44102
QQYSSYSGFT

SEQ ID NO: 88204 - protein, 20 aa, Homo sapiens
  heavy chain complementarity determining region 3 for antibody 44102
ARGGRAYYYGSGSAHNAQDY

SEQ ID NO: 88205 - protein, 9 aa, Homo sapiens
  light chain complementarity determining region 3 for antibody 44103
QQYSSYPLT

SEQ ID NO: 88206 - protein, 16 aa, Homo sapiens
  heavy chain complementarity determining region 3 for antibody 44103
ARRGWLGGTYSDPFDY

SEQ ID NO: 88207 - protein, 8 aa, Homo sapiens
  light chain complementarity determining region 3 for antibody 44104
QQYSNYRT

SEQ ID NO: 88208 - protein, 12 aa, Homo sapiens
  heavy chain complementarity determining region 3 for antibody 44104
ATSSQLVYYFDY

SEQ ID NO: 88209 - protein, 9 aa, Homo sapiens
  light chain complementarity determining region 3 for antibody 44105
QQYSNYPHT

SEQ ID NO: 88210 - protein, 15 aa, Homo sapiens
  heavy chain complementarity determining region 3 for antibody 44105
ARDLEVAVGGYYFDY

SEQ ID NO: 88211 - protein, 10 aa, Homo sapiens
  light chain complementarity determining region 3 for antibody 44106
QQYSNWPPYT

SEQ ID NO: 88212 - protein, 7 aa, Homo sapiens
  heavy chain complementarity determining region 3 for antibody 44106
ARNYFDY

SEQ ID NO: 88213 - protein, 9 aa, Homo sapiens
  light chain complementarity determining region 3 for antibody 44107
QQYSHWPPT

SEQ ID NO: 88214 - protein, 18 aa, Homo sapiens
  heavy chain complementarity determining region 3 for antibody 44107
ARDRMLSYGSGSYYWFDP

SEQ ID NO: 88215 - protein, 9 aa, Homo sapiens
  light chain complementarity determining region 3 for antibody 44108
QQYRSSPLT

SEQ ID NO: 88216 - protein, 15 aa, Homo sapiens
  heavy chain complementarity determining region 3 for antibody 44108
ARDGDTSGRYWYFDL

SEQ ID NO: 88217 - protein, 8 aa, Homo sapiens
  light chain complementarity determining region 3 for antibody 44109
QQYRSSFP

SEQ ID NO: 88218 - protein, 13 aa, Homo sapiens
  heavy chain complementarity determining region 3 for antibody 44109
ATESGWYQGAFDT

SEQ ID NO: 88219 - protein, 9 aa, Homo sapiens
  light chain complementarity determining region 3 for antibody 44110
QQYNVYPYT

SEQ ID NO: 88220 - protein, 19 aa, Homo sapiens
  heavy chain complementarity determining region 3 for antibody 44110
ARGPCGGDCYAHHYQAMDV

SEQ ID NO: 88221 - protein, 9 aa, Homo sapiens
  light chain complementarity determining region 3 for antibody 44111
QQYNTYPFS

SEQ ID NO: 88222 - protein, 13 aa, Homo sapiens
  heavy chain complementarity determining region 3 for antibody 44111
TKLRGGPVTTLEY

SEQ ID NO: 88223 - protein, 8 aa, Homo sapiens
  light chain complementarity determining region 3 for antibody 44112
QQYNTYCT

SEQ ID NO: 88224 - protein, 21 aa, Homo sapiens
  heavy chain complementarity determining region 3 for antibody 44112
ARGKTQRILMGRGVIPYYFDY

SEQ ID NO: 88225 - protein, 8 aa, Homo sapiens
  light chain complementarity determining region 3 for antibody 44113
QQYNTWPT

SEQ ID NO: 88226 - protein, 12 aa, Homo sapiens
  heavy chain complementarity determining region 3 for antibody 44113
VRRGVDGDHYRH

SEQ ID NO: 88227 - protein, 8 aa, Homo sapiens
  light chain complementarity determining region 3 for antibody 44114
QQYNSYYT

SEQ ID NO: 88228 - protein, 14 aa, Homo sapiens
  heavy chain complementarity determining region 3 for antibody 44114
ARGGGRGYYSSVDD

SEQ ID NO: 88229 - protein, 9 aa, Homo sapiens
  light chain complementarity determining region 3 for antibody 44115
QQYNSYSYT

SEQ ID NO: 88230 - protein, 19 aa, Homo sapiens
  heavy chain complementarity determining region 3 for antibody 44115
ARAPRYCSGGSCSRGWFDP

SEQ ID NO: 88231 - protein, 9 aa, Homo sapiens
  light chain complementarity determining region 3 for antibody 44116
QQYNSYSYI

SEQ ID NO: 88232 - protein, 11 aa, Homo sapiens
  heavy chain complementarity determining region 3 for antibody 44116
ARENGEDGFDV

SEQ ID NO: 88233 - protein, 9 aa, Homo sapiens
  light chain complementarity determining region 3 for antibody 44117
QQYNSYSWT

SEQ ID NO: 88234 - protein, 14 aa, Homo sapiens
  heavy chain complementarity determining region 3 for antibody 44117
ARLEIVEIPPGKNN

SEQ ID NO: 88235 - protein, 9 aa, Homo sapiens
  light chain complementarity determining region 3 for antibody 44118
QQYNSYSWT

SEQ ID NO: 88236 - protein, 17 aa, Homo sapiens
  heavy chain complementarity determining region 3 for antibody 44118
AKDSSRGYSYYFYGMDV

SEQ ID NO: 88237 - protein, 9 aa, Homo sapiens
  light chain complementarity determining region 3 for antibody 44119
QQYNSYSRT

SEQ ID NO: 88238 - protein, 14 aa, Homo sapiens
  heavy chain complementarity determining region 3 for antibody 44119
ARGVNSGSYYNLAH

SEQ ID NO: 88239 - protein, 9 aa, Homo sapiens
  light chain complementarity determining region 3 for antibody 44120
QQYNSYSIT

SEQ ID NO: 88240 - protein, 18 aa, Homo sapiens
  heavy chain complementarity determining region 3 for antibody 44120
ARIQPHIVVVTAIDRIDP

SEQ ID NO: 88241 - protein, 10 aa, Homo sapiens
  light chain complementarity determining region 3 for antibody 44121
QQYNSYSAKT

SEQ ID NO: 88242 - protein, 11 aa, Homo sapiens
  heavy chain complementarity determining region 3 for antibody 44121
ARAADYYGLDV

SEQ ID NO: 88243 - protein, 9 aa, Homo sapiens
  light chain complementarity determining region 3 for antibody 44122
QQYNSYPYT

SEQ ID NO: 88244 - protein, 13 aa, Homo sapiens
  heavy chain complementarity determining region 3 for antibody 44122
VRDRGDGYNQIDY

SEQ ID NO: 88245 - protein, 9 aa, Homo sapiens
  light chain complementarity determining region 3 for antibody 44123
QQYNSYPYT

SEQ ID NO: 88246 - protein, 11 aa, Homo sapiens
  heavy chain complementarity determining region 3 for antibody 44123
VHSRDSSGWYY

SEQ ID NO: 88247 - protein, 9 aa, Homo sapiens
  light chain complementarity determining region 3 for antibody 44124
QQYNSYPWT

SEQ ID NO: 88248 - protein, 20 aa, Homo sapiens
  heavy chain complementarity determining region 3 for antibody 44124
ATLRRERQQVVPSLRDPFDI

SEQ ID NO: 88249 - protein, 9 aa, Homo sapiens
  light chain complementarity determining region 3 for antibody 44125
QQYNSYPWT

SEQ ID NO: 88250 - protein, 17 aa, Homo sapiens
  heavy chain complementarity determining region 3 for antibody 44125
ARRRDLVVGVAAGSFDI

SEQ ID NO: 88251 - protein, 9 aa, Homo sapiens
  light chain complementarity determining region 3 for antibody 44126
QQYNSYPWT

SEQ ID NO: 88252 - protein, 14 aa, Homo sapiens
  heavy chain complementarity determining region 3 for antibody 44126
ARDSGADYHFGLDV

SEQ ID NO: 88253 - protein, 9 aa, Homo sapiens
  light chain complementarity determining region 3 for antibody 44127
QQYNSYPVT

SEQ ID NO: 88254 - protein, 12 aa, Homo sapiens
  heavy chain complementarity determining region 3 for antibody 44127
KPTGYTTAWSGH

SEQ ID NO: 88255 - protein, 9 aa, Homo sapiens
  light chain complementarity determining region 3 for antibody 44128
QQYNSYPRT

SEQ ID NO: 88256 - protein, 21 aa, Homo sapiens
  heavy chain complementarity determining region 3 for antibody 44128
ARVRGAVVEVTSNTDPDFFDV

SEQ ID NO: 88257 - protein, 9 aa, Homo sapiens
  light chain complementarity determining region 3 for antibody 44129
QQYNSYPRT

SEQ ID NO: 88258 - protein, 19 aa, Homo sapiens
  heavy chain complementarity determining region 3 for antibody 44129
ARAHTHYCADGVCYKSEDY

SEQ ID NO: 88259 - protein, 9 aa, Homo sapiens
  light chain complementarity determining region 3 for antibody 44130
QQYNSYPPT

SEQ ID NO: 88260 - protein, 29 aa, Homo sapiens
  heavy chain complementarity determining region 3 for antibody 44130
ARDRGRGFPPPRGRYDRSSYYPLDHGLDV

SEQ ID NO: 88261 - protein, 9 aa, Homo sapiens
  light chain complementarity determining region 3 for antibody 44131
QQYNSYFPT

SEQ ID NO: 88262 - protein, 15 aa, Homo sapiens
  heavy chain complementarity determining region 3 for antibody 44131
ARESGGDGYRDAFDI

SEQ ID NO: 88263 - protein, 10 aa, Homo sapiens
  light chain complementarity determining region 3 for antibody 44132
QQYNSWPPLT

SEQ ID NO: 88264 - protein, 8 aa, Homo sapiens
  heavy chain complementarity determining region 3 for antibody 44132
ARGGDLDY

SEQ ID NO: 88265 - protein, 9 aa, Homo sapiens
  light chain complementarity determining region 3 for antibody 44133
QQYNSSPQT

SEQ ID NO: 88266 - protein, 16 aa, Homo sapiens
  heavy chain complementarity determining region 3 for antibody 44133
ARLRFGELSDRAYFQH

SEQ ID NO: 88267 - protein, 9 aa, Homo sapiens
  light chain complementarity determining region 3 for antibody 44134
QQYNSGPLT

SEQ ID NO: 88268 - protein, 11 aa, Homo sapiens
  heavy chain complementarity determining region 3 for antibody 44134
VRHEVGCEVYS

SEQ ID NO: 88269 - protein, 9 aa, Homo sapiens
  light chain complementarity determining region 3 for antibody 44135
QQYNSFPYT

SEQ ID NO: 88270 - protein, 16 aa, Homo sapiens
  heavy chain complementarity determining region 3 for antibody 44135
AKDRFTYGVRGALMDV

SEQ ID NO: 88271 - protein, 9 aa, Homo sapiens
  light chain complementarity determining region 3 for antibody 44136
QQYNSAPLA

SEQ ID NO: 88272 - protein, 19 aa, Homo sapiens
  heavy chain complementarity determining region 3 for antibody 44136
AKPYENSDYYSNQGYYFDS

SEQ ID NO: 88273 - protein, 9 aa, Homo sapiens
  light chain complementarity determining region 3 for antibody 44137
QQYNRYALT

SEQ ID NO: 88274 - protein, 12 aa, Homo sapiens
  heavy chain complementarity determining region 3 for antibody 44137
ARIRYFDWFVDS

SEQ ID NO: 88275 - protein, 9 aa, Homo sapiens
  light chain complementarity determining region 3 for antibody 44138
QQYNNWTWT

SEQ ID NO: 88276 - protein, 19 aa, Homo sapiens
  heavy chain complementarity determining region 3 for antibody 44138
ARPATDFHDSDGTHNWFDP

SEQ ID NO: 88277 - protein, 9 aa, Homo sapiens
  light chain complementarity determining region 3 for antibody 44139
QQYNNWPRT

SEQ ID NO: 88278 - protein, 20 aa, Homo sapiens
  heavy chain complementarity determining region 3 for antibody 44139
ARRCPFYGSGSYYTPYFFDY

SEQ ID NO: 88279 - protein, 9 aa, Homo sapiens
  light chain complementarity determining region 3 for antibody 44140
QQYNNWPQT

SEQ ID NO: 88280 - protein, 16 aa, Homo sapiens
  heavy chain complementarity determining region 3 for antibody 44140
ARPSGAAGPRLSGLDV

SEQ ID NO: 88281 - protein, 9 aa, Homo sapiens
  light chain complementarity determining region 3 for antibody 44141
QQYNNWPLT

SEQ ID NO: 88282 - protein, 17 aa, Homo sapiens
  heavy chain complementarity determining region 3 for antibody 44141
ARGVDYYGSGGHHWFDP

SEQ ID NO: 88283 - protein, 9 aa, Homo sapiens
  light chain complementarity determining region 3 for antibody 44142
QQYNNLPYT

SEQ ID NO: 88284 - protein, 10 aa, Homo sapiens
  heavy chain complementarity determining region 3 for antibody 44142
VRVGKRWGKY

SEQ ID NO: 88285 - protein, 9 aa, Homo sapiens
  light chain complementarity determining region 3 for antibody 44143
QQYNKWPLT

SEQ ID NO: 88286 - protein, 15 aa, Homo sapiens
  heavy chain complementarity determining region 3 for antibody 44143
AKDICLGDSGCAFDI

SEQ ID NO: 88287 - protein, 11 aa, Homo sapiens
  light chain complementarity determining region 3 for antibody 44144
QQYNGYSPVFT

SEQ ID NO: 88288 - protein, 19 aa, Homo sapiens
  heavy chain complementarity determining region 3 for antibody 44144
VRTLNYYDDDGSYYCRFDP

SEQ ID NO: 88289 - protein, 9 aa, Homo sapiens
  light chain complementarity determining region 3 for antibody 44145
QQYNDYRYT

SEQ ID NO: 88290 - protein, 14 aa, Homo sapiens
  heavy chain complementarity determining region 3 for antibody 44145
TRLFSSASRRVFDP

SEQ ID NO: 88291 - protein, 9 aa, Homo sapiens
  light chain complementarity determining region 3 for antibody 44146
QQYKTYSQT

SEQ ID NO: 88292 - protein, 14 aa, Homo sapiens
  heavy chain complementarity determining region 3 for antibody 44146
ARAYDSSGYYYFDF

SEQ ID NO: 88293 - protein, 9 aa, Homo sapiens
  light chain complementarity determining region 3 for antibody 44147
QQYKSYPLT

SEQ ID NO: 88294 - protein, 19 aa, Homo sapiens
  heavy chain complementarity determining region 3 for antibody 44147
AKEAPSKYDSSGFAAFTED

SEQ ID NO: 88295 - protein, 8 aa, Homo sapiens
  light chain complementarity determining region 3 for antibody 44148
QQYKNWPT

SEQ ID NO: 88296 - protein, 13 aa, Homo sapiens
  heavy chain complementarity determining region 3 for antibody 44148
ASRNDGDYHLIDY

SEQ ID NO: 88297 - protein, 9 aa, Homo sapiens
  light chain complementarity determining region 3 for antibody 44149
QQYKNWPRT

SEQ ID NO: 88298 - protein, 18 aa, Homo sapiens
  heavy chain complementarity determining region 3 for antibody 44149
AREGTVAVVGGTRGAFDI

SEQ ID NO: 88299 - protein, 8 aa, Homo sapiens
  light chain complementarity determining region 3 for antibody 44150
QQYISYRS

SEQ ID NO: 88300 - protein, 27 aa, Homo sapiens
  heavy chain complementarity determining region 3 for antibody 44150
ARQMPAQPTRRLLMVRGVIGSFRWFDP

SEQ ID NO: 88301 - protein, 10 aa, Homo sapiens
  light chain complementarity determining region 3 for antibody 44151
QQYINWPAIT

SEQ ID NO: 88302 - protein, 17 aa, Homo sapiens
  heavy chain complementarity determining region 3 for antibody 44151
AKDIFFGIAVAGTAFDI

SEQ ID NO: 88303 - protein, 8 aa, Homo sapiens
  light chain complementarity determining region 3 for antibody 44152
QQYIHWWT

SEQ ID NO: 88304 - protein, 12 aa, Homo sapiens
  heavy chain complementarity determining region 3 for antibody 44152
ARIRDGYNYFAY

SEQ ID NO: 88305 - protein, 9 aa, Homo sapiens
  light chain complementarity determining region 3 for antibody 44153
QQYHTTPYT

SEQ ID NO: 88306 - protein, 14 aa, Homo sapiens
  heavy chain complementarity determining region 3 for antibody 44153
ALRWGSVYYDVSDV

SEQ ID NO: 88307 - protein, 10 aa, Homo sapiens
  light chain complementarity determining region 3 for antibody 44154
QQYHSYSPWT

SEQ ID NO: 88308 - protein, 20 aa, Homo sapiens
  heavy chain complementarity determining region 3 for antibody 44154
ARKDIVRGQPHPWSNLIFDS

SEQ ID NO: 88309 - protein, 8 aa, Homo sapiens
  light chain complementarity determining region 3 for antibody 44155
QQYHSYGT

SEQ ID NO: 88310 - protein, 24 aa, Homo sapiens
  heavy chain complementarity determining region 3 for antibody 44155
ARDQGSRHVGFFDSSDDFYSPFDM

SEQ ID NO: 88311 - protein, 8 aa, Homo sapiens
  light chain complementarity determining region 3 for antibody 44156
QQYHRWWT

SEQ ID NO: 88312 - protein, 15 aa, Homo sapiens
  heavy chain complementarity determining region 3 for antibody 44156
ARGVVSDSIGYYLDY

SEQ ID NO: 88313 - protein, 10 aa, Homo sapiens
  light chain complementarity determining region 3 for antibody 44157
QQYHNRPPDT

SEQ ID NO: 88314 - protein, 14 aa, Homo sapiens
  heavy chain complementarity determining region 3 for antibody 44157
ARDPPGIALAGNSG

SEQ ID NO: 88315 - protein, 8 aa, Homo sapiens
  light chain complementarity determining region 3 for antibody 44158
QQYHFHWT

SEQ ID NO: 88316 - protein, 11 aa, Homo sapiens
  heavy chain complementarity determining region 3 for antibody 44158
ASRDVVETRPF

SEQ ID NO: 88317 - protein, 9 aa, Homo sapiens
  light chain complementarity determining region 3 for antibody 44159
QQYHDYTGT

SEQ ID NO: 88318 - protein, 17 aa, Homo sapiens
  heavy chain complementarity determining region 3 for antibody 44159
ARSRDNWNVSPYGSLDH

SEQ ID NO: 88319 - protein, 9 aa, Homo sapiens
  light chain complementarity determining region 3 for antibody 44160
QQYGVSPVT

SEQ ID NO: 88320 - protein, 11 aa, Homo sapiens
  heavy chain complementarity determining region 3 for antibody 44160
ARVFRSWIFDL

SEQ ID NO: 88321 - protein, 9 aa, Homo sapiens
  light chain complementarity determining region 3 for antibody 44161
QQYGTSPVT

SEQ ID NO: 88322 - protein, 19 aa, Homo sapiens
  heavy chain complementarity determining region 3 for antibody 44161
ARDQNADYDVLTGYNPADY

SEQ ID NO: 88323 - protein, 10 aa, Homo sapiens
  light chain complementarity determining region 3 for antibody 44162
QQYGTSPLYT

SEQ ID NO: 88324 - protein, 18 aa, Homo sapiens
  heavy chain complementarity determining region 3 for antibody 44162
ARADYDDSSGYYFYYFDS

SEQ ID NO: 88325 - protein, 9 aa, Homo sapiens
  light chain complementarity determining region 3 for antibody 44163
QQYGSSPYT

SEQ ID NO: 88326 - protein, 19 aa, Homo sapiens
  heavy chain complementarity determining region 3 for antibody 44163
ARGHNYCSGGSCYSLARDY

SEQ ID NO: 88327 - protein, 9 aa, Homo sapiens
  light chain complementarity determining region 3 for antibody 44164
QQYGSSPYT

SEQ ID NO: 88328 - protein, 11 aa, Homo sapiens
  heavy chain complementarity determining region 3 for antibody 44164
ARDEGRRIMYY

SEQ ID NO: 88329 - protein, 9 aa, Homo sapiens
  light chain complementarity determining region 3 for antibody 44165
QQYGSSPVT

SEQ ID NO: 88330 - protein, 16 aa, Homo sapiens
  heavy chain complementarity determining region 3 for antibody 44165
ARHTVNGWAMVKIFDS

SEQ ID NO: 88331 - protein, 10 aa, Homo sapiens
  light chain complementarity determining region 3 for antibody 44166
QQYGSSPTWT

SEQ ID NO: 88332 - protein, 16 aa, Homo sapiens
  heavy chain complementarity determining region 3 for antibody 44166
AKAGGKWLNTDGFFES

SEQ ID NO: 88333 - protein, 10 aa, Homo sapiens
  light chain complementarity determining region 3 for antibody 44167
QQYGSSPRYT

SEQ ID NO: 88334 - protein, 12 aa, Homo sapiens
  heavy chain complementarity determining region 3 for antibody 44167
ARGGSGGTAFDY

SEQ ID NO: 88335 - protein, 9 aa, Homo sapiens
  light chain complementarity determining region 3 for antibody 44168
QQYGSSPRT

SEQ ID NO: 88336 - protein, 17 aa, Homo sapiens
  heavy chain complementarity determining region 3 for antibody 44168
VREDGCSGGSCRLYFDL

SEQ ID NO: 88337 - protein, 9 aa, Homo sapiens
  light chain complementarity determining region 3 for antibody 44169
QQYGSSPRT

SEQ ID NO: 88338 - protein, 22 aa, Homo sapiens
  heavy chain complementarity determining region 3 for antibody 44169
ARVLGTCSGDICYSYHDDAFGT

SEQ ID NO: 88339 - protein, 9 aa, Homo sapiens
  light chain complementarity determining region 3 for antibody 44170
QQYGSSPRT

SEQ ID NO: 88340 - protein, 13 aa, Homo sapiens
  heavy chain complementarity determining region 3 for antibody 44170
ARGKYESSGYKEN

SEQ ID NO: 88341 - protein, 9 aa, Homo sapiens
  light chain complementarity determining region 3 for antibody 44171
QQYGSSPRT

SEQ ID NO: 88342 - protein, 8 aa, Homo sapiens
  heavy chain complementarity determining region 3 for antibody 44171
ARGFQYDL

SEQ ID NO: 88343 - protein, 9 aa, Homo sapiens
  light chain complementarity determining region 3 for antibody 44172
QQYGSSPRT

SEQ ID NO: 88344 - protein, 17 aa, Homo sapiens
  heavy chain complementarity determining region 3 for antibody 44172
AREPGRRGWGSFGGFDY

SEQ ID NO: 88345 - protein, 9 aa, Homo sapiens
  light chain complementarity determining region 3 for antibody 44173
QQYGSSPRT

SEQ ID NO: 88346 - protein, 11 aa, Homo sapiens
  heavy chain complementarity determining region 3 for antibody 44173
ARDSGVRVSNL

SEQ ID NO: 88347 - protein, 9 aa, Homo sapiens
  light chain complementarity determining region 3 for antibody 44174
QQYGSSPRT

SEQ ID NO: 88348 - protein, 20 aa, Homo sapiens
  heavy chain complementarity determining region 3 for antibody 44174
AHGTVLAFNFWNDYPYYFDF

SEQ ID NO: 88349 - protein, 9 aa, Homo sapiens
  light chain complementarity determining region 3 for antibody 44175
QQYGSSPQT

SEQ ID NO: 88350 - protein, 11 aa, Homo sapiens
  heavy chain complementarity determining region 3 for antibody 44175
ARKPTRMALDY

SEQ ID NO: 88351 - protein, 12 aa, Homo sapiens
  light chain complementarity determining region 3 for antibody 44176
QQYGSSPPWPWT

SEQ ID NO: 88352 - protein, 14 aa, Homo sapiens
  heavy chain complementarity determining region 3 for antibody 44176
VRGGSSGYYHQLDY

SEQ ID NO: 88353 - protein, 9 aa, Homo sapiens
  light chain complementarity determining region 3 for antibody 44177
QQYGSSPPT

SEQ ID NO: 88354 - protein, 14 aa, Homo sapiens
  heavy chain complementarity determining region 3 for antibody 44177
AKMGTSSWYPYFEY

SEQ ID NO: 88355 - protein, 11 aa, Homo sapiens
  light chain complementarity determining region 3 for antibody 44178
QQYGSSPPGYT

SEQ ID NO: 88356 - protein, 16 aa, Homo sapiens
  heavy chain complementarity determining region 3 for antibody 44178
AKEYDFWSAYYSAVDY

SEQ ID NO: 88357 - protein, 10 aa, Homo sapiens
  light chain complementarity determining region 3 for antibody 44179
QQYGSSPPGT

SEQ ID NO: 88358 - protein, 14 aa, Homo sapiens
  heavy chain complementarity determining region 3 for antibody 44179
AKRGRKAATGYFDS

SEQ ID NO: 88359 - protein, 10 aa, Homo sapiens
  light chain complementarity determining region 3 for antibody 44180
QQYGSSPPAT

SEQ ID NO: 88360 - protein, 11 aa, Homo sapiens
  heavy chain complementarity determining region 3 for antibody 44180
ARHGSEMELDF

SEQ ID NO: 88361 - protein, 9 aa, Homo sapiens
  light chain complementarity determining region 3 for antibody 44181
QQYGSSPGT

SEQ ID NO: 88362 - protein, 18 aa, Homo sapiens
  heavy chain complementarity determining region 3 for antibody 44181
ARGLLWNRGVRGKTAFDY

SEQ ID NO: 88363 - protein, 9 aa, Homo sapiens
  light chain complementarity determining region 3 for antibody 44182
QQYGSSGGT

SEQ ID NO: 88364 - protein, 14 aa, Homo sapiens
  heavy chain complementarity determining region 3 for antibody 44182
ARDAPSYNYGAFDY

SEQ ID NO: 88365 - protein, 9 aa, Homo sapiens
  light chain complementarity determining region 3 for antibody 44183
QQYGSQRYT

SEQ ID NO: 88366 - protein, 17 aa, Homo sapiens
  heavy chain complementarity determining region 3 for antibody 44183
AKDIFFGIAVAGTAFEI

SEQ ID NO: 88367 - protein, 9 aa, Homo sapiens
  light chain complementarity determining region 3 for antibody 44184
QQYGSLQYS

SEQ ID NO: 88368 - protein, 14 aa, Homo sapiens
  heavy chain complementarity determining region 3 for antibody 44184
VRGKDNYFSRNFDQ

SEQ ID NO: 88369 - protein, 10 aa, Homo sapiens
  light chain complementarity determining region 3 for antibody 44185
QQYGRSLPIT

SEQ ID NO: 88370 - protein, 22 aa, Homo sapiens
  heavy chain complementarity determining region 3 for antibody 44185
AHRRLTLEFLETHPKTKNWFNP

SEQ ID NO: 88371 - protein, 9 aa, Homo sapiens
  light chain complementarity determining region 3 for antibody 44186
QQYGNSPWT

SEQ ID NO: 88372 - protein, 13 aa, Homo sapiens
  heavy chain complementarity determining region 3 for antibody 44186
AFSTADALDAFDV

SEQ ID NO: 88373 - protein, 10 aa, Homo sapiens
  light chain complementarity determining region 3 for antibody 44187
QQYGNSPLYS

SEQ ID NO: 88374 - protein, 13 aa, Homo sapiens
  heavy chain complementarity determining region 3 for antibody 44187
ARGSNGFYYYFDY

SEQ ID NO: 88375 - protein, 9 aa, Homo sapiens
  light chain complementarity determining region 3 for antibody 44188
QQYGNSPLT

SEQ ID NO: 88376 - protein, 19 aa, Homo sapiens
  heavy chain complementarity determining region 3 for antibody 44188
VRVGVVYHGSGSPYNWFDP

SEQ ID NO: 88377 - protein, 9 aa, Homo sapiens
  light chain complementarity determining region 3 for antibody 44189
QQYGLSMYT

SEQ ID NO: 88378 - protein, 14 aa, Homo sapiens
  heavy chain complementarity determining region 3 for antibody 44189
ARTNHLLYNDAFDI

SEQ ID NO: 88379 - protein, 9 aa, Homo sapiens
  light chain complementarity determining region 3 for antibody 44190
QQYGISPWT

SEQ ID NO: 88380 - protein, 14 aa, Homo sapiens
  heavy chain complementarity determining region 3 for antibody 44190
ARFHDESGYYRLDY

SEQ ID NO: 88381 - protein, 9 aa, Homo sapiens
  light chain complementarity determining region 3 for antibody 44191
QQYGGSPRT

SEQ ID NO: 88382 - protein, 19 aa, Homo sapiens
  heavy chain complementarity determining region 3 for antibody 44191
VRDNGYYDFWNTNLYYFDY

SEQ ID NO: 88383 - protein, 9 aa, Homo sapiens
  light chain complementarity determining region 3 for antibody 44192
QQYGGSPRT

SEQ ID NO: 88384 - protein, 17 aa, Homo sapiens
  heavy chain complementarity determining region 3 for antibody 44192
ARDGGNAGLESGDTWPY

SEQ ID NO: 88385 - protein, 9 aa, Homo sapiens
  light chain complementarity determining region 3 for antibody 44193
QQYFRAPWT

SEQ ID NO: 88386 - protein, 12 aa, Homo sapiens
  heavy chain complementarity determining region 3 for antibody 44193
LGSTGSDYYFDY

SEQ ID NO: 88387 - protein, 9 aa, Homo sapiens
  light chain complementarity determining region 3 for antibody 44194
QQYETYPFT

SEQ ID NO: 88388 - protein, 13 aa, Homo sapiens
  heavy chain complementarity determining region 3 for antibody 44194
ARGSSAIIVGHNF

SEQ ID NO: 88389 - protein, 9 aa, Homo sapiens
  light chain complementarity determining region 3 for antibody 44195
QQYERSPRM

SEQ ID NO: 88390 - protein, 15 aa, Homo sapiens
  heavy chain complementarity determining region 3 for antibody 44195
ARDGNVLSTGYPLDS

SEQ ID NO: 88391 - protein, 9 aa, Homo sapiens
  light chain complementarity determining region 3 for antibody 44196
QQYENLPIT

SEQ ID NO: 88392 - protein, 12 aa, Homo sapiens
  heavy chain complementarity determining region 3 for antibody 44196
TTFYPGAGYFQH

SEQ ID NO: 88393 - protein, 9 aa, Homo sapiens
  light chain complementarity determining region 3 for antibody 44197
QQYDTYSYT

SEQ ID NO: 88394 - protein, 13 aa, Homo sapiens
  heavy chain complementarity determining region 3 for antibody 44197
ARSAGDGRDASDI

SEQ ID NO: 88395 - protein, 11 aa, Homo sapiens
  light chain complementarity determining region 3 for antibody 44198
QQYDTSPSGYT

SEQ ID NO: 88396 - protein, 14 aa, Homo sapiens
  heavy chain complementarity determining region 3 for antibody 44198
ARETSNSRKRSFDQ

SEQ ID NO: 88397 - protein, 11 aa, Homo sapiens
  light chain complementarity determining region 3 for antibody 44199
QQYDTSPPGYP

SEQ ID NO: 88398 - protein, 14 aa, Homo sapiens
  heavy chain complementarity determining region 3 for antibody 44199
ARETSNSRKRSFDQ

SEQ ID NO: 88399 - protein, 11 aa, Homo sapiens
  light chain complementarity determining region 3 for antibody 44200
QQYDTSPPGSP

SEQ ID NO: 88400 - protein, 14 aa, Homo sapiens
  heavy chain complementarity determining region 3 for antibody 44200
ARETSNSRKRSFDQ

SEQ ID NO: 88401 - protein, 9 aa, Homo sapiens
  light chain complementarity determining region 3 for antibody 44201
QQYDSLPYT

SEQ ID NO: 88402 - protein, 17 aa, Homo sapiens
  heavy chain complementarity determining region 3 for antibody 44201
ARHLLRAPGGRSSYFEH

SEQ ID NO: 88403 - protein, 10 aa, Homo sapiens
  light chain complementarity determining region 3 for antibody 44202
QQYDSLPPLT

SEQ ID NO: 88404 - protein, 12 aa, Homo sapiens
  heavy chain complementarity determining region 3 for antibody 44202
ARYNWARGGFDN

SEQ ID NO: 88405 - protein, 10 aa, Homo sapiens
  light chain complementarity determining region 3 for antibody 44203
QQYDNWPPWT

SEQ ID NO: 88406 - protein, 12 aa, Homo sapiens
  heavy chain complementarity determining region 3 for antibody 44203
ARGIATGGYYPN

SEQ ID NO: 88407 - protein, 9 aa, Homo sapiens
  light chain complementarity determining region 3 for antibody 44204
QQYDNVTFT

SEQ ID NO: 88408 - protein, 6 aa, Homo sapiens
  heavy chain complementarity determining region 3 for antibody 44204
VSLMFA

SEQ ID NO: 88409 - protein, 9 aa, Homo sapiens
  light chain complementarity determining region 3 for antibody 44205
QQYDNVPFT

SEQ ID NO: 88410 - protein, 11 aa, Homo sapiens
  heavy chain complementarity determining region 3 for antibody 44205
ATSPGGRGGHY

SEQ ID NO: 88411 - protein, 9 aa, Homo sapiens
  light chain complementarity determining region 3 for antibody 44206
QQYDNLPRT

SEQ ID NO: 88412 - protein, 25 aa, Homo sapiens
  heavy chain complementarity determining region 3 for antibody 44206
ARDSHLGEYDESGYYFPHNYFGMDV

SEQ ID NO: 88413 - protein, 9 aa, Homo sapiens
  light chain complementarity determining region 3 for antibody 44207
QQYDNLPLT

SEQ ID NO: 88414 - protein, 19 aa, Homo sapiens
  heavy chain complementarity determining region 3 for antibody 44207
ARGGSLIDVVPTFYYAMDV

SEQ ID NO: 88415 - protein, 9 aa, Homo sapiens
  light chain complementarity determining region 3 for antibody 44208
QQYDNLPLT

SEQ ID NO: 88416 - protein, 25 aa, Homo sapiens
  heavy chain complementarity determining region 3 for antibody 44208
ARERVDYYYDSSGDPWAKYTYGLDV

SEQ ID NO: 88417 - protein, 9 aa, Homo sapiens
  light chain complementarity determining region 3 for antibody 44209
QQYDNLPIT

SEQ ID NO: 88418 - protein, 15 aa, Homo sapiens
  heavy chain complementarity determining region 3 for antibody 44209
ARAHTNDGGKVAFDS

SEQ ID NO: 88419 - protein, 10 aa, Homo sapiens
  light chain complementarity determining region 3 for antibody 44210
QQYDNLLRCT

SEQ ID NO: 88420 - protein, 15 aa, Homo sapiens
  heavy chain complementarity determining region 3 for antibody 44210
ARLRGWEVRGRAFPI

SEQ ID NO: 88421 - protein, 9 aa, Homo sapiens
  light chain complementarity determining region 3 for antibody 44211
QQYDKSLYT

SEQ ID NO: 88422 - protein, 20 aa, Homo sapiens
  heavy chain complementarity determining region 3 for antibody 44211
ARDSGYCSGGSCSYYYGLDV

SEQ ID NO: 88423 - protein, 12 aa, Homo sapiens
  light chain complementarity determining region 3 for antibody 44212
QQYDGLPPGRYI

SEQ ID NO: 88424 - protein, 20 aa, Homo sapiens
  heavy chain complementarity determining region 3 for antibody 44212
ARGHPMWFGATRNKNYYFDN

SEQ ID NO: 88425 - protein, 9 aa, Homo sapiens
  light chain complementarity determining region 3 for antibody 44213
QQYDDLLPT

SEQ ID NO: 88426 - protein, 16 aa, Homo sapiens
  heavy chain complementarity determining region 3 for antibody 44213
ARYHIQVTGINYYFDY

SEQ ID NO: 88427 - protein, 10 aa, Homo sapiens
  light chain complementarity determining region 3 for antibody 44214
QQYDDILPIT

SEQ ID NO: 88428 - protein, 12 aa, Homo sapiens
  heavy chain complementarity determining region 3 for antibody 44214
VRDVTGTRLFDY

SEQ ID NO: 88429 - protein, 8 aa, Homo sapiens
  light chain complementarity determining region 3 for antibody 44215
QQYDDGYT

SEQ ID NO: 88430 - protein, 19 aa, Homo sapiens
  heavy chain complementarity determining region 3 for antibody 44215
ARGARRYFGSGPPPGSLDI

SEQ ID NO: 88431 - protein, 8 aa, Homo sapiens
  light chain complementarity determining region 3 for antibody 44216
QQVNSYPT

SEQ ID NO: 88432 - protein, 22 aa, Homo sapiens
  heavy chain complementarity determining region 3 for antibody 44216
TRSAMGGMWVGADHYHYYGMDV

SEQ ID NO: 88433 - protein, 9 aa, Homo sapiens
  light chain complementarity determining region 3 for antibody 44217
QQVNNYPRT

SEQ ID NO: 88434 - protein, 22 aa, Homo sapiens
  heavy chain complementarity determining region 3 for antibody 44217
AKEMGILRFLEWRDPAQNYFGF

SEQ ID NO: 88435 - protein, 10 aa, Homo sapiens
  light chain complementarity determining region 3 for antibody 44218
QQVKSYPPWT

SEQ ID NO: 88436 - protein, 15 aa, Homo sapiens
  heavy chain complementarity determining region 3 for antibody 44218
ARQGDGSTWYPHFDY

SEQ ID NO: 88437 - protein, 9 aa, Homo sapiens
  light chain complementarity determining region 3 for antibody 44219
QQVISYPFT

SEQ ID NO: 88438 - protein, 12 aa, Homo sapiens
  heavy chain complementarity determining region 3 for antibody 44219
ARPLDGDHGFDP

SEQ ID NO: 88439 - protein, 9 aa, Homo sapiens
  light chain complementarity determining region 3 for antibody 44220
QQTYSTPLT

SEQ ID NO: 88440 - protein, 15 aa, Homo sapiens
  heavy chain complementarity determining region 3 for antibody 44220
AKEAGFSVLRGRLQY

SEQ ID NO: 88441 - protein, 9 aa, Homo sapiens
  light chain complementarity determining region 3 for antibody 44221
QQTYSPLWT

SEQ ID NO: 88442 - protein, 13 aa, Homo sapiens
  heavy chain complementarity determining region 3 for antibody 44221
ARHNSGTYFRFDY

SEQ ID NO: 88443 - protein, 8 aa, Homo sapiens
  light chain complementarity determining region 3 for antibody 44222
QQTYNNPS

SEQ ID NO: 88444 - protein, 24 aa, Homo sapiens
  heavy chain complementarity determining region 3 for antibody 44222
ARDSTHFYYDSSGYYFAPGGDFDF

SEQ ID NO: 88445 - protein, 9 aa, Homo sapiens
  light chain complementarity determining region 3 for antibody 44223
QQTYGTPYT

SEQ ID NO: 88446 - protein, 17 aa, Homo sapiens
  heavy chain complementarity determining region 3 for antibody 44223
ARDAADYGDNHIYYFDY

SEQ ID NO: 88447 - protein, 9 aa, Homo sapiens
  light chain complementarity determining region 3 for antibody 44224
QQTDRAPLT

SEQ ID NO: 88448 - protein, 13 aa, Homo sapiens
  heavy chain complementarity determining region 3 for antibody 44224
VRDKVEGPTILDF

SEQ ID NO: 88449 - protein, 9 aa, Homo sapiens
  light chain complementarity determining region 3 for antibody 44225
QQSYTTPFT

SEQ ID NO: 88450 - protein, 13 aa, Homo sapiens
  heavy chain complementarity determining region 3 for antibody 44225
ARHAHGDYELVDY

SEQ ID NO: 88451 - protein, 9 aa, Homo sapiens
  light chain complementarity determining region 3 for antibody 44226
QQSYSTPYT

SEQ ID NO: 88452 - protein, 13 aa, Homo sapiens
  heavy chain complementarity determining region 3 for antibody 44226
ARDGGGGYNPIDF

SEQ ID NO: 88453 - protein, 9 aa, Homo sapiens
  light chain complementarity determining region 3 for antibody 44227
QQSYSTPWT

SEQ ID NO: 88454 - protein, 15 aa, Homo sapiens
  heavy chain complementarity determining region 3 for antibody 44227
VRDPRTYWGPYYFDY

SEQ ID NO: 88455 - protein, 10 aa, Homo sapiens
  light chain complementarity determining region 3 for antibody 44228
QQSYSTPRYT

SEQ ID NO: 88456 - protein, 14 aa, Homo sapiens
  heavy chain complementarity determining region 3 for antibody 44228
VKSYAPMTRGVFDF

SEQ ID NO: 88457 - protein, 9 aa, Homo sapiens
  light chain complementarity determining region 3 for antibody 44229
QQSYSTPRT

SEQ ID NO: 88458 - protein, 12 aa, Homo sapiens
  heavy chain complementarity determining region 3 for antibody 44229
CRDPHAGWERGF

SEQ ID NO: 88459 - protein, 9 aa, Homo sapiens
  light chain complementarity determining region 3 for antibody 44230
QQSYSTPRT

SEQ ID NO: 88460 - protein, 11 aa, Homo sapiens
  heavy chain complementarity determining region 3 for antibody 44230
ARDKPFGWFDS

SEQ ID NO: 88461 - protein, 9 aa, Homo sapiens
  light chain complementarity determining region 3 for antibody 44231
QQSYSTPQT

SEQ ID NO: 88462 - protein, 13 aa, Homo sapiens
  heavy chain complementarity determining region 3 for antibody 44231
ARENLGNYVVFDT

SEQ ID NO: 88463 - protein, 9 aa, Homo sapiens
  light chain complementarity determining region 3 for antibody 44232
QQSYSTPPT

SEQ ID NO: 88464 - protein, 8 aa, Homo sapiens
  heavy chain complementarity determining region 3 for antibody 44232
AAEYTFPV

SEQ ID NO: 88465 - protein, 9 aa, Homo sapiens
  light chain complementarity determining region 3 for antibody 44233
QQSYSTPLT

SEQ ID NO: 88466 - protein, 17 aa, Homo sapiens
  heavy chain complementarity determining region 3 for antibody 44233
TPHPIIIVRGVITPFDY

SEQ ID NO: 88467 - protein, 9 aa, Homo sapiens
  light chain complementarity determining region 3 for antibody 44234
QQSYSTPFT

SEQ ID NO: 88468 - protein, 12 aa, Homo sapiens
  heavy chain complementarity determining region 3 for antibody 44234
ARHWTSATYFDS

SEQ ID NO: 88469 - protein, 8 aa, Homo sapiens
  light chain complementarity determining region 3 for antibody 44235
QQSYSTLT

SEQ ID NO: 88470 - protein, 22 aa, Homo sapiens
  heavy chain complementarity determining region 3 for antibody 44235
ARKMAGLLGDPERYYHYYNMDV

SEQ ID NO: 88471 - protein, 10 aa, Homo sapiens
  light chain complementarity determining region 3 for antibody 44236
QQSYSSSPYT

SEQ ID NO: 88472 - protein, 12 aa, Homo sapiens
  heavy chain complementarity determining region 3 for antibody 44236
ATRDTYGHNFDS

SEQ ID NO: 88473 - protein, 9 aa, Homo sapiens
  light chain complementarity determining region 3 for antibody 44237
QQSYSAPPD

SEQ ID NO: 88474 - protein, 30 aa, Homo sapiens
  heavy chain complementarity determining region 3 for antibody 44237
ARLAEDLPGRWFDGPDGGPGSDYYWYPMDV

SEQ ID NO: 88475 - protein, 9 aa, Homo sapiens
  light chain complementarity determining region 3 for antibody 44238
QQSYSAPPD

SEQ ID NO: 88476 - protein, 17 aa, Homo sapiens
  heavy chain complementarity determining region 3 for antibody 44238
ARGLHHADGTYFHGMDV

SEQ ID NO: 88477 - protein, 9 aa, Homo sapiens
  light chain complementarity determining region 3 for antibody 44239
QQSYRTPYT

SEQ ID NO: 88478 - protein, 20 aa, Homo sapiens
  heavy chain complementarity determining region 3 for antibody 44239
TADRVVLRFLERPPKSWFDP

SEQ ID NO: 88479 - protein, 9 aa, Homo sapiens
  light chain complementarity determining region 3 for antibody 44240
QQSYRTPIT

SEQ ID NO: 88480 - protein, 17 aa, Homo sapiens
  heavy chain complementarity determining region 3 for antibody 44240
ARLASVVGTTRGDAFDI

SEQ ID NO: 88481 - protein, 8 aa, Homo sapiens
  light chain complementarity determining region 3 for antibody 44241
QQSYNTLT

SEQ ID NO: 88482 - protein, 18 aa, Homo sapiens
  heavy chain complementarity determining region 3 for antibody 44241
ARERLSVPWFGELPHFDH

SEQ ID NO: 88483 - protein, 9 aa, Homo sapiens
  light chain complementarity determining region 3 for antibody 44242
QQSYNIPWT

SEQ ID NO: 88484 - protein, 15 aa, Homo sapiens
  heavy chain complementarity determining region 3 for antibody 44242
ARWGNDNGDYGRLDY

SEQ ID NO: 88485 - protein, 9 aa, Homo sapiens
  light chain complementarity determining region 3 for antibody 44243
QQSYNIPFT

SEQ ID NO: 88486 - protein, 18 aa, Homo sapiens
  heavy chain complementarity determining region 3 for antibody 44243
ARYDFYYSSGTYYHVIDY

SEQ ID NO: 88487 - protein, 9 aa, Homo sapiens
  light chain complementarity determining region 3 for antibody 44244
QQSYNAPLT

SEQ ID NO: 88488 - protein, 16 aa, Homo sapiens
  heavy chain complementarity determining region 3 for antibody 44244
ARQSWIRGVLLGAFDY

SEQ ID NO: 88489 - protein, 9 aa, Homo sapiens
  light chain complementarity determining region 3 for antibody 44245
QQSSTTPQT

SEQ ID NO: 88490 - protein, 15 aa, Homo sapiens
  heavy chain complementarity determining region 3 for antibody 44245
AREITMMRGGGWFDP

SEQ ID NO: 88491 - protein, 9 aa, Homo sapiens
  light chain complementarity determining region 3 for antibody 44246
QQSHSTPCS

SEQ ID NO: 88492 - protein, 18 aa, Homo sapiens
  heavy chain complementarity determining region 3 for antibody 44246
AGPASVTWGGNYYYYMDV

SEQ ID NO: 88493 - protein, 9 aa, Homo sapiens
  light chain complementarity determining region 3 for antibody 44247
QQSHDFPYS

SEQ ID NO: 88494 - protein, 13 aa, Homo sapiens
  heavy chain complementarity determining region 3 for antibody 44247
ATLRNVDGWPFDY

SEQ ID NO: 88495 - protein, 9 aa, Homo sapiens
  light chain complementarity determining region 3 for antibody 44248
QQSGNLPLT

SEQ ID NO: 88496 - protein, 14 aa, Homo sapiens
  heavy chain complementarity determining region 3 for antibody 44248
ATGAMIRFPGYFDY

SEQ ID NO: 88497 - protein, 9 aa, Homo sapiens
  light chain complementarity determining region 3 for antibody 44249
QQSFSYPYT

SEQ ID NO: 88498 - protein, 20 aa, Homo sapiens
  heavy chain complementarity determining region 3 for antibody 44249
AKDLWDGGFCSSTSCHGIDY

SEQ ID NO: 88499 - protein, 9 aa, Homo sapiens
  light chain complementarity determining region 3 for antibody 44250
QQSFSTPLT

SEQ ID NO: 88500 - protein, 9 aa, Homo sapiens
  heavy chain complementarity determining region 3 for antibody 44250
ARDLGSSSH

SEQ ID NO: 88501 - protein, 9 aa, Homo sapiens
  light chain complementarity determining region 3 for antibody 44251
QQSFSTPFT

SEQ ID NO: 88502 - protein, 14 aa, Homo sapiens
  heavy chain complementarity determining region 3 for antibody 44251
ARDPYITATVRVDK

SEQ ID NO: 88503 - protein, 9 aa, Homo sapiens
  light chain complementarity determining region 3 for antibody 44252
QQSFSAPPS

SEQ ID NO: 88504 - protein, 20 aa, Homo sapiens
  heavy chain complementarity determining region 3 for antibody 44252
ATMGPYRYYSDNSGPNWFDT

SEQ ID NO: 88505 - protein, 10 aa, Homo sapiens
  light chain complementarity determining region 3 for antibody 44253
QQSFNTLSIT

SEQ ID NO: 88506 - protein, 13 aa, Homo sapiens
  heavy chain complementarity determining region 3 for antibody 44253
VRDFEFGSSCYDY

SEQ ID NO: 88507 - protein, 9 aa, Homo sapiens
  light chain complementarity determining region 3 for antibody 44254
QQSFKTPWT

SEQ ID NO: 88508 - protein, 19 aa, Homo sapiens
  heavy chain complementarity determining region 3 for antibody 44254
ARVSDLGERDGYNYDSFDI

SEQ ID NO: 88509 - protein, 9 aa, Homo sapiens
  light chain complementarity determining region 3 for antibody 44255
QQSDVLPVT

SEQ ID NO: 88510 - protein, 14 aa, Homo sapiens
  heavy chain complementarity determining region 3 for antibody 44255
ARGKRSGWHFRFDY

SEQ ID NO: 88511 - protein, 9 aa, Homo sapiens
  light chain complementarity determining region 3 for antibody 44256
QQSDSPLWT

SEQ ID NO: 88512 - protein, 13 aa, Homo sapiens
  heavy chain complementarity determining region 3 for antibody 44256
AKHRRYAGGWYDY

SEQ ID NO: 88513 - protein, 9 aa, Homo sapiens
  light chain complementarity determining region 3 for antibody 44257
QQSASAPYS

SEQ ID NO: 88514 - protein, 18 aa, Homo sapiens
  heavy chain complementarity determining region 3 for antibody 44257
ARHASDPISMPLSFWFDP

SEQ ID NO: 88515 - protein, 10 aa, Homo sapiens
  light chain complementarity determining region 3 for antibody 44258
QQRTDRPPYP

SEQ ID NO: 88516 - protein, 15 aa, Homo sapiens
  heavy chain complementarity determining region 3 for antibody 44258
ARLMGDWELPRGTDY

SEQ ID NO: 88517 - protein, 12 aa, Homo sapiens
  light chain complementarity determining region 3 for antibody 44259
QQRSNWPPVSLP

SEQ ID NO: 88518 - protein, 15 aa, Homo sapiens
  heavy chain complementarity determining region 3 for antibody 44259
ARDRLHSSGNFYFDY

SEQ ID NO: 88519 - protein, 10 aa, Homo sapiens
  light chain complementarity determining region 3 for antibody 44260
QQRSNWPPLT

SEQ ID NO: 88520 - protein, 16 aa, Homo sapiens
  heavy chain complementarity determining region 3 for antibody 44260
TRDRSNWNYIYYGMDV

SEQ ID NO: 88521 - protein, 10 aa, Homo sapiens
  light chain complementarity determining region 3 for antibody 44261
QQRSNWPPLT

SEQ ID NO: 88522 - protein, 11 aa, Homo sapiens
  heavy chain complementarity determining region 3 for antibody 44261
TRDPGWGSYDY

SEQ ID NO: 88523 - protein, 10 aa, Homo sapiens
  light chain complementarity determining region 3 for antibody 44262
QQRSNWPPIT

SEQ ID NO: 88524 - protein, 22 aa, Homo sapiens
  heavy chain complementarity determining region 3 for antibody 44262
ATDRDFSRGNITSAYYPGVLIE

SEQ ID NO: 88525 - protein, 10 aa, Homo sapiens
  light chain complementarity determining region 3 for antibody 44263
QQRSNWPPIT

SEQ ID NO: 88526 - protein, 13 aa, Homo sapiens
  heavy chain complementarity determining region 3 for antibody 44263
ARDGSRGAGTSDY

SEQ ID NO: 88527 - protein, 10 aa, Homo sapiens
  light chain complementarity determining region 3 for antibody 44264
QQRSNWPPFT

SEQ ID NO: 88528 - protein, 17 aa, Homo sapiens
  heavy chain complementarity determining region 3 for antibody 44264
AKDIFFGIAVAGTAFDI

SEQ ID NO: 88529 - protein, 9 aa, Homo sapiens
  light chain complementarity determining region 3 for antibody 44265
QQRSNWPLT

SEQ ID NO: 88530 - protein, 18 aa, Homo sapiens
  heavy chain complementarity determining region 3 for antibody 44265
ARDIGEIRAAAASDAFDI

SEQ ID NO: 88531 - protein, 9 aa, Homo sapiens
  light chain complementarity determining region 3 for antibody 44266
QQRSNWPLT

SEQ ID NO: 88532 - protein, 16 aa, Homo sapiens
  heavy chain complementarity determining region 3 for antibody 44266
AKPGAFSSGGPYSFDY

SEQ ID NO: 88533 - protein, 9 aa, Homo sapiens
  light chain complementarity determining region 3 for antibody 44267
QQRSNWPLT

SEQ ID NO: 88534 - protein, 17 aa, Homo sapiens
  heavy chain complementarity determining region 3 for antibody 44267
AKAPRGGYTSAWYGIDY

SEQ ID NO: 88535 - protein, 8 aa, Homo sapiens
  light chain complementarity determining region 3 for antibody 44268
QQRSNWLS

SEQ ID NO: 88536 - protein, 18 aa, Homo sapiens
  heavy chain complementarity determining region 3 for antibody 44268
AIIPTYEFDTTSSYSPDS

SEQ ID NO: 88537 - protein, 10 aa, Homo sapiens
  light chain complementarity determining region 3 for antibody 44269
QQRSKGPPLT

SEQ ID NO: 88538 - protein, 9 aa, Homo sapiens
  heavy chain complementarity determining region 3 for antibody 44269
ARVDGYFDY

SEQ ID NO: 88539 - protein, 11 aa, Homo sapiens
  light chain complementarity determining region 3 for antibody 44270
QQRSGWPPIFT

SEQ ID NO: 88540 - protein, 14 aa, Homo sapiens
  heavy chain complementarity determining region 3 for antibody 44270
ARGWSGSSWRYIDY

SEQ ID NO: 88541 - protein, 9 aa, Homo sapiens
  light chain complementarity determining region 3 for antibody 44271
QQRRDWPIT

SEQ ID NO: 88542 - protein, 16 aa, Homo sapiens
  heavy chain complementarity determining region 3 for antibody 44271
AREYVMGATGQVYFDY

SEQ ID NO: 88543 - protein, 9 aa, Homo sapiens
  light chain complementarity determining region 3 for antibody 44272
QQRNNWPNT

SEQ ID NO: 88544 - protein, 15 aa, Homo sapiens
  heavy chain complementarity determining region 3 for antibody 44272
GREVHFNSGGNYVLD

SEQ ID NO: 88545 - protein, 9 aa, Homo sapiens
  light chain complementarity determining region 3 for antibody 44273
QQRGYWPIT

SEQ ID NO: 88546 - protein, 14 aa, Homo sapiens
  heavy chain complementarity determining region 3 for antibody 44273
TRDTGFYDHESFDV

SEQ ID NO: 88547 - protein, 9 aa, Homo sapiens
  light chain complementarity determining region 3 for antibody 44274
QQRGNWPVT

SEQ ID NO: 88548 - protein, 16 aa, Homo sapiens
  heavy chain complementarity determining region 3 for antibody 44274
GRLYHYDSGSYSPSDY

SEQ ID NO: 88549 - protein, 9 aa, Homo sapiens
  light chain complementarity determining region 3 for antibody 44275
QQRGNWPPT

SEQ ID NO: 88550 - protein, 14 aa, Homo sapiens
  heavy chain complementarity determining region 3 for antibody 44275
ATGRTGYDYYGLDV

SEQ ID NO: 88551 - protein, 10 aa, Homo sapiens
  light chain complementarity determining region 3 for antibody 44276
QQRFNWPQVT

SEQ ID NO: 88552 - protein, 15 aa, Homo sapiens
  heavy chain complementarity determining region 3 for antibody 44276
ARIPVLLGPDFYFDL

SEQ ID NO: 88553 - protein, 10 aa, Homo sapiens
  light chain complementarity determining region 3 for antibody 44277
QQRDDWPRLT

SEQ ID NO: 88554 - protein, 17 aa, Homo sapiens
  heavy chain complementarity determining region 3 for antibody 44277
AREGEYEDSSRHEYFQH

SEQ ID NO: 88555 - protein, 9 aa, Homo sapiens
  light chain complementarity determining region 3 for antibody 44278
QQLYGYPFT

SEQ ID NO: 88556 - protein, 13 aa, Homo sapiens
  heavy chain complementarity determining region 3 for antibody 44278
ARMNSSWSRGVLH

SEQ ID NO: 88557 - protein, 9 aa, Homo sapiens
  light chain complementarity determining region 3 for antibody 44279
QQLNSYPRT

SEQ ID NO: 88558 - protein, 24 aa, Homo sapiens
  heavy chain complementarity determining region 3 for antibody 44279
ARGRTYYCDTCGYPLGYFYYGMDV

SEQ ID NO: 88559 - protein, 9 aa, Homo sapiens
  light chain complementarity determining region 3 for antibody 44280
QQLNSYPLT

SEQ ID NO: 88560 - protein, 15 aa, Homo sapiens
  heavy chain complementarity determining region 3 for antibody 44280
AREFYASGSYYLIDY

SEQ ID NO: 88561 - protein, 9 aa, Homo sapiens
  light chain complementarity determining region 3 for antibody 44281
QQLNSYPIT

SEQ ID NO: 88562 - protein, 13 aa, Homo sapiens
  heavy chain complementarity determining region 3 for antibody 44281
ATFGSGNYYNVDY

SEQ ID NO: 88563 - protein, 9 aa, Homo sapiens
  light chain complementarity determining region 3 for antibody 44282
QQLNSYLFS

SEQ ID NO: 88564 - protein, 18 aa, Homo sapiens
  heavy chain complementarity determining region 3 for antibody 44282
ARVWGELLIYYYSFGMDV

SEQ ID NO: 88565 - protein, 9 aa, Homo sapiens
  light chain complementarity determining region 3 for antibody 44283
QQLNSFPYT

SEQ ID NO: 88566 - protein, 14 aa, Homo sapiens
  heavy chain complementarity determining region 3 for antibody 44283
AKDNGNYYYYGMDV

SEQ ID NO: 88567 - protein, 9 aa, Homo sapiens
  light chain complementarity determining region 3 for antibody 44284
QQLNNYPLT

SEQ ID NO: 88568 - protein, 11 aa, Homo sapiens
  heavy chain complementarity determining region 3 for antibody 44284
ARNPGHWYFDL

SEQ ID NO: 88569 - protein, 8 aa, Homo sapiens
  light chain complementarity determining region 3 for antibody 44285
QQLNGYPL

SEQ ID NO: 88570 - protein, 17 aa, Homo sapiens
  heavy chain complementarity determining region 3 for antibody 44285
ARGVAYSLAGDPHSFDY

SEQ ID NO: 88571 - protein, 9 aa, Homo sapiens
  light chain complementarity determining region 3 for antibody 44286
QQLIDYPVT

SEQ ID NO: 88572 - protein, 19 aa, Homo sapiens
  heavy chain complementarity determining region 3 for antibody 44286
VRHHPHDDGDPRFEFDFDY

SEQ ID NO: 88573 - protein, 9 aa, Homo sapiens
  light chain complementarity determining region 3 for antibody 44287
QQLASYPIT

SEQ ID NO: 88574 - protein, 13 aa, Homo sapiens
  heavy chain complementarity determining region 3 for antibody 44287
TSRSLDAGAPQDL

SEQ ID NO: 88575 - protein, 9 aa, Homo sapiens
  light chain complementarity determining region 3 for antibody 44288
QQKHSYPYT

SEQ ID NO: 88576 - protein, 13 aa, Homo sapiens
  heavy chain complementarity determining region 3 for antibody 44288
ARRNFGDRQIFDY

SEQ ID NO: 88577 - protein, 12 aa, Homo sapiens
  light chain complementarity determining region 3 for antibody 44289
QQHGSSPPWPWT

SEQ ID NO: 88578 - protein, 14 aa, Homo sapiens
  heavy chain complementarity determining region 3 for antibody 44289
VRGGSSGYYHQLDY

SEQ ID NO: 88579 - protein, 9 aa, Homo sapiens
  light chain complementarity determining region 3 for antibody 44290
QQHDTYPWT

SEQ ID NO: 88580 - protein, 16 aa, Homo sapiens
  heavy chain complementarity determining region 3 for antibody 44290
AKDKGYSYGYENYFDL

SEQ ID NO: 88581 - protein, 9 aa, Homo sapiens
  light chain complementarity determining region 3 for antibody 44291
QQGYTGPLT

SEQ ID NO: 88582 - protein, 15 aa, Homo sapiens
  heavy chain complementarity determining region 3 for antibody 44291
SRDLGRSPYASSSDS

SEQ ID NO: 88583 - protein, 9 aa, Homo sapiens
  light chain complementarity determining region 3 for antibody 44292
QQGYSAPLT

SEQ ID NO: 88584 - protein, 15 aa, Homo sapiens
  heavy chain complementarity determining region 3 for antibody 44292
ARDLGRVTYASSSDS

SEQ ID NO: 88585 - protein, 9 aa, Homo sapiens
  light chain complementarity determining region 3 for antibody 44293
QQGYDTPRT

SEQ ID NO: 88586 - protein, 12 aa, Homo sapiens
  heavy chain complementarity determining region 3 for antibody 44293
ASGGSRVTTLRY

SEQ ID NO: 88587 - protein, 9 aa, Homo sapiens
  light chain complementarity determining region 3 for antibody 44294
QQGSSFPYT

SEQ ID NO: 88588 - protein, 9 aa, Homo sapiens
  heavy chain complementarity determining region 3 for antibody 44294
ARDQAMVDS

SEQ ID NO: 88589 - protein, 9 aa, Homo sapiens
  light chain complementarity determining region 3 for antibody 44295
QQGNSFPYN

SEQ ID NO: 88590 - protein, 15 aa, Homo sapiens
  heavy chain complementarity determining region 3 for antibody 44295
AREVTGDGYHKTFDI

SEQ ID NO: 88591 - protein, 9 aa, Homo sapiens
  light chain complementarity determining region 3 for antibody 44296
QQGATSPLT

SEQ ID NO: 88592 - protein, 11 aa, Homo sapiens
  heavy chain complementarity determining region 3 for antibody 44296
VRDRGWLQHDY

SEQ ID NO: 88593 - protein, 9 aa, Homo sapiens
  light chain complementarity determining region 3 for antibody 44297
QQFYSHPPS

SEQ ID NO: 88594 - protein, 19 aa, Homo sapiens
  heavy chain complementarity determining region 3 for antibody 44297
ARERGGASKYLTPYYGMDV

SEQ ID NO: 88595 - protein, 9 aa, Homo sapiens
  light chain complementarity determining region 3 for antibody 44298
QQFYAYPWT

SEQ ID NO: 88596 - protein, 9 aa, Homo sapiens
  heavy chain complementarity determining region 3 for antibody 44298
ARGQHRSDQ

SEQ ID NO: 88597 - protein, 9 aa, Homo sapiens
  light chain complementarity determining region 3 for antibody 44299
QQFSKYPLT

SEQ ID NO: 88598 - protein, 20 aa, Homo sapiens
  heavy chain complementarity determining region 3 for antibody 44299
ARLTVSSYSDILTGKGYFHL

SEQ ID NO: 88599 - protein, 9 aa, Homo sapiens
  light chain complementarity determining region 3 for antibody 44300
QQFNTYPLT

SEQ ID NO: 88600 - protein, 18 aa, Homo sapiens
  heavy chain complementarity determining region 3 for antibody 44300
ARGPYCSGGTCYSQYFDS

SEQ ID NO: 88601 - protein, 9 aa, Homo sapiens
  light chain complementarity determining region 3 for antibody 44301
QQFGSAPLT

SEQ ID NO: 88602 - protein, 15 aa, Homo sapiens
  heavy chain complementarity determining region 3 for antibody 44301
ARAPGSSSRYAYFDY

SEQ ID NO: 88603 - protein, 9 aa, Homo sapiens
  light chain complementarity determining region 3 for antibody 44302
QQFENSPYS

SEQ ID NO: 88604 - protein, 11 aa, Homo sapiens
  heavy chain complementarity determining region 3 for antibody 44302
VKVGTMRAFDY

SEQ ID NO: 88605 - protein, 9 aa, Homo sapiens
  light chain complementarity determining region 3 for antibody 44303
QQFDRSPYT

SEQ ID NO: 88606 - protein, 22 aa, Homo sapiens
  heavy chain complementarity determining region 3 for antibody 44303
TRGRPSASTTFRQGGRQGPFDI

SEQ ID NO: 88607 - protein, 9 aa, Homo sapiens
  light chain complementarity determining region 3 for antibody 44304
QQFDDVPYT

SEQ ID NO: 88608 - protein, 13 aa, Homo sapiens
  heavy chain complementarity determining region 3 for antibody 44304
SRGAGYTTPPFDF

SEQ ID NO: 88609 - protein, 9 aa, Homo sapiens
  light chain complementarity determining region 3 for antibody 44305
QQDNTYPWT

SEQ ID NO: 88610 - protein, 15 aa, Homo sapiens
  heavy chain complementarity determining region 3 for antibody 44305
ASLLDDYAPGWHFDL

SEQ ID NO: 88611 - protein, 10 aa, Homo sapiens
  light chain complementarity determining region 3 for antibody 44306
QQCMSYSMYT

SEQ ID NO: 88612 - protein, 12 aa, Homo sapiens
  heavy chain complementarity determining region 3 for antibody 44306
AGEVDGTGNFDP

SEQ ID NO: 88613 - protein, 9 aa, Homo sapiens
  light chain complementarity determining region 3 for antibody 44307
QQANSFPWT

SEQ ID NO: 88614 - protein, 10 aa, Homo sapiens
  heavy chain complementarity determining region 3 for antibody 44307
ANGGYYGRAA

SEQ ID NO: 88615 - protein, 9 aa, Homo sapiens
  light chain complementarity determining region 3 for antibody 44308
QQANSFPRT

SEQ ID NO: 88616 - protein, 18 aa, Homo sapiens
  heavy chain complementarity determining region 3 for antibody 44308
ARDAGVLSSSSWYVGFDV

SEQ ID NO: 88617 - protein, 9 aa, Homo sapiens
  light chain complementarity determining region 3 for antibody 44309
QQANSFFGT

SEQ ID NO: 88618 - protein, 13 aa, Homo sapiens
  heavy chain complementarity determining region 3 for antibody 44309
ARQPHNGNYVNDY

SEQ ID NO: 88619 - protein, 9 aa, Homo sapiens
  light chain complementarity determining region 3 for antibody 44310
QQAINFPWT

SEQ ID NO: 88620 - protein, 13 aa, Homo sapiens
  heavy chain complementarity determining region 3 for antibody 44310
ARHKRPGNNWFDP

SEQ ID NO: 88621 - protein, 8 aa, Homo sapiens
  light chain complementarity determining region 3 for antibody 44311
QLFGTSLT

SEQ ID NO: 88622 - protein, 16 aa, Homo sapiens
  heavy chain complementarity determining region 3 for antibody 44311
ARSLYFGSGNVIFFGS

SEQ ID NO: 88623 - protein, 11 aa, Homo sapiens
  light chain complementarity determining region 3 for antibody 44312
QLCCSPGPLYT

SEQ ID NO: 88624 - protein, 15 aa, Homo sapiens
  heavy chain complementarity determining region 3 for antibody 44312
ARGFSNNGWTWGLDF

SEQ ID NO: 88625 - protein, 9 aa, Homo sapiens
  light chain complementarity determining region 3 for antibody 44313
QKYNSAPLT

SEQ ID NO: 88626 - protein, 13 aa, Homo sapiens
  heavy chain complementarity determining region 3 for antibody 44313
VRDSSVLRGILVV

SEQ ID NO: 88627 - protein, 9 aa, Homo sapiens
  light chain complementarity determining region 3 for antibody 44314
QKYNSAPLT

SEQ ID NO: 88628 - protein, 20 aa, Homo sapiens
  heavy chain complementarity determining region 3 for antibody 44314
ARDLHPMFSSGWYLSKALEY

SEQ ID NO: 88629 - protein, 9 aa, Homo sapiens
  light chain complementarity determining region 3 for antibody 44315
QKYNSAPIT

SEQ ID NO: 88630 - protein, 21 aa, Homo sapiens
  heavy chain complementarity determining region 3 for antibody 44315
AQHGRNMVRGIPLGMKFYFQY

SEQ ID NO: 88631 - protein, 9 aa, Homo sapiens
  light chain complementarity determining region 3 for antibody 44316
QKYNSAPFT

SEQ ID NO: 88632 - protein, 14 aa, Homo sapiens
  heavy chain complementarity determining region 3 for antibody 44316
ARKQWMVQYRAFDV

SEQ ID NO: 88633 - protein, 9 aa, Homo sapiens
  light chain complementarity determining region 3 for antibody 44317
QKYNGAPWT

SEQ ID NO: 88634 - protein, 17 aa, Homo sapiens
  heavy chain complementarity determining region 3 for antibody 44317
ARGPHILVAGMYNWFDP

SEQ ID NO: 88635 - protein, 9 aa, Homo sapiens
  light chain complementarity determining region 3 for antibody 44318
QKYDSAPWT

SEQ ID NO: 88636 - protein, 15 aa, Homo sapiens
  heavy chain complementarity determining region 3 for antibody 44318
ARAYCTDTNCYGFDY

SEQ ID NO: 88637 - protein, 9 aa, Homo sapiens
  light chain complementarity determining region 3 for antibody 44319
QKYDSAPQT

SEQ ID NO: 88638 - protein, 13 aa, Homo sapiens
  heavy chain complementarity determining region 3 for antibody 44319
AREGQWLGEAFDL

SEQ ID NO: 88639 - protein, 9 aa, Homo sapiens
  light chain complementarity determining region 3 for antibody 44320
QKYDSAPLT

SEQ ID NO: 88640 - protein, 8 aa, Homo sapiens
  heavy chain complementarity determining region 3 for antibody 44320
TTYGSSQP

SEQ ID NO: 88641 - protein, 9 aa, Homo sapiens
  light chain complementarity determining region 3 for antibody 44321
QKYDSAPFT

SEQ ID NO: 88642 - protein, 16 aa, Homo sapiens
  heavy chain complementarity determining region 3 for antibody 44321
AKAGRGYNSVWNYFDL

SEQ ID NO: 88643 - protein, 10 aa, Homo sapiens
  light chain complementarity determining region 3 for antibody 44322
QHYRNSPPWA

SEQ ID NO: 88644 - protein, 16 aa, Homo sapiens
  heavy chain complementarity determining region 3 for antibody 44322
ARPRRQHGSGNDFVDS

SEQ ID NO: 88645 - protein, 9 aa, Homo sapiens
  light chain complementarity determining region 3 for antibody 44323
QHYNSWPET

SEQ ID NO: 88646 - protein, 14 aa, Homo sapiens
  heavy chain complementarity determining region 3 for antibody 44323
AKHQALTTITPLDY

SEQ ID NO: 88647 - protein, 9 aa, Homo sapiens
  light chain complementarity determining region 3 for antibody 44324
QHYNGYPSS

SEQ ID NO: 88648 - protein, 18 aa, Homo sapiens
  heavy chain complementarity determining region 3 for antibody 44324
AKGEGYCRGGSCHRYYDR

SEQ ID NO: 88649 - protein, 9 aa, Homo sapiens
  light chain complementarity determining region 3 for antibody 44325
QHYHSLPLT

SEQ ID NO: 88650 - protein, 13 aa, Homo sapiens
  heavy chain complementarity determining region 3 for antibody 44325
ARAGYAGNSILDY

SEQ ID NO: 88651 - protein, 9 aa, Homo sapiens
  light chain complementarity determining region 3 for antibody 44326
QHYGTSSIT

SEQ ID NO: 88652 - protein, 17 aa, Homo sapiens
  heavy chain complementarity determining region 3 for antibody 44326
AKSSKWLNNYYYFGMDL

SEQ ID NO: 88653 - protein, 10 aa, Homo sapiens
  light chain complementarity determining region 3 for antibody 44327
QHYGSSPMYT

SEQ ID NO: 88654 - protein, 11 aa, Homo sapiens
  heavy chain complementarity determining region 3 for antibody 44327
ARLQEGDSEDY

SEQ ID NO: 88655 - protein, 8 aa, Homo sapiens
  light chain complementarity determining region 3 for antibody 44328
QHYGNSLT

SEQ ID NO: 88656 - protein, 18 aa, Homo sapiens
  heavy chain complementarity determining region 3 for antibody 44328
ARDSRNLLIASPGGSIDI

SEQ ID NO: 88657 - protein, 10 aa, Homo sapiens
  light chain complementarity determining region 3 for antibody 44329
QHYGDSPPYT

SEQ ID NO: 88658 - protein, 17 aa, Homo sapiens
  heavy chain complementarity determining region 3 for antibody 44329
AAWAGFSSGRFSGPLDH

SEQ ID NO: 88659 - protein, 9 aa, Homo sapiens
  light chain complementarity determining region 3 for antibody 44330
QHYDSWPLT

SEQ ID NO: 88660 - protein, 15 aa, Homo sapiens
  heavy chain complementarity determining region 3 for antibody 44330
ATRPPDTNYWGVSNY

SEQ ID NO: 88661 - protein, 9 aa, Homo sapiens
  light chain complementarity determining region 3 for antibody 44331
QHSYNNSPT

SEQ ID NO: 88662 - protein, 16 aa, Homo sapiens
  heavy chain complementarity determining region 3 for antibody 44331
ARGVDIVVVVSTPFDY

SEQ ID NO: 88663 - protein, 11 aa, Homo sapiens
  light chain complementarity determining region 3 for antibody 44332
QHRSDWPPKFT

SEQ ID NO: 88664 - protein, 14 aa, Homo sapiens
  heavy chain complementarity determining region 3 for antibody 44332
ARGWSGSSWRYIDF

SEQ ID NO: 88665 - protein, 9 aa, Homo sapiens
  light chain complementarity determining region 3 for antibody 44333
QHRDNWSWT

SEQ ID NO: 88666 - protein, 18 aa, Homo sapiens
  heavy chain complementarity determining region 3 for antibody 44333
ARHMALGYRVAAVGGFDI

SEQ ID NO: 88667 - protein, 9 aa, Homo sapiens
  light chain complementarity determining region 3 for antibody 44334
QHLNSYPFS

SEQ ID NO: 88668 - protein, 12 aa, Homo sapiens
  heavy chain complementarity determining region 3 for antibody 44334
ARDHISGWSLSN

SEQ ID NO: 88669 - protein, 9 aa, Homo sapiens
  light chain complementarity determining region 3 for antibody 44335
QHLHSYPIT

SEQ ID NO: 88670 - protein, 20 aa, Homo sapiens
  heavy chain complementarity determining region 3 for antibody 44335
ARRGAGRGYHNPGVSGYADY

SEQ ID NO: 88671 - protein, 9 aa, Homo sapiens
  light chain complementarity determining region 3 for antibody 44336
QHAYTFPYT

SEQ ID NO: 88672 - protein, 18 aa, Homo sapiens
  heavy chain complementarity determining region 3 for antibody 44336
ATAKADILTGYHRGWFDP

SEQ ID NO: 88673 - protein, 9 aa, Homo sapiens
  light chain complementarity determining region 3 for antibody 44337
QFYARSPWT

SEQ ID NO: 88674 - protein, 10 aa, Homo sapiens
  heavy chain complementarity determining region 3 for antibody 44337
ARAVGTYFDS

SEQ ID NO: 88675 - protein, 7 aa, Homo sapiens
  light chain complementarity determining region 3 for antibody 44338
QEYNGWT

SEQ ID NO: 88676 - protein, 10 aa, Homo sapiens
  heavy chain complementarity determining region 3 for antibody 44338
ARAGYGAFDL

SEQ ID NO: 88677 - protein, 9 aa, Homo sapiens
  light chain complementarity determining region 3 for antibody 44339
QELHNYPPT

SEQ ID NO: 88678 - protein, 15 aa, Homo sapiens
  heavy chain complementarity determining region 3 for antibody 44339
ARARLPERMLYAFDA

SEQ ID NO: 88679 - protein, 9 aa, Homo sapiens
  light chain complementarity determining region 3 for antibody 44340
QDYSTISGT

SEQ ID NO: 88680 - protein, 21 aa, Homo sapiens
  heavy chain complementarity determining region 3 for antibody 44340
ARGAVRGFSSGRYSGYDYFHH

SEQ ID NO: 88681 - protein, 9 aa, Homo sapiens
  light chain complementarity determining region 3 for antibody 44341
MQVLQTPLT

SEQ ID NO: 88682 - protein, 12 aa, Homo sapiens
  heavy chain complementarity determining region 3 for antibody 44341
ARWSHSDRIFDS

SEQ ID NO: 88683 - protein, 9 aa, Homo sapiens
  light chain complementarity determining region 3 for antibody 44342
MQTLQTPYT

SEQ ID NO: 88684 - protein, 14 aa, Homo sapiens
  heavy chain complementarity determining region 3 for antibody 44342
VRVGFIGWYLVFDY

SEQ ID NO: 88685 - protein, 9 aa, Homo sapiens
  light chain complementarity determining region 3 for antibody 44343
MQTLHLPYT

SEQ ID NO: 88686 - protein, 17 aa, Homo sapiens
  heavy chain complementarity determining region 3 for antibody 44343
AKDIFFAIAVAGTAFDI

SEQ ID NO: 88687 - protein, 9 aa, Homo sapiens
  light chain complementarity determining region 3 for antibody 44344
MQSRQTPYT

SEQ ID NO: 88688 - protein, 19 aa, Homo sapiens
  heavy chain complementarity determining region 3 for antibody 44344
ARGRYHHPQNGGDYRGLNV

SEQ ID NO: 88689 - protein, 9 aa, Homo sapiens
  light chain complementarity determining region 3 for antibody 44345
MQSLQTPYT

SEQ ID NO: 88690 - protein, 11 aa, Homo sapiens
  heavy chain complementarity determining region 3 for antibody 44345
VRDPPGNAFDR

SEQ ID NO: 88691 - protein, 9 aa, Homo sapiens
  light chain complementarity determining region 3 for antibody 44346
MQSLQTPLT

SEQ ID NO: 88692 - protein, 16 aa, Homo sapiens
  heavy chain complementarity determining region 3 for antibody 44346
VRSPRVAVGGTSTGNY

SEQ ID NO: 88693 - protein, 9 aa, Homo sapiens
  light chain complementarity determining region 3 for antibody 44347
MQNTQWPLT

SEQ ID NO: 88694 - protein, 8 aa, Homo sapiens
  heavy chain complementarity determining region 3 for antibody 44347
ALGQDMIH

SEQ ID NO: 88695 - protein, 8 aa, Homo sapiens
  light chain complementarity determining region 3 for antibody 44348
MQGTYWPT

SEQ ID NO: 88696 - protein, 11 aa, Homo sapiens
  heavy chain complementarity determining region 3 for antibody 44348
STADTANNADY

SEQ ID NO: 88697 - protein, 9 aa, Homo sapiens
  light chain complementarity determining region 3 for antibody 44349
MQGTQWPPA

SEQ ID NO: 88698 - protein, 18 aa, Homo sapiens
  heavy chain complementarity determining region 3 for antibody 44349
ARNGYVESHFDLRQYLQH

SEQ ID NO: 88699 - protein, 9 aa, Homo sapiens
  light chain complementarity determining region 3 for antibody 44350
MQGTHWPYT

SEQ ID NO: 88700 - protein, 19 aa, Homo sapiens
  heavy chain complementarity determining region 3 for antibody 44350
ARDPYSGDGHNIEYGAFDM

SEQ ID NO: 88701 - protein, 9 aa, Homo sapiens
  light chain complementarity determining region 3 for antibody 44351
MQGTHWPWT

SEQ ID NO: 88702 - protein, 18 aa, Homo sapiens
  heavy chain complementarity determining region 3 for antibody 44351
AKTGAFFFDSSVNRPFDY

SEQ ID NO: 88703 - protein, 9 aa, Homo sapiens
  light chain complementarity determining region 3 for antibody 44352
MQGTHWPPT

SEQ ID NO: 88704 - protein, 16 aa, Homo sapiens
  heavy chain complementarity determining region 3 for antibody 44352
ARVASFYYDRDGMFDS

SEQ ID NO: 88705 - protein, 9 aa, Homo sapiens
  light chain complementarity determining region 3 for antibody 44353
MQGTHWPPT

SEQ ID NO: 88706 - protein, 14 aa, Homo sapiens
  heavy chain complementarity determining region 3 for antibody 44353
AALGYCNGRICLDL

SEQ ID NO: 88707 - protein, 9 aa, Homo sapiens
  light chain complementarity determining region 3 for antibody 44354
MQGTHWPFT

SEQ ID NO: 88708 - protein, 11 aa, Homo sapiens
  heavy chain complementarity determining region 3 for antibody 44354
AKDDYNGSLDY

SEQ ID NO: 88709 - protein, 9 aa, Homo sapiens
  light chain complementarity determining region 3 for antibody 44355
MQGTHWLYT

SEQ ID NO: 88710 - protein, 8 aa, Homo sapiens
  heavy chain complementarity determining region 3 for antibody 44355
ARYYDRLI

SEQ ID NO: 88711 - protein, 9 aa, Homo sapiens
  light chain complementarity determining region 3 for antibody 44356
MQGTFWSYT

SEQ ID NO: 88712 - protein, 20 aa, Homo sapiens
  heavy chain complementarity determining region 3 for antibody 44356
TTECKSSNCGAKYYYFGMDV

SEQ ID NO: 88713 - protein, 9 aa, Homo sapiens
  light chain complementarity determining region 3 for antibody 44357
MQGLQTPYT

SEQ ID NO: 88714 - protein, 10 aa, Homo sapiens
  heavy chain complementarity determining region 3 for antibody 44357
ARDVAGGAGY

SEQ ID NO: 88715 - protein, 9 aa, Homo sapiens
  light chain complementarity determining region 3 for antibody 44358
MQGLQTPST

SEQ ID NO: 88716 - protein, 11 aa, Homo sapiens
  heavy chain complementarity determining region 3 for antibody 44358
ARGSDDWHFDL

SEQ ID NO: 88717 - protein, 8 aa, Homo sapiens
  light chain complementarity determining region 3 for antibody 44359
MQGLQTPR

SEQ ID NO: 88718 - protein, 14 aa, Homo sapiens
  heavy chain complementarity determining region 3 for antibody 44359
VRGHGWGNYYNFDS

SEQ ID NO: 88719 - protein, 9 aa, Homo sapiens
  light chain complementarity determining region 3 for antibody 44360
MQGKYWPLT

SEQ ID NO: 88720 - protein, 15 aa, Homo sapiens
  heavy chain complementarity determining region 3 for antibody 44360
TRLGSGTLSNWDFSL

SEQ ID NO: 88721 - protein, 9 aa, Homo sapiens
  light chain complementarity determining region 3 for antibody 44361
MQGKNWPYI

SEQ ID NO: 88722 - protein, 11 aa, Homo sapiens
  heavy chain complementarity determining region 3 for antibody 44361
ARVGDWNNLEY

SEQ ID NO: 88723 - protein, 10 aa, Homo sapiens
  light chain complementarity determining region 3 for antibody 44362
MQATHWPPWT

SEQ ID NO: 88724 - protein, 18 aa, Homo sapiens
  heavy chain complementarity determining region 3 for antibody 44362
VRAEISVTMVRGLRAFDT

SEQ ID NO: 88725 - protein, 10 aa, Homo sapiens
  light chain complementarity determining region 3 for antibody 44363
MQATHWPPWT

SEQ ID NO: 88726 - protein, 15 aa, Homo sapiens
  heavy chain complementarity determining region 3 for antibody 44363
ARTWIKQWPSEDLDQ

SEQ ID NO: 88727 - protein, 8 aa, Homo sapiens
  light chain complementarity determining region 3 for antibody 44364
MQARQTPP

SEQ ID NO: 88728 - protein, 16 aa, Homo sapiens
  heavy chain complementarity determining region 3 for antibody 44364
ARATAYSTYWYYGLDV

SEQ ID NO: 88729 - protein, 9 aa, Homo sapiens
  light chain complementarity determining region 3 for antibody 44365
MQALQTPYT

SEQ ID NO: 88730 - protein, 16 aa, Homo sapiens
  heavy chain complementarity determining region 3 for antibody 44365
ATPRYGAGRQYGGVDY

SEQ ID NO: 88731 - protein, 8 aa, Homo sapiens
  light chain complementarity determining region 3 for antibody 44366
MQALQTPT

SEQ ID NO: 88732 - protein, 17 aa, Homo sapiens
  heavy chain complementarity determining region 3 for antibody 44366
ARERGFCRSAGCYGLDF

SEQ ID NO: 88733 - protein, 9 aa, Homo sapiens
  light chain complementarity determining region 3 for antibody 44367
MQALQTPRT

SEQ ID NO: 88734 - protein, 18 aa, Homo sapiens
  heavy chain complementarity determining region 3 for antibody 44367
ASRFTGGKLGATDHWFGP

SEQ ID NO: 88735 - protein, 10 aa, Homo sapiens
  light chain complementarity determining region 3 for antibody 44368
MQALQTPQFT

SEQ ID NO: 88736 - protein, 13 aa, Homo sapiens
  heavy chain complementarity determining region 3 for antibody 44368
ARGSIAAAGHFPF

SEQ ID NO: 88737 - protein, 9 aa, Homo sapiens
  light chain complementarity determining region 3 for antibody 44369
MQALQTPPT

SEQ ID NO: 88738 - protein, 20 aa, Homo sapiens
  heavy chain complementarity determining region 3 for antibody 44369
ARARSISLVRGAMPNWGLDY

SEQ ID NO: 88739 - protein, 9 aa, Homo sapiens
  light chain complementarity determining region 3 for antibody 44370
MQALQTPFT

SEQ ID NO: 88740 - protein, 14 aa, Homo sapiens
  heavy chain complementarity determining region 3 for antibody 44370
ATDLTYASGIGLGV

SEQ ID NO: 88741 - protein, 9 aa, Homo sapiens
  light chain complementarity determining region 3 for antibody 44371
MQALQIPLT

SEQ ID NO: 88742 - protein, 12 aa, Homo sapiens
  heavy chain complementarity determining region 3 for antibody 44371
VRDNGWLGTFDA

SEQ ID NO: 88743 - protein, 8 aa, Homo sapiens
  light chain complementarity determining region 3 for antibody 44372
MQALKSRV

SEQ ID NO: 88744 - protein, 20 aa, Homo sapiens
  heavy chain complementarity determining region 3 for antibody 44372
ARERVRHSSGPLHYYLGIDV

SEQ ID NO: 88745 - protein, 9 aa, Homo sapiens
  light chain complementarity determining region 3 for antibody 44373
MQALETPRT

SEQ ID NO: 88746 - protein, 14 aa, Homo sapiens
  heavy chain complementarity determining region 3 for antibody 44373
ARFSGYDESRYFDS

SEQ ID NO: 88747 - protein, 9 aa, Homo sapiens
  light chain complementarity determining region 3 for antibody 44374
MQAAHWPIT

SEQ ID NO: 88748 - protein, 21 aa, Homo sapiens
  heavy chain complementarity determining region 3 for antibody 44374
ARDAPVRPLLWFGELSPNFDY

SEQ ID NO: 88749 - protein, 8 aa, Homo sapiens
  light chain complementarity determining region 3 for antibody 44375
METLQLRT

SEQ ID NO: 88750 - protein, 14 aa, Homo sapiens
  heavy chain complementarity determining region 3 for antibody 44375
ARMGFSSGWYYFEY

SEQ ID NO: 88751 - protein, 8 aa, Homo sapiens
  light chain complementarity determining region 3 for antibody 44376
MEALQTWT

SEQ ID NO: 88752 - protein, 14 aa, Homo sapiens
  heavy chain complementarity determining region 3 for antibody 44376
ARVAGGHKGNAFDI

SEQ ID NO: 88753 - protein, 9 aa, Homo sapiens
  light chain complementarity determining region 3 for antibody 44377
LQYYSTPRT

SEQ ID NO: 88754 - protein, 12 aa, Homo sapiens
  heavy chain complementarity determining region 3 for antibody 44377
VRDSGYDHWFDP

SEQ ID NO: 88755 - protein, 9 aa, Homo sapiens
  light chain complementarity determining region 3 for antibody 44378
LQYSNYPHT

SEQ ID NO: 88756 - protein, 15 aa, Homo sapiens
  heavy chain complementarity determining region 3 for antibody 44378
VKAYTYSYRGPCFDF

SEQ ID NO: 88757 - protein, 9 aa, Homo sapiens
  light chain complementarity determining region 3 for antibody 44379
LQYNSYPRT

SEQ ID NO: 88758 - protein, 17 aa, Homo sapiens
  heavy chain complementarity determining region 3 for antibody 44379
ATGEGWAPKVASTGLDY

SEQ ID NO: 88759 - protein, 8 aa, Homo sapiens
  light chain complementarity determining region 3 for antibody 44380
LQYHSSST

SEQ ID NO: 88760 - protein, 11 aa, Homo sapiens
  heavy chain complementarity determining region 3 for antibody 44380
SVGGGIAVSHA

SEQ ID NO: 88761 - protein, 9 aa, Homo sapiens
  light chain complementarity determining region 3 for antibody 44381
LQVYIYPYA

SEQ ID NO: 88762 - protein, 11 aa, Homo sapiens
  heavy chain complementarity determining region 3 for antibody 44381
ARVPSGDPFDY

SEQ ID NO: 88763 - protein, 9 aa, Homo sapiens
  light chain complementarity determining region 3 for antibody 44382
LQVVSFPRT

SEQ ID NO: 88764 - protein, 8 aa, Homo sapiens
  heavy chain complementarity determining region 3 for antibody 44382
ARNSGWYD

SEQ ID NO: 88765 - protein, 9 aa, Homo sapiens
  light chain complementarity determining region 3 for antibody 44383
LQTYSTPWT

SEQ ID NO: 88766 - protein, 15 aa, Homo sapiens
  heavy chain complementarity determining region 3 for antibody 44383
ASRRGVQYFDWSMDV

SEQ ID NO: 88767 - protein, 9 aa, Homo sapiens
  light chain complementarity determining region 3 for antibody 44384
LQNSIHPPT

SEQ ID NO: 88768 - protein, 16 aa, Homo sapiens
  heavy chain complementarity determining region 3 for antibody 44384
ARSGFVAAVGSTLIDY

SEQ ID NO: 88769 - protein, 9 aa, Homo sapiens
  light chain complementarity determining region 3 for antibody 44385
LQHYIYPRT

SEQ ID NO: 88770 - protein, 14 aa, Homo sapiens
  heavy chain complementarity determining region 3 for antibody 44385
ARREALGNLRYFDY

SEQ ID NO: 88771 - protein, 9 aa, Homo sapiens
  light chain complementarity determining region 3 for antibody 44386
LQHNSYPYT

SEQ ID NO: 88772 - protein, 9 aa, Homo sapiens
  heavy chain complementarity determining region 3 for antibody 44386
GLFSGGRDY

SEQ ID NO: 88773 - protein, 9 aa, Homo sapiens
  light chain complementarity determining region 3 for antibody 44387
LQHNSYPRT

SEQ ID NO: 88774 - protein, 12 aa, Homo sapiens
  heavy chain complementarity determining region 3 for antibody 44387
ARGRGYTVPFDM

SEQ ID NO: 88775 - protein, 9 aa, Homo sapiens
  light chain complementarity determining region 3 for antibody 44388
LQGYNDPWT

SEQ ID NO: 88776 - protein, 17 aa, Homo sapiens
  heavy chain complementarity determining region 3 for antibody 44388
AKQLGNRDLRGHTAFDF

SEQ ID NO: 88777 - protein, 10 aa, Homo sapiens
  light chain complementarity determining region 3 for antibody 44389
LQGTHWPYYN

SEQ ID NO: 88778 - protein, 12 aa, Homo sapiens
  heavy chain complementarity determining region 3 for antibody 44389
ARDPPGDQGLDF

SEQ ID NO: 88779 - protein, 9 aa, Homo sapiens
  light chain complementarity determining region 3 for antibody 44390
LQDYTYPWT

SEQ ID NO: 88780 - protein, 15 aa, Homo sapiens
  heavy chain complementarity determining region 3 for antibody 44390
ANLYGPPSGPECLQR

SEQ ID NO: 88781 - protein, 9 aa, Homo sapiens
  light chain complementarity determining region 3 for antibody 44391
LQDYSYPRT

SEQ ID NO: 88782 - protein, 18 aa, Homo sapiens
  heavy chain complementarity determining region 3 for antibody 44391
ARDTNPNSGDLYFDAFDI

SEQ ID NO: 88783 - protein, 9 aa, Homo sapiens
  light chain complementarity determining region 3 for antibody 44392
LQDYNYPWT

SEQ ID NO: 88784 - protein, 14 aa, Homo sapiens
  heavy chain complementarity determining region 3 for antibody 44392
AGTWIPVAGLVFDF

SEQ ID NO: 88785 - protein, 9 aa, Homo sapiens
  light chain complementarity determining region 3 for antibody 44393
LQDYNYPLT

SEQ ID NO: 88786 - protein, 13 aa, Homo sapiens
  heavy chain complementarity determining region 3 for antibody 44393
VRALRGVDNWFDP

SEQ ID NO: 88787 - protein, 10 aa, Homo sapiens
  light chain complementarity determining region 3 for antibody 44394
KQYKSWPPFT

SEQ ID NO: 88788 - protein, 13 aa, Homo sapiens
  heavy chain complementarity determining region 3 for antibody 44394
ARDDLLADNGFDY

SEQ ID NO: 88789 - protein, 9 aa, Homo sapiens
  light chain complementarity determining region 3 for antibody 44395
KQFKGFPIT

SEQ ID NO: 88790 - protein, 11 aa, Homo sapiens
  heavy chain complementarity determining region 3 for antibody 44395
VTDGGHWDFDF

SEQ ID NO: 88791 - protein, 10 aa, Homo sapiens
  light chain complementarity determining region 3 for antibody 44396
HQYSTSPPWT

SEQ ID NO: 88792 - protein, 16 aa, Homo sapiens
  heavy chain complementarity determining region 3 for antibody 44396
ARRQWVRGLFRGGLDS

SEQ ID NO: 88793 - protein, 9 aa, Homo sapiens
  light chain complementarity determining region 3 for antibody 44397
HQYSSSPYT

SEQ ID NO: 88794 - protein, 13 aa, Homo sapiens
  heavy chain complementarity determining region 3 for antibody 44397
ARGTYSAFAIFGV

SEQ ID NO: 88795 - protein, 10 aa, Homo sapiens
  light chain complementarity determining region 3 for antibody 44398
HQYNNWPPST

SEQ ID NO: 88796 - protein, 14 aa, Homo sapiens
  heavy chain complementarity determining region 3 for antibody 44398
ARGQYDDPGFYFDY

SEQ ID NO: 88797 - protein, 9 aa, Homo sapiens
  light chain complementarity determining region 3 for antibody 44399
HQYGRSPWT

SEQ ID NO: 88798 - protein, 14 aa, Homo sapiens
  heavy chain complementarity determining region 3 for antibody 44399
ARKKSLVAYYTMDV

SEQ ID NO: 88799 - protein, 9 aa, Homo sapiens
  light chain complementarity determining region 3 for antibody 44400
HQYDTYSWT

SEQ ID NO: 88800 - protein, 17 aa, Homo sapiens
  heavy chain complementarity determining region 3 for antibody 44400
ARSRIASRPIWRPPNDY

SEQ ID NO: 88801 - protein, 9 aa, Homo sapiens
  light chain complementarity determining region 3 for antibody 44401
HQYDSSPYN

SEQ ID NO: 88802 - protein, 13 aa, Homo sapiens
  heavy chain complementarity determining region 3 for antibody 44401
ARGTYSHFVIFDV

SEQ ID NO: 88803 - protein, 9 aa, Homo sapiens
  light chain complementarity determining region 3 for antibody 44402
HQTYSLPLT

SEQ ID NO: 88804 - protein, 21 aa, Homo sapiens
  heavy chain complementarity determining region 3 for antibody 44402
ASRLSYYSDGNSHYYDNWFDS

SEQ ID NO: 88805 - protein, 9 aa, Homo sapiens
  light chain complementarity determining region 3 for antibody 44403
HQTFASPYT

SEQ ID NO: 88806 - protein, 16 aa, Homo sapiens
  heavy chain complementarity determining region 3 for antibody 44403
ARDQGNEWLVGTPWTY

SEQ ID NO: 88807 - protein, 9 aa, Homo sapiens
  light chain complementarity determining region 3 for antibody 44404
HQSSSLPHT

SEQ ID NO: 88808 - protein, 13 aa, Homo sapiens
  heavy chain complementarity determining region 3 for antibody 44404
ARVVSPYSRVFDF

SEQ ID NO: 88809 - protein, 10 aa, Homo sapiens
  light chain complementarity determining region 3 for antibody 44405
HQRINWPPIT

SEQ ID NO: 88810 - protein, 17 aa, Homo sapiens
  heavy chain complementarity determining region 3 for antibody 44405
ARDLTAPGGTVSMLLDY

SEQ ID NO: 88811 - protein, 9 aa, Homo sapiens
  light chain complementarity determining region 3 for antibody 44406
HQGYSTPFT

SEQ ID NO: 88812 - protein, 15 aa, Homo sapiens
  heavy chain complementarity determining region 3 for antibody 44406
AKAQVIWGHLYYFES

SEQ ID NO: 88813 - protein, 9 aa, Homo sapiens
  light chain complementarity determining region 3 for antibody 44407
HKYNSAPFT

SEQ ID NO: 88814 - protein, 14 aa, Homo sapiens
  heavy chain complementarity determining region 3 for antibody 44407
ARRPETSLLYGMDV

SEQ ID NO: 88815 - protein, 11 aa, Homo sapiens
  light chain complementarity determining region 3 for antibody 44408
HHRTNWPRRFT

SEQ ID NO: 88816 - protein, 14 aa, Homo sapiens
  heavy chain complementarity determining region 3 for antibody 44408
ARGPDYFDRTEADS

SEQ ID NO: 88817 - protein, 9 aa, Homo sapiens
  light chain complementarity determining region 3 for antibody 44409
EQYGNSPNT

SEQ ID NO: 88818 - protein, 19 aa, Homo sapiens
  heavy chain complementarity determining region 3 for antibody 44409
ARRVPYVRGSYRRDYGLDV

SEQ ID NO: 88819 - protein, 8 aa, Homo sapiens
  light chain complementarity determining region 3 for antibody 44410
QYLNAYLV

SEQ ID NO: 88820 - protein, 15 aa, Homo sapiens
  heavy chain complementarity determining region 3 for antibody 44410
AREVANYSNYYGMDV

SEQ ID NO: 88821 - protein, 8 aa, Homo sapiens
  light chain complementarity determining region 3 for antibody 44411
QWYGSSLT

SEQ ID NO: 88822 - protein, 13 aa, Homo sapiens
  heavy chain complementarity determining region 3 for antibody 44411
ARTQWLTFDVFNM

SEQ ID NO: 88823 - protein, 9 aa, Homo sapiens
  light chain complementarity determining region 3 for antibody 44412
QRYNSAPQT

SEQ ID NO: 88824 - protein, 17 aa, Homo sapiens
  heavy chain complementarity determining region 3 for antibody 44412
ARGKGGIPVAWYNWFDP

SEQ ID NO: 88825 - protein, 11 aa, Homo sapiens
  light chain complementarity determining region 3 for antibody 44413
QRYGSSPPGYT

SEQ ID NO: 88826 - protein, 25 aa, Homo sapiens
  heavy chain complementarity determining region 3 for antibody 44413
AKDKAREMAVLNWGPKKYYYYGMDV

SEQ ID NO: 88827 - protein, 9 aa, Homo sapiens
  light chain complementarity determining region 3 for antibody 44414
QRHNTAPFT

SEQ ID NO: 88828 - protein, 20 aa, Homo sapiens
  heavy chain complementarity determining region 3 for antibody 44414
ARSFHDYSVDRLEWVNAFSF

SEQ ID NO: 88829 - protein, 9 aa, Homo sapiens
  light chain complementarity determining region 3 for antibody 44415
QQYYTTPLT

SEQ ID NO: 88830 - protein, 14 aa, Homo sapiens
  heavy chain complementarity determining region 3 for antibody 44415
ARDRYGSGSYPFDY

SEQ ID NO: 88831 - protein, 8 aa, Homo sapiens
  light chain complementarity determining region 3 for antibody 44416
QQYYTFWT

SEQ ID NO: 88832 - protein, 19 aa, Homo sapiens
  heavy chain complementarity determining region 3 for antibody 44416
ARALYQGTAAAEYFYGMDI

SEQ ID NO: 88833 - protein, 9 aa, Homo sapiens
  light chain complementarity determining region 3 for antibody 44417
QQYYSTLWT

SEQ ID NO: 88834 - protein, 9 aa, Homo sapiens
  heavy chain complementarity determining region 3 for antibody 44417
ARTYGYFDW

SEQ ID NO: 88835 - protein, 9 aa, Homo sapiens
  light chain complementarity determining region 3 for antibody 44418
QQYYSLPYT

SEQ ID NO: 88836 - protein, 18 aa, Homo sapiens
  heavy chain complementarity determining region 3 for antibody 44418
ARHAPHLEGSVGWFIFDY

SEQ ID NO: 88837 - protein, 9 aa, Homo sapiens
  light chain complementarity determining region 3 for antibody 44419
QQYYNYPFT

SEQ ID NO: 88838 - protein, 13 aa, Homo sapiens
  heavy chain complementarity determining region 3 for antibody 44419
ARNRGTPVTTIDD

SEQ ID NO: 88839 - protein, 10 aa, Homo sapiens
  light chain complementarity determining region 3 for antibody 44420
QQYYNWPPIT

SEQ ID NO: 88840 - protein, 17 aa, Homo sapiens
  heavy chain complementarity determining region 3 for antibody 44420
AQDLPQPSSVLSGIFKY

SEQ ID NO: 88841 - protein, 9 aa, Homo sapiens
  light chain complementarity determining region 3 for antibody 44421
QQYVSSPRT

SEQ ID NO: 88842 - protein, 15 aa, Homo sapiens
  heavy chain complementarity determining region 3 for antibody 44421
VREPGITTSDWYFDL

SEQ ID NO: 88843 - protein, 10 aa, Homo sapiens
  light chain complementarity determining region 3 for antibody 44422
QQYVDWPSLT

SEQ ID NO: 88844 - protein, 17 aa, Homo sapiens
  heavy chain complementarity determining region 3 for antibody 44422
ARDVGRSGRSDDYGLDA

SEQ ID NO: 88845 - protein, 9 aa, Homo sapiens
  light chain complementarity determining region 3 for antibody 44423
QQYTTYSRT

SEQ ID NO: 88846 - protein, 17 aa, Homo sapiens
  heavy chain complementarity determining region 3 for antibody 44423
ARRSTLIRGVLTNVVDY

SEQ ID NO: 88847 - protein, 8 aa, Homo sapiens
  light chain complementarity determining region 3 for antibody 44424
QQYTSLWT

SEQ ID NO: 88848 - protein, 11 aa, Homo sapiens
  heavy chain complementarity determining region 3 for antibody 44424
AHRSRTALLDY

SEQ ID NO: 88849 - protein, 9 aa, Homo sapiens
  light chain complementarity determining region 3 for antibody 44425
QQYSVAPRT

SEQ ID NO: 88850 - protein, 20 aa, Homo sapiens
  heavy chain complementarity determining region 3 for antibody 44425
ARGLRGPGQYDSSGSDYYDY

SEQ ID NO: 88851 - protein, 9 aa, Homo sapiens
  light chain complementarity determining region 3 for antibody 44426
QQYSSYPLT

SEQ ID NO: 88852 - protein, 13 aa, Homo sapiens
  heavy chain complementarity determining region 3 for antibody 44426
AREASGKYYAFDL

SEQ ID NO: 88853 - protein, 10 aa, Homo sapiens
  light chain complementarity determining region 3 for antibody 44427
QQYSSSPPWT

SEQ ID NO: 88854 - protein, 11 aa, Homo sapiens
  heavy chain complementarity determining region 3 for antibody 44427
AREAGYYGMDV

SEQ ID NO: 88855 - protein, 9 aa, Homo sapiens
  light chain complementarity determining region 3 for antibody 44428
QQYSSSPLT

SEQ ID NO: 88856 - protein, 21 aa, Homo sapiens
  heavy chain complementarity determining region 3 for antibody 44428
AREKIWGHYADRTPGAPHFDY

SEQ ID NO: 88857 - protein, 10 aa, Homo sapiens
  light chain complementarity determining region 3 for antibody 44429
QQYSDWPPYT

SEQ ID NO: 88858 - protein, 17 aa, Homo sapiens
  heavy chain complementarity determining region 3 for antibody 44429
AKEVAEGGLPPGGALGS

SEQ ID NO: 88859 - protein, 10 aa, Homo sapiens
  light chain complementarity determining region 3 for antibody 44430
QQYSAWPLFT

SEQ ID NO: 88860 - protein, 15 aa, Homo sapiens
  heavy chain complementarity determining region 3 for antibody 44430
VRGGELGYSFDYAAY

SEQ ID NO: 88861 - protein, 8 aa, Homo sapiens
  light chain complementarity determining region 3 for antibody 44431
QQYRDLLT

SEQ ID NO: 88862 - protein, 12 aa, Homo sapiens
  heavy chain complementarity determining region 3 for antibody 44431
ARVTWPAMAFDI

SEQ ID NO: 88863 - protein, 9 aa, Homo sapiens
  light chain complementarity determining region 3 for antibody 44432
QQYNVYPRT

SEQ ID NO: 88864 - protein, 18 aa, Homo sapiens
  heavy chain complementarity determining region 3 for antibody 44432
ARRPTTGYNSGWFAAFDI

SEQ ID NO: 88865 - protein, 8 aa, Homo sapiens
  light chain complementarity determining region 3 for antibody 44433
QQYNTYST

SEQ ID NO: 88866 - protein, 12 aa, Homo sapiens
  heavy chain complementarity determining region 3 for antibody 44433
ARARSEMGPAEH

SEQ ID NO: 88867 - protein, 9 aa, Homo sapiens
  light chain complementarity determining region 3 for antibody 44434
QQYNTYPPT

SEQ ID NO: 88868 - protein, 19 aa, Homo sapiens
  heavy chain complementarity determining region 3 for antibody 44434
ARAQGWYSSGWYSGFAFDI

SEQ ID NO: 88869 - protein, 8 aa, Homo sapiens
  light chain complementarity determining region 3 for antibody 44435
QQYNSYWT

SEQ ID NO: 88870 - protein, 19 aa, Homo sapiens
  heavy chain complementarity determining region 3 for antibody 44435
GHLVQHRHHTGYINNYFDV

SEQ ID NO: 88871 - protein, 8 aa, Homo sapiens
  light chain complementarity determining region 3 for antibody 44436
QQYNSYST

SEQ ID NO: 88872 - protein, 17 aa, Homo sapiens
  heavy chain complementarity determining region 3 for antibody 44436
AREGGFCIGAGCRWFDL

SEQ ID NO: 88873 - protein, 9 aa, Homo sapiens
  light chain complementarity determining region 3 for antibody 44437
QQYNSYSLT

SEQ ID NO: 88874 - protein, 10 aa, Homo sapiens
  heavy chain complementarity determining region 3 for antibody 44437
ARGSARRPDL

SEQ ID NO: 88875 - protein, 9 aa, Homo sapiens
  light chain complementarity determining region 3 for antibody 44438
QQYNSYPVT

SEQ ID NO: 88876 - protein, 20 aa, Homo sapiens
  heavy chain complementarity determining region 3 for antibody 44438
ATSDDYGGHSFIYYYYGMDV

SEQ ID NO: 88877 - protein, 9 aa, Homo sapiens
  light chain complementarity determining region 3 for antibody 44439
QQYNSYPRT

SEQ ID NO: 88878 - protein, 15 aa, Homo sapiens
  heavy chain complementarity determining region 3 for antibody 44439
TRETWEFGDEHAFDV

SEQ ID NO: 88879 - protein, 9 aa, Homo sapiens
  light chain complementarity determining region 3 for antibody 44440
QQYNSYPLT

SEQ ID NO: 88880 - protein, 19 aa, Homo sapiens
  heavy chain complementarity determining region 3 for antibody 44440
ARSPYYDILTGLKDDAFDI

SEQ ID NO: 88881 - protein, 9 aa, Homo sapiens
  light chain complementarity determining region 3 for antibody 44441
QQYNSYPIT

SEQ ID NO: 88882 - protein, 14 aa, Homo sapiens
  heavy chain complementarity determining region 3 for antibody 44441
VKARYTNTWEPFDY

SEQ ID NO: 88883 - protein, 8 aa, Homo sapiens
  light chain complementarity determining region 3 for antibody 44442
QQYNSYPA

SEQ ID NO: 88884 - protein, 19 aa, Homo sapiens
  heavy chain complementarity determining region 3 for antibody 44442
ARAGGINDFWSGHLNLFDP

SEQ ID NO: 88885 - protein, 10 aa, Homo sapiens
  light chain complementarity determining region 3 for antibody 44443
QQYNSWPPLT

SEQ ID NO: 88886 - protein, 18 aa, Homo sapiens
  heavy chain complementarity determining region 3 for antibody 44443
ARDFRRSGTHSPDVVFDY

SEQ ID NO: 88887 - protein, 9 aa, Homo sapiens
  light chain complementarity determining region 3 for antibody 44444
QQYNSSPRT

SEQ ID NO: 88888 - protein, 19 aa, Homo sapiens
  heavy chain complementarity determining region 3 for antibody 44444
ARSEGATKDDYYYYYGMDV

SEQ ID NO: 88889 - protein, 8 aa, Homo sapiens
  light chain complementarity determining region 3 for antibody 44445
QQYNSLYT

SEQ ID NO: 88890 - protein, 15 aa, Homo sapiens
  heavy chain complementarity determining region 3 for antibody 44445
ARDPDMDSGDSDFDY

SEQ ID NO: 88891 - protein, 9 aa, Homo sapiens
  light chain complementarity determining region 3 for antibody 44446
QQYNSFSWT

SEQ ID NO: 88892 - protein, 19 aa, Homo sapiens
  heavy chain complementarity determining region 3 for antibody 44446
AKSPTYYYDASGTSPPFDY

SEQ ID NO: 88893 - protein, 9 aa, Homo sapiens
  light chain complementarity determining region 3 for antibody 44447
QQYNSFPLT

SEQ ID NO: 88894 - protein, 11 aa, Homo sapiens
  heavy chain complementarity determining region 3 for antibody 44447
TRGVGSYPFDQ

SEQ ID NO: 88895 - protein, 9 aa, Homo sapiens
  light chain complementarity determining region 3 for antibody 44448
QQYNPYSRT

SEQ ID NO: 88896 - protein, 20 aa, Homo sapiens
  heavy chain complementarity determining region 3 for antibody 44448
ARGAPVVAALKGSRPEYFQQ

SEQ ID NO: 88897 - protein, 8 aa, Homo sapiens
  light chain complementarity determining region 3 for antibody 44449
QQYNNYWT

SEQ ID NO: 88898 - protein, 21 aa, Homo sapiens
  heavy chain complementarity determining region 3 for antibody 44449
VRGGHAMVRGVILKKGNWFGP

SEQ ID NO: 88899 - protein, 8 aa, Homo sapiens
  light chain complementarity determining region 3 for antibody 44450
QQYNNYWT

SEQ ID NO: 88900 - protein, 15 aa, Homo sapiens
  heavy chain complementarity determining region 3 for antibody 44450
ARDRYDGSYGGTFDI

SEQ ID NO: 88901 - protein, 9 aa, Homo sapiens
  light chain complementarity determining region 3 for antibody 44451
QQYNNYLWT

SEQ ID NO: 88902 - protein, 18 aa, Homo sapiens
  heavy chain complementarity determining region 3 for antibody 44451
VSHSSVRGGGNSGIWHVD

SEQ ID NO: 88903 - protein, 9 aa, Homo sapiens
  light chain complementarity determining region 3 for antibody 44452
QQYNNWPYT

SEQ ID NO: 88904 - protein, 18 aa, Homo sapiens
  heavy chain complementarity determining region 3 for antibody 44452
ARMLGPITVRGANDAFDI

SEQ ID NO: 88905 - protein, 9 aa, Homo sapiens
  light chain complementarity determining region 3 for antibody 44453
QQYNNWPRT

SEQ ID NO: 88906 - protein, 18 aa, Homo sapiens
  heavy chain complementarity determining region 3 for antibody 44453
ATNPRRVHDYGSGSPFYN

SEQ ID NO: 88907 - protein, 9 aa, Homo sapiens
  light chain complementarity determining region 3 for antibody 44454
QQYNNWPRT

SEQ ID NO: 88908 - protein, 11 aa, Homo sapiens
  heavy chain complementarity determining region 3 for antibody 44454
ARLRYQGYFDV

SEQ ID NO: 88909 - protein, 10 aa, Homo sapiens
  light chain complementarity determining region 3 for antibody 44455
QQYNNWPPGP

SEQ ID NO: 88910 - protein, 13 aa, Homo sapiens
  heavy chain complementarity determining region 3 for antibody 44455
ATSPPWNDGRLAD

SEQ ID NO: 88911 - protein, 9 aa, Homo sapiens
  light chain complementarity determining region 3 for antibody 44456
QQYNNWPLT

SEQ ID NO: 88912 - protein, 14 aa, Homo sapiens
  heavy chain complementarity determining region 3 for antibody 44456
ASAANPGEQFYFDF

SEQ ID NO: 88913 - protein, 9 aa, Homo sapiens
  light chain complementarity determining region 3 for antibody 44457
QQYNNWPLT

SEQ ID NO: 88914 - protein, 14 aa, Homo sapiens
  heavy chain complementarity determining region 3 for antibody 44457
ARDVTAPGYTGVAY

SEQ ID NO: 88915 - protein, 10 aa, Homo sapiens
  light chain complementarity determining region 3 for antibody 44458
QQYNIWPPIT

SEQ ID NO: 88916 - protein, 12 aa, Homo sapiens
  heavy chain complementarity determining region 3 for antibody 44458
ARDRAGDYVFEV

SEQ ID NO: 88917 - protein, 9 aa, Homo sapiens
  light chain complementarity determining region 3 for antibody 44459
QQYNGYSYT

SEQ ID NO: 88918 - protein, 16 aa, Homo sapiens
  heavy chain complementarity determining region 3 for antibody 44459
ARAQDGSGSVYSGAAY

SEQ ID NO: 88919 - protein, 9 aa, Homo sapiens
  light chain complementarity determining region 3 for antibody 44460
QQYNGYSRT

SEQ ID NO: 88920 - protein, 11 aa, Homo sapiens
  heavy chain complementarity determining region 3 for antibody 44460
VRVGTVRSLDL

SEQ ID NO: 88921 - protein, 10 aa, Homo sapiens
  light chain complementarity determining region 3 for antibody 44461
QQYNDWPPYT

SEQ ID NO: 88922 - protein, 21 aa, Homo sapiens
  heavy chain complementarity determining region 3 for antibody 44461
ARRRQNTIIRGADSRSGVLDM

SEQ ID NO: 88923 - protein, 9 aa, Homo sapiens
  light chain complementarity determining region 3 for antibody 44462
QQYLTSPGT

SEQ ID NO: 88924 - protein, 20 aa, Homo sapiens
  heavy chain complementarity determining region 3 for antibody 44462
AREALSWVALGETPPCDFDY

SEQ ID NO: 88925 - protein, 11 aa, Homo sapiens
  light chain complementarity determining region 3 for antibody 44463
QQYKTYSLGLT

SEQ ID NO: 88926 - protein, 12 aa, Homo sapiens
  heavy chain complementarity determining region 3 for antibody 44463
AKPLPSRAYFDY

SEQ ID NO: 88927 - protein, 9 aa, Homo sapiens
  light chain complementarity determining region 3 for antibody 44464
QQYKTYPIT

SEQ ID NO: 88928 - protein, 18 aa, Homo sapiens
  heavy chain complementarity determining region 3 for antibody 44464
VRDRRRGSNWEGEIRFDH

SEQ ID NO: 88929 - protein, 10 aa, Homo sapiens
  light chain complementarity determining region 3 for antibody 44465
QQYKTYPEIT

SEQ ID NO: 88930 - protein, 13 aa, Homo sapiens
  heavy chain complementarity determining region 3 for antibody 44465
RREMPRATTLPDY

SEQ ID NO: 88931 - protein, 9 aa, Homo sapiens
  light chain complementarity determining region 3 for antibody 44466
QQYKSYSYT

SEQ ID NO: 88932 - protein, 12 aa, Homo sapiens
  heavy chain complementarity determining region 3 for antibody 44466
AREGVSGPGFDF

SEQ ID NO: 88933 - protein, 9 aa, Homo sapiens
  light chain complementarity determining region 3 for antibody 44467
QQYKNWPYT

SEQ ID NO: 88934 - protein, 15 aa, Homo sapiens
  heavy chain complementarity determining region 3 for antibody 44467
ARRVSRVRYHWSFDL

SEQ ID NO: 88935 - protein, 9 aa, Homo sapiens
  light chain complementarity determining region 3 for antibody 44468
QQYKNLPWT

SEQ ID NO: 88936 - protein, 14 aa, Homo sapiens
  heavy chain complementarity determining region 3 for antibody 44468
TAETAYGSGSYSDS

SEQ ID NO: 88937 - protein, 9 aa, Homo sapiens
  light chain complementarity determining region 3 for antibody 44469
QQYISYPHT

SEQ ID NO: 88938 - protein, 15 aa, Homo sapiens
  heavy chain complementarity determining region 3 for antibody 44469
AKEYYSNSRSDACDI

SEQ ID NO: 88939 - protein, 9 aa, Homo sapiens
  light chain complementarity determining region 3 for antibody 44470
QQYIGYPIT

SEQ ID NO: 88940 - protein, 20 aa, Homo sapiens
  heavy chain complementarity determining region 3 for antibody 44470
ARASFSYDSTSYSYNNYFDY

SEQ ID NO: 88941 - protein, 10 aa, Homo sapiens
  light chain complementarity determining region 3 for antibody 44471
QQYHNWPPWT

SEQ ID NO: 88942 - protein, 15 aa, Homo sapiens
  heavy chain complementarity determining region 3 for antibody 44471
ARDASTLWPPKGFDP

SEQ ID NO: 88943 - protein, 9 aa, Homo sapiens
  light chain complementarity determining region 3 for antibody 44472
QQYGYSTVT

SEQ ID NO: 88944 - protein, 15 aa, Homo sapiens
  heavy chain complementarity determining region 3 for antibody 44472
ATFLRTDGSNYGFDY

SEQ ID NO: 88945 - protein, 9 aa, Homo sapiens
  light chain complementarity determining region 3 for antibody 44473
QQYGVSPKT

SEQ ID NO: 88946 - protein, 13 aa, Homo sapiens
  heavy chain complementarity determining region 3 for antibody 44473
TSRSLDAGAPLDF

SEQ ID NO: 88947 - protein, 9 aa, Homo sapiens
  light chain complementarity determining region 3 for antibody 44474
QQYGSTPLA

SEQ ID NO: 88948 - protein, 17 aa, Homo sapiens
  heavy chain complementarity determining region 3 for antibody 44474
ARDVSYTSLYHYWYFDL

SEQ ID NO: 88949 - protein, 10 aa, Homo sapiens
  light chain complementarity determining region 3 for antibody 44475
QQYGSTFSIT

SEQ ID NO: 88950 - protein, 16 aa, Homo sapiens
  heavy chain complementarity determining region 3 for antibody 44475
AGRSGGSRWGRSHFDY

SEQ ID NO: 88951 - protein, 9 aa, Homo sapiens
  light chain complementarity determining region 3 for antibody 44476
QQYGSSPYT

SEQ ID NO: 88952 - protein, 16 aa, Homo sapiens
  heavy chain complementarity determining region 3 for antibody 44476
ATMYTSGWSDTSFFDH

SEQ ID NO: 88953 - protein, 9 aa, Homo sapiens
  light chain complementarity determining region 3 for antibody 44477
QQYGSSPYT

SEQ ID NO: 88954 - protein, 24 aa, Homo sapiens
  heavy chain complementarity determining region 3 for antibody 44477
ARGTLQYYYDGSGYYYATGDSFDL

SEQ ID NO: 88955 - protein, 9 aa, Homo sapiens
  light chain complementarity determining region 3 for antibody 44478
QQYGSSPYT

SEQ ID NO: 88956 - protein, 9 aa, Homo sapiens
  heavy chain complementarity determining region 3 for antibody 44478
ARELGAVRD

SEQ ID NO: 88957 - protein, 9 aa, Homo sapiens
  light chain complementarity determining region 3 for antibody 44479
QQYGSSPWT

SEQ ID NO: 88958 - protein, 17 aa, Homo sapiens
  heavy chain complementarity determining region 3 for antibody 44479
ARVHMTIHGFPMWYFDQ

SEQ ID NO: 88959 - protein, 9 aa, Homo sapiens
  light chain complementarity determining region 3 for antibody 44480
QQYGSSPWT

SEQ ID NO: 88960 - protein, 14 aa, Homo sapiens
  heavy chain complementarity determining region 3 for antibody 44480
ARLVAGGGSNWFDP

SEQ ID NO: 88961 - protein, 9 aa, Homo sapiens
  light chain complementarity determining region 3 for antibody 44481
QQYGSSPRT

SEQ ID NO: 88962 - protein, 15 aa, Homo sapiens
  heavy chain complementarity determining region 3 for antibody 44481
ARGPPVVSLAGFFDF

SEQ ID NO: 88963 - protein, 9 aa, Homo sapiens
  light chain complementarity determining region 3 for antibody 44482
QQYGSSPQT

SEQ ID NO: 88964 - protein, 22 aa, Homo sapiens
  heavy chain complementarity determining region 3 for antibody 44482
ARDLTPTSYSETSLLYYDALDI

SEQ ID NO: 88965 - protein, 10 aa, Homo sapiens
  light chain complementarity determining region 3 for antibody 44483
QQYGSSPPYT

SEQ ID NO: 88966 - protein, 19 aa, Homo sapiens
  heavy chain complementarity determining region 3 for antibody 44483
ARVLWNFSRAYYDILALDY

SEQ ID NO: 88967 - protein, 10 aa, Homo sapiens
  light chain complementarity determining region 3 for antibody 44484
QQYGSSPPWT

SEQ ID NO: 88968 - protein, 18 aa, Homo sapiens
  heavy chain complementarity determining region 3 for antibody 44484
VTGGNRPDWSKLHNYFDY

SEQ ID NO: 88969 - protein, 10 aa, Homo sapiens
  light chain complementarity determining region 3 for antibody 44485
QQYGSSPPGT

SEQ ID NO: 88970 - protein, 19 aa, Homo sapiens
  heavy chain complementarity determining region 3 for antibody 44485
VRDNYDYWSGRPSAGYFDY

SEQ ID NO: 88971 - protein, 9 aa, Homo sapiens
  light chain complementarity determining region 3 for antibody 44486
QQYGSSPKT

SEQ ID NO: 88972 - protein, 13 aa, Homo sapiens
  heavy chain complementarity determining region 3 for antibody 44486
ARDQGYSASVPGF

SEQ ID NO: 88973 - protein, 9 aa, Homo sapiens
  light chain complementarity determining region 3 for antibody 44487
QQYGSSPGT

SEQ ID NO: 88974 - protein, 22 aa, Homo sapiens
  heavy chain complementarity determining region 3 for antibody 44487
ARGEYLSDGTDYLWLTDEYFQH

SEQ ID NO: 88975 - protein, 8 aa, Homo sapiens
  light chain complementarity determining region 3 for antibody 44488
QQYGSSGT

SEQ ID NO: 88976 - protein, 24 aa, Homo sapiens
  heavy chain complementarity determining region 3 for antibody 44488
ARILGRRYCSGGVCYFYHYNGLDV

SEQ ID NO: 88977 - protein, 8 aa, Homo sapiens
  light chain complementarity determining region 3 for antibody 44489
QQYGSSFT

SEQ ID NO: 88978 - protein, 22 aa, Homo sapiens
  heavy chain complementarity determining region 3 for antibody 44489
TRRRPTGRTSFRRGGRQGAFDI

SEQ ID NO: 88979 - protein, 8 aa, Homo sapiens
  light chain complementarity determining region 3 for antibody 44490
QQYGSFFT

SEQ ID NO: 88980 - protein, 14 aa, Homo sapiens
  heavy chain complementarity determining region 3 for antibody 44490
ARHGHSSAWSYFDN

SEQ ID NO: 88981 - protein, 8 aa, Homo sapiens
  light chain complementarity determining region 3 for antibody 44491
QQYGRSPT

SEQ ID NO: 88982 - protein, 17 aa, Homo sapiens
  heavy chain complementarity determining region 3 for antibody 44491
ATTVVEAAAGDYWFFGL

SEQ ID NO: 88983 - protein, 9 aa, Homo sapiens
  light chain complementarity determining region 3 for antibody 44492
QQYGNSPGT

SEQ ID NO: 88984 - protein, 14 aa, Homo sapiens
  heavy chain complementarity determining region 3 for antibody 44492
ARDSHVVTPYYFDS

SEQ ID NO: 88985 - protein, 8 aa, Homo sapiens
  light chain complementarity determining region 3 for antibody 44493
QQYGMSVT

SEQ ID NO: 88986 - protein, 17 aa, Homo sapiens
  heavy chain complementarity determining region 3 for antibody 44493
ARHAHDSDMSGFYPFDH

SEQ ID NO: 88987 - protein, 9 aa, Homo sapiens
  light chain complementarity determining region 3 for antibody 44494
QQYGISVIT

SEQ ID NO: 88988 - protein, 13 aa, Homo sapiens
  heavy chain complementarity determining region 3 for antibody 44494
ARWAAAGTQGFDS

SEQ ID NO: 88989 - protein, 9 aa, Homo sapiens
  light chain complementarity determining region 3 for antibody 44495
QQYGILPYT

SEQ ID NO: 88990 - protein, 22 aa, Homo sapiens
  heavy chain complementarity determining region 3 for antibody 44495
VSMRQTLAVAGRSRFFYYDMDV

SEQ ID NO: 88991 - protein, 10 aa, Homo sapiens
  light chain complementarity determining region 3 for antibody 44496
QQYGGSPRDT

SEQ ID NO: 88992 - protein, 15 aa, Homo sapiens
  heavy chain complementarity determining region 3 for antibody 44496
ARLGWVRGDYGPIDY

SEQ ID NO: 88993 - protein, 9 aa, Homo sapiens
  light chain complementarity determining region 3 for antibody 44497
QQYGDSPIT

SEQ ID NO: 88994 - protein, 14 aa, Homo sapiens
  heavy chain complementarity determining region 3 for antibody 44497
VKHNYLSGSYYPPF

SEQ ID NO: 88995 - protein, 9 aa, Homo sapiens
  light chain complementarity determining region 3 for antibody 44498
QQYGASPLT

SEQ ID NO: 88996 - protein, 13 aa, Homo sapiens
  heavy chain complementarity determining region 3 for antibody 44498
ARAGVVGANWLDP

SEQ ID NO: 88997 - protein, 9 aa, Homo sapiens
  light chain complementarity determining region 3 for antibody 44499
QQYESLPPT

SEQ ID NO: 88998 - protein, 12 aa, Homo sapiens
  heavy chain complementarity determining region 3 for antibody 44499
VRDRVAGDAFDT

SEQ ID NO: 88999 - protein, 9 aa, Homo sapiens
  light chain complementarity determining region 3 for antibody 44500
QQYENYPGT

SEQ ID NO: 89000 - protein, 12 aa, Homo sapiens
  heavy chain complementarity determining region 3 for antibody 44500
ARLRGGTYYSDF

SEQ ID NO: 89001 - protein, 9 aa, Homo sapiens
  light chain complementarity determining region 3 for antibody 44501
QQYDTIAWT

SEQ ID NO: 89002 - protein, 15 aa, Homo sapiens
  heavy chain complementarity determining region 3 for antibody 44501
VKGSFLARWGDSFDV

SEQ ID NO: 89003 - protein, 8 aa, Homo sapiens
  light chain complementarity determining region 3 for antibody 44502
QQYDSYRT

SEQ ID NO: 89004 - protein, 14 aa, Homo sapiens
  heavy chain complementarity determining region 3 for antibody 44502
AREAVDGNIHAFDI

SEQ ID NO: 89005 - protein, 9 aa, Homo sapiens
  light chain complementarity determining region 3 for antibody 44503
QQYDSSPWT

SEQ ID NO: 89006 - protein, 13 aa, Homo sapiens
  heavy chain complementarity determining region 3 for antibody 44503
ARGIAVAGIFFQH

SEQ ID NO: 89007 - protein, 11 aa, Homo sapiens
  light chain complementarity determining region 3 for antibody 44504
QQYDRSHQGYT

SEQ ID NO: 89008 - protein, 14 aa, Homo sapiens
  heavy chain complementarity determining region 3 for antibody 44504
TFYASNSPKTSFDQ

SEQ ID NO: 89009 - protein, 10 aa, Homo sapiens
  light chain complementarity determining region 3 for antibody 44505
QQYDNWPPIT

SEQ ID NO: 89010 - protein, 14 aa, Homo sapiens
  heavy chain complementarity determining region 3 for antibody 44505
ASDRGTGWYGALEI

SEQ ID NO: 89011 - protein, 9 aa, Homo sapiens
  light chain complementarity determining region 3 for antibody 44506
QQYDNWPLT

SEQ ID NO: 89012 - protein, 15 aa, Homo sapiens
  heavy chain complementarity determining region 3 for antibody 44506
ARTKEWFGEIDPFDY

SEQ ID NO: 89013 - protein, 9 aa, Homo sapiens
  light chain complementarity determining region 3 for antibody 44507
QQYDNLPYT

SEQ ID NO: 89014 - protein, 17 aa, Homo sapiens
  heavy chain complementarity determining region 3 for antibody 44507
ARLEERDFHDYGDHFDY

SEQ ID NO: 89015 - protein, 10 aa, Homo sapiens
  light chain complementarity determining region 3 for antibody 44508
QQYDNLPSII

SEQ ID NO: 89016 - protein, 11 aa, Homo sapiens
  heavy chain complementarity determining region 3 for antibody 44508
ARAPYGAKIDS

SEQ ID NO: 89017 - protein, 9 aa, Homo sapiens
  light chain complementarity determining region 3 for antibody 44509
QQYDNLPLT

SEQ ID NO: 89018 - protein, 21 aa, Homo sapiens
  heavy chain complementarity determining region 3 for antibody 44509
ARHSSDWSYNSRGYYLNDLDF

SEQ ID NO: 89019 - protein, 9 aa, Homo sapiens
  light chain complementarity determining region 3 for antibody 44510
QQYDNLPLT

SEQ ID NO: 89020 - protein, 11 aa, Homo sapiens
  heavy chain complementarity determining region 3 for antibody 44510
AEGWLRGSFDY

SEQ ID NO: 89021 - protein, 9 aa, Homo sapiens
  light chain complementarity determining region 3 for antibody 44511
QQYDKLPLT

SEQ ID NO: 89022 - protein, 14 aa, Homo sapiens
  heavy chain complementarity determining region 3 for antibody 44511
ASVKYDTSWFSFDY

SEQ ID NO: 89023 - protein, 9 aa, Homo sapiens
  light chain complementarity determining region 3 for antibody 44512
QQYDISQRT

SEQ ID NO: 89024 - protein, 18 aa, Homo sapiens
  heavy chain complementarity determining region 3 for antibody 44512
ATSVATTVDGYYYYALDV

SEQ ID NO: 89025 - protein, 9 aa, Homo sapiens
  light chain complementarity determining region 3 for antibody 44513
QQYDDLPYT

SEQ ID NO: 89026 - protein, 18 aa, Homo sapiens
  heavy chain complementarity determining region 3 for antibody 44513
ARGFTCSVDGCYPGYFQY

SEQ ID NO: 89027 - protein, 9 aa, Homo sapiens
  light chain complementarity determining region 3 for antibody 44514
QQYDDLPYT

SEQ ID NO: 89028 - protein, 20 aa, Homo sapiens
  heavy chain complementarity determining region 3 for antibody 44514
AKDSNAYGITLGGLIGSFDS

SEQ ID NO: 89029 - protein, 9 aa, Homo sapiens
  light chain complementarity determining region 3 for antibody 44515
QQYDDLPVT

SEQ ID NO: 89030 - protein, 13 aa, Homo sapiens
  heavy chain complementarity determining region 3 for antibody 44515
VRERSGDAEIFDF

SEQ ID NO: 89031 - protein, 10 aa, Homo sapiens
  light chain complementarity determining region 3 for antibody 44516
QQYATYLPLS

SEQ ID NO: 89032 - protein, 15 aa, Homo sapiens
  heavy chain complementarity determining region 3 for antibody 44516
ARHHLRWPQGWYFDL

SEQ ID NO: 89033 - protein, 9 aa, Homo sapiens
  light chain complementarity determining region 3 for antibody 44517
QQYATSPWT

SEQ ID NO: 89034 - protein, 15 aa, Homo sapiens
  heavy chain complementarity determining region 3 for antibody 44517
ATRVGDGFNVGVWDY

SEQ ID NO: 89035 - protein, 9 aa, Homo sapiens
  light chain complementarity determining region 3 for antibody 44518
QQYARSPIT

SEQ ID NO: 89036 - protein, 10 aa, Homo sapiens
  heavy chain complementarity determining region 3 for antibody 44518
VTSGGWAFIH

SEQ ID NO: 89037 - protein, 9 aa, Homo sapiens
  light chain complementarity determining region 3 for antibody 44519
QQYADSPYT

SEQ ID NO: 89038 - protein, 15 aa, Homo sapiens
  heavy chain complementarity determining region 3 for antibody 44519
AKHKADYGAKDYFDY

SEQ ID NO: 89039 - protein, 8 aa, Homo sapiens
  light chain complementarity determining region 3 for antibody 44520
QQVVRSRT

SEQ ID NO: 89040 - protein, 23 aa, Homo sapiens
  heavy chain complementarity determining region 3 for antibody 44520
ARHYRLYYDFWNGYSKAPDAFDI

SEQ ID NO: 89041 - protein, 10 aa, Homo sapiens
  light chain complementarity determining region 3 for antibody 44521
QQTYTDPMYT

SEQ ID NO: 89042 - protein, 12 aa, Homo sapiens
  heavy chain complementarity determining region 3 for antibody 44521
ARTYGSGSFYDY

SEQ ID NO: 89043 - protein, 9 aa, Homo sapiens
  light chain complementarity determining region 3 for antibody 44522
QQTYSLPYT

SEQ ID NO: 89044 - protein, 12 aa, Homo sapiens
  heavy chain complementarity determining region 3 for antibody 44522
ARSPTGVPAGDF

SEQ ID NO: 89045 - protein, 8 aa, Homo sapiens
  light chain complementarity determining region 3 for antibody 44523
QQTYSIIT

SEQ ID NO: 89046 - protein, 14 aa, Homo sapiens
  heavy chain complementarity determining region 3 for antibody 44523
ARSLGSEHSYGMDV

SEQ ID NO: 89047 - protein, 9 aa, Homo sapiens
  light chain complementarity determining region 3 for antibody 44524
QQTYNTPRT

SEQ ID NO: 89048 - protein, 12 aa, Homo sapiens
  heavy chain complementarity determining region 3 for antibody 44524
ARNGGGSYGMDV

SEQ ID NO: 89049 - protein, 9 aa, Homo sapiens
  light chain complementarity determining region 3 for antibody 44525
QQTFRTPLT

SEQ ID NO: 89050 - protein, 21 aa, Homo sapiens
  heavy chain complementarity determining region 3 for antibody 44525
ARLGAAGDDFGDYLYYHGMDV

SEQ ID NO: 89051 - protein, 9 aa, Homo sapiens
  light chain complementarity determining region 3 for antibody 44526
QQTDTPPWT

SEQ ID NO: 89052 - protein, 17 aa, Homo sapiens
  heavy chain complementarity determining region 3 for antibody 44526
AREVRYCSRTSCSRYDL

SEQ ID NO: 89053 - protein, 9 aa, Homo sapiens
  light chain complementarity determining region 3 for antibody 44527
QQTDSFPFT

SEQ ID NO: 89054 - protein, 10 aa, Homo sapiens
  heavy chain complementarity determining region 3 for antibody 44527
ARHQGYTFDI

SEQ ID NO: 89055 - protein, 9 aa, Homo sapiens
  light chain complementarity determining region 3 for antibody 44528
QQSYTTPLI

SEQ ID NO: 89056 - protein, 14 aa, Homo sapiens
  heavy chain complementarity determining region 3 for antibody 44528
AREVRHRAYYALDV

SEQ ID NO: 89057 - protein, 9 aa, Homo sapiens
  light chain complementarity determining region 3 for antibody 44529
QQSYTMPLT

SEQ ID NO: 89058 - protein, 16 aa, Homo sapiens
  heavy chain complementarity determining region 3 for antibody 44529
ARVREGDFDDLFWFDY

SEQ ID NO: 89059 - protein, 9 aa, Homo sapiens
  light chain complementarity determining region 3 for antibody 44530
QQSYSTWYT

SEQ ID NO: 89060 - protein, 12 aa, Homo sapiens
  heavy chain complementarity determining region 3 for antibody 44530
ASLHVMGYWFDS

SEQ ID NO: 89061 - protein, 9 aa, Homo sapiens
  light chain complementarity determining region 3 for antibody 44531
QQSYSTPYT

SEQ ID NO: 89062 - protein, 12 aa, Homo sapiens
  heavy chain complementarity determining region 3 for antibody 44531
ARHRAPVAYRDS

SEQ ID NO: 89063 - protein, 9 aa, Homo sapiens
  light chain complementarity determining region 3 for antibody 44532
QQSYSTPRT

SEQ ID NO: 89064 - protein, 15 aa, Homo sapiens
  heavy chain complementarity determining region 3 for antibody 44532
ARVKIRGVNPYFFDY

SEQ ID NO: 89065 - protein, 9 aa, Homo sapiens
  light chain complementarity determining region 3 for antibody 44533
QQSYSTPRT

SEQ ID NO: 89066 - protein, 21 aa, Homo sapiens
  heavy chain complementarity determining region 3 for antibody 44533
ARDVESSFGSGYYNPAGGPTY

SEQ ID NO: 89067 - protein, 9 aa, Homo sapiens
  light chain complementarity determining region 3 for antibody 44534
QQSYSTPRT

SEQ ID NO: 89068 - protein, 15 aa, Homo sapiens
  heavy chain complementarity determining region 3 for antibody 44534
ARDNIVGVAGYGMGV

SEQ ID NO: 89069 - protein, 10 aa, Homo sapiens
  light chain complementarity determining region 3 for antibody 44535
QQSYSTPRGT

SEQ ID NO: 89070 - protein, 12 aa, Homo sapiens
  heavy chain complementarity determining region 3 for antibody 44535
ARRTAYSNYFDY

SEQ ID NO: 89071 - protein, 10 aa, Homo sapiens
  light chain complementarity determining region 3 for antibody 44536
QQSYSTPPYT

SEQ ID NO: 89072 - protein, 22 aa, Homo sapiens
  heavy chain complementarity determining region 3 for antibody 44536
ARGQGYDSSGYYGSGNYYGMDV

SEQ ID NO: 89073 - protein, 9 aa, Homo sapiens
  light chain complementarity determining region 3 for antibody 44537
QQSYSTPPT

SEQ ID NO: 89074 - protein, 20 aa, Homo sapiens
  heavy chain complementarity determining region 3 for antibody 44537
ARDSLGGQNWNYGRNDAFDI

SEQ ID NO: 89075 - protein, 9 aa, Homo sapiens
  light chain complementarity determining region 3 for antibody 44538
QQSYSTPLT

SEQ ID NO: 89076 - protein, 14 aa, Homo sapiens
  heavy chain complementarity determining region 3 for antibody 44538
AKASDTSGYSRFDY

SEQ ID NO: 89077 - protein, 9 aa, Homo sapiens
  light chain complementarity determining region 3 for antibody 44539
QQSYSTPFT

SEQ ID NO: 89078 - protein, 13 aa, Homo sapiens
  heavy chain complementarity determining region 3 for antibody 44539
ARDSRTYGGAFDI

SEQ ID NO: 89079 - protein, 9 aa, Homo sapiens
  light chain complementarity determining region 3 for antibody 44540
QQSYSTPFT

SEQ ID NO: 89080 - protein, 19 aa, Homo sapiens
  heavy chain complementarity determining region 3 for antibody 44540
ARASGSYCSRISCYPYFDS

SEQ ID NO: 89081 - protein, 9 aa, Homo sapiens
  light chain complementarity determining region 3 for antibody 44541
QQSYSSPYT

SEQ ID NO: 89082 - protein, 18 aa, Homo sapiens
  heavy chain complementarity determining region 3 for antibody 44541
VRRAIKTSGWTVDFYFDY

SEQ ID NO: 89083 - protein, 9 aa, Homo sapiens
  light chain complementarity determining region 3 for antibody 44542
QQSYSSPRT

SEQ ID NO: 89084 - protein, 15 aa, Homo sapiens
  heavy chain complementarity determining region 3 for antibody 44542
ARVLAMAGTEAPFDI

SEQ ID NO: 89085 - protein, 9 aa, Homo sapiens
  light chain complementarity determining region 3 for antibody 44543
QQSYSPPYT

SEQ ID NO: 89086 - protein, 21 aa, Homo sapiens
  heavy chain complementarity determining region 3 for antibody 44543
ATLEFYGLYGDPNKGGYYFDY

SEQ ID NO: 89087 - protein, 9 aa, Homo sapiens
  light chain complementarity determining region 3 for antibody 44544
QQSYSPPRT

SEQ ID NO: 89088 - protein, 21 aa, Homo sapiens
  heavy chain complementarity determining region 3 for antibody 44544
ARVTVRVPSTTGFGEYYGLDV

SEQ ID NO: 89089 - protein, 9 aa, Homo sapiens
  light chain complementarity determining region 3 for antibody 44545
QQSYSLPYT

SEQ ID NO: 89090 - protein, 15 aa, Homo sapiens
  heavy chain complementarity determining region 3 for antibody 44545
ARLRKYSSGTRPFDF

SEQ ID NO: 89091 - protein, 9 aa, Homo sapiens
  light chain complementarity determining region 3 for antibody 44546
QQSYSIPLT

SEQ ID NO: 89092 - protein, 19 aa, Homo sapiens
  heavy chain complementarity determining region 3 for antibody 44546
AKEQAGLGFGDYGYWYFDL

SEQ ID NO: 89093 - protein, 9 aa, Homo sapiens
  light chain complementarity determining region 3 for antibody 44547
QQSYSIPFT

SEQ ID NO: 89094 - protein, 23 aa, Homo sapiens
  heavy chain complementarity determining region 3 for antibody 44547
ARSHPVGPWELPDGDYYFHGMDV

SEQ ID NO: 89095 - protein, 9 aa, Homo sapiens
  light chain complementarity determining region 3 for antibody 44548
QQSYSILWT

SEQ ID NO: 89096 - protein, 19 aa, Homo sapiens
  heavy chain complementarity determining region 3 for antibody 44548
GRLSELERRLSEYYYAMDV

SEQ ID NO: 89097 - protein, 10 aa, Homo sapiens
  light chain complementarity determining region 3 for antibody 44549
QQSYSGTALT

SEQ ID NO: 89098 - protein, 15 aa, Homo sapiens
  heavy chain complementarity determining region 3 for antibody 44549
ARVWGEINYYYGMDV

SEQ ID NO: 89099 - protein, 9 aa, Homo sapiens
  light chain complementarity determining region 3 for antibody 44550
QQSYSFPPT

SEQ ID NO: 89100 - protein, 20 aa, Homo sapiens
  heavy chain complementarity determining region 3 for antibody 44550
ARRGGIAMVRGVIRGYYHDY

SEQ ID NO: 89101 - protein, 10 aa, Homo sapiens
  light chain complementarity determining region 3 for antibody 44551
QQSYSDLPFT

SEQ ID NO: 89102 - protein, 21 aa, Homo sapiens
  heavy chain complementarity determining region 3 for antibody 44551
ARDVKHYDSSGSYWPLDMFDM

SEQ ID NO: 89103 - protein, 9 aa, Homo sapiens
  light chain complementarity determining region 3 for antibody 44552
QQSYRTPFT

SEQ ID NO: 89104 - protein, 16 aa, Homo sapiens
  heavy chain complementarity determining region 3 for antibody 44552
ARIPPAQWLGNEAFDI

SEQ ID NO: 89105 - protein, 9 aa, Homo sapiens
  light chain complementarity determining region 3 for antibody 44553
QQSYNGPWT

SEQ ID NO: 89106 - protein, 11 aa, Homo sapiens
  heavy chain complementarity determining region 3 for antibody 44553
ARQNGGSHLDF

SEQ ID NO: 89107 - protein, 9 aa, Homo sapiens
  light chain complementarity determining region 3 for antibody 44554
QQSYITPLT

SEQ ID NO: 89108 - protein, 16 aa, Homo sapiens
  heavy chain complementarity determining region 3 for antibody 44554
ARGLDYLYDILTQLEY

SEQ ID NO: 89109 - protein, 9 aa, Homo sapiens
  light chain complementarity determining region 3 for antibody 44555
QQSYIIPHT

SEQ ID NO: 89110 - protein, 11 aa, Homo sapiens
  heavy chain complementarity determining region 3 for antibody 44555
ARVRSGYYYDY

SEQ ID NO: 89111 - protein, 9 aa, Homo sapiens
  light chain complementarity determining region 3 for antibody 44556
QQSYGIPFS

SEQ ID NO: 89112 - protein, 15 aa, Homo sapiens
  heavy chain complementarity determining region 3 for antibody 44556
AKRVPVSSSWGDIDY

SEQ ID NO: 89113 - protein, 9 aa, Homo sapiens
  light chain complementarity determining region 3 for antibody 44557
QQSYDTPWT

SEQ ID NO: 89114 - protein, 20 aa, Homo sapiens
  heavy chain complementarity determining region 3 for antibody 44557
ARLSQVFFDSSGTGYYAMDV

SEQ ID NO: 89115 - protein, 10 aa, Homo sapiens
  light chain complementarity determining region 3 for antibody 44558
QQSYASPRFT

SEQ ID NO: 89116 - protein, 13 aa, Homo sapiens
  heavy chain complementarity determining region 3 for antibody 44558
ASLLYHGSGYFDS

SEQ ID NO: 89117 - protein, 9 aa, Homo sapiens
  light chain complementarity determining region 3 for antibody 44559
QQSVTTPIT

SEQ ID NO: 89118 - protein, 6 aa, Homo sapiens
  heavy chain complementarity determining region 3 for antibody 44559
ASLMFG

SEQ ID NO: 89119 - protein, 9 aa, Homo sapiens
  light chain complementarity determining region 3 for antibody 44560
QQSSTTPLT

SEQ ID NO: 89120 - protein, 13 aa, Homo sapiens
  heavy chain complementarity determining region 3 for antibody 44560
ARDSGEYSSSLDY

SEQ ID NO: 89121 - protein, 9 aa, Homo sapiens
  light chain complementarity determining region 3 for antibody 44561
QQSSHFPYT

SEQ ID NO: 89122 - protein, 16 aa, Homo sapiens
  heavy chain complementarity determining region 3 for antibody 44561
ARFRPISGGLVSGFDY

SEQ ID NO: 89123 - protein, 9 aa, Homo sapiens
  light chain complementarity determining region 3 for antibody 44562
QQSLTYPWT

SEQ ID NO: 89124 - protein, 16 aa, Homo sapiens
  heavy chain complementarity determining region 3 for antibody 44562
VRVEYRGFADLPALDY

SEQ ID NO: 89125 - protein, 9 aa, Homo sapiens
  light chain complementarity determining region 3 for antibody 44563
QQSHTTPLT

SEQ ID NO: 89126 - protein, 13 aa, Homo sapiens
  heavy chain complementarity determining region 3 for antibody 44563
ARGGAAAGKAFDF

SEQ ID NO: 89127 - protein, 9 aa, Homo sapiens
  light chain complementarity determining region 3 for antibody 44564
QQSHSIPIT

SEQ ID NO: 89128 - protein, 13 aa, Homo sapiens
  heavy chain complementarity determining region 3 for antibody 44564
ARDGGHWLVGLDS

SEQ ID NO: 89129 - protein, 9 aa, Homo sapiens
  light chain complementarity determining region 3 for antibody 44565
QQSHITPIT

SEQ ID NO: 89130 - protein, 10 aa, Homo sapiens
  heavy chain complementarity determining region 3 for antibody 44565
TRSEGFGMDV

SEQ ID NO: 89131 - protein, 9 aa, Homo sapiens
  light chain complementarity determining region 3 for antibody 44566
QQSHITPIT

SEQ ID NO: 89132 - protein, 11 aa, Homo sapiens
  heavy chain complementarity determining region 3 for antibody 44566
ASSGYETTLEY

SEQ ID NO: 89133 - protein, 9 aa, Homo sapiens
  light chain complementarity determining region 3 for antibody 44567
QQSFTTPFT

SEQ ID NO: 89134 - protein, 14 aa, Homo sapiens
  heavy chain complementarity determining region 3 for antibody 44567
ARDTDSSGYYSFGV

SEQ ID NO: 89135 - protein, 9 aa, Homo sapiens
  light chain complementarity determining region 3 for antibody 44568
QQSFSNPPT

SEQ ID NO: 89136 - protein, 19 aa, Homo sapiens
  heavy chain complementarity determining region 3 for antibody 44568
AREVDTLVGRQQNFNWFDP

SEQ ID NO: 89137 - protein, 9 aa, Homo sapiens
  light chain complementarity determining region 3 for antibody 44569
QQSDSIPIT

SEQ ID NO: 89138 - protein, 17 aa, Homo sapiens
  heavy chain complementarity determining region 3 for antibody 44569
VRDPLRLVTLQGGYFDY

SEQ ID NO: 89139 - protein, 9 aa, Homo sapiens
  light chain complementarity determining region 3 for antibody 44570
QQSDSAPYT

SEQ ID NO: 89140 - protein, 11 aa, Homo sapiens
  heavy chain complementarity determining region 3 for antibody 44570
GDYGRLAIAVE

SEQ ID NO: 89141 - protein, 10 aa, Homo sapiens
  light chain complementarity determining region 3 for antibody 44571
QQRYNWPPYP

SEQ ID NO: 89142 - protein, 11 aa, Homo sapiens
  heavy chain complementarity determining region 3 for antibody 44571
ARGVGSYVFES

SEQ ID NO: 89143 - protein, 10 aa, Homo sapiens
  light chain complementarity determining region 3 for antibody 44572
QQRYNWPPLT

SEQ ID NO: 89144 - protein, 11 aa, Homo sapiens
  heavy chain complementarity determining region 3 for antibody 44572
ARGVGSYPFDS

SEQ ID NO: 89145 - protein, 9 aa, Homo sapiens
  light chain complementarity determining region 3 for antibody 44573
QQRYKWPLT

SEQ ID NO: 89146 - protein, 18 aa, Homo sapiens
  heavy chain complementarity determining region 3 for antibody 44573
ASMRQGCSTTSCYNDMDV

SEQ ID NO: 89147 - protein, 8 aa, Homo sapiens
  light chain complementarity determining region 3 for antibody 44574
QQRTEGLT

SEQ ID NO: 89148 - protein, 13 aa, Homo sapiens
  heavy chain complementarity determining region 3 for antibody 44574
ARDLGEGAVPDES

SEQ ID NO: 89149 - protein, 8 aa, Homo sapiens
  light chain complementarity determining region 3 for antibody 44575
QQRSYWLT

SEQ ID NO: 89150 - protein, 11 aa, Homo sapiens
  heavy chain complementarity determining region 3 for antibody 44575
ARGLSPGLFDF

SEQ ID NO: 89151 - protein, 9 aa, Homo sapiens
  light chain complementarity determining region 3 for antibody 44576
QQRSTWPWT

SEQ ID NO: 89152 - protein, 9 aa, Homo sapiens
  heavy chain complementarity determining region 3 for antibody 44576
ARDSDYEDF

SEQ ID NO: 89153 - protein, 10 aa, Homo sapiens
  light chain complementarity determining region 3 for antibody 44577
QQRSTWPPIT

SEQ ID NO: 89154 - protein, 11 aa, Homo sapiens
  heavy chain complementarity determining region 3 for antibody 44577
TREGSIGGLDV

SEQ ID NO: 89155 - protein, 8 aa, Homo sapiens
  light chain complementarity determining region 3 for antibody 44578
QQRSSWPT

SEQ ID NO: 89156 - protein, 17 aa, Homo sapiens
  heavy chain complementarity determining region 3 for antibody 44578
TRAPAGISGGWYPIFDS

SEQ ID NO: 89157 - protein, 8 aa, Homo sapiens
  light chain complementarity determining region 3 for antibody 44579
QQRSNWYT

SEQ ID NO: 89158 - protein, 12 aa, Homo sapiens
  heavy chain complementarity determining region 3 for antibody 44579
ARSFWGFAEHLN

SEQ ID NO: 89159 - protein, 10 aa, Homo sapiens
  light chain complementarity determining region 3 for antibody 44580
QQRSNWPPYT

SEQ ID NO: 89160 - protein, 21 aa, Homo sapiens
  heavy chain complementarity determining region 3 for antibody 44580
ARDAPVSRPYSSGWYSSAFDY

SEQ ID NO: 89161 - protein, 11 aa, Homo sapiens
  light chain complementarity determining region 3 for antibody 44581
QQRSNWPPVFT

SEQ ID NO: 89162 - protein, 13 aa, Homo sapiens
  heavy chain complementarity determining region 3 for antibody 44581
ARAKTSTYFYFDY

SEQ ID NO: 89163 - protein, 11 aa, Homo sapiens
  light chain complementarity determining region 3 for antibody 44582
QQRSNWPPTFT

SEQ ID NO: 89164 - protein, 15 aa, Homo sapiens
  heavy chain complementarity determining region 3 for antibody 44582
TKGDSRKSYWDYFHY

SEQ ID NO: 89165 - protein, 10 aa, Homo sapiens
  light chain complementarity determining region 3 for antibody 44583
QQRSNWPPLT

SEQ ID NO: 89166 - protein, 9 aa, Homo sapiens
  heavy chain complementarity determining region 3 for antibody 44583
ARVDGYFDY

SEQ ID NO: 89167 - protein, 10 aa, Homo sapiens
  light chain complementarity determining region 3 for antibody 44584
QQRSNWPPGT

SEQ ID NO: 89168 - protein, 11 aa, Homo sapiens
  heavy chain complementarity determining region 3 for antibody 44584
AREAYDVLTSP

SEQ ID NO: 89169 - protein, 10 aa, Homo sapiens
  light chain complementarity determining region 3 for antibody 44585
QQRSNWPPAT

SEQ ID NO: 89170 - protein, 15 aa, Homo sapiens
  heavy chain complementarity determining region 3 for antibody 44585
AGSIALPGTADYFDY

SEQ ID NO: 89171 - protein, 9 aa, Homo sapiens
  light chain complementarity determining region 3 for antibody 44586
QQRSNWPLT

SEQ ID NO: 89172 - protein, 8 aa, Homo sapiens
  heavy chain complementarity determining region 3 for antibody 44586
EGSGSYAY

SEQ ID NO: 89173 - protein, 9 aa, Homo sapiens
  light chain complementarity determining region 3 for antibody 44587
QQRSNWPKT

SEQ ID NO: 89174 - protein, 20 aa, Homo sapiens
  heavy chain complementarity determining region 3 for antibody 44587
ARSDRRQWLATPVSPYYFDS

SEQ ID NO: 89175 - protein, 9 aa, Homo sapiens
  light chain complementarity determining region 3 for antibody 44588
QQRSNWPIT

SEQ ID NO: 89176 - protein, 11 aa, Homo sapiens
  heavy chain complementarity determining region 3 for antibody 44588
ARKNGANSFDM

SEQ ID NO: 89177 - protein, 9 aa, Homo sapiens
  light chain complementarity determining region 3 for antibody 44589
QQRSNWPIT

SEQ ID NO: 89178 - protein, 22 aa, Homo sapiens
  heavy chain complementarity determining region 3 for antibody 44589
AKGIAVVTVALSRTHHYYGMEV

SEQ ID NO: 89179 - protein, 8 aa, Homo sapiens
  light chain complementarity determining region 3 for antibody 44590
QQRSNWLT

SEQ ID NO: 89180 - protein, 11 aa, Homo sapiens
  heavy chain complementarity determining region 3 for antibody 44590
ARGTDGYNWFY

SEQ ID NO: 89181 - protein, 10 aa, Homo sapiens
  light chain complementarity determining region 3 for antibody 44591
QQRSDWPPWT

SEQ ID NO: 89182 - protein, 13 aa, Homo sapiens
  heavy chain complementarity determining region 3 for antibody 44591
ARAIAAAGNFPST

SEQ ID NO: 89183 - protein, 9 aa, Homo sapiens
  light chain complementarity determining region 3 for antibody 44592
QQRSDWPPT

SEQ ID NO: 89184 - protein, 18 aa, Homo sapiens
  heavy chain complementarity determining region 3 for antibody 44592
ARDHIYCADSKCYNLIDY

SEQ ID NO: 89185 - protein, 10 aa, Homo sapiens
  light chain complementarity determining region 3 for antibody 44593
QQRSDWPPIT

SEQ ID NO: 89186 - protein, 13 aa, Homo sapiens
  heavy chain complementarity determining region 3 for antibody 44593
ARDGSRGAGTSDY

SEQ ID NO: 89187 - protein, 11 aa, Homo sapiens
  light chain complementarity determining region 3 for antibody 44594
QQRSDWPPGAT

SEQ ID NO: 89188 - protein, 11 aa, Homo sapiens
  heavy chain complementarity determining region 3 for antibody 44594
ARGTSVWYFDL

SEQ ID NO: 89189 - protein, 10 aa, Homo sapiens
  light chain complementarity determining region 3 for antibody 44595
QQRNTWPPFT

SEQ ID NO: 89190 - protein, 21 aa, Homo sapiens
  heavy chain complementarity determining region 3 for antibody 44595
ARDLGLFYGSGSSYSYHGMDV

SEQ ID NO: 89191 - protein, 11 aa, Homo sapiens
  light chain complementarity determining region 3 for antibody 44596
QQRITWPPLFT

SEQ ID NO: 89192 - protein, 11 aa, Homo sapiens
  heavy chain complementarity determining region 3 for antibody 44596
ARLTSGWYFDI

SEQ ID NO: 89193 - protein, 9 aa, Homo sapiens
  light chain complementarity determining region 3 for antibody 44597
QQRIIWPLS

SEQ ID NO: 89194 - protein, 19 aa, Homo sapiens
  heavy chain complementarity determining region 3 for antibody 44597
ARDPRHTEMENYYYYGMDV

SEQ ID NO: 89195 - protein, 10 aa, Homo sapiens
  light chain complementarity determining region 3 for antibody 44598
QQLNSYPRLT

SEQ ID NO: 89196 - protein, 20 aa, Homo sapiens
  heavy chain complementarity determining region 3 for antibody 44598
ARLSPGDYDPRGYFYYGLDV

SEQ ID NO: 89197 - protein, 9 aa, Homo sapiens
  light chain complementarity determining region 3 for antibody 44599
QQLNSFPLT

SEQ ID NO: 89198 - protein, 19 aa, Homo sapiens
  heavy chain complementarity determining region 3 for antibody 44599
AKDLTLVRGVIFYYYGMDV

SEQ ID NO: 89199 - protein, 9 aa, Homo sapiens
  light chain complementarity determining region 3 for antibody 44600
QQLNRYPLT

SEQ ID NO: 89200 - protein, 16 aa, Homo sapiens
  heavy chain complementarity determining region 3 for antibody 44600
VRGWQVAIDISGYFDL

SEQ ID NO: 89201 - protein, 8 aa, Homo sapiens
  light chain complementarity determining region 3 for antibody 44601
QQLNPYPV

SEQ ID NO: 89202 - protein, 20 aa, Homo sapiens
  heavy chain complementarity determining region 3 for antibody 44601
ARRSHSVTYSIGGSEYYFDY

SEQ ID NO: 89203 - protein, 9 aa, Homo sapiens
  light chain complementarity determining region 3 for antibody 44602
QQLNNYPVT

SEQ ID NO: 89204 - protein, 12 aa, Homo sapiens
  heavy chain complementarity determining region 3 for antibody 44602
ARDGYGDSLLDS

SEQ ID NO: 89205 - protein, 10 aa, Homo sapiens
  light chain complementarity determining region 3 for antibody 44603
QQLNIYPPWT

SEQ ID NO: 89206 - protein, 19 aa, Homo sapiens
  heavy chain complementarity determining region 3 for antibody 44603
ARDVWPSYYYGSGRNAFDI

SEQ ID NO: 89207 - protein, 11 aa, Homo sapiens
  light chain complementarity determining region 3 for antibody 44604
QQLNGYPPMYT

SEQ ID NO: 89208 - protein, 19 aa, Homo sapiens
  heavy chain complementarity determining region 3 for antibody 44604
ARGFRTVVSATDGYNWFDP

SEQ ID NO: 89209 - protein, 9 aa, Homo sapiens
  light chain complementarity determining region 3 for antibody 44605
QQLLTYPNT

SEQ ID NO: 89210 - protein, 16 aa, Homo sapiens
  heavy chain complementarity determining region 3 for antibody 44605
GKEFYLVTGGSWGLDH

SEQ ID NO: 89211 - protein, 9 aa, Homo sapiens
  light chain complementarity determining region 3 for antibody 44606
QQLKNYPLS

SEQ ID NO: 89212 - protein, 11 aa, Homo sapiens
  heavy chain complementarity determining region 3 for antibody 44606
ARWGVLYGMDV

SEQ ID NO: 89213 - protein, 8 aa, Homo sapiens
  light chain complementarity determining region 3 for antibody 44607
QQLDSLIS

SEQ ID NO: 89214 - protein, 17 aa, Homo sapiens
  heavy chain complementarity determining region 3 for antibody 44607
AKVRTEYRYAQPYYFDY

SEQ ID NO: 89215 - protein, 10 aa, Homo sapiens
  light chain complementarity determining region 3 for antibody 44608
QQINSYQLYT

SEQ ID NO: 89216 - protein, 11 aa, Homo sapiens
  heavy chain complementarity determining region 3 for antibody 44608
AHLNYGVGFDY

SEQ ID NO: 89217 - protein, 11 aa, Homo sapiens
  light chain complementarity determining region 3 for antibody 44609
QQHYNWPPKWT

SEQ ID NO: 89218 - protein, 14 aa, Homo sapiens
  heavy chain complementarity determining region 3 for antibody 44609
ARPNDRLIYYGLDV

SEQ ID NO: 89219 - protein, 9 aa, Homo sapiens
  light chain complementarity determining region 3 for antibody 44610
QQHDTLLFT

SEQ ID NO: 89220 - protein, 17 aa, Homo sapiens
  heavy chain complementarity determining region 3 for antibody 44610
ARKVAWIRGAISSTFDI

SEQ ID NO: 89221 - protein, 9 aa, Homo sapiens
  light chain complementarity determining region 3 for antibody 44611
QQHATSQWT

SEQ ID NO: 89222 - protein, 6 aa, Homo sapiens
  heavy chain complementarity determining region 3 for antibody 44611
ASVRWG

SEQ ID NO: 89223 - protein, 9 aa, Homo sapiens
  light chain complementarity determining region 3 for antibody 44612
QQGYSTPWT

SEQ ID NO: 89224 - protein, 21 aa, Homo sapiens
  heavy chain complementarity determining region 3 for antibody 44612
ARVNWGGYDRDPRQPYKWFDL

SEQ ID NO: 89225 - protein, 9 aa, Homo sapiens
  light chain complementarity determining region 3 for antibody 44613
QQGYSTPLT

SEQ ID NO: 89226 - protein, 14 aa, Homo sapiens
  heavy chain complementarity determining region 3 for antibody 44613
ATESSGWYSGAVHL

SEQ ID NO: 89227 - protein, 9 aa, Homo sapiens
  light chain complementarity determining region 3 for antibody 44614
QQGYSLPWT

SEQ ID NO: 89228 - protein, 15 aa, Homo sapiens
  heavy chain complementarity determining region 3 for antibody 44614
TRFYGDGWSLNAFDI

SEQ ID NO: 89229 - protein, 9 aa, Homo sapiens
  light chain complementarity determining region 3 for antibody 44615
QQFNSYPRT

SEQ ID NO: 89230 - protein, 17 aa, Homo sapiens
  heavy chain complementarity determining region 3 for antibody 44615
ARDLVRFLDLRADAFDL

SEQ ID NO: 89231 - protein, 9 aa, Homo sapiens
  light chain complementarity determining region 3 for antibody 44616
QQFKTYPFT

SEQ ID NO: 89232 - protein, 14 aa, Homo sapiens
  heavy chain complementarity determining region 3 for antibody 44616
AKAKDSSGYHCLEY

SEQ ID NO: 89233 - protein, 9 aa, Homo sapiens
  light chain complementarity determining region 3 for antibody 44617
QQFHNYPLT

SEQ ID NO: 89234 - protein, 15 aa, Homo sapiens
  heavy chain complementarity determining region 3 for antibody 44617
ARKDFFGSGSYSFDY

SEQ ID NO: 89235 - protein, 9 aa, Homo sapiens
  light chain complementarity determining region 3 for antibody 44618
QQFGSSSFT

SEQ ID NO: 89236 - protein, 13 aa, Homo sapiens
  heavy chain complementarity determining region 3 for antibody 44618
AKVYFAELFPFDY

SEQ ID NO: 89237 - protein, 11 aa, Homo sapiens
  light chain complementarity determining region 3 for antibody 44619
QQFGSPQPPGT

SEQ ID NO: 89238 - protein, 11 aa, Homo sapiens
  heavy chain complementarity determining region 3 for antibody 44619
ARDANYGLFDY

SEQ ID NO: 89239 - protein, 9 aa, Homo sapiens
  light chain complementarity determining region 3 for antibody 44620
QQFDSFPYT

SEQ ID NO: 89240 - protein, 15 aa, Homo sapiens
  heavy chain complementarity determining region 3 for antibody 44620
ARETRYSTRGRAFDI

SEQ ID NO: 89241 - protein, 9 aa, Homo sapiens
  light chain complementarity determining region 3 for antibody 44621
QQDYDYPFT

SEQ ID NO: 89242 - protein, 23 aa, Homo sapiens
  heavy chain complementarity determining region 3 for antibody 44621
ARSPSTYSSGWYAKTYYYSGMDI

SEQ ID NO: 89243 - protein, 11 aa, Homo sapiens
  light chain complementarity determining region 3 for antibody 44622
QQCSNSPPMYT

SEQ ID NO: 89244 - protein, 14 aa, Homo sapiens
  heavy chain complementarity determining region 3 for antibody 44622
VKFLRQQLVNDIDY

SEQ ID NO: 89245 - protein, 9 aa, Homo sapiens
  light chain complementarity determining region 3 for antibody 44623
QQCNNWPLT

SEQ ID NO: 89246 - protein, 15 aa, Homo sapiens
  heavy chain complementarity determining region 3 for antibody 44623
ARVDYGDYVPGAFDI

SEQ ID NO: 89247 - protein, 9 aa, Homo sapiens
  light chain complementarity determining region 3 for antibody 44624
QQAYSFPYT

SEQ ID NO: 89248 - protein, 13 aa, Homo sapiens
  heavy chain complementarity determining region 3 for antibody 44624
ARAKGSGWLPPGH

SEQ ID NO: 89249 - protein, 9 aa, Homo sapiens
  light chain complementarity determining region 3 for antibody 44625
QQANSFPYT

SEQ ID NO: 89250 - protein, 17 aa, Homo sapiens
  heavy chain complementarity determining region 3 for antibody 44625
ARAAAGIVGAPAYYFDY

SEQ ID NO: 89251 - protein, 9 aa, Homo sapiens
  light chain complementarity determining region 3 for antibody 44626
QQANSFPRT

SEQ ID NO: 89252 - protein, 20 aa, Homo sapiens
  heavy chain complementarity determining region 3 for antibody 44626
ARVPRRKAPAGTGYYYGMDV

SEQ ID NO: 89253 - protein, 9 aa, Homo sapiens
  light chain complementarity determining region 3 for antibody 44627
QQANSFPLT

SEQ ID NO: 89254 - protein, 15 aa, Homo sapiens
  heavy chain complementarity determining region 3 for antibody 44627
ASLPGYSSARRSVDS

SEQ ID NO: 89255 - protein, 9 aa, Homo sapiens
  light chain complementarity determining region 3 for antibody 44628
QQANSFPLT

SEQ ID NO: 89256 - protein, 11 aa, Homo sapiens
  heavy chain complementarity determining region 3 for antibody 44628
AHRRVWMGVGY

SEQ ID NO: 89257 - protein, 9 aa, Homo sapiens
  light chain complementarity determining region 3 for antibody 44629
QQADSFPRT

SEQ ID NO: 89258 - protein, 14 aa, Homo sapiens
  heavy chain complementarity determining region 3 for antibody 44629
ARGRRYSYAYYFDY

SEQ ID NO: 89259 - protein, 9 aa, Homo sapiens
  light chain complementarity determining region 3 for antibody 44630
QNYNSGSWT

SEQ ID NO: 89260 - protein, 14 aa, Homo sapiens
  heavy chain complementarity determining region 3 for antibody 44630
ARPRTGHYSFFFDF

SEQ ID NO: 89261 - protein, 9 aa, Homo sapiens
  light chain complementarity determining region 3 for antibody 44631
QMYNSAPRT

SEQ ID NO: 89262 - protein, 14 aa, Homo sapiens
  heavy chain complementarity determining region 3 for antibody 44631
ARHVEVRISGSYSY

SEQ ID NO: 89263 - protein, 8 aa, Homo sapiens
  light chain complementarity determining region 3 for antibody 44632
QLYDNSFT

SEQ ID NO: 89264 - protein, 20 aa, Homo sapiens
  heavy chain complementarity determining region 3 for antibody 44632
ARDSTTDAYFGSGTRYAFDI

SEQ ID NO: 89265 - protein, 10 aa, Homo sapiens
  light chain complementarity determining region 3 for antibody 44633
QLLNSYPPYT

SEQ ID NO: 89266 - protein, 17 aa, Homo sapiens
  heavy chain complementarity determining region 3 for antibody 44633
ARQGLVTDQLLVRAGDS

SEQ ID NO: 89267 - protein, 9 aa, Homo sapiens
  light chain complementarity determining region 3 for antibody 44634
QKYNSVPWT

SEQ ID NO: 89268 - protein, 15 aa, Homo sapiens
  heavy chain complementarity determining region 3 for antibody 44634
ARMPDTSMTGSQFDS

SEQ ID NO: 89269 - protein, 9 aa, Homo sapiens
  light chain complementarity determining region 3 for antibody 44635
QKYNSGPLT

SEQ ID NO: 89270 - protein, 11 aa, Homo sapiens
  heavy chain complementarity determining region 3 for antibody 44635
VRRGVQDTFDL

SEQ ID NO: 89271 - protein, 9 aa, Homo sapiens
  light chain complementarity determining region 3 for antibody 44636
QKYNSAPYT

SEQ ID NO: 89272 - protein, 14 aa, Homo sapiens
  heavy chain complementarity determining region 3 for antibody 44636
ASLHNAYYNYGMDV

SEQ ID NO: 89273 - protein, 9 aa, Homo sapiens
  light chain complementarity determining region 3 for antibody 44637
QKYNSAPRT

SEQ ID NO: 89274 - protein, 13 aa, Homo sapiens
  heavy chain complementarity determining region 3 for antibody 44637
ARVNTILGASVDD

SEQ ID NO: 89275 - protein, 9 aa, Homo sapiens
  light chain complementarity determining region 3 for antibody 44638
QKYNSAPPT

SEQ ID NO: 89276 - protein, 20 aa, Homo sapiens
  heavy chain complementarity determining region 3 for antibody 44638
VRDGYSDNWFFLHRPNYFDN

SEQ ID NO: 89277 - protein, 10 aa, Homo sapiens
  light chain complementarity determining region 3 for antibody 44639
QKYNRAPLWT

SEQ ID NO: 89278 - protein, 13 aa, Homo sapiens
  heavy chain complementarity determining region 3 for antibody 44639
ASEIWDYGGNFDF

SEQ ID NO: 89279 - protein, 10 aa, Homo sapiens
  light chain complementarity determining region 3 for antibody 44640
QKYGSSPRWT

SEQ ID NO: 89280 - protein, 12 aa, Homo sapiens
  heavy chain complementarity determining region 3 for antibody 44640
TRDRFSDDFRDY

SEQ ID NO: 89281 - protein, 9 aa, Homo sapiens
  light chain complementarity determining region 3 for antibody 44641
QHYNSDPWT

SEQ ID NO: 89282 - protein, 20 aa, Homo sapiens
  heavy chain complementarity determining region 3 for antibody 44641
ARARSWARGSNYWAYYGMDV

SEQ ID NO: 89283 - protein, 9 aa, Homo sapiens
  light chain complementarity determining region 3 for antibody 44642
QHYLSYPYT

SEQ ID NO: 89284 - protein, 18 aa, Homo sapiens
  heavy chain complementarity determining region 3 for antibody 44642
ARGEYCSSPSCPNDAFDI

SEQ ID NO: 89285 - protein, 9 aa, Homo sapiens
  light chain complementarity determining region 3 for antibody 44643
QHYKTYPYT

SEQ ID NO: 89286 - protein, 18 aa, Homo sapiens
  heavy chain complementarity determining region 3 for antibody 44643
AKANWEFQVFAGAVWFEL

SEQ ID NO: 89287 - protein, 9 aa, Homo sapiens
  light chain complementarity determining region 3 for antibody 44644
QHYGSSPIT

SEQ ID NO: 89288 - protein, 15 aa, Homo sapiens
  heavy chain complementarity determining region 3 for antibody 44644
ASIVPTYYYDSSVLG

SEQ ID NO: 89289 - protein, 10 aa, Homo sapiens
  light chain complementarity determining region 3 for antibody 44645
QHYGDDSLFT

SEQ ID NO: 89290 - protein, 11 aa, Homo sapiens
  heavy chain complementarity determining region 3 for antibody 44645
TVEGKKGALNF

SEQ ID NO: 89291 - protein, 9 aa, Homo sapiens
  light chain complementarity determining region 3 for antibody 44646
QHYDTYSRT

SEQ ID NO: 89292 - protein, 21 aa, Homo sapiens
  heavy chain complementarity determining region 3 for antibody 44646
ARERAASGSWEEKNYYYGMDV

SEQ ID NO: 89293 - protein, 11 aa, Homo sapiens
  light chain complementarity determining region 3 for antibody 44647
QHYDNLLGGFT

SEQ ID NO: 89294 - protein, 16 aa, Homo sapiens
  heavy chain complementarity determining region 3 for antibody 44647
AKDRWKGGTYHNRPGY

SEQ ID NO: 89295 - protein, 9 aa, Homo sapiens
  light chain complementarity determining region 3 for antibody 44648
QHYDGLPLT

SEQ ID NO: 89296 - protein, 12 aa, Homo sapiens
  heavy chain complementarity determining region 3 for antibody 44648
ARYNWGVGSFDY

SEQ ID NO: 89297 - protein, 10 aa, Homo sapiens
  light chain complementarity determining region 3 for antibody 44649
QHRSHRPPYT

SEQ ID NO: 89298 - protein, 13 aa, Homo sapiens
  heavy chain complementarity determining region 3 for antibody 44649
ATSIFGVPTRRDY

SEQ ID NO: 89299 - protein, 11 aa, Homo sapiens
  light chain complementarity determining region 3 for antibody 44650
QHRSDWPPKFT

SEQ ID NO: 89300 - protein, 15 aa, Homo sapiens
  heavy chain complementarity determining region 3 for antibody 44650
AKALNYYGSGNYFGY

SEQ ID NO: 89301 - protein, 9 aa, Homo sapiens
  light chain complementarity determining region 3 for antibody 44651
QHLHGYPRT

SEQ ID NO: 89302 - protein, 14 aa, Homo sapiens
  heavy chain complementarity determining region 3 for antibody 44651
ARGMIGWYRGYFDY

SEQ ID NO: 89303 - protein, 9 aa, Homo sapiens
  light chain complementarity determining region 3 for antibody 44652
QEYNSAPQT

SEQ ID NO: 89304 - protein, 18 aa, Homo sapiens
  heavy chain complementarity determining region 3 for antibody 44652
ATDGVYCRAGNCFSEGLA

SEQ ID NO: 89305 - protein, 10 aa, Homo sapiens
  light chain complementarity determining region 3 for antibody 44653
QESYSTPGAT

SEQ ID NO: 89306 - protein, 13 aa, Homo sapiens
  heavy chain complementarity determining region 3 for antibody 44653
ARVATSDYFGMDV

SEQ ID NO: 89307 - protein, 9 aa, Homo sapiens
  light chain complementarity determining region 3 for antibody 44654
QELHIYPFT

SEQ ID NO: 89308 - protein, 14 aa, Homo sapiens
  heavy chain complementarity determining region 3 for antibody 44654
ARTTFLQGDDGFDI

SEQ ID NO: 89309 - protein, 9 aa, Homo sapiens
  light chain complementarity determining region 3 for antibody 44655
QEAFSTTPT

SEQ ID NO: 89310 - protein, 10 aa, Homo sapiens
  heavy chain complementarity determining region 3 for antibody 44655
ARRDTDALDV

SEQ ID NO: 89311 - protein, 10 aa, Homo sapiens
  light chain complementarity determining region 3 for antibody 44656
QDYSTYSGLT

SEQ ID NO: 89312 - protein, 11 aa, Homo sapiens
  heavy chain complementarity determining region 3 for antibody 44656
ARRRGVDVTDS

SEQ ID NO: 89313 - protein, 9 aa, Homo sapiens
  light chain complementarity determining region 3 for antibody 44657
QAYNNWPYT

SEQ ID NO: 89314 - protein, 16 aa, Homo sapiens
  heavy chain complementarity determining region 3 for antibody 44657
VKKLVEGDNWLCYFDF

SEQ ID NO: 89315 - protein, 9 aa, Homo sapiens
  light chain complementarity determining region 3 for antibody 44658
MQTVQTPWT

SEQ ID NO: 89316 - protein, 13 aa, Homo sapiens
  heavy chain complementarity determining region 3 for antibody 44658
AKGSRTRSVEMGY

SEQ ID NO: 89317 - protein, 9 aa, Homo sapiens
  light chain complementarity determining region 3 for antibody 44659
MQTVQTPGT

SEQ ID NO: 89318 - protein, 13 aa, Homo sapiens
  heavy chain complementarity determining region 3 for antibody 44659
ARGSRTRSVEMGY

SEQ ID NO: 89319 - protein, 9 aa, Homo sapiens
  light chain complementarity determining region 3 for antibody 44660
MQTTHWPPT

SEQ ID NO: 89320 - protein, 29 aa, Homo sapiens
  heavy chain complementarity determining region 3 for antibody 44660
AGGRRWRLGESTLTQCPTIGDCSHRAFDT

SEQ ID NO: 89321 - protein, 9 aa, Homo sapiens
  light chain complementarity determining region 3 for antibody 44661
MQTLQTPLT

SEQ ID NO: 89322 - protein, 16 aa, Homo sapiens
  heavy chain complementarity determining region 3 for antibody 44661
ARDMASITMIGRAFDI

SEQ ID NO: 89323 - protein, 9 aa, Homo sapiens
  light chain complementarity determining region 3 for antibody 44662
MQSLQTPLT

SEQ ID NO: 89324 - protein, 14 aa, Homo sapiens
  heavy chain complementarity determining region 3 for antibody 44662
VRDSSYYNSGIFDY

SEQ ID NO: 89325 - protein, 9 aa, Homo sapiens
  light chain complementarity determining region 3 for antibody 44663
MQSLQTPLT

SEQ ID NO: 89326 - protein, 12 aa, Homo sapiens
  heavy chain complementarity determining region 3 for antibody 44663
AREGSSRATEGH

SEQ ID NO: 89327 - protein, 9 aa, Homo sapiens
  light chain complementarity determining region 3 for antibody 44664
MQSLQTPFT

SEQ ID NO: 89328 - protein, 16 aa, Homo sapiens
  heavy chain complementarity determining region 3 for antibody 44664
ARTLRGSGNHFNPISY

SEQ ID NO: 89329 - protein, 9 aa, Homo sapiens
  light chain complementarity determining region 3 for antibody 44665
MQNTHWPWT

SEQ ID NO: 89330 - protein, 9 aa, Homo sapiens
  heavy chain complementarity determining region 3 for antibody 44665
ASYRGSGST

SEQ ID NO: 89331 - protein, 9 aa, Homo sapiens
  light chain complementarity determining region 3 for antibody 44666
MQGTHWPYT

SEQ ID NO: 89332 - protein, 25 aa, Homo sapiens
  heavy chain complementarity determining region 3 for antibody 44666
ARSDLVSVRSLWFGDQVDHYYNLDV

SEQ ID NO: 89333 - protein, 9 aa, Homo sapiens
  light chain complementarity determining region 3 for antibody 44667
MQGTHWPWT

SEQ ID NO: 89334 - protein, 19 aa, Homo sapiens
  heavy chain complementarity determining region 3 for antibody 44667
ARDTARYFDWSEEPNTLDI

SEQ ID NO: 89335 - protein, 9 aa, Homo sapiens
  light chain complementarity determining region 3 for antibody 44668
MQGTHWPWT

SEQ ID NO: 89336 - protein, 15 aa, Homo sapiens
  heavy chain complementarity determining region 3 for antibody 44668
ARAQVIWGQLYYFDS

SEQ ID NO: 89337 - protein, 9 aa, Homo sapiens
  light chain complementarity determining region 3 for antibody 44669
MQGTHWPVT

SEQ ID NO: 89338 - protein, 13 aa, Homo sapiens
  heavy chain complementarity determining region 3 for antibody 44669
ARSGPRLAATASY

SEQ ID NO: 89339 - protein, 9 aa, Homo sapiens
  light chain complementarity determining region 3 for antibody 44670
MQGTHWPIT

SEQ ID NO: 89340 - protein, 13 aa, Homo sapiens
  heavy chain complementarity determining region 3 for antibody 44670
ARLYLDVVATTDY

SEQ ID NO: 89341 - protein, 9 aa, Homo sapiens
  light chain complementarity determining region 3 for antibody 44671
MQGSHWFPS

SEQ ID NO: 89342 - protein, 14 aa, Homo sapiens
  heavy chain complementarity determining region 3 for antibody 44671
ARSPLKAGITDLQY

SEQ ID NO: 89343 - protein, 9 aa, Homo sapiens
  light chain complementarity determining region 3 for antibody 44672
MQGLQTPWT

SEQ ID NO: 89344 - protein, 13 aa, Homo sapiens
  heavy chain complementarity determining region 3 for antibody 44672
ARGISSLSSSWGF

SEQ ID NO: 89345 - protein, 9 aa, Homo sapiens
  light chain complementarity determining region 3 for antibody 44673
MQGLQTPWT

SEQ ID NO: 89346 - protein, 21 aa, Homo sapiens
  heavy chain complementarity determining region 3 for antibody 44673
AKDRRRILVAGTRNYYYGMDV

SEQ ID NO: 89347 - protein, 9 aa, Homo sapiens
  light chain complementarity determining region 3 for antibody 44674
MQGLQSPPT

SEQ ID NO: 89348 - protein, 22 aa, Homo sapiens
  heavy chain complementarity determining region 3 for antibody 44674
ARGRFKSFDYDSTGYYRKYFDK

SEQ ID NO: 89349 - protein, 9 aa, Homo sapiens
  light chain complementarity determining region 3 for antibody 44675
MQGLQLPPA

SEQ ID NO: 89350 - protein, 19 aa, Homo sapiens
  heavy chain complementarity determining region 3 for antibody 44675
ARSARPTVIITYYYYGMDL

SEQ ID NO: 89351 - protein, 8 aa, Homo sapiens
  light chain complementarity determining region 3 for antibody 44676
MQAQQAPT

SEQ ID NO: 89352 - protein, 11 aa, Homo sapiens
  heavy chain complementarity determining region 3 for antibody 44676
AHVISVAHFDY

SEQ ID NO: 89353 - protein, 9 aa, Homo sapiens
  light chain complementarity determining region 3 for antibody 44677
MQALQTSYT

SEQ ID NO: 89354 - protein, 20 aa, Homo sapiens
  heavy chain complementarity determining region 3 for antibody 44677
ADSLYDFWTENYNIYYGLDV

SEQ ID NO: 89355 - protein, 9 aa, Homo sapiens
  light chain complementarity determining region 3 for antibody 44678
MQALQTPYT

SEQ ID NO: 89356 - protein, 14 aa, Homo sapiens
  heavy chain complementarity determining region 3 for antibody 44678
ARDPYITATVRVDK

SEQ ID NO: 89357 - protein, 9 aa, Homo sapiens
  light chain complementarity determining region 3 for antibody 44679
MQALQTPWT

SEQ ID NO: 89358 - protein, 15 aa, Homo sapiens
  heavy chain complementarity determining region 3 for antibody 44679
ARYYYNTSGYYQLDY

SEQ ID NO: 89359 - protein, 9 aa, Homo sapiens
  light chain complementarity determining region 3 for antibody 44680
MQALQTPWT

SEQ ID NO: 89360 - protein, 19 aa, Homo sapiens
  heavy chain complementarity determining region 3 for antibody 44680
ARSPEAMFPPTVWYYGMDV

SEQ ID NO: 89361 - protein, 9 aa, Homo sapiens
  light chain complementarity determining region 3 for antibody 44681
MQALQTPRT

SEQ ID NO: 89362 - protein, 14 aa, Homo sapiens
  heavy chain complementarity determining region 3 for antibody 44681
ARVYGTSVSASGYY

SEQ ID NO: 89363 - protein, 9 aa, Homo sapiens
  light chain complementarity determining region 3 for antibody 44682
MQALQTPRT

SEQ ID NO: 89364 - protein, 14 aa, Homo sapiens
  heavy chain complementarity determining region 3 for antibody 44682
ARGRDTSGYSGLDF

SEQ ID NO: 89365 - protein, 9 aa, Homo sapiens
  light chain complementarity determining region 3 for antibody 44683
MQALQTPRT

SEQ ID NO: 89366 - protein, 16 aa, Homo sapiens
  heavy chain complementarity determining region 3 for antibody 44683
ARETYGSGHYYYGMDV

SEQ ID NO: 89367 - protein, 10 aa, Homo sapiens
  light chain complementarity determining region 3 for antibody 44684
MQALQTPLYT

SEQ ID NO: 89368 - protein, 12 aa, Homo sapiens
  heavy chain complementarity determining region 3 for antibody 44684
ARGSDYADYVDY

SEQ ID NO: 89369 - protein, 9 aa, Homo sapiens
  light chain complementarity determining region 3 for antibody 44685
MQALQTPLT

SEQ ID NO: 89370 - protein, 18 aa, Homo sapiens
  heavy chain complementarity determining region 3 for antibody 44685
ARGLYCIGTSCYSNWFDP

SEQ ID NO: 89371 - protein, 8 aa, Homo sapiens
  light chain complementarity determining region 3 for antibody 44686
MQALQTPL

SEQ ID NO: 89372 - protein, 25 aa, Homo sapiens
  heavy chain complementarity determining region 3 for antibody 44686
ARDTSLFCSDGTCNHFLYHYSGMDV

SEQ ID NO: 89373 - protein, 9 aa, Homo sapiens
  light chain complementarity determining region 3 for antibody 44687
MQALQTPHT

SEQ ID NO: 89374 - protein, 14 aa, Homo sapiens
  heavy chain complementarity determining region 3 for antibody 44687
ARDLGGGGTCYLDF

SEQ ID NO: 89375 - protein, 9 aa, Homo sapiens
  light chain complementarity determining region 3 for antibody 44688
MQALQTPFT

SEQ ID NO: 89376 - protein, 16 aa, Homo sapiens
  heavy chain complementarity determining region 3 for antibody 44688
ARLRAAGYSYGYGFDF

SEQ ID NO: 89377 - protein, 8 aa, Homo sapiens
  light chain complementarity determining region 3 for antibody 44689
MQALQTLT

SEQ ID NO: 89378 - protein, 10 aa, Homo sapiens
  heavy chain complementarity determining region 3 for antibody 44689
GKADWNYVSY

SEQ ID NO: 89379 - protein, 9 aa, Homo sapiens
  light chain complementarity determining region 3 for antibody 44690
MQALQTLFT

SEQ ID NO: 89380 - protein, 21 aa, Homo sapiens
  heavy chain complementarity determining region 3 for antibody 44690
ANEGSRVGGSTNRYYYSGVDV

SEQ ID NO: 89381 - protein, 9 aa, Homo sapiens
  light chain complementarity determining region 3 for antibody 44691
MQALQSPRT

SEQ ID NO: 89382 - protein, 13 aa, Homo sapiens
  heavy chain complementarity determining region 3 for antibody 44691
ASYCGGDCYSGHF

SEQ ID NO: 89383 - protein, 9 aa, Homo sapiens
  light chain complementarity determining region 3 for antibody 44692
MQALQSPPT

SEQ ID NO: 89384 - protein, 22 aa, Homo sapiens
  heavy chain complementarity determining region 3 for antibody 44692
ARGQIAAAGITRGQYFYYGMDV

SEQ ID NO: 89385 - protein, 9 aa, Homo sapiens
  light chain complementarity determining region 3 for antibody 44693
MQALQPPRT

SEQ ID NO: 89386 - protein, 11 aa, Homo sapiens
  heavy chain complementarity determining region 3 for antibody 44693
VREEAVAGSVY

SEQ ID NO: 89387 - protein, 9 aa, Homo sapiens
  light chain complementarity determining region 3 for antibody 44694
MQALKLPWT

SEQ ID NO: 89388 - protein, 13 aa, Homo sapiens
  heavy chain complementarity determining region 3 for antibody 44694
ARDHEGSGWEFDY

SEQ ID NO: 89389 - protein, 9 aa, Homo sapiens
  light chain complementarity determining region 3 for antibody 44695
MQALHSPRT

SEQ ID NO: 89390 - protein, 15 aa, Homo sapiens
  heavy chain complementarity determining region 3 for antibody 44695
AKDIHGDDGMRQFEN

SEQ ID NO: 89391 - protein, 9 aa, Homo sapiens
  light chain complementarity determining region 3 for antibody 44696
MQALETPWT

SEQ ID NO: 89392 - protein, 12 aa, Homo sapiens
  heavy chain complementarity determining region 3 for antibody 44696
ARESTRVTTLDY

SEQ ID NO: 89393 - protein, 9 aa, Homo sapiens
  light chain complementarity determining region 3 for antibody 44697
MQALERPYT

SEQ ID NO: 89394 - protein, 10 aa, Homo sapiens
  heavy chain complementarity determining region 3 for antibody 44697
TRVEVDPFDY

SEQ ID NO: 89395 - protein, 9 aa, Homo sapiens
  light chain complementarity determining region 3 for antibody 44698
MHALQTPGT

SEQ ID NO: 89396 - protein, 17 aa, Homo sapiens
  heavy chain complementarity determining region 3 for antibody 44698
VRVRDPMVRGTYDAFDL

SEQ ID NO: 89397 - protein, 9 aa, Homo sapiens
  light chain complementarity determining region 3 for antibody 44699
LQVKSHPFT

SEQ ID NO: 89398 - protein, 16 aa, Homo sapiens
  heavy chain complementarity determining region 3 for antibody 44699
AREGQLVRAYYYGMDV

SEQ ID NO: 89399 - protein, 9 aa, Homo sapiens
  light chain complementarity determining region 3 for antibody 44700
LQSYSTLYT

SEQ ID NO: 89400 - protein, 11 aa, Homo sapiens
  heavy chain complementarity determining region 3 for antibody 44700
ARSTGSGDLDY

SEQ ID NO: 89401 - protein, 9 aa, Homo sapiens
  light chain complementarity determining region 3 for antibody 44701
LQSTHWPYT

SEQ ID NO: 89402 - protein, 10 aa, Homo sapiens
  heavy chain complementarity determining region 3 for antibody 44701
GIYSSDGETY

SEQ ID NO: 89403 - protein, 9 aa, Homo sapiens
  light chain complementarity determining region 3 for antibody 44702
LQHNTYPPT

SEQ ID NO: 89404 - protein, 15 aa, Homo sapiens
  heavy chain complementarity determining region 3 for antibody 44702
AKVWRGNSLWYDSDY

SEQ ID NO: 89405 - protein, 9 aa, Homo sapiens
  light chain complementarity determining region 3 for antibody 44703
LQHNSYPYT

SEQ ID NO: 89406 - protein, 19 aa, Homo sapiens
  heavy chain complementarity determining region 3 for antibody 44703
ARAPPACRDGSCSITYFDS

SEQ ID NO: 89407 - protein, 9 aa, Homo sapiens
  light chain complementarity determining region 3 for antibody 44704
LQHNSYPWT

SEQ ID NO: 89408 - protein, 20 aa, Homo sapiens
  heavy chain complementarity determining region 3 for antibody 44704
AKLVFGGSGSYSFVMGAFDI

SEQ ID NO: 89409 - protein, 9 aa, Homo sapiens
  light chain complementarity determining region 3 for antibody 44705
LQHNSYPWM

SEQ ID NO: 89410 - protein, 14 aa, Homo sapiens
  heavy chain complementarity determining region 3 for antibody 44705
VKDPGWLVVDAFDF

SEQ ID NO: 89411 - protein, 9 aa, Homo sapiens
  light chain complementarity determining region 3 for antibody 44706
LQHNSYPRT

SEQ ID NO: 89412 - protein, 17 aa, Homo sapiens
  heavy chain complementarity determining region 3 for antibody 44706
ARPGIAAAAMSGYWFDP

SEQ ID NO: 89413 - protein, 9 aa, Homo sapiens
  light chain complementarity determining region 3 for antibody 44707
LQHNSYPLT

SEQ ID NO: 89414 - protein, 22 aa, Homo sapiens
  heavy chain complementarity determining region 3 for antibody 44707
AKDQASTVVVVSRPWEVSDLTF

SEQ ID NO: 89415 - protein, 9 aa, Homo sapiens
  light chain complementarity determining region 3 for antibody 44708
LQHNSYPFT

SEQ ID NO: 89416 - protein, 13 aa, Homo sapiens
  heavy chain complementarity determining region 3 for antibody 44708
TKGGYSYDFAYDR

SEQ ID NO: 89417 - protein, 9 aa, Homo sapiens
  light chain complementarity determining region 3 for antibody 44709
LQHNSYPFT

SEQ ID NO: 89418 - protein, 17 aa, Homo sapiens
  heavy chain complementarity determining region 3 for antibody 44709
ARRRCGGSSCYSGYFDL

SEQ ID NO: 89419 - protein, 9 aa, Homo sapiens
  light chain complementarity determining region 3 for antibody 44710
LQDYTYPYT

SEQ ID NO: 89420 - protein, 23 aa, Homo sapiens
  heavy chain complementarity determining region 3 for antibody 44710
ARDKYSSSWFSAGLGPIYFEFHY

SEQ ID NO: 89421 - protein, 9 aa, Homo sapiens
  light chain complementarity determining region 3 for antibody 44711
LQDYNYPYT

SEQ ID NO: 89422 - protein, 13 aa, Homo sapiens
  heavy chain complementarity determining region 3 for antibody 44711
ARSVRGSHTLIVY

SEQ ID NO: 89423 - protein, 9 aa, Homo sapiens
  light chain complementarity determining region 3 for antibody 44712
LKYNTAPYT

SEQ ID NO: 89424 - protein, 13 aa, Homo sapiens
  heavy chain complementarity determining region 3 for antibody 44712
ARLPYWELYYLDY

SEQ ID NO: 89425 - protein, 9 aa, Homo sapiens
  light chain complementarity determining region 3 for antibody 44713
KQTLQTPLT

SEQ ID NO: 89426 - protein, 15 aa, Homo sapiens
  heavy chain complementarity determining region 3 for antibody 44713
AKDVYSGYDFGGFDF

SEQ ID NO: 89427 - protein, 9 aa, Homo sapiens
  light chain complementarity determining region 3 for antibody 44714
HQYKSYPLT

SEQ ID NO: 89428 - protein, 15 aa, Homo sapiens
  heavy chain complementarity determining region 3 for antibody 44714
ATTVFVLGAPDRIDF

SEQ ID NO: 89429 - protein, 9 aa, Homo sapiens
  light chain complementarity determining region 3 for antibody 44715
HQYGSSPRP

SEQ ID NO: 89430 - protein, 13 aa, Homo sapiens
  heavy chain complementarity determining region 3 for antibody 44715
ATESGSYYGGLDY

SEQ ID NO: 89431 - protein, 9 aa, Homo sapiens
  light chain complementarity determining region 3 for antibody 44716
HQYGSSPKS

SEQ ID NO: 89432 - protein, 17 aa, Homo sapiens
  heavy chain complementarity determining region 3 for antibody 44716
ASGFRHRVTRRHGHIES

SEQ ID NO: 89433 - protein, 9 aa, Homo sapiens
  light chain complementarity determining region 3 for antibody 44717
HQYGSSPGT

SEQ ID NO: 89434 - protein, 18 aa, Homo sapiens
  heavy chain complementarity determining region 3 for antibody 44717
TRAAEYCSSTTCYTPFDY

SEQ ID NO: 89435 - protein, 9 aa, Homo sapiens
  light chain complementarity determining region 3 for antibody 44718
HQSYNSPYA

SEQ ID NO: 89436 - protein, 13 aa, Homo sapiens
  heavy chain complementarity determining region 3 for antibody 44718
ARSDYYPPDAFDV

SEQ ID NO: 89437 - protein, 9 aa, Homo sapiens
  light chain complementarity determining region 3 for antibody 44719
HQSSDLPWT

SEQ ID NO: 89438 - protein, 13 aa, Homo sapiens
  heavy chain complementarity determining region 3 for antibody 44719
ARLVAQTRVPFDS

SEQ ID NO: 89439 - protein, 9 aa, Homo sapiens
  light chain complementarity determining region 3 for antibody 44720
HQHKSYPLS

SEQ ID NO: 89440 - protein, 15 aa, Homo sapiens
  heavy chain complementarity determining region 3 for antibody 44720
ATVVFVFGAPDRIDF

SEQ ID NO: 89441 - protein, 9 aa, Homo sapiens
  light chain complementarity determining region 3 for antibody 44721
HHYNSFSGT

SEQ ID NO: 89442 - protein, 21 aa, Homo sapiens
  heavy chain complementarity determining region 3 for antibody 44721
ARGIIRTYTTGRYSGYDYFQY

SEQ ID NO: 89443 - protein, 9 aa, Homo sapiens
  light chain complementarity determining region 3 for antibody 44722
FQTLHTPRT

SEQ ID NO: 89444 - protein, 9 aa, Homo sapiens
  heavy chain complementarity determining region 3 for antibody 44722
ARAVPGLDY

SEQ ID NO: 89445 - protein, 8 aa, Homo sapiens
  light chain complementarity determining region 3 for antibody 44723
QYYDDLIT

SEQ ID NO: 89446 - protein, 8 aa, Homo sapiens
  heavy chain complementarity determining region 3 for antibody 44723
ARGASMDR

SEQ ID NO: 89447 - protein, 9 aa, Homo sapiens
  light chain complementarity determining region 3 for antibody 44724
QTYKNAPLT

SEQ ID NO: 89448 - protein, 15 aa, Homo sapiens
  heavy chain complementarity determining region 3 for antibody 44724
AGGRHLGFGESYFDP

SEQ ID NO: 89449 - protein, 8 aa, Homo sapiens
  light chain complementarity determining region 3 for antibody 44725
QSYDIVFT

SEQ ID NO: 89450 - protein, 15 aa, Homo sapiens
  heavy chain complementarity determining region 3 for antibody 44725
ARGLGGILRGYYFDS

SEQ ID NO: 89451 - protein, 9 aa, Homo sapiens
  light chain complementarity determining region 3 for antibody 44726
QRYNSYSET

SEQ ID NO: 89452 - protein, 17 aa, Homo sapiens
  heavy chain complementarity determining region 3 for antibody 44726
ATSDRPVYLSAPYFHAH

SEQ ID NO: 89453 - protein, 11 aa, Homo sapiens
  light chain complementarity determining region 3 for antibody 44727
QRYGSSLPMYT

SEQ ID NO: 89454 - protein, 16 aa, Homo sapiens
  heavy chain complementarity determining region 3 for antibody 44727
ARVGGTSGKNFRELDY

SEQ ID NO: 89455 - protein, 10 aa, Homo sapiens
  light chain complementarity determining region 3 for antibody 44728
QRYDTSPRLT

SEQ ID NO: 89456 - protein, 16 aa, Homo sapiens
  heavy chain complementarity determining region 3 for antibody 44728
ARDVHGSGTSGPAFDV

SEQ ID NO: 89457 - protein, 9 aa, Homo sapiens
  light chain complementarity determining region 3 for antibody 44729
QRYDNWPYT

SEQ ID NO: 89458 - protein, 15 aa, Homo sapiens
  heavy chain complementarity determining region 3 for antibody 44729
ARQPRDGHSLQWIDS

SEQ ID NO: 89459 - protein, 9 aa, Homo sapiens
  light chain complementarity determining region 3 for antibody 44730
QQYYTSPLT

SEQ ID NO: 89460 - protein, 16 aa, Homo sapiens
  heavy chain complementarity determining region 3 for antibody 44730
ARDAVPTFGDFNWFGP

SEQ ID NO: 89461 - protein, 9 aa, Homo sapiens
  light chain complementarity determining region 3 for antibody 44731
QQYYSYRRT

SEQ ID NO: 89462 - protein, 14 aa, Homo sapiens
  heavy chain complementarity determining region 3 for antibody 44731
ARHPGIPVIGTEDY

SEQ ID NO: 89463 - protein, 9 aa, Homo sapiens
  light chain complementarity determining region 3 for antibody 44732
QQYYSYPLT

SEQ ID NO: 89464 - protein, 17 aa, Homo sapiens
  heavy chain complementarity determining region 3 for antibody 44732
AREHFNKWLAFRHQLDY

SEQ ID NO: 89465 - protein, 9 aa, Homo sapiens
  light chain complementarity determining region 3 for antibody 44733
QQYYSYPLT

SEQ ID NO: 89466 - protein, 12 aa, Homo sapiens
  heavy chain complementarity determining region 3 for antibody 44733
ARDPGRWAFLND

SEQ ID NO: 89467 - protein, 9 aa, Homo sapiens
  light chain complementarity determining region 3 for antibody 44734
QQYYSTPWT

SEQ ID NO: 89468 - protein, 17 aa, Homo sapiens
  heavy chain complementarity determining region 3 for antibody 44734
AHTGKLQYHVYPPYFAH

SEQ ID NO: 89469 - protein, 9 aa, Homo sapiens
  light chain complementarity determining region 3 for antibody 44735
QQYYSTPLT

SEQ ID NO: 89470 - protein, 11 aa, Homo sapiens
  heavy chain complementarity determining region 3 for antibody 44735
ARGVGSYPFDS

SEQ ID NO: 89471 - protein, 9 aa, Homo sapiens
  light chain complementarity determining region 3 for antibody 44736
QQYYSSPYP

SEQ ID NO: 89472 - protein, 23 aa, Homo sapiens
  heavy chain complementarity determining region 3 for antibody 44736
ARGVTDCSGRNCYGGEVINAFDV

SEQ ID NO: 89473 - protein, 9 aa, Homo sapiens
  light chain complementarity determining region 3 for antibody 44737
QQYYGSPRT

SEQ ID NO: 89474 - protein, 18 aa, Homo sapiens
  heavy chain complementarity determining region 3 for antibody 44737
AREGWGSGLEGQAPGFDY

SEQ ID NO: 89475 - protein, 10 aa, Homo sapiens
  light chain complementarity determining region 3 for antibody 44738
QQYYDTPLLT

SEQ ID NO: 89476 - protein, 9 aa, Homo sapiens
  heavy chain complementarity determining region 3 for antibody 44738
ARRAGPFDV

SEQ ID NO: 89477 - protein, 9 aa, Homo sapiens
  light chain complementarity determining region 3 for antibody 44739
QQYVSSPWT

SEQ ID NO: 89478 - protein, 17 aa, Homo sapiens
  heavy chain complementarity determining region 3 for antibody 44739
ARVDHPFIAVAVGSGDY

SEQ ID NO: 89479 - protein, 11 aa, Homo sapiens
  light chain complementarity determining region 3 for antibody 44740
QQYVDSPPSYT

SEQ ID NO: 89480 - protein, 15 aa, Homo sapiens
  heavy chain complementarity determining region 3 for antibody 44740
ARHNDISTGCPSFWY

SEQ ID NO: 89481 - protein, 10 aa, Homo sapiens
  light chain complementarity determining region 3 for antibody 44741
QQYTNWPALT

SEQ ID NO: 89482 - protein, 13 aa, Homo sapiens
  heavy chain complementarity determining region 3 for antibody 44741
ARLGSNSFGFFDS

SEQ ID NO: 89483 - protein, 11 aa, Homo sapiens
  light chain complementarity determining region 3 for antibody 44742
QQYTGWPPAWT

SEQ ID NO: 89484 - protein, 14 aa, Homo sapiens
  heavy chain complementarity determining region 3 for antibody 44742
ARPQPGNFYHGMDV

SEQ ID NO: 89485 - protein, 9 aa, Homo sapiens
  light chain complementarity determining region 3 for antibody 44743
QQYSSHRAT

SEQ ID NO: 89486 - protein, 21 aa, Homo sapiens
  heavy chain complementarity determining region 3 for antibody 44743
AREKIWGHYVGETPGSPHFDY

SEQ ID NO: 89487 - protein, 9 aa, Homo sapiens
  light chain complementarity determining region 3 for antibody 44744
QQYSIYSHT

SEQ ID NO: 89488 - protein, 13 aa, Homo sapiens
  heavy chain complementarity determining region 3 for antibody 44744
ARGGGNSYGAFDV

SEQ ID NO: 89489 - protein, 9 aa, Homo sapiens
  light chain complementarity determining region 3 for antibody 44745
QQYSDSPYT

SEQ ID NO: 89490 - protein, 22 aa, Homo sapiens
  heavy chain complementarity determining region 3 for antibody 44745
ARARSVHVSVFGVNSGRDAFDI

SEQ ID NO: 89491 - protein, 8 aa, Homo sapiens
  light chain complementarity determining region 3 for antibody 44746
QQYSDNVT

SEQ ID NO: 89492 - protein, 13 aa, Homo sapiens
  heavy chain complementarity determining region 3 for antibody 44746
ARGDDDVDHSFDY

SEQ ID NO: 89493 - protein, 9 aa, Homo sapiens
  light chain complementarity determining region 3 for antibody 44747
QQYREYPYT

SEQ ID NO: 89494 - protein, 14 aa, Homo sapiens
  heavy chain complementarity determining region 3 for antibody 44747
ARHASSWARTPFDS

SEQ ID NO: 89495 - protein, 9 aa, Homo sapiens
  light chain complementarity determining region 3 for antibody 44748
QQYNTYSVT

SEQ ID NO: 89496 - protein, 15 aa, Homo sapiens
  heavy chain complementarity determining region 3 for antibody 44748
ARVSRAAGGHYYFDY

SEQ ID NO: 89497 - protein, 9 aa, Homo sapiens
  light chain complementarity determining region 3 for antibody 44749
QQYNTYSGT

SEQ ID NO: 89498 - protein, 16 aa, Homo sapiens
  heavy chain complementarity determining region 3 for antibody 44749
ARDVGADYGKVGWFDP

SEQ ID NO: 89499 - protein, 9 aa, Homo sapiens
  light chain complementarity determining region 3 for antibody 44750
QQYNTYPLT

SEQ ID NO: 89500 - protein, 15 aa, Homo sapiens
  heavy chain complementarity determining region 3 for antibody 44750
ARDYYDSGGYYSVDY

SEQ ID NO: 89501 - protein, 11 aa, Homo sapiens
  light chain complementarity determining region 3 for antibody 44751
QQYNTWPPGRT

SEQ ID NO: 89502 - protein, 15 aa, Homo sapiens
  heavy chain complementarity determining region 3 for antibody 44751
AKDQTVTAYATAFDL

SEQ ID NO: 89503 - protein, 9 aa, Homo sapiens
  light chain complementarity determining region 3 for antibody 44752
QQYNTFPWT

SEQ ID NO: 89504 - protein, 17 aa, Homo sapiens
  heavy chain complementarity determining region 3 for antibody 44752
ARDSRGDWNYRAGAFDI

SEQ ID NO: 89505 - protein, 9 aa, Homo sapiens
  light chain complementarity determining region 3 for antibody 44753
QQYNSYSYT

SEQ ID NO: 89506 - protein, 18 aa, Homo sapiens
  heavy chain complementarity determining region 3 for antibody 44753
ATHPRLTSLTMVLKAFDM

SEQ ID NO: 89507 - protein, 9 aa, Homo sapiens
  light chain complementarity determining region 3 for antibody 44754
QQYNSYSYT

SEQ ID NO: 89508 - protein, 12 aa, Homo sapiens
  heavy chain complementarity determining region 3 for antibody 44754
ARERGGSRSFED

SEQ ID NO: 89509 - protein, 9 aa, Homo sapiens
  light chain complementarity determining region 3 for antibody 44755
QQYNSYSRT

SEQ ID NO: 89510 - protein, 18 aa, Homo sapiens
  heavy chain complementarity determining region 3 for antibody 44755
VKDRVFTTFVIRDLEFDS

SEQ ID NO: 89511 - protein, 10 aa, Homo sapiens
  light chain complementarity determining region 3 for antibody 44756
QQYNSYSPYT

SEQ ID NO: 89512 - protein, 15 aa, Homo sapiens
  heavy chain complementarity determining region 3 for antibody 44756
AGHSGYNYYSDPFDM

SEQ ID NO: 89513 - protein, 9 aa, Homo sapiens
  light chain complementarity determining region 3 for antibody 44757
QQYNSYPYT

SEQ ID NO: 89514 - protein, 11 aa, Homo sapiens
  heavy chain complementarity determining region 3 for antibody 44757
TRYGSGKTLDY

SEQ ID NO: 89515 - protein, 9 aa, Homo sapiens
  light chain complementarity determining region 3 for antibody 44758
QQYNSYPYT

SEQ ID NO: 89516 - protein, 19 aa, Homo sapiens
  heavy chain complementarity determining region 3 for antibody 44758
ASGRRPPRNGGYPFSGLDV

SEQ ID NO: 89517 - protein, 9 aa, Homo sapiens
  light chain complementarity determining region 3 for antibody 44759
QQYNSYPYT

SEQ ID NO: 89518 - protein, 9 aa, Homo sapiens
  heavy chain complementarity determining region 3 for antibody 44759
ARDLGSSSH

SEQ ID NO: 89519 - protein, 9 aa, Homo sapiens
  light chain complementarity determining region 3 for antibody 44760
QQYNSYPWT

SEQ ID NO: 89520 - protein, 19 aa, Homo sapiens
  heavy chain complementarity determining region 3 for antibody 44760
ARRGDILPGYYNFRGGFDY

SEQ ID NO: 89521 - protein, 8 aa, Homo sapiens
  light chain complementarity determining region 3 for antibody 44761
QQYNSYPT

SEQ ID NO: 89522 - protein, 17 aa, Homo sapiens
  heavy chain complementarity determining region 3 for antibody 44761
ARVGTGTSQSRGGYFDL

SEQ ID NO: 89523 - protein, 9 aa, Homo sapiens
  light chain complementarity determining region 3 for antibody 44762
QQYNSYPIT

SEQ ID NO: 89524 - protein, 18 aa, Homo sapiens
  heavy chain complementarity determining region 3 for antibody 44762
TRDARARTAVTNGWYFDL

SEQ ID NO: 89525 - protein, 9 aa, Homo sapiens
  light chain complementarity determining region 3 for antibody 44763
QQYNSYMYT

SEQ ID NO: 89526 - protein, 12 aa, Homo sapiens
  heavy chain complementarity determining region 3 for antibody 44763
ATYRTVFGVIDY

SEQ ID NO: 89527 - protein, 10 aa, Homo sapiens
  light chain complementarity determining region 3 for antibody 44764
QQYNSNSIST

SEQ ID NO: 89528 - protein, 16 aa, Homo sapiens
  heavy chain complementarity determining region 3 for antibody 44764
AREGEGAYGEDEYFQH

SEQ ID NO: 89529 - protein, 9 aa, Homo sapiens
  light chain complementarity determining region 3 for antibody 44765
QQYNSFPYT

SEQ ID NO: 89530 - protein, 23 aa, Homo sapiens
  heavy chain complementarity determining region 3 for antibody 44765
ARVGYCDTTGCYNHDENGYGLGY

SEQ ID NO: 89531 - protein, 8 aa, Homo sapiens
  light chain complementarity determining region 3 for antibody 44766
QQYNSDWT

SEQ ID NO: 89532 - protein, 14 aa, Homo sapiens
  heavy chain complementarity determining region 3 for antibody 44766
ARDQDIRPPRTFDI

SEQ ID NO: 89533 - protein, 10 aa, Homo sapiens
  light chain complementarity determining region 3 for antibody 44767
QQYNNYPPIT

SEQ ID NO: 89534 - protein, 18 aa, Homo sapiens
  heavy chain complementarity determining region 3 for antibody 44767
AGQYYFDRSGYFLAPLDY

SEQ ID NO: 89535 - protein, 9 aa, Homo sapiens
  light chain complementarity determining region 3 for antibody 44768
QQYNNWPWT

SEQ ID NO: 89536 - protein, 13 aa, Homo sapiens
  heavy chain complementarity determining region 3 for antibody 44768
ASRNDGDYHLIDY

SEQ ID NO: 89537 - protein, 9 aa, Homo sapiens
  light chain complementarity determining region 3 for antibody 44769
QQYNNWPRT

SEQ ID NO: 89538 - protein, 12 aa, Homo sapiens
  heavy chain complementarity determining region 3 for antibody 44769
ARDSPNWGFGWY

SEQ ID NO: 89539 - protein, 10 aa, Homo sapiens
  light chain complementarity determining region 3 for antibody 44770
QQYNNWPPLT

SEQ ID NO: 89540 - protein, 14 aa, Homo sapiens
  heavy chain complementarity determining region 3 for antibody 44770
ARSRWAAPGTPPAY

SEQ ID NO: 89541 - protein, 10 aa, Homo sapiens
  light chain complementarity determining region 3 for antibody 44771
QQYNNWPPLT

SEQ ID NO: 89542 - protein, 18 aa, Homo sapiens
  heavy chain complementarity determining region 3 for antibody 44771
ARGRRYYGSGTYQAAFDY

SEQ ID NO: 89543 - protein, 10 aa, Homo sapiens
  light chain complementarity determining region 3 for antibody 44772
QQYNNWPPLT

SEQ ID NO: 89544 - protein, 20 aa, Homo sapiens
  heavy chain complementarity determining region 3 for antibody 44772
ARAEAVLWFGKLLYPGWLDP

SEQ ID NO: 89545 - protein, 10 aa, Homo sapiens
  light chain complementarity determining region 3 for antibody 44773
QQYNNWPPGT

SEQ ID NO: 89546 - protein, 13 aa, Homo sapiens
  heavy chain complementarity determining region 3 for antibody 44773
GRDLKYGGDYLET

SEQ ID NO: 89547 - protein, 11 aa, Homo sapiens
  light chain complementarity determining region 3 for antibody 44774
QQYNNWPPAHT

SEQ ID NO: 89548 - protein, 13 aa, Homo sapiens
  heavy chain complementarity determining region 3 for antibody 44774
VRGQLAAAGVFDF

SEQ ID NO: 89549 - protein, 9 aa, Homo sapiens
  light chain complementarity determining region 3 for antibody 44775
QQYNNWPPA

SEQ ID NO: 89550 - protein, 12 aa, Homo sapiens
  heavy chain complementarity determining region 3 for antibody 44775
ASAFFIDSYFDS

SEQ ID NO: 89551 - protein, 10 aa, Homo sapiens
  light chain complementarity determining region 3 for antibody 44776
QQYNNWPMYT

SEQ ID NO: 89552 - protein, 14 aa, Homo sapiens
  heavy chain complementarity determining region 3 for antibody 44776
ARAFRYGSGSPLDF

SEQ ID NO: 89553 - protein, 10 aa, Homo sapiens
  light chain complementarity determining region 3 for antibody 44777
QQYNNWPLYT

SEQ ID NO: 89554 - protein, 13 aa, Homo sapiens
  heavy chain complementarity determining region 3 for antibody 44777
ARAGFGSSSDFDY

SEQ ID NO: 89555 - protein, 9 aa, Homo sapiens
  light chain complementarity determining region 3 for antibody 44778
QQYNNWPLT

SEQ ID NO: 89556 - protein, 34 aa, Homo sapiens
  heavy chain complementarity determining region 3 for antibody 44778
TTGGFYETSDSIWGGYYDSSDSIGGEDSYYGMDV

SEQ ID NO: 89557 - protein, 9 aa, Homo sapiens
  light chain complementarity determining region 3 for antibody 44779
QQYNNWPFT

SEQ ID NO: 89558 - protein, 14 aa, Homo sapiens
  heavy chain complementarity determining region 3 for antibody 44779
ARDRGSSPDYAMDV

SEQ ID NO: 89559 - protein, 9 aa, Homo sapiens
  light chain complementarity determining region 3 for antibody 44780
QQYNNWLYT

SEQ ID NO: 89560 - protein, 12 aa, Homo sapiens
  heavy chain complementarity determining region 3 for antibody 44780
AKEVGYFSGYDF

SEQ ID NO: 89561 - protein, 9 aa, Homo sapiens
  light chain complementarity determining region 3 for antibody 44781
QQYNMSPRS

SEQ ID NO: 89562 - protein, 22 aa, Homo sapiens
  heavy chain complementarity determining region 3 for antibody 44781
VREWERLTLCDGAGCQRDAFDI

SEQ ID NO: 89563 - protein, 11 aa, Homo sapiens
  light chain complementarity determining region 3 for antibody 44782
QQYNMFPHMYT

SEQ ID NO: 89564 - protein, 12 aa, Homo sapiens
  heavy chain complementarity determining region 3 for antibody 44782
ATDRPLRGYFDQ

SEQ ID NO: 89565 - protein, 12 aa, Homo sapiens
  light chain complementarity determining region 3 for antibody 44783
QQYNKWPPAGST

SEQ ID NO: 89566 - protein, 18 aa, Homo sapiens
  heavy chain complementarity determining region 3 for antibody 44783
ASWAGSSGNDWGYAVFDY

SEQ ID NO: 89567 - protein, 9 aa, Homo sapiens
  light chain complementarity determining region 3 for antibody 44784
QQYNIYTWT

SEQ ID NO: 89568 - protein, 21 aa, Homo sapiens
  heavy chain complementarity determining region 3 for antibody 44784
ARGRRGTTGIPRGRRGDYFDS

SEQ ID NO: 89569 - protein, 9 aa, Homo sapiens
  light chain complementarity determining region 3 for antibody 44785
QQYNGYSRT

SEQ ID NO: 89570 - protein, 21 aa, Homo sapiens
  heavy chain complementarity determining region 3 for antibody 44785
ARGGGEESSGWYRTLRGYFDN

SEQ ID NO: 89571 - protein, 10 aa, Homo sapiens
  light chain complementarity determining region 3 for antibody 44786
QQYNGYDRIT

SEQ ID NO: 89572 - protein, 18 aa, Homo sapiens
  heavy chain complementarity determining region 3 for antibody 44786
ARASRGGSGTSYQYYFDY

SEQ ID NO: 89573 - protein, 11 aa, Homo sapiens
  light chain complementarity determining region 3 for antibody 44787
QQYNDWPPQYT

SEQ ID NO: 89574 - protein, 22 aa, Homo sapiens
  heavy chain complementarity determining region 3 for antibody 44787
ARGAGMYCSGASCQSYYYGLDV

SEQ ID NO: 89575 - protein, 8 aa, Homo sapiens
  light chain complementarity determining region 3 for antibody 44788
QQYNDRAT

SEQ ID NO: 89576 - protein, 15 aa, Homo sapiens
  heavy chain complementarity determining region 3 for antibody 44788
ARPPLGGSFYFGMDV

SEQ ID NO: 89577 - protein, 9 aa, Homo sapiens
  light chain complementarity determining region 3 for antibody 44789
QQYKTYSWT

SEQ ID NO: 89578 - protein, 12 aa, Homo sapiens
  heavy chain complementarity determining region 3 for antibody 44789
ATLPVGALGWQH

SEQ ID NO: 89579 - protein, 9 aa, Homo sapiens
  light chain complementarity determining region 3 for antibody 44790
QQYKTYSRT

SEQ ID NO: 89580 - protein, 18 aa, Homo sapiens
  heavy chain complementarity determining region 3 for antibody 44790
ARVYDTFTVYPDGRYFDL

SEQ ID NO: 89581 - protein, 8 aa, Homo sapiens
  light chain complementarity determining region 3 for antibody 44791
QQYKSYWK

SEQ ID NO: 89582 - protein, 19 aa, Homo sapiens
  heavy chain complementarity determining region 3 for antibody 44791
AREANCGTSDCYTYWHFDV

SEQ ID NO: 89583 - protein, 9 aa, Homo sapiens
  light chain complementarity determining region 3 for antibody 44792
QQYKSYPYT

SEQ ID NO: 89584 - protein, 16 aa, Homo sapiens
  heavy chain complementarity determining region 3 for antibody 44792
ARETGATLEGHDSFDL

SEQ ID NO: 89585 - protein, 9 aa, Homo sapiens
  light chain complementarity determining region 3 for antibody 44793
QQYKSFPIT

SEQ ID NO: 89586 - protein, 13 aa, Homo sapiens
  heavy chain complementarity determining region 3 for antibody 44793
ARQTANLQSGLEN

SEQ ID NO: 89587 - protein, 9 aa, Homo sapiens
  light chain complementarity determining region 3 for antibody 44794
QQYHSSPWT

SEQ ID NO: 89588 - protein, 18 aa, Homo sapiens
  heavy chain complementarity determining region 3 for antibody 44794
AKDREPFYGSGSHRLPDL

SEQ ID NO: 89589 - protein, 9 aa, Homo sapiens
  light chain complementarity determining region 3 for antibody 44795
QQYHNYPRT

SEQ ID NO: 89590 - protein, 9 aa, Homo sapiens
  heavy chain complementarity determining region 3 for antibody 44795
ARYGSELGY

SEQ ID NO: 89591 - protein, 9 aa, Homo sapiens
  light chain complementarity determining region 3 for antibody 44796
QQYHKYPFT

SEQ ID NO: 89592 - protein, 14 aa, Homo sapiens
  heavy chain complementarity determining region 3 for antibody 44796
ARFLTLVGGASFDS

SEQ ID NO: 89593 - protein, 8 aa, Homo sapiens
  light chain complementarity determining region 3 for antibody 44797
QQYGTSRN

SEQ ID NO: 89594 - protein, 21 aa, Homo sapiens
  heavy chain complementarity determining region 3 for antibody 44797
ARWKGQVHSDWDRDFYPPVDY

SEQ ID NO: 89595 - protein, 9 aa, Homo sapiens
  light chain complementarity determining region 3 for antibody 44798
QQYGTSPRT

SEQ ID NO: 89596 - protein, 15 aa, Homo sapiens
  heavy chain complementarity determining region 3 for antibody 44798
AQCSGGACQGGYFAS

SEQ ID NO: 89597 - protein, 10 aa, Homo sapiens
  light chain complementarity determining region 3 for antibody 44799
QQYGTSPPHT

SEQ ID NO: 89598 - protein, 16 aa, Homo sapiens
  heavy chain complementarity determining region 3 for antibody 44799
ARPSAPAWTEINALDI

SEQ ID NO: 89599 - protein, 9 aa, Homo sapiens
  light chain complementarity determining region 3 for antibody 44800
QQYGTSPGT

SEQ ID NO: 89600 - protein, 20 aa, Homo sapiens
  heavy chain complementarity determining region 3 for antibody 44800
ARGLHIVVLTSFPTGEYFHH

SEQ ID NO: 89601 - protein, 9 aa, Homo sapiens
  light chain complementarity determining region 3 for antibody 44801
QQYGTSLRT

SEQ ID NO: 89602 - protein, 21 aa, Homo sapiens
  heavy chain complementarity determining region 3 for antibody 44801
ARETGRRRDLLRHNYNYGLDV

SEQ ID NO: 89603 - protein, 9 aa, Homo sapiens
  light chain complementarity determining region 3 for antibody 44802
QQYGSTPLT

SEQ ID NO: 89604 - protein, 17 aa, Homo sapiens
  heavy chain complementarity determining region 3 for antibody 44802
ARDVSYPSRYHYWYFDL

SEQ ID NO: 89605 - protein, 9 aa, Homo sapiens
  light chain complementarity determining region 3 for antibody 44803
QQYGSSTIT

SEQ ID NO: 89606 - protein, 13 aa, Homo sapiens
  heavy chain complementarity determining region 3 for antibody 44803
ARVLQEQLAQLDH

SEQ ID NO: 89607 - protein, 9 aa, Homo sapiens
  light chain complementarity determining region 3 for antibody 44804
QQYGSSPYT

SEQ ID NO: 89608 - protein, 15 aa, Homo sapiens
  heavy chain complementarity determining region 3 for antibody 44804
ARRFGLTRNDWYFDH

SEQ ID NO: 89609 - protein, 9 aa, Homo sapiens
  light chain complementarity determining region 3 for antibody 44805
QQYGSSPYT

SEQ ID NO: 89610 - protein, 19 aa, Homo sapiens
  heavy chain complementarity determining region 3 for antibody 44805
ARAPRYCSGGSCSRGWFDP

SEQ ID NO: 89611 - protein, 9 aa, Homo sapiens
  light chain complementarity determining region 3 for antibody 44806
QQYGSSPWT

SEQ ID NO: 89612 - protein, 18 aa, Homo sapiens
  heavy chain complementarity determining region 3 for antibody 44806
ARTSADSSGYYFPYGMDV

SEQ ID NO: 89613 - protein, 9 aa, Homo sapiens
  light chain complementarity determining region 3 for antibody 44807
QQYGSSPWP

SEQ ID NO: 89614 - protein, 11 aa, Homo sapiens
  heavy chain complementarity determining region 3 for antibody 44807
ARDAQWGWLDP

SEQ ID NO: 89615 - protein, 9 aa, Homo sapiens
  light chain complementarity determining region 3 for antibody 44808
QQYGSSPRT

SEQ ID NO: 89616 - protein, 17 aa, Homo sapiens
  heavy chain complementarity determining region 3 for antibody 44808
ARMASSDSSGYFGYFDL

SEQ ID NO: 89617 - protein, 9 aa, Homo sapiens
  light chain complementarity determining region 3 for antibody 44809
QQYGSSPRT

SEQ ID NO: 89618 - protein, 19 aa, Homo sapiens
  heavy chain complementarity determining region 3 for antibody 44809
ARGNYDYVWNSVRPNWFDP

SEQ ID NO: 89619 - protein, 9 aa, Homo sapiens
  light chain complementarity determining region 3 for antibody 44810
QQYGSSPRT

SEQ ID NO: 89620 - protein, 14 aa, Homo sapiens
  heavy chain complementarity determining region 3 for antibody 44810
AKCGHSYGNDAFDI

SEQ ID NO: 89621 - protein, 10 aa, Homo sapiens
  light chain complementarity determining region 3 for antibody 44811
QQYGSSPRLT

SEQ ID NO: 89622 - protein, 17 aa, Homo sapiens
  heavy chain complementarity determining region 3 for antibody 44811
TRALRGYSTGWHGLFGY

SEQ ID NO: 89623 - protein, 9 aa, Homo sapiens
  light chain complementarity determining region 3 for antibody 44812
QQYGSSPPT

SEQ ID NO: 89624 - protein, 12 aa, Homo sapiens
  heavy chain complementarity determining region 3 for antibody 44812
ARNGYSSSWYRN

SEQ ID NO: 89625 - protein, 10 aa, Homo sapiens
  light chain complementarity determining region 3 for antibody 44813
QQYGSSPPIT

SEQ ID NO: 89626 - protein, 12 aa, Homo sapiens
  heavy chain complementarity determining region 3 for antibody 44813
ARTLLVGGSSGW

SEQ ID NO: 89627 - protein, 9 aa, Homo sapiens
  light chain complementarity determining region 3 for antibody 44814
QQYGSSPPA

SEQ ID NO: 89628 - protein, 16 aa, Homo sapiens
  heavy chain complementarity determining region 3 for antibody 44814
ARHVAGVGIKGDVFDI

SEQ ID NO: 89629 - protein, 9 aa, Homo sapiens
  light chain complementarity determining region 3 for antibody 44815
QQYGSSPNT

SEQ ID NO: 89630 - protein, 21 aa, Homo sapiens
  heavy chain complementarity determining region 3 for antibody 44815
ARRMQQQPVFNSGVASWVFAY

SEQ ID NO: 89631 - protein, 9 aa, Homo sapiens
  light chain complementarity determining region 3 for antibody 44816
QQYGSSPNT

SEQ ID NO: 89632 - protein, 11 aa, Homo sapiens
  heavy chain complementarity determining region 3 for antibody 44816
ARKPTSMATDY

SEQ ID NO: 89633 - protein, 10 aa, Homo sapiens
  light chain complementarity determining region 3 for antibody 44817
QQYGSSPMYT

SEQ ID NO: 89634 - protein, 18 aa, Homo sapiens
  heavy chain complementarity determining region 3 for antibody 44817
ARDSDLDYESDGEDYLDY

SEQ ID NO: 89635 - protein, 9 aa, Homo sapiens
  light chain complementarity determining region 3 for antibody 44818
QQYGSSPLT

SEQ ID NO: 89636 - protein, 16 aa, Homo sapiens
  heavy chain complementarity determining region 3 for antibody 44818
ARGSPLVRGVMSHFDL

SEQ ID NO: 89637 - protein, 9 aa, Homo sapiens
  light chain complementarity determining region 3 for antibody 44819
QQYGSSPLT

SEQ ID NO: 89638 - protein, 20 aa, Homo sapiens
  heavy chain complementarity determining region 3 for antibody 44819
AKDPGYCSGGTCSPWNWFDS

SEQ ID NO: 89639 - protein, 8 aa, Homo sapiens
  light chain complementarity determining region 3 for antibody 44820
QQYGSSLT

SEQ ID NO: 89640 - protein, 17 aa, Homo sapiens
  heavy chain complementarity determining region 3 for antibody 44820
ARDLRETDYAIGWYFDS

SEQ ID NO: 89641 - protein, 10 aa, Homo sapiens
  light chain complementarity determining region 3 for antibody 44821
QQYGSSLLWT

SEQ ID NO: 89642 - protein, 11 aa, Homo sapiens
  heavy chain complementarity determining region 3 for antibody 44821
VHRFGRNYFDP

SEQ ID NO: 89643 - protein, 9 aa, Homo sapiens
  light chain complementarity determining region 3 for antibody 44822
QQYGSAPWT

SEQ ID NO: 89644 - protein, 12 aa, Homo sapiens
  heavy chain complementarity determining region 3 for antibody 44822
ARGTNPYDAFDI

SEQ ID NO: 89645 - protein, 9 aa, Homo sapiens
  light chain complementarity determining region 3 for antibody 44823
QQYGSAPPT

SEQ ID NO: 89646 - protein, 21 aa, Homo sapiens
  heavy chain complementarity determining region 3 for antibody 44823
ASALRGFSTAYYSPHLDPFDV

SEQ ID NO: 89647 - protein, 9 aa, Homo sapiens
  light chain complementarity determining region 3 for antibody 44824
QQYGRPPRT

SEQ ID NO: 89648 - protein, 15 aa, Homo sapiens
  heavy chain complementarity determining region 3 for antibody 44824
AKDGEFCGSNCYFGS

SEQ ID NO: 89649 - protein, 9 aa, Homo sapiens
  light chain complementarity determining region 3 for antibody 44825
QQYGRAPRT

SEQ ID NO: 89650 - protein, 15 aa, Homo sapiens
  heavy chain complementarity determining region 3 for antibody 44825
AKDGEFCGSNCYFGS

SEQ ID NO: 89651 - protein, 9 aa, Homo sapiens
  light chain complementarity determining region 3 for antibody 44826
QQYGNSPRT

SEQ ID NO: 89652 - protein, 23 aa, Homo sapiens
  heavy chain complementarity determining region 3 for antibody 44826
ARGRKLSSITMIRAVTLNSPLEY

SEQ ID NO: 89653 - protein, 9 aa, Homo sapiens
  light chain complementarity determining region 3 for antibody 44827
QQYGISPYT

SEQ ID NO: 89654 - protein, 18 aa, Homo sapiens
  heavy chain complementarity determining region 3 for antibody 44827
AKDQGPTYDRYSSSYQTN

SEQ ID NO: 89655 - protein, 10 aa, Homo sapiens
  light chain complementarity determining region 3 for antibody 44828
QQYGGSPGYT

SEQ ID NO: 89656 - protein, 15 aa, Homo sapiens
  heavy chain complementarity determining region 3 for antibody 44828
ARLGWVRGDYGPIDY

SEQ ID NO: 89657 - protein, 6 aa, Homo sapiens
  light chain complementarity determining region 3 for antibody 44829
QQYGES

SEQ ID NO: 89658 - protein, 12 aa, Homo sapiens
  heavy chain complementarity determining region 3 for antibody 44829
ARDHDSGWSLSS

SEQ ID NO: 89659 - protein, 9 aa, Homo sapiens
  light chain complementarity determining region 3 for antibody 44830
QQYGASPLT

SEQ ID NO: 89660 - protein, 16 aa, Homo sapiens
  heavy chain complementarity determining region 3 for antibody 44830
ATTANGLAEPSPSPPA

SEQ ID NO: 89661 - protein, 9 aa, Homo sapiens
  light chain complementarity determining region 3 for antibody 44831
QQYESSVHT

SEQ ID NO: 89662 - protein, 13 aa, Homo sapiens
  heavy chain complementarity determining region 3 for antibody 44831
VRFDCSGDRCYWS

SEQ ID NO: 89663 - protein, 9 aa, Homo sapiens
  light chain complementarity determining region 3 for antibody 44832
QQYERIPLT

SEQ ID NO: 89664 - protein, 16 aa, Homo sapiens
  heavy chain complementarity determining region 3 for antibody 44832
ARGSAYSYGSRYFLDH

SEQ ID NO: 89665 - protein, 9 aa, Homo sapiens
  light chain complementarity determining region 3 for antibody 44833
QQYDTYPWT

SEQ ID NO: 89666 - protein, 14 aa, Homo sapiens
  heavy chain complementarity determining region 3 for antibody 44833
ARPRTGYYSFFFDF

SEQ ID NO: 89667 - protein, 10 aa, Homo sapiens
  light chain complementarity determining region 3 for antibody 44834
QQYDTVRRAT

SEQ ID NO: 89668 - protein, 14 aa, Homo sapiens
  heavy chain complementarity determining region 3 for antibody 44834
RGSDWYRGMYYFDH

SEQ ID NO: 89669 - protein, 8 aa, Homo sapiens
  light chain complementarity determining region 3 for antibody 44835
QQYDTLIT

SEQ ID NO: 89670 - protein, 14 aa, Homo sapiens
  heavy chain complementarity determining region 3 for antibody 44835
AGREDLYDSSAFYF

SEQ ID NO: 89671 - protein, 9 aa, Homo sapiens
  light chain complementarity determining region 3 for antibody 44836
QQYDSYPLT

SEQ ID NO: 89672 - protein, 12 aa, Homo sapiens
  heavy chain complementarity determining region 3 for antibody 44836
TGKQEGWWAFDN

SEQ ID NO: 89673 - protein, 9 aa, Homo sapiens
  light chain complementarity determining region 3 for antibody 44837
QQYDSYPLT

SEQ ID NO: 89674 - protein, 13 aa, Homo sapiens
  heavy chain complementarity determining region 3 for antibody 44837
ARGPDISGSRLDL

SEQ ID NO: 89675 - protein, 9 aa, Homo sapiens
  light chain complementarity determining region 3 for antibody 44838
QQYDSTPFT

SEQ ID NO: 89676 - protein, 17 aa, Homo sapiens
  heavy chain complementarity determining region 3 for antibody 44838
ARGWGYTYGFNPITFDS

SEQ ID NO: 89677 - protein, 9 aa, Homo sapiens
  light chain complementarity determining region 3 for antibody 44839
QQYDSSPIT

SEQ ID NO: 89678 - protein, 17 aa, Homo sapiens
  heavy chain complementarity determining region 3 for antibody 44839
VRVGGASGLYIAEYFQH

SEQ ID NO: 89679 - protein, 9 aa, Homo sapiens
  light chain complementarity determining region 3 for antibody 44840
QQYDRYSYT

SEQ ID NO: 89680 - protein, 17 aa, Homo sapiens
  heavy chain complementarity determining region 3 for antibody 44840
ARERGVGIYTGSHYFDY

SEQ ID NO: 89681 - protein, 9 aa, Homo sapiens
  light chain complementarity determining region 3 for antibody 44841
QQYDRSPRT

SEQ ID NO: 89682 - protein, 21 aa, Homo sapiens
  heavy chain complementarity determining region 3 for antibody 44841
CRESEYFDLLTTSWTVDGFDI

SEQ ID NO: 89683 - protein, 8 aa, Homo sapiens
  light chain complementarity determining region 3 for antibody 44842
QQYDRLPT

SEQ ID NO: 89684 - protein, 17 aa, Homo sapiens
  heavy chain complementarity determining region 3 for antibody 44842
AVPTLGEHDGLPAAFNI

SEQ ID NO: 89685 - protein, 8 aa, Homo sapiens
  light chain complementarity determining region 3 for antibody 44843
QQYDQWPT

SEQ ID NO: 89686 - protein, 12 aa, Homo sapiens
  heavy chain complementarity determining region 3 for antibody 44843
GRSLVGPTALDN

SEQ ID NO: 89687 - protein, 9 aa, Homo sapiens
  light chain complementarity determining region 3 for antibody 44844
QQYDNWPRT

SEQ ID NO: 89688 - protein, 20 aa, Homo sapiens
  heavy chain complementarity determining region 3 for antibody 44844
ARLPDFFDGGYHYINSHYDY

SEQ ID NO: 89689 - protein, 9 aa, Homo sapiens
  light chain complementarity determining region 3 for antibody 44845
QQYDNLSFT

SEQ ID NO: 89690 - protein, 17 aa, Homo sapiens
  heavy chain complementarity determining region 3 for antibody 44845
VKDRTARIFGVVSDLDS

SEQ ID NO: 89691 - protein, 10 aa, Homo sapiens
  light chain complementarity determining region 3 for antibody 44846
QQYDNLPLYT

SEQ ID NO: 89692 - protein, 16 aa, Homo sapiens
  heavy chain complementarity determining region 3 for antibody 44846
AREVADSNTWGWHFDL

SEQ ID NO: 89693 - protein, 9 aa, Homo sapiens
  light chain complementarity determining region 3 for antibody 44847
QQYDNIPLT

SEQ ID NO: 89694 - protein, 9 aa, Homo sapiens
  heavy chain complementarity determining region 3 for antibody 44847
ARDGNLGSY

SEQ ID NO: 89695 - protein, 9 aa, Homo sapiens
  light chain complementarity determining region 3 for antibody 44848
QQYDHVPLT

SEQ ID NO: 89696 - protein, 15 aa, Homo sapiens
  heavy chain complementarity determining region 3 for antibody 44848
AKPKTIVVTKSAFHI

SEQ ID NO: 89697 - protein, 9 aa, Homo sapiens
  light chain complementarity determining region 3 for antibody 44849
QQYDGFPWT

SEQ ID NO: 89698 - protein, 13 aa, Homo sapiens
  heavy chain complementarity determining region 3 for antibody 44849
ARIFYDDTAFRDY

SEQ ID NO: 89699 - protein, 8 aa, Homo sapiens
  light chain complementarity determining region 3 for antibody 44850
QQYDGFPS

SEQ ID NO: 89700 - protein, 15 aa, Homo sapiens
  heavy chain complementarity determining region 3 for antibody 44850
AKRGDSGKYPGYFDL

SEQ ID NO: 89701 - protein, 9 aa, Homo sapiens
  light chain complementarity determining region 3 for antibody 44851
QQYDELHLT

SEQ ID NO: 89702 - protein, 11 aa, Homo sapiens
  heavy chain complementarity determining region 3 for antibody 44851
MREQYGGHFDH

SEQ ID NO: 89703 - protein, 8 aa, Homo sapiens
  light chain complementarity determining region 3 for antibody 44852
QQYATSPT

SEQ ID NO: 89704 - protein, 16 aa, Homo sapiens
  heavy chain complementarity determining region 3 for antibody 44852
ARVGDSSSWYSGYFDY

SEQ ID NO: 89705 - protein, 10 aa, Homo sapiens
  light chain complementarity determining region 3 for antibody 44853
QQYANWPPLT

SEQ ID NO: 89706 - protein, 17 aa, Homo sapiens
  heavy chain complementarity determining region 3 for antibody 44853
ARDALFALVRGGRYFDL

SEQ ID NO: 89707 - protein, 9 aa, Homo sapiens
  light chain complementarity determining region 3 for antibody 44854
QQYAGSTET

SEQ ID NO: 89708 - protein, 15 aa, Homo sapiens
  heavy chain complementarity determining region 3 for antibody 44854
AKYGDILTGHYHFDY

SEQ ID NO: 89709 - protein, 9 aa, Homo sapiens
  light chain complementarity determining region 3 for antibody 44855
QQVNTYPPS

SEQ ID NO: 89710 - protein, 15 aa, Homo sapiens
  heavy chain complementarity determining region 3 for antibody 44855
ARGRYDSGGWGYFQL

SEQ ID NO: 89711 - protein, 9 aa, Homo sapiens
  light chain complementarity determining region 3 for antibody 44856
QQVNSFPPT

SEQ ID NO: 89712 - protein, 17 aa, Homo sapiens
  heavy chain complementarity determining region 3 for antibody 44856
GRHDPSGTTGWDAPFDH

SEQ ID NO: 89713 - protein, 9 aa, Homo sapiens
  light chain complementarity determining region 3 for antibody 44857
QQTYSTPYT

SEQ ID NO: 89714 - protein, 16 aa, Homo sapiens
  heavy chain complementarity determining region 3 for antibody 44857
ARDVYQRLMPGGWFDP

SEQ ID NO: 89715 - protein, 9 aa, Homo sapiens
  light chain complementarity determining region 3 for antibody 44858
QQTYSTPWT

SEQ ID NO: 89716 - protein, 19 aa, Homo sapiens
  heavy chain complementarity determining region 3 for antibody 44858
ARAPMEYCDSVKCLDAFDI

SEQ ID NO: 89717 - protein, 9 aa, Homo sapiens
  light chain complementarity determining region 3 for antibody 44859
QQTYSTPQA

SEQ ID NO: 89718 - protein, 15 aa, Homo sapiens
  heavy chain complementarity determining region 3 for antibody 44859
ATPDALTKDYYGLDV

SEQ ID NO: 89719 - protein, 10 aa, Homo sapiens
  light chain complementarity determining region 3 for antibody 44860
QQTYSTPMST

SEQ ID NO: 89720 - protein, 14 aa, Homo sapiens
  heavy chain complementarity determining region 3 for antibody 44860
ARRYYDSSGYPLDY

SEQ ID NO: 89721 - protein, 9 aa, Homo sapiens
  light chain complementarity determining region 3 for antibody 44861
QQTYSSPYT

SEQ ID NO: 89722 - protein, 15 aa, Homo sapiens
  heavy chain complementarity determining region 3 for antibody 44861
ARFYYGSSGYTGMDV

SEQ ID NO: 89723 - protein, 9 aa, Homo sapiens
  light chain complementarity determining region 3 for antibody 44862
QQTYNAPRT

SEQ ID NO: 89724 - protein, 12 aa, Homo sapiens
  heavy chain complementarity determining region 3 for antibody 44862
ARGRSFQYHLDY

SEQ ID NO: 89725 - protein, 9 aa, Homo sapiens
  light chain complementarity determining region 3 for antibody 44863
QQTYITPYT

SEQ ID NO: 89726 - protein, 14 aa, Homo sapiens
  heavy chain complementarity determining region 3 for antibody 44863
AKDRVLWFGEGMDV

SEQ ID NO: 89727 - protein, 9 aa, Homo sapiens
  light chain complementarity determining region 3 for antibody 44864
QQTSSTPYT

SEQ ID NO: 89728 - protein, 23 aa, Homo sapiens
  heavy chain complementarity determining region 3 for antibody 44864
ARLALLTGYESSGYVGGINWFDP

SEQ ID NO: 89729 - protein, 9 aa, Homo sapiens
  light chain complementarity determining region 3 for antibody 44865
QQTNRFPHT

SEQ ID NO: 89730 - protein, 14 aa, Homo sapiens
  heavy chain complementarity determining region 3 for antibody 44865
GRVMGLGAPGPLDY

SEQ ID NO: 89731 - protein, 9 aa, Homo sapiens
  light chain complementarity determining region 3 for antibody 44866
QQTKTFPLT

SEQ ID NO: 89732 - protein, 14 aa, Homo sapiens
  heavy chain complementarity determining region 3 for antibody 44866
ARGLGLYSADGLDV

SEQ ID NO: 89733 - protein, 9 aa, Homo sapiens
  light chain complementarity determining region 3 for antibody 44867
QQTDYWPRT

SEQ ID NO: 89734 - protein, 15 aa, Homo sapiens
  heavy chain complementarity determining region 3 for antibody 44867
ARDGRNTTNYNWSDL

SEQ ID NO: 89735 - protein, 9 aa, Homo sapiens
  light chain complementarity determining region 3 for antibody 44868
QQSYYAPWT

SEQ ID NO: 89736 - protein, 15 aa, Homo sapiens
  heavy chain complementarity determining region 3 for antibody 44868
ARGYLSKWGSEYFQY

SEQ ID NO: 89737 - protein, 9 aa, Homo sapiens
  light chain complementarity determining region 3 for antibody 44869
QQSYTTPYT

SEQ ID NO: 89738 - protein, 13 aa, Homo sapiens
  heavy chain complementarity determining region 3 for antibody 44869
ARDLLWSLNWFDP

SEQ ID NO: 89739 - protein, 9 aa, Homo sapiens
  light chain complementarity determining region 3 for antibody 44870
QQSYTPPNT

SEQ ID NO: 89740 - protein, 15 aa, Homo sapiens
  heavy chain complementarity determining region 3 for antibody 44870
ARAQVIWGQLYYFDS

SEQ ID NO: 89741 - protein, 8 aa, Homo sapiens
  light chain complementarity determining region 3 for antibody 44871
QQSYSTYT

SEQ ID NO: 89742 - protein, 15 aa, Homo sapiens
  heavy chain complementarity determining region 3 for antibody 44871
ARTTGHPLETAYFDS

SEQ ID NO: 89743 - protein, 10 aa, Homo sapiens
  light chain complementarity determining region 3 for antibody 44872
QQSYSTSLLT

SEQ ID NO: 89744 - protein, 10 aa, Homo sapiens
  heavy chain complementarity determining region 3 for antibody 44872
ALANGGWENY

SEQ ID NO: 89745 - protein, 9 aa, Homo sapiens
  light chain complementarity determining region 3 for antibody 44873
QQSYSTPYT

SEQ ID NO: 89746 - protein, 19 aa, Homo sapiens
  heavy chain complementarity determining region 3 for antibody 44873
ARVAYAYHDSSGYYYVFDI

SEQ ID NO: 89747 - protein, 9 aa, Homo sapiens
  light chain complementarity determining region 3 for antibody 44874
QQSYSTPYT

SEQ ID NO: 89748 - protein, 16 aa, Homo sapiens
  heavy chain complementarity determining region 3 for antibody 44874
ARPLTRYSNRAWTSDI

SEQ ID NO: 89749 - protein, 9 aa, Homo sapiens
  light chain complementarity determining region 3 for antibody 44875
QQSYSTPYT

SEQ ID NO: 89750 - protein, 23 aa, Homo sapiens
  heavy chain complementarity determining region 3 for antibody 44875
AKDLISSRLIGGSGRLRGGYFDD

SEQ ID NO: 89751 - protein, 9 aa, Homo sapiens
  light chain complementarity determining region 3 for antibody 44876
QQSYSTPWT

SEQ ID NO: 89752 - protein, 15 aa, Homo sapiens
  heavy chain complementarity determining region 3 for antibody 44876
AREGAGYKYAYYFDY

SEQ ID NO: 89753 - protein, 9 aa, Homo sapiens
  light chain complementarity determining region 3 for antibody 44877
QQSYSTPWT

SEQ ID NO: 89754 - protein, 12 aa, Homo sapiens
  heavy chain complementarity determining region 3 for antibody 44877
ARAGLFRSWLDP

SEQ ID NO: 89755 - protein, 9 aa, Homo sapiens
  light chain complementarity determining region 3 for antibody 44878
QQSYSTPRT

SEQ ID NO: 89756 - protein, 13 aa, Homo sapiens
  heavy chain complementarity determining region 3 for antibody 44878
ARNGDLVNIGFDY

SEQ ID NO: 89757 - protein, 9 aa, Homo sapiens
  light chain complementarity determining region 3 for antibody 44879
QQSYSTPRT

SEQ ID NO: 89758 - protein, 17 aa, Homo sapiens
  heavy chain complementarity determining region 3 for antibody 44879
AKDIFFGIAVAGTAFDI

SEQ ID NO: 89759 - protein, 9 aa, Homo sapiens
  light chain complementarity determining region 3 for antibody 44880
QQSYSTPQT

SEQ ID NO: 89760 - protein, 14 aa, Homo sapiens
  heavy chain complementarity determining region 3 for antibody 44880
ARTYRRTSGYDLDY

SEQ ID NO: 89761 - protein, 9 aa, Homo sapiens
  light chain complementarity determining region 3 for antibody 44881
QQSYSTPPT

SEQ ID NO: 89762 - protein, 17 aa, Homo sapiens
  heavy chain complementarity determining region 3 for antibody 44881
VRGPGGSRYTYANPWVY

SEQ ID NO: 89763 - protein, 9 aa, Homo sapiens
  light chain complementarity determining region 3 for antibody 44882
QQSYSTPPT

SEQ ID NO: 89764 - protein, 12 aa, Homo sapiens
  heavy chain complementarity determining region 3 for antibody 44882
ARSYSSSSWFDP

SEQ ID NO: 89765 - protein, 9 aa, Homo sapiens
  light chain complementarity determining region 3 for antibody 44883
QQSYSTPPT

SEQ ID NO: 89766 - protein, 11 aa, Homo sapiens
  heavy chain complementarity determining region 3 for antibody 44883
ARDEAEQQMKD

SEQ ID NO: 89767 - protein, 10 aa, Homo sapiens
  light chain complementarity determining region 3 for antibody 44884
QQSYSTPPFP

SEQ ID NO: 89768 - protein, 17 aa, Homo sapiens
  heavy chain complementarity determining region 3 for antibody 44884
ARGSPISEVLTGNRFDA

SEQ ID NO: 89769 - protein, 10 aa, Homo sapiens
  light chain complementarity determining region 3 for antibody 44885
QQSYSTPMYT

SEQ ID NO: 89770 - protein, 18 aa, Homo sapiens
  heavy chain complementarity determining region 3 for antibody 44885
ARESITAAGTLGSYAFDI

SEQ ID NO: 89771 - protein, 9 aa, Homo sapiens
  light chain complementarity determining region 3 for antibody 44886
QQSYSTPGT

SEQ ID NO: 89772 - protein, 18 aa, Homo sapiens
  heavy chain complementarity determining region 3 for antibody 44886
ARVENPKLPGLDGRPVEN

SEQ ID NO: 89773 - protein, 9 aa, Homo sapiens
  light chain complementarity determining region 3 for antibody 44887
QQSYSTPFT

SEQ ID NO: 89774 - protein, 15 aa, Homo sapiens
  heavy chain complementarity determining region 3 for antibody 44887
AADLAPTDIYNWFAP

SEQ ID NO: 89775 - protein, 9 aa, Homo sapiens
  light chain complementarity determining region 3 for antibody 44888
QQSYSTLWT

SEQ ID NO: 89776 - protein, 12 aa, Homo sapiens
  heavy chain complementarity determining region 3 for antibody 44888
ARDLSRSTENDY

SEQ ID NO: 89777 - protein, 8 aa, Homo sapiens
  light chain complementarity determining region 3 for antibody 44889
QQSYSTLT

SEQ ID NO: 89778 - protein, 17 aa, Homo sapiens
  heavy chain complementarity determining region 3 for antibody 44889
ARASDVDTGVALYFYDS

SEQ ID NO: 89779 - protein, 9 aa, Homo sapiens
  light chain complementarity determining region 3 for antibody 44890
QQSYSTLPT

SEQ ID NO: 89780 - protein, 15 aa, Homo sapiens
  heavy chain complementarity determining region 3 for antibody 44890
ARKIAPDGGPHYFDS

SEQ ID NO: 89781 - protein, 10 aa, Homo sapiens
  light chain complementarity determining region 3 for antibody 44891
QQSYSTFLYT

SEQ ID NO: 89782 - protein, 11 aa, Homo sapiens
  heavy chain complementarity determining region 3 for antibody 44891
AKDNNFWTIDY

SEQ ID NO: 89783 - protein, 9 aa, Homo sapiens
  light chain complementarity determining region 3 for antibody 44892
QQSYSPPYT

SEQ ID NO: 89784 - protein, 16 aa, Homo sapiens
  heavy chain complementarity determining region 3 for antibody 44892
ARDGSVDRPRGNWFDP

SEQ ID NO: 89785 - protein, 9 aa, Homo sapiens
  light chain complementarity determining region 3 for antibody 44893
QQSYSPPIT

SEQ ID NO: 89786 - protein, 11 aa, Homo sapiens
  heavy chain complementarity determining region 3 for antibody 44893
ARGVGSYVFES

SEQ ID NO: 89787 - protein, 10 aa, Homo sapiens
  light chain complementarity determining region 3 for antibody 44894
QQSYSPLRFT

SEQ ID NO: 89788 - protein, 17 aa, Homo sapiens
  heavy chain complementarity determining region 3 for antibody 44894
AKDLIWNGDGYFYGMDV

SEQ ID NO: 89789 - protein, 9 aa, Homo sapiens
  light chain complementarity determining region 3 for antibody 44895
QQSYSLPLT

SEQ ID NO: 89790 - protein, 16 aa, Homo sapiens
  heavy chain complementarity determining region 3 for antibody 44895
ARGVDDYSNYLNAFDI

SEQ ID NO: 89791 - protein, 9 aa, Homo sapiens
  light chain complementarity determining region 3 for antibody 44896
QQSYSIPRT

SEQ ID NO: 89792 - protein, 12 aa, Homo sapiens
  heavy chain complementarity determining region 3 for antibody 44896
ARNGAGSYGMDV

SEQ ID NO: 89793 - protein, 9 aa, Homo sapiens
  light chain complementarity determining region 3 for antibody 44897
QQSYSAPYT

SEQ ID NO: 89794 - protein, 16 aa, Homo sapiens
  heavy chain complementarity determining region 3 for antibody 44897
AREGHYGSGSHDAFDI

SEQ ID NO: 89795 - protein, 9 aa, Homo sapiens
  light chain complementarity determining region 3 for antibody 44898
QQSYRTPYT

SEQ ID NO: 89796 - protein, 13 aa, Homo sapiens
  heavy chain complementarity determining region 3 for antibody 44898
ARDWGLPPSPVVY

SEQ ID NO: 89797 - protein, 9 aa, Homo sapiens
  light chain complementarity determining region 3 for antibody 44899
QQSYRTPFT

SEQ ID NO: 89798 - protein, 17 aa, Homo sapiens
  heavy chain complementarity determining region 3 for antibody 44899
AREKYYYDSRGYYPFDY

SEQ ID NO: 89799 - protein, 9 aa, Homo sapiens
  light chain complementarity determining region 3 for antibody 44900
QQSYRSPIT

SEQ ID NO: 89800 - protein, 12 aa, Homo sapiens
  heavy chain complementarity determining region 3 for antibody 44900
ARLRWQQSEFDN

SEQ ID NO: 89801 - protein, 9 aa, Homo sapiens
  light chain complementarity determining region 3 for antibody 44901
QQSYNTPWT

SEQ ID NO: 89802 - protein, 12 aa, Homo sapiens
  heavy chain complementarity determining region 3 for antibody 44901
GRERFGVFAIAY

SEQ ID NO: 89803 - protein, 9 aa, Homo sapiens
  light chain complementarity determining region 3 for antibody 44902
QQSYNTPLT

SEQ ID NO: 89804 - protein, 21 aa, Homo sapiens
  heavy chain complementarity determining region 3 for antibody 44902
ARGPGGEAPAGSESYYYPMDV

SEQ ID NO: 89805 - protein, 9 aa, Homo sapiens
  light chain complementarity determining region 3 for antibody 44903
QQSYNNSPT

SEQ ID NO: 89806 - protein, 23 aa, Homo sapiens
  heavy chain complementarity determining region 3 for antibody 44903
ARGLHCSTTSCLSQFYKYYGMDV

SEQ ID NO: 89807 - protein, 9 aa, Homo sapiens
  light chain complementarity determining region 3 for antibody 44904
QQSYNNSPT

SEQ ID NO: 89808 - protein, 21 aa, Homo sapiens
  heavy chain complementarity determining region 3 for antibody 44904
AKRTDHHFHRTVYQYRSVFDM

SEQ ID NO: 89809 - protein, 8 aa, Homo sapiens
  light chain complementarity determining region 3 for antibody 44905
QQSYNLFS

SEQ ID NO: 89810 - protein, 16 aa, Homo sapiens
  heavy chain complementarity determining region 3 for antibody 44905
ARGGRGSGGYYYGMDV

SEQ ID NO: 89811 - protein, 9 aa, Homo sapiens
  light chain complementarity determining region 3 for antibody 44906
QQSYMTPKT

SEQ ID NO: 89812 - protein, 22 aa, Homo sapiens
  heavy chain complementarity determining region 3 for antibody 44906
ARAGYTGSAFGAPNYYYYGMDV

SEQ ID NO: 89813 - protein, 9 aa, Homo sapiens
  light chain complementarity determining region 3 for antibody 44907
QQSYIIPRT

SEQ ID NO: 89814 - protein, 19 aa, Homo sapiens
  heavy chain complementarity determining region 3 for antibody 44907
ARDGPRVGDSFDGREWFDP

SEQ ID NO: 89815 - protein, 10 aa, Homo sapiens
  light chain complementarity determining region 3 for antibody 44908
QQSYFTPRFT

SEQ ID NO: 89816 - protein, 15 aa, Homo sapiens
  heavy chain complementarity determining region 3 for antibody 44908
VRGMVRGVIREAFDI

SEQ ID NO: 89817 - protein, 9 aa, Homo sapiens
  light chain complementarity determining region 3 for antibody 44909
QQSYETPRT

SEQ ID NO: 89818 - protein, 16 aa, Homo sapiens
  heavy chain complementarity determining region 3 for antibody 44909
ARDSLNYYASGGFYYY

SEQ ID NO: 89819 - protein, 9 aa, Homo sapiens
  light chain complementarity determining region 3 for antibody 44910
QQSYETPLT

SEQ ID NO: 89820 - protein, 18 aa, Homo sapiens
  heavy chain complementarity determining region 3 for antibody 44910
AKDRASVPGISYYYGMDV

SEQ ID NO: 89821 - protein, 8 aa, Homo sapiens
  light chain complementarity determining region 3 for antibody 44911
QQSYAIIT

SEQ ID NO: 89822 - protein, 15 aa, Homo sapiens
  heavy chain complementarity determining region 3 for antibody 44911
AMSTNEAATIGAFDV

SEQ ID NO: 89823 - protein, 10 aa, Homo sapiens
  light chain complementarity determining region 3 for antibody 44912
QQSTTSPMYS

SEQ ID NO: 89824 - protein, 14 aa, Homo sapiens
  heavy chain complementarity determining region 3 for antibody 44912
ATHQWLLRYDAVDI

SEQ ID NO: 89825 - protein, 9 aa, Homo sapiens
  light chain complementarity determining region 3 for antibody 44913
QQSSNIPVT

SEQ ID NO: 89826 - protein, 18 aa, Homo sapiens
  heavy chain complementarity determining region 3 for antibody 44913
VRWGSSMVRGIMVNWFDP

SEQ ID NO: 89827 - protein, 9 aa, Homo sapiens
  light chain complementarity determining region 3 for antibody 44914
QQSNTYPLT

SEQ ID NO: 89828 - protein, 8 aa, Homo sapiens
  heavy chain complementarity determining region 3 for antibody 44914
INYNTGWS

SEQ ID NO: 89829 - protein, 9 aa, Homo sapiens
  light chain complementarity determining region 3 for antibody 44915
QQSLAVPLT

SEQ ID NO: 89830 - protein, 8 aa, Homo sapiens
  heavy chain complementarity determining region 3 for antibody 44915
AAEYTFPV

SEQ ID NO: 89831 - protein, 9 aa, Homo sapiens
  light chain complementarity determining region 3 for antibody 44916
QQSHSIPLT

SEQ ID NO: 89832 - protein, 5 aa, Homo sapiens
  heavy chain complementarity determining region 3 for antibody 44916
SGWLA

SEQ ID NO: 89833 - protein, 8 aa, Homo sapiens
  light chain complementarity determining region 3 for antibody 44917
QQSHRSYT

SEQ ID NO: 89834 - protein, 17 aa, Homo sapiens
  heavy chain complementarity determining region 3 for antibody 44917
AKGRPGSSIALAKVVDY

SEQ ID NO: 89835 - protein, 9 aa, Homo sapiens
  light chain complementarity determining region 3 for antibody 44918
QQSGSSMWT

SEQ ID NO: 89836 - protein, 13 aa, Homo sapiens
  heavy chain complementarity determining region 3 for antibody 44918
ARGGRVAAGAFDY

SEQ ID NO: 89837 - protein, 9 aa, Homo sapiens
  light chain complementarity determining region 3 for antibody 44919
QQSGNSPWT

SEQ ID NO: 89838 - protein, 12 aa, Homo sapiens
  heavy chain complementarity determining region 3 for antibody 44919
ATRAETFGVLNY

SEQ ID NO: 89839 - protein, 9 aa, Homo sapiens
  light chain complementarity determining region 3 for antibody 44920
QQSFTTPYT

SEQ ID NO: 89840 - protein, 17 aa, Homo sapiens
  heavy chain complementarity determining region 3 for antibody 44920
ARDRGGRKQWLESGLDI

SEQ ID NO: 89841 - protein, 9 aa, Homo sapiens
  light chain complementarity determining region 3 for antibody 44921
QQSFTTPPT

SEQ ID NO: 89842 - protein, 26 aa, Homo sapiens
  heavy chain complementarity determining region 3 for antibody 44921
AREWADVLRFVEWPHIQNRRDYYFDY

SEQ ID NO: 89843 - protein, 9 aa, Homo sapiens
  light chain complementarity determining region 3 for antibody 44922
QQSFTNPPT

SEQ ID NO: 89844 - protein, 18 aa, Homo sapiens
  heavy chain complementarity determining region 3 for antibody 44922
AREVDSYNGDAYYNIFDY

SEQ ID NO: 89845 - protein, 9 aa, Homo sapiens
  light chain complementarity determining region 3 for antibody 44923
QQSFSTPRT

SEQ ID NO: 89846 - protein, 17 aa, Homo sapiens
  heavy chain complementarity determining region 3 for antibody 44923
ARDLAVTAKGARGAFDI

SEQ ID NO: 89847 - protein, 9 aa, Homo sapiens
  light chain complementarity determining region 3 for antibody 44924
QQSFLTPFT

SEQ ID NO: 89848 - protein, 20 aa, Homo sapiens
  heavy chain complementarity determining region 3 for antibody 44924
ARGRGDDISTFYTVWWGIDC

SEQ ID NO: 89849 - protein, 9 aa, Homo sapiens
  light chain complementarity determining region 3 for antibody 44925
QQSFGTPRT

SEQ ID NO: 89850 - protein, 17 aa, Homo sapiens
  heavy chain complementarity determining region 3 for antibody 44925
AKDIFFAIAVAGTAFDI

SEQ ID NO: 89851 - protein, 9 aa, Homo sapiens
  light chain complementarity determining region 3 for antibody 44926
QQSATTPET

SEQ ID NO: 89852 - protein, 14 aa, Homo sapiens
  heavy chain complementarity determining region 3 for antibody 44926
GRLSRDGHNNPFDY

SEQ ID NO: 89853 - protein, 10 aa, Homo sapiens
  light chain complementarity determining region 3 for antibody 44927
QQRYNWPPYT

SEQ ID NO: 89854 - protein, 11 aa, Homo sapiens
  heavy chain complementarity determining region 3 for antibody 44927
TRGVGSYPFDH

SEQ ID NO: 89855 - protein, 10 aa, Homo sapiens
  light chain complementarity determining region 3 for antibody 44928
QQRYNWPPVT

SEQ ID NO: 89856 - protein, 11 aa, Homo sapiens
  heavy chain complementarity determining region 3 for antibody 44928
ARGVGSYPFDS

SEQ ID NO: 89857 - protein, 9 aa, Homo sapiens
  light chain complementarity determining region 3 for antibody 44929
QQRTNWLWT

SEQ ID NO: 89858 - protein, 14 aa, Homo sapiens
  heavy chain complementarity determining region 3 for antibody 44929
ARDRRLLNPGDFES

SEQ ID NO: 89859 - protein, 8 aa, Homo sapiens
  light chain complementarity determining region 3 for antibody 44930
QQRSSWPT

SEQ ID NO: 89860 - protein, 17 aa, Homo sapiens
  heavy chain complementarity determining region 3 for antibody 44930
ARAPAGISGGWYPIFDP

SEQ ID NO: 89861 - protein, 10 aa, Homo sapiens
  light chain complementarity determining region 3 for antibody 44931
QQRSNWPRYT

SEQ ID NO: 89862 - protein, 23 aa, Homo sapiens
  heavy chain complementarity determining region 3 for antibody 44931
AGGDYYDSSGYYYVDHYFYDMDV

SEQ ID NO: 89863 - protein, 9 aa, Homo sapiens
  light chain complementarity determining region 3 for antibody 44932
QQRSNWPRT

SEQ ID NO: 89864 - protein, 18 aa, Homo sapiens
  heavy chain complementarity determining region 3 for antibody 44932
TRDRPSRMATTGGTWFDP

SEQ ID NO: 89865 - protein, 9 aa, Homo sapiens
  light chain complementarity determining region 3 for antibody 44933
QQRSNWPRT

SEQ ID NO: 89866 - protein, 23 aa, Homo sapiens
  heavy chain complementarity determining region 3 for antibody 44933
AREPRETVNFMGSYYYYYNGMDV

SEQ ID NO: 89867 - protein, 10 aa, Homo sapiens
  light chain complementarity determining region 3 for antibody 44934
QQRSNWPPLP

SEQ ID NO: 89868 - protein, 11 aa, Homo sapiens
  heavy chain complementarity determining region 3 for antibody 44934
AGWRPTRHFDY

SEQ ID NO: 89869 - protein, 10 aa, Homo sapiens
  light chain complementarity determining region 3 for antibody 44935
QQRSNWPPIT

SEQ ID NO: 89870 - protein, 17 aa, Homo sapiens
  heavy chain complementarity determining region 3 for antibody 44935
AAGYHSGSLSADDVFDM

SEQ ID NO: 89871 - protein, 11 aa, Homo sapiens
  light chain complementarity determining region 3 for antibody 44936
QQRSNWPPGLT

SEQ ID NO: 89872 - protein, 20 aa, Homo sapiens
  heavy chain complementarity determining region 3 for antibody 44936
ARAEGGVYYDSSDYLGYFYE

SEQ ID NO: 89873 - protein, 9 aa, Homo sapiens
  light chain complementarity determining region 3 for antibody 44937
QQRSNWPLT

SEQ ID NO: 89874 - protein, 20 aa, Homo sapiens
  heavy chain complementarity determining region 3 for antibody 44937
ARARRGVWAGSYSSNYFFDY

SEQ ID NO: 89875 - protein, 9 aa, Homo sapiens
  light chain complementarity determining region 3 for antibody 44938
QQRSNWMYT

SEQ ID NO: 89876 - protein, 12 aa, Homo sapiens
  heavy chain complementarity determining region 3 for antibody 44938
ARERENGDYDPD

SEQ ID NO: 89877 - protein, 9 aa, Homo sapiens
  light chain complementarity determining region 3 for antibody 44939
QQRSLWPWT

SEQ ID NO: 89878 - protein, 14 aa, Homo sapiens
  heavy chain complementarity determining region 3 for antibody 44939
AKSPGTTYNGFVDV

SEQ ID NO: 89879 - protein, 10 aa, Homo sapiens
  light chain complementarity determining region 3 for antibody 44940
QQRSKWPPPT

SEQ ID NO: 89880 - protein, 9 aa, Homo sapiens
  heavy chain complementarity determining region 3 for antibody 44940
ARVDGYFDY

SEQ ID NO: 89881 - protein, 9 aa, Homo sapiens
  light chain complementarity determining region 3 for antibody 44941
QQRRNWLLT

SEQ ID NO: 89882 - protein, 17 aa, Homo sapiens
  heavy chain complementarity determining region 3 for antibody 44941
TMDHRRDTFGGVIAFDS

SEQ ID NO: 89883 - protein, 9 aa, Homo sapiens
  light chain complementarity determining region 3 for antibody 44942
QQRRDWPLT

SEQ ID NO: 89884 - protein, 23 aa, Homo sapiens
  heavy chain complementarity determining region 3 for antibody 44942
ARDGHCSGGNCHQWDNAYYGLDV

SEQ ID NO: 89885 - protein, 11 aa, Homo sapiens
  light chain complementarity determining region 3 for antibody 44943
QQRQESTNWLT

SEQ ID NO: 89886 - protein, 15 aa, Homo sapiens
  heavy chain complementarity determining region 3 for antibody 44943
ARGGYSSNWYWWFDP

SEQ ID NO: 89887 - protein, 11 aa, Homo sapiens
  light chain complementarity determining region 3 for antibody 44944
QQRQESTNWLI

SEQ ID NO: 89888 - protein, 15 aa, Homo sapiens
  heavy chain complementarity determining region 3 for antibody 44944
ARGGYSSNWYWWFDP

SEQ ID NO: 89889 - protein, 9 aa, Homo sapiens
  light chain complementarity determining region 3 for antibody 44945
QQRNNWRIT

SEQ ID NO: 89890 - protein, 12 aa, Homo sapiens
  heavy chain complementarity determining region 3 for antibody 44945
TRASESSGWYAH

SEQ ID NO: 89891 - protein, 9 aa, Homo sapiens
  light chain complementarity determining region 3 for antibody 44946
QQRNNWPPT

SEQ ID NO: 89892 - protein, 21 aa, Homo sapiens
  heavy chain complementarity determining region 3 for antibody 44946
AKSVGSGKDYYGSGRSDNYHI

SEQ ID NO: 89893 - protein, 9 aa, Homo sapiens
  light chain complementarity determining region 3 for antibody 44947
QQRGNWPPA

SEQ ID NO: 89894 - protein, 19 aa, Homo sapiens
  heavy chain complementarity determining region 3 for antibody 44947
ARDGAPGGFGWFGVSGFDL

SEQ ID NO: 89895 - protein, 9 aa, Homo sapiens
  light chain complementarity determining region 3 for antibody 44948
QQRGNWPPA

SEQ ID NO: 89896 - protein, 20 aa, Homo sapiens
  heavy chain complementarity determining region 3 for antibody 44948
AKDLVRFATGDYHRPTYLDY

SEQ ID NO: 89897 - protein, 9 aa, Homo sapiens
  light chain complementarity determining region 3 for antibody 44949
QQRGNWPLT

SEQ ID NO: 89898 - protein, 20 aa, Homo sapiens
  heavy chain complementarity determining region 3 for antibody 44949
TTECKSSNCGAKYYYFGMDV

SEQ ID NO: 89899 - protein, 9 aa, Homo sapiens
  light chain complementarity determining region 3 for antibody 44950
QQNYQTPGT

SEQ ID NO: 89900 - protein, 15 aa, Homo sapiens
  heavy chain complementarity determining region 3 for antibody 44950
VRSRPILIGYFPFDF

SEQ ID NO: 89901 - protein, 9 aa, Homo sapiens
  light chain complementarity determining region 3 for antibody 44951
QQNGSSPWT

SEQ ID NO: 89902 - protein, 17 aa, Homo sapiens
  heavy chain complementarity determining region 3 for antibody 44951
ARGGAYYDSSGYDQFDY

SEQ ID NO: 89903 - protein, 6 aa, Homo sapiens
  light chain complementarity determining region 3 for antibody 44952
QQNGMP

SEQ ID NO: 89904 - protein, 12 aa, Homo sapiens
  heavy chain complementarity determining region 3 for antibody 44952
ARLANSWYPYDY

SEQ ID NO: 89905 - protein, 9 aa, Homo sapiens
  light chain complementarity determining region 3 for antibody 44953
QQLSGYPLT

SEQ ID NO: 89906 - protein, 13 aa, Homo sapiens
  heavy chain complementarity determining region 3 for antibody 44953
VRQISGWNDVFDI

SEQ ID NO: 89907 - protein, 9 aa, Homo sapiens
  light chain complementarity determining region 3 for antibody 44954
QQLNTFPIT

SEQ ID NO: 89908 - protein, 21 aa, Homo sapiens
  heavy chain complementarity determining region 3 for antibody 44954
ARVSTLRNSRGEATYHYVMDV

SEQ ID NO: 89909 - protein, 9 aa, Homo sapiens
  light chain complementarity determining region 3 for antibody 44955
QQLNSYPLT

SEQ ID NO: 89910 - protein, 14 aa, Homo sapiens
  heavy chain complementarity determining region 3 for antibody 44955
ATGLVGDRTYYFDY

SEQ ID NO: 89911 - protein, 10 aa, Homo sapiens
  light chain complementarity determining region 3 for antibody 44956
QQLNSFPPRT

SEQ ID NO: 89912 - protein, 18 aa, Homo sapiens
  heavy chain complementarity determining region 3 for antibody 44956
ARRHYFDSGDYADDPFDH

SEQ ID NO: 89913 - protein, 9 aa, Homo sapiens
  light chain complementarity determining region 3 for antibody 44957
QQINSYLLT

SEQ ID NO: 89914 - protein, 13 aa, Homo sapiens
  heavy chain complementarity determining region 3 for antibody 44957
AREEEVTLGALDI

SEQ ID NO: 89915 - protein, 9 aa, Homo sapiens
  light chain complementarity determining region 3 for antibody 44958
QQHYIYPLT

SEQ ID NO: 89916 - protein, 16 aa, Homo sapiens
  heavy chain complementarity determining region 3 for antibody 44958
ARRVDVDHTAHWYFDL

SEQ ID NO: 89917 - protein, 9 aa, Homo sapiens
  light chain complementarity determining region 3 for antibody 44959
QQHLNLPLS

SEQ ID NO: 89918 - protein, 13 aa, Homo sapiens
  heavy chain complementarity determining region 3 for antibody 44959
SRRFGEDKVAFDT

SEQ ID NO: 89919 - protein, 8 aa, Homo sapiens
  light chain complementarity determining region 3 for antibody 44960
QQHGDSHT

SEQ ID NO: 89920 - protein, 9 aa, Homo sapiens
  heavy chain complementarity determining region 3 for antibody 44960
ARWNEGSDY

SEQ ID NO: 89921 - protein, 9 aa, Homo sapiens
  light chain complementarity determining region 3 for antibody 44961
QQGYSTPFT

SEQ ID NO: 89922 - protein, 16 aa, Homo sapiens
  heavy chain complementarity determining region 3 for antibody 44961
VRGLDTAMITAENFAF

SEQ ID NO: 89923 - protein, 9 aa, Homo sapiens
  light chain complementarity determining region 3 for antibody 44962
QQGYGAPYT

SEQ ID NO: 89924 - protein, 13 aa, Homo sapiens
  heavy chain complementarity determining region 3 for antibody 44962
ASAFDYGSGTYIY

SEQ ID NO: 89925 - protein, 9 aa, Homo sapiens
  light chain complementarity determining region 3 for antibody 44963
QQGSSFPYT

SEQ ID NO: 89926 - protein, 9 aa, Homo sapiens
  heavy chain complementarity determining region 3 for antibody 44963
ARDTAMVDS

SEQ ID NO: 89927 - protein, 9 aa, Homo sapiens
  light chain complementarity determining region 3 for antibody 44964
QQFNSWPWT

SEQ ID NO: 89928 - protein, 14 aa, Homo sapiens
  heavy chain complementarity determining region 3 for antibody 44964
ARYGSTNFYYGMDV

SEQ ID NO: 89929 - protein, 9 aa, Homo sapiens
  light chain complementarity determining region 3 for antibody 44965
QQFNIYPPT

SEQ ID NO: 89930 - protein, 15 aa, Homo sapiens
  heavy chain complementarity determining region 3 for antibody 44965
ARDSGIKVREDYFDH

SEQ ID NO: 89931 - protein, 9 aa, Homo sapiens
  light chain complementarity determining region 3 for antibody 44966
QQFHYHPVT

SEQ ID NO: 89932 - protein, 13 aa, Homo sapiens
  heavy chain complementarity determining region 3 for antibody 44966
ARDGYGLGNTYDL

SEQ ID NO: 89933 - protein, 9 aa, Homo sapiens
  light chain complementarity determining region 3 for antibody 44967
QQFGSSPPT

SEQ ID NO: 89934 - protein, 17 aa, Homo sapiens
  heavy chain complementarity determining region 3 for antibody 44967
AVYDRTSNYNLDFLCYS

SEQ ID NO: 89935 - protein, 8 aa, Homo sapiens
  light chain complementarity determining region 3 for antibody 44968
QQFGDSQT

SEQ ID NO: 89936 - protein, 14 aa, Homo sapiens
  heavy chain complementarity determining region 3 for antibody 44968
ARDSEYNGPYLYHH

SEQ ID NO: 89937 - protein, 9 aa, Homo sapiens
  light chain complementarity determining region 3 for antibody 44969
QQFETSPWT

SEQ ID NO: 89938 - protein, 16 aa, Homo sapiens
  heavy chain complementarity determining region 3 for antibody 44969
AREGYFDHPLEYGLDV

SEQ ID NO: 89939 - protein, 9 aa, Homo sapiens
  light chain complementarity determining region 3 for antibody 44970
QQFDFLPIT

SEQ ID NO: 89940 - protein, 16 aa, Homo sapiens
  heavy chain complementarity determining region 3 for antibody 44970
ARQRYNWNEVVGAFDI

SEQ ID NO: 89941 - protein, 9 aa, Homo sapiens
  light chain complementarity determining region 3 for antibody 44971
QQFDDPPQT

SEQ ID NO: 89942 - protein, 19 aa, Homo sapiens
  heavy chain complementarity determining region 3 for antibody 44971
GRLSELERRLSEYYYAMDV

SEQ ID NO: 89943 - protein, 9 aa, Homo sapiens
  light chain complementarity determining region 3 for antibody 44972
QQCGDSPWT

SEQ ID NO: 89944 - protein, 12 aa, Homo sapiens
  heavy chain complementarity determining region 3 for antibody 44972
VRDGVGPPPFDH

SEQ ID NO: 89945 - protein, 9 aa, Homo sapiens
  light chain complementarity determining region 3 for antibody 44973
QQCATSPLT

SEQ ID NO: 89946 - protein, 11 aa, Homo sapiens
  heavy chain complementarity determining region 3 for antibody 44973
VRDRGRLQHDY

SEQ ID NO: 89947 - protein, 9 aa, Homo sapiens
  light chain complementarity determining region 3 for antibody 44974
QQASSFPLT

SEQ ID NO: 89948 - protein, 15 aa, Homo sapiens
  heavy chain complementarity determining region 3 for antibody 44974
AREGGTGPGSVSLGY

SEQ ID NO: 89949 - protein, 10 aa, Homo sapiens
  light chain complementarity determining region 3 for antibody 44975
QQANTFPPWT

SEQ ID NO: 89950 - protein, 18 aa, Homo sapiens
  heavy chain complementarity determining region 3 for antibody 44975
ARDGGGLGSSSWYVGLDI

SEQ ID NO: 89951 - protein, 9 aa, Homo sapiens
  light chain complementarity determining region 3 for antibody 44976
QQANSFSLT

SEQ ID NO: 89952 - protein, 11 aa, Homo sapiens
  heavy chain complementarity determining region 3 for antibody 44976
ARDASEQTFDY

SEQ ID NO: 89953 - protein, 9 aa, Homo sapiens
  light chain complementarity determining region 3 for antibody 44977
QQANSFPYT

SEQ ID NO: 89954 - protein, 22 aa, Homo sapiens
  heavy chain complementarity determining region 3 for antibody 44977
ARDSPNVSSWEKRLSALGWVDP

SEQ ID NO: 89955 - protein, 9 aa, Homo sapiens
  light chain complementarity determining region 3 for antibody 44978
QQANSFPLT

SEQ ID NO: 89956 - protein, 14 aa, Homo sapiens
  heavy chain complementarity determining region 3 for antibody 44978
ARTYRRTSGYDLDY

SEQ ID NO: 89957 - protein, 9 aa, Homo sapiens
  light chain complementarity determining region 3 for antibody 44979
QQANSFPLT

SEQ ID NO: 89958 - protein, 19 aa, Homo sapiens
  heavy chain complementarity determining region 3 for antibody 44979
AKDHETSGLTAVNTGYFQN

SEQ ID NO: 89959 - protein, 9 aa, Homo sapiens
  light chain complementarity determining region 3 for antibody 44980
QQANSFPHT

SEQ ID NO: 89960 - protein, 10 aa, Homo sapiens
  heavy chain complementarity determining region 3 for antibody 44980
ARDLSGGNSL

SEQ ID NO: 89961 - protein, 9 aa, Homo sapiens
  light chain complementarity determining region 3 for antibody 44981
QQANSFPFT

SEQ ID NO: 89962 - protein, 17 aa, Homo sapiens
  heavy chain complementarity determining region 3 for antibody 44981
ARVSGGEIITAKTHYDL

SEQ ID NO: 89963 - protein, 9 aa, Homo sapiens
  light chain complementarity determining region 3 for antibody 44982
QQAKSFLWT

SEQ ID NO: 89964 - protein, 17 aa, Homo sapiens
  heavy chain complementarity determining region 3 for antibody 44982
ARDRTSTPSENPPGMDV

SEQ ID NO: 89965 - protein, 9 aa, Homo sapiens
  light chain complementarity determining region 3 for antibody 44983
QQAGGAPYT

SEQ ID NO: 89966 - protein, 13 aa, Homo sapiens
  heavy chain complementarity determining region 3 for antibody 44983
ARDWYSSSLSMDV

SEQ ID NO: 89967 - protein, 11 aa, Homo sapiens
  light chain complementarity determining region 3 for antibody 44984
QNYNTALRGLT

SEQ ID NO: 89968 - protein, 17 aa, Homo sapiens
  heavy chain complementarity determining region 3 for antibody 44984
AAGYHSESLSADEVFDI

SEQ ID NO: 89969 - protein, 10 aa, Homo sapiens
  light chain complementarity determining region 3 for antibody 44985
QLYGSSPPYT

SEQ ID NO: 89970 - protein, 19 aa, Homo sapiens
  heavy chain complementarity determining region 3 for antibody 44985
VRGEGEAWCTNGVCYPFDY

SEQ ID NO: 89971 - protein, 9 aa, Homo sapiens
  light chain complementarity determining region 3 for antibody 44986
QKYNTAPLT

SEQ ID NO: 89972 - protein, 15 aa, Homo sapiens
  heavy chain complementarity determining region 3 for antibody 44986
ARPGQQLVRWSWFDP

SEQ ID NO: 89973 - protein, 9 aa, Homo sapiens
  light chain complementarity determining region 3 for antibody 44987
QKYNSAPWT

SEQ ID NO: 89974 - protein, 15 aa, Homo sapiens
  heavy chain complementarity determining region 3 for antibody 44987
AKDQGPYDTLTGYDY

SEQ ID NO: 89975 - protein, 9 aa, Homo sapiens
  light chain complementarity determining region 3 for antibody 44988
QKYNSAPLT

SEQ ID NO: 89976 - protein, 15 aa, Homo sapiens
  heavy chain complementarity determining region 3 for antibody 44988
ARGSRSGHYYYGMDV

SEQ ID NO: 89977 - protein, 9 aa, Homo sapiens
  light chain complementarity determining region 3 for antibody 44989
QKYNSAPLT

SEQ ID NO: 89978 - protein, 17 aa, Homo sapiens
  heavy chain complementarity determining region 3 for antibody 44989
AKAPTSTYSGKYGGFDY

SEQ ID NO: 89979 - protein, 9 aa, Homo sapiens
  light chain complementarity determining region 3 for antibody 44990
QKYNSAPLA

SEQ ID NO: 89980 - protein, 17 aa, Homo sapiens
  heavy chain complementarity determining region 3 for antibody 44990
AKFVYYGSGRPDDAFDI

SEQ ID NO: 89981 - protein, 9 aa, Homo sapiens
  light chain complementarity determining region 3 for antibody 44991
QKYNRAPWT

SEQ ID NO: 89982 - protein, 15 aa, Homo sapiens
  heavy chain complementarity determining region 3 for antibody 44991
VIPPLPMTTHDVFDI

SEQ ID NO: 89983 - protein, 9 aa, Homo sapiens
  light chain complementarity determining region 3 for antibody 44992
QKYNDAPWT

SEQ ID NO: 89984 - protein, 16 aa, Homo sapiens
  heavy chain complementarity determining region 3 for antibody 44992
AKKGGHVAATGNYFDL

SEQ ID NO: 89985 - protein, 9 aa, Homo sapiens
  light chain complementarity determining region 3 for antibody 44993
QKYDSAPFT

SEQ ID NO: 89986 - protein, 12 aa, Homo sapiens
  heavy chain complementarity determining region 3 for antibody 44993
AKKVGNPDVFDS

SEQ ID NO: 89987 - protein, 9 aa, Homo sapiens
  light chain complementarity determining region 3 for antibody 44994
QKRSNWSLT

SEQ ID NO: 89988 - protein, 19 aa, Homo sapiens
  heavy chain complementarity determining region 3 for antibody 44994
ARDSRHTEMENYYYYGMDV

SEQ ID NO: 89989 - protein, 9 aa, Homo sapiens
  light chain complementarity determining region 3 for antibody 44995
QHYYSQSRS

SEQ ID NO: 89990 - protein, 13 aa, Homo sapiens
  heavy chain complementarity determining region 3 for antibody 44995
AGEYFYDSSGYEY

SEQ ID NO: 89991 - protein, 11 aa, Homo sapiens
  light chain complementarity determining region 3 for antibody 44996
QHYSDSPPEYP

SEQ ID NO: 89992 - protein, 13 aa, Homo sapiens
  heavy chain complementarity determining region 3 for antibody 44996
ARESGPNSRGFDF

SEQ ID NO: 89993 - protein, 9 aa, Homo sapiens
  light chain complementarity determining region 3 for antibody 44997
QHYKSYPLT

SEQ ID NO: 89994 - protein, 13 aa, Homo sapiens
  heavy chain complementarity determining region 3 for antibody 44997
TRARSSDNSYCEY

SEQ ID NO: 89995 - protein, 9 aa, Homo sapiens
  light chain complementarity determining region 3 for antibody 44998
QHYGSSRWT

SEQ ID NO: 89996 - protein, 11 aa, Homo sapiens
  heavy chain complementarity determining region 3 for antibody 44998
AKGFYSGYAEY

SEQ ID NO: 89997 - protein, 9 aa, Homo sapiens
  light chain complementarity determining region 3 for antibody 44999
QHYDTSPWT

SEQ ID NO: 89998 - protein, 18 aa, Homo sapiens
  heavy chain complementarity determining region 3 for antibody 44999
ARGGQWRGTQRHFYGLDV

SEQ ID NO: 89999 - protein, 10 aa, Homo sapiens
  light chain complementarity determining region 3 for antibody 45000
QHYDSSPALF

SEQ ID NO: 90000 - protein, 21 aa, Homo sapiens
  heavy chain complementarity determining region 3 for antibody 45000
AKDGETSKLDNGDYYERPPEA

SEQ ID NO: 90001 - protein, 9 aa, Homo sapiens
  light chain complementarity determining region 3 for antibody 45001
QHYDSLPYT

SEQ ID NO: 90002 - protein, 15 aa, Homo sapiens
  heavy chain complementarity determining region 3 for antibody 45001
ARGVRGVVMADAFDV

SEQ ID NO: 90003 - protein, 8 aa, Homo sapiens
  light chain complementarity determining region 3 for antibody 45002
QHYDDSPT

SEQ ID NO: 90004 - protein, 15 aa, Homo sapiens
  heavy chain complementarity determining region 3 for antibody 45002
GRIRDTAVAKWYFDL

SEQ ID NO: 90005 - protein, 10 aa, Homo sapiens
  light chain complementarity determining region 3 for antibody 45003
QHYAFSLPLT

SEQ ID NO: 90006 - protein, 16 aa, Homo sapiens
  heavy chain complementarity determining region 3 for antibody 45003
AKGSWNLEAVAGYVDF

SEQ ID NO: 90007 - protein, 9 aa, Homo sapiens
  light chain complementarity determining region 3 for antibody 45004
QHRANWPRT

SEQ ID NO: 90008 - protein, 13 aa, Homo sapiens
  heavy chain complementarity determining region 3 for antibody 45004
ARDYPAQRGYFDY

SEQ ID NO: 90009 - protein, 9 aa, Homo sapiens
  light chain complementarity determining region 3 for antibody 45005
QHNYSPPYT

SEQ ID NO: 90010 - protein, 11 aa, Homo sapiens
  heavy chain complementarity determining region 3 for antibody 45005
AGDLHRGAPFY

SEQ ID NO: 90011 - protein, 9 aa, Homo sapiens
  light chain complementarity determining region 3 for antibody 45006
QHLKSYLWT

SEQ ID NO: 90012 - protein, 20 aa, Homo sapiens
  heavy chain complementarity determining region 3 for antibody 45006
ARCFCTSISCYLFGFDALDI

SEQ ID NO: 90013 - protein, 9 aa, Homo sapiens
  light chain complementarity determining region 3 for antibody 45007
QGYANFLWA

SEQ ID NO: 90014 - protein, 17 aa, Homo sapiens
  heavy chain complementarity determining region 3 for antibody 45007
AAERDWHADTAPGGFDP

SEQ ID NO: 90015 - protein, 10 aa, Homo sapiens
  light chain complementarity determining region 3 for antibody 45008
QEYNFWPRLT

SEQ ID NO: 90016 - protein, 14 aa, Homo sapiens
  heavy chain complementarity determining region 3 for antibody 45008
ARDQDFGDVGALDV

SEQ ID NO: 90017 - protein, 9 aa, Homo sapiens
  light chain complementarity determining region 3 for antibody 45009
QEYFHFSGT

SEQ ID NO: 90018 - protein, 16 aa, Homo sapiens
  heavy chain complementarity determining region 3 for antibody 45009
ARGPIVRIPTVGYGRH

SEQ ID NO: 90019 - protein, 7 aa, Homo sapiens
  light chain complementarity determining region 3 for antibody 45010
QELETYA

SEQ ID NO: 90020 - protein, 17 aa, Homo sapiens
  heavy chain complementarity determining region 3 for antibody 45010
VKDMGPLFGSGLDAFDI

SEQ ID NO: 90021 - protein, 11 aa, Homo sapiens
  light chain complementarity determining region 3 for antibody 45011
MQVTHWPPRVT

SEQ ID NO: 90022 - protein, 15 aa, Homo sapiens
  heavy chain complementarity determining region 3 for antibody 45011
LSGWRSAAAGSGAPK

SEQ ID NO: 90023 - protein, 9 aa, Homo sapiens
  light chain complementarity determining region 3 for antibody 45012
MQTVQMPPT

SEQ ID NO: 90024 - protein, 19 aa, Homo sapiens
  heavy chain complementarity determining region 3 for antibody 45012
ATVSVFLLPVGLPNEYFHH

SEQ ID NO: 90025 - protein, 9 aa, Homo sapiens
  light chain complementarity determining region 3 for antibody 45013
MQTLQTPFT

SEQ ID NO: 90026 - protein, 12 aa, Homo sapiens
  heavy chain complementarity determining region 3 for antibody 45013
ARWNSGHDCFDY

SEQ ID NO: 90027 - protein, 9 aa, Homo sapiens
  light chain complementarity determining region 3 for antibody 45014
MQSLQTRYT

SEQ ID NO: 90028 - protein, 14 aa, Homo sapiens
  heavy chain complementarity determining region 3 for antibody 45014
ARDEGYYGRSGYHF

SEQ ID NO: 90029 - protein, 8 aa, Homo sapiens
  light chain complementarity determining region 3 for antibody 45015
MQSLQPFT

SEQ ID NO: 90030 - protein, 14 aa, Homo sapiens
  heavy chain complementarity determining region 3 for antibody 45015
ARVSSTWYSPLFDF

SEQ ID NO: 90031 - protein, 9 aa, Homo sapiens
  light chain complementarity determining region 3 for antibody 45016
MQPLQAPWT

SEQ ID NO: 90032 - protein, 21 aa, Homo sapiens
  heavy chain complementarity determining region 3 for antibody 45016
AREGQKPPPIISSGSRGGLDY

SEQ ID NO: 90033 - protein, 8 aa, Homo sapiens
  light chain complementarity determining region 3 for antibody 45017
MQGTHWYT

SEQ ID NO: 90034 - protein, 14 aa, Homo sapiens
  heavy chain complementarity determining region 3 for antibody 45017
ARELLRGGDWPTDY

SEQ ID NO: 90035 - protein, 9 aa, Homo sapiens
  light chain complementarity determining region 3 for antibody 45018
MQGTHWPWT

SEQ ID NO: 90036 - protein, 21 aa, Homo sapiens
  heavy chain complementarity determining region 3 for antibody 45018
AREVEIRYCSSSSCYGALFDY

SEQ ID NO: 90037 - protein, 9 aa, Homo sapiens
  light chain complementarity determining region 3 for antibody 45019
MQGTHWPPT

SEQ ID NO: 90038 - protein, 9 aa, Homo sapiens
  heavy chain complementarity determining region 3 for antibody 45019
TWSNSGGDY

SEQ ID NO: 90039 - protein, 9 aa, Homo sapiens
  light chain complementarity determining region 3 for antibody 45020
MQGTHWPLT

SEQ ID NO: 90040 - protein, 16 aa, Homo sapiens
  heavy chain complementarity determining region 3 for antibody 45020
ARDHVGSNWYSRYFAY

SEQ ID NO: 90041 - protein, 10 aa, Homo sapiens
  light chain complementarity determining region 3 for antibody 45021
MQGTHWPLLT

SEQ ID NO: 90042 - protein, 19 aa, Homo sapiens
  heavy chain complementarity determining region 3 for antibody 45021
ARDHPPYNNVDHYYYGMDV

SEQ ID NO: 90043 - protein, 9 aa, Homo sapiens
  light chain complementarity determining region 3 for antibody 45022
MQGTHWPGT

SEQ ID NO: 90044 - protein, 12 aa, Homo sapiens
  heavy chain complementarity determining region 3 for antibody 45022
ARGPLISSAGNH

SEQ ID NO: 90045 - protein, 9 aa, Homo sapiens
  light chain complementarity determining region 3 for antibody 45023
MQGTHRPPT

SEQ ID NO: 90046 - protein, 12 aa, Homo sapiens
  heavy chain complementarity determining region 3 for antibody 45023
ARSNWNIIAFDL

SEQ ID NO: 90047 - protein, 9 aa, Homo sapiens
  light chain complementarity determining region 3 for antibody 45024
MQGSHWPPT

SEQ ID NO: 90048 - protein, 16 aa, Homo sapiens
  heavy chain complementarity determining region 3 for antibody 45024
AKGSLPTGLTVGGIDY

SEQ ID NO: 90049 - protein, 10 aa, Homo sapiens
  light chain complementarity determining region 3 for antibody 45025
MQGLRWPPYS

SEQ ID NO: 90050 - protein, 19 aa, Homo sapiens
  heavy chain complementarity determining region 3 for antibody 45025
ARVRGYCGVSGCLVHWLDY

SEQ ID NO: 90051 - protein, 9 aa, Homo sapiens
  light chain complementarity determining region 3 for antibody 45026
MQGLQTPRT

SEQ ID NO: 90052 - protein, 15 aa, Homo sapiens
  heavy chain complementarity determining region 3 for antibody 45026
AKGGKTGGYYYGMDV

SEQ ID NO: 90053 - protein, 9 aa, Homo sapiens
  light chain complementarity determining region 3 for antibody 45027
MQGLQTPLT

SEQ ID NO: 90054 - protein, 17 aa, Homo sapiens
  heavy chain complementarity determining region 3 for antibody 45027
ANRLLGLLDRPEEAIDI

SEQ ID NO: 90055 - protein, 8 aa, Homo sapiens
  light chain complementarity determining region 3 for antibody 45028
MQGLGTWT

SEQ ID NO: 90056 - protein, 14 aa, Homo sapiens
  heavy chain complementarity determining region 3 for antibody 45028
TSDPFGHYYGTFTI

SEQ ID NO: 90057 - protein, 9 aa, Homo sapiens
  light chain complementarity determining region 3 for antibody 45029
MQGIHWPRT

SEQ ID NO: 90058 - protein, 14 aa, Homo sapiens
  heavy chain complementarity determining region 3 for antibody 45029
TRESGAVAAAMFDY

SEQ ID NO: 90059 - protein, 10 aa, Homo sapiens
  light chain complementarity determining region 3 for antibody 45030
MQDTHWPPCT

SEQ ID NO: 90060 - protein, 16 aa, Homo sapiens
  heavy chain complementarity determining region 3 for antibody 45030
AKRVWFGELSSAVFDV

SEQ ID NO: 90061 - protein, 9 aa, Homo sapiens
  light chain complementarity determining region 3 for antibody 45031
MQALRSPGT

SEQ ID NO: 90062 - protein, 12 aa, Homo sapiens
  heavy chain complementarity determining region 3 for antibody 45031
ANNGLEGGTFDH

SEQ ID NO: 90063 - protein, 8 aa, Homo sapiens
  light chain complementarity determining region 3 for antibody 45032
MQALQVPT

SEQ ID NO: 90064 - protein, 22 aa, Homo sapiens
  heavy chain complementarity determining region 3 for antibody 45032
ARDPHYYDSSDYYAQYYYEMDV

SEQ ID NO: 90065 - protein, 9 aa, Homo sapiens
  light chain complementarity determining region 3 for antibody 45033
MQALQTPYT

SEQ ID NO: 90066 - protein, 14 aa, Homo sapiens
  heavy chain complementarity determining region 3 for antibody 45033
ASDPPGRYYGAFDV

SEQ ID NO: 90067 - protein, 9 aa, Homo sapiens
  light chain complementarity determining region 3 for antibody 45034
MQALQTPWT

SEQ ID NO: 90068 - protein, 15 aa, Homo sapiens
  heavy chain complementarity determining region 3 for antibody 45034
ARRGGGSPWPSAFDV

SEQ ID NO: 90069 - protein, 8 aa, Homo sapiens
  light chain complementarity determining region 3 for antibody 45035
MQALQTPT

SEQ ID NO: 90070 - protein, 12 aa, Homo sapiens
  heavy chain complementarity determining region 3 for antibody 45035
ELLGDSGGDSDF

SEQ ID NO: 90071 - protein, 9 aa, Homo sapiens
  light chain complementarity determining region 3 for antibody 45036
MQALQTPRT

SEQ ID NO: 90072 - protein, 11 aa, Homo sapiens
  heavy chain complementarity determining region 3 for antibody 45036
VREGVVAGSVS

SEQ ID NO: 90073 - protein, 9 aa, Homo sapiens
  light chain complementarity determining region 3 for antibody 45037
MQALQTPRT

SEQ ID NO: 90074 - protein, 15 aa, Homo sapiens
  heavy chain complementarity determining region 3 for antibody 45037
AREVTGDGYHKTFDI

SEQ ID NO: 90075 - protein, 9 aa, Homo sapiens
  light chain complementarity determining region 3 for antibody 45038
MQALQTPRT

SEQ ID NO: 90076 - protein, 10 aa, Homo sapiens
  heavy chain complementarity determining region 3 for antibody 45038
ARESFGDFDY

SEQ ID NO: 90077 - protein, 9 aa, Homo sapiens
  light chain complementarity determining region 3 for antibody 45039
MQALQTPPT

SEQ ID NO: 90078 - protein, 14 aa, Homo sapiens
  heavy chain complementarity determining region 3 for antibody 45039
ARIEDSGGWGGFDF

SEQ ID NO: 90079 - protein, 11 aa, Homo sapiens
  light chain complementarity determining region 3 for antibody 45040
MQALQTPLGYT

SEQ ID NO: 90080 - protein, 13 aa, Homo sapiens
  heavy chain complementarity determining region 3 for antibody 45040
AKSSRGREHQFMP

SEQ ID NO: 90081 - protein, 10 aa, Homo sapiens
  light chain complementarity determining region 3 for antibody 45041
MQALQTPGVT

SEQ ID NO: 90082 - protein, 17 aa, Homo sapiens
  heavy chain complementarity determining region 3 for antibody 45041
AKGAIDHDGTTFYTHHY

SEQ ID NO: 90083 - protein, 9 aa, Homo sapiens
  light chain complementarity determining region 3 for antibody 45042
MQALQTPGT

SEQ ID NO: 90084 - protein, 13 aa, Homo sapiens
  heavy chain complementarity determining region 3 for antibody 45042
VRGARRGRYEFDY

SEQ ID NO: 90085 - protein, 9 aa, Homo sapiens
  light chain complementarity determining region 3 for antibody 45043
MQALQTPFT

SEQ ID NO: 90086 - protein, 12 aa, Homo sapiens
  heavy chain complementarity determining region 3 for antibody 45043
VHSHYHGWGFQQ

SEQ ID NO: 90087 - protein, 9 aa, Homo sapiens
  light chain complementarity determining region 3 for antibody 45044
MQALQTPFT

SEQ ID NO: 90088 - protein, 13 aa, Homo sapiens
  heavy chain complementarity determining region 3 for antibody 45044
ARDVDSGWYEFDY

SEQ ID NO: 90089 - protein, 9 aa, Homo sapiens
  light chain complementarity determining region 3 for antibody 45045
MQALQSPWT

SEQ ID NO: 90090 - protein, 12 aa, Homo sapiens
  heavy chain complementarity determining region 3 for antibody 45045
ARNYEHSGYFGY

SEQ ID NO: 90091 - protein, 9 aa, Homo sapiens
  light chain complementarity determining region 3 for antibody 45046
MQALQSPRT

SEQ ID NO: 90092 - protein, 13 aa, Homo sapiens
  heavy chain complementarity determining region 3 for antibody 45046
ARDRLGSGNFFDF

SEQ ID NO: 90093 - protein, 9 aa, Homo sapiens
  light chain complementarity determining region 3 for antibody 45047
MQALQSPFT

SEQ ID NO: 90094 - protein, 20 aa, Homo sapiens
  heavy chain complementarity determining region 3 for antibody 45047
ARPRSPVSRRYLYYHYGMDV

SEQ ID NO: 90095 - protein, 9 aa, Homo sapiens
  light chain complementarity determining region 3 for antibody 45048
MQALQPPLT

SEQ ID NO: 90096 - protein, 9 aa, Homo sapiens
  heavy chain complementarity determining region 3 for antibody 45048
TRDGRADSP

SEQ ID NO: 90097 - protein, 9 aa, Homo sapiens
  light chain complementarity determining region 3 for antibody 45049
MQALHTPLT

SEQ ID NO: 90098 - protein, 21 aa, Homo sapiens
  heavy chain complementarity determining region 3 for antibody 45049
VRSMSHRMAAAGKDYHHGLDV

SEQ ID NO: 90099 - protein, 9 aa, Homo sapiens
  light chain complementarity determining region 3 for antibody 45050
MQAAHWPHT

SEQ ID NO: 90100 - protein, 12 aa, Homo sapiens
  heavy chain complementarity determining region 3 for antibody 45050
ARGARDSSGVDY

SEQ ID NO: 90101 - protein, 9 aa, Homo sapiens
  light chain complementarity determining region 3 for antibody 45051
MHGIFWPGT

SEQ ID NO: 90102 - protein, 10 aa, Homo sapiens
  heavy chain complementarity determining region 3 for antibody 45051
ARDSLGSIDY

SEQ ID NO: 90103 - protein, 9 aa, Homo sapiens
  light chain complementarity determining region 3 for antibody 45052
LQYNNYPCT

SEQ ID NO: 90104 - protein, 9 aa, Homo sapiens
  heavy chain complementarity determining region 3 for antibody 45052
ARDGESFDY

SEQ ID NO: 90105 - protein, 9 aa, Homo sapiens
  light chain complementarity determining region 3 for antibody 45053
LQRSEWPIT

SEQ ID NO: 90106 - protein, 10 aa, Homo sapiens
  heavy chain complementarity determining region 3 for antibody 45053
VRVQKWDLDY

SEQ ID NO: 90107 - protein, 9 aa, Homo sapiens
  light chain complementarity determining region 3 for antibody 45054
LQLNINPIT

SEQ ID NO: 90108 - protein, 18 aa, Homo sapiens
  heavy chain complementarity determining region 3 for antibody 45054
ARDLGIDVVVVTASPFDY

SEQ ID NO: 90109 - protein, 9 aa, Homo sapiens
  light chain complementarity determining region 3 for antibody 45055
LQIQSHPHT

SEQ ID NO: 90110 - protein, 12 aa, Homo sapiens
  heavy chain complementarity determining region 3 for antibody 45055
ASPDIGGSYFDH

SEQ ID NO: 90111 - protein, 9 aa, Homo sapiens
  light chain complementarity determining region 3 for antibody 45056
LQHSLDPWT

SEQ ID NO: 90112 - protein, 7 aa, Homo sapiens
  heavy chain complementarity determining region 3 for antibody 45056
ARGGSDY

SEQ ID NO: 90113 - protein, 9 aa, Homo sapiens
  light chain complementarity determining region 3 for antibody 45057
LQHNSFPYT

SEQ ID NO: 90114 - protein, 13 aa, Homo sapiens
  heavy chain complementarity determining region 3 for antibody 45057
ARSAGDGRDASDI

SEQ ID NO: 90115 - protein, 9 aa, Homo sapiens
  light chain complementarity determining region 3 for antibody 45058
LQHNIYPWT

SEQ ID NO: 90116 - protein, 8 aa, Homo sapiens
  heavy chain complementarity determining region 3 for antibody 45058
VDALDDDY

SEQ ID NO: 90117 - protein, 9 aa, Homo sapiens
  light chain complementarity determining region 3 for antibody 45059
LQHNAYPRS

SEQ ID NO: 90118 - protein, 13 aa, Homo sapiens
  heavy chain complementarity determining region 3 for antibody 45059
ARELYSTSFTFDS

SEQ ID NO: 90119 - protein, 9 aa, Homo sapiens
  light chain complementarity determining region 3 for antibody 45060
LQHETHPGS

SEQ ID NO: 90120 - protein, 17 aa, Homo sapiens
  heavy chain complementarity determining region 3 for antibody 45060
ARRGPAYSGYDWGFFDH

SEQ ID NO: 90121 - protein, 10 aa, Homo sapiens
  light chain complementarity determining region 3 for antibody 45061
LQHDNFPLQA

SEQ ID NO: 90122 - protein, 12 aa, Homo sapiens
  heavy chain complementarity determining region 3 for antibody 45061
ARGHGDNGAGGH

SEQ ID NO: 90123 - protein, 9 aa, Homo sapiens
  light chain complementarity determining region 3 for antibody 45062
LQHDAYPYT

SEQ ID NO: 90124 - protein, 13 aa, Homo sapiens
  heavy chain complementarity determining region 3 for antibody 45062
ARDRPNYNVYLDY

SEQ ID NO: 90125 - protein, 9 aa, Homo sapiens
  light chain complementarity determining region 3 for antibody 45063
LQDYNYPQT

SEQ ID NO: 90126 - protein, 15 aa, Homo sapiens
  heavy chain complementarity determining region 3 for antibody 45063
AKDLNWGSGLGGFDY

SEQ ID NO: 90127 - protein, 9 aa, Homo sapiens
  light chain complementarity determining region 3 for antibody 45064
LQDYNYPLT

SEQ ID NO: 90128 - protein, 12 aa, Homo sapiens
  heavy chain complementarity determining region 3 for antibody 45064
AREERVGAPPDY

SEQ ID NO: 90129 - protein, 9 aa, Homo sapiens
  light chain complementarity determining region 3 for antibody 45065
LQDYDYPRT

SEQ ID NO: 90130 - protein, 13 aa, Homo sapiens
  heavy chain complementarity determining region 3 for antibody 45065
AGVVDYRYNGYDA

SEQ ID NO: 90131 - protein, 9 aa, Homo sapiens
  light chain complementarity determining region 3 for antibody 45066
LQATLWPWT

SEQ ID NO: 90132 - protein, 12 aa, Homo sapiens
  heavy chain complementarity determining region 3 for antibody 45066
ARGTNPYDAFDI

SEQ ID NO: 90133 - protein, 11 aa, Homo sapiens
  light chain complementarity determining region 3 for antibody 45067
LHYNTYSLMYT

SEQ ID NO: 90134 - protein, 18 aa, Homo sapiens
  heavy chain complementarity determining region 3 for antibody 45067
SRGAMSGVALTGTLPPTD

SEQ ID NO: 90135 - protein, 9 aa, Homo sapiens
  light chain complementarity determining region 3 for antibody 45068
LHYNTYPRT

SEQ ID NO: 90136 - protein, 10 aa, Homo sapiens
  heavy chain complementarity determining region 3 for antibody 45068
ARVTGSGSPL

SEQ ID NO: 90137 - protein, 9 aa, Homo sapiens
  light chain complementarity determining region 3 for antibody 45069
HYYGGTPQT

SEQ ID NO: 90138 - protein, 10 aa, Homo sapiens
  heavy chain complementarity determining region 3 for antibody 45069
VLSTTKWGPS

SEQ ID NO: 90139 - protein, 9 aa, Homo sapiens
  light chain complementarity determining region 3 for antibody 45070
HQYSTSPRP

SEQ ID NO: 90140 - protein, 17 aa, Homo sapiens
  heavy chain complementarity determining region 3 for antibody 45070
VKPRETYSSGWVDAFEM

SEQ ID NO: 90141 - protein, 9 aa, Homo sapiens
  light chain complementarity determining region 3 for antibody 45071
HQYNSYSWT

SEQ ID NO: 90142 - protein, 16 aa, Homo sapiens
  heavy chain complementarity determining region 3 for antibody 45071
AREGLVVTGIVDPFDI

SEQ ID NO: 90143 - protein, 9 aa, Homo sapiens
  light chain complementarity determining region 3 for antibody 45072
HQYNNWPFT

SEQ ID NO: 90144 - protein, 10 aa, Homo sapiens
  heavy chain complementarity determining region 3 for antibody 45072
TSGNHPRFEY

SEQ ID NO: 90145 - protein, 9 aa, Homo sapiens
  light chain complementarity determining region 3 for antibody 45073
HQYGTSLYT

SEQ ID NO: 90146 - protein, 16 aa, Homo sapiens
  heavy chain complementarity determining region 3 for antibody 45073
ARAGRDGYKDGIGFDY

SEQ ID NO: 90147 - protein, 9 aa, Homo sapiens
  light chain complementarity determining region 3 for antibody 45074
HQYGNSPWT

SEQ ID NO: 90148 - protein, 9 aa, Homo sapiens
  heavy chain complementarity determining region 3 for antibody 45074
ARWNFAFDI

SEQ ID NO: 90149 - protein, 9 aa, Homo sapiens
  light chain complementarity determining region 3 for antibody 45075
HQYATSPRT

SEQ ID NO: 90150 - protein, 13 aa, Homo sapiens
  heavy chain complementarity determining region 3 for antibody 45075
ATESGSYYGGLDY

SEQ ID NO: 90151 - protein, 9 aa, Homo sapiens
  light chain complementarity determining region 3 for antibody 45076
HQTSSFPHA

SEQ ID NO: 90152 - protein, 14 aa, Homo sapiens
  heavy chain complementarity determining region 3 for antibody 45076
ARPSSGVYYSALDV

SEQ ID NO: 90153 - protein, 9 aa, Homo sapiens
  light chain complementarity determining region 3 for antibody 45077
HQSSYVPRT

SEQ ID NO: 90154 - protein, 19 aa, Homo sapiens
  heavy chain complementarity determining region 3 for antibody 45077
ARDRPSSRRFLEWLLPFDY

SEQ ID NO: 90155 - protein, 9 aa, Homo sapiens
  light chain complementarity determining region 3 for antibody 45078
HQSSSLKGT

SEQ ID NO: 90156 - protein, 18 aa, Homo sapiens
  heavy chain complementarity determining region 3 for antibody 45078
ARGSPREYSVYDSEAFDI

SEQ ID NO: 90157 - protein, 9 aa, Homo sapiens
  light chain complementarity determining region 3 for antibody 45079
HQSGTLPWT

SEQ ID NO: 90158 - protein, 14 aa, Homo sapiens
  heavy chain complementarity determining region 3 for antibody 45079
IMDASGTGGWYADS

SEQ ID NO: 90159 - protein, 9 aa, Homo sapiens
  light chain complementarity determining region 3 for antibody 45080
HQHAYAPLP

SEQ ID NO: 90160 - protein, 10 aa, Homo sapiens
  heavy chain complementarity determining region 3 for antibody 45080
ARTSGWLGDY

SEQ ID NO: 90161 - protein, 10 aa, Homo sapiens
  light chain complementarity determining region 3 for antibody 45081
HHYNNWPSDS

SEQ ID NO: 90162 - protein, 18 aa, Homo sapiens
  heavy chain complementarity determining region 3 for antibody 45081
ARGGYDYGWGSYGVYFDY

SEQ ID NO: 90163 - protein, 9 aa, Homo sapiens
  light chain complementarity determining region 3 for antibody 45082
EQYDNSPIT

SEQ ID NO: 90164 - protein, 12 aa, Homo sapiens
  heavy chain complementarity determining region 3 for antibody 45082
VHKAPNNWYFDL

SEQ ID NO: 90165 - protein, 10 aa, Homo sapiens
  light chain complementarity determining region 3 for antibody 45083
VQTLQTPPWT

SEQ ID NO: 90166 - protein, 11 aa, Homo sapiens
  heavy chain complementarity determining region 3 for antibody 45083
ARSGDSWPFDF

SEQ ID NO: 90167 - protein, 10 aa, Homo sapiens
  light chain complementarity determining region 3 for antibody 45084
TQALQTPPIT

SEQ ID NO: 90168 - protein, 16 aa, Homo sapiens
  heavy chain complementarity determining region 3 for antibody 45084
AREGWHRGYMYGGFDY

SEQ ID NO: 90169 - protein, 9 aa, Homo sapiens
  light chain complementarity determining region 3 for antibody 45085
RQYGSAPGM

SEQ ID NO: 90170 - protein, 15 aa, Homo sapiens
  heavy chain complementarity determining region 3 for antibody 45085
ARDGVGGGLYFGESR

SEQ ID NO: 90171 - protein, 6 aa, Homo sapiens
  light chain complementarity determining region 3 for antibody 45086
QYLGLT

SEQ ID NO: 90172 - protein, 18 aa, Homo sapiens
  heavy chain complementarity determining region 3 for antibody 45086
TTDLSLRYYDYASYLASG

SEQ ID NO: 90173 - protein, 11 aa, Homo sapiens
  light chain complementarity determining region 3 for antibody 45087
QRRNNFPAEYT

SEQ ID NO: 90174 - protein, 15 aa, Homo sapiens
  heavy chain complementarity determining region 3 for antibody 45087
AREGVERLTMSAFDL

SEQ ID NO: 90175 - protein, 9 aa, Homo sapiens
  light chain complementarity determining region 3 for antibody 45088
QRNNDYPFT

SEQ ID NO: 90176 - protein, 13 aa, Homo sapiens
  heavy chain complementarity determining region 3 for antibody 45088
ARIPRYSSGWSDY

SEQ ID NO: 90177 - protein, 9 aa, Homo sapiens
  light chain complementarity determining region 3 for antibody 45089
QQYYTIPYT

SEQ ID NO: 90178 - protein, 17 aa, Homo sapiens
  heavy chain complementarity determining region 3 for antibody 45089
ARDDTAMAKVAYWYFNV

SEQ ID NO: 90179 - protein, 9 aa, Homo sapiens
  light chain complementarity determining region 3 for antibody 45090
QQYYSTPYT

SEQ ID NO: 90180 - protein, 12 aa, Homo sapiens
  heavy chain complementarity determining region 3 for antibody 45090
MTDPIEALILGY

SEQ ID NO: 90181 - protein, 9 aa, Homo sapiens
  light chain complementarity determining region 3 for antibody 45091
QQYYSTPPT

SEQ ID NO: 90182 - protein, 11 aa, Homo sapiens
  heavy chain complementarity determining region 3 for antibody 45091
TRVYSWGVYSY

SEQ ID NO: 90183 - protein, 9 aa, Homo sapiens
  light chain complementarity determining region 3 for antibody 45092
QQYYSTPLT

SEQ ID NO: 90184 - protein, 13 aa, Homo sapiens
  heavy chain complementarity determining region 3 for antibody 45092
ATVSGSGYHWFDP

SEQ ID NO: 90185 - protein, 10 aa, Homo sapiens
  light chain complementarity determining region 3 for antibody 45093
QQYYSNPPWT

SEQ ID NO: 90186 - protein, 10 aa, Homo sapiens
  heavy chain complementarity determining region 3 for antibody 45093
ARERQRALDY

SEQ ID NO: 90187 - protein, 11 aa, Homo sapiens
  light chain complementarity determining region 3 for antibody 45094
QQYYRWPPGGT

SEQ ID NO: 90188 - protein, 12 aa, Homo sapiens
  heavy chain complementarity determining region 3 for antibody 45094
AILYSSGTPLGY

SEQ ID NO: 90189 - protein, 9 aa, Homo sapiens
  light chain complementarity determining region 3 for antibody 45095
QQYYNYPYT

SEQ ID NO: 90190 - protein, 16 aa, Homo sapiens
  heavy chain complementarity determining region 3 for antibody 45095
ARDRVRNTSPERAFDY

SEQ ID NO: 90191 - protein, 9 aa, Homo sapiens
  light chain complementarity determining region 3 for antibody 45096
QQYYNTPRT

SEQ ID NO: 90192 - protein, 11 aa, Homo sapiens
  heavy chain complementarity determining region 3 for antibody 45096
ARKGFHAPLDV

SEQ ID NO: 90193 - protein, 9 aa, Homo sapiens
  light chain complementarity determining region 3 for antibody 45097
QQYYKYAYT

SEQ ID NO: 90194 - protein, 10 aa, Homo sapiens
  heavy chain complementarity determining region 3 for antibody 45097
ARDGGFGAVD

SEQ ID NO: 90195 - protein, 9 aa, Homo sapiens
  light chain complementarity determining region 3 for antibody 45098
QQYYKVPYT

SEQ ID NO: 90196 - protein, 16 aa, Homo sapiens
  heavy chain complementarity determining region 3 for antibody 45098
ARHRLTSGPSGYYLNL

SEQ ID NO: 90197 - protein, 9 aa, Homo sapiens
  light chain complementarity determining region 3 for antibody 45099
QQYYGTPRT

SEQ ID NO: 90198 - protein, 12 aa, Homo sapiens
  heavy chain complementarity determining region 3 for antibody 45099
AKPKEGVYHFDK

SEQ ID NO: 90199 - protein, 9 aa, Homo sapiens
  light chain complementarity determining region 3 for antibody 45100
QQYYGTART

SEQ ID NO: 90200 - protein, 11 aa, Homo sapiens
  heavy chain complementarity determining region 3 for antibody 45100
AKSGDGNWFET

SEQ ID NO: 90201 - protein, 9 aa, Homo sapiens
  light chain complementarity determining region 3 for antibody 45101
QQYVTSPYH

SEQ ID NO: 90202 - protein, 16 aa, Homo sapiens
  heavy chain complementarity determining region 3 for antibody 45101
ARGRGSFYDTLGWFDP

SEQ ID NO: 90203 - protein, 10 aa, Homo sapiens
  light chain complementarity determining region 3 for antibody 45102
QQYTSSSIYT

SEQ ID NO: 90204 - protein, 9 aa, Homo sapiens
  heavy chain complementarity determining region 3 for antibody 45102
VREDWGIDY

SEQ ID NO: 90205 - protein, 8 aa, Homo sapiens
  light chain complementarity determining region 3 for antibody 45103
QQYTNYCT

SEQ ID NO: 90206 - protein, 18 aa, Homo sapiens
  heavy chain complementarity determining region 3 for antibody 45103
ARVDPLWSGQPSYWYFDL

SEQ ID NO: 90207 - protein, 9 aa, Homo sapiens
  light chain complementarity determining region 3 for antibody 45104
QQYSVLPLS

SEQ ID NO: 90208 - protein, 14 aa, Homo sapiens
  heavy chain complementarity determining region 3 for antibody 45104
ARGYNSGAYNPFHY

SEQ ID NO: 90209 - protein, 8 aa, Homo sapiens
  light chain complementarity determining region 3 for antibody 45105
QQYSSSIT

SEQ ID NO: 90210 - protein, 13 aa, Homo sapiens
  heavy chain complementarity determining region 3 for antibody 45105
ARVVAGDFDVFDI

SEQ ID NO: 90211 - protein, 9 aa, Homo sapiens
  light chain complementarity determining region 3 for antibody 45106
QQYSSDSNT

SEQ ID NO: 90212 - protein, 13 aa, Homo sapiens
  heavy chain complementarity determining region 3 for antibody 45106
ARRHIGTQGAFDI

SEQ ID NO: 90213 - protein, 8 aa, Homo sapiens
  light chain complementarity determining region 3 for antibody 45107
QQYSRPGT

SEQ ID NO: 90214 - protein, 19 aa, Homo sapiens
  heavy chain complementarity determining region 3 for antibody 45107
AKPYENSDYYSNQGYYFDS

SEQ ID NO: 90215 - protein, 8 aa, Homo sapiens
  light chain complementarity determining region 3 for antibody 45108
QQYSDWQT

SEQ ID NO: 90216 - protein, 13 aa, Homo sapiens
  heavy chain complementarity determining region 3 for antibody 45108
ARANDYGDYYFDY

SEQ ID NO: 90217 - protein, 9 aa, Homo sapiens
  light chain complementarity determining region 3 for antibody 45109
QQYSDSPYT

SEQ ID NO: 90218 - protein, 12 aa, Homo sapiens
  heavy chain complementarity determining region 3 for antibody 45109
TKQPHSRSWSDL

SEQ ID NO: 90219 - protein, 8 aa, Homo sapiens
  light chain complementarity determining region 3 for antibody 45110
QQYRSSFP

SEQ ID NO: 90220 - protein, 15 aa, Homo sapiens
  heavy chain complementarity determining region 3 for antibody 45110
AKVSHRLSSDISFES

SEQ ID NO: 90221 - protein, 8 aa, Homo sapiens
  light chain complementarity determining region 3 for antibody 45111
QQYRNGET

SEQ ID NO: 90222 - protein, 10 aa, Homo sapiens
  heavy chain complementarity determining region 3 for antibody 45111
ARDLAFGIDY

SEQ ID NO: 90223 - protein, 9 aa, Homo sapiens
  light chain complementarity determining region 3 for antibody 45112
QQYNTYPYT

SEQ ID NO: 90224 - protein, 13 aa, Homo sapiens
  heavy chain complementarity determining region 3 for antibody 45112
ARDRGHRPDEFDY

SEQ ID NO: 90225 - protein, 9 aa, Homo sapiens
  light chain complementarity determining region 3 for antibody 45113
QQYNTWPWT

SEQ ID NO: 90226 - protein, 9 aa, Homo sapiens
  heavy chain complementarity determining region 3 for antibody 45113
ARRLLGFDV

SEQ ID NO: 90227 - protein, 10 aa, Homo sapiens
  light chain complementarity determining region 3 for antibody 45114
QQYNTWPPIT

SEQ ID NO: 90228 - protein, 15 aa, Homo sapiens
  heavy chain complementarity determining region 3 for antibody 45114
AREGSTGYIRGHCDY

SEQ ID NO: 90229 - protein, 9 aa, Homo sapiens
  light chain complementarity determining region 3 for antibody 45115
QQYNTWPLT

SEQ ID NO: 90230 - protein, 14 aa, Homo sapiens
  heavy chain complementarity determining region 3 for antibody 45115
GRDIRAGWLRNVDY

SEQ ID NO: 90231 - protein, 8 aa, Homo sapiens
  light chain complementarity determining region 3 for antibody 45116
QQYNTSWT

SEQ ID NO: 90232 - protein, 19 aa, Homo sapiens
  heavy chain complementarity determining region 3 for antibody 45116
AKDNYYGSGSYELSWFFDL

SEQ ID NO: 90233 - protein, 9 aa, Homo sapiens
  light chain complementarity determining region 3 for antibody 45117
QQYNTFSGT

SEQ ID NO: 90234 - protein, 10 aa, Homo sapiens
  heavy chain complementarity determining region 3 for antibody 45117
ARAVGTYFDS

SEQ ID NO: 90235 - protein, 10 aa, Homo sapiens
  light chain complementarity determining region 3 for antibody 45118
QQYNSYSVWT

SEQ ID NO: 90236 - protein, 14 aa, Homo sapiens
  heavy chain complementarity determining region 3 for antibody 45118
ASVRGMVRSHAFDR

SEQ ID NO: 90237 - protein, 8 aa, Homo sapiens
  light chain complementarity determining region 3 for antibody 45119
QQYNSYST

SEQ ID NO: 90238 - protein, 18 aa, Homo sapiens
  heavy chain complementarity determining region 3 for antibody 45119
ARGYYDILIAWGPDAFDI

SEQ ID NO: 90239 - protein, 9 aa, Homo sapiens
  light chain complementarity determining region 3 for antibody 45120
QQYNSYSRT

SEQ ID NO: 90240 - protein, 16 aa, Homo sapiens
  heavy chain complementarity determining region 3 for antibody 45120
ARDEGLAGDYSRYFDL

SEQ ID NO: 90241 - protein, 12 aa, Homo sapiens
  light chain complementarity determining region 3 for antibody 45121
QQYNSYSRGGFP

SEQ ID NO: 90242 - protein, 16 aa, Homo sapiens
  heavy chain complementarity determining region 3 for antibody 45121
AKGSSGGPGQNNAFDF

SEQ ID NO: 90243 - protein, 10 aa, Homo sapiens
  light chain complementarity determining region 3 for antibody 45122
QQYNSYSPFT

SEQ ID NO: 90244 - protein, 13 aa, Homo sapiens
  heavy chain complementarity determining region 3 for antibody 45122
AHMPATSGRYFDY

SEQ ID NO: 90245 - protein, 9 aa, Homo sapiens
  light chain complementarity determining region 3 for antibody 45123
QQYNSYPYT

SEQ ID NO: 90246 - protein, 15 aa, Homo sapiens
  heavy chain complementarity determining region 3 for antibody 45123
GRDYYDVLTHYYVDS

SEQ ID NO: 90247 - protein, 9 aa, Homo sapiens
  light chain complementarity determining region 3 for antibody 45124
QQYNSYPYT

SEQ ID NO: 90248 - protein, 8 aa, Homo sapiens
  heavy chain complementarity determining region 3 for antibody 45124
ASFPARAY

SEQ ID NO: 90249 - protein, 9 aa, Homo sapiens
  light chain complementarity determining region 3 for antibody 45125
QQYNSYPRT

SEQ ID NO: 90250 - protein, 17 aa, Homo sapiens
  heavy chain complementarity determining region 3 for antibody 45125
ARDLRRGIAVASTVDDH

SEQ ID NO: 90251 - protein, 9 aa, Homo sapiens
  light chain complementarity determining region 3 for antibody 45126
QQYNSYPLT

SEQ ID NO: 90252 - protein, 18 aa, Homo sapiens
  heavy chain complementarity determining region 3 for antibody 45126
AKRTGSRSNWNDEGPFDY

SEQ ID NO: 90253 - protein, 9 aa, Homo sapiens
  light chain complementarity determining region 3 for antibody 45127
QQYNSYPFT

SEQ ID NO: 90254 - protein, 14 aa, Homo sapiens
  heavy chain complementarity determining region 3 for antibody 45127
AKGRQAGEYYNEDD

SEQ ID NO: 90255 - protein, 8 aa, Homo sapiens
  light chain complementarity determining region 3 for antibody 45128
QQYNSWPT

SEQ ID NO: 90256 - protein, 18 aa, Homo sapiens
  heavy chain complementarity determining region 3 for antibody 45128
ARRLFFSNYGDYVGWFDP

SEQ ID NO: 90257 - protein, 9 aa, Homo sapiens
  light chain complementarity determining region 3 for antibody 45129
QQYNSWPHT

SEQ ID NO: 90258 - protein, 13 aa, Homo sapiens
  heavy chain complementarity determining region 3 for antibody 45129
AKWAAGGVGYFNH

SEQ ID NO: 90259 - protein, 9 aa, Homo sapiens
  light chain complementarity determining region 3 for antibody 45130
QQYNSFALT

SEQ ID NO: 90260 - protein, 14 aa, Homo sapiens
  heavy chain complementarity determining region 3 for antibody 45130
AKGGSETAMITFAS

SEQ ID NO: 90261 - protein, 8 aa, Homo sapiens
  light chain complementarity determining region 3 for antibody 45131
QQYNNWRT

SEQ ID NO: 90262 - protein, 18 aa, Homo sapiens
  heavy chain complementarity determining region 3 for antibody 45131
ARDLREQCHLSRCDNFDY

SEQ ID NO: 90263 - protein, 9 aa, Homo sapiens
  light chain complementarity determining region 3 for antibody 45132
QQYNNWPYT

SEQ ID NO: 90264 - protein, 12 aa, Homo sapiens
  heavy chain complementarity determining region 3 for antibody 45132
AHIPVGRDAFDI

SEQ ID NO: 90265 - protein, 9 aa, Homo sapiens
  light chain complementarity determining region 3 for antibody 45133
QQYNNWPRT

SEQ ID NO: 90266 - protein, 18 aa, Homo sapiens
  heavy chain complementarity determining region 3 for antibody 45133
ARVFVRARRYDTGWYKSD

SEQ ID NO: 90267 - protein, 8 aa, Homo sapiens
  light chain complementarity determining region 3 for antibody 45134
QQYNNWPR

SEQ ID NO: 90268 - protein, 18 aa, Homo sapiens
  heavy chain complementarity determining region 3 for antibody 45134
ARGFYSEKTDHHPTLWDS

SEQ ID NO: 90269 - protein, 10 aa, Homo sapiens
  light chain complementarity determining region 3 for antibody 45135
QQYNNWPPYT

SEQ ID NO: 90270 - protein, 17 aa, Homo sapiens
  heavy chain complementarity determining region 3 for antibody 45135
ARADYVGGNYRYDAFDI

SEQ ID NO: 90271 - protein, 10 aa, Homo sapiens
  light chain complementarity determining region 3 for antibody 45136
QQYNNWPPYT

SEQ ID NO: 90272 - protein, 10 aa, Homo sapiens
  heavy chain complementarity determining region 3 for antibody 45136
AGGRRAGVDY

SEQ ID NO: 90273 - protein, 10 aa, Homo sapiens [sequence omitted]

SEQ ID NO: 90274 - protein, 11 aa, Homo sapiens
  heavy chain complementarity determining region 3 for antibody 45137
AVHDGWLSPSY

SEQ ID NO: 90275 - protein, 10 aa, Homo sapiens
  light chain complementarity determining region 3 for antibody 45138
QQYNNWPPLT

SEQ ID NO: 90276 - protein, 18 aa, Homo sapiens
  heavy chain complementarity determining region 3 for antibody 45138
AKSPDRLDSPGVYYAMDV

SEQ ID NO: 90277 - protein, 10 aa, Homo sapiens
  light chain complementarity determining region 3 for antibody 45139
QQYNNWPPIT

SEQ ID NO: 90278 - protein, 13 aa, Homo sapiens
  heavy chain complementarity determining region 3 for antibody 45139
AKDIFPRPEYFDS

SEQ ID NO: 90279 - protein, 10 aa, Homo sapiens
  light chain complementarity determining region 3 for antibody 45140
QQYNNWPPGT

SEQ ID NO: 90280 - protein, 14 aa, Homo sapiens
  heavy chain complementarity determining region 3 for antibody 45140
ARAPYDYGAQPFDY

SEQ ID NO: 90281 - protein, 9 aa, Homo sapiens
  light chain complementarity determining region 3 for antibody 45141
QQYNNLPLT

SEQ ID NO: 90282 - protein, 16 aa, Homo sapiens
  heavy chain complementarity determining region 3 for antibody 45141
ARQRYNWNEVVGAFDI

SEQ ID NO: 90283 - protein, 8 aa, Homo sapiens
  light chain complementarity determining region 3 for antibody 45142
QQYNIYWT

SEQ ID NO: 90284 - protein, 21 aa, Homo sapiens
  heavy chain complementarity determining region 3 for antibody 45142
AQGSGRPNYYDSSTYFIAFHI

SEQ ID NO: 90285 - protein, 9 aa, Homo sapiens
  light chain complementarity determining region 3 for antibody 45143
QQYNGYPWT

SEQ ID NO: 90286 - protein, 10 aa, Homo sapiens
  heavy chain complementarity determining region 3 for antibody 45143
ARDSGYGIEY

SEQ ID NO: 90287 - protein, 9 aa, Homo sapiens
  light chain complementarity determining region 3 for antibody 45144
QQYNDWPWT

SEQ ID NO: 90288 - protein, 9 aa, Homo sapiens
  heavy chain complementarity determining region 3 for antibody 45144
ARGRLHYAL

SEQ ID NO: 90289 - protein, 9 aa, Homo sapiens
  light chain complementarity determining region 3 for antibody 45145
QQYNDRPLT

SEQ ID NO: 90290 - protein, 16 aa, Homo sapiens
  heavy chain complementarity determining region 3 for antibody 45145
ARWGVECSGGYCYFEY

SEQ ID NO: 90291 - protein, 8 aa, Homo sapiens
  light chain complementarity determining region 3 for antibody 45146
QQYNDRLS

SEQ ID NO: 90292 - protein, 19 aa, Homo sapiens
  heavy chain complementarity determining region 3 for antibody 45146
VRGTSGRFGELATIRYFDY

SEQ ID NO: 90293 - protein, 9 aa, Homo sapiens
  light chain complementarity determining region 3 for antibody 45147
QQYNAYPWM

SEQ ID NO: 90294 - protein, 24 aa, Homo sapiens
  heavy chain complementarity determining region 3 for antibody 45147
ARERAPSGYCSGGRCYSSSALLDY

SEQ ID NO: 90295 - protein, 9 aa, Homo sapiens
  light chain complementarity determining region 3 for antibody 45148
QQYKTYPYN

SEQ ID NO: 90296 - protein, 14 aa, Homo sapiens
  heavy chain complementarity determining region 3 for antibody 45148
ARGSIAAAGTAFDV

SEQ ID NO: 90297 - protein, 10 aa, Homo sapiens
  light chain complementarity determining region 3 for antibody 45149
QQYKNWRPLT

SEQ ID NO: 90298 - protein, 17 aa, Homo sapiens
  heavy chain complementarity determining region 3 for antibody 45149
ARGPAPFGHSYGYYLDY

SEQ ID NO: 90299 - protein, 8 aa, Homo sapiens
  light chain complementarity determining region 3 for antibody 45150
QQYIYWQT

SEQ ID NO: 90300 - protein, 13 aa, Homo sapiens
  heavy chain complementarity determining region 3 for antibody 45150
ARKGGGDYYYFPY

SEQ ID NO: 90301 - protein, 9 aa, Homo sapiens
  light chain complementarity determining region 3 for antibody 45151
QQYISSPWT

SEQ ID NO: 90302 - protein, 13 aa, Homo sapiens
  heavy chain complementarity determining region 3 for antibody 45151
AGVIGYSMNYFHY

SEQ ID NO: 90303 - protein, 10 aa, Homo sapiens
  light chain complementarity determining region 3 for antibody 45152
QQYHYWPPLT

SEQ ID NO: 90304 - protein, 19 aa, Homo sapiens
  heavy chain complementarity determining region 3 for antibody 45152
ARDSGLWSGSHLPKAHSDC

SEQ ID NO: 90305 - protein, 8 aa, Homo sapiens
  light chain complementarity determining region 3 for antibody 45153
QQYHTYST

SEQ ID NO: 90306 - protein, 13 aa, Homo sapiens
  heavy chain complementarity determining region 3 for antibody 45153
AGSARSNNWLKQY

SEQ ID NO: 90307 - protein, 8 aa, Homo sapiens
  light chain complementarity determining region 3 for antibody 45154
QQYHTNWT

SEQ ID NO: 90308 - protein, 14 aa, Homo sapiens
  heavy chain complementarity determining region 3 for antibody 45154
ARDQTRVGPTTFDF

SEQ ID NO: 90309 - protein, 9 aa, Homo sapiens
  light chain complementarity determining region 3 for antibody 45155
QQYHSYSRA

SEQ ID NO: 90310 - protein, 17 aa, Homo sapiens
  heavy chain complementarity determining region 3 for antibody 45155
AKDSATRPVRGGSYFDS

SEQ ID NO: 90311 - protein, 9 aa, Homo sapiens
  light chain complementarity determining region 3 for antibody 45156
QQYHRSQFT

SEQ ID NO: 90312 - protein, 16 aa, Homo sapiens
  heavy chain complementarity determining region 3 for antibody 45156
ARSDCRSTSCYAIFDY

SEQ ID NO: 90313 - protein, 9 aa, Homo sapiens
  light chain complementarity determining region 3 for antibody 45157
QQYGTSPWT

SEQ ID NO: 90314 - protein, 15 aa, Homo sapiens
  heavy chain complementarity determining region 3 for antibody 45157
AGSRFTYGYRAAFGI

SEQ ID NO: 90315 - protein, 8 aa, Homo sapiens
  light chain complementarity determining region 3 for antibody 45158
QQYGTSPT

SEQ ID NO: 90316 - protein, 16 aa, Homo sapiens
  heavy chain complementarity determining region 3 for antibody 45158
AKVADSSSWYSGYFDH

SEQ ID NO: 90317 - protein, 10 aa, Homo sapiens
  light chain complementarity determining region 3 for antibody 45159
QQYGTSPGIT

SEQ ID NO: 90318 - protein, 10 aa, Homo sapiens
  heavy chain complementarity determining region 3 for antibody 45159
ARVTGSGSPL

SEQ ID NO: 90319 - protein, 9 aa, Homo sapiens
  light chain complementarity determining region 3 for antibody 45160
QQYGTSPFT

SEQ ID NO: 90320 - protein, 18 aa, Homo sapiens
  heavy chain complementarity determining region 3 for antibody 45160
ARGLYCIGTSCYSNWFDP

SEQ ID NO: 90321 - protein, 9 aa, Homo sapiens
  light chain complementarity determining region 3 for antibody 45161
QQYGTSPET

SEQ ID NO: 90322 - protein, 18 aa, Homo sapiens
  heavy chain complementarity determining region 3 for antibody 45161
AVTPKEILELRPVAWLDT

SEQ ID NO: 90323 - protein, 10 aa, Homo sapiens
  light chain complementarity determining region 3 for antibody 45162
QQYGTAPPNT

SEQ ID NO: 90324 - protein, 12 aa, Homo sapiens
  heavy chain complementarity determining region 3 for antibody 45162
ANEVGPAPAYDV

SEQ ID NO: 90325 - protein, 9 aa, Homo sapiens
  light chain complementarity determining region 3 for antibody 45163
QQYGSTPRT

SEQ ID NO: 90326 - protein, 20 aa, Homo sapiens
  heavy chain complementarity determining region 3 for antibody 45163
AREGGSISMILEVEDDATDI

SEQ ID NO: 90327 - protein, 9 aa, Homo sapiens
  light chain complementarity determining region 3 for antibody 45164
QQYGSTPQT

SEQ ID NO: 90328 - protein, 11 aa, Homo sapiens
  heavy chain complementarity determining region 3 for antibody 45164
ARGPSGGNFDY

SEQ ID NO: 90329 - protein, 9 aa, Homo sapiens
  light chain complementarity determining region 3 for antibody 45165
QQYGSSRWT

SEQ ID NO: 90330 - protein, 11 aa, Homo sapiens
  heavy chain complementarity determining region 3 for antibody 45165
ATWTMVNAFDI

SEQ ID NO: 90331 - protein, 9 aa, Homo sapiens
  light chain complementarity determining region 3 for antibody 45166
QQYGSSQWT

SEQ ID NO: 90332 - protein, 24 aa, Homo sapiens
  heavy chain complementarity determining region 3 for antibody 45166
ARDRFLGEYDSDFYIPESANGMDV

SEQ ID NO: 90333 - protein, 9 aa, Homo sapiens
  light chain complementarity determining region 3 for antibody 45167
QQYGSSPYT

SEQ ID NO: 90334 - protein, 14 aa, Homo sapiens
  heavy chain complementarity determining region 3 for antibody 45167
VRLHSSGYFVQFDY

SEQ ID NO: 90335 - protein, 9 aa, Homo sapiens
  light chain complementarity determining region 3 for antibody 45168
QQYGSSPYA

SEQ ID NO: 90336 - protein, 13 aa, Homo sapiens
  heavy chain complementarity determining region 3 for antibody 45168
ARGESYSGRIFDY

SEQ ID NO: 90337 - protein, 9 aa, Homo sapiens
  light chain complementarity determining region 3 for antibody 45169
QQYGSSPVT

SEQ ID NO: 90338 - protein, 19 aa, Homo sapiens
  heavy chain complementarity determining region 3 for antibody 45169
ATQSDYSGDVGHYFNGLDV

SEQ ID NO: 90339 - protein, 10 aa, Homo sapiens
  light chain complementarity determining region 3 for antibody 45170
QQYGSSPSRT

SEQ ID NO: 90340 - protein, 25 aa, Homo sapiens
  heavy chain complementarity determining region 3 for antibody 45170
ARQNTYYYDRGGDFEGDFYYYGMDV

SEQ ID NO: 90341 - protein, 9 aa, Homo sapiens
  light chain complementarity determining region 3 for antibody 45171
QQYGSSPRT

SEQ ID NO: 90342 - protein, 21 aa, Homo sapiens
  heavy chain complementarity determining region 3 for antibody 45171
ARGAVRGFSSGRYSGYDYFHH

SEQ ID NO: 90343 - protein, 10 aa, Homo sapiens
  light chain complementarity determining region 3 for antibody 45172
QQYGSSPRIT

SEQ ID NO: 90344 - protein, 17 aa, Homo sapiens
  heavy chain complementarity determining region 3 for antibody 45172
ARDYGSGIYKHFAWFDS

SEQ ID NO: 90345 - protein, 10 aa, Homo sapiens
  light chain complementarity determining region 3 for antibody 45173
QQYGSSPPYT

SEQ ID NO: 90346 - protein, 10 aa, Homo sapiens
  heavy chain complementarity determining region 3 for antibody 45173
ARDPPGEGIF

SEQ ID NO: 90347 - protein, 10 aa, Homo sapiens
  light chain complementarity determining region 3 for antibody 45174
QQYGSSPPYT

SEQ ID NO: 90348 - protein, 21 aa, Homo sapiens
  heavy chain complementarity determining region 3 for antibody 45174
AAAKLSRRGAAFLWDLPPFDS

SEQ ID NO: 90349 - protein, 9 aa, Homo sapiens
  light chain complementarity determining region 3 for antibody 45175
QQYGSSPPT

SEQ ID NO: 90350 - protein, 13 aa, Homo sapiens
  heavy chain complementarity determining region 3 for antibody 45175
ATVRSVGDYSLDF

SEQ ID NO: 90351 - protein, 9 aa, Homo sapiens
  light chain complementarity determining region 3 for antibody 45176
QQYGSSPPP

SEQ ID NO: 90352 - protein, 15 aa, Homo sapiens
  heavy chain complementarity determining region 3 for antibody 45176
ARRISDSSGFFYVDN

SEQ ID NO: 90353 - protein, 11 aa, Homo sapiens
  light chain complementarity determining region 3 for antibody 45177
QQYGSSPPMYP

SEQ ID NO: 90354 - protein, 16 aa, Homo sapiens
  heavy chain complementarity determining region 3 for antibody 45177
VRVHGVYYYYYYGLGV

SEQ ID NO: 90355 - protein, 11 aa, Homo sapiens
  light chain complementarity determining region 3 for antibody 45178
QQYGSSPPMYP

SEQ ID NO: 90356 - protein, 19 aa, Homo sapiens
  heavy chain complementarity determining region 3 for antibody 45178
ARDGGLVVVPAATRSYFDF

SEQ ID NO: 90357 - protein, 10 aa, Homo sapiens
  light chain complementarity determining region 3 for antibody 45179
QQYGSSPPIT

SEQ ID NO: 90358 - protein, 12 aa, Homo sapiens
  heavy chain complementarity determining region 3 for antibody 45179
ARGGGLLRRYQH

SEQ ID NO: 90359 - protein, 9 aa, Homo sapiens
  light chain complementarity determining region 3 for antibody 45180
QQYGSSPLT

SEQ ID NO: 90360 - protein, 13 aa, Homo sapiens
  heavy chain complementarity determining region 3 for antibody 45180
VRVSSKTYGAYDI

SEQ ID NO: 90361 - protein, 9 aa, Homo sapiens
  light chain complementarity determining region 3 for antibody 45181
QQYGSSPFT

SEQ ID NO: 90362 - protein, 15 aa, Homo sapiens
  heavy chain complementarity determining region 3 for antibody 45181
ARGGGSGYYPWRFDY

SEQ ID NO: 90363 - protein, 8 aa, Homo sapiens
  light chain complementarity determining region 3 for antibody 45182
QQYGSSLT

SEQ ID NO: 90364 - protein, 17 aa, Homo sapiens
  heavy chain complementarity determining region 3 for antibody 45182
ARDLRAPITAVGDPFDI

SEQ ID NO: 90365 - protein, 9 aa, Homo sapiens
  light chain complementarity determining region 3 for antibody 45183
QQYGSSGYT

SEQ ID NO: 90366 - protein, 17 aa, Homo sapiens
  heavy chain complementarity determining region 3 for antibody 45183
ARPAITEFRGINDAFDI

SEQ ID NO: 90367 - protein, 9 aa, Homo sapiens
  light chain complementarity determining region 3 for antibody 45184
QQYGSLLLT

SEQ ID NO: 90368 - protein, 15 aa, Homo sapiens
  heavy chain complementarity determining region 3 for antibody 45184
AHRPNYYDKAGAFDI

SEQ ID NO: 90369 - protein, 9 aa, Homo sapiens
  light chain complementarity determining region 3 for antibody 45185
QQYGRSPYT

SEQ ID NO: 90370 - protein, 26 aa, Homo sapiens
  heavy chain complementarity determining region 3 for antibody 45185
ARDSDLGYYDDDSGHYFPHRYYGMDV

SEQ ID NO: 90371 - protein, 9 aa, Homo sapiens
  light chain complementarity determining region 3 for antibody 45186
QQYGRSPRT

SEQ ID NO: 90372 - protein, 15 aa, Homo sapiens
  heavy chain complementarity determining region 3 for antibody 45186
AKDGEFCGSNCYFGA

SEQ ID NO: 90373 - protein, 10 aa, Homo sapiens
  light chain complementarity determining region 3 for antibody 45187
QQYGNWPPYT

SEQ ID NO: 90374 - protein, 17 aa, Homo sapiens
  heavy chain complementarity determining region 3 for antibody 45187
AGGGGTAEQYMYPPNNY

SEQ ID NO: 90375 - protein, 9 aa, Homo sapiens
  light chain complementarity determining region 3 for antibody 45188
QQYGNSPYS

SEQ ID NO: 90376 - protein, 12 aa, Homo sapiens
  heavy chain complementarity determining region 3 for antibody 45188
APAWFGPNWRDP

SEQ ID NO: 90377 - protein, 11 aa, Homo sapiens
  light chain complementarity determining region 3 for antibody 45189
QQYGNSPVMYT

SEQ ID NO: 90378 - protein, 15 aa, Homo sapiens
  heavy chain complementarity determining region 3 for antibody 45189
AKDRLIAATSTPLDH

SEQ ID NO: 90379 - protein, 8 aa, Homo sapiens
  light chain complementarity determining region 3 for antibody 45190
QQYGISVT

SEQ ID NO: 90380 - protein, 17 aa, Homo sapiens
  heavy chain complementarity determining region 3 for antibody 45190
ARHAHISDMSGFYPLEH

SEQ ID NO: 90381 - protein, 10 aa, Homo sapiens
  light chain complementarity determining region 3 for antibody 45191
QQYGGSPRYI

SEQ ID NO: 90382 - protein, 15 aa, Homo sapiens
  heavy chain complementarity determining region 3 for antibody 45191
ARLTWIRGDYGPIDY

SEQ ID NO: 90383 - protein, 9 aa, Homo sapiens
  light chain complementarity determining region 3 for antibody 45192
QQYGGSPQT

SEQ ID NO: 90384 - protein, 15 aa, Homo sapiens
  heavy chain complementarity determining region 3 for antibody 45192
ARQPNYGDSSWYFDL

SEQ ID NO: 90385 - protein, 10 aa, Homo sapiens
  light chain complementarity determining region 3 for antibody 45193
QQYGGSPPYT

SEQ ID NO: 90386 - protein, 11 aa, Homo sapiens
  heavy chain complementarity determining region 3 for antibody 45193
ARDLWDIALDY

SEQ ID NO: 90387 - protein, 10 aa, Homo sapiens
  light chain complementarity determining region 3 for antibody 45194
QQYGGSPPWT

SEQ ID NO: 90388 - protein, 14 aa, Homo sapiens
  heavy chain complementarity determining region 3 for antibody 45194
ARGGNSTYYHQFDY

SEQ ID NO: 90389 - protein, 10 aa, Homo sapiens
  light chain complementarity determining region 3 for antibody 45195
QQYGGSPPGT

SEQ ID NO: 90390 - protein, 17 aa, Homo sapiens
  heavy chain complementarity determining region 3 for antibody 45195
ARVQNYFNNSGWGDFDY

SEQ ID NO: 90391 - protein, 9 aa, Homo sapiens
  light chain complementarity determining region 3 for antibody 45196
QQYGGPPRT

SEQ ID NO: 90392 - protein, 20 aa, Homo sapiens
  heavy chain complementarity determining region 3 for antibody 45196
TREGMDHDYGDTHLVYYFDS

SEQ ID NO: 90393 - protein, 8 aa, Homo sapiens
  light chain complementarity determining region 3 for antibody 45197
QQYGDSVT

SEQ ID NO: 90394 - protein, 13 aa, Homo sapiens
  heavy chain complementarity determining region 3 for antibody 45197
AKIGALGKWYFDH

SEQ ID NO: 90395 - protein, 9 aa, Homo sapiens
  light chain complementarity determining region 3 for antibody 45198
QQYGDSRRT

SEQ ID NO: 90396 - protein, 12 aa, Homo sapiens
  heavy chain complementarity determining region 3 for antibody 45198
ARALISHDAFDI

SEQ ID NO: 90397 - protein, 9 aa, Homo sapiens
  light chain complementarity determining region 3 for antibody 45199
QQYFRYPYT

SEQ ID NO: 90398 - protein, 14 aa, Homo sapiens
  heavy chain complementarity determining region 3 for antibody 45199
TTGQDLLFYHGVDV

SEQ ID NO: 90399 - protein, 9 aa, Homo sapiens
  light chain complementarity determining region 3 for antibody 45200
QQYFGAPLT

SEQ ID NO: 90400 - protein, 18 aa, Homo sapiens
  heavy chain complementarity determining region 3 for antibody 45200
ARDRGGDYVISHYYGMDV

SEQ ID NO: 90401 - protein, 9 aa, Homo sapiens
  light chain complementarity determining region 3 for antibody 45201
QQYESYPWT

SEQ ID NO: 90402 - protein, 13 aa, Homo sapiens
  heavy chain complementarity determining region 3 for antibody 45201
VRQSSGSIKAVDV

SEQ ID NO: 90403 - protein, 9 aa, Homo sapiens
  light chain complementarity determining region 3 for antibody 45202
QQYENLPLT

SEQ ID NO: 90404 - protein, 11 aa, Homo sapiens
  heavy chain complementarity determining region 3 for antibody 45202
STWFFLSDVDV

SEQ ID NO: 90405 - protein, 8 aa, Homo sapiens
  light chain complementarity determining region 3 for antibody 45203
QQYDYWYT

SEQ ID NO: 90406 - protein, 21 aa, Homo sapiens
  heavy chain complementarity determining region 3 for antibody 45203
ARDPSEKFFDSSGYYYEYFQE

SEQ ID NO: 90407 - protein, 9 aa, Homo sapiens
  light chain complementarity determining region 3 for antibody 45204
QQYDTYPFT

SEQ ID NO: 90408 - protein, 16 aa, Homo sapiens
  heavy chain complementarity determining region 3 for antibody 45204
AKVQPRYSLNYSPFDH

SEQ ID NO: 90409 - protein, 10 aa, Homo sapiens
  light chain complementarity determining region 3 for antibody 45205
QQYDTWPRGT

SEQ ID NO: 90410 - protein, 9 aa, Homo sapiens
  heavy chain complementarity determining region 3 for antibody 45205
ATGGTYYVS

SEQ ID NO: 90411 - protein, 9 aa, Homo sapiens
  light chain complementarity determining region 3 for antibody 45206
QQYDTSPDT

SEQ ID NO: 90412 - protein, 14 aa, Homo sapiens
  heavy chain complementarity determining region 3 for antibody 45206
AGKKQMVQYFGLGV

SEQ ID NO: 90413 - protein, 9 aa, Homo sapiens
  light chain complementarity determining region 3 for antibody 45207
QQYDSYPYT

SEQ ID NO: 90414 - protein, 18 aa, Homo sapiens
  heavy chain complementarity determining region 3 for antibody 45207
ARGEFCSTTHCPNDAFDF

SEQ ID NO: 90415 - protein, 11 aa, Homo sapiens
  light chain complementarity determining region 3 for antibody 45208
QQYDSYFVMYT

SEQ ID NO: 90416 - protein, 14 aa, Homo sapiens
  heavy chain complementarity determining region 3 for antibody 45208
ARPAAVGVTGWFDL

SEQ ID NO: 90417 - protein, 10 aa, Homo sapiens
  light chain complementarity determining region 3 for antibody 45209
QQYDSIPPRT

SEQ ID NO: 90418 - protein, 12 aa, Homo sapiens
  heavy chain complementarity determining region 3 for antibody 45209
TTGLGTLWVGDH

SEQ ID NO: 90419 - protein, 10 aa, Homo sapiens
  light chain complementarity determining region 3 for antibody 45210
QQYDRSPMYT

SEQ ID NO: 90420 - protein, 16 aa, Homo sapiens
  heavy chain complementarity determining region 3 for antibody 45210
ARREKTYDVHELALKH

SEQ ID NO: 90421 - protein, 10 aa, Homo sapiens
  light chain complementarity determining region 3 for antibody 45211
QQYDNSPPWT

SEQ ID NO: 90422 - protein, 15 aa, Homo sapiens
  heavy chain complementarity determining region 3 for antibody 45211
ASGTSGWLNSGGLLD

SEQ ID NO: 90423 - protein, 9 aa, Homo sapiens
  light chain complementarity determining region 3 for antibody 45212
QQYDNLPLT

SEQ ID NO: 90424 - protein, 14 aa, Homo sapiens
  heavy chain complementarity determining region 3 for antibody 45212
ARSRYCGGDCYLDY

SEQ ID NO: 90425 - protein, 9 aa, Homo sapiens
  light chain complementarity determining region 3 for antibody 45213
QQYDNLPLT

SEQ ID NO: 90426 - protein, 12 aa, Homo sapiens
  heavy chain complementarity determining region 3 for antibody 45213
ARAGDGYTHRVY

SEQ ID NO: 90427 - protein, 9 aa, Homo sapiens
  light chain complementarity determining region 3 for antibody 45214
QQYDNLPLT

SEQ ID NO: 90428 - protein, 13 aa, Homo sapiens
  heavy chain complementarity determining region 3 for antibody 45214
AKGTYSSGYWIDY

SEQ ID NO: 90429 - protein, 10 aa, Homo sapiens
  light chain complementarity determining region 3 for antibody 45215
QQYDNLISYT

SEQ ID NO: 90430 - protein, 14 aa, Homo sapiens
  heavy chain complementarity determining region 3 for antibody 45215
AKARQQLIRGIFDS

SEQ ID NO: 90431 - protein, 9 aa, Homo sapiens
  light chain complementarity determining region 3 for antibody 45216
QQYDNLGLT

SEQ ID NO: 90432 - protein, 19 aa, Homo sapiens
  heavy chain complementarity determining region 3 for antibody 45216
TRGSRNRRDYYDSSGYLDY

SEQ ID NO: 90433 - protein, 9 aa, Homo sapiens
  light chain complementarity determining region 3 for antibody 45217
QQYDKWPLT

SEQ ID NO: 90434 - protein, 14 aa, Homo sapiens
  heavy chain complementarity determining region 3 for antibody 45217
ARLEIVEIPPGKNN

SEQ ID NO: 90435 - protein, 9 aa, Homo sapiens
  light chain complementarity determining region 3 for antibody 45218
QQYDKWPLT

SEQ ID NO: 90436 - protein, 11 aa, Homo sapiens
  heavy chain complementarity determining region 3 for antibody 45218
ARISSDDAFDI

SEQ ID NO: 90437 - protein, 9 aa, Homo sapiens
  light chain complementarity determining region 3 for antibody 45219
QQYDHVVWT

SEQ ID NO: 90438 - protein, 22 aa, Homo sapiens
  heavy chain complementarity determining region 3 for antibody 45219
ARVEYHGSGSYYNPHWYDGLDV

SEQ ID NO: 90439 - protein, 10 aa, Homo sapiens
  light chain complementarity determining region 3 for antibody 45220
QQYDDWPPLT

SEQ ID NO: 90440 - protein, 14 aa, Homo sapiens
  heavy chain complementarity determining region 3 for antibody 45220
ARGVIPVEPGGMDV

SEQ ID NO: 90441 - protein, 9 aa, Homo sapiens
  light chain complementarity determining region 3 for antibody 45221
QQYAISPWT

SEQ ID NO: 90442 - protein, 17 aa, Homo sapiens
  heavy chain complementarity determining region 3 for antibody 45221
ARDANPSKRWPDNYFDP

SEQ ID NO: 90443 - protein, 11 aa, Homo sapiens
  light chain complementarity determining region 3 for antibody 45222
QQYADNSPGYT

SEQ ID NO: 90444 - protein, 18 aa, Homo sapiens
  heavy chain complementarity determining region 3 for antibody 45222
ARANSYSRVPGIVRYFQH

SEQ ID NO: 90445 - protein, 9 aa, Homo sapiens
  light chain complementarity determining region 3 for antibody 45223
QQVYGTPYT

SEQ ID NO: 90446 - protein, 13 aa, Homo sapiens
  heavy chain complementarity determining region 3 for antibody 45223
ARARNYDRITCDI

SEQ ID NO: 90447 - protein, 10 aa, Homo sapiens
  light chain complementarity determining region 3 for antibody 45224
QQTYYTPVIT

SEQ ID NO: 90448 - protein, 12 aa, Homo sapiens
  heavy chain complementarity determining region 3 for antibody 45224
ARDLSRLRLLDY

SEQ ID NO: 90449 - protein, 8 aa, Homo sapiens
  light chain complementarity determining region 3 for antibody 45225
QQTYVTVS

SEQ ID NO: 90450 - protein, 9 aa, Homo sapiens
  heavy chain complementarity determining region 3 for antibody 45225
ARGDYYFDY

SEQ ID NO: 90451 - protein, 9 aa, Homo sapiens
  light chain complementarity determining region 3 for antibody 45226
QQTYSTLWT

SEQ ID NO: 90452 - protein, 17 aa, Homo sapiens
  heavy chain complementarity determining region 3 for antibody 45226
AGKEMYYQDSGARGLDY

SEQ ID NO: 90453 - protein, 9 aa, Homo sapiens
  light chain complementarity determining region 3 for antibody 45227
QQTYSNPST

SEQ ID NO: 90454 - protein, 13 aa, Homo sapiens
  heavy chain complementarity determining region 3 for antibody 45227
ARNGGGYSYGLDY

SEQ ID NO: 90455 - protein, 9 aa, Homo sapiens
  light chain complementarity determining region 3 for antibody 45228
QQTYSDSLT

SEQ ID NO: 90456 - protein, 19 aa, Homo sapiens
  heavy chain complementarity determining region 3 for antibody 45228
AHRGNYYDSSGYLNDAFDV

SEQ ID NO: 90457 - protein, 10 aa, Homo sapiens
  light chain complementarity determining region 3 for antibody 45229
QQTYNAPRIS

SEQ ID NO: 90458 - protein, 11 aa, Homo sapiens
  heavy chain complementarity determining region 3 for antibody 45229
VSTGRRRWVDY

SEQ ID NO: 90459 - protein, 9 aa, Homo sapiens
  light chain complementarity determining region 3 for antibody 45230
QQTYGIPYT

SEQ ID NO: 90460 - protein, 17 aa, Homo sapiens
  heavy chain complementarity determining region 3 for antibody 45230
ARYFRPSFGYDDSRFDY

SEQ ID NO: 90461 - protein, 9 aa, Homo sapiens
  light chain complementarity determining region 3 for antibody 45231
QQTDTSPWT

SEQ ID NO: 90462 - protein, 15 aa, Homo sapiens
  heavy chain complementarity determining region 3 for antibody 45231
ARDVGIDYNEGDRDY

SEQ ID NO: 90463 - protein, 9 aa, Homo sapiens
  light chain complementarity determining region 3 for antibody 45232
QQSYTTPPT

SEQ ID NO: 90464 - protein, 18 aa, Homo sapiens
  heavy chain complementarity determining region 3 for antibody 45232
ATEADVMVITTSYNLFDR

SEQ ID NO: 90465 - protein, 9 aa, Homo sapiens
  light chain complementarity determining region 3 for antibody 45233
QQSYTTPFT

SEQ ID NO: 90466 - protein, 22 aa, Homo sapiens
  heavy chain complementarity determining region 3 for antibody 45233
AVLAGLEVIRGGLPTWRDWFDP

SEQ ID NO: 90467 - protein, 8 aa, Homo sapiens
  light chain complementarity determining region 3 for antibody 45234
QQSYTTGT

SEQ ID NO: 90468 - protein, 11 aa, Homo sapiens
  heavy chain complementarity determining region 3 for antibody 45234
ARMVPDLGGDY

SEQ ID NO: 90469 - protein, 9 aa, Homo sapiens
  light chain complementarity determining region 3 for antibody 45235
QQSYSVPRT

SEQ ID NO: 90470 - protein, 14 aa, Homo sapiens
  heavy chain complementarity determining region 3 for antibody 45235
ARDNHSSGPGYFDY

SEQ ID NO: 90471 - protein, 9 aa, Homo sapiens
  light chain complementarity determining region 3 for antibody 45236
QQSYSTPWT

SEQ ID NO: 90472 - protein, 16 aa, Homo sapiens
  heavy chain complementarity determining region 3 for antibody 45236
ARGDGYTYGSTYGLDV

SEQ ID NO: 90473 - protein, 9 aa, Homo sapiens
  light chain complementarity determining region 3 for antibody 45237
QQSYSTPRT

SEQ ID NO: 90474 - protein, 20 aa, Homo sapiens
  heavy chain complementarity determining region 3 for antibody 45237
ARESGDNLEMPTSPYGALDV

SEQ ID NO: 90475 - protein, 9 aa, Homo sapiens
  light chain complementarity determining region 3 for antibody 45238
QQSYSTPPR

SEQ ID NO: 90476 - protein, 10 aa, Homo sapiens
  heavy chain complementarity determining region 3 for antibody 45238
ARNIKLNFDY

SEQ ID NO: 90477 - protein, 9 aa, Homo sapiens
  light chain complementarity determining region 3 for antibody 45239
QQSYSTPLT

SEQ ID NO: 90478 - protein, 18 aa, Homo sapiens
  heavy chain complementarity determining region 3 for antibody 45239
VRPGWQQLVGSNSLGFDV

SEQ ID NO: 90479 - protein, 9 aa, Homo sapiens
  light chain complementarity determining region 3 for antibody 45240
QQSYSTPLT

SEQ ID NO: 90480 - protein, 14 aa, Homo sapiens
  heavy chain complementarity determining region 3 for antibody 45240
ARVQGSEAYYGMDV

SEQ ID NO: 90481 - protein, 10 aa, Homo sapiens
  light chain complementarity determining region 3 for antibody 45241
QQSYSTPLIT

SEQ ID NO: 90482 - protein, 13 aa, Homo sapiens
  heavy chain complementarity determining region 3 for antibody 45241
ARLPYYGSGNGHY

SEQ ID NO: 90483 - protein, 9 aa, Homo sapiens
  light chain complementarity determining region 3 for antibody 45242
QQSYSTPLA

SEQ ID NO: 90484 - protein, 13 aa, Homo sapiens
  heavy chain complementarity determining region 3 for antibody 45242
AREVQVAGMGVVS

SEQ ID NO: 90485 - protein, 9 aa, Homo sapiens
  light chain complementarity determining region 3 for antibody 45243
QQSYSTLYT

SEQ ID NO: 90486 - protein, 19 aa, Homo sapiens
  heavy chain complementarity determining region 3 for antibody 45243
ARDEGVYGDFVYYFYGMDV

SEQ ID NO: 90487 - protein, 9 aa, Homo sapiens
  light chain complementarity determining region 3 for antibody 45244
QQSYSTLFT

SEQ ID NO: 90488 - protein, 17 aa, Homo sapiens
  heavy chain complementarity determining region 3 for antibody 45244
AGDRSGPRSYYKGPFDP

SEQ ID NO: 90489 - protein, 10 aa, Homo sapiens
  light chain complementarity determining region 3 for antibody 45245
QQSYSTITWT

SEQ ID NO: 90490 - protein, 12 aa, Homo sapiens
  heavy chain complementarity determining region 3 for antibody 45245
ARQDRGLNWFAP

SEQ ID NO: 90491 - protein, 9 aa, Homo sapiens
  light chain complementarity determining region 3 for antibody 45246
QQSYSPVWT

SEQ ID NO: 90492 - protein, 18 aa, Homo sapiens
  heavy chain complementarity determining region 3 for antibody 45246
ARGGQYCSSTSCYAVLDY

SEQ ID NO: 90493 - protein, 9 aa, Homo sapiens
  light chain complementarity determining region 3 for antibody 45247
QQSYSPPLT

SEQ ID NO: 90494 - protein, 14 aa, Homo sapiens
  heavy chain complementarity determining region 3 for antibody 45247
ARGTTVTTTYGMDV

SEQ ID NO: 90495 - protein, 9 aa, Homo sapiens
  light chain complementarity determining region 3 for antibody 45248
QQSYSMSWT

SEQ ID NO: 90496 - protein, 17 aa, Homo sapiens
  heavy chain complementarity determining region 3 for antibody 45248
ARAPFYYDSGSYYYFDY

SEQ ID NO: 90497 - protein, 9 aa, Homo sapiens
  light chain complementarity determining region 3 for antibody 45249
QQSYSMPQT

SEQ ID NO: 90498 - protein, 24 aa, Homo sapiens
  heavy chain complementarity determining region 3 for antibody 45249
AREAPEIPLWSGYSMARRYYGLDV

SEQ ID NO: 90499 - protein, 9 aa, Homo sapiens
  light chain complementarity determining region 3 for antibody 45250
QQSYSIPRT

SEQ ID NO: 90500 - protein, 18 aa, Homo sapiens
  heavy chain complementarity determining region 3 for antibody 45250
ARDRGVHIGRVWYHDLDV

SEQ ID NO: 90501 - protein, 9 aa, Homo sapiens
  light chain complementarity determining region 3 for antibody 45251
QQSYSIPRT

SEQ ID NO: 90502 - protein, 17 aa, Homo sapiens
  heavy chain complementarity determining region 3 for antibody 45251
AKESHYNWNRQHSWFDP

SEQ ID NO: 90503 - protein, 9 aa, Homo sapiens
  light chain complementarity determining region 3 for antibody 45252
QQSYSFPYS

SEQ ID NO: 90504 - protein, 18 aa, Homo sapiens
  heavy chain complementarity determining region 3 for antibody 45252
ARGQIVGATAHYYYGFDV

SEQ ID NO: 90505 - protein, 10 aa, Homo sapiens
  light chain complementarity determining region 3 for antibody 45253
QQSYSAPPFT

SEQ ID NO: 90506 - protein, 21 aa, Homo sapiens
  heavy chain complementarity determining region 3 for antibody 45253
ARDMKHYDSSGNYWPLDVFDI

SEQ ID NO: 90507 - protein, 9 aa, Homo sapiens
  light chain complementarity determining region 3 for antibody 45254
QQSYNTPLT

SEQ ID NO: 90508 - protein, 14 aa, Homo sapiens
  heavy chain complementarity determining region 3 for antibody 45254
VKSGDTSGYSRLDS

SEQ ID NO: 90509 - protein, 9 aa, Homo sapiens
  light chain complementarity determining region 3 for antibody 45255
QQSYITPYT

SEQ ID NO: 90510 - protein, 14 aa, Homo sapiens
  heavy chain complementarity determining region 3 for antibody 45255
ARGGESHNLDYFDF

SEQ ID NO: 90511 - protein, 10 aa, Homo sapiens
  light chain complementarity determining region 3 for antibody 45256
QQSYHNPLYT

SEQ ID NO: 90512 - protein, 13 aa, Homo sapiens
  heavy chain complementarity determining region 3 for antibody 45256
ARDFPRIGGALDL

SEQ ID NO: 90513 - protein, 9 aa, Homo sapiens
  light chain complementarity determining region 3 for antibody 45257
QQSYFIPRT

SEQ ID NO: 90514 - protein, 13 aa, Homo sapiens
  heavy chain complementarity determining region 3 for antibody 45257
STDLDQWVVPLDY

SEQ ID NO: 90515 - protein, 9 aa, Homo sapiens
  light chain complementarity determining region 3 for antibody 45258
QQSSTAPLT

SEQ ID NO: 90516 - protein, 16 aa, Homo sapiens
  heavy chain complementarity determining region 3 for antibody 45258
ARSKSRAVEVEAPFDI

SEQ ID NO: 90517 - protein, 9 aa, Homo sapiens
  light chain complementarity determining region 3 for antibody 45259
QQSSDSPFT

SEQ ID NO: 90518 - protein, 18 aa, Homo sapiens
  heavy chain complementarity determining region 3 for antibody 45259
ALPPKDLMHYYYQYGMDV

SEQ ID NO: 90519 - protein, 9 aa, Homo sapiens
  light chain complementarity determining region 3 for antibody 45260
QQSNRTPYT

SEQ ID NO: 90520 - protein, 18 aa, Homo sapiens
  heavy chain complementarity determining region 3 for antibody 45260
ARAREATIATRYYHGMDV

SEQ ID NO: 90521 - protein, 9 aa, Homo sapiens
  light chain complementarity determining region 3 for antibody 45261
QQSNNYPIT

SEQ ID NO: 90522 - protein, 18 aa, Homo sapiens
  heavy chain complementarity determining region 3 for antibody 45261
VKAHKTEYTAYGRDAFDV

SEQ ID NO: 90523 - protein, 8 aa, Homo sapiens
  light chain complementarity determining region 3 for antibody 45262
QQSNKFWT

SEQ ID NO: 90524 - protein, 16 aa, Homo sapiens
  heavy chain complementarity determining region 3 for antibody 45262
ARESFSCSGGSCYFDY

SEQ ID NO: 90525 - protein, 9 aa, Homo sapiens
  light chain complementarity determining region 3 for antibody 45263
QQSLTYFHT

SEQ ID NO: 90526 - protein, 24 aa, Homo sapiens
  heavy chain complementarity determining region 3 for antibody 45263
ARGSLSFYYDSSGYYYAPGDAYDI

SEQ ID NO: 90527 - protein, 9 aa, Homo sapiens
  light chain complementarity determining region 3 for antibody 45264
QQSHSTPVT

SEQ ID NO: 90528 - protein, 12 aa, Homo sapiens
  heavy chain complementarity determining region 3 for antibody 45264
ASLWFYDSDRDV

SEQ ID NO: 90529 - protein, 9 aa, Homo sapiens
  light chain complementarity determining region 3 for antibody 45265
QQSHSSPNT

SEQ ID NO: 90530 - protein, 13 aa, Homo sapiens
  heavy chain complementarity determining region 3 for antibody 45265
ARSPSPGVHGFDS

SEQ ID NO: 90531 - protein, 9 aa, Homo sapiens
  light chain complementarity determining region 3 for antibody 45266
QQSHITPFT

SEQ ID NO: 90532 - protein, 11 aa, Homo sapiens
  heavy chain complementarity determining region 3 for antibody 45266
AIDRALIGFDD

SEQ ID NO: 90533 - protein, 9 aa, Homo sapiens
  light chain complementarity determining region 3 for antibody 45267
QQSHIAPGT

SEQ ID NO: 90534 - protein, 13 aa, Homo sapiens
  heavy chain complementarity determining region 3 for antibody 45267
ARMFAEDVEAFDI

SEQ ID NO: 90535 - protein, 11 aa, Homo sapiens
  light chain complementarity determining region 3 for antibody 45268
QQSGSSPPMYT

SEQ ID NO: 90536 - protein, 12 aa, Homo sapiens
  heavy chain complementarity determining region 3 for antibody 45268
ARDGHSSNWFGY

SEQ ID NO: 90537 - protein, 10 aa, Homo sapiens
  light chain complementarity determining region 3 for antibody 45269
QQSDGAPPYT

SEQ ID NO: 90538 - protein, 14 aa, Homo sapiens
  heavy chain complementarity determining region 3 for antibody 45269
ARTPPLRVYWYFDL

SEQ ID NO: 90539 - protein, 9 aa, Homo sapiens
  light chain complementarity determining region 3 for antibody 45270
QQSASSPHT

SEQ ID NO: 90540 - protein, 18 aa, Homo sapiens
  heavy chain complementarity determining region 3 for antibody 45270
ARRTQKISVGGVIVVLDY

SEQ ID NO: 90541 - protein, 10 aa, Homo sapiens
  light chain complementarity determining region 3 for antibody 45271
QQRYSWPPLP

SEQ ID NO: 90542 - protein, 17 aa, Homo sapiens
  heavy chain complementarity determining region 3 for antibody 45271
VKPRETYSSGWVDAFDT

SEQ ID NO: 90543 - protein, 10 aa, Homo sapiens
  light chain complementarity determining region 3 for antibody 45272
QQRYNWPPYT

SEQ ID NO: 90544 - protein, 17 aa, Homo sapiens
  heavy chain complementarity determining region 3 for antibody 45272
AKDIFFAIAVAGTAFDI

SEQ ID NO: 90545 - protein, 9 aa, Homo sapiens
  light chain complementarity determining region 3 for antibody 45273
QQRTNWPST

SEQ ID NO: 90546 - protein, 14 aa, Homo sapiens
  heavy chain complementarity determining region 3 for antibody 45273
ASPYEDGSGWYFDP

SEQ ID NO: 90547 - protein, 9 aa, Homo sapiens
  light chain complementarity determining region 3 for antibody 45274
QQRSTWPLT

SEQ ID NO: 90548 - protein, 17 aa, Homo sapiens
  heavy chain complementarity determining region 3 for antibody 45274
AKDIFFAIAVAGTAFDI

SEQ ID NO: 90549 - protein, 9 aa, Homo sapiens
  light chain complementarity determining region 3 for antibody 45275
QQRSSWPYT

SEQ ID NO: 90550 - protein, 13 aa, Homo sapiens
  heavy chain complementarity determining region 3 for antibody 45275
AKPRWLTPGAFDI

SEQ ID NO: 90551 - protein, 10 aa, Homo sapiens
  light chain complementarity determining region 3 for antibody 45276
QQRSSWPPIT

SEQ ID NO: 90552 - protein, 19 aa, Homo sapiens
  heavy chain complementarity determining region 3 for antibody 45276
ARVVDGSGNYFGARWYFDI

SEQ ID NO: 90553 - protein, 9 aa, Homo sapiens
  light chain complementarity determining region 3 for antibody 45277
QQRSSWPLT

SEQ ID NO: 90554 - protein, 18 aa, Homo sapiens
  heavy chain complementarity determining region 3 for antibody 45277
ARIPRDSDSTGYPFAFDI

SEQ ID NO: 90555 - protein, 9 aa, Homo sapiens
  light chain complementarity determining region 3 for antibody 45278
QQRSNWPRT

SEQ ID NO: 90556 - protein, 23 aa, Homo sapiens
  heavy chain complementarity determining region 3 for antibody 45278
ARTRKLSGITLVRGVTLNSPLDY

SEQ ID NO: 90557 - protein, 9 aa, Homo sapiens
  light chain complementarity determining region 3 for antibody 45279
QQRSNWPRT

SEQ ID NO: 90558 - protein, 16 aa, Homo sapiens
  heavy chain complementarity determining region 3 for antibody 45279
ARLPEAGDPRAGGMDV

SEQ ID NO: 90559 - protein, 10 aa, Homo sapiens
  light chain complementarity determining region 3 for antibody 45280
QQRSNWPPYT

SEQ ID NO: 90560 - protein, 12 aa, Homo sapiens
  heavy chain complementarity determining region 3 for antibody 45280
ARQYSGYKAFEF

SEQ ID NO: 90561 - protein, 10 aa, Homo sapiens
  light chain complementarity determining region 3 for antibody 45281
QQRSNWPPYT

SEQ ID NO: 90562 - protein, 11 aa, Homo sapiens
  heavy chain complementarity determining region 3 for antibody 45281
ARLLGYGSDSY

SEQ ID NO: 90563 - protein, 10 aa, Homo sapiens
  light chain complementarity determining region 3 for antibody 45282
QQRSNWPPYT

SEQ ID NO: 90564 - protein, 19 aa, Homo sapiens
  heavy chain complementarity determining region 3 for antibody 45282
AREGSGGWDGGREVNWFDP

SEQ ID NO: 90565 - protein, 10 aa, Homo sapiens
  light chain complementarity determining region 3 for antibody 45283
QQRSNWPPLT

SEQ ID NO: 90566 - protein, 21 aa, Homo sapiens
  heavy chain complementarity determining region 3 for antibody 45283
ARDLPERNYYASGSDPYYFDY

SEQ ID NO: 90567 - protein, 10 aa, Homo sapiens
  light chain complementarity determining region 3 for antibody 45284
QQRSNWPPLT

SEQ ID NO: 90568 - protein, 11 aa, Homo sapiens
  heavy chain complementarity determining region 3 for antibody 45284
ARDIHWNALDL

SEQ ID NO: 90569 - protein, 11 aa, Homo sapiens
  light chain complementarity determining region 3 for antibody 45285
QQRSNWPPGAP

SEQ ID NO: 90570 - protein, 11 aa, Homo sapiens
  heavy chain complementarity determining region 3 for antibody 45285
ARGTSVWYFDL

SEQ ID NO: 90571 - protein, 8 aa, Homo sapiens
  light chain complementarity determining region 3 for antibody 45286
QQRSNWPP

SEQ ID NO: 90572 - protein, 24 aa, Homo sapiens
  heavy chain complementarity determining region 3 for antibody 45286
AREYFSVSGGYFMWGTEEQQYFDI

SEQ ID NO: 90573 - protein, 9 aa, Homo sapiens
  light chain complementarity determining region 3 for antibody 45287
QQRSNWPLT

SEQ ID NO: 90574 - protein, 18 aa, Homo sapiens
  heavy chain complementarity determining region 3 for antibody 45287
ARVSLAGPLAMVTAGFDY

SEQ ID NO: 90575 - protein, 9 aa, Homo sapiens
  light chain complementarity determining region 3 for antibody 45288
QQRSNWPLT

SEQ ID NO: 90576 - protein, 15 aa, Homo sapiens
  heavy chain complementarity determining region 3 for antibody 45288
AKVGGRVEAGSLLEY

SEQ ID NO: 90577 - protein, 9 aa, Homo sapiens
  light chain complementarity determining region 3 for antibody 45289
QQRSNWPIT

SEQ ID NO: 90578 - protein, 11 aa, Homo sapiens
  heavy chain complementarity determining region 3 for antibody 45289
AREGLQLPTDL

SEQ ID NO: 90579 - protein, 9 aa, Homo sapiens
  light chain complementarity determining region 3 for antibody 45290
QQRSNWLLT

SEQ ID NO: 90580 - protein, 20 aa, Homo sapiens
  heavy chain complementarity determining region 3 for antibody 45290
ARDLTVPHGWVGVVTAGSDY

SEQ ID NO: 90581 - protein, 9 aa, Homo sapiens
  light chain complementarity determining region 3 for antibody 45291
QQRSNWIFT

SEQ ID NO: 90582 - protein, 21 aa, Homo sapiens
  heavy chain complementarity determining region 3 for antibody 45291
STDNWDYYDILIGHSYPYFDH

SEQ ID NO: 90583 - protein, 9 aa, Homo sapiens
  light chain complementarity determining region 3 for antibody 45292
QQRSNWAYP

SEQ ID NO: 90584 - protein, 13 aa, Homo sapiens
  heavy chain complementarity determining region 3 for antibody 45292
VSARGYDTRDFDH

SEQ ID NO: 90585 - protein, 10 aa, Homo sapiens
  light chain complementarity determining region 3 for antibody 45293
QQRSNCQGLT

SEQ ID NO: 90586 - protein, 13 aa, Homo sapiens
  heavy chain complementarity determining region 3 for antibody 45293
VRFGRVAAGAFDY

SEQ ID NO: 90587 - protein, 9 aa, Homo sapiens
  light chain complementarity determining region 3 for antibody 45294
QQRSDWPIT

SEQ ID NO: 90588 - protein, 12 aa, Homo sapiens
  heavy chain complementarity determining region 3 for antibody 45294
ARVQVEGYYLDY

SEQ ID NO: 90589 - protein, 10 aa, Homo sapiens
  light chain complementarity determining region 3 for antibody 45295
QQRQSWPPLT

SEQ ID NO: 90590 - protein, 17 aa, Homo sapiens
  heavy chain complementarity determining region 3 for antibody 45295
ARHDDRDTVPGQDAFDI

SEQ ID NO: 90591 - protein, 11 aa, Homo sapiens
  light chain complementarity determining region 3 for antibody 45296
QQRQESTNWRN

SEQ ID NO: 90592 - protein, 15 aa, Homo sapiens
  heavy chain complementarity determining region 3 for antibody 45296
ARGGYSSNWYWWFDP

SEQ ID NO: 90593 - protein, 11 aa, Homo sapiens
  light chain complementarity determining region 3 for antibody 45297
QQRQERTNWLN

SEQ ID NO: 90594 - protein, 15 aa, Homo sapiens
  heavy chain complementarity determining region 3 for antibody 45297
ARGGYSSAWYWWFDP

SEQ ID NO: 90595 - protein, 11 aa, Homo sapiens
  light chain complementarity determining region 3 for antibody 45298
QQRNSWPPTWT

SEQ ID NO: 90596 - protein, 10 aa, Homo sapiens
  heavy chain complementarity determining region 3 for antibody 45298
ALSRHSSAYY

SEQ ID NO: 90597 - protein, 8 aa, Homo sapiens
  light chain complementarity determining region 3 for antibody 45299
QQRKWWYT

SEQ ID NO: 90598 - protein, 16 aa, Homo sapiens
  heavy chain complementarity determining region 3 for antibody 45299
ARGSYFGNTVGIYFDW

SEQ ID NO: 90599 - protein, 10 aa, Homo sapiens
  light chain complementarity determining region 3 for antibody 45300
QQRINWPLFT

SEQ ID NO: 90600 - protein, 13 aa, Homo sapiens
  heavy chain complementarity determining region 3 for antibody 45300
ARPGGSSLMFFDF

SEQ ID NO: 90601 - protein, 10 aa, Homo sapiens
  light chain complementarity determining region 3 for antibody 45301
QQRGNWPPIT

SEQ ID NO: 90602 - protein, 13 aa, Homo sapiens
  heavy chain complementarity determining region 3 for antibody 45301
ARDQVPTAGGFDS

SEQ ID NO: 90603 - protein, 12 aa, Homo sapiens
  light chain complementarity determining region 3 for antibody 45302
QQRGNWPFPGLT

SEQ ID NO: 90604 - protein, 20 aa, Homo sapiens
  heavy chain complementarity determining region 3 for antibody 45302
ASGFIDYYGSGSYSPHAFDI

SEQ ID NO: 90605 - protein, 9 aa, Homo sapiens
  light chain complementarity determining region 3 for antibody 45303
QQRANWPIT

SEQ ID NO: 90606 - protein, 20 aa, Homo sapiens
  heavy chain complementarity determining region 3 for antibody 45303
ARDRTRYCSSASCPGYAFDI

SEQ ID NO: 90607 - protein, 9 aa, Homo sapiens
  light chain complementarity determining region 3 for antibody 45304
QQNNNWPRT

SEQ ID NO: 90608 - protein, 17 aa, Homo sapiens
  heavy chain complementarity determining region 3 for antibody 45304
AKDIFFGIAVAGTAFDI

SEQ ID NO: 90609 - protein, 9 aa, Homo sapiens
  light chain complementarity determining region 3 for antibody 45305
QQNNITPLT

SEQ ID NO: 90610 - protein, 21 aa, Homo sapiens
  heavy chain complementarity determining region 3 for antibody 45305
VKGGRYYGSGGNFGGGVGMDV

SEQ ID NO: 90611 - protein, 9 aa, Homo sapiens
  light chain complementarity determining region 3 for antibody 45306
QQLSSYPPT

SEQ ID NO: 90612 - protein, 14 aa, Homo sapiens
  heavy chain complementarity determining region 3 for antibody 45306
ARVPSGISWTRHEN

SEQ ID NO: 90613 - protein, 9 aa, Homo sapiens
  light chain complementarity determining region 3 for antibody 45307
QQLSNSPST

SEQ ID NO: 90614 - protein, 16 aa, Homo sapiens
  heavy chain complementarity determining region 3 for antibody 45307
AKDQRDTAMAHYFFDY

SEQ ID NO: 90615 - protein, 9 aa, Homo sapiens
  light chain complementarity determining region 3 for antibody 45308
QQLNSYPYT

SEQ ID NO: 90616 - protein, 10 aa, Homo sapiens
  heavy chain complementarity determining region 3 for antibody 45308
ARRGLFFGES

SEQ ID NO: 90617 - protein, 9 aa, Homo sapiens
  light chain complementarity determining region 3 for antibody 45309
QQLNSYPIT

SEQ ID NO: 90618 - protein, 19 aa, Homo sapiens
  heavy chain complementarity determining region 3 for antibody 45309
AKDRAPTVTRYNYYYGMDV

SEQ ID NO: 90619 - protein, 11 aa, Homo sapiens
  light chain complementarity determining region 3 for antibody 45310
QQLNSYPFMFT

SEQ ID NO: 90620 - protein, 10 aa, Homo sapiens
  heavy chain complementarity determining region 3 for antibody 45310
TKMWGQRLEH

SEQ ID NO: 90621 - protein, 8 aa, Homo sapiens
  light chain complementarity determining region 3 for antibody 45311
QQLNSNPL

SEQ ID NO: 90622 - protein, 18 aa, Homo sapiens
  heavy chain complementarity determining region 3 for antibody 45311
ASAFPIFGEVTLWDVFDI

SEQ ID NO: 90623 - protein, 10 aa, Homo sapiens
  light chain complementarity determining region 3 for antibody 45312
QQLNSFPPLT

SEQ ID NO: 90624 - protein, 24 aa, Homo sapiens
  heavy chain complementarity determining region 3 for antibody 45312
ARILGRRYCSGGVCYFYHYNGLDV

SEQ ID NO: 90625 - protein, 7 aa, Homo sapiens
  light chain complementarity determining region 3 for antibody 45313
QQLNRWT

SEQ ID NO: 90626 - protein, 18 aa, Homo sapiens
  heavy chain complementarity determining region 3 for antibody 45313
ASESSITLFGVPYPYFDY

SEQ ID NO: 90627 - protein, 9 aa, Homo sapiens
  light chain complementarity determining region 3 for antibody 45314
QQLKSYPLT

SEQ ID NO: 90628 - protein, 15 aa, Homo sapiens
  heavy chain complementarity determining region 3 for antibody 45314
TRVFMITFGEDAFDI

SEQ ID NO: 90629 - protein, 9 aa, Homo sapiens
  light chain complementarity determining region 3 for antibody 45315
QQHYSNSWT

SEQ ID NO: 90630 - protein, 12 aa, Homo sapiens
  heavy chain complementarity determining region 3 for antibody 45315
ARGSRVATIPRF

SEQ ID NO: 90631 - protein, 8 aa, Homo sapiens
  light chain complementarity determining region 3 for antibody 45316
QQHGYSHT

SEQ ID NO: 90632 - protein, 13 aa, Homo sapiens
  heavy chain complementarity determining region 3 for antibody 45316
VRDMEGDTTDFDC

SEQ ID NO: 90633 - protein, 9 aa, Homo sapiens
  light chain complementarity determining region 3 for antibody 45317
QQGYSTPYT

SEQ ID NO: 90634 - protein, 9 aa, Homo sapiens
  heavy chain complementarity determining region 3 for antibody 45317
VRDTQSSSN

SEQ ID NO: 90635 - protein, 10 aa, Homo sapiens
  light chain complementarity determining region 3 for antibody 45318
QQGYSTLLYT

SEQ ID NO: 90636 - protein, 12 aa, Homo sapiens
  heavy chain complementarity determining region 3 for antibody 45318
AREVAAAGDFDY

SEQ ID NO: 90637 - protein, 9 aa, Homo sapiens
  light chain complementarity determining region 3 for antibody 45319
QQGYSRLPT

SEQ ID NO: 90638 - protein, 18 aa, Homo sapiens
  heavy chain complementarity determining region 3 for antibody 45319
ARGYGSGSYSNYYYGMDV

SEQ ID NO: 90639 - protein, 9 aa, Homo sapiens
  light chain complementarity determining region 3 for antibody 45320
QQGYNTPRT

SEQ ID NO: 90640 - protein, 12 aa, Homo sapiens
  heavy chain complementarity determining region 3 for antibody 45320
AVMVPVYSASDY

SEQ ID NO: 90641 - protein, 9 aa, Homo sapiens
  light chain complementarity determining region 3 for antibody 45321
QQFGSSPTT

SEQ ID NO: 90642 - protein, 16 aa, Homo sapiens
  heavy chain complementarity determining region 3 for antibody 45321
ARGITMVRGVPQYFDY

SEQ ID NO: 90643 - protein, 9 aa, Homo sapiens
  light chain complementarity determining region 3 for antibody 45322
QQFGDPIYT

SEQ ID NO: 90644 - protein, 21 aa, Homo sapiens
  heavy chain complementarity determining region 3 for antibody 45322
ARDGGGGYDNNSDQYYSYLDY

SEQ ID NO: 90645 - protein, 13 aa, Homo sapiens
  light chain complementarity determining region 3 for antibody 45323
QQFDDIPRLGRVT

SEQ ID NO: 90646 - protein, 18 aa, Homo sapiens
  heavy chain complementarity determining region 3 for antibody 45323
TTDWPYRWGYDFGLPFDY

SEQ ID NO: 90647 - protein, 9 aa, Homo sapiens
  light chain complementarity determining region 3 for antibody 45324
QQDGRSPGT

SEQ ID NO: 90648 - protein, 19 aa, Homo sapiens
  heavy chain complementarity determining region 3 for antibody 45324
AHRLVVWFGELFGYDAFDI

SEQ ID NO: 90649 - protein, 9 aa, Homo sapiens
  light chain complementarity determining region 3 for antibody 45325
QQDFESPWT

SEQ ID NO: 90650 - protein, 18 aa, Homo sapiens
  heavy chain complementarity determining region 3 for antibody 45325
ATDGVYCRAGNCFSEGLA

SEQ ID NO: 90651 - protein, 9 aa, Homo sapiens
  light chain complementarity determining region 3 for antibody 45326
QQCYSAPYT

SEQ ID NO: 90652 - protein, 18 aa, Homo sapiens
  heavy chain complementarity determining region 3 for antibody 45326
ARDQFNSRRAIRWATFGS

SEQ ID NO: 90653 - protein, 8 aa, Homo sapiens
  light chain complementarity determining region 3 for antibody 45327
QQCYDTPT

SEQ ID NO: 90654 - protein, 15 aa, Homo sapiens
  heavy chain complementarity determining region 3 for antibody 45327
TRGGNHIQLWQRFDY

SEQ ID NO: 90655 - protein, 9 aa, Homo sapiens
  light chain complementarity determining region 3 for antibody 45328
QQCSNIPWT

SEQ ID NO: 90656 - protein, 13 aa, Homo sapiens
  heavy chain complementarity determining region 3 for antibody 45328
ARGNWGDRGTFDI

SEQ ID NO: 90657 - protein, 9 aa, Homo sapiens
  light chain complementarity determining region 3 for antibody 45329
QQCNNYPWT

SEQ ID NO: 90658 - protein, 19 aa, Homo sapiens
  heavy chain complementarity determining region 3 for antibody 45329
ARTPPVDTTMAALGYYFDL

SEQ ID NO: 90659 - protein, 8 aa, Homo sapiens
  light chain complementarity determining region 3 for antibody 45330
QQCHVFLS

SEQ ID NO: 90660 - protein, 12 aa, Homo sapiens
  heavy chain complementarity determining region 3 for antibody 45330
ATYYFGSGTFDY

SEQ ID NO: 90661 - protein, 9 aa, Homo sapiens
  light chain complementarity determining region 3 for antibody 45331
QQAYSYPWT

SEQ ID NO: 90662 - protein, 13 aa, Homo sapiens
  heavy chain complementarity determining region 3 for antibody 45331
VKGRGYGYGYFDF

SEQ ID NO: 90663 - protein, 9 aa, Homo sapiens
  light chain complementarity determining region 3 for antibody 45332
QQANSFPYT

SEQ ID NO: 90664 - protein, 18 aa, Homo sapiens
  heavy chain complementarity determining region 3 for antibody 45332
ARDSDKRLGEWGLFGMDV

SEQ ID NO: 90665 - protein, 9 aa, Homo sapiens
  light chain complementarity determining region 3 for antibody 45333
QQANSFPRT

SEQ ID NO: 90666 - protein, 20 aa, Homo sapiens
  heavy chain complementarity determining region 3 for antibody 45333
ARVPRRKAPSGTGYYYGMDV

SEQ ID NO: 90667 - protein, 9 aa, Homo sapiens
  light chain complementarity determining region 3 for antibody 45334
QQANSFPRT

SEQ ID NO: 90668 - protein, 16 aa, Homo sapiens
  heavy chain complementarity determining region 3 for antibody 45334
ARTLRGSGNHFNPISY

SEQ ID NO: 90669 - protein, 9 aa, Homo sapiens
  light chain complementarity determining region 3 for antibody 45335
QQANSFPLT

SEQ ID NO: 90670 - protein, 13 aa, Homo sapiens
  heavy chain complementarity determining region 3 for antibody 45335
ASAFEYGPGSYIY

SEQ ID NO: 90671 - protein, 9 aa, Homo sapiens
  light chain complementarity determining region 3 for antibody 45336
QQANSFPLT

SEQ ID NO: 90672 - protein, 18 aa, Homo sapiens
  heavy chain complementarity determining region 3 for antibody 45336
ARHLGYDSRGYSHDAFDI

SEQ ID NO: 90673 - protein, 9 aa, Homo sapiens
  light chain complementarity determining region 3 for antibody 45337
QQANSFPLT

SEQ ID NO: 90674 - protein, 16 aa, Homo sapiens
  heavy chain complementarity determining region 3 for antibody 45337
ARHKSWRQLATPLFDH

SEQ ID NO: 90675 - protein, 9 aa, Homo sapiens
  light chain complementarity determining region 3 for antibody 45338
QQANSFPFT

SEQ ID NO: 90676 - protein, 17 aa, Homo sapiens
  heavy chain complementarity determining region 3 for antibody 45338
AKDLIWNGDGYFYGMDV

SEQ ID NO: 90677 - protein, 9 aa, Homo sapiens
  light chain complementarity determining region 3 for antibody 45339
QQAKSFPLT

SEQ ID NO: 90678 - protein, 14 aa, Homo sapiens
  heavy chain complementarity determining region 3 for antibody 45339
ARGNYYNSVNWFDP

SEQ ID NO: 90679 - protein, 11 aa, Homo sapiens
  light chain complementarity determining region 3 for antibody 45340
QLYGSSPPSYT

SEQ ID NO: 90680 - protein, 15 aa, Homo sapiens
  heavy chain complementarity determining region 3 for antibody 45340
AREAITMIEPGAFDI

SEQ ID NO: 90681 - protein, 11 aa, Homo sapiens
  light chain complementarity determining region 3 for antibody 45341
QLYETSPPGYT

SEQ ID NO: 90682 - protein, 14 aa, Homo sapiens
  heavy chain complementarity determining region 3 for antibody 45341
ARENRISRKRSFDQ

SEQ ID NO: 90683 - protein, 11 aa, Homo sapiens
  light chain complementarity determining region 3 for antibody 45342
QLCCSPGPLYP

SEQ ID NO: 90684 - protein, 15 aa, Homo sapiens
  heavy chain complementarity determining region 3 for antibody 45342
ARGFSNNGWTWGLDF

SEQ ID NO: 90685 - protein, 8 aa, Homo sapiens
  light chain complementarity determining region 3 for antibody 45343
QKYNVPFT

SEQ ID NO: 90686 - protein, 13 aa, Homo sapiens
  heavy chain complementarity determining region 3 for antibody 45343
AISSVAVIGTVDY

SEQ ID NO: 90687 - protein, 9 aa, Homo sapiens
  light chain complementarity determining region 3 for antibody 45344
QKYNSPPDT

SEQ ID NO: 90688 - protein, 11 aa, Homo sapiens
  heavy chain complementarity determining region 3 for antibody 45344
ARGILWSGLGF

SEQ ID NO: 90689 - protein, 8 aa, Homo sapiens
  light chain complementarity determining region 3 for antibody 45345
QKYNSGGT

SEQ ID NO: 90690 - protein, 18 aa, Homo sapiens
  heavy chain complementarity determining region 3 for antibody 45345
ARGQYDGTGYYMLEYFLH

SEQ ID NO: 90691 - protein, 10 aa, Homo sapiens
  light chain complementarity determining region 3 for antibody 45346
QKYNSDPPQT

SEQ ID NO: 90692 - protein, 14 aa, Homo sapiens
  heavy chain complementarity determining region 3 for antibody 45346
ARVSEKRSTFPFDY

SEQ ID NO: 90693 - protein, 9 aa, Homo sapiens
  light chain complementarity determining region 3 for antibody 45347
QKYNSAPLT

SEQ ID NO: 90694 - protein, 14 aa, Homo sapiens
  heavy chain complementarity determining region 3 for antibody 45347
ARGRSGSDCCIPDY

SEQ ID NO: 90695 - protein, 9 aa, Homo sapiens
  light chain complementarity determining region 3 for antibody 45348
QKYNSAPFT

SEQ ID NO: 90696 - protein, 17 aa, Homo sapiens
  heavy chain complementarity determining region 3 for antibody 45348
ARGGAYYDSSGYDQFDY

SEQ ID NO: 90697 - protein, 8 aa, Homo sapiens
  light chain complementarity determining region 3 for antibody 45349
QKYISALT

SEQ ID NO: 90698 - protein, 22 aa, Homo sapiens
  heavy chain complementarity determining region 3 for antibody 45349
ARGPVGSPGGTMVRGVTYYFDH

SEQ ID NO: 90699 - protein, 9 aa, Homo sapiens
  light chain complementarity determining region 3 for antibody 45350
QKYANAPFT

SEQ ID NO: 90700 - protein, 15 aa, Homo sapiens
  heavy chain complementarity determining region 3 for antibody 45350
ARDSQYPFFQGLGSS

SEQ ID NO: 90701 - protein, 9 aa, Homo sapiens
  light chain complementarity determining region 3 for antibody 45351
QKFNSAPQT

SEQ ID NO: 90702 - protein, 13 aa, Homo sapiens
  heavy chain complementarity determining region 3 for antibody 45351
ARGASGNWGLSGH

SEQ ID NO: 90703 - protein, 9 aa, Homo sapiens
  light chain complementarity determining region 3 for antibody 45352
QHYYSYPYS

SEQ ID NO: 90704 - protein, 15 aa, Homo sapiens
  heavy chain complementarity determining region 3 for antibody 45352
VRDGGSSSWHSRLDY

SEQ ID NO: 90705 - protein, 10 aa, Homo sapiens
  light chain complementarity determining region 3 for antibody 45353
QHYSNSPPGT

SEQ ID NO: 90706 - protein, 16 aa, Homo sapiens
  heavy chain complementarity determining region 3 for antibody 45353
ARRQWVRGLFRGGLDS

SEQ ID NO: 90707 - protein, 9 aa, Homo sapiens
  light chain complementarity determining region 3 for antibody 45354
QHYQGYPIT

SEQ ID NO: 90708 - protein, 21 aa, Homo sapiens
  heavy chain complementarity determining region 3 for antibody 45354
ARGPGGEAPAGSESYYYPMDV

SEQ ID NO: 90709 - protein, 9 aa, Homo sapiens
  light chain complementarity determining region 3 for antibody 45355
QHYNGYSQT

SEQ ID NO: 90710 - protein, 19 aa, Homo sapiens
  heavy chain complementarity determining region 3 for antibody 45355
ARGSFGMVRGSPYHNPLDV

SEQ ID NO: 90711 - protein, 9 aa, Homo sapiens
  light chain complementarity determining region 3 for antibody 45356
QHYGYAPWT

SEQ ID NO: 90712 - protein, 13 aa, Homo sapiens
  heavy chain complementarity determining region 3 for antibody 45356
ARVAVPGLGYFQH

SEQ ID NO: 90713 - protein, 8 aa, Homo sapiens
  light chain complementarity determining region 3 for antibody 45357
QHYGTSFT

SEQ ID NO: 90714 - protein, 13 aa, Homo sapiens
  heavy chain complementarity determining region 3 for antibody 45357
ARQTPVPSEHFPR

SEQ ID NO: 90715 - protein, 11 aa, Homo sapiens
  light chain complementarity determining region 3 for antibody 45358
QHYGSSPPLYT

SEQ ID NO: 90716 - protein, 12 aa, Homo sapiens
  heavy chain complementarity determining region 3 for antibody 45358
ARHIAGANAYDY

SEQ ID NO: 90717 - protein, 9 aa, Homo sapiens
  light chain complementarity determining region 3 for antibody 45359
QHYGSSPIT

SEQ ID NO: 90718 - protein, 16 aa, Homo sapiens
  heavy chain complementarity determining region 3 for antibody 45359
ATGSSKGLLIRATLDY

SEQ ID NO: 90719 - protein, 10 aa, Homo sapiens
  light chain complementarity determining region 3 for antibody 45360
QHYGSSPAGT

SEQ ID NO: 90720 - protein, 12 aa, Homo sapiens
  heavy chain complementarity determining region 3 for antibody 45360
ARAQTTVTTADF

SEQ ID NO: 90721 - protein, 9 aa, Homo sapiens
  light chain complementarity determining region 3 for antibody 45361
QHYGGSPYP

SEQ ID NO: 90722 - protein, 17 aa, Homo sapiens
  heavy chain complementarity determining region 3 for antibody 45361
ARVDLSEQWLVLWYFDL

SEQ ID NO: 90723 - protein, 9 aa, Homo sapiens
  light chain complementarity determining region 3 for antibody 45362
QHYFNVPPT

SEQ ID NO: 90724 - protein, 18 aa, Homo sapiens
  heavy chain complementarity determining region 3 for antibody 45362
ARPQTYFYNGKGWYYFEV

SEQ ID NO: 90725 - protein, 10 aa, Homo sapiens
  light chain complementarity determining region 3 for antibody 45363
QHSNDYSPWM

SEQ ID NO: 90726 - protein, 17 aa, Homo sapiens
  heavy chain complementarity determining region 3 for antibody 45363
ARANPTVITPGPGAFDI

SEQ ID NO: 90727 - protein, 10 aa, Homo sapiens
  light chain complementarity determining region 3 for antibody 45364
QHSGTSRLGT

SEQ ID NO: 90728 - protein, 15 aa, Homo sapiens
  heavy chain complementarity determining region 3 for antibody 45364
ARMFDYGDYTCPLDY

SEQ ID NO: 90729 - protein, 10 aa, Homo sapiens
  light chain complementarity determining region 3 for antibody 45365
QHSDLVSPIT

SEQ ID NO: 90730 - protein, 12 aa, Homo sapiens
  heavy chain complementarity determining region 3 for antibody 45365
ARDTGGGHVFDH

SEQ ID NO: 90731 - protein, 9 aa, Homo sapiens
  light chain complementarity determining region 3 for antibody 45366
QHSDGSLWT

SEQ ID NO: 90732 - protein, 20 aa, Homo sapiens
  heavy chain complementarity determining region 3 for antibody 45366
ASPRPVDFLATGPRSDAFEI

SEQ ID NO: 90733 - protein, 9 aa, Homo sapiens
  light chain complementarity determining region 3 for antibody 45367
QHRSNWLFT

SEQ ID NO: 90734 - protein, 11 aa, Homo sapiens
  heavy chain complementarity determining region 3 for antibody 45367
AKDKGVNYFDY

SEQ ID NO: 90735 - protein, 11 aa, Homo sapiens
  light chain complementarity determining region 3 for antibody 45368
QHRQEHTNWLG

SEQ ID NO: 90736 - protein, 15 aa, Homo sapiens
  heavy chain complementarity determining region 3 for antibody 45368
ARGGYSSGWYYWFDP

SEQ ID NO: 90737 - protein, 10 aa, Homo sapiens
  light chain complementarity determining region 3 for antibody 45369
QHLNSYRLYT

SEQ ID NO: 90738 - protein, 15 aa, Homo sapiens
  heavy chain complementarity determining region 3 for antibody 45369
ARDRSYFDSSGLLDL

SEQ ID NO: 90739 - protein, 9 aa, Homo sapiens
  light chain complementarity determining region 3 for antibody 45370
QHFNSYSVT

SEQ ID NO: 90740 - protein, 15 aa, Homo sapiens
  heavy chain complementarity determining region 3 for antibody 45370
ARSGAVIAADWYFDF

SEQ ID NO: 90741 - protein, 10 aa, Homo sapiens
  light chain complementarity determining region 3 for antibody 45371
QHFDTLPPIT

SEQ ID NO: 90742 - protein, 24 aa, Homo sapiens
  heavy chain complementarity determining region 3 for antibody 45371
VGGRTGRGGTCYSPILFCNWYFTL

SEQ ID NO: 90743 - protein, 6 aa, Homo sapiens
  light chain complementarity determining region 3 for antibody 45372
QGGGQT

SEQ ID NO: 90744 - protein, 12 aa, Homo sapiens
  heavy chain complementarity determining region 3 for antibody 45372
AKDHDRGWSLSD

SEQ ID NO: 90745 - protein, 9 aa, Homo sapiens
  light chain complementarity determining region 3 for antibody 45373
QEYDSAPRV

SEQ ID NO: 90746 - protein, 14 aa, Homo sapiens
  heavy chain complementarity determining region 3 for antibody 45373
ARGRGSGSPWFFDL

SEQ ID NO: 90747 - protein, 9 aa, Homo sapiens
  light chain complementarity determining region 3 for antibody 45374
QDYSGYSWT

SEQ ID NO: 90748 - protein, 16 aa, Homo sapiens
  heavy chain complementarity determining region 3 for antibody 45374
VKARRGVLMWFGDGQD

SEQ ID NO: 90749 - protein, 8 aa, Homo sapiens
  light chain complementarity determining region 3 for antibody 45375
MQTLQVPA

SEQ ID NO: 90750 - protein, 21 aa, Homo sapiens
  heavy chain complementarity determining region 3 for antibody 45375
ARRKGQVLGIRDNYYFYGMDV

SEQ ID NO: 90751 - protein, 9 aa, Homo sapiens
  light chain complementarity determining region 3 for antibody 45376
MQTLQTPCT

SEQ ID NO: 90752 - protein, 14 aa, Homo sapiens
  heavy chain complementarity determining region 3 for antibody 45376
TTGVVTRGGRFFDI

SEQ ID NO: 90753 - protein, 9 aa, Homo sapiens
  light chain complementarity determining region 3 for antibody 45377
MQSLQTPRT

SEQ ID NO: 90754 - protein, 30 aa, Homo sapiens
  heavy chain complementarity determining region 3 for antibody 45377
ARGLTRTLPFIDKFGSGINLPQPEVEWFDP

SEQ ID NO: 90755 - protein, 9 aa, Homo sapiens
  light chain complementarity determining region 3 for antibody 45378
MQSLQAPVT

SEQ ID NO: 90756 - protein, 15 aa, Homo sapiens
  heavy chain complementarity determining region 3 for antibody 45378
AKEVTRVSNGRASDI

SEQ ID NO: 90757 - protein, 9 aa, Homo sapiens
  light chain complementarity determining region 3 for antibody 45379
MQSLETPYT

SEQ ID NO: 90758 - protein, 19 aa, Homo sapiens
  heavy chain complementarity determining region 3 for antibody 45379
ARDLGVVTGVSTRSYAVDV

SEQ ID NO: 90759 - protein, 10 aa, Homo sapiens
  light chain complementarity determining region 3 for antibody 45380
MQRREFPSYT

SEQ ID NO: 90760 - protein, 17 aa, Homo sapiens
  heavy chain complementarity determining region 3 for antibody 45380
ARDWGSGWYGARKAFAF

SEQ ID NO: 90761 - protein, 9 aa, Homo sapiens
  light chain complementarity determining region 3 for antibody 45381
MQPLQAPLT

SEQ ID NO: 90762 - protein, 22 aa, Homo sapiens
  heavy chain complementarity determining region 3 for antibody 45381
ARTETGYYGSGSYYRRSYYFDY

SEQ ID NO: 90763 - protein, 9 aa, Homo sapiens
  light chain complementarity determining region 3 for antibody 45382
MQNLQTPLT

SEQ ID NO: 90764 - protein, 16 aa, Homo sapiens
  heavy chain complementarity determining region 3 for antibody 45382
TTDWGSGYNYIRAFDI

SEQ ID NO: 90765 - protein, 10 aa, Homo sapiens
  light chain complementarity determining region 3 for antibody 45383
MQLLQLPPVT

SEQ ID NO: 90766 - protein, 16 aa, Homo sapiens
  heavy chain complementarity determining region 3 for antibody 45383
SRPRLGYGDYGHSLQH

SEQ ID NO: 90767 - protein, 9 aa, Homo sapiens
  light chain complementarity determining region 3 for antibody 45384
MQHIYWPHT

SEQ ID NO: 90768 - protein, 14 aa, Homo sapiens
  heavy chain complementarity determining region 3 for antibody 45384
ARLEIVEIPPGKNN

SEQ ID NO: 90769 - protein, 9 aa, Homo sapiens
  light chain complementarity determining region 3 for antibody 45385
MQGTHWPYT

SEQ ID NO: 90770 - protein, 11 aa, Homo sapiens
  heavy chain complementarity determining region 3 for antibody 45385
VAEVGVRDFQN

SEQ ID NO: 90771 - protein, 9 aa, Homo sapiens
  light chain complementarity determining region 3 for antibody 45386
MQGTHWPYT

SEQ ID NO: 90772 - protein, 15 aa, Homo sapiens
  heavy chain complementarity determining region 3 for antibody 45386
AVVVAGPSGRKAIDY

SEQ ID NO: 90773 - protein, 9 aa, Homo sapiens
  light chain complementarity determining region 3 for antibody 45387
MQGTHWPYT

SEQ ID NO: 90774 - protein, 15 aa, Homo sapiens
  heavy chain complementarity determining region 3 for antibody 45387
ARWGNDNGDYGRLDS

SEQ ID NO: 90775 - protein, 9 aa, Homo sapiens
  light chain complementarity determining region 3 for antibody 45388
MQGTHWPYT

SEQ ID NO: 90776 - protein, 17 aa, Homo sapiens
  heavy chain complementarity determining region 3 for antibody 45388
ARDGGCSGSRCNSGLGY

SEQ ID NO: 90777 - protein, 9 aa, Homo sapiens
  light chain complementarity determining region 3 for antibody 45389
MQGTHWPYT

SEQ ID NO: 90778 - protein, 15 aa, Homo sapiens
  heavy chain complementarity determining region 3 for antibody 45389
ARAQVIWGQLYYFDS

SEQ ID NO: 90779 - protein, 10 aa, Homo sapiens
  light chain complementarity determining region 3 for antibody 45390
MQGTHWPPWT

SEQ ID NO: 90780 - protein, 13 aa, Homo sapiens
  heavy chain complementarity determining region 3 for antibody 45390
VRDGDSSNWPLDY

SEQ ID NO: 90781 - protein, 9 aa, Homo sapiens
  light chain complementarity determining region 3 for antibody 45391
MQGTHWPGT

SEQ ID NO: 90782 - protein, 15 aa, Homo sapiens
  heavy chain complementarity determining region 3 for antibody 45391
ARHSQSGTYTSNYDY

SEQ ID NO: 90783 - protein, 9 aa, Homo sapiens
  light chain complementarity determining region 3 for antibody 45392
MQGTHWPGT

SEQ ID NO: 90784 - protein, 19 aa, Homo sapiens
  heavy chain complementarity determining region 3 for antibody 45392
ARDTARYFDWSEEPNTLDI

SEQ ID NO: 90785 - protein, 9 aa, Homo sapiens
  light chain complementarity determining region 3 for antibody 45393
MQGTHWPFT

SEQ ID NO: 90786 - protein, 14 aa, Homo sapiens
  heavy chain complementarity determining region 3 for antibody 45393
AKALQNWNDHPSDY

SEQ ID NO: 90787 - protein, 9 aa, Homo sapiens
  light chain complementarity determining region 3 for antibody 45394
MQGTHWLWT

SEQ ID NO: 90788 - protein, 18 aa, Homo sapiens
  heavy chain complementarity determining region 3 for antibody 45394
ARDFRRSGTHSPDVVFDY

SEQ ID NO: 90789 - protein, 8 aa, Homo sapiens
  light chain complementarity determining region 3 for antibody 45395
MQGTHWLT

SEQ ID NO: 90790 - protein, 10 aa, Homo sapiens
  heavy chain complementarity determining region 3 for antibody 45395
ATEYSGGPDY

SEQ ID NO: 90791 - protein, 10 aa, Homo sapiens
  light chain complementarity determining region 3 for antibody 45396
MQGTHWASRP

SEQ ID NO: 90792 - protein, 8 aa, Homo sapiens
  heavy chain complementarity determining region 3 for antibody 45396
MKTASIEG

SEQ ID NO: 90793 - protein, 9 aa, Homo sapiens
  light chain complementarity determining region 3 for antibody 45397
MQGSHYSGT

SEQ ID NO: 90794 - protein, 10 aa, Homo sapiens
  heavy chain complementarity determining region 3 for antibody 45397
ARDTFASIDY

SEQ ID NO: 90795 - protein, 9 aa, Homo sapiens
  light chain complementarity determining region 3 for antibody 45398
MQGLRIPPT

SEQ ID NO: 90796 - protein, 18 aa, Homo sapiens
  heavy chain complementarity determining region 3 for antibody 45398
ARGGRPWQEWLVFNWFVS

SEQ ID NO: 90797 - protein, 9 aa, Homo sapiens
  light chain complementarity determining region 3 for antibody 45399
MQGLQTPYT

SEQ ID NO: 90798 - protein, 15 aa, Homo sapiens
  heavy chain complementarity determining region 3 for antibody 45399
ATVGAGSWYRGFFDH

SEQ ID NO: 90799 - protein, 9 aa, Homo sapiens
  light chain complementarity determining region 3 for antibody 45400
MQGLQTPLV

SEQ ID NO: 90800 - protein, 12 aa, Homo sapiens
  heavy chain complementarity determining region 3 for antibody 45400
ARGNTGMIQFDS

SEQ ID NO: 90801 - protein, 9 aa, Homo sapiens
  light chain complementarity determining region 3 for antibody 45401
MQGLQTPFT

SEQ ID NO: 90802 - protein, 10 aa, Homo sapiens
  heavy chain complementarity determining region 3 for antibody 45401
ARGVGNRKPR

SEQ ID NO: 90803 - protein, 9 aa, Homo sapiens
  light chain complementarity determining region 3 for antibody 45402
MQDTHWPGT

SEQ ID NO: 90804 - protein, 7 aa, Homo sapiens
  heavy chain complementarity determining region 3 for antibody 45402
ARDSTDF

SEQ ID NO: 90805 - protein, 9 aa, Homo sapiens
  light chain complementarity determining region 3 for antibody 45403
MQAVQTPLT

SEQ ID NO: 90806 - protein, 18 aa, Homo sapiens
  heavy chain complementarity determining region 3 for antibody 45403
ARTLPDVTAAGYGRALGY

SEQ ID NO: 90807 - protein, 9 aa, Homo sapiens
  light chain complementarity determining region 3 for antibody 45404
MQAVQNPVT

SEQ ID NO: 90808 - protein, 14 aa, Homo sapiens
  heavy chain complementarity determining region 3 for antibody 45404
ARRASGGVVIPYDS

SEQ ID NO: 90809 - protein, 9 aa, Homo sapiens
  light chain complementarity determining region 3 for antibody 45405
MQAQQTPLT

SEQ ID NO: 90810 - protein, 13 aa, Homo sapiens
  heavy chain complementarity determining region 3 for antibody 45405
ARGNYDFWSGLAS

SEQ ID NO: 90811 - protein, 9 aa, Homo sapiens
  light chain complementarity determining region 3 for antibody 45406
MQAQQIPRS

SEQ ID NO: 90812 - protein, 10 aa, Homo sapiens
  heavy chain complementarity determining region 3 for antibody 45406
AREFRNAFDI

SEQ ID NO: 90813 - protein, 9 aa, Homo sapiens
  light chain complementarity determining region 3 for antibody 45407
MQALRTPLT

SEQ ID NO: 90814 - protein, 21 aa, Homo sapiens
  heavy chain complementarity determining region 3 for antibody 45407
ARDRGIRFFEWSSKNYYGMDV

SEQ ID NO: 90815 - protein, 10 aa, Homo sapiens
  light chain complementarity determining region 3 for antibody 45408
MQALQTRALT

SEQ ID NO: 90816 - protein, 13 aa, Homo sapiens
  heavy chain complementarity determining region 3 for antibody 45408
TKLRGGPVTTLEY

SEQ ID NO: 90817 - protein, 9 aa, Homo sapiens
  light chain complementarity determining region 3 for antibody 45409
MQALQTPYT

SEQ ID NO: 90818 - protein, 15 aa, Homo sapiens
  heavy chain complementarity determining region 3 for antibody 45409
ATDRGINWAYSRFDS

SEQ ID NO: 90819 - protein, 9 aa, Homo sapiens
  light chain complementarity determining region 3 for antibody 45410
MQALQTPYT

SEQ ID NO: 90820 - protein, 12 aa, Homo sapiens
  heavy chain complementarity determining region 3 for antibody 45410
ARATWFGVRFDS

SEQ ID NO: 90821 - protein, 9 aa, Homo sapiens
  light chain complementarity determining region 3 for antibody 45411
MQALQTPWT

SEQ ID NO: 90822 - protein, 17 aa, Homo sapiens
  heavy chain complementarity determining region 3 for antibody 45411
ARDAWFRGLIMFYGMDV

SEQ ID NO: 90823 - protein, 9 aa, Homo sapiens
  light chain complementarity determining region 3 for antibody 45412
MQALQTPWT

SEQ ID NO: 90824 - protein, 19 aa, Homo sapiens
  heavy chain complementarity determining region 3 for antibody 45412
ARAYCGGDCSHYHYYGVDV

SEQ ID NO: 90825 - protein, 8 aa, Homo sapiens
  light chain complementarity determining region 3 for antibody 45413
MQALQTPT

SEQ ID NO: 90826 - protein, 16 aa, Homo sapiens
  heavy chain complementarity determining region 3 for antibody 45413
ARDVHGSGTSGPAFDV

SEQ ID NO: 90827 - protein, 8 aa, Homo sapiens
  light chain complementarity determining region 3 for antibody 45414
MQALQTPS

SEQ ID NO: 90828 - protein, 14 aa, Homo sapiens
  heavy chain complementarity determining region 3 for antibody 45414
ATGGRGSSWFPFHY

SEQ ID NO: 90829 - protein, 10 aa, Homo sapiens
  light chain complementarity determining region 3 for antibody 45415
MQALQTPRVT

SEQ ID NO: 90830 - protein, 17 aa, Homo sapiens
  heavy chain complementarity determining region 3 for antibody 45415
ARERTEVPGPMPADLDY

SEQ ID NO: 90831 - protein, 9 aa, Homo sapiens
  light chain complementarity determining region 3 for antibody 45416
MQALQTPQT

SEQ ID NO: 90832 - protein, 16 aa, Homo sapiens
  heavy chain complementarity determining region 3 for antibody 45416
AVGVSKDVLEPSVALF

SEQ ID NO: 90833 - protein, 9 aa, Homo sapiens
  light chain complementarity determining region 3 for antibody 45417
MQALQTPQT

SEQ ID NO: 90834 - protein, 17 aa, Homo sapiens
  heavy chain complementarity determining region 3 for antibody 45417
ARATALVVNSVLSGFDA

SEQ ID NO: 90835 - protein, 9 aa, Homo sapiens
  light chain complementarity determining region 3 for antibody 45418
MQALQTPPT

SEQ ID NO: 90836 - protein, 20 aa, Homo sapiens
  heavy chain complementarity determining region 3 for antibody 45418
VKVYYSSSGYPVYYYYGLAV

SEQ ID NO: 90837 - protein, 9 aa, Homo sapiens
  light chain complementarity determining region 3 for antibody 45419
MQALQTPPT

SEQ ID NO: 90838 - protein, 14 aa, Homo sapiens
  heavy chain complementarity determining region 3 for antibody 45419
ARKGDRSAYKAFDV

SEQ ID NO: 90839 - protein, 9 aa, Homo sapiens
  light chain complementarity determining region 3 for antibody 45420
MQALQTPPT

SEQ ID NO: 90840 - protein, 16 aa, Homo sapiens
  heavy chain complementarity determining region 3 for antibody 45420
ARGTAVATGGLDWFDS

SEQ ID NO: 90841 - protein, 9 aa, Homo sapiens
  light chain complementarity determining region 3 for antibody 45421
MQALQTPPT

SEQ ID NO: 90842 - protein, 17 aa, Homo sapiens
  heavy chain complementarity determining region 3 for antibody 45421
AREGTNYYDNNGYWFDP

SEQ ID NO: 90843 - protein, 9 aa, Homo sapiens
  light chain complementarity determining region 3 for antibody 45422
MQALQTPLT

SEQ ID NO: 90844 - protein, 14 aa, Homo sapiens
  heavy chain complementarity determining region 3 for antibody 45422
ATDGISISSLTFDY

SEQ ID NO: 90845 - protein, 9 aa, Homo sapiens
  light chain complementarity determining region 3 for antibody 45423
MQALQTPLT

SEQ ID NO: 90846 - protein, 16 aa, Homo sapiens
  heavy chain complementarity determining region 3 for antibody 45423
ASGNAAFGVVFISLGS

SEQ ID NO: 90847 - protein, 9 aa, Homo sapiens
  light chain complementarity determining region 3 for antibody 45424
MQALQTPLT

SEQ ID NO: 90848 - protein, 16 aa, Homo sapiens
  heavy chain complementarity determining region 3 for antibody 45424
ARDPDQDSSMENGMDV

SEQ ID NO: 90849 - protein, 10 aa, Homo sapiens
  light chain complementarity determining region 3 for antibody 45425
MQALQTPGYT

SEQ ID NO: 90850 - protein, 14 aa, Homo sapiens
  heavy chain complementarity determining region 3 for antibody 45425
ARDLSLGNPGGFDY

SEQ ID NO: 90851 - protein, 9 aa, Homo sapiens
  light chain complementarity determining region 3 for antibody 45426
MQALQTPGT

SEQ ID NO: 90852 - protein, 10 aa, Homo sapiens
  heavy chain complementarity determining region 3 for antibody 45426
ARDLGGGRGY

SEQ ID NO: 90853 - protein, 9 aa, Homo sapiens
  light chain complementarity determining region 3 for antibody 45427
MQALQTPGT

SEQ ID NO: 90854 - protein, 19 aa, Homo sapiens
  heavy chain complementarity determining region 3 for antibody 45427
ARAYCGGDCSHYHYYGVDV

SEQ ID NO: 90855 - protein, 9 aa, Homo sapiens
  light chain complementarity determining region 3 for antibody 45428
MQALQTPFT

SEQ ID NO: 90856 - protein, 21 aa, Homo sapiens
  heavy chain complementarity determining region 3 for antibody 45428
AKDIKSRREYYYDSSGYHLQH

SEQ ID NO: 90857 - protein, 8 aa, Homo sapiens
  light chain complementarity determining region 3 for antibody 45429
MQALQTLT

SEQ ID NO: 90858 - protein, 16 aa, Homo sapiens
  heavy chain complementarity determining region 3 for antibody 45429
ARDRGSLWFAEEGFDD

SEQ ID NO: 90859 - protein, 8 aa, Homo sapiens
  light chain complementarity determining region 3 for antibody 45430
MQALQTLT

SEQ ID NO: 90860 - protein, 16 aa, Homo sapiens
  heavy chain complementarity determining region 3 for antibody 45430
AKAGWLVGYDLSRGCA

SEQ ID NO: 90861 - protein, 9 aa, Homo sapiens
  light chain complementarity determining region 3 for antibody 45431
MQALQSPLT

SEQ ID NO: 90862 - protein, 12 aa, Homo sapiens
  heavy chain complementarity determining region 3 for antibody 45431
ASWHHTSRFFDS

SEQ ID NO: 90863 - protein, 10 aa, Homo sapiens
  light chain complementarity determining region 3 for antibody 45432
MQALQSPLFT

SEQ ID NO: 90864 - protein, 19 aa, Homo sapiens
  heavy chain complementarity determining region 3 for antibody 45432
VRDGYSGYDSYLNLGGLAV

SEQ ID NO: 90865 - protein, 8 aa, Homo sapiens
  light chain complementarity determining region 3 for antibody 45433
MQALQNPS

SEQ ID NO: 90866 - protein, 20 aa, Homo sapiens
  heavy chain complementarity determining region 3 for antibody 45433
ARALAVPGYSSSWYGISPDY

SEQ ID NO: 90867 - protein, 8 aa, Homo sapiens
  light chain complementarity determining region 3 for antibody 45434
MQALQIPT

SEQ ID NO: 90868 - protein, 15 aa, Homo sapiens
  heavy chain complementarity determining region 3 for antibody 45434
TRDRGDETRWFGFGL

SEQ ID NO: 90869 - protein, 8 aa, Homo sapiens
  light chain complementarity determining region 3 for antibody 45435
MQALQFIT

SEQ ID NO: 90870 - protein, 13 aa, Homo sapiens
  heavy chain complementarity determining region 3 for antibody 45435
TRGTTSTVGPFAV

SEQ ID NO: 90871 - protein, 9 aa, Homo sapiens
  light chain complementarity determining region 3 for antibody 45436
MQALETPGT

SEQ ID NO: 90872 - protein, 12 aa, Homo sapiens
  heavy chain complementarity determining region 3 for antibody 45436
ARESTRVTTLDY

SEQ ID NO: 90873 - protein, 9 aa, Homo sapiens
  light chain complementarity determining region 3 for antibody 45437
MQAHETPVT

SEQ ID NO: 90874 - protein, 15 aa, Homo sapiens
  heavy chain complementarity determining region 3 for antibody 45437
ARTGSSTWYGYGMGD

SEQ ID NO: 90875 - protein, 8 aa, Homo sapiens
  light chain complementarity determining region 3 for antibody 45438
LQYSSFWT

SEQ ID NO: 90876 - protein, 18 aa, Homo sapiens
  heavy chain complementarity determining region 3 for antibody 45438
AKDWGTISDLSRFGIFDY

SEQ ID NO: 90877 - protein, 9 aa, Homo sapiens
  light chain complementarity determining region 3 for antibody 45439
LQYNTYTWT

SEQ ID NO: 90878 - protein, 16 aa, Homo sapiens
  heavy chain complementarity determining region 3 for antibody 45439
ARGIPSGQSSSWAPDY

SEQ ID NO: 90879 - protein, 9 aa, Homo sapiens
  light chain complementarity determining region 3 for antibody 45440
LQYNDYPWT

SEQ ID NO: 90880 - protein, 15 aa, Homo sapiens
  heavy chain complementarity determining region 3 for antibody 45440
ARAYSGSYTQDEFDY

SEQ ID NO: 90881 - protein, 9 aa, Homo sapiens
  light chain complementarity determining region 3 for antibody 45441
LQYNDFPYI

SEQ ID NO: 90882 - protein, 13 aa, Homo sapiens
  heavy chain complementarity determining region 3 for antibody 45441
ARSPYSSGWYPDF

SEQ ID NO: 90883 - protein, 9 aa, Homo sapiens
  light chain complementarity determining region 3 for antibody 45442
LQYGGTPLT

SEQ ID NO: 90884 - protein, 8 aa, Homo sapiens
  heavy chain complementarity determining region 3 for antibody 45442
VRIMDPGY

SEQ ID NO: 90885 - protein, 9 aa, Homo sapiens
  light chain complementarity determining region 3 for antibody 45443
LQSKDFPPT

SEQ ID NO: 90886 - protein, 19 aa, Homo sapiens
  heavy chain complementarity determining region 3 for antibody 45443
TRDRDYGAYPPYNYYGTDV

SEQ ID NO: 90887 - protein, 9 aa, Homo sapiens
  light chain complementarity determining region 3 for antibody 45444
LQRSNWPST

SEQ ID NO: 90888 - protein, 18 aa, Homo sapiens
  heavy chain complementarity determining region 3 for antibody 45444
ARDRDAAMASYYYYGMDV

SEQ ID NO: 90889 - protein, 9 aa, Homo sapiens
  light chain complementarity determining region 3 for antibody 45445
LQHYTFPYM

SEQ ID NO: 90890 - protein, 20 aa, Homo sapiens
  heavy chain complementarity determining region 3 for antibody 45445
ARVRRGYCSADACYDDALDL

SEQ ID NO: 90891 - protein, 9 aa, Homo sapiens
  light chain complementarity determining region 3 for antibody 45446
LQHSTYPRT

SEQ ID NO: 90892 - protein, 13 aa, Homo sapiens
  heavy chain complementarity determining region 3 for antibody 45446
AREVEPGPSPYDY

SEQ ID NO: 90893 - protein, 9 aa, Homo sapiens
  light chain complementarity determining region 3 for antibody 45447
LQHSSNPPT

SEQ ID NO: 90894 - protein, 12 aa, Homo sapiens
  heavy chain complementarity determining region 3 for antibody 45447
ARGRRGGSCPDY

SEQ ID NO: 90895 - protein, 9 aa, Homo sapiens
  light chain complementarity determining region 3 for antibody 45448
LQHNSYSYT

SEQ ID NO: 90896 - protein, 19 aa, Homo sapiens
  heavy chain complementarity determining region 3 for antibody 45448
ARGRHIVVVTAIQGDAFEN

SEQ ID NO: 90897 - protein, 9 aa, Homo sapiens
  light chain complementarity determining region 3 for antibody 45449
LQHNSYPWT

SEQ ID NO: 90898 - protein, 19 aa, Homo sapiens
  heavy chain complementarity determining region 3 for antibody 45449
ARRGMGGYATDEGHNYFDP

SEQ ID NO: 90899 - protein, 9 aa, Homo sapiens
  light chain complementarity determining region 3 for antibody 45450
LQHNSYPQT

SEQ ID NO: 90900 - protein, 18 aa, Homo sapiens
  heavy chain complementarity determining region 3 for antibody 45450
ARINPSAYYDSSGYYLDY

SEQ ID NO: 90901 - protein, 9 aa, Homo sapiens
  light chain complementarity determining region 3 for antibody 45451
LQHNSYPLT

SEQ ID NO: 90902 - protein, 19 aa, Homo sapiens
  heavy chain complementarity determining region 3 for antibody 45451
ARDMSLWFDSRGFSGAFDY

SEQ ID NO: 90903 - protein, 10 aa, Homo sapiens
  light chain complementarity determining region 3 for antibody 45452
LQHDNFPPHT

SEQ ID NO: 90904 - protein, 20 aa, Homo sapiens
  heavy chain complementarity determining region 3 for antibody 45452
AKTRNWRIQLWLVPHDAFDV

SEQ ID NO: 90905 - protein, 9 aa, Homo sapiens
  light chain complementarity determining region 3 for antibody 45453
LQGKYWPYT

SEQ ID NO: 90906 - protein, 11 aa, Homo sapiens
  heavy chain complementarity determining region 3 for antibody 45453
AKDDAAGSIDS

SEQ ID NO: 90907 - protein, 9 aa, Homo sapiens
  light chain complementarity determining region 3 for antibody 45454
LQDYSYPLT

SEQ ID NO: 90908 - protein, 13 aa, Homo sapiens
  heavy chain complementarity determining region 3 for antibody 45454
AQVHGSGLAHGGF

SEQ ID NO: 90909 - protein, 9 aa, Homo sapiens
  light chain complementarity determining region 3 for antibody 45455
LQDYNYPYT

SEQ ID NO: 90910 - protein, 16 aa, Homo sapiens
  heavy chain complementarity determining region 3 for antibody 45455
GRARRGEGITFGLIDN

SEQ ID NO: 90911 - protein, 9 aa, Homo sapiens
  light chain complementarity determining region 3 for antibody 45456
LQDYNYPRT

SEQ ID NO: 90912 - protein, 13 aa, Homo sapiens
  heavy chain complementarity determining region 3 for antibody 45456
ARAQLWLAGWFDP

SEQ ID NO: 90913 - protein, 9 aa, Homo sapiens
  light chain complementarity determining region 3 for antibody 45457
LQDYNYPRT

SEQ ID NO: 90914 - protein, 20 aa, Homo sapiens
  heavy chain complementarity determining region 3 for antibody 45457
AKTRNWRIQLWLVPHDAFDV

SEQ ID NO: 90915 - protein, 9 aa, Homo sapiens
  light chain complementarity determining region 3 for antibody 45458
LQDYNYPLT

SEQ ID NO: 90916 - protein, 17 aa, Homo sapiens
  heavy chain complementarity determining region 3 for antibody 45458
ARHLGDMSDQDQVGFDL

SEQ ID NO: 90917 - protein, 9 aa, Homo sapiens
  light chain complementarity determining region 3 for antibody 45459
LHYNNWPYT

SEQ ID NO: 90918 - protein, 11 aa, Homo sapiens
  heavy chain complementarity determining region 3 for antibody 45459
AMGLRGFEIEF

SEQ ID NO: 90919 - protein, 10 aa, Homo sapiens
  light chain complementarity determining region 3 for antibody 45460
LEGTHWPPVT

SEQ ID NO: 90920 - protein, 19 aa, Homo sapiens
  heavy chain complementarity determining region 3 for antibody 45460
SRDQSRPEANGWGIKSFDV

SEQ ID NO: 90921 - protein, 9 aa, Homo sapiens
  light chain complementarity determining region 3 for antibody 45461
IQALQTPFS

SEQ ID NO: 90922 - protein, 18 aa, Homo sapiens
  heavy chain complementarity determining region 3 for antibody 45461
ARDRDAAMASYYYYGMDV

SEQ ID NO: 90923 - protein, 9 aa, Homo sapiens
  light chain complementarity determining region 3 for antibody 45462
HQYRGHSQT

SEQ ID NO: 90924 - protein, 21 aa, Homo sapiens
  heavy chain complementarity determining region 3 for antibody 45462
ARNSYGSGTYYDRSSYYGMDV

SEQ ID NO: 90925 - protein, 9 aa, Homo sapiens
  light chain complementarity determining region 3 for antibody 45463
HQYNNWPFT

SEQ ID NO: 90926 - protein, 17 aa, Homo sapiens
  heavy chain complementarity determining region 3 for antibody 45463
APRLGIAPEPHYWYFDL

SEQ ID NO: 90927 - protein, 9 aa, Homo sapiens
  light chain complementarity determining region 3 for antibody 45464
HQYKNYPQT

SEQ ID NO: 90928 - protein, 21 aa, Homo sapiens
  heavy chain complementarity determining region 3 for antibody 45464
AKDAPVFRPYSSGWYSSAFDS

SEQ ID NO: 90929 - protein, 8 aa, Homo sapiens
  light chain complementarity determining region 3 for antibody 45465
HQYGGSQT

SEQ ID NO: 90930 - protein, 9 aa, Homo sapiens
  heavy chain complementarity determining region 3 for antibody 45465
ARGMLGFDS

SEQ ID NO: 90931 - protein, 9 aa, Homo sapiens
  light chain complementarity determining region 3 for antibody 45466
HQYFSPPLT

SEQ ID NO: 90932 - protein, 15 aa, Homo sapiens
  heavy chain complementarity determining region 3 for antibody 45466
ARGSCSAGSCYLIDI

SEQ ID NO: 90933 - protein, 9 aa, Homo sapiens
  light chain complementarity determining region 3 for antibody 45467
HQTRALPLT

SEQ ID NO: 90934 - protein, 17 aa, Homo sapiens
  heavy chain complementarity determining region 3 for antibody 45467
ASMGIAMVRGRYDAFDM

SEQ ID NO: 90935 - protein, 9 aa, Homo sapiens
  light chain complementarity determining region 3 for antibody 45468
HQSYSPPQT

SEQ ID NO: 90936 - protein, 22 aa, Homo sapiens
  heavy chain complementarity determining region 3 for antibody 45468
ARGRKSIMASEVRERSVRLIDY

SEQ ID NO: 90937 - protein, 9 aa, Homo sapiens
  light chain complementarity determining region 3 for antibody 45469
HQSSSLPQT

SEQ ID NO: 90938 - protein, 22 aa, Homo sapiens
  heavy chain complementarity determining region 3 for antibody 45469
ARDGHFTRGYCSDSSCFGGFDV

SEQ ID NO: 90939 - protein, 9 aa, Homo sapiens
  light chain complementarity determining region 3 for antibody 45470
HQSSSLPFT

SEQ ID NO: 90940 - protein, 17 aa, Homo sapiens
  heavy chain complementarity determining region 3 for antibody 45470
ARGLHHADGTYFHGMDV

SEQ ID NO: 90941 - protein, 11 aa, Homo sapiens
  light chain complementarity determining region 3 for antibody 45471
HQRSNWPPGIT

SEQ ID NO: 90942 - protein, 10 aa, Homo sapiens
  heavy chain complementarity determining region 3 for antibody 45471
AGGNGDSFDD

SEQ ID NO: 90943 - protein, 9 aa, Homo sapiens
  light chain complementarity determining region 3 for antibody 45472
HQRGNWPST

SEQ ID NO: 90944 - protein, 14 aa, Homo sapiens
  heavy chain complementarity determining region 3 for antibody 45472
VKEKDYHISTTYDY

SEQ ID NO: 90945 - protein, 9 aa, Homo sapiens
  light chain complementarity determining region 3 for antibody 45473
HHSSSAPLI

SEQ ID NO: 90946 - protein, 13 aa, Homo sapiens
  heavy chain complementarity determining region 3 for antibody 45473
ARHLPYSNGYFDY

SEQ ID NO: 90947 - protein, 9 aa, Homo sapiens
  light chain complementarity determining region 3 for antibody 45474
FQTLLSPQT

SEQ ID NO: 90948 - protein, 18 aa, Homo sapiens
  heavy chain complementarity determining region 3 for antibody 45474
ARPRDVFTGYGYAFGMDV

SEQ ID NO: 90949 - protein, 9 aa, Homo sapiens
  light chain complementarity determining region 3 for antibody 45475
EQTSIIPLT

SEQ ID NO: 90950 - protein, 5 aa, Homo sapiens
  heavy chain complementarity determining region 3 for antibody 45475
AGWLA

SEQ ID NO: 90951 - protein, 9 aa, Homo sapiens
  light chain complementarity determining region 3 for antibody 45476
VQHNAYPYT

SEQ ID NO: 90952 - protein, 15 aa, Homo sapiens
  heavy chain complementarity determining region 3 for antibody 45476
AREKAGRFFDVGLDS

SEQ ID NO: 90953 - protein, 12 aa, Homo sapiens
  light chain complementarity determining region 3 for antibody 45477
VQALQIPPNMYT

SEQ ID NO: 90954 - protein, 15 aa, Homo sapiens
  heavy chain complementarity determining region 3 for antibody 45477
VKDSSGWYWDDVFDV

SEQ ID NO: 90955 - protein, 6 aa, Homo sapiens
  light chain complementarity determining region 3 for antibody 45478
QYLGGW

SEQ ID NO: 90956 - protein, 11 aa, Homo sapiens
  heavy chain complementarity determining region 3 for antibody 45478
ARVGLPHAYDI

SEQ ID NO: 90957 - protein, 11 aa, Homo sapiens
  light chain complementarity determining region 3 for antibody 45479
QVRVHWPPLIT

SEQ ID NO: 90958 - protein, 20 aa, Homo sapiens
  heavy chain complementarity determining region 3 for antibody 45479
ARLGQEPMYGVLVTLDGLDM

SEQ ID NO: 90959 - protein, 10 aa, Homo sapiens
  light chain complementarity determining region 3 for antibody 45480
QRYDSSPLYT

SEQ ID NO: 90960 - protein, 12 aa, Homo sapiens
  heavy chain complementarity determining region 3 for antibody 45480
ARGGISGYHFDY

SEQ ID NO: 90961 - protein, 9 aa, Homo sapiens
  light chain complementarity determining region 3 for antibody 45481
QQYYTTPDT

SEQ ID NO: 90962 - protein, 13 aa, Homo sapiens
  heavy chain complementarity determining region 3 for antibody 45481
TTRHLHGDFHFDY

SEQ ID NO: 90963 - protein, 10 aa, Homo sapiens
  light chain complementarity determining region 3 for antibody 45482
QQYYSYSPYT

SEQ ID NO: 90964 - protein, 15 aa, Homo sapiens
  heavy chain complementarity determining region 3 for antibody 45482
AKGATRGWEVSHFDY

SEQ ID NO: 90965 - protein, 9 aa, Homo sapiens
  light chain complementarity determining region 3 for antibody 45483
QQYYSYPYT

SEQ ID NO: 90966 - protein, 19 aa, Homo sapiens
  heavy chain complementarity determining region 3 for antibody 45483
VRDSYRAQQWLATGHAFDI

SEQ ID NO: 90967 - protein, 9 aa, Homo sapiens
  light chain complementarity determining region 3 for antibody 45484
QQYYSTPPT

SEQ ID NO: 90968 - protein, 11 aa, Homo sapiens
  heavy chain complementarity determining region 3 for antibody 45484
ATWEAITGFDN

SEQ ID NO: 90969 - protein, 9 aa, Homo sapiens
  light chain complementarity determining region 3 for antibody 45485
QQYYSTPPT

SEQ ID NO: 90970 - protein, 18 aa, Homo sapiens
  heavy chain complementarity determining region 3 for antibody 45485
ARDMSSDYDYEYKFTMDV

SEQ ID NO: 90971 - protein, 10 aa, Homo sapiens
  light chain complementarity determining region 3 for antibody 45486
QQYYSTPMYT

SEQ ID NO: 90972 - protein, 10 aa, Homo sapiens
  heavy chain complementarity determining region 3 for antibody 45486
ARGAGTGLDY

SEQ ID NO: 90973 - protein, 9 aa, Homo sapiens
  light chain complementarity determining region 3 for antibody 45487
QQYYSTPKT

SEQ ID NO: 90974 - protein, 13 aa, Homo sapiens
  heavy chain complementarity determining region 3 for antibody 45487
AREGYYGSGEFDY

SEQ ID NO: 90975 - protein, 9 aa, Homo sapiens
  light chain complementarity determining region 3 for antibody 45488
QQYYSTLFT

SEQ ID NO: 90976 - protein, 15 aa, Homo sapiens
  heavy chain complementarity determining region 3 for antibody 45488
AKDVWVHGDSYAFDV

SEQ ID NO: 90977 - protein, 9 aa, Homo sapiens
  light chain complementarity determining region 3 for antibody 45489
QQYYSSQWT

SEQ ID NO: 90978 - protein, 12 aa, Homo sapiens
  heavy chain complementarity determining region 3 for antibody 45489
TPARGSGLGMDV

SEQ ID NO: 90979 - protein, 9 aa, Homo sapiens
  light chain complementarity determining region 3 for antibody 45490
QQYYSPPYN

SEQ ID NO: 90980 - protein, 13 aa, Homo sapiens
  heavy chain complementarity determining region 3 for antibody 45490
ATGMLGAEYYFDS

SEQ ID NO: 90981 - protein, 9 aa, Homo sapiens
  light chain complementarity determining region 3 for antibody 45491
QQYYSAPFT

SEQ ID NO: 90982 - protein, 16 aa, Homo sapiens
  heavy chain complementarity determining region 3 for antibody 45491
ARTMDCRDNCRNWFDL

SEQ ID NO: 90983 - protein, 9 aa, Homo sapiens
  light chain complementarity determining region 3 for antibody 45492
QQYYRYAIT

SEQ ID NO: 90984 - protein, 16 aa, Homo sapiens
  heavy chain complementarity determining region 3 for antibody 45492
AKMGLGEYCAGACNPN

SEQ ID NO: 90985 - protein, 9 aa, Homo sapiens
  light chain complementarity determining region 3 for antibody 45493
QQYYNFPVT

SEQ ID NO: 90986 - protein, 14 aa, Homo sapiens
  heavy chain complementarity determining region 3 for antibody 45493
ARAHDTSGYSKFDY

SEQ ID NO: 90987 - protein, 8 aa, Homo sapiens
  light chain complementarity determining region 3 for antibody 45494
QQYVTSHT

SEQ ID NO: 90988 - protein, 17 aa, Homo sapiens
  heavy chain complementarity determining region 3 for antibody 45494
ARVKSDYGLGTLGRFDY

SEQ ID NO: 90989 - protein, 9 aa, Homo sapiens
  light chain complementarity determining region 3 for antibody 45495
QQYVSSPYT

SEQ ID NO: 90990 - protein, 19 aa, Homo sapiens
  heavy chain complementarity determining region 3 for antibody 45495
ARDHEAYCGADCWTDGFDL

SEQ ID NO: 90991 - protein, 11 aa, Homo sapiens
  light chain complementarity determining region 3 for antibody 45496
QQYVNSPPTYT

SEQ ID NO: 90992 - protein, 15 aa, Homo sapiens
  heavy chain complementarity determining region 3 for antibody 45496
ARHNDISTVYPSFWF

SEQ ID NO: 90993 - protein, 9 aa, Homo sapiens
  light chain complementarity determining region 3 for antibody 45497
QQYTNWPIT

SEQ ID NO: 90994 - protein, 11 aa, Homo sapiens
  heavy chain complementarity determining region 3 for antibody 45497
AIDRALIGFDD

SEQ ID NO: 90995 - protein, 9 aa, Homo sapiens
  light chain complementarity determining region 3 for antibody 45498
QQYTGAPLP

SEQ ID NO: 90996 - protein, 11 aa, Homo sapiens
  heavy chain complementarity determining region 3 for antibody 45498
ARRGVTPALDI

SEQ ID NO: 90997 - protein, 10 aa, Homo sapiens
  light chain complementarity determining region 3 for antibody 45499
QQYSTSPPWT

SEQ ID NO: 90998 - protein, 17 aa, Homo sapiens
  heavy chain complementarity determining region 3 for antibody 45499
AKDIFFAIAVAGTAFDI

SEQ ID NO: 90999 - protein, 8 aa, Homo sapiens
  light chain complementarity determining region 3 for antibody 45500
QQYSTLPS

SEQ ID NO: 91000 - protein, 16 aa, Homo sapiens
  heavy chain complementarity determining region 3 for antibody 45500
ARAANWGSALGWHFDL

SEQ ID NO: 91001 - protein, 9 aa, Homo sapiens
  light chain complementarity determining region 3 for antibody 45501
QQYSSSPWT

SEQ ID NO: 91002 - protein, 14 aa, Homo sapiens
  heavy chain complementarity determining region 3 for antibody 45501
ARDSSSTSWGPIDY

SEQ ID NO: 91003 - protein, 9 aa, Homo sapiens
  light chain complementarity determining region 3 for antibody 45502
QQYSNYPWT

SEQ ID NO: 91004 - protein, 17 aa, Homo sapiens
  heavy chain complementarity determining region 3 for antibody 45502
AKGRPTSTFGEVMPPDS

SEQ ID NO: 91005 - protein, 9 aa, Homo sapiens
  light chain complementarity determining region 3 for antibody 45503
QQYSNWPWT

SEQ ID NO: 91006 - protein, 11 aa, Homo sapiens
  heavy chain complementarity determining region 3 for antibody 45503
ARDRYVGRVGY

SEQ ID NO: 91007 - protein, 9 aa, Homo sapiens
  light chain complementarity determining region 3 for antibody 45504
QQYREYPYT

SEQ ID NO: 91008 - protein, 15 aa, Homo sapiens
  heavy chain complementarity determining region 3 for antibody 45504
ATDRGINWAHSRFDS

SEQ ID NO: 91009 - protein, 8 aa, Homo sapiens
  light chain complementarity determining region 3 for antibody 45505
QQYRASFP

SEQ ID NO: 91010 - protein, 13 aa, Homo sapiens
  heavy chain complementarity determining region 3 for antibody 45505
ATESGSYQGAFDI

SEQ ID NO: 91011 - protein, 8 aa, Homo sapiens
  light chain complementarity determining region 3 for antibody 45506
QQYQSYFS

SEQ ID NO: 91012 - protein, 22 aa, Homo sapiens
  heavy chain complementarity determining region 3 for antibody 45506
ARAAGGESVVGPRGHFYYNMDV

SEQ ID NO: 91013 - protein, 9 aa, Homo sapiens
  light chain complementarity determining region 3 for antibody 45507
QQYQKYPFT

SEQ ID NO: 91014 - protein, 14 aa, Homo sapiens
  heavy chain complementarity determining region 3 for antibody 45507
ARFLTLVGGASFDS

SEQ ID NO: 91015 - protein, 9 aa, Homo sapiens
  light chain complementarity determining region 3 for antibody 45508
QQYNTYPWT

SEQ ID NO: 91016 - protein, 13 aa, Homo sapiens
  heavy chain complementarity determining region 3 for antibody 45508
ATVGGGGYAPEKD

SEQ ID NO: 91017 - protein, 9 aa, Homo sapiens
  light chain complementarity determining region 3 for antibody 45509
QQYNSYSWT

SEQ ID NO: 91018 - protein, 24 aa, Homo sapiens
  heavy chain complementarity determining region 3 for antibody 45509
AKDWQNAPYATARRDGYNFEGPEY

SEQ ID NO: 91019 - protein, 8 aa, Homo sapiens
  light chain complementarity determining region 3 for antibody 45510
QQYNSYSS

SEQ ID NO: 91020 - protein, 18 aa, Homo sapiens
  heavy chain complementarity determining region 3 for antibody 45510
ARRTAPRPGSTLASVMDS

SEQ ID NO: 91021 - protein, 9 aa, Homo sapiens
  light chain complementarity determining region 3 for antibody 45511
QQYNSYSRT

SEQ ID NO: 91022 - protein, 14 aa, Homo sapiens
  heavy chain complementarity determining region 3 for antibody 45511
ASPDDVYFSRAFDI

SEQ ID NO: 91023 - protein, 10 aa, Homo sapiens
  light chain complementarity determining region 3 for antibody 45512
QQYNSYSPYT

SEQ ID NO: 91024 - protein, 19 aa, Homo sapiens
  heavy chain complementarity determining region 3 for antibody 45512
VRHAVGASVAAQLFWYFDL

SEQ ID NO: 91025 - protein, 10 aa, Homo sapiens
  light chain complementarity determining region 3 for antibody 45513
QQYNSYSPYT

SEQ ID NO: 91026 - protein, 12 aa, Homo sapiens
  heavy chain complementarity determining region 3 for antibody 45513
AALRYFDWYFNS

SEQ ID NO: 91027 - protein, 9 aa, Homo sapiens
  light chain complementarity determining region 3 for antibody 45514
QQYNSYSGT

SEQ ID NO: 91028 - protein, 15 aa, Homo sapiens
  heavy chain complementarity determining region 3 for antibody 45514
ARRHYYGSGSYYFDY

SEQ ID NO: 91029 - protein, 9 aa, Homo sapiens
  light chain complementarity determining region 3 for antibody 45515
QQYNSYPYT

SEQ ID NO: 91030 - protein, 18 aa, Homo sapiens
  heavy chain complementarity determining region 3 for antibody 45515
ARGYRPGVAASGFIHFDN

SEQ ID NO: 91031 - protein, 9 aa, Homo sapiens
  light chain complementarity determining region 3 for antibody 45516
QQYNSYPRT

SEQ ID NO: 91032 - protein, 19 aa, Homo sapiens
  heavy chain complementarity determining region 3 for antibody 45516
AKDLTLVRGVIFYYYGMDV

SEQ ID NO: 91033 - protein, 9 aa, Homo sapiens
  light chain complementarity determining region 3 for antibody 45517
QQYNSYPLT

SEQ ID NO: 91034 - protein, 20 aa, Homo sapiens
  heavy chain complementarity determining region 3 for antibody 45517
ASEEVTGYSSSWTGIDAFDI

SEQ ID NO: 91035 - protein, 9 aa, Homo sapiens
  light chain complementarity determining region 3 for antibody 45518
QQYNSYPLT

SEQ ID NO: 91036 - protein, 14 aa, Homo sapiens
  heavy chain complementarity determining region 3 for antibody 45518
ARSHIVMVAYGIDV

SEQ ID NO: 91037 - protein, 9 aa, Homo sapiens
  light chain complementarity determining region 3 for antibody 45519
QQYNSYPLT

SEQ ID NO: 91038 - protein, 21 aa, Homo sapiens
  heavy chain complementarity determining region 3 for antibody 45519
ARARKAPDICRTCYYYYGMDV

SEQ ID NO: 91039 - protein, 9 aa, Homo sapiens
  light chain complementarity determining region 3 for antibody 45520
QQYNSYPIT

SEQ ID NO: 91040 - protein, 15 aa, Homo sapiens
  heavy chain complementarity determining region 3 for antibody 45520
ARIAYISGWYTWFDP

SEQ ID NO: 91041 - protein, 9 aa, Homo sapiens
  light chain complementarity determining region 3 for antibody 45521
QQYNSYPHT

SEQ ID NO: 91042 - protein, 17 aa, Homo sapiens
  heavy chain complementarity determining region 3 for antibody 45521
AHTSYYYGSGSYPNFDY

SEQ ID NO: 91043 - protein, 9 aa, Homo sapiens
  light chain complementarity determining region 3 for antibody 45522
QQYNSYPFT

SEQ ID NO: 91044 - protein, 15 aa, Homo sapiens
  heavy chain complementarity determining region 3 for antibody 45522
ARGLNILTGYSLFDY

SEQ ID NO: 91045 - protein, 9 aa, Homo sapiens
  light chain complementarity determining region 3 for antibody 45523
QQYNSPPWT

SEQ ID NO: 91046 - protein, 18 aa, Homo sapiens
  heavy chain complementarity determining region 3 for antibody 45523
AKKDYHDINGYSSDGLDV

SEQ ID NO: 91047 - protein, 9 aa, Homo sapiens
  light chain complementarity determining region 3 for antibody 45524
QQYNRYPYT

SEQ ID NO: 91048 - protein, 12 aa, Homo sapiens
  heavy chain complementarity determining region 3 for antibody 45524
ATNGANSWYGDS

SEQ ID NO: 91049 - protein, 9 aa, Homo sapiens
  light chain complementarity determining region 3 for antibody 45525
QQYNRVPFT

SEQ ID NO: 91050 - protein, 14 aa, Homo sapiens
  heavy chain complementarity determining region 3 for antibody 45525
AREIAGPGPQPLDY

SEQ ID NO: 91051 - protein, 9 aa, Homo sapiens
  light chain complementarity determining region 3 for antibody 45526
QQYNNYLYT

SEQ ID NO: 91052 - protein, 11 aa, Homo sapiens
  heavy chain complementarity determining region 3 for antibody 45526
AREFVSRPPDY

SEQ ID NO: 91053 - protein, 9 aa, Homo sapiens
  light chain complementarity determining region 3 for antibody 45527
QQYNNWPWT

SEQ ID NO: 91054 - protein, 15 aa, Homo sapiens
  heavy chain complementarity determining region 3 for antibody 45527
ARDFSSLWELLPFDY

SEQ ID NO: 91055 - protein, 9 aa, Homo sapiens
  light chain complementarity determining region 3 for antibody 45528
QQYNNWPRT

SEQ ID NO: 91056 - protein, 13 aa, Homo sapiens
  heavy chain complementarity determining region 3 for antibody 45528
SKQSGGGSSGLDV

SEQ ID NO: 91057 - protein, 9 aa, Homo sapiens
  light chain complementarity determining region 3 for antibody 45529
QQYNNWPRT

SEQ ID NO: 91058 - protein, 13 aa, Homo sapiens
  heavy chain complementarity determining region 3 for antibody 45529
ARGRAAAGTYFDY

SEQ ID NO: 91059 - protein, 10 aa, Homo sapiens
  light chain complementarity determining region 3 for antibody 45530
QQYNNWPPYT

SEQ ID NO: 91060 - protein, 17 aa, Homo sapiens
  heavy chain complementarity determining region 3 for antibody 45530
ASGKRGYSYGLRGPGDY

SEQ ID NO: 91061 - protein, 10 aa, Homo sapiens [sequence omitted]

SEQ ID NO: 91062 - protein, 16 aa, Homo sapiens
  heavy chain complementarity determining region 3 for antibody 45531
ARPRLDYGDYGHSLQH

SEQ ID NO: 91063 - protein, 10 aa, Homo sapiens [sequence omitted]

SEQ ID NO: 91064 - protein, 15 aa, Homo sapiens
  heavy chain complementarity determining region 3 for antibody 45532
ARGSYNWNPADPFDL

SEQ ID NO: 91065 - protein, 11 aa, Homo sapiens
  light chain complementarity determining region 3 for antibody 45533
QQYNNWPPPYT

SEQ ID NO: 91066 - protein, 15 aa, Homo sapiens
  heavy chain complementarity determining region 3 for antibody 45533
ASAQSSSSFHRYFDY

SEQ ID NO: 91067 - protein, 10 aa, Homo sapiens
  light chain complementarity determining region 3 for antibody 45534
QQYNNWPPHT

SEQ ID NO: 91068 - protein, 20 aa, Homo sapiens
  heavy chain complementarity determining region 3 for antibody 45534
AKVYGTPERPAVTRGVPLDN

SEQ ID NO: 91069 - protein, 9 aa, Homo sapiens
  light chain complementarity determining region 3 for antibody 45535
QQYNNWPPA

SEQ ID NO: 91070 - protein, 13 aa, Homo sapiens
  heavy chain complementarity determining region 3 for antibody 45535
ARVPGTSFYYFNY

SEQ ID NO: 91071 - protein, 10 aa, Homo sapiens
  light chain complementarity determining region 3 for antibody 45536
QQYNNVPVFT

SEQ ID NO: 91072 - protein, 17 aa, Homo sapiens
  heavy chain complementarity determining region 3 for antibody 45536
AIIPVAKAYYYSYDMDV

SEQ ID NO: 91073 - protein, 12 aa, Homo sapiens
  light chain complementarity determining region 3 for antibody 45537
QQYNKWPPAGGT

SEQ ID NO: 91074 - protein, 18 aa, Homo sapiens
  heavy chain complementarity determining region 3 for antibody 45537
ASWAGSSGNDWGYAVFDY

SEQ ID NO: 91075 - protein, 8 aa, Homo sapiens
  light chain complementarity determining region 3 for antibody 45538
QQYNDYWT

SEQ ID NO: 91076 - protein, 15 aa, Homo sapiens
  heavy chain complementarity determining region 3 for antibody 45538
VRGYCIADCYGLLGY

SEQ ID NO: 91077 - protein, 9 aa, Homo sapiens
  light chain complementarity determining region 3 for antibody 45539
QQYNDWPIT

SEQ ID NO: 91078 - protein, 14 aa, Homo sapiens
  heavy chain complementarity determining region 3 for antibody 45539
ARDRGKVAGAYSDY

SEQ ID NO: 91079 - protein, 9 aa, Homo sapiens
  light chain complementarity determining region 3 for antibody 45540
QQYNAWPWT

SEQ ID NO: 91080 - protein, 13 aa, Homo sapiens
  heavy chain complementarity determining region 3 for antibody 45540
AKSSGTWYEVADY

SEQ ID NO: 91081 - protein, 9 aa, Homo sapiens
  light chain complementarity determining region 3 for antibody 45541
QQYKSYLYT

SEQ ID NO: 91082 - protein, 19 aa, Homo sapiens
  heavy chain complementarity determining region 3 for antibody 45541
ARHVFFGSGSWHTGNWFDP

SEQ ID NO: 91083 - protein, 9 aa, Homo sapiens
  light chain complementarity determining region 3 for antibody 45542
QQYKSFPWT

SEQ ID NO: 91084 - protein, 16 aa, Homo sapiens
  heavy chain complementarity determining region 3 for antibody 45542
ARLKRDGGSQQYYFAS

SEQ ID NO: 91085 - protein, 10 aa, Homo sapiens
  light chain complementarity determining region 3 for antibody 45543
QQYKQWPPYT

SEQ ID NO: 91086 - protein, 16 aa, Homo sapiens
  heavy chain complementarity determining region 3 for antibody 45543
ARGMWTVGEPGDKFDL

SEQ ID NO: 91087 - protein, 9 aa, Homo sapiens
  light chain complementarity determining region 3 for antibody 45544
QQYISTPYT

SEQ ID NO: 91088 - protein, 20 aa, Homo sapiens
  heavy chain complementarity determining region 3 for antibody 45544
ARDLDISVLRGVTEDDAFDI

SEQ ID NO: 91089 - protein, 9 aa, Homo sapiens
  light chain complementarity determining region 3 for antibody 45545
QQYHNLPQT

SEQ ID NO: 91090 - protein, 17 aa, Homo sapiens
  heavy chain complementarity determining region 3 for antibody 45545
AKDLTPWLARADNPFDY

SEQ ID NO: 91091 - protein, 11 aa, Homo sapiens
  light chain complementarity determining region 3 for antibody 45546
QQYGTSPPRLP

SEQ ID NO: 91092 - protein, 9 aa, Homo sapiens
  heavy chain complementarity determining region 3 for antibody 45546
ARGSTALGY

SEQ ID NO: 91093 - protein, 9 aa, Homo sapiens
  light chain complementarity determining region 3 for antibody 45547
QQYGSWPWT

SEQ ID NO: 91094 - protein, 15 aa, Homo sapiens
  heavy chain complementarity determining region 3 for antibody 45547
ARDPHSGSYPIAFDI

SEQ ID NO: 91095 - protein, 9 aa, Homo sapiens
  light chain complementarity determining region 3 for antibody 45548
QQYGSSSHT

SEQ ID NO: 91096 - protein, 15 aa, Homo sapiens
  heavy chain complementarity determining region 3 for antibody 45548
ACPSGWYTIFHAFDY

SEQ ID NO: 91097 - protein, 10 aa, Homo sapiens
  light chain complementarity determining region 3 for antibody 45549
QQYGSSRSIT

SEQ ID NO: 91098 - protein, 14 aa, Homo sapiens
  heavy chain complementarity determining region 3 for antibody 45549
ARGRQLGTGWYFDV

SEQ ID NO: 91099 - protein, 9 aa, Homo sapiens
  light chain complementarity determining region 3 for antibody 45550
QQYGSSRFT

SEQ ID NO: 91100 - protein, 18 aa, Homo sapiens
  heavy chain complementarity determining region 3 for antibody 45550
ARGLGFRWKNIYHYGMNV

SEQ ID NO: 91101 - protein, 9 aa, Homo sapiens
  light chain complementarity determining region 3 for antibody 45551
QQYGSSQWT

SEQ ID NO: 91102 - protein, 21 aa, Homo sapiens
  heavy chain complementarity determining region 3 for antibody 45551
ARVKVAAGHKANTYYYNAMDV

SEQ ID NO: 91103 - protein, 9 aa, Homo sapiens
  light chain complementarity determining region 3 for antibody 45552
QQYGSSQWT

SEQ ID NO: 91104 - protein, 26 aa, Homo sapiens
  heavy chain complementarity determining region 3 for antibody 45552
ARDRFLGYYDDTDSLYSPGFANGMDV

SEQ ID NO: 91105 - protein, 9 aa, Homo sapiens
  light chain complementarity determining region 3 for antibody 45553
QQYGSSPYT

SEQ ID NO: 91106 - protein, 17 aa, Homo sapiens
  heavy chain complementarity determining region 3 for antibody 45553
ARGAVDFWSGRTGSHDP

SEQ ID NO: 91107 - protein, 9 aa, Homo sapiens
  light chain complementarity determining region 3 for antibody 45554
QQYGSSPWT

SEQ ID NO: 91108 - protein, 12 aa, Homo sapiens
  heavy chain complementarity determining region 3 for antibody 45554
ARHNGREGHFDY

SEQ ID NO: 91109 - protein, 9 aa, Homo sapiens
  light chain complementarity determining region 3 for antibody 45555
QQYGSSPWT

SEQ ID NO: 91110 - protein, 18 aa, Homo sapiens
  heavy chain complementarity determining region 3 for antibody 45555
AHATRVPGTRAGIYYFDY

SEQ ID NO: 91111 - protein, 9 aa, Homo sapiens
  light chain complementarity determining region 3 for antibody 45556
QQYGSSPWP

SEQ ID NO: 91112 - protein, 17 aa, Homo sapiens
  heavy chain complementarity determining region 3 for antibody 45556
ARGGAYYDSSGYDQFDY

SEQ ID NO: 91113 - protein, 10 aa, Homo sapiens
  light chain complementarity determining region 3 for antibody 45557
QQYGSSPSYT

SEQ ID NO: 91114 - protein, 11 aa, Homo sapiens
  heavy chain complementarity determining region 3 for antibody 45557
ARSPDIGTTDY

SEQ ID NO: 91115 - protein, 9 aa, Homo sapiens
  light chain complementarity determining region 3 for antibody 45558
QQYGSSPST

SEQ ID NO: 91116 - protein, 16 aa, Homo sapiens
  heavy chain complementarity determining region 3 for antibody 45558
AATRRRREGYRVVLDY

SEQ ID NO: 91117 - protein, 9 aa, Homo sapiens
  light chain complementarity determining region 3 for antibody 45559
QQYGSSPRT

SEQ ID NO: 91118 - protein, 16 aa, Homo sapiens
  heavy chain complementarity determining region 3 for antibody 45559
ARVTWVRGLTTPAFDY

SEQ ID NO: 91119 - protein, 9 aa, Homo sapiens
  light chain complementarity determining region 3 for antibody 45560
QQYGSSPRT

SEQ ID NO: 91120 - protein, 12 aa, Homo sapiens
  heavy chain complementarity determining region 3 for antibody 45560
AAYGIGWYFRDY

SEQ ID NO: 91121 - protein, 10 aa, Homo sapiens
  light chain complementarity determining region 3 for antibody 45561
QQYGSSPPVT

SEQ ID NO: 91122 - protein, 15 aa, Homo sapiens
  heavy chain complementarity determining region 3 for antibody 45561
ANGGGSGTYYTTFDY

SEQ ID NO: 91123 - protein, 9 aa, Homo sapiens
  light chain complementarity determining region 3 for antibody 45562
QQYGSSPPT

SEQ ID NO: 91124 - protein, 16 aa, Homo sapiens
  heavy chain complementarity determining region 3 for antibody 45562
VRDLPPMAASDTAYDV

SEQ ID NO: 91125 - protein, 10 aa, Homo sapiens
  light chain complementarity determining region 3 for antibody 45563
QQYGSSPPTT

SEQ ID NO: 91126 - protein, 19 aa, Homo sapiens
  heavy chain complementarity determining region 3 for antibody 45563
ARVAPLNYYYPSSGHPADF

SEQ ID NO: 91127 - protein, 11 aa, Homo sapiens
  light chain complementarity determining region 3 for antibody 45564
QQYGSSPPGYT

SEQ ID NO: 91128 - protein, 25 aa, Homo sapiens
  heavy chain complementarity determining region 3 for antibody 45564
TKDKAREMATLNWGPKSYYYYGMDV

SEQ ID NO: 91129 - protein, 10 aa, Homo sapiens
  light chain complementarity determining region 3 for antibody 45565
QQYGSSPMYT

SEQ ID NO: 91130 - protein, 18 aa, Homo sapiens
  heavy chain complementarity determining region 3 for antibody 45565
ARTRRSGWNGLPYGPIEY

SEQ ID NO: 91131 - protein, 9 aa, Homo sapiens
  light chain complementarity determining region 3 for antibody 45566
QQYGSSPLT

SEQ ID NO: 91132 - protein, 16 aa, Homo sapiens
  heavy chain complementarity determining region 3 for antibody 45566
ARSFDSGGHFYGTFVS

SEQ ID NO: 91133 - protein, 9 aa, Homo sapiens
  light chain complementarity determining region 3 for antibody 45567
QQYGSSPLT

SEQ ID NO: 91134 - protein, 18 aa, Homo sapiens
  heavy chain complementarity determining region 3 for antibody 45567
ARDAGGLGNSGWYVGFDV

SEQ ID NO: 91135 - protein, 9 aa, Homo sapiens
  light chain complementarity determining region 3 for antibody 45568
QQYGSSPIT

SEQ ID NO: 91136 - protein, 15 aa, Homo sapiens
  heavy chain complementarity determining region 3 for antibody 45568
ARDGFSSDWFGAFDI

SEQ ID NO: 91137 - protein, 9 aa, Homo sapiens
  light chain complementarity determining region 3 for antibody 45569
QQYGSSPIP

SEQ ID NO: 91138 - protein, 15 aa, Homo sapiens
  heavy chain complementarity determining region 3 for antibody 45569
ARVLLVGFEEYYFDY

SEQ ID NO: 91139 - protein, 9 aa, Homo sapiens
  light chain complementarity determining region 3 for antibody 45570
QQYGSSPGT

SEQ ID NO: 91140 - protein, 15 aa, Homo sapiens
  heavy chain complementarity determining region 3 for antibody 45570
AREDVWGSGSAGFDY

SEQ ID NO: 91141 - protein, 9 aa, Homo sapiens
  light chain complementarity determining region 3 for antibody 45571
QQYGSSNGT

SEQ ID NO: 91142 - protein, 16 aa, Homo sapiens
  heavy chain complementarity determining region 3 for antibody 45571
AKDDPYGGNSGSTFDV

SEQ ID NO: 91143 - protein, 8 aa, Homo sapiens
  light chain complementarity determining region 3 for antibody 45572
QQYGSSFT

SEQ ID NO: 91144 - protein, 18 aa, Homo sapiens
  heavy chain complementarity determining region 3 for antibody 45572
ARFAQQDSGGFYWDAFDV

SEQ ID NO: 91145 - protein, 9 aa, Homo sapiens
  light chain complementarity determining region 3 for antibody 45573
QQYGSPPRT

SEQ ID NO: 91146 - protein, 20 aa, Homo sapiens
  heavy chain complementarity determining region 3 for antibody 45573
AREGGSISMILEVEDDATDI

SEQ ID NO: 91147 - protein, 9 aa, Homo sapiens
  light chain complementarity determining region 3 for antibody 45574
QQYGSPPLT

SEQ ID NO: 91148 - protein, 15 aa, Homo sapiens
  heavy chain complementarity determining region 3 for antibody 45574
ARAMGLIWFGEKLDP

SEQ ID NO: 91149 - protein, 9 aa, Homo sapiens
  light chain complementarity determining region 3 for antibody 45575
QQYGSAPPD

SEQ ID NO: 91150 - protein, 16 aa, Homo sapiens
  heavy chain complementarity determining region 3 for antibody 45575
AKHIADHIAAAAHFDN

SEQ ID NO: 91151 - protein, 9 aa, Homo sapiens
  light chain complementarity determining region 3 for antibody 45576
QQYGRSPWT

SEQ ID NO: 91152 - protein, 9 aa, Homo sapiens
  heavy chain complementarity determining region 3 for antibody 45576
GRAKGGVFS

SEQ ID NO: 91153 - protein, 9 aa, Homo sapiens
  light chain complementarity determining region 3 for antibody 45577
QQYGRSPRT

SEQ ID NO: 91154 - protein, 13 aa, Homo sapiens
  heavy chain complementarity determining region 3 for antibody 45577
ARAIATDYGLGDS

SEQ ID NO: 91155 - protein, 9 aa, Homo sapiens
  light chain complementarity determining region 3 for antibody 45578
QQYGRSPIT

SEQ ID NO: 91156 - protein, 13 aa, Homo sapiens
  heavy chain complementarity determining region 3 for antibody 45578
ASQRGGDYWYFDL

SEQ ID NO: 91157 - protein, 10 aa, Homo sapiens
  light chain complementarity determining region 3 for antibody 45579
QQYGRSLPIT

SEQ ID NO: 91158 - protein, 22 aa, Homo sapiens
  heavy chain complementarity determining region 3 for antibody 45579
AHRRLTLEFLETHPKTENWFNP

SEQ ID NO: 91159 - protein, 9 aa, Homo sapiens
  light chain complementarity determining region 3 for antibody 45580
QQYGRLPRT

SEQ ID NO: 91160 - protein, 15 aa, Homo sapiens
  heavy chain complementarity determining region 3 for antibody 45580
AKDGEFCGSNCYFGS

SEQ ID NO: 91161 - protein, 10 aa, Homo sapiens
  light chain complementarity determining region 3 for antibody 45581
QQYGNSPPYT

SEQ ID NO: 91162 - protein, 16 aa, Homo sapiens
  heavy chain complementarity determining region 3 for antibody 45581
ASAVNTAVGRPGPFDV

SEQ ID NO: 91163 - protein, 8 aa, Homo sapiens
  light chain complementarity determining region 3 for antibody 45582
QQYGNSPF

SEQ ID NO: 91164 - protein, 15 aa, Homo sapiens
  heavy chain complementarity determining region 3 for antibody 45582
ARGNDFGDYGVAFDI

SEQ ID NO: 91165 - protein, 10 aa, Homo sapiens
  light chain complementarity determining region 3 for antibody 45583
QQYGMSPPVT

SEQ ID NO: 91166 - protein, 19 aa, Homo sapiens
  heavy chain complementarity determining region 3 for antibody 45583
TTDHARVLWFGSGTFNFDN

SEQ ID NO: 91167 - protein, 10 aa, Homo sapiens
  light chain complementarity determining region 3 for antibody 45584
QQYGMSPPLT

SEQ ID NO: 91168 - protein, 10 aa, Homo sapiens
  heavy chain complementarity determining region 3 for antibody 45584
ARPYYYAFDI

SEQ ID NO: 91169 - protein, 9 aa, Homo sapiens
  light chain complementarity determining region 3 for antibody 45585
QQYGHSQST

SEQ ID NO: 91170 - protein, 8 aa, Homo sapiens
  heavy chain complementarity determining region 3 for antibody 45585
ARARYFDY

SEQ ID NO: 91171 - protein, 9 aa, Homo sapiens
  light chain complementarity determining region 3 for antibody 45586
QQYGHSPGT

SEQ ID NO: 91172 - protein, 15 aa, Homo sapiens
  heavy chain complementarity determining region 3 for antibody 45586
AKVMTGHTIDCHFDY

SEQ ID NO: 91173 - protein, 9 aa, Homo sapiens
  light chain complementarity determining region 3 for antibody 45587
QQYGGSPYT

SEQ ID NO: 91174 - protein, 15 aa, Homo sapiens
  heavy chain complementarity determining region 3 for antibody 45587
ARGQLDYYDNSGYNY

SEQ ID NO: 91175 - protein, 9 aa, Homo sapiens
  light chain complementarity determining region 3 for antibody 45588
QQYGGSPRT

SEQ ID NO: 91176 - protein, 21 aa, Homo sapiens
  heavy chain complementarity determining region 3 for antibody 45588
ARDSNCVGGFCHSYYYYGMDA

SEQ ID NO: 91177 - protein, 11 aa, Homo sapiens
  light chain complementarity determining region 3 for antibody 45589
QQYGGSPRMYT

SEQ ID NO: 91178 - protein, 17 aa, Homo sapiens
  heavy chain complementarity determining region 3 for antibody 45589
AFWNGLDSGWFSGPLDY

SEQ ID NO: 91179 - protein, 10 aa, Homo sapiens
  light chain complementarity determining region 3 for antibody 45590
QQYGGSPPYT

SEQ ID NO: 91180 - protein, 13 aa, Homo sapiens
  heavy chain complementarity determining region 3 for antibody 45590
ARDPPGPDGAFDL

SEQ ID NO: 91181 - protein, 11 aa, Homo sapiens
  light chain complementarity determining region 3 for antibody 45591
QQYGGSPPMYP

SEQ ID NO: 91182 - protein, 16 aa, Homo sapiens
  heavy chain complementarity determining region 3 for antibody 45591
VRAMFCGDWCYRGFDK

SEQ ID NO: 91183 - protein, 9 aa, Homo sapiens
  light chain complementarity determining region 3 for antibody 45592
QQYGGPPYT

SEQ ID NO: 91184 - protein, 17 aa, Homo sapiens
  heavy chain complementarity determining region 3 for antibody 45592
AKHHYRHCARDCYVGDS

SEQ ID NO: 91185 - protein, 6 aa, Homo sapiens
  light chain complementarity determining region 3 for antibody 45593
QQYGAT

SEQ ID NO: 91186 - protein, 12 aa, Homo sapiens
  heavy chain complementarity determining region 3 for antibody 45593
ARDHISGWSLAN

SEQ ID NO: 91187 - protein, 11 aa, Homo sapiens
  light chain complementarity determining region 3 for antibody 45594
QQYGASPRMYP

SEQ ID NO: 91188 - protein, 17 aa, Homo sapiens
  heavy chain complementarity determining region 3 for antibody 45594
AIWFGRNSGWFSGPFDF

SEQ ID NO: 91189 - protein, 9 aa, Homo sapiens
  light chain complementarity determining region 3 for antibody 45595
QQYFSDPRT

SEQ ID NO: 91190 - protein, 12 aa, Homo sapiens
  heavy chain complementarity determining region 3 for antibody 45595
ARGRGNSYYFDY

SEQ ID NO: 91191 - protein, 10 aa, Homo sapiens
  light chain complementarity determining region 3 for antibody 45596
QQYFQTPPFS

SEQ ID NO: 91192 - protein, 11 aa, Homo sapiens
  heavy chain complementarity determining region 3 for antibody 45596
GRPIGSWYFDL

SEQ ID NO: 91193 - protein, 9 aa, Homo sapiens
  light chain complementarity determining region 3 for antibody 45597
QQYFNTPRT

SEQ ID NO: 91194 - protein, 12 aa, Homo sapiens
  heavy chain complementarity determining region 3 for antibody 45597
ARGRTLLRAFDP

SEQ ID NO: 91195 - protein, 9 aa, Homo sapiens
  light chain complementarity determining region 3 for antibody 45598
QQYFGIPLT

SEQ ID NO: 91196 - protein, 17 aa, Homo sapiens
  heavy chain complementarity determining region 3 for antibody 45598
ARDKDIVATIGRNYFEY

SEQ ID NO: 91197 - protein, 9 aa, Homo sapiens
  light chain complementarity determining region 3 for antibody 45599
QQYEGFPWT

SEQ ID NO: 91198 - protein, 26 aa, Homo sapiens
  heavy chain complementarity determining region 3 for antibody 45599
ARDKSELRISVLRGILMTNYYYGMDV

SEQ ID NO: 91199 - protein, 9 aa, Homo sapiens
  light chain complementarity determining region 3 for antibody 45600
QQYDYLPYT

SEQ ID NO: 91200 - protein, 16 aa, Homo sapiens
  heavy chain complementarity determining region 3 for antibody 45600
ARARRATTEVSGPFDY

SEQ ID NO: 91201 - protein, 9 aa, Homo sapiens
  light chain complementarity determining region 3 for antibody 45601
QQYDVVPLT

SEQ ID NO: 91202 - protein, 15 aa, Homo sapiens
  heavy chain complementarity determining region 3 for antibody 45601
ARTGFGLGRYYKMDV

SEQ ID NO: 91203 - protein, 9 aa, Homo sapiens
  light chain complementarity determining region 3 for antibody 45602
QQYDTYPHT

SEQ ID NO: 91204 - protein, 13 aa, Homo sapiens
  heavy chain complementarity determining region 3 for antibody 45602
ASRPPYLEWFKSY

SEQ ID NO: 91205 - protein, 8 aa, Homo sapiens
  light chain complementarity determining region 3 for antibody 45603
QQYDSYWT

SEQ ID NO: 91206 - protein, 15 aa, Homo sapiens
  heavy chain complementarity determining region 3 for antibody 45603
VKVPYTTALRGHLQY

SEQ ID NO: 91207 - protein, 9 aa, Homo sapiens
  light chain complementarity determining region 3 for antibody 45604
QQYDSYSYT

SEQ ID NO: 91208 - protein, 16 aa, Homo sapiens
  heavy chain complementarity determining region 3 for antibody 45604
ARTTKLGATFWNYFDS

SEQ ID NO: 91209 - protein, 10 aa, Homo sapiens
  light chain complementarity determining region 3 for antibody 45605
QQYDSWLSFT

SEQ ID NO: 91210 - protein, 13 aa, Homo sapiens
  heavy chain complementarity determining region 3 for antibody 45605
ARVIRSGELSLGY

SEQ ID NO: 91211 - protein, 10 aa, Homo sapiens
  light chain complementarity determining region 3 for antibody 45606
QQYDSSPPVT

SEQ ID NO: 91212 - protein, 17 aa, Homo sapiens
  heavy chain complementarity determining region 3 for antibody 45606
AASLPHSVWLRFRWFDP

SEQ ID NO: 91213 - protein, 9 aa, Homo sapiens
  light chain complementarity determining region 3 for antibody 45607
QQYDSLPYT

SEQ ID NO: 91214 - protein, 14 aa, Homo sapiens
  heavy chain complementarity determining region 3 for antibody 45607
TCRGPDEYKYYFDY

SEQ ID NO: 91215 - protein, 9 aa, Homo sapiens
  light chain complementarity determining region 3 for antibody 45608
QQYDSFPYT

SEQ ID NO: 91216 - protein, 15 aa, Homo sapiens
  heavy chain complementarity determining region 3 for antibody 45608
ARETRYDTRGRAFDI

SEQ ID NO: 91217 - protein, 9 aa, Homo sapiens
  light chain complementarity determining region 3 for antibody 45609
QQYDRWPDT

SEQ ID NO: 91218 - protein, 8 aa, Homo sapiens
  heavy chain complementarity determining region 3 for antibody 45609
AVSGGSEN

SEQ ID NO: 91219 - protein, 10 aa, Homo sapiens
  light chain complementarity determining region 3 for antibody 45610
QQYDNWPPCT

SEQ ID NO: 91220 - protein, 14 aa, Homo sapiens
  heavy chain complementarity determining region 3 for antibody 45610
TRLSYFETKGSFDF

SEQ ID NO: 91221 - protein, 8 aa, Homo sapiens
  light chain complementarity determining region 3 for antibody 45611
QQYDNLPT

SEQ ID NO: 91222 - protein, 20 aa, Homo sapiens
  heavy chain complementarity determining region 3 for antibody 45611
AREGVLARRRGLTPNRAMDV

SEQ ID NO: 91223 - protein, 10 aa, Homo sapiens
  light chain complementarity determining region 3 for antibody 45612
QQYDNLPSFT

SEQ ID NO: 91224 - protein, 10 aa, Homo sapiens
  heavy chain complementarity determining region 3 for antibody 45612
ASGGGYTLSD

SEQ ID NO: 91225 - protein, 9 aa, Homo sapiens
  light chain complementarity determining region 3 for antibody 45613
QQYDNLPLT

SEQ ID NO: 91226 - protein, 18 aa, Homo sapiens
  heavy chain complementarity determining region 3 for antibody 45613
VRQPFLQGSVEGFDIFDM

SEQ ID NO: 91227 - protein, 9 aa, Homo sapiens
  light chain complementarity determining region 3 for antibody 45614
QQYDNLPLT

SEQ ID NO: 91228 - protein, 12 aa, Homo sapiens
  heavy chain complementarity determining region 3 for antibody 45614
TRSKGIHIWFDP

SEQ ID NO: 91229 - protein, 9 aa, Homo sapiens
  light chain complementarity determining region 3 for antibody 45615
QQYDNLPLT

SEQ ID NO: 91230 - protein, 13 aa, Homo sapiens
  heavy chain complementarity determining region 3 for antibody 45615
AKWIPGGQGYFEH

SEQ ID NO: 91231 - protein, 10 aa, Homo sapiens
  light chain complementarity determining region 3 for antibody 45616
QQYDNIPPYT

SEQ ID NO: 91232 - protein, 14 aa, Homo sapiens
  heavy chain complementarity determining region 3 for antibody 45616
ARTTHIAAAGRGGY

SEQ ID NO: 91233 - protein, 8 aa, Homo sapiens
  light chain complementarity determining region 3 for antibody 45617
QQYDLMYS

SEQ ID NO: 91234 - protein, 9 aa, Homo sapiens
  heavy chain complementarity determining region 3 for antibody 45617
ANLGGGLDY

SEQ ID NO: 91235 - protein, 10 aa, Homo sapiens
  light chain complementarity determining region 3 for antibody 45618
QQYDHWPPWT

SEQ ID NO: 91236 - protein, 16 aa, Homo sapiens
  heavy chain complementarity determining region 3 for antibody 45618
ARVDDFGSGNQGTFDP

SEQ ID NO: 91237 - protein, 9 aa, Homo sapiens
  light chain complementarity determining region 3 for antibody 45619
QQYDEVRLT

SEQ ID NO: 91238 - protein, 14 aa, Homo sapiens
  heavy chain complementarity determining region 3 for antibody 45619
ARDLAAARNYFLDL

SEQ ID NO: 91239 - protein, 9 aa, Homo sapiens
  light chain complementarity determining region 3 for antibody 45620
QQYDALPRT

SEQ ID NO: 91240 - protein, 17 aa, Homo sapiens
  heavy chain complementarity determining region 3 for antibody 45620
AREGYDSSGYQNWYFDL

SEQ ID NO: 91241 - protein, 8 aa, Homo sapiens
  light chain complementarity determining region 3 for antibody 45621
QQYCSSFP

SEQ ID NO: 91242 - protein, 13 aa, Homo sapiens
  heavy chain complementarity determining region 3 for antibody 45621
ATESGWYQGAFDI

SEQ ID NO: 91243 - protein, 7 aa, Homo sapiens
  light chain complementarity determining region 3 for antibody 45622
QQVWKRA

SEQ ID NO: 91244 - protein, 14 aa, Homo sapiens
  heavy chain complementarity determining region 3 for antibody 45622
AKFQAAGVYDAFDM

SEQ ID NO: 91245 - protein, 9 aa, Homo sapiens
  light chain complementarity determining region 3 for antibody 45623
QQVKSFPYT

SEQ ID NO: 91246 - protein, 20 aa, Homo sapiens
  heavy chain complementarity determining region 3 for antibody 45623
VKNYFASGSSSLYYYYGMDV

SEQ ID NO: 91247 - protein, 9 aa, Homo sapiens
  light chain complementarity determining region 3 for antibody 45624
QQVDSFPPT

SEQ ID NO: 91248 - protein, 18 aa, Homo sapiens
  heavy chain complementarity determining region 3 for antibody 45624
ARQGDLYRNSSGMFYFEY

SEQ ID NO: 91249 - protein, 9 aa, Homo sapiens
  light chain complementarity determining region 3 for antibody 45625
QQTYTVSVT

SEQ ID NO: 91250 - protein, 14 aa, Homo sapiens
  heavy chain complementarity determining region 3 for antibody 45625
ARDRVRGSSWIADS

SEQ ID NO: 91251 - protein, 9 aa, Homo sapiens
  light chain complementarity determining region 3 for antibody 45626
QQTYTVPVT

SEQ ID NO: 91252 - protein, 14 aa, Homo sapiens
  heavy chain complementarity determining region 3 for antibody 45626
ARDRVRGSSWIADS

SEQ ID NO: 91253 - protein, 10 aa, Homo sapiens
  light chain complementarity determining region 3 for antibody 45627
QQTYTRPPYS

SEQ ID NO: 91254 - protein, 16 aa, Homo sapiens
  heavy chain complementarity determining region 3 for antibody 45627
ARAMWVRGLMTPAFDY

SEQ ID NO: 91255 - protein, 10 aa, Homo sapiens
  light chain complementarity determining region 3 for antibody 45628
QQTYTLSPIT

SEQ ID NO: 91256 - protein, 14 aa, Homo sapiens
  heavy chain complementarity determining region 3 for antibody 45628
ATTEGYSQNYGFAY

SEQ ID NO: 91257 - protein, 9 aa, Homo sapiens
  light chain complementarity determining region 3 for antibody 45629
QQTYSPPYT

SEQ ID NO: 91258 - protein, 13 aa, Homo sapiens
  heavy chain complementarity determining region 3 for antibody 45629
TRSGDNDFWRFDY

SEQ ID NO: 91259 - protein, 9 aa, Homo sapiens
  light chain complementarity determining region 3 for antibody 45630
QQTYSPPPT

SEQ ID NO: 91260 - protein, 17 aa, Homo sapiens
  heavy chain complementarity determining region 3 for antibody 45630
ARAPAGISGGWYPIFDS

SEQ ID NO: 91261 - protein, 9 aa, Homo sapiens
  light chain complementarity determining region 3 for antibody 45631
QQTYSAPIH

SEQ ID NO: 91262 - protein, 15 aa, Homo sapiens
  heavy chain complementarity determining region 3 for antibody 45631
ARGYLGLPAAVGWAY

SEQ ID NO: 91263 - protein, 9 aa, Homo sapiens
  light chain complementarity determining region 3 for antibody 45632
QQTYNSPQT

SEQ ID NO: 91264 - protein, 15 aa, Homo sapiens
  heavy chain complementarity determining region 3 for antibody 45632
ARDRTTEVTGDGMDV

SEQ ID NO: 91265 - protein, 10 aa, Homo sapiens
  light chain complementarity determining region 3 for antibody 45633
QQTYGTPPIT

SEQ ID NO: 91266 - protein, 17 aa, Homo sapiens
  heavy chain complementarity determining region 3 for antibody 45633
AKDLTPWLARADNPFDY

SEQ ID NO: 91267 - protein, 9 aa, Homo sapiens
  light chain complementarity determining region 3 for antibody 45634
QQTYDTPQT

SEQ ID NO: 91268 - protein, 19 aa, Homo sapiens
  heavy chain complementarity determining region 3 for antibody 45634
ARSRVRGELRSFDPDGFDI

SEQ ID NO: 91269 - protein, 9 aa, Homo sapiens
  light chain complementarity determining region 3 for antibody 45635
QQTNNFPLT

SEQ ID NO: 91270 - protein, 18 aa, Homo sapiens
  heavy chain complementarity determining region 3 for antibody 45635
ATDAVLSPLVETATYFDH

SEQ ID NO: 91271 - protein, 9 aa, Homo sapiens
  light chain complementarity determining region 3 for antibody 45636
QQTKGIPIT

SEQ ID NO: 91272 - protein, 15 aa, Homo sapiens
  heavy chain complementarity determining region 3 for antibody 45636
ARVNSGWDFGDAFDV

SEQ ID NO: 91273 - protein, 9 aa, Homo sapiens
  light chain complementarity determining region 3 for antibody 45637
QQTFTMPIT

SEQ ID NO: 91274 - protein, 12 aa, Homo sapiens
  heavy chain complementarity determining region 3 for antibody 45637
ARPPGGDYYFGL

SEQ ID NO: 91275 - protein, 8 aa, Homo sapiens
  light chain complementarity determining region 3 for antibody 45638
QQTFSTKT

SEQ ID NO: 91276 - protein, 16 aa, Homo sapiens
  heavy chain complementarity determining region 3 for antibody 45638
ATHVAARGWLRGAFHI

SEQ ID NO: 91277 - protein, 9 aa, Homo sapiens
  light chain complementarity determining region 3 for antibody 45639
QQSYSVVVT

SEQ ID NO: 91278 - protein, 17 aa, Homo sapiens
  heavy chain complementarity determining region 3 for antibody 45639
ARDDMVRDLAAYFGMDV

SEQ ID NO: 91279 - protein, 9 aa, Homo sapiens
  light chain complementarity determining region 3 for antibody 45640
QQSYSVPWT

SEQ ID NO: 91280 - protein, 16 aa, Homo sapiens
  heavy chain complementarity determining region 3 for antibody 45640
AKTYSTIALAGSTSDY

SEQ ID NO: 91281 - protein, 9 aa, Homo sapiens
  light chain complementarity determining region 3 for antibody 45641
QQSYSTQHT

SEQ ID NO: 91282 - protein, 16 aa, Homo sapiens
  heavy chain complementarity determining region 3 for antibody 45641
ARASQQWQYYSYGMDV

SEQ ID NO: 91283 - protein, 9 aa, Homo sapiens
  light chain complementarity determining region 3 for antibody 45642
QQSYSTPYT

SEQ ID NO: 91284 - protein, 16 aa, Homo sapiens
  heavy chain complementarity determining region 3 for antibody 45642
ARGRGYGGNSLRSFDY

SEQ ID NO: 91285 - protein, 9 aa, Homo sapiens
  light chain complementarity determining region 3 for antibody 45643
QQSYSTPYT

SEQ ID NO: 91286 - protein, 13 aa, Homo sapiens
  heavy chain complementarity determining region 3 for antibody 45643
ARDAGQHYDQFDC

SEQ ID NO: 91287 - protein, 9 aa, Homo sapiens
  light chain complementarity determining region 3 for antibody 45644
QQSYSTPYT

SEQ ID NO: 91288 - protein, 18 aa, Homo sapiens
  heavy chain complementarity determining region 3 for antibody 45644
ALSRASESNTYYYWYLDV

SEQ ID NO: 91289 - protein, 9 aa, Homo sapiens
  light chain complementarity determining region 3 for antibody 45645
QQSYSTPYT

SEQ ID NO: 91290 - protein, 21 aa, Homo sapiens
  heavy chain complementarity determining region 3 for antibody 45645
AKGAPRLYGPRAVAAAGSLDR

SEQ ID NO: 91291 - protein, 8 aa, Homo sapiens
  light chain complementarity determining region 3 for antibody 45646
QQSYSTPT

SEQ ID NO: 91292 - protein, 9 aa, Homo sapiens
  heavy chain complementarity determining region 3 for antibody 45646
VCLELTPPV

SEQ ID NO: 91293 - protein, 9 aa, Homo sapiens
  light chain complementarity determining region 3 for antibody 45647
QQSYSTPRT

SEQ ID NO: 91294 - protein, 22 aa, Homo sapiens
  heavy chain complementarity determining region 3 for antibody 45647
TREITLAGKERPGGETYNWFDP

SEQ ID NO: 91295 - protein, 10 aa, Homo sapiens
  light chain complementarity determining region 3 for antibody 45648
QQSYSTPPWT

SEQ ID NO: 91296 - protein, 19 aa, Homo sapiens
  heavy chain complementarity determining region 3 for antibody 45648
ARDGNPKQSGRRTPSYFDY

SEQ ID NO: 91297 - protein, 10 aa, Homo sapiens
  light chain complementarity determining region 3 for antibody 45649
QQSYSTPMYT

SEQ ID NO: 91298 - protein, 27 aa, Homo sapiens
  heavy chain complementarity determining region 3 for antibody 45649
ARDPSERACSSTTCPQERDYFYYGMDV

SEQ ID NO: 91299 - protein, 10 aa, Homo sapiens
  light chain complementarity determining region 3 for antibody 45650
QQSYSTPLYT

SEQ ID NO: 91300 - protein, 20 aa, Homo sapiens
  heavy chain complementarity determining region 3 for antibody 45650
VRHGQGDHKTRGYEFNGMDV

SEQ ID NO: 91301 - protein, 9 aa, Homo sapiens
  light chain complementarity determining region 3 for antibody 45651
QQSYSTPLT

SEQ ID NO: 91302 - protein, 17 aa, Homo sapiens
  heavy chain complementarity determining region 3 for antibody 45651
ARDAVLRGLIMFYAMDV

SEQ ID NO: 91303 - protein, 8 aa, Homo sapiens
  light chain complementarity determining region 3 for antibody 45652
QQSYSTPL

SEQ ID NO: 91304 - protein, 21 aa, Homo sapiens
  heavy chain complementarity determining region 3 for antibody 45652
AKGLHIVVVTSILRGFWYFGL

SEQ ID NO: 91305 - protein, 9 aa, Homo sapiens
  light chain complementarity determining region 3 for antibody 45653
QQSYSTPHT

SEQ ID NO: 91306 - protein, 16 aa, Homo sapiens
  heavy chain complementarity determining region 3 for antibody 45653
ARPLTRYSNRAWTSDI

SEQ ID NO: 91307 - protein, 9 aa, Homo sapiens
  light chain complementarity determining region 3 for antibody 45654
QQSYSSPFT

SEQ ID NO: 91308 - protein, 16 aa, Homo sapiens
  heavy chain complementarity determining region 3 for antibody 45654
AHAVPPERYFDWLFDY

SEQ ID NO: 91309 - protein, 9 aa, Homo sapiens
  light chain complementarity determining region 3 for antibody 45655
QQSYSPPLT

SEQ ID NO: 91310 - protein, 15 aa, Homo sapiens
  heavy chain complementarity determining region 3 for antibody 45655
VKEGGTAILYHGLDV

SEQ ID NO: 91311 - protein, 9 aa, Homo sapiens
  light chain complementarity determining region 3 for antibody 45656
QQSYSIPRT

SEQ ID NO: 91312 - protein, 14 aa, Homo sapiens
  heavy chain complementarity determining region 3 for antibody 45656
ARGGDYSGSGSYHA

SEQ ID NO: 91313 - protein, 8 aa, Homo sapiens
  light chain complementarity determining region 3 for antibody 45657
QQSYSART

SEQ ID NO: 91314 - protein, 26 aa, Homo sapiens
  heavy chain complementarity determining region 3 for antibody 45657
ARADQYYYDSSDPLGGGGGWVGYFDY

SEQ ID NO: 91315 - protein, 9 aa, Homo sapiens
  light chain complementarity determining region 3 for antibody 45658
QQSYNTPLT

SEQ ID NO: 91316 - protein, 15 aa, Homo sapiens
  heavy chain complementarity determining region 3 for antibody 45658
ARDLGGSIAAGGFDY

SEQ ID NO: 91317 - protein, 9 aa, Homo sapiens
  light chain complementarity determining region 3 for antibody 45659
QQSYNTPHT

SEQ ID NO: 91318 - protein, 20 aa, Homo sapiens
  heavy chain complementarity determining region 3 for antibody 45659
ARAYDETGYYGRTHRGWFDP

SEQ ID NO: 91319 - protein, 9 aa, Homo sapiens
  light chain complementarity determining region 3 for antibody 45660
QQSYNSPRT

SEQ ID NO: 91320 - protein, 25 aa, Homo sapiens
  heavy chain complementarity determining region 3 for antibody 45660
ARDAPAPRDADLVAVAGTGYYGMDV

SEQ ID NO: 91321 - protein, 9 aa, Homo sapiens
  light chain complementarity determining region 3 for antibody 45661
QQSYNNPPT

SEQ ID NO: 91322 - protein, 20 aa, Homo sapiens
  heavy chain complementarity determining region 3 for antibody 45661
ARETDRFPSGSFSSYNSFDY

SEQ ID NO: 91323 - protein, 9 aa, Homo sapiens
  light chain complementarity determining region 3 for antibody 45662
QQSYNFPVT

SEQ ID NO: 91324 - protein, 12 aa, Homo sapiens
  heavy chain complementarity determining region 3 for antibody 45662
ARQAAPYGDFDF

SEQ ID NO: 91325 - protein, 10 aa, Homo sapiens
  light chain complementarity determining region 3 for antibody 45663
QQSYITPPYT

SEQ ID NO: 91326 - protein, 19 aa, Homo sapiens
  heavy chain complementarity determining region 3 for antibody 45663
ARVPIVVTASTSSGNWFDP

SEQ ID NO: 91327 - protein, 9 aa, Homo sapiens
  light chain complementarity determining region 3 for antibody 45664
QQSYITPLT

SEQ ID NO: 91328 - protein, 17 aa, Homo sapiens
  heavy chain complementarity determining region 3 for antibody 45664
ARATSMTPPAIYYAMDV

SEQ ID NO: 91329 - protein, 9 aa, Homo sapiens
  light chain complementarity determining region 3 for antibody 45665
QQSYIPPRA

SEQ ID NO: 91330 - protein, 21 aa, Homo sapiens
  heavy chain complementarity determining region 3 for antibody 45665
AQLAVGVPSTTGFGHYYGLDV

SEQ ID NO: 91331 - protein, 9 aa, Homo sapiens
  light chain complementarity determining region 3 for antibody 45666
QQSYGPPFT

SEQ ID NO: 91332 - protein, 18 aa, Homo sapiens
  heavy chain complementarity determining region 3 for antibody 45666
ANERGLNIVRLGELSLLH

SEQ ID NO: 91333 - protein, 9 aa, Homo sapiens
  light chain complementarity determining region 3 for antibody 45667
QQSYFTPYT

SEQ ID NO: 91334 - protein, 21 aa, Homo sapiens
  heavy chain complementarity determining region 3 for antibody 45667
AKAGEVDSTDLYSENDDAFEN

SEQ ID NO: 91335 - protein, 9 aa, Homo sapiens
  light chain complementarity determining region 3 for antibody 45668
QQSYFIPHT

SEQ ID NO: 91336 - protein, 15 aa, Homo sapiens
  heavy chain complementarity determining region 3 for antibody 45668
AKGRQDSSGYSYFDY

SEQ ID NO: 91337 - protein, 9 aa, Homo sapiens
  light chain complementarity determining region 3 for antibody 45669
QQSTNWPIT

SEQ ID NO: 91338 - protein, 10 aa, Homo sapiens
  heavy chain complementarity determining region 3 for antibody 45669
AMKKWLAVHY

SEQ ID NO: 91339 - protein, 9 aa, Homo sapiens
  light chain complementarity determining region 3 for antibody 45670
QQSSQTPTT

SEQ ID NO: 91340 - protein, 15 aa, Homo sapiens
  heavy chain complementarity determining region 3 for antibody 45670
ARDQSDHYPVFNFDY

SEQ ID NO: 91341 - protein, 9 aa, Homo sapiens
  light chain complementarity determining region 3 for antibody 45671
QQSRNLMIT

SEQ ID NO: 91342 - protein, 12 aa, Homo sapiens
  heavy chain complementarity determining region 3 for antibody 45671
ARLAWGVSALDI

SEQ ID NO: 91343 - protein, 11 aa, Homo sapiens
  light chain complementarity determining region 3 for antibody 45672
QQSNNWPPIFT

SEQ ID NO: 91344 - protein, 16 aa, Homo sapiens
  heavy chain complementarity determining region 3 for antibody 45672
ARIPNRFDNSGYSFDQ

SEQ ID NO: 91345 - protein, 9 aa, Homo sapiens
  light chain complementarity determining region 3 for antibody 45673
QQSITIPRT

SEQ ID NO: 91346 - protein, 14 aa, Homo sapiens
  heavy chain complementarity determining region 3 for antibody 45673
ARVSFFGSGNWFDS

SEQ ID NO: 91347 - protein, 9 aa, Homo sapiens
  light chain complementarity determining region 3 for antibody 45674
QQSHLLPWT

SEQ ID NO: 91348 - protein, 13 aa, Homo sapiens
  heavy chain complementarity determining region 3 for antibody 45674
AKVWFGPTNPFDM

SEQ ID NO: 91349 - protein, 8 aa, Homo sapiens
  light chain complementarity determining region 3 for antibody 45675
QQSGSSWT

SEQ ID NO: 91350 - protein, 13 aa, Homo sapiens
  heavy chain complementarity determining region 3 for antibody 45675
ARDLKSSGSGRND

SEQ ID NO: 91351 - protein, 9 aa, Homo sapiens
  light chain complementarity determining region 3 for antibody 45676
QQSGRSPRT

SEQ ID NO: 91352 - protein, 15 aa, Homo sapiens
  heavy chain complementarity determining region 3 for antibody 45676
AKDGEFCGSNCYFGS

SEQ ID NO: 91353 - protein, 9 aa, Homo sapiens
  light chain complementarity determining region 3 for antibody 45677
QQSFSTPWT

SEQ ID NO: 91354 - protein, 12 aa, Homo sapiens
  heavy chain complementarity determining region 3 for antibody 45677
ARGWFGERQLDP

SEQ ID NO: 91355 - protein, 9 aa, Homo sapiens
  light chain complementarity determining region 3 for antibody 45678
QQSFPTPWT

SEQ ID NO: 91356 - protein, 13 aa, Homo sapiens
  heavy chain complementarity determining region 3 for antibody 45678
VRAADGTQGVFDY

SEQ ID NO: 91357 - protein, 10 aa, Homo sapiens
  light chain complementarity determining region 3 for antibody 45679
QQSFNPLLFT

SEQ ID NO: 91358 - protein, 17 aa, Homo sapiens
  heavy chain complementarity determining region 3 for antibody 45679
ARDTSGGWKIGYYGMDV

SEQ ID NO: 91359 - protein, 10 aa, Homo sapiens
  light chain complementarity determining region 3 for antibody 45680
QQRYNWPPYT

SEQ ID NO: 91360 - protein, 11 aa, Homo sapiens
  heavy chain complementarity determining region 3 for antibody 45680
SRGVGSYVFES

SEQ ID NO: 91361 - protein, 9 aa, Homo sapiens
  light chain complementarity determining region 3 for antibody 45681
QQRYNWPLT

SEQ ID NO: 91362 - protein, 14 aa, Homo sapiens
  heavy chain complementarity determining region 3 for antibody 45681
ATGPAGGGGYYFDY

SEQ ID NO: 91363 - protein, 9 aa, Homo sapiens
  light chain complementarity determining region 3 for antibody 45682
QQRYNWPDT

SEQ ID NO: 91364 - protein, 17 aa, Homo sapiens
  heavy chain complementarity determining region 3 for antibody 45682
ARLYGYRTDGSYDTSDI

SEQ ID NO: 91365 - protein, 9 aa, Homo sapiens
  light chain complementarity determining region 3 for antibody 45683
QQRSTWPLT

SEQ ID NO: 91366 - protein, 13 aa, Homo sapiens
  heavy chain complementarity determining region 3 for antibody 45683
AREGYYGSGEFDY

SEQ ID NO: 91367 - protein, 9 aa, Homo sapiens
  light chain complementarity determining region 3 for antibody 45684
QQRSSWPYT

SEQ ID NO: 91368 - protein, 15 aa, Homo sapiens
  heavy chain complementarity determining region 3 for antibody 45684
AKEGYYLDGSGYCPN

SEQ ID NO: 91369 - protein, 9 aa, Homo sapiens
  light chain complementarity determining region 3 for antibody 45685
QQRSSWPRT

SEQ ID NO: 91370 - protein, 24 aa, Homo sapiens
  heavy chain complementarity determining region 3 for antibody 45685
AGGTRLTRKTLVAPRGHYNSPMDV

SEQ ID NO: 91371 - protein, 10 aa, Homo sapiens
  light chain complementarity determining region 3 for antibody 45686
QQRSSWGALT

SEQ ID NO: 91372 - protein, 13 aa, Homo sapiens
  heavy chain complementarity determining region 3 for antibody 45686
ARFRTSIPYYFDY

SEQ ID NO: 91373 - protein, 9 aa, Homo sapiens
  light chain complementarity determining region 3 for antibody 45687
QQRSNWSWT

SEQ ID NO: 91374 - protein, 26 aa, Homo sapiens
  heavy chain complementarity determining region 3 for antibody 45687
ARDRGALLHPGRGIRHQLVKFGYFDL

SEQ ID NO: 91375 - protein, 9 aa, Homo sapiens
  light chain complementarity determining region 3 for antibody 45688
QQRSNWPYT

SEQ ID NO: 91376 - protein, 17 aa, Homo sapiens
  heavy chain complementarity determining region 3 for antibody 45688
ARYSSASSGYTGNYFDY

SEQ ID NO: 91377 - protein, 9 aa, Homo sapiens
  light chain complementarity determining region 3 for antibody 45689
QQRSNWPWT

SEQ ID NO: 91378 - protein, 11 aa, Homo sapiens
  heavy chain complementarity determining region 3 for antibody 45689
TSGRIVGAPDY

SEQ ID NO: 91379 - protein, 9 aa, Homo sapiens
  light chain complementarity determining region 3 for antibody 45690
QQRSNWPWT

SEQ ID NO: 91380 - protein, 17 aa, Homo sapiens
  heavy chain complementarity determining region 3 for antibody 45690
AGPRAYGGDVPSLGFDI

SEQ ID NO: 91381 - protein, 10 aa, Homo sapiens
  light chain complementarity determining region 3 for antibody 45691
QQRSNWPPYT

SEQ ID NO: 91382 - protein, 20 aa, Homo sapiens
  heavy chain complementarity determining region 3 for antibody 45691
ARKDGDYPDYGGFYEDAFDI

SEQ ID NO: 91383 - protein, 10 aa, Homo sapiens
  light chain complementarity determining region 3 for antibody 45692
QQRSNWPPWT

SEQ ID NO: 91384 - protein, 12 aa, Homo sapiens
  heavy chain complementarity determining region 3 for antibody 45692
VTSAWFGVSPEY

SEQ ID NO: 91385 - protein, 11 aa, Homo sapiens
  light chain complementarity determining region 3 for antibody 45693
QQRSNWPPVLT

SEQ ID NO: 91386 - protein, 16 aa, Homo sapiens
  heavy chain complementarity determining region 3 for antibody 45693
ARAREYTTSWYNPFNF

SEQ ID NO: 91387 - protein, 10 aa, Homo sapiens
  light chain complementarity determining region 3 for antibody 45694
QQRSNWPPIT

SEQ ID NO: 91388 - protein, 10 aa, Homo sapiens
  heavy chain complementarity determining region 3 for antibody 45694
ASGLGIQVPI

SEQ ID NO: 91389 - protein, 11 aa, Homo sapiens
  light chain complementarity determining region 3 for antibody 45695
QQRSNWPPGFT

SEQ ID NO: 91390 - protein, 14 aa, Homo sapiens
  heavy chain complementarity determining region 3 for antibody 45695
TRHPTVGGPVGFDT

SEQ ID NO: 91391 - protein, 9 aa, Homo sapiens
  light chain complementarity determining region 3 for antibody 45696
QQRSDWPRT

SEQ ID NO: 91392 - protein, 11 aa, Homo sapiens
  heavy chain complementarity determining region 3 for antibody 45696
ARIGGVNFFDY

SEQ ID NO: 91393 - protein, 9 aa, Homo sapiens
  light chain complementarity determining region 3 for antibody 45697
QQRSDWPPT

SEQ ID NO: 91394 - protein, 18 aa, Homo sapiens
  heavy chain complementarity determining region 3 for antibody 45697
ARHYCTSPSCPWAWYFDL

SEQ ID NO: 91395 - protein, 9 aa, Homo sapiens
  light chain complementarity determining region 3 for antibody 45698
QQRSDWPLT

SEQ ID NO: 91396 - protein, 10 aa, Homo sapiens
  heavy chain complementarity determining region 3 for antibody 45698
AKHEERTHDY

SEQ ID NO: 91397 - protein, 9 aa, Homo sapiens
  light chain complementarity determining region 3 for antibody 45699
QQRSDWPIT

SEQ ID NO: 91398 - protein, 23 aa, Homo sapiens
  heavy chain complementarity determining region 3 for antibody 45699
GKQRPPPAYISGWSSGHYNTVAV

SEQ ID NO: 91399 - protein, 9 aa, Homo sapiens
  light chain complementarity determining region 3 for antibody 45700
QQRRDWQVT

SEQ ID NO: 91400 - protein, 15 aa, Homo sapiens
  heavy chain complementarity determining region 3 for antibody 45700
ARDSGKSGHATRLDN

SEQ ID NO: 91401 - protein, 9 aa, Homo sapiens
  light chain complementarity determining region 3 for antibody 45701
QQRRDWPPA

SEQ ID NO: 91402 - protein, 17 aa, Homo sapiens
  heavy chain complementarity determining region 3 for antibody 45701
ARDERQAAAGAEYYFDY

SEQ ID NO: 91403 - protein, 11 aa, Homo sapiens
  light chain complementarity determining region 3 for antibody 45702
QQRQESPNWLN

SEQ ID NO: 91404 - protein, 15 aa, Homo sapiens
  heavy chain complementarity determining region 3 for antibody 45702
ARGGYSSNWYWWFDP

SEQ ID NO: 91405 - protein, 9 aa, Homo sapiens
  light chain complementarity determining region 3 for antibody 45703
QQRNNWPPT

SEQ ID NO: 91406 - protein, 20 aa, Homo sapiens
  heavy chain complementarity determining region 3 for antibody 45703
ARESRLMVFGLTTRGGRSDY

SEQ ID NO: 91407 - protein, 9 aa, Homo sapiens
  light chain complementarity determining region 3 for antibody 45704
QQRNNWPPT

SEQ ID NO: 91408 - protein, 13 aa, Homo sapiens
  heavy chain complementarity determining region 3 for antibody 45704
ARDLDDSGDVFDY

SEQ ID NO: 91409 - protein, 11 aa, Homo sapiens
  light chain complementarity determining region 3 for antibody 45705
QQRNNLPAEYT

SEQ ID NO: 91410 - protein, 15 aa, Homo sapiens
  heavy chain complementarity determining region 3 for antibody 45705
AREGVERLTISAFDL

SEQ ID NO: 91411 - protein, 9 aa, Homo sapiens
  light chain complementarity determining region 3 for antibody 45706
QQRGDWPIT

SEQ ID NO: 91412 - protein, 14 aa, Homo sapiens
  heavy chain complementarity determining region 3 for antibody 45706
AKSWQLLYDDAFDI

SEQ ID NO: 91413 - protein, 10 aa, Homo sapiens
  light chain complementarity determining region 3 for antibody 45707
QQRFTTSPYT

SEQ ID NO: 91414 - protein, 12 aa, Homo sapiens
  heavy chain complementarity determining region 3 for antibody 45707
ARESPAGTFFDH

SEQ ID NO: 91415 - protein, 9 aa, Homo sapiens
  light chain complementarity determining region 3 for antibody 45708
QQRFDWPIT

SEQ ID NO: 91416 - protein, 15 aa, Homo sapiens
  heavy chain complementarity determining region 3 for antibody 45708
TKDGVYGGESGPFDS

SEQ ID NO: 91417 - protein, 11 aa, Homo sapiens
  light chain complementarity determining region 3 for antibody 45709
QQREERTNWLN

SEQ ID NO: 91418 - protein, 15 aa, Homo sapiens
  heavy chain complementarity determining region 3 for antibody 45709
ARGGYSSGWYWWFDP

SEQ ID NO: 91419 - protein, 12 aa, Homo sapiens
  light chain complementarity determining region 3 for antibody 45710
QQRDNWPPYMFT

SEQ ID NO: 91420 - protein, 19 aa, Homo sapiens
  heavy chain complementarity determining region 3 for antibody 45710
ATALGGDIATWYLNYNMDV

SEQ ID NO: 91421 - protein, 9 aa, Homo sapiens
  light chain complementarity determining region 3 for antibody 45711
QQNYNTPVT

SEQ ID NO: 91422 - protein, 10 aa, Homo sapiens
  heavy chain complementarity determining region 3 for antibody 45711
GTIWDRVSDY

SEQ ID NO: 91423 - protein, 9 aa, Homo sapiens
  light chain complementarity determining region 3 for antibody 45712
QQNSDIPYT

SEQ ID NO: 91424 - protein, 14 aa, Homo sapiens
  heavy chain complementarity determining region 3 for antibody 45712
VRVGKTYGATSWDY

SEQ ID NO: 91425 - protein, 9 aa, Homo sapiens
  light chain complementarity determining region 3 for antibody 45713
QQLNSYPYT

SEQ ID NO: 91426 - protein, 21 aa, Homo sapiens
  heavy chain complementarity determining region 3 for antibody 45713
ARRVTWRPCISGACHTWYFDL

SEQ ID NO: 91427 - protein, 9 aa, Homo sapiens
  light chain complementarity determining region 3 for antibody 45714
QQLNSYPYT

SEQ ID NO: 91428 - protein, 14 aa, Homo sapiens
  heavy chain complementarity determining region 3 for antibody 45714
ARDPESSGWFYFDI

SEQ ID NO: 91429 - protein, 10 aa, Homo sapiens
  light chain complementarity determining region 3 for antibody 45715
QQLNSYPPFP

SEQ ID NO: 91430 - protein, 14 aa, Homo sapiens
  heavy chain complementarity determining region 3 for antibody 45715
AREAHDFWSGYLAY

SEQ ID NO: 91431 - protein, 9 aa, Homo sapiens
  light chain complementarity determining region 3 for antibody 45716
QQLNSYPLT

SEQ ID NO: 91432 - protein, 18 aa, Homo sapiens
  heavy chain complementarity determining region 3 for antibody 45716
TTVYWGSWRGAIEGPHDY

SEQ ID NO: 91433 - protein, 9 aa, Homo sapiens
  light chain complementarity determining region 3 for antibody 45717
QQLNSYPLT

SEQ ID NO: 91434 - protein, 17 aa, Homo sapiens
  heavy chain complementarity determining region 3 for antibody 45717
ARDRGGPIAVADDVFDI

SEQ ID NO: 91435 - protein, 9 aa, Homo sapiens
  light chain complementarity determining region 3 for antibody 45718
QQLKTYPLT

SEQ ID NO: 91436 - protein, 15 aa, Homo sapiens
  heavy chain complementarity determining region 3 for antibody 45718
ARARGYGSGRSYMDH

SEQ ID NO: 91437 - protein, 10 aa, Homo sapiens
  light chain complementarity determining region 3 for antibody 45719
QQLGGNSPWT

SEQ ID NO: 91438 - protein, 12 aa, Homo sapiens
  heavy chain complementarity determining region 3 for antibody 45719
ATYYLNGGGRGY

SEQ ID NO: 91439 - protein, 11 aa, Homo sapiens
  light chain complementarity determining region 3 for antibody 45720
QQLDSHLPSIA

SEQ ID NO: 91440 - protein, 15 aa, Homo sapiens
  heavy chain complementarity determining region 3 for antibody 45720
AKGRQDSSGYSYFDY

SEQ ID NO: 91441 - protein, 9 aa, Homo sapiens
  light chain complementarity determining region 3 for antibody 45721
QQIDDPPYT

SEQ ID NO: 91442 - protein, 15 aa, Homo sapiens
  heavy chain complementarity determining region 3 for antibody 45721
ARDPLRYGDNDEVSC

SEQ ID NO: 91443 - protein, 9 aa, Homo sapiens
  light chain complementarity determining region 3 for antibody 45722
QQHTDWPLT

SEQ ID NO: 91444 - protein, 17 aa, Homo sapiens
  heavy chain complementarity determining region 3 for antibody 45722
ARVPSNSDSSGFLSFDL

SEQ ID NO: 91445 - protein, 9 aa, Homo sapiens
  light chain complementarity determining region 3 for antibody 45723
QQHGTLPLT

SEQ ID NO: 91446 - protein, 15 aa, Homo sapiens
  heavy chain complementarity determining region 3 for antibody 45723
TREGRYLGAYWYFDF

SEQ ID NO: 91447 - protein, 9 aa, Homo sapiens
  light chain complementarity determining region 3 for antibody 45724
QQHGRSPQT

SEQ ID NO: 91448 - protein, 16 aa, Homo sapiens
  heavy chain complementarity determining region 3 for antibody 45724
ARGSPTVEDFSWPSDL

SEQ ID NO: 91449 - protein, 9 aa, Homo sapiens
  light chain complementarity determining region 3 for antibody 45725
QQHFGSPWT

SEQ ID NO: 91450 - protein, 18 aa, Homo sapiens
  heavy chain complementarity determining region 3 for antibody 45725
ATDGIYCRGGNCYSEGLA

SEQ ID NO: 91451 - protein, 9 aa, Homo sapiens
  light chain complementarity determining region 3 for antibody 45726
QQGYIPPIT

SEQ ID NO: 91452 - protein, 16 aa, Homo sapiens
  heavy chain complementarity determining region 3 for antibody 45726
ARGSVSSSGWYGYYQY

SEQ ID NO: 91453 - protein, 9 aa, Homo sapiens
  light chain complementarity determining region 3 for antibody 45727
QQGSSFPIT

SEQ ID NO: 91454 - protein, 17 aa, Homo sapiens
  heavy chain complementarity determining region 3 for antibody 45727
ARDSSYPGGHFYYGMDD

SEQ ID NO: 91455 - protein, 9 aa, Homo sapiens
  light chain complementarity determining region 3 for antibody 45728
QQFNTYPWT

SEQ ID NO: 91456 - protein, 6 aa, Homo sapiens
  heavy chain complementarity determining region 3 for antibody 45728
ARHPDY

SEQ ID NO: 91457 - protein, 9 aa, Homo sapiens
  light chain complementarity determining region 3 for antibody 45729
QQFNNYPLT

SEQ ID NO: 91458 - protein, 10 aa, Homo sapiens
  heavy chain complementarity determining region 3 for antibody 45729
TRQMGGGFDY

SEQ ID NO: 91459 - protein, 9 aa, Homo sapiens
  light chain complementarity determining region 3 for antibody 45730
QQFKTYPFT

SEQ ID NO: 91460 - protein, 14 aa, Homo sapiens
  heavy chain complementarity determining region 3 for antibody 45730
AKAKDASGFHYLDY

SEQ ID NO: 91461 - protein, 9 aa, Homo sapiens
  light chain complementarity determining region 3 for antibody 45731
QQFISFPLT

SEQ ID NO: 91462 - protein, 15 aa, Homo sapiens
  heavy chain complementarity determining region 3 for antibody 45731
VRDPRTYWGPYYFDY

SEQ ID NO: 91463 - protein, 10 aa, Homo sapiens
  light chain complementarity determining region 3 for antibody 45732
QQFGSTLTYR

SEQ ID NO: 91464 - protein, 11 aa, Homo sapiens
  heavy chain complementarity determining region 3 for antibody 45732
ARISSDDAFDI

SEQ ID NO: 91465 - protein, 9 aa, Homo sapiens
  light chain complementarity determining region 3 for antibody 45733
QQFGISPRT

SEQ ID NO: 91466 - protein, 19 aa, Homo sapiens
  heavy chain complementarity determining region 3 for antibody 45733
ARDHEAYCGADCWTDGFDL

SEQ ID NO: 91467 - protein, 9 aa, Homo sapiens
  light chain complementarity determining region 3 for antibody 45734
QQFDTSPRT

SEQ ID NO: 91468 - protein, 18 aa, Homo sapiens
  heavy chain complementarity determining region 3 for antibody 45734
ARGGPLSYSTASSHWFDP

SEQ ID NO: 91469 - protein, 8 aa, Homo sapiens
  light chain complementarity determining region 3 for antibody 45735
QQDRSSFP

SEQ ID NO: 91470 - protein, 13 aa, Homo sapiens
  heavy chain complementarity determining region 3 for antibody 45735
ATESGWYQGAFDI

SEQ ID NO: 91471 - protein, 9 aa, Homo sapiens
  light chain complementarity determining region 3 for antibody 45736
QQDGTSPFT

SEQ ID NO: 91472 - protein, 9 aa, Homo sapiens
  heavy chain complementarity determining region 3 for antibody 45736
ARGAGSLSY

SEQ ID NO: 91473 - protein, 9 aa, Homo sapiens
  light chain complementarity determining region 3 for antibody 45737
QQDGSSSIT

SEQ ID NO: 91474 - protein, 13 aa, Homo sapiens
  heavy chain complementarity determining region 3 for antibody 45737
VKEFFMVFDAFDM

SEQ ID NO: 91475 - protein, 9 aa, Homo sapiens
  light chain complementarity determining region 3 for antibody 45738
QQDGSSLWT

SEQ ID NO: 91476 - protein, 13 aa, Homo sapiens
  heavy chain complementarity determining region 3 for antibody 45738
ARDDLLADNGFDY

SEQ ID NO: 91477 - protein, 9 aa, Homo sapiens
  light chain complementarity determining region 3 for antibody 45739
QQDGSLPIT

SEQ ID NO: 91478 - protein, 20 aa, Homo sapiens
  heavy chain complementarity determining region 3 for antibody 45739
ARGPHIVVLTSIPWRWSFGL

SEQ ID NO: 91479 - protein, 8 aa, Homo sapiens
  light chain complementarity determining region 3 for antibody 45740
QQDGNSRT

SEQ ID NO: 91480 - protein, 15 aa, Homo sapiens
  heavy chain complementarity determining region 3 for antibody 45740
AKTDYCSAANCPFDS

SEQ ID NO: 91481 - protein, 9 aa, Homo sapiens
  light chain complementarity determining region 3 for antibody 45741
QQCGSSPWT

SEQ ID NO: 91482 - protein, 11 aa, Homo sapiens
  heavy chain complementarity determining region 3 for antibody 45741
VASEHEDPFHY

SEQ ID NO: 91483 - protein, 9 aa, Homo sapiens
  light chain complementarity determining region 3 for antibody 45742
QQCDSLPYT

SEQ ID NO: 91484 - protein, 11 aa, Homo sapiens
  heavy chain complementarity determining region 3 for antibody 45742
AHWVGSDLLDF

SEQ ID NO: 91485 - protein, 9 aa, Homo sapiens
  light chain complementarity determining region 3 for antibody 45743
QQASFPPLT

SEQ ID NO: 91486 - protein, 13 aa, Homo sapiens
  heavy chain complementarity determining region 3 for antibody 45743
ARDLDSGWYEFDS

SEQ ID NO: 91487 - protein, 8 aa, Homo sapiens
  light chain complementarity determining region 3 for antibody 45744
QQANTFPR

SEQ ID NO: 91488 - protein, 15 aa, Homo sapiens
  heavy chain complementarity determining region 3 for antibody 45744
AKGRGLEGNEYYFDY

SEQ ID NO: 91489 - protein, 9 aa, Homo sapiens
  light chain complementarity determining region 3 for antibody 45745
QQANSFPYT

SEQ ID NO: 91490 - protein, 15 aa, Homo sapiens
  heavy chain complementarity determining region 3 for antibody 45745
ARSLLRGVNPPVFQH

SEQ ID NO: 91491 - protein, 9 aa, Homo sapiens
  light chain complementarity determining region 3 for antibody 45746
QQANSFPLT

SEQ ID NO: 91492 - protein, 14 aa, Homo sapiens
  heavy chain complementarity determining region 3 for antibody 45746
ARLEIVVIPPAKNR

SEQ ID NO: 91493 - protein, 9 aa, Homo sapiens
  light chain complementarity determining region 3 for antibody 45747
QQANNFPIT

SEQ ID NO: 91494 - protein, 15 aa, Homo sapiens
  heavy chain complementarity determining region 3 for antibody 45747
ARDKDTAMITDAFDI

SEQ ID NO: 91495 - protein, 9 aa, Homo sapiens
  light chain complementarity determining region 3 for antibody 45748
QQAKSLPRT

SEQ ID NO: 91496 - protein, 17 aa, Homo sapiens
  heavy chain complementarity determining region 3 for antibody 45748
ARDSAAVADAGGYFLDY

SEQ ID NO: 91497 - protein, 9 aa, Homo sapiens
  light chain complementarity determining region 3 for antibody 45749
QQAKSFPWT

SEQ ID NO: 91498 - protein, 13 aa, Homo sapiens
  heavy chain complementarity determining region 3 for antibody 45749
ARLVGTPVDGFDI

SEQ ID NO: 91499 - protein, 9 aa, Homo sapiens
  light chain complementarity determining region 3 for antibody 45750
QQAHSFPYT

SEQ ID NO: 91500 - protein, 20 aa, Homo sapiens
  heavy chain complementarity determining region 3 for antibody 45750
ARTTYYYDRSGLSLFYKFDY

SEQ ID NO: 91501 - protein, 9 aa, Homo sapiens
  light chain complementarity determining region 3 for antibody 45751
QPYGRSPRT

SEQ ID NO: 91502 - protein, 15 aa, Homo sapiens
  heavy chain complementarity determining region 3 for antibody 45751
AKDGEFCGSNCYFGS

SEQ ID NO: 91503 - protein, 9 aa, Homo sapiens
  light chain complementarity determining region 3 for antibody 45752
QPSHNAPRT

SEQ ID NO: 91504 - protein, 10 aa, Homo sapiens
  heavy chain complementarity determining region 3 for antibody 45752
TTYERAVSTH

SEQ ID NO: 91505 - protein, 9 aa, Homo sapiens
  light chain complementarity determining region 3 for antibody 45753
QNYDTAPLT

SEQ ID NO: 91506 - protein, 13 aa, Homo sapiens
  heavy chain complementarity determining region 3 for antibody 45753
ARDLGAGWSDFDH

SEQ ID NO: 91507 - protein, 10 aa, Homo sapiens
  light chain complementarity determining region 3 for antibody 45754
QLYGTSVPWT

SEQ ID NO: 91508 - protein, 14 aa, Homo sapiens
  heavy chain complementarity determining region 3 for antibody 45754
ARGGSSDYDHHFDY

SEQ ID NO: 91509 - protein, 10 aa, Homo sapiens
  light chain complementarity determining region 3 for antibody 45755
QLRSGWPSIT

SEQ ID NO: 91510 - protein, 20 aa, Homo sapiens
  heavy chain complementarity determining region 3 for antibody 45755
AKDRYYDSSGHYYGVNGFDY

SEQ ID NO: 91511 - protein, 9 aa, Homo sapiens
  light chain complementarity determining region 3 for antibody 45756
QLPGNSPPT

SEQ ID NO: 91512 - protein, 15 aa, Homo sapiens
  heavy chain complementarity determining region 3 for antibody 45756
ARGEVGAGLKYLFDL

SEQ ID NO: 91513 - protein, 9 aa, Homo sapiens
  light chain complementarity determining region 3 for antibody 45757
QKYNSVPFT

SEQ ID NO: 91514 - protein, 14 aa, Homo sapiens
  heavy chain complementarity determining region 3 for antibody 45757
ARKVAGPGPQPLDY

SEQ ID NO: 91515 - protein, 9 aa, Homo sapiens
  light chain complementarity determining region 3 for antibody 45758
QKYNSAPYT

SEQ ID NO: 91516 - protein, 14 aa, Homo sapiens
  heavy chain complementarity determining region 3 for antibody 45758
ATLYNTYYSHSMNV

SEQ ID NO: 91517 - protein, 9 aa, Homo sapiens
  light chain complementarity determining region 3 for antibody 45759
QKYNGAPWT

SEQ ID NO: 91518 - protein, 11 aa, Homo sapiens
  heavy chain complementarity determining region 3 for antibody 45759
AGRYGTGSYYL

SEQ ID NO: 91519 - protein, 9 aa, Homo sapiens
  light chain complementarity determining region 3 for antibody 45760
QKYDSAPQT

SEQ ID NO: 91520 - protein, 19 aa, Homo sapiens
  heavy chain complementarity determining region 3 for antibody 45760
ARHLILGGPPMTRGYGMDV

SEQ ID NO: 91521 - protein, 9 aa, Homo sapiens
  light chain complementarity determining region 3 for antibody 45761
QKHNDVPWT

SEQ ID NO: 91522 - protein, 14 aa, Homo sapiens
  heavy chain complementarity determining region 3 for antibody 45761
ARDDYYDRLNAFDV

SEQ ID NO: 91523 - protein, 11 aa, Homo sapiens
  light chain complementarity determining region 3 for antibody 45762
QHYVRSPPLYT

SEQ ID NO: 91524 - protein, 12 aa, Homo sapiens
  heavy chain complementarity determining region 3 for antibody 45762
ARHIAGADAFDY

SEQ ID NO: 91525 - protein, 11 aa, Homo sapiens
  light chain complementarity determining region 3 for antibody 45763
QHYNTYSPAWT

SEQ ID NO: 91526 - protein, 22 aa, Homo sapiens
  heavy chain complementarity determining region 3 for antibody 45763
ARASLQYYYDTSGYYHGDAFDI

SEQ ID NO: 91527 - protein, 9 aa, Homo sapiens
  light chain complementarity determining region 3 for antibody 45764
QHYNNWPRT

SEQ ID NO: 91528 - protein, 21 aa, Homo sapiens
  heavy chain complementarity determining region 3 for antibody 45764
AREGRILGGQPHSPGDDALDI

SEQ ID NO: 91529 - protein, 9 aa, Homo sapiens
  light chain complementarity determining region 3 for antibody 45765
QHYIPPSWT

SEQ ID NO: 91530 - protein, 12 aa, Homo sapiens
  heavy chain complementarity determining region 3 for antibody 45765
AIYLAGMGGVGP

SEQ ID NO: 91531 - protein, 9 aa, Homo sapiens
  light chain complementarity determining region 3 for antibody 45766
QHYGTTPET

SEQ ID NO: 91532 - protein, 14 aa, Homo sapiens
  heavy chain complementarity determining region 3 for antibody 45766
ARDLLGGVKDPFDI

SEQ ID NO: 91533 - protein, 11 aa, Homo sapiens
  light chain complementarity determining region 3 for antibody 45767
QHYGTSPPAYP

SEQ ID NO: 91534 - protein, 15 aa, Homo sapiens
  heavy chain complementarity determining region 3 for antibody 45767
AREVTSMIEPGGLDI

SEQ ID NO: 91535 - protein, 9 aa, Homo sapiens
  light chain complementarity determining region 3 for antibody 45768
QHYGTSPLP

SEQ ID NO: 91536 - protein, 16 aa, Homo sapiens
  heavy chain complementarity determining region 3 for antibody 45768
ASPVPTSWAVHDAFDI

SEQ ID NO: 91537 - protein, 8 aa, Homo sapiens
  light chain complementarity determining region 3 for antibody 45769
QHYGSSWT

SEQ ID NO: 91538 - protein, 16 aa, Homo sapiens
  heavy chain complementarity determining region 3 for antibody 45769
ARDWGSTNAATGRFDY

SEQ ID NO: 91539 - protein, 10 aa, Homo sapiens
  light chain complementarity determining region 3 for antibody 45770
QHYGSSPLFT

SEQ ID NO: 91540 - protein, 16 aa, Homo sapiens
  heavy chain complementarity determining region 3 for antibody 45770
ARISGMAGYSYFGMDV

SEQ ID NO: 91541 - protein, 9 aa, Homo sapiens
  light chain complementarity determining region 3 for antibody 45771
QHYGNSLFT

SEQ ID NO: 91542 - protein, 10 aa, Homo sapiens
  heavy chain complementarity determining region 3 for antibody 45771
ARDPFEYFDY

SEQ ID NO: 91543 - protein, 9 aa, Homo sapiens
  light chain complementarity determining region 3 for antibody 45772
QHYGGSPST

SEQ ID NO: 91544 - protein, 17 aa, Homo sapiens
  heavy chain complementarity determining region 3 for antibody 45772
ARVDLSEQWLVLWYFDL

SEQ ID NO: 91545 - protein, 9 aa, Homo sapiens
  light chain complementarity determining region 3 for antibody 45773
QHYDTYPYT

SEQ ID NO: 91546 - protein, 11 aa, Homo sapiens
  heavy chain complementarity determining region 3 for antibody 45773
AIMHVTEAFDF

SEQ ID NO: 91547 - protein, 11 aa, Homo sapiens
  light chain complementarity determining region 3 for antibody 45774
QHYDEWPPAWT

SEQ ID NO: 91548 - protein, 19 aa, Homo sapiens
  heavy chain complementarity determining region 3 for antibody 45774
ARTANLPYCTTTSCPQTDV

SEQ ID NO: 91549 - protein, 9 aa, Homo sapiens
  light chain complementarity determining region 3 for antibody 45775
QHYANSPQT

SEQ ID NO: 91550 - protein, 19 aa, Homo sapiens
  heavy chain complementarity determining region 3 for antibody 45775
ARDQSIGYCSSISCYQIDY

SEQ ID NO: 91551 - protein, 9 aa, Homo sapiens
  light chain complementarity determining region 3 for antibody 45776
QHSYNNPPL

SEQ ID NO: 91552 - protein, 29 aa, Homo sapiens
  heavy chain complementarity determining region 3 for antibody 45776
ASGKRWRLGESTLLECPATEDCLHDAFHI

SEQ ID NO: 91553 - protein, 11 aa, Homo sapiens
  light chain complementarity determining region 3 for antibody 45777
QHRTNWPPLFT

SEQ ID NO: 91554 - protein, 9 aa, Homo sapiens
  heavy chain complementarity determining region 3 for antibody 45777
VRDPGGLDD

SEQ ID NO: 91555 - protein, 10 aa, Homo sapiens
  light chain complementarity determining region 3 for antibody 45778
QHRFDRPPYT

SEQ ID NO: 91556 - protein, 17 aa, Homo sapiens
  heavy chain complementarity determining region 3 for antibody 45778
VRDHVRGPGYDYKGLDV

SEQ ID NO: 91557 - protein, 9 aa, Homo sapiens
  light chain complementarity determining region 3 for antibody 45779
QHLISYPFT

SEQ ID NO: 91558 - protein, 22 aa, Homo sapiens
  heavy chain complementarity determining region 3 for antibody 45779
ALSVGINMFRPEQGSYHYGMDV

SEQ ID NO: 91559 - protein, 9 aa, Homo sapiens
  light chain complementarity determining region 3 for antibody 45780
QEYGAHFRT

SEQ ID NO: 91560 - protein, 10 aa, Homo sapiens
  heavy chain complementarity determining region 3 for antibody 45780
TRDWPRSGMD

SEQ ID NO: 91561 - protein, 10 aa, Homo sapiens
  light chain complementarity determining region 3 for antibody 45781
QETYSTPSIP

SEQ ID NO: 91562 - protein, 15 aa, Homo sapiens
  heavy chain complementarity determining region 3 for antibody 45781
ARDPGWTQTSYYFDY

SEQ ID NO: 91563 - protein, 9 aa, Homo sapiens
  light chain complementarity determining region 3 for antibody 45782
QDGLSTSPT

SEQ ID NO: 91564 - protein, 10 aa, Homo sapiens
  heavy chain complementarity determining region 3 for antibody 45782
ARRDTDALDV

SEQ ID NO: 91565 - protein, 9 aa, Homo sapiens
  light chain complementarity determining region 3 for antibody 45783
MQVQQTPRT

SEQ ID NO: 91566 - protein, 18 aa, Homo sapiens
  heavy chain complementarity determining region 3 for antibody 45783
AKTLIGAAGNSYGYAMDV

SEQ ID NO: 91567 - protein, 9 aa, Homo sapiens
  light chain complementarity determining region 3 for antibody 45784
MQTLQTPYN

SEQ ID NO: 91568 - protein, 18 aa, Homo sapiens
  heavy chain complementarity determining region 3 for antibody 45784
AKDGYIGGRSNPAPRIDH

SEQ ID NO: 91569 - protein, 9 aa, Homo sapiens
  light chain complementarity determining region 3 for antibody 45785
MQTLQTPPA

SEQ ID NO: 91570 - protein, 12 aa, Homo sapiens
  heavy chain complementarity determining region 3 for antibody 45785
ARDLYSSWTFGY

SEQ ID NO: 91571 - protein, 9 aa, Homo sapiens
  light chain complementarity determining region 3 for antibody 45786
MQSLQTPPT

SEQ ID NO: 91572 - protein, 22 aa, Homo sapiens
  heavy chain complementarity determining region 3 for antibody 45786
ARRWGRGFSFDVRALTQYGMDV

SEQ ID NO: 91573 - protein, 9 aa, Homo sapiens
  light chain complementarity determining region 3 for antibody 45787
MQSLQSPPD

SEQ ID NO: 91574 - protein, 17 aa, Homo sapiens
  heavy chain complementarity determining region 3 for antibody 45787
ARRWGPRDVATTATRDY

SEQ ID NO: 91575 - protein, 9 aa, Homo sapiens
  light chain complementarity determining region 3 for antibody 45788
MQRQQFPWT

SEQ ID NO: 91576 - protein, 12 aa, Homo sapiens
  heavy chain complementarity determining region 3 for antibody 45788
ARTFNYDWAFDI

SEQ ID NO: 91577 - protein, 9 aa, Homo sapiens
  light chain complementarity determining region 3 for antibody 45789
MQPLQAPFA

SEQ ID NO: 91578 - protein, 18 aa, Homo sapiens
  heavy chain complementarity determining region 3 for antibody 45789
ARVTVGRTDYHYYFGMDV

SEQ ID NO: 91579 - protein, 9 aa, Homo sapiens
  light chain complementarity determining region 3 for antibody 45790
MQHRQTLYT

SEQ ID NO: 91580 - protein, 11 aa, Homo sapiens
  heavy chain complementarity determining region 3 for antibody 45790
ARLFEGSPGDY

SEQ ID NO: 91581 - protein, 10 aa, Homo sapiens
  light chain complementarity determining region 3 for antibody 45791
MQGTYWPPGT

SEQ ID NO: 91582 - protein, 14 aa, Homo sapiens
  heavy chain complementarity determining region 3 for antibody 45791
AILGYCAGPTCLDY

SEQ ID NO: 91583 - protein, 9 aa, Homo sapiens
  light chain complementarity determining region 3 for antibody 45792
MQGTHWRGT

SEQ ID NO: 91584 - protein, 9 aa, Homo sapiens
  heavy chain complementarity determining region 3 for antibody 45792
ARGGAWFDY

SEQ ID NO: 91585 - protein, 9 aa, Homo sapiens
  light chain complementarity determining region 3 for antibody 45793
MQGTHWPYT

SEQ ID NO: 91586 - protein, 12 aa, Homo sapiens
  heavy chain complementarity determining region 3 for antibody 45793
ARWSAHDFAFDV

SEQ ID NO: 91587 - protein, 9 aa, Homo sapiens
  light chain complementarity determining region 3 for antibody 45794
MQGTHWPWT

SEQ ID NO: 91588 - protein, 15 aa, Homo sapiens
  heavy chain complementarity determining region 3 for antibody 45794
WMYYYGAGRYGGVDS

SEQ ID NO: 91589 - protein, 9 aa, Homo sapiens
  light chain complementarity determining region 3 for antibody 45795
MQGTHWPWT

SEQ ID NO: 91590 - protein, 14 aa, Homo sapiens
  heavy chain complementarity determining region 3 for antibody 45795
ARLGDSGSYGHFDL

SEQ ID NO: 91591 - protein, 9 aa, Homo sapiens
  light chain complementarity determining region 3 for antibody 45796
MQGTHWPRT

SEQ ID NO: 91592 - protein, 15 aa, Homo sapiens
  heavy chain complementarity determining region 3 for antibody 45796
ARSGAVYGTFWYFDL

SEQ ID NO: 91593 - protein, 10 aa, Homo sapiens
  light chain complementarity determining region 3 for antibody 45797
MQGTHWPPGT

SEQ ID NO: 91594 - protein, 7 aa, Homo sapiens
  heavy chain complementarity determining region 3 for antibody 45797
VRGTFDI

SEQ ID NO: 91595 - protein, 9 aa, Homo sapiens
  light chain complementarity determining region 3 for antibody 45798
MQGTHWPLP

SEQ ID NO: 91596 - protein, 9 aa, Homo sapiens
  heavy chain complementarity determining region 3 for antibody 45798
TWSNSGGDY

SEQ ID NO: 91597 - protein, 9 aa, Homo sapiens
  light chain complementarity determining region 3 for antibody 45799
MQGTHWPGT

SEQ ID NO: 91598 - protein, 6 aa, Homo sapiens
  heavy chain complementarity determining region 3 for antibody 45799
VRTSSY

SEQ ID NO: 91599 - protein, 9 aa, Homo sapiens
  light chain complementarity determining region 3 for antibody 45800
MQGTHWPGT

SEQ ID NO: 91600 - protein, 15 aa, Homo sapiens
  heavy chain complementarity determining region 3 for antibody 45800
ARDSGVYFGLTPFDI

SEQ ID NO: 91601 - protein, 9 aa, Homo sapiens
  light chain complementarity determining region 3 for antibody 45801
MQGTHWLWT

SEQ ID NO: 91602 - protein, 10 aa, Homo sapiens
  heavy chain complementarity determining region 3 for antibody 45801
VHLFDASPGA

SEQ ID NO: 91603 - protein, 9 aa, Homo sapiens
  light chain complementarity determining region 3 for antibody 45802
MQGTHLPFT

SEQ ID NO: 91604 - protein, 19 aa, Homo sapiens
  heavy chain complementarity determining region 3 for antibody 45802
AARSKFCSGGSCYYWYFDL

SEQ ID NO: 91605 - protein, 9 aa, Homo sapiens
  light chain complementarity determining region 3 for antibody 45803
MQGTHGPRT

SEQ ID NO: 91606 - protein, 10 aa, Homo sapiens
  heavy chain complementarity determining region 3 for antibody 45803
IHTGDAWGDY

SEQ ID NO: 91607 - protein, 9 aa, Homo sapiens
  light chain complementarity determining region 3 for antibody 45804
MQGSHWPYT

SEQ ID NO: 91608 - protein, 18 aa, Homo sapiens
  heavy chain complementarity determining region 3 for antibody 45804
ARSPKHIVRGLTLYDMEV

SEQ ID NO: 91609 - protein, 9 aa, Homo sapiens
  light chain complementarity determining region 3 for antibody 45805
MQGLQTPWK

SEQ ID NO: 91610 - protein, 14 aa, Homo sapiens
  heavy chain complementarity determining region 3 for antibody 45805
AREDSAVGYYGMDV

SEQ ID NO: 91611 - protein, 9 aa, Homo sapiens
  light chain complementarity determining region 3 for antibody 45806
MQGLQTPRT

SEQ ID NO: 91612 - protein, 20 aa, Homo sapiens
  heavy chain complementarity determining region 3 for antibody 45806
ATSHVDVVARIRGYYFAMDV

SEQ ID NO: 91613 - protein, 9 aa, Homo sapiens
  light chain complementarity determining region 3 for antibody 45807
MQGLQTPHT

SEQ ID NO: 91614 - protein, 21 aa, Homo sapiens
  heavy chain complementarity determining region 3 for antibody 45807
ARGRSEHRIQYASLTSVPFDH

SEQ ID NO: 91615 - protein, 9 aa, Homo sapiens
  light chain complementarity determining region 3 for antibody 45808
MQGLQTPGT

SEQ ID NO: 91616 - protein, 13 aa, Homo sapiens
  heavy chain complementarity determining region 3 for antibody 45808
ARGISSLSSSWGF

SEQ ID NO: 91617 - protein, 9 aa, Homo sapiens
  light chain complementarity determining region 3 for antibody 45809
MQGLQTPFT

SEQ ID NO: 91618 - protein, 14 aa, Homo sapiens
  heavy chain complementarity determining region 3 for antibody 45809
AADPRGYSGYAGGV

SEQ ID NO: 91619 - protein, 9 aa, Homo sapiens
  light chain complementarity determining region 3 for antibody 45810
MQGLQPPYS

SEQ ID NO: 91620 - protein, 11 aa, Homo sapiens
  heavy chain complementarity determining region 3 for antibody 45810
ARPGEESQFDY

SEQ ID NO: 91621 - protein, 9 aa, Homo sapiens
  light chain complementarity determining region 3 for antibody 45811
MQGLQIPLT

SEQ ID NO: 91622 - protein, 14 aa, Homo sapiens
  heavy chain complementarity determining region 3 for antibody 45811
ARGGTVTDPDGFDV

SEQ ID NO: 91623 - protein, 9 aa, Homo sapiens
  light chain complementarity determining region 3 for antibody 45812
MQGLQAPRT

SEQ ID NO: 91624 - protein, 23 aa, Homo sapiens
  heavy chain complementarity determining region 3 for antibody 45812
AREREYASGPYYSPLYYYYGVDV

SEQ ID NO: 91625 - protein, 9 aa, Homo sapiens
  light chain complementarity determining region 3 for antibody 45813
MQGLQAALT

SEQ ID NO: 91626 - protein, 12 aa, Homo sapiens
  heavy chain complementarity determining region 3 for antibody 45813
ARESPFTNYFDF

SEQ ID NO: 91627 - protein, 8 aa, Homo sapiens
  light chain complementarity determining region 3 for antibody 45814
MQGLHIPS

SEQ ID NO: 91628 - protein, 22 aa, Homo sapiens
  heavy chain complementarity determining region 3 for antibody 45814
ARGGPPYYFDSTGYRQGDPFGL

SEQ ID NO: 91629 - protein, 8 aa, Homo sapiens
  light chain complementarity determining region 3 for antibody 45815
MQGGQPYP

SEQ ID NO: 91630 - protein, 7 aa, Homo sapiens
  heavy chain complementarity determining region 3 for antibody 45815
ATKMGDY

SEQ ID NO: 91631 - protein, 9 aa, Homo sapiens
  light chain complementarity determining region 3 for antibody 45816
MQDTHWPLT

SEQ ID NO: 91632 - protein, 8 aa, Homo sapiens
  heavy chain complementarity determining region 3 for antibody 45816
ARTRTFDI

SEQ ID NO: 91633 - protein, 8 aa, Homo sapiens
  light chain complementarity determining region 3 for antibody 45817
MQALQTRV

SEQ ID NO: 91634 - protein, 20 aa, Homo sapiens
  heavy chain complementarity determining region 3 for antibody 45817
ARERGRRSSGPLHYYFGLDV

SEQ ID NO: 91635 - protein, 9 aa, Homo sapiens
  light chain complementarity determining region 3 for antibody 45818
MQALQTPYT

SEQ ID NO: 91636 - protein, 14 aa, Homo sapiens
  heavy chain complementarity determining region 3 for antibody 45818
ARPYSSNWGYAFDI

SEQ ID NO: 91637 - protein, 9 aa, Homo sapiens
  light chain complementarity determining region 3 for antibody 45819
MQALQTPYT

SEQ ID NO: 91638 - protein, 19 aa, Homo sapiens
  heavy chain complementarity determining region 3 for antibody 45819
ARGEKGIAVRPSGNNWFDP

SEQ ID NO: 91639 - protein, 9 aa, Homo sapiens
  light chain complementarity determining region 3 for antibody 45820
MQALQTPYT

SEQ ID NO: 91640 - protein, 16 aa, Homo sapiens
  heavy chain complementarity determining region 3 for antibody 45820
ARDLGGTYYSVWAFDL

SEQ ID NO: 91641 - protein, 9 aa, Homo sapiens
  light chain complementarity determining region 3 for antibody 45821
MQALQTPYT

SEQ ID NO: 91642 - protein, 18 aa, Homo sapiens
  heavy chain complementarity determining region 3 for antibody 45821
AMGELLGHCNGGDCYFDP

SEQ ID NO: 91643 - protein, 9 aa, Homo sapiens
  light chain complementarity determining region 3 for antibody 45822
MQALQTPWA

SEQ ID NO: 91644 - protein, 15 aa, Homo sapiens
  heavy chain complementarity determining region 3 for antibody 45822
ARGALLWSRGHGFDI

SEQ ID NO: 91645 - protein, 9 aa, Homo sapiens
  light chain complementarity determining region 3 for antibody 45823
MQALQTPVT

SEQ ID NO: 91646 - protein, 17 aa, Homo sapiens
  heavy chain complementarity determining region 3 for antibody 45823
ARGRTVYSGKQAGAFDI

SEQ ID NO: 91647 - protein, 8 aa, Homo sapiens
  light chain complementarity determining region 3 for antibody 45824
MQALQTPT

SEQ ID NO: 91648 - protein, 15 aa, Homo sapiens
  heavy chain complementarity determining region 3 for antibody 45824
TKDRGDSSRWYGMDV

SEQ ID NO: 91649 - protein, 9 aa, Homo sapiens
  light chain complementarity determining region 3 for antibody 45825
MQALQTPRT

SEQ ID NO: 91650 - protein, 20 aa, Homo sapiens
  heavy chain complementarity determining region 3 for antibody 45825
ARAKDFVVAAVATPLGAFYV

SEQ ID NO: 91651 - protein, 9 aa, Homo sapiens
  light chain complementarity determining region 3 for antibody 45826
MQALQTPRT

SEQ ID NO: 91652 - protein, 22 aa, Homo sapiens
  heavy chain complementarity determining region 3 for antibody 45826
ALSVGINMFRPEQGSYHYGMDV

SEQ ID NO: 91653 - protein, 10 aa, Homo sapiens
  light chain complementarity determining region 3 for antibody 45827
MQALQTPPYT

SEQ ID NO: 91654 - protein, 15 aa, Homo sapiens
  heavy chain complementarity determining region 3 for antibody 45827
VRDSYQDPYYYGMDV

SEQ ID NO: 91655 - protein, 10 aa, Homo sapiens
  light chain complementarity determining region 3 for antibody 45828
MQALQTPPGT

SEQ ID NO: 91656 - protein, 19 aa, Homo sapiens
  heavy chain complementarity determining region 3 for antibody 45828
ARDKLPFDYGDFRGEAFDS

SEQ ID NO: 91657 - protein, 9 aa, Homo sapiens
  light chain complementarity determining region 3 for antibody 45829
MQALQTPLT

SEQ ID NO: 91658 - protein, 16 aa, Homo sapiens
  heavy chain complementarity determining region 3 for antibody 45829
ARHRGGGLQWLVGIDD

SEQ ID NO: 91659 - protein, 9 aa, Homo sapiens
  light chain complementarity determining region 3 for antibody 45830
MQALQTPGT

SEQ ID NO: 91660 - protein, 16 aa, Homo sapiens
  heavy chain complementarity determining region 3 for antibody 45830
AREFGDYFRRAGTFDY

SEQ ID NO: 91661 - protein, 9 aa, Homo sapiens
  light chain complementarity determining region 3 for antibody 45831
MQALQTPFT

SEQ ID NO: 91662 - protein, 10 aa, Homo sapiens
  heavy chain complementarity determining region 3 for antibody 45831
VVGVGVEMDS

SEQ ID NO: 91663 - protein, 9 aa, Homo sapiens
  light chain complementarity determining region 3 for antibody 45832
MQALQPPVT

SEQ ID NO: 91664 - protein, 12 aa, Homo sapiens
  heavy chain complementarity determining region 3 for antibody 45832
ARGTPGDMTQVT

SEQ ID NO: 91665 - protein, 9 aa, Homo sapiens
  light chain complementarity determining region 3 for antibody 45833
MQALQIPWT

SEQ ID NO: 91666 - protein, 10 aa, Homo sapiens
  heavy chain complementarity determining region 3 for antibody 45833
AKHGNNVFDY

SEQ ID NO: 91667 - protein, 9 aa, Homo sapiens
  light chain complementarity determining region 3 for antibody 45834
MQALQILYT

SEQ ID NO: 91668 - protein, 19 aa, Homo sapiens
  heavy chain complementarity determining region 3 for antibody 45834
ARVRCSSTSCLKYYYGMDV

SEQ ID NO: 91669 - protein, 9 aa, Homo sapiens
  light chain complementarity determining region 3 for antibody 45835
MQALHTPPT

SEQ ID NO: 91670 - protein, 16 aa, Homo sapiens
  heavy chain complementarity determining region 3 for antibody 45835
ARGTTTNTGLVWGIAH

SEQ ID NO: 91671 - protein, 9 aa, Homo sapiens
  light chain complementarity determining region 3 for antibody 45836
MQALHTAYT

SEQ ID NO: 91672 - protein, 15 aa, Homo sapiens
  heavy chain complementarity determining region 3 for antibody 45836
ARQDAVAAKQYVLDP

SEQ ID NO: 91673 - protein, 9 aa, Homo sapiens
  light chain complementarity determining region 3 for antibody 45837
MQAIQPPRT

SEQ ID NO: 91674 - protein, 13 aa, Homo sapiens
  heavy chain complementarity determining region 3 for antibody 45837
ARDSGDYYGYFDV

SEQ ID NO: 91675 - protein, 9 aa, Homo sapiens
  light chain complementarity determining region 3 for antibody 45838
LRYIHYSGT

SEQ ID NO: 91676 - protein, 13 aa, Homo sapiens
  heavy chain complementarity determining region 3 for antibody 45838
ARDSGDQQVVPDS

SEQ ID NO: 91677 - protein, 9 aa, Homo sapiens
  light chain complementarity determining region 3 for antibody 45839
LRHSSYPLT

SEQ ID NO: 91678 - protein, 13 aa, Homo sapiens
  heavy chain complementarity determining region 3 for antibody 45839
TRDSGRQWQIFDY

SEQ ID NO: 91679 - protein, 8 aa, Homo sapiens
  light chain complementarity determining region 3 for antibody 45840
LQYNTYWT

SEQ ID NO: 91680 - protein, 11 aa, Homo sapiens
  heavy chain complementarity determining region 3 for antibody 45840
VKHLTSGTFDY

SEQ ID NO: 91681 - protein, 9 aa, Homo sapiens
  light chain complementarity determining region 3 for antibody 45841
LQYHSYSGT

SEQ ID NO: 91682 - protein, 9 aa, Homo sapiens
  heavy chain complementarity determining region 3 for antibody 45841
AKRTGFGYY

SEQ ID NO: 91683 - protein, 9 aa, Homo sapiens
  light chain complementarity determining region 3 for antibody 45842
LQYDSFPHT

SEQ ID NO: 91684 - protein, 17 aa, Homo sapiens
  heavy chain complementarity determining region 3 for antibody 45842
ARDFVLGPDRLLKWQSS

SEQ ID NO: 91685 - protein, 9 aa, Homo sapiens
  light chain complementarity determining region 3 for antibody 45843
LQYDISPRT

SEQ ID NO: 91686 - protein, 13 aa, Homo sapiens
  heavy chain complementarity determining region 3 for antibody 45843
ARVRTDNGWYDDY

SEQ ID NO: 91687 - protein, 9 aa, Homo sapiens
  light chain complementarity determining region 3 for antibody 45844
LQVHNYPYT

SEQ ID NO: 91688 - protein, 14 aa, Homo sapiens
  heavy chain complementarity determining region 3 for antibody 45844
ARDSSTTTGTGIDF

SEQ ID NO: 91689 - protein, 9 aa, Homo sapiens
  light chain complementarity determining region 3 for antibody 45845
LQLSDFPIT

SEQ ID NO: 91690 - protein, 14 aa, Homo sapiens
  heavy chain complementarity determining region 3 for antibody 45845
ARLEIVVIPPAKNR

SEQ ID NO: 91691 - protein, 9 aa, Homo sapiens
  light chain complementarity determining region 3 for antibody 45846
LQHNSYPWT

SEQ ID NO: 91692 - protein, 12 aa, Homo sapiens
  heavy chain complementarity determining region 3 for antibody 45846
ARVRFGDLHFDP

SEQ ID NO: 91693 - protein, 9 aa, Homo sapiens
  light chain complementarity determining region 3 for antibody 45847
LQHNSYPWT

SEQ ID NO: 91694 - protein, 17 aa, Homo sapiens
  heavy chain complementarity determining region 3 for antibody 45847
AKSDWGGGFFDWLSIDY

SEQ ID NO: 91695 - protein, 9 aa, Homo sapiens
  light chain complementarity determining region 3 for antibody 45848
LQHDSYPRT

SEQ ID NO: 91696 - protein, 13 aa, Homo sapiens
  heavy chain complementarity determining region 3 for antibody 45848
ASRPFHFGKVLDV

SEQ ID NO: 91697 - protein, 8 aa, Homo sapiens
  light chain complementarity determining region 3 for antibody 45849
LQHDNFPP

SEQ ID NO: 91698 - protein, 19 aa, Homo sapiens
  heavy chain complementarity determining region 3 for antibody 45849
ARVGPGYTRGRYLASYFDF

SEQ ID NO: 91699 - protein, 9 aa, Homo sapiens
  light chain complementarity determining region 3 for antibody 45850
LQDYTYPRT

SEQ ID NO: 91700 - protein, 18 aa, Homo sapiens
  heavy chain complementarity determining region 3 for antibody 45850
VRDADVVVEGITLDRFDS

SEQ ID NO: 91701 - protein, 9 aa, Homo sapiens
  light chain complementarity determining region 3 for antibody 45851
LQDYTYPRT

SEQ ID NO: 91702 - protein, 18 aa, Homo sapiens
  heavy chain complementarity determining region 3 for antibody 45851
ARDANYNERSAYYDAFDV

SEQ ID NO: 91703 - protein, 9 aa, Homo sapiens
  light chain complementarity determining region 3 for antibody 45852
LQDYNFPIT

SEQ ID NO: 91704 - protein, 16 aa, Homo sapiens
  heavy chain complementarity determining region 3 for antibody 45852
ARYCSSQSCNGDWVDP

SEQ ID NO: 91705 - protein, 9 aa, Homo sapiens
  light chain complementarity determining region 3 for antibody 45853
LQDNSYPRT

SEQ ID NO: 91706 - protein, 18 aa, Homo sapiens
  heavy chain complementarity determining region 3 for antibody 45853
VRDLSPIRKGVTYDALDT

SEQ ID NO: 91707 - protein, 9 aa, Homo sapiens
  light chain complementarity determining region 3 for antibody 45854
LHYKSDSRT

SEQ ID NO: 91708 - protein, 15 aa, Homo sapiens
  heavy chain complementarity determining region 3 for antibody 45854
AKGRQDSSDYSYFDY

SEQ ID NO: 91709 - protein, 9 aa, Homo sapiens
  light chain complementarity determining region 3 for antibody 45855
KQANSFPLT

SEQ ID NO: 91710 - protein, 24 aa, Homo sapiens
  heavy chain complementarity determining region 3 for antibody 45855
ARVRIKKTRRVDLVVNYDHYGMDV

SEQ ID NO: 91711 - protein, 9 aa, Homo sapiens
  light chain complementarity determining region 3 for antibody 45856
IQTLQTYLT

SEQ ID NO: 91712 - protein, 17 aa, Homo sapiens
  heavy chain complementarity determining region 3 for antibody 45856
ARDRGKEWEPGRGSFQI

SEQ ID NO: 91713 - protein, 9 aa, Homo sapiens
  light chain complementarity determining region 3 for antibody 45857
HQYVRSPYT

SEQ ID NO: 91714 - protein, 18 aa, Homo sapiens
  heavy chain complementarity determining region 3 for antibody 45857
ARGGVEQRPVAWGSWFDP

SEQ ID NO: 91715 - protein, 9 aa, Homo sapiens
  light chain complementarity determining region 3 for antibody 45858
HQYRDYMWA

SEQ ID NO: 91716 - protein, 10 aa, Homo sapiens
  heavy chain complementarity determining region 3 for antibody 45858
ASLYSYGHFF

SEQ ID NO: 91717 - protein, 8 aa, Homo sapiens
  light chain complementarity determining region 3 for antibody 45859
HQYGSSHT

SEQ ID NO: 91718 - protein, 15 aa, Homo sapiens
  heavy chain complementarity determining region 3 for antibody 45859
AKDSYSSGRIGYFNY

SEQ ID NO: 91719 - protein, 9 aa, Homo sapiens
  light chain complementarity determining region 3 for antibody 45860
HQYGNSPRT

SEQ ID NO: 91720 - protein, 17 aa, Homo sapiens
  heavy chain complementarity determining region 3 for antibody 45860
VRDSDVGFWSGPGSFDV

SEQ ID NO: 91721 - protein, 9 aa, Homo sapiens
  light chain complementarity determining region 3 for antibody 45861
HQYGGSPYT

SEQ ID NO: 91722 - protein, 17 aa, Homo sapiens
  heavy chain complementarity determining region 3 for antibody 45861
TRDQWGVAVGARSPSRH

SEQ ID NO: 91723 - protein, 9 aa, Homo sapiens
  light chain complementarity determining region 3 for antibody 45862
HQYGDSQYT

SEQ ID NO: 91724 - protein, 13 aa, Homo sapiens
  heavy chain complementarity determining region 3 for antibody 45862
ATRGVGQTAGFNF

SEQ ID NO: 91725 - protein, 9 aa, Homo sapiens
  light chain complementarity determining region 3 for antibody 45863
HQYGASPDT

SEQ ID NO: 91726 - protein, 15 aa, Homo sapiens
  heavy chain complementarity determining region 3 for antibody 45863
ARHAPTRITRGAFDI

SEQ ID NO: 91727 - protein, 9 aa, Homo sapiens
  light chain complementarity determining region 3 for antibody 45864
HQYFTSPWT

SEQ ID NO: 91728 - protein, 16 aa, Homo sapiens
  heavy chain complementarity determining region 3 for antibody 45864
ARLGDEIVMMVVGRDY

SEQ ID NO: 91729 - protein, 9 aa, Homo sapiens
  light chain complementarity determining region 3 for antibody 45865
HQYAKTPIP

SEQ ID NO: 91730 - protein, 13 aa, Homo sapiens
  heavy chain complementarity determining region 3 for antibody 45865
ARAQEFSTSCPGY

SEQ ID NO: 91731 - protein, 9 aa, Homo sapiens
  light chain complementarity determining region 3 for antibody 45866
HQSSSLPLT

SEQ ID NO: 91732 - protein, 11 aa, Homo sapiens
  heavy chain complementarity determining region 3 for antibody 45866
AKDDYNGSLDY

SEQ ID NO: 91733 - protein, 9 aa, Homo sapiens
  light chain complementarity determining region 3 for antibody 45867
HQRSSLPLT

SEQ ID NO: 91734 - protein, 16 aa, Homo sapiens
  heavy chain complementarity determining region 3 for antibody 45867
VRGGYRYSGPPDAFDI

SEQ ID NO: 91735 - protein, 9 aa, Homo sapiens
  light chain complementarity determining region 3 for antibody 45868
HKYNGAPYS

SEQ ID NO: 91736 - protein, 13 aa, Homo sapiens
  heavy chain complementarity determining region 3 for antibody 45868
AKDFRGADEALDI

SEQ ID NO: 91737 - protein, 9 aa, Homo sapiens
  light chain complementarity determining region 3 for antibody 45869
HHYGSSVIT

SEQ ID NO: 91738 - protein, 13 aa, Homo sapiens
  heavy chain complementarity determining region 3 for antibody 45869
VRQVDYGLRRLDY

SEQ ID NO: 91739 - protein, 10 aa, Homo sapiens
  light chain complementarity determining region 3 for antibody 45870
HFYGSPSPNT

SEQ ID NO: 91740 - protein, 18 aa, Homo sapiens
  heavy chain complementarity determining region 3 for antibody 45870
ARVGGTTYDASGHYPGDY

SEQ ID NO: 91741 - protein, 9 aa, Homo sapiens
  light chain complementarity determining region 3 for antibody 45871
EQYNAFPFT

SEQ ID NO: 91742 - protein, 14 aa, Homo sapiens
  heavy chain complementarity determining region 3 for antibody 45871
ARAPYSHLMTTQEW

SEQ ID NO: 91743 - protein, 9 aa, Homo sapiens
  light chain complementarity determining region 3 for antibody 45872
EQYDESPYT

SEQ ID NO: 91744 - protein, 16 aa, Homo sapiens
  heavy chain complementarity determining region 3 for antibody 45872
ATLLTGEMGFYFYFDH

SEQ ID NO: 91745 - protein, 8 aa, Homo sapiens
  light chain complementarity determining region 3 for antibody 45873
AQYNYYWT

SEQ ID NO: 91746 - protein, 16 aa, Homo sapiens
  heavy chain complementarity determining region 3 for antibody 45873
AYSFYYDGNGFKTFRH

SEQ ID NO: 91747 - protein, 9 aa, Homo sapiens
  light chain complementarity determining region 3 for antibody 45874
AQGLQFPRT

SEQ ID NO: 91748 - protein, 20 aa, Homo sapiens
  heavy chain complementarity determining region 3 for antibody 45874
SSGGVFYDSPGSPLLDHFDY

SEQ ID NO: 91749 - protein, 9 aa, Homo sapiens
  light chain complementarity determining region 3 for antibody 45875
YQYGSSPPT

SEQ ID NO: 91750 - protein, 10 aa, Homo sapiens
  heavy chain complementarity determining region 3 for antibody 45875
VRGRWLLGDY

SEQ ID NO: 91751 - protein, 9 aa, Homo sapiens
  light chain complementarity determining region 3 for antibody 45876
VQYNRNPRT

SEQ ID NO: 91752 - protein, 6 aa, Homo sapiens
  heavy chain complementarity determining region 3 for antibody 45876
TRALDY

SEQ ID NO: 91753 - protein, 10 aa, Homo sapiens
  light chain complementarity determining region 3 for antibody 45877
VQTLQTPPGT

SEQ ID NO: 91754 - protein, 11 aa, Homo sapiens
  heavy chain complementarity determining region 3 for antibody 45877
ARSGDSWPFDF

SEQ ID NO: 91755 - protein, 10 aa, Homo sapiens
  light chain complementarity determining region 3 for antibody 45878
VQGTHWPPST

SEQ ID NO: 91756 - protein, 11 aa, Homo sapiens
  heavy chain complementarity determining region 3 for antibody 45878
ATDWGSSGWVR

SEQ ID NO: 91757 - protein, 9 aa, Homo sapiens
  light chain complementarity determining region 3 for antibody 45879
RQSYITPST

SEQ ID NO: 91758 - protein, 13 aa, Homo sapiens
  heavy chain complementarity determining region 3 for antibody 45879
AADEAGEDWYFDL

SEQ ID NO: 91759 - protein, 8 aa, Homo sapiens
  light chain complementarity determining region 3 for antibody 45880
QYYHDSWT

SEQ ID NO: 91760 - protein, 9 aa, Homo sapiens
  heavy chain complementarity determining region 3 for antibody 45880
ATEEYYFAN

SEQ ID NO: 91761 - protein, 8 aa, Homo sapiens
  light chain complementarity determining region 3 for antibody 45881
QYYHDSGT

SEQ ID NO: 91762 - protein, 9 aa, Homo sapiens
  heavy chain complementarity determining region 3 for antibody 45881
ATEEYYFSN

SEQ ID NO: 91763 - protein, 9 aa, Homo sapiens
  light chain complementarity determining region 3 for antibody 45882
QYYGSSPYT

SEQ ID NO: 91764 - protein, 17 aa, Homo sapiens
  heavy chain complementarity determining region 3 for antibody 45882
ARGSPISEVLTGNRFDA

SEQ ID NO: 91765 - protein, 11 aa, Homo sapiens
  light chain complementarity determining region 3 for antibody 45883
QYRHNWPAEYT

SEQ ID NO: 91766 - protein, 15 aa, Homo sapiens
  heavy chain complementarity determining region 3 for antibody 45883
AREGVDRLTISAFDI

SEQ ID NO: 91767 - protein, 9 aa, Homo sapiens
  light chain complementarity determining region 3 for antibody 45884
QTYNSFRRT

SEQ ID NO: 91768 - protein, 20 aa, Homo sapiens
  heavy chain complementarity determining region 3 for antibody 45884
ATDPSGIILGQRKRKQYFHH

SEQ ID NO: 91769 - protein, 9 aa, Homo sapiens
  light chain complementarity determining region 3 for antibody 45885
QRYNRAPQT

SEQ ID NO: 91770 - protein, 13 aa, Homo sapiens
  heavy chain complementarity determining region 3 for antibody 45885
SLSLFTLMVGLQS

SEQ ID NO: 91771 - protein, 9 aa, Homo sapiens
  light chain complementarity determining region 3 for antibody 45886
QRYNDYPFT

SEQ ID NO: 91772 - protein, 13 aa, Homo sapiens
  heavy chain complementarity determining region 3 for antibody 45886
ARMPRYSSGWSDY

SEQ ID NO: 91773 - protein, 9 aa, Homo sapiens
  light chain complementarity determining region 3 for antibody 45887
QRYGRSPRT

SEQ ID NO: 91774 - protein, 15 aa, Homo sapiens
  heavy chain complementarity determining region 3 for antibody 45887
AKDGEFCGSNCYFGS

SEQ ID NO: 91775 - protein, 9 aa, Homo sapiens
  light chain complementarity determining region 3 for antibody 45888
QRYDSWPYT

SEQ ID NO: 91776 - protein, 12 aa, Homo sapiens
  heavy chain complementarity determining region 3 for antibody 45888
ARDPRGWVYFDN

SEQ ID NO: 91777 - protein, 11 aa, Homo sapiens
  light chain complementarity determining region 3 for antibody 45889
QRYDGSPPLST

SEQ ID NO: 91778 - protein, 14 aa, Homo sapiens
  heavy chain complementarity determining region 3 for antibody 45889
ARGLDFWMNGWFDP

SEQ ID NO: 91779 - protein, 9 aa, Homo sapiens
  light chain complementarity determining region 3 for antibody 45890
QRYDEASWT

SEQ ID NO: 91780 - protein, 16 aa, Homo sapiens
  heavy chain complementarity determining region 3 for antibody 45890
ARDRGSLWFAEEGFDD

SEQ ID NO: 91781 - protein, 10 aa, Homo sapiens
  light chain complementarity determining region 3 for antibody 45891
QRTYNAPPLT

SEQ ID NO: 91782 - protein, 20 aa, Homo sapiens
  heavy chain complementarity determining region 3 for antibody 45891
ARWAGRVADSFPFVTFPLDF

SEQ ID NO: 91783 - protein, 9 aa, Homo sapiens
  light chain complementarity determining region 3 for antibody 45892
QRQNIAPLT

SEQ ID NO: 91784 - protein, 10 aa, Homo sapiens
  heavy chain complementarity determining region 3 for antibody 45892
ARDEGYFGAS

SEQ ID NO: 91785 - protein, 9 aa, Homo sapiens
  light chain complementarity determining region 3 for antibody 45893
QQYYVTPPT

SEQ ID NO: 91786 - protein, 16 aa, Homo sapiens
  heavy chain complementarity determining region 3 for antibody 45893
ARGGPQSFSYLDAFDI

SEQ ID NO: 91787 - protein, 9 aa, Homo sapiens
  light chain complementarity determining region 3 for antibody 45894
QQYYTTPYT

SEQ ID NO: 91788 - protein, 12 aa, Homo sapiens
  heavy chain complementarity determining region 3 for antibody 45894
ARGRGWGGWFDP

SEQ ID NO: 91789 - protein, 9 aa, Homo sapiens
  light chain complementarity determining region 3 for antibody 45895
QQYYTSPQT

SEQ ID NO: 91790 - protein, 13 aa, Homo sapiens
  heavy chain complementarity determining region 3 for antibody 45895
ARSLAAIGHWFDR

SEQ ID NO: 91791 - protein, 9 aa, Homo sapiens
  light chain complementarity determining region 3 for antibody 45896
QQYYSTPYT

SEQ ID NO: 91792 - protein, 11 aa, Homo sapiens
  heavy chain complementarity determining region 3 for antibody 45896
ARVPSGDPFDY

SEQ ID NO: 91793 - protein, 10 aa, Homo sapiens
  light chain complementarity determining region 3 for antibody 45897
QQYYSTPWYT

SEQ ID NO: 91794 - protein, 11 aa, Homo sapiens
  heavy chain complementarity determining region 3 for antibody 45897
ARFNWDDAFDI

SEQ ID NO: 91795 - protein, 9 aa, Homo sapiens
  light chain complementarity determining region 3 for antibody 45898
QQYYSTPWT

SEQ ID NO: 91796 - protein, 10 aa, Homo sapiens
  heavy chain complementarity determining region 3 for antibody 45898
STPSRVGAKF

SEQ ID NO: 91797 - protein, 9 aa, Homo sapiens
  light chain complementarity determining region 3 for antibody 45899
QQYYSTPPT

SEQ ID NO: 91798 - protein, 13 aa, Homo sapiens
  heavy chain complementarity determining region 3 for antibody 45899
ATVSGSGYHWFDP

SEQ ID NO: 91799 - protein, 9 aa, Homo sapiens
  light chain complementarity determining region 3 for antibody 45900
QQYYSTPLT

SEQ ID NO: 91800 - protein, 11 aa, Homo sapiens
  heavy chain complementarity determining region 3 for antibody 45900
TRVYSWGVYSY

SEQ ID NO: 91801 - protein, 9 aa, Homo sapiens
  light chain complementarity determining region 3 for antibody 45901
QQYYSTPLT

SEQ ID NO: 91802 - protein, 14 aa, Homo sapiens
  heavy chain complementarity determining region 3 for antibody 45901
ARQLGDIPPSSVDY

SEQ ID NO: 91803 - protein, 10 aa, Homo sapiens
  light chain complementarity determining region 3 for antibody 45902
QQYYSTPALT

SEQ ID NO: 91804 - protein, 12 aa, Homo sapiens
  heavy chain complementarity determining region 3 for antibody 45902
VRGGPSHCYFDY

SEQ ID NO: 91805 - protein, 8 aa, Homo sapiens
  light chain complementarity determining region 3 for antibody 45903
QQYYSTLT

SEQ ID NO: 91806 - protein, 12 aa, Homo sapiens
  heavy chain complementarity determining region 3 for antibody 45903
ARVHGGNSPSDY

SEQ ID NO: 91807 - protein, 9 aa, Homo sapiens
  light chain complementarity determining region 3 for antibody 45904
QQYYSSPYT

SEQ ID NO: 91808 - protein, 23 aa, Homo sapiens
  heavy chain complementarity determining region 3 for antibody 45904
ARGITDCSGRNCYGGEVINAFDM

SEQ ID NO: 91809 - protein, 9 aa, Homo sapiens
  light chain complementarity determining region 3 for antibody 45905
QQYYSSPVA

SEQ ID NO: 91810 - protein, 15 aa, Homo sapiens
  heavy chain complementarity determining region 3 for antibody 45905
AKGVYGGSLRSSFDF

SEQ ID NO: 91811 - protein, 9 aa, Homo sapiens
  light chain complementarity determining region 3 for antibody 45906
QQYYSSPFT

SEQ ID NO: 91812 - protein, 17 aa, Homo sapiens
  heavy chain complementarity determining region 3 for antibody 45906
ARAMDCRSGSCRNWFDS

SEQ ID NO: 91813 - protein, 10 aa, Homo sapiens
  light chain complementarity determining region 3 for antibody 45907
QQYYSIPLWT

SEQ ID NO: 91814 - protein, 14 aa, Homo sapiens
  heavy chain complementarity determining region 3 for antibody 45907
AGDFVVGKTAARTV

SEQ ID NO: 91815 - protein, 9 aa, Homo sapiens
  light chain complementarity determining region 3 for antibody 45908
QQYYSIPLT

SEQ ID NO: 91816 - protein, 17 aa, Homo sapiens
  heavy chain complementarity determining region 3 for antibody 45908
ARGLGRMEDSPYNWFDS

SEQ ID NO: 91817 - protein, 11 aa, Homo sapiens
  light chain complementarity determining region 3 for antibody 45909
QQYYSDPPEYT

SEQ ID NO: 91818 - protein, 16 aa, Homo sapiens
  heavy chain complementarity determining region 3 for antibody 45909
ARDLRVRIAVAGTIEH

SEQ ID NO: 91819 - protein, 9 aa, Homo sapiens
  light chain complementarity determining region 3 for antibody 45910
QQYYSAPLT

SEQ ID NO: 91820 - protein, 13 aa, Homo sapiens
  heavy chain complementarity determining region 3 for antibody 45910
TKGDTEGGFLVDS

SEQ ID NO: 91821 - protein, 9 aa, Homo sapiens
  light chain complementarity determining region 3 for antibody 45911
QQYYRTPYT

SEQ ID NO: 91822 - protein, 15 aa, Homo sapiens
  heavy chain complementarity determining region 3 for antibody 45911
ARVGVDPNYYYGMDV

SEQ ID NO: 91823 - protein, 9 aa, Homo sapiens
  light chain complementarity determining region 3 for antibody 45912
QQYYNSPRT

SEQ ID NO: 91824 - protein, 15 aa, Homo sapiens
  heavy chain complementarity determining region 3 for antibody 45912
ARDAWESGTFDWFDP

SEQ ID NO: 91825 - protein, 9 aa, Homo sapiens
  light chain complementarity determining region 3 for antibody 45913
QQYYNSLRT

SEQ ID NO: 91826 - protein, 12 aa, Homo sapiens
  heavy chain complementarity determining region 3 for antibody 45913
VKDCGLGGPRDF

SEQ ID NO: 91827 - protein, 9 aa, Homo sapiens
  light chain complementarity determining region 3 for antibody 45914
QQYYMTPLT

SEQ ID NO: 91828 - protein, 14 aa, Homo sapiens
  heavy chain complementarity determining region 3 for antibody 45914
VGQDCSGRACDYPR

SEQ ID NO: 91829 - protein, 10 aa, Homo sapiens
  light chain complementarity determining region 3 for antibody 45915
QQYYGDPPRT

SEQ ID NO: 91830 - protein, 13 aa, Homo sapiens
  heavy chain complementarity determining region 3 for antibody 45915
VRDDIDGYSNLDY

SEQ ID NO: 91831 - protein, 9 aa, Homo sapiens
  light chain complementarity determining region 3 for antibody 45916
QQYVSPPYT

SEQ ID NO: 91832 - protein, 20 aa, Homo sapiens
  heavy chain complementarity determining region 3 for antibody 45916
ARDLDISVPPGVTDDDGFDI

SEQ ID NO: 91833 - protein, 9 aa, Homo sapiens
  light chain complementarity determining region 3 for antibody 45917
QQYVNSPWT

SEQ ID NO: 91834 - protein, 12 aa, Homo sapiens
  heavy chain complementarity determining region 3 for antibody 45917
ARGLSSGWGLDY

SEQ ID NO: 91835 - protein, 10 aa, Homo sapiens
  light chain complementarity determining region 3 for antibody 45918
QQYTSHLMYT

SEQ ID NO: 91836 - protein, 14 aa, Homo sapiens
  heavy chain complementarity determining region 3 for antibody 45918
AGGEYSNSFGYFNF

SEQ ID NO: 91837 - protein, 6 aa, Homo sapiens
  light chain complementarity determining region 3 for antibody 45919
QQYSWT

SEQ ID NO: 91838 - protein, 16 aa, Homo sapiens
  heavy chain complementarity determining region 3 for antibody 45919
AVSLRGGSGWYGPIHH

SEQ ID NO: 91839 - protein, 9 aa, Homo sapiens
  light chain complementarity determining region 3 for antibody 45920
QQYSSYSWT

SEQ ID NO: 91840 - protein, 24 aa, Homo sapiens
  heavy chain complementarity determining region 3 for antibody 45920
ATVKCVARRRLFYSGSGTQCYPDY

SEQ ID NO: 91841 - protein, 9 aa, Homo sapiens
  light chain complementarity determining region 3 for antibody 45921
QQYSSFPGT

SEQ ID NO: 91842 - protein, 13 aa, Homo sapiens
  heavy chain complementarity determining region 3 for antibody 45921
ARQTPVPSEYFRH

SEQ ID NO: 91843 - protein, 9 aa, Homo sapiens
  light chain complementarity determining region 3 for antibody 45922
QQYSRSFVG

SEQ ID NO: 91844 - protein, 9 aa, Homo sapiens
  heavy chain complementarity determining region 3 for antibody 45922
AGPGVMSSV

SEQ ID NO: 91845 - protein, 10 aa, Homo sapiens
  light chain complementarity determining region 3 for antibody 45923
QQYSNYSPYT

SEQ ID NO: 91846 - protein, 18 aa, Homo sapiens
  heavy chain complementarity determining region 3 for antibody 45923
VRQPFLQGSVEGFDIFDM

SEQ ID NO: 91847 - protein, 10 aa, Homo sapiens
  light chain complementarity determining region 3 for antibody 45924
QQYRTDSDYT

SEQ ID NO: 91848 - protein, 25 aa, Homo sapiens
  heavy chain complementarity determining region 3 for antibody 45924
ARGSYDSPPWYRMQPSVPEDDVLDL

SEQ ID NO: 91849 - protein, 10 aa, Homo sapiens
  light chain complementarity determining region 3 for antibody 45925
QQYRSSSGLT

SEQ ID NO: 91850 - protein, 17 aa, Homo sapiens
  heavy chain complementarity determining region 3 for antibody 45925
ARDRWFYGSGNYYPSDY

SEQ ID NO: 91851 - protein, 8 aa, Homo sapiens
  light chain complementarity determining region 3 for antibody 45926
QQYRSPFP

SEQ ID NO: 91852 - protein, 13 aa, Homo sapiens
  heavy chain complementarity determining region 3 for antibody 45926
ATESGWYQGAFDI

SEQ ID NO: 91853 - protein, 10 aa, Homo sapiens
  light chain complementarity determining region 3 for antibody 45927
QQYRNWPPWT

SEQ ID NO: 91854 - protein, 23 aa, Homo sapiens
  heavy chain complementarity determining region 3 for antibody 45927
ARVGWFGDFLARPPPGHQTYFDF

SEQ ID NO: 91855 - protein, 9 aa, Homo sapiens
  light chain complementarity determining region 3 for antibody 45928
QQYRNTPLT

SEQ ID NO: 91856 - protein, 18 aa, Homo sapiens
  heavy chain complementarity determining region 3 for antibody 45928
AKDFAGYGSSYSYYGLDV

SEQ ID NO: 91857 - protein, 10 aa, Homo sapiens
  light chain complementarity determining region 3 for antibody 45929
QQYQQWPPLT

SEQ ID NO: 91858 - protein, 16 aa, Homo sapiens
  heavy chain complementarity determining region 3 for antibody 45929
ARDMASITMIGRAFDI

SEQ ID NO: 91859 - protein, 8 aa, Homo sapiens
  light chain complementarity determining region 3 for antibody 45930
QQYNTYWT

SEQ ID NO: 91860 - protein, 14 aa, Homo sapiens
  heavy chain complementarity determining region 3 for antibody 45930
ARIRDWGSQGALDL

SEQ ID NO: 91861 - protein, 8 aa, Homo sapiens
  light chain complementarity determining region 3 for antibody 45931
QQYNTYST

SEQ ID NO: 91862 - protein, 14 aa, Homo sapiens
  heavy chain complementarity determining region 3 for antibody 45931
GHTDLHLWPYAMDV

SEQ ID NO: 91863 - protein, 9 aa, Homo sapiens
  light chain complementarity determining region 3 for antibody 45932
QQYNTYPYT

SEQ ID NO: 91864 - protein, 21 aa, Homo sapiens
  heavy chain complementarity determining region 3 for antibody 45932
VRQRPEYYYDNSGYYHGGFDY

SEQ ID NO: 91865 - protein, 9 aa, Homo sapiens
  light chain complementarity determining region 3 for antibody 45933
QQYNTYPLT

SEQ ID NO: 91866 - protein, 17 aa, Homo sapiens
  heavy chain complementarity determining region 3 for antibody 45933
ATRLGIAPEPHYWYFDL

SEQ ID NO: 91867 - protein, 9 aa, Homo sapiens
  light chain complementarity determining region 3 for antibody 45934
QQYNTYPLT

SEQ ID NO: 91868 - protein, 12 aa, Homo sapiens
  heavy chain complementarity determining region 3 for antibody 45934
ASSYDSSGYLTY

SEQ ID NO: 91869 - protein, 9 aa, Homo sapiens
  light chain complementarity determining region 3 for antibody 45935
QQYNTYALT

SEQ ID NO: 91870 - protein, 16 aa, Homo sapiens
  heavy chain complementarity determining region 3 for antibody 45935
ARQAPTKAKSIGIFDN

SEQ ID NO: 91871 - protein, 9 aa, Homo sapiens
  light chain complementarity determining region 3 for antibody 45936
QQYNTWRAS

SEQ ID NO: 91872 - protein, 15 aa, Homo sapiens
  heavy chain complementarity determining region 3 for antibody 45936
AKTRKFSSGHDAFDL

SEQ ID NO: 91873 - protein, 9 aa, Homo sapiens
  light chain complementarity determining region 3 for antibody 45937
QQYNTSPWT

SEQ ID NO: 91874 - protein, 17 aa, Homo sapiens
  heavy chain complementarity determining region 3 for antibody 45937
ARDSRGDWNYRAGAFDI

SEQ ID NO: 91875 - protein, 8 aa, Homo sapiens
  light chain complementarity determining region 3 for antibody 45938
QQYNSYST

SEQ ID NO: 91876 - protein, 14 aa, Homo sapiens
  heavy chain complementarity determining region 3 for antibody 45938
EKDVSDVRGVITDC

SEQ ID NO: 91877 - protein, 9 aa, Homo sapiens
  light chain complementarity determining region 3 for antibody 45939
QQYNSYSRT

SEQ ID NO: 91878 - protein, 14 aa, Homo sapiens
  heavy chain complementarity determining region 3 for antibody 45939
AKVFSSTRYHAFDV

SEQ ID NO: 91879 - protein, 9 aa, Homo sapiens
  light chain complementarity determining region 3 for antibody 45940
QQYNSYSRT

SEQ ID NO: 91880 - protein, 16 aa, Homo sapiens
  heavy chain complementarity determining region 3 for antibody 45940
AAGVGMGRGITTTFDY

SEQ ID NO: 91881 - protein, 9 aa, Homo sapiens
  light chain complementarity determining region 3 for antibody 45941
QQYNSYPYT

SEQ ID NO: 91882 - protein, 15 aa, Homo sapiens
  heavy chain complementarity determining region 3 for antibody 45941
ARDDYASGSYGLFDF

SEQ ID NO: 91883 - protein, 9 aa, Homo sapiens
  light chain complementarity determining region 3 for antibody 45942
QQYNSYPVT

SEQ ID NO: 91884 - protein, 12 aa, Homo sapiens
  heavy chain complementarity determining region 3 for antibody 45942
GRVAMAHKTLDY

SEQ ID NO: 91885 - protein, 9 aa, Homo sapiens
  light chain complementarity determining region 3 for antibody 45943
QQYNSYPPT

SEQ ID NO: 91886 - protein, 19 aa, Homo sapiens
  heavy chain complementarity determining region 3 for antibody 45943
ARSPYYDILTGLKDDAFDI

SEQ ID NO: 91887 - protein, 9 aa, Homo sapiens
  light chain complementarity determining region 3 for antibody 45944
QQYNSYPFT

SEQ ID NO: 91888 - protein, 14 aa, Homo sapiens
  heavy chain complementarity determining region 3 for antibody 45944
AKGRQAGEYYSEDD

SEQ ID NO: 91889 - protein, 10 aa, Homo sapiens
  light chain complementarity determining region 3 for antibody 45945
QQYNSYFSIT

SEQ ID NO: 91890 - protein, 17 aa, Homo sapiens
  heavy chain complementarity determining region 3 for antibody 45945
AREVRPGYPDSSEYFHH

SEQ ID NO: 91891 - protein, 11 aa, Homo sapiens
  light chain complementarity determining region 3 for antibody 45946
QQYNSWPPMYT

SEQ ID NO: 91892 - protein, 14 aa, Homo sapiens
  heavy chain complementarity determining region 3 for antibody 45946
AGYSHGSGSYQLDY

SEQ ID NO: 91893 - protein, 8 aa, Homo sapiens
  light chain complementarity determining region 3 for antibody 45947
QQYNSRWT

SEQ ID NO: 91894 - protein, 14 aa, Homo sapiens
  heavy chain complementarity determining region 3 for antibody 45947
ARGGGRLLYDAFDL

SEQ ID NO: 91895 - protein, 8 aa, Homo sapiens
  light chain complementarity determining region 3 for antibody 45948
QQYNSRWP

SEQ ID NO: 91896 - protein, 14 aa, Homo sapiens
  heavy chain complementarity determining region 3 for antibody 45948
ARDGGRLLYDAFDL

SEQ ID NO: 91897 - protein, 8 aa, Homo sapiens
  light chain complementarity determining region 3 for antibody 45949
QQYNSPYT

SEQ ID NO: 91898 - protein, 16 aa, Homo sapiens
  heavy chain complementarity determining region 3 for antibody 45949
ARPVRHGSFNYWYFDL

SEQ ID NO: 91899 - protein, 9 aa, Homo sapiens
  light chain complementarity determining region 3 for antibody 45950
QQYNSNSRT

SEQ ID NO: 91900 - protein, 16 aa, Homo sapiens
  heavy chain complementarity determining region 3 for antibody 45950
ARDINPRVGATTYFDF

SEQ ID NO: 91901 - protein, 9 aa, Homo sapiens
  light chain complementarity determining region 3 for antibody 45951
QQYNSHPRT

SEQ ID NO: 91902 - protein, 15 aa, Homo sapiens
  heavy chain complementarity determining region 3 for antibody 45951
ARDSIAMAGKDAFDI

SEQ ID NO: 91903 - protein, 10 aa, Homo sapiens
  light chain complementarity determining region 3 for antibody 45952
QQYNSESLYT

SEQ ID NO: 91904 - protein, 15 aa, Homo sapiens
  heavy chain complementarity determining region 3 for antibody 45952
TRQRWKAWGEDAFDI

SEQ ID NO: 91905 - protein, 8 aa, Homo sapiens
  light chain complementarity determining region 3 for antibody 45953
QQYNNWST

SEQ ID NO: 91906 - protein, 19 aa, Homo sapiens
  heavy chain complementarity determining region 3 for antibody 45953
ARGATYYYDSSPYYPNFDY

SEQ ID NO: 91907 - protein, 9 aa, Homo sapiens
  light chain complementarity determining region 3 for antibody 45954
QQYNNWPYT

SEQ ID NO: 91908 - protein, 11 aa, Homo sapiens
  heavy chain complementarity determining region 3 for antibody 45954
GGFYHGGPCGY

SEQ ID NO: 91909 - protein, 10 aa, Homo sapiens
  light chain complementarity determining region 3 for antibody 45955
QQYNNWPTWT

SEQ ID NO: 91910 - protein, 15 aa, Homo sapiens
  heavy chain complementarity determining region 3 for antibody 45955
AHSYDYWSGYRYFDY

SEQ ID NO: 91911 - protein, 10 aa, Homo sapiens
  light chain complementarity determining region 3 for antibody 45956
QQYNNWPPYT

SEQ ID NO: 91912 - protein, 18 aa, Homo sapiens
  heavy chain complementarity determining region 3 for antibody 45956
TRTSDSSTYYSYYYGMDV

SEQ ID NO: 91913 - protein, 10 aa, Homo sapiens [sequence omitted]

SEQ ID NO: 91914 - protein, 12 aa, Homo sapiens
  heavy chain complementarity determining region 3 for antibody 45957
GSWDARELLFDY

SEQ ID NO: 91915 - protein, 10 aa, Homo sapiens [sequence omitted]

SEQ ID NO: 91916 - protein, 13 aa, Homo sapiens
  heavy chain complementarity determining region 3 for antibody 45958
ARGDDDVDHSFDY

SEQ ID NO: 91917 - protein, 10 aa, Homo sapiens
  light chain complementarity determining region 3 for antibody 45959
QQYNNWPPRT

SEQ ID NO: 91918 - protein, 21 aa, Homo sapiens
  heavy chain complementarity determining region 3 for antibody 45959
ARDLGYYDSSGYYYVKALPDY

SEQ ID NO: 91919 - protein, 9 aa, Homo sapiens
  light chain complementarity determining region 3 for antibody 45960
QQYNNWPPP

SEQ ID NO: 91920 - protein, 15 aa, Homo sapiens
  heavy chain complementarity determining region 3 for antibody 45960
ARYPPSGWGNYYFDI

SEQ ID NO: 91921 - protein, 10 aa, Homo sapiens
  light chain complementarity determining region 3 for antibody 45961
QQYNNWPPLT

SEQ ID NO: 91922 - protein, 11 aa, Homo sapiens
  heavy chain complementarity determining region 3 for antibody 45961
ARRGPLKEFDY

SEQ ID NO: 91923 - protein, 10 aa, Homo sapiens
  light chain complementarity determining region 3 for antibody 45962
QQYNNWPPLP

SEQ ID NO: 91924 - protein, 8 aa, Homo sapiens
  heavy chain complementarity determining region 3 for antibody 45962
VRRFALDL

SEQ ID NO: 91925 - protein, 10 aa, Homo sapiens
  light chain complementarity determining region 3 for antibody 45963
QQYNNWPPGT

SEQ ID NO: 91926 - protein, 14 aa, Homo sapiens
  heavy chain complementarity determining region 3 for antibody 45963
ARAPYDYGAQPFNY

SEQ ID NO: 91927 - protein, 10 aa, Homo sapiens
  light chain complementarity determining region 3 for antibody 45964
QQYNNWPPFT

SEQ ID NO: 91928 - protein, 20 aa, Homo sapiens
  heavy chain complementarity determining region 3 for antibody 45964
THSRDYDYVWGSYRRYYSDH

SEQ ID NO: 91929 - protein, 10 aa, Homo sapiens
  light chain complementarity determining region 3 for antibody 45965
QQYNNWPLYT

SEQ ID NO: 91930 - protein, 11 aa, Homo sapiens
  heavy chain complementarity determining region 3 for antibody 45965
VNYDYRGYFDS

SEQ ID NO: 91931 - protein, 9 aa, Homo sapiens
  light chain complementarity determining region 3 for antibody 45966
QQYNNWPLT

SEQ ID NO: 91932 - protein, 16 aa, Homo sapiens
  heavy chain complementarity determining region 3 for antibody 45966
ARNLYFGDFASGVFDF

SEQ ID NO: 91933 - protein, 9 aa, Homo sapiens
  light chain complementarity determining region 3 for antibody 45967
QQYNIWPFT

SEQ ID NO: 91934 - protein, 18 aa, Homo sapiens
  heavy chain complementarity determining region 3 for antibody 45967
ARAGCADGCYSDRVAFDF

SEQ ID NO: 91935 - protein, 9 aa, Homo sapiens
  light chain complementarity determining region 3 for antibody 45968
QQYNHHLLT

SEQ ID NO: 91936 - protein, 15 aa, Homo sapiens
  heavy chain complementarity determining region 3 for antibody 45968
ARDAGAHLWEYYFDY

SEQ ID NO: 91937 - protein, 9 aa, Homo sapiens
  light chain complementarity determining region 3 for antibody 45969
QQYNGYPYT

SEQ ID NO: 91938 - protein, 10 aa, Homo sapiens
  heavy chain complementarity determining region 3 for antibody 45969
ARPTRDAFDM

SEQ ID NO: 91939 - protein, 9 aa, Homo sapiens
  light chain complementarity determining region 3 for antibody 45970
QQYNGYPLT

SEQ ID NO: 91940 - protein, 18 aa, Homo sapiens
  heavy chain complementarity determining region 3 for antibody 45970
VKDVSPAHKLWSTGGLDY

SEQ ID NO: 91941 - protein, 8 aa, Homo sapiens
  light chain complementarity determining region 3 for antibody 45971
QQYNGPLT

SEQ ID NO: 91942 - protein, 17 aa, Homo sapiens
  heavy chain complementarity determining region 3 for antibody 45971
ARTIVVVPAAMRLYFDY

SEQ ID NO: 91943 - protein, 9 aa, Homo sapiens
  light chain complementarity determining region 3 for antibody 45972
QQYNDWPFA

SEQ ID NO: 91944 - protein, 17 aa, Homo sapiens
  heavy chain complementarity determining region 3 for antibody 45972
ARVRDSSAWSTNDAFDI

SEQ ID NO: 91945 - protein, 10 aa, Homo sapiens
  light chain complementarity determining region 3 for antibody 45973
QQYNDFSMGT

SEQ ID NO: 91946 - protein, 22 aa, Homo sapiens
  heavy chain complementarity determining region 3 for antibody 45973
ARYQKDHYDVSGYYHRYWYFDL

SEQ ID NO: 91947 - protein, 9 aa, Homo sapiens
  light chain complementarity determining region 3 for antibody 45974
QQYNAWPGT

SEQ ID NO: 91948 - protein, 18 aa, Homo sapiens
  heavy chain complementarity determining region 3 for antibody 45974
ATGGNRPDWSKLEYYFDN

SEQ ID NO: 91949 - protein, 9 aa, Homo sapiens
  light chain complementarity determining region 3 for antibody 45975
QQYLGSPRT

SEQ ID NO: 91950 - protein, 15 aa, Homo sapiens
  heavy chain complementarity determining region 3 for antibody 45975
AGAAPRRAARGFFHH

SEQ ID NO: 91951 - protein, 8 aa, Homo sapiens
  light chain complementarity determining region 3 for antibody 45976
QQYKSYSS

SEQ ID NO: 91952 - protein, 14 aa, Homo sapiens
  heavy chain complementarity determining region 3 for antibody 45976
TRGEPQGLTGPLDF

SEQ ID NO: 91953 - protein, 10 aa, Homo sapiens
  light chain complementarity determining region 3 for antibody 45977
QQYHSYSSLS

SEQ ID NO: 91954 - protein, 20 aa, Homo sapiens
  heavy chain complementarity determining region 3 for antibody 45977
ARDRVRGGNFTSYAGGGIDP

SEQ ID NO: 91955 - protein, 9 aa, Homo sapiens
  light chain complementarity determining region 3 for antibody 45978
QQYHRVPYT

SEQ ID NO: 91956 - protein, 11 aa, Homo sapiens
  heavy chain complementarity determining region 3 for antibody 45978
VRDIALGVFDF

SEQ ID NO: 91957 - protein, 9 aa, Homo sapiens
  light chain complementarity determining region 3 for antibody 45979
QQYHNFPYT

SEQ ID NO: 91958 - protein, 11 aa, Homo sapiens
  heavy chain complementarity determining region 3 for antibody 45979
ARVGAVGDFDY

SEQ ID NO: 91959 - protein, 8 aa, Homo sapiens
  light chain complementarity determining region 3 for antibody 45980
QQYHHYFT

SEQ ID NO: 91960 - protein, 18 aa, Homo sapiens
  heavy chain complementarity determining region 3 for antibody 45980
ARTYGSGTRKELYSGMDV

SEQ ID NO: 91961 - protein, 8 aa, Homo sapiens
  light chain complementarity determining region 3 for antibody 45981
QQYGTSRT

SEQ ID NO: 91962 - protein, 15 aa, Homo sapiens
  heavy chain complementarity determining region 3 for antibody 45981
TRTYYFGSDSWAFDL

SEQ ID NO: 91963 - protein, 9 aa, Homo sapiens
  light chain complementarity determining region 3 for antibody 45982
QQYGTSPWT

SEQ ID NO: 91964 - protein, 9 aa, Homo sapiens
  heavy chain complementarity determining region 3 for antibody 45982
ARGFDYWDF

SEQ ID NO: 91965 - protein, 9 aa, Homo sapiens
  light chain complementarity determining region 3 for antibody 45983
QQYGTPPRP

SEQ ID NO: 91966 - protein, 14 aa, Homo sapiens
  heavy chain complementarity determining region 3 for antibody 45983
AKDPSDDGGGYFDS

SEQ ID NO: 91967 - protein, 10 aa, Homo sapiens
  light chain complementarity determining region 3 for antibody 45984
QQYGTAPPDT

SEQ ID NO: 91968 - protein, 12 aa, Homo sapiens
  heavy chain complementarity determining region 3 for antibody 45984
ANEVGPAPAYDV

SEQ ID NO: 91969 - protein, 9 aa, Homo sapiens
  light chain complementarity determining region 3 for antibody 45985
QQYGSTPPT

SEQ ID NO: 91970 - protein, 19 aa, Homo sapiens
  heavy chain complementarity determining region 3 for antibody 45985
VRDPGYCRSVDCKGDAYDI

SEQ ID NO: 91971 - protein, 8 aa, Homo sapiens
  light chain complementarity determining region 3 for antibody 45986
QQYGSSYT

SEQ ID NO: 91972 - protein, 21 aa, Homo sapiens
  heavy chain complementarity determining region 3 for antibody 45986
ARSLHQAVVGATGRRNDAFEI

SEQ ID NO: 91973 - protein, 8 aa, Homo sapiens
  light chain complementarity determining region 3 for antibody 45987
QQYGSSVT

SEQ ID NO: 91974 - protein, 15 aa, Homo sapiens
  heavy chain complementarity determining region 3 for antibody 45987
AKASGSSWGTEYFQN

SEQ ID NO: 91975 - protein, 9 aa, Homo sapiens
  light chain complementarity determining region 3 for antibody 45988
QQYGSSSWT

SEQ ID NO: 91976 - protein, 10 aa, Homo sapiens
  heavy chain complementarity determining region 3 for antibody 45988
ARNPLVGMDV

SEQ ID NO: 91977 - protein, 8 aa, Homo sapiens
  light chain complementarity determining region 3 for antibody 45989
QQYGSSSS

SEQ ID NO: 91978 - protein, 15 aa, Homo sapiens
  heavy chain complementarity determining region 3 for antibody 45989
ARGGFSVVVPTSIRY

SEQ ID NO: 91979 - protein, 9 aa, Homo sapiens
  light chain complementarity determining region 3 for antibody 45990
QQYGSSSIT

SEQ ID NO: 91980 - protein, 14 aa, Homo sapiens
  heavy chain complementarity determining region 3 for antibody 45990
ARLEIVIIPPAKNR

SEQ ID NO: 91981 - protein, 9 aa, Homo sapiens
  light chain complementarity determining region 3 for antibody 45991
QQYGSSPYT

SEQ ID NO: 91982 - protein, 8 aa, Homo sapiens
  heavy chain complementarity determining region 3 for antibody 45991
GLIPSAVP

SEQ ID NO: 91983 - protein, 9 aa, Homo sapiens
  light chain complementarity determining region 3 for antibody 45992
QQYGSSPYP

SEQ ID NO: 91984 - protein, 15 aa, Homo sapiens
  heavy chain complementarity determining region 3 for antibody 45992
AILSRDDFKQYYFDY

SEQ ID NO: 91985 - protein, 9 aa, Homo sapiens
  light chain complementarity determining region 3 for antibody 45993
QQYGSSPWT

SEQ ID NO: 91986 - protein, 15 aa, Homo sapiens
  heavy chain complementarity determining region 3 for antibody 45993
ARPRSQQWPGRDFEH

SEQ ID NO: 91987 - protein, 9 aa, Homo sapiens
  light chain complementarity determining region 3 for antibody 45994
QQYGSSPWT

SEQ ID NO: 91988 - protein, 18 aa, Homo sapiens
  heavy chain complementarity determining region 3 for antibody 45994
ARAGVEMVRGLSRGAFDI

SEQ ID NO: 91989 - protein, 11 aa, Homo sapiens
  light chain complementarity determining region 3 for antibody 45995
QQYGSSPSVVT

SEQ ID NO: 91990 - protein, 13 aa, Homo sapiens
  heavy chain complementarity determining region 3 for antibody 45995
ARTGDWQYDAFDI

SEQ ID NO: 91991 - protein, 9 aa, Homo sapiens
  light chain complementarity determining region 3 for antibody 45996
QQYGSSPRT

SEQ ID NO: 91992 - protein, 17 aa, Homo sapiens
  heavy chain complementarity determining region 3 for antibody 45996
ARGGAYYDSSGYDQFDY

SEQ ID NO: 91993 - protein, 9 aa, Homo sapiens
  light chain complementarity determining region 3 for antibody 45997
QQYGSSPRP

SEQ ID NO: 91994 - protein, 14 aa, Homo sapiens
  heavy chain complementarity determining region 3 for antibody 45997
AKVPYGDYANAFDI

SEQ ID NO: 91995 - protein, 11 aa, Homo sapiens
  light chain complementarity determining region 3 for antibody 45998
QQYGSSPRALP

SEQ ID NO: 91996 - protein, 9 aa, Homo sapiens
  heavy chain complementarity determining region 3 for antibody 45998
ASGYQVLKT

SEQ ID NO: 91997 - protein, 9 aa, Homo sapiens
  light chain complementarity determining region 3 for antibody 45999
QQYGSSPQT

SEQ ID NO: 91998 - protein, 19 aa, Homo sapiens
  heavy chain complementarity determining region 3 for antibody 45999
ARVAHYDVFTGYHFYYFDL

SEQ ID NO: 91999 - protein, 9 aa, Homo sapiens
  light chain complementarity determining region 3 for antibody 46000
QQYGSSPQT

SEQ ID NO: 92000 - protein, 12 aa, Homo sapiens
  heavy chain complementarity determining region 3 for antibody 46000
ARNGYSSSRYRN

SEQ ID NO: 92001 - protein, 10 aa, Homo sapiens
  light chain complementarity determining region 3 for antibody 46001
QQYGSSPPYT

SEQ ID NO: 92002 - protein, 17 aa, Homo sapiens
  heavy chain complementarity determining region 3 for antibody 46001
ATSPDDRYGYNFYYFDF

SEQ ID NO: 92003 - protein, 10 aa, Homo sapiens
  light chain complementarity determining region 3 for antibody 46002
QQYGSSPPWT

SEQ ID NO: 92004 - protein, 16 aa, Homo sapiens
  heavy chain complementarity determining region 3 for antibody 46002
ARVQWVRGLFRGGLDY

SEQ ID NO: 92005 - protein, 10 aa, Homo sapiens
  light chain complementarity determining region 3 for antibody 46003
QQYGSSPPVT

SEQ ID NO: 92006 - protein, 16 aa, Homo sapiens
  heavy chain complementarity determining region 3 for antibody 46003
ARDAHESGTYYRLFDH

SEQ ID NO: 92007 - protein, 9 aa, Homo sapiens
  light chain complementarity determining region 3 for antibody 46004
QQYGSSPLT

SEQ ID NO: 92008 - protein, 15 aa, Homo sapiens
  heavy chain complementarity determining region 3 for antibody 46004
ARVLLVGFEEYYFDY

SEQ ID NO: 92009 - protein, 9 aa, Homo sapiens
  light chain complementarity determining region 3 for antibody 46005
QQYGSSPLT

SEQ ID NO: 92010 - protein, 12 aa, Homo sapiens
  heavy chain complementarity determining region 3 for antibody 46005
ARMLGFGSGLAY

SEQ ID NO: 92011 - protein, 9 aa, Homo sapiens
  light chain complementarity determining region 3 for antibody 46006
QQYGSSPLT

SEQ ID NO: 92012 - protein, 10 aa, Homo sapiens
  heavy chain complementarity determining region 3 for antibody 46006
ARGGGGAFDV

SEQ ID NO: 92013 - protein, 9 aa, Homo sapiens
  light chain complementarity determining region 3 for antibody 46007
QQYGSSPLT

SEQ ID NO: 92014 - protein, 19 aa, Homo sapiens
  heavy chain complementarity determining region 3 for antibody 46007
ARDPLDPDELGYFYYGLDV

SEQ ID NO: 92015 - protein, 9 aa, Homo sapiens
  light chain complementarity determining region 3 for antibody 46008
QQYGSSPLT

SEQ ID NO: 92016 - protein, 14 aa, Homo sapiens
  heavy chain complementarity determining region 3 for antibody 46008
AKDRRVAGDWYFDL

SEQ ID NO: 92017 - protein, 9 aa, Homo sapiens
  light chain complementarity determining region 3 for antibody 46009
QQYGSSPLP

SEQ ID NO: 92018 - protein, 19 aa, Homo sapiens
  heavy chain complementarity determining region 3 for antibody 46009
ATVSTYPSGSLGILGTFDF

SEQ ID NO: 92019 - protein, 9 aa, Homo sapiens
  light chain complementarity determining region 3 for antibody 46010
QQYGSSPLP

SEQ ID NO: 92020 - protein, 16 aa, Homo sapiens
  heavy chain complementarity determining region 3 for antibody 46010
ARGLPLVRGVISPMDV

SEQ ID NO: 92021 - protein, 9 aa, Homo sapiens
  light chain complementarity determining region 3 for antibody 46011
QQYGSSPIT

SEQ ID NO: 92022 - protein, 15 aa, Homo sapiens
  heavy chain complementarity determining region 3 for antibody 46011
ARDREYKLLVGNFDY

SEQ ID NO: 92023 - protein, 9 aa, Homo sapiens
  light chain complementarity determining region 3 for antibody 46012
QQYGSSPGT

SEQ ID NO: 92024 - protein, 17 aa, Homo sapiens
  heavy chain complementarity determining region 3 for antibody 46012
VRSFYFDSSGDHGPFDY

SEQ ID NO: 92025 - protein, 9 aa, Homo sapiens
  light chain complementarity determining region 3 for antibody 46013
QQYGSSPGT

SEQ ID NO: 92026 - protein, 14 aa, Homo sapiens
  heavy chain complementarity determining region 3 for antibody 46013
ARGRDGYNFLPMDY

SEQ ID NO: 92027 - protein, 9 aa, Homo sapiens
  light chain complementarity determining region 3 for antibody 46014
QQYGSSPGT

SEQ ID NO: 92028 - protein, 19 aa, Homo sapiens
  heavy chain complementarity determining region 3 for antibody 46014
AHRLVVWFGELFGYDAFDI

SEQ ID NO: 92029 - protein, 10 aa, Homo sapiens
  light chain complementarity determining region 3 for antibody 46015
QQYGSSPGLP

SEQ ID NO: 92030 - protein, 17 aa, Homo sapiens
  heavy chain complementarity determining region 3 for antibody 46015
ARGGDYGSFTAYSRIDH

SEQ ID NO: 92031 - protein, 10 aa, Homo sapiens
  light chain complementarity determining region 3 for antibody 46016
QQYGSSPAWR

SEQ ID NO: 92032 - protein, 12 aa, Homo sapiens
  heavy chain complementarity determining region 3 for antibody 46016
ARAQTTVTTADS

SEQ ID NO: 92033 - protein, 9 aa, Homo sapiens
  light chain complementarity determining region 3 for antibody 46017
QQYGSSLVT

SEQ ID NO: 92034 - protein, 17 aa, Homo sapiens
  heavy chain complementarity determining region 3 for antibody 46017
VSDWRWYRGTFPYYFDE

SEQ ID NO: 92035 - protein, 10 aa, Homo sapiens
  light chain complementarity determining region 3 for antibody 46018
QQYGSSLSWT

SEQ ID NO: 92036 - protein, 20 aa, Homo sapiens
  heavy chain complementarity determining region 3 for antibody 46018
AKEWRITLARGVIKNGPFDY

SEQ ID NO: 92037 - protein, 10 aa, Homo sapiens
  light chain complementarity determining region 3 for antibody 46019
QQYGSSLSVT

SEQ ID NO: 92038 - protein, 17 aa, Homo sapiens
  heavy chain complementarity determining region 3 for antibody 46019
ARHVSNPRTMDYYYFDV

SEQ ID NO: 92039 - protein, 9 aa, Homo sapiens
  light chain complementarity determining region 3 for antibody 46020
QQYGSSLGT

SEQ ID NO: 92040 - protein, 14 aa, Homo sapiens
  heavy chain complementarity determining region 3 for antibody 46020
ARGYFYGSGLGMDV

SEQ ID NO: 92041 - protein, 9 aa, Homo sapiens
  light chain complementarity determining region 3 for antibody 46021
QQYGSSGYT

SEQ ID NO: 92042 - protein, 17 aa, Homo sapiens
  heavy chain complementarity determining region 3 for antibody 46021
ARGWGYTYGFNPITFDS

SEQ ID NO: 92043 - protein, 10 aa, Homo sapiens
  light chain complementarity determining region 3 for antibody 46022
QQYGSRSPIT

SEQ ID NO: 92044 - protein, 12 aa, Homo sapiens
  heavy chain complementarity determining region 3 for antibody 46022
ARPQGAGDRIDY

SEQ ID NO: 92045 - protein, 9 aa, Homo sapiens
  light chain complementarity determining region 3 for antibody 46023
QQYGSPRLS

SEQ ID NO: 92046 - protein, 16 aa, Homo sapiens
  heavy chain complementarity determining region 3 for antibody 46023
AKDGPVIGGWYGAFDY

SEQ ID NO: 92047 - protein, 9 aa, Homo sapiens
  light chain complementarity determining region 3 for antibody 46024
QQYGSPPYT

SEQ ID NO: 92048 - protein, 21 aa, Homo sapiens
  heavy chain complementarity determining region 3 for antibody 46024
ARDATYYDFLTGYYRAGYSDY

SEQ ID NO: 92049 - protein, 9 aa, Homo sapiens
  light chain complementarity determining region 3 for antibody 46025
QQYGSLPLT

SEQ ID NO: 92050 - protein, 16 aa, Homo sapiens
  heavy chain complementarity determining region 3 for antibody 46025
ARDMWLGDQSAEYFHH

SEQ ID NO: 92051 - protein, 8 aa, Homo sapiens
  light chain complementarity determining region 3 for antibody 46026
QQYGSLIT

SEQ ID NO: 92052 - protein, 18 aa, Homo sapiens
  heavy chain complementarity determining region 3 for antibody 46026
AKAQLGSCSGTRCYPFDY

SEQ ID NO: 92053 - protein, 9 aa, Homo sapiens
  light chain complementarity determining region 3 for antibody 46027
QQYGSFPYS

SEQ ID NO: 92054 - protein, 19 aa, Homo sapiens
  heavy chain complementarity determining region 3 for antibody 46027
ARERGGGGWYPVPLSPFTY

SEQ ID NO: 92055 - protein, 9 aa, Homo sapiens
  light chain complementarity determining region 3 for antibody 46028
QQYGSAPQT

SEQ ID NO: 92056 - protein, 9 aa, Homo sapiens
  heavy chain complementarity determining region 3 for antibody 46028
IAVVTTIPH

SEQ ID NO: 92057 - protein, 10 aa, Homo sapiens
  light chain complementarity determining region 3 for antibody 46029
QQYGRSPSIP

SEQ ID NO: 92058 - protein, 15 aa, Homo sapiens
  heavy chain complementarity determining region 3 for antibody 46029
ARGALTAAALVYFDF

SEQ ID NO: 92059 - protein, 9 aa, Homo sapiens
  light chain complementarity determining region 3 for antibody 46030
QQYGRSPRT

SEQ ID NO: 92060 - protein, 22 aa, Homo sapiens
  heavy chain complementarity determining region 3 for antibody 46030
ATYPRYDYDSSGYSRRYDALHI

SEQ ID NO: 92061 - protein, 8 aa, Homo sapiens
  light chain complementarity determining region 3 for antibody 46031
QQYGRSPL

SEQ ID NO: 92062 - protein, 13 aa, Homo sapiens
  heavy chain complementarity determining region 3 for antibody 46031
ARDWVGVTRQFDY

SEQ ID NO: 92063 - protein, 9 aa, Homo sapiens
  light chain complementarity determining region 3 for antibody 46032
QQYGRSPIT

SEQ ID NO: 92064 - protein, 15 aa, Homo sapiens
  heavy chain complementarity determining region 3 for antibody 46032
ARDFREFLDEYFFDY

SEQ ID NO: 92065 - protein, 9 aa, Homo sapiens
  light chain complementarity determining region 3 for antibody 46033
QQYGPYTWT

SEQ ID NO: 92066 - protein, 9 aa, Homo sapiens
  heavy chain complementarity determining region 3 for antibody 46033
ATGALAFDI

SEQ ID NO: 92067 - protein, 9 aa, Homo sapiens
  light chain complementarity determining region 3 for antibody 46034
QQYGPSQYT

SEQ ID NO: 92068 - protein, 8 aa, Homo sapiens
  heavy chain complementarity determining region 3 for antibody 46034
ARARYFDY

SEQ ID NO: 92069 - protein, 11 aa, Homo sapiens
  light chain complementarity determining region 3 for antibody 46035
QQYGPSGPEYP

SEQ ID NO: 92070 - protein, 13 aa, Homo sapiens
  heavy chain complementarity determining region 3 for antibody 46035
TIDYYNPSGDFDY

SEQ ID NO: 92071 - protein, 8 aa, Homo sapiens
  light chain complementarity determining region 3 for antibody 46036
QQYGNSRT

SEQ ID NO: 92072 - protein, 15 aa, Homo sapiens
  heavy chain complementarity determining region 3 for antibody 46036
AKADYCSAANCPFDS

SEQ ID NO: 92073 - protein, 11 aa, Homo sapiens
  light chain complementarity determining region 3 for antibody 46037
QQYGNSPVMYP

SEQ ID NO: 92074 - protein, 15 aa, Homo sapiens
  heavy chain complementarity determining region 3 for antibody 46037
AKDRLIAATSTPLDH

SEQ ID NO: 92075 - protein, 10 aa, Homo sapiens
  light chain complementarity determining region 3 for antibody 46038
QQYGNSPRYT

SEQ ID NO: 92076 - protein, 15 aa, Homo sapiens
  heavy chain complementarity determining region 3 for antibody 46038
ARLGWVRGDYGPIAD

SEQ ID NO: 92077 - protein, 9 aa, Homo sapiens
  light chain complementarity determining region 3 for antibody 46039
QQYGNSPRT

SEQ ID NO: 92078 - protein, 16 aa, Homo sapiens
  heavy chain complementarity determining region 3 for antibody 46039
ARIWFGEHDYNDAFDI

SEQ ID NO: 92079 - protein, 9 aa, Homo sapiens
  light chain complementarity determining region 3 for antibody 46040
QQYGNSPFT

SEQ ID NO: 92080 - protein, 14 aa, Homo sapiens
  heavy chain complementarity determining region 3 for antibody 46040
ARVWDYAPRGAFDI

SEQ ID NO: 92081 - protein, 9 aa, Homo sapiens
  light chain complementarity determining region 3 for antibody 46041
QQYGNAPYT

SEQ ID NO: 92082 - protein, 17 aa, Homo sapiens
  heavy chain complementarity determining region 3 for antibody 46041
TRDHGDRRGYSGYTALY

SEQ ID NO: 92083 - protein, 9 aa, Homo sapiens
  light chain complementarity determining region 3 for antibody 46042
QQYGISPYP

SEQ ID NO: 92084 - protein, 13 aa, Homo sapiens
  heavy chain complementarity determining region 3 for antibody 46042
TTYWTTVLRVGGP

SEQ ID NO: 92085 - protein, 9 aa, Homo sapiens
  light chain complementarity determining region 3 for antibody 46043
QQYGISPLT

SEQ ID NO: 92086 - protein, 13 aa, Homo sapiens
  heavy chain complementarity determining region 3 for antibody 46043
ARDPYGSGSCWDY

SEQ ID NO: 92087 - protein, 8 aa, Homo sapiens
  light chain complementarity determining region 3 for antibody 46044
QQYGHSWT

SEQ ID NO: 92088 - protein, 17 aa, Homo sapiens
  heavy chain complementarity determining region 3 for antibody 46044
ARPHRYGAYHYYYPMDV

SEQ ID NO: 92089 - protein, 11 aa, Homo sapiens
  light chain complementarity determining region 3 for antibody 46045
QQYGGSPRMYP

SEQ ID NO: 92090 - protein, 17 aa, Homo sapiens
  heavy chain complementarity determining region 3 for antibody 46045
AYWNGLDSGWFSGPLDY

SEQ ID NO: 92091 - protein, 10 aa, Homo sapiens
  light chain complementarity determining region 3 for antibody 46046
QQYGGSPQYT

SEQ ID NO: 92092 - protein, 15 aa, Homo sapiens
  heavy chain complementarity determining region 3 for antibody 46046
ARDDRFATRFHSLEN

SEQ ID NO: 92093 - protein, 10 aa, Homo sapiens
  light chain complementarity determining region 3 for antibody 46047
QQYGGSPPVP

SEQ ID NO: 92094 - protein, 17 aa, Homo sapiens
  heavy chain complementarity determining region 3 for antibody 46047
ARVQNYFNNSGWGDFDY

SEQ ID NO: 92095 - protein, 9 aa, Homo sapiens
  light chain complementarity determining region 3 for antibody 46048
QQYGGSPLT

SEQ ID NO: 92096 - protein, 23 aa, Homo sapiens
  heavy chain complementarity determining region 3 for antibody 46048
TTDRVDGSPWYTLWWGLDFYFGN

SEQ ID NO: 92097 - protein, 10 aa, Homo sapiens
  light chain complementarity determining region 3 for antibody 46049
QQYGGSPLFT

SEQ ID NO: 92098 - protein, 16 aa, Homo sapiens
  heavy chain complementarity determining region 3 for antibody 46049
ARDPRYYASGSNGMDV

SEQ ID NO: 92099 - protein, 10 aa, Homo sapiens
  light chain complementarity determining region 3 for antibody 46050
QQYGFSPPIT

SEQ ID NO: 92100 - protein, 16 aa, Homo sapiens
  heavy chain complementarity determining region 3 for antibody 46050
ARDSLGYSNGLDAFDM

SEQ ID NO: 92101 - protein, 9 aa, Homo sapiens
  light chain complementarity determining region 3 for antibody 46051
QQYGDSPWK

SEQ ID NO: 92102 - protein, 11 aa, Homo sapiens
  heavy chain complementarity determining region 3 for antibody 46051
ARIDVTVGYDI

SEQ ID NO: 92103 - protein, 9 aa, Homo sapiens
  light chain complementarity determining region 3 for antibody 46052
QQYGDAPLT

SEQ ID NO: 92104 - protein, 18 aa, Homo sapiens
  heavy chain complementarity determining region 3 for antibody 46052
ARDFSESGGYYYRGSIEY

SEQ ID NO: 92105 - protein, 10 aa, Homo sapiens
  light chain complementarity determining region 3 for antibody 46053
QQYFSSRPFT

SEQ ID NO: 92106 - protein, 11 aa, Homo sapiens
  heavy chain complementarity determining region 3 for antibody 46053
AGGYGGNLEDY

SEQ ID NO: 92107 - protein, 10 aa, Homo sapiens
  light chain complementarity determining region 3 for antibody 46054
QQYFSNPSLT

SEQ ID NO: 92108 - protein, 13 aa, Homo sapiens
  heavy chain complementarity determining region 3 for antibody 46054
AARMGPPDWILRH

SEQ ID NO: 92109 - protein, 9 aa, Homo sapiens
  light chain complementarity determining region 3 for antibody 46055
QQYFETPFT

SEQ ID NO: 92110 - protein, 15 aa, Homo sapiens
  heavy chain complementarity determining region 3 for antibody 46055
AHSRRNNWYKGDFDY

SEQ ID NO: 92111 - protein, 9 aa, Homo sapiens
  light chain complementarity determining region 3 for antibody 46056
QQYETLPWT

SEQ ID NO: 92112 - protein, 12 aa, Homo sapiens
  heavy chain complementarity determining region 3 for antibody 46056
ARGLSSGWGLDY

SEQ ID NO: 92113 - protein, 9 aa, Homo sapiens
  light chain complementarity determining region 3 for antibody 46057
QQYDTYPWT

SEQ ID NO: 92114 - protein, 15 aa, Homo sapiens
  heavy chain complementarity determining region 3 for antibody 46057
ARVARITKLRGVPQT

SEQ ID NO: 92115 - protein, 9 aa, Homo sapiens
  light chain complementarity determining region 3 for antibody 46058
QQYDTYPWT

SEQ ID NO: 92116 - protein, 14 aa, Homo sapiens
  heavy chain complementarity determining region 3 for antibody 46058
ARRGKTTVVRGFDF

SEQ ID NO: 92117 - protein, 11 aa, Homo sapiens
  light chain complementarity determining region 3 for antibody 46059
QQYDTSPPGDT

SEQ ID NO: 92118 - protein, 14 aa, Homo sapiens
  heavy chain complementarity determining region 3 for antibody 46059
ARETSNSRKRSFDQ

SEQ ID NO: 92119 - protein, 9 aa, Homo sapiens
  light chain complementarity determining region 3 for antibody 46060
QQYDTSPGP

SEQ ID NO: 92120 - protein, 16 aa, Homo sapiens
  heavy chain complementarity determining region 3 for antibody 46060
ARLSGDWGSAPHFFDT

SEQ ID NO: 92121 - protein, 9 aa, Homo sapiens
  light chain complementarity determining region 3 for antibody 46061
QQYDSYPYT

SEQ ID NO: 92122 - protein, 15 aa, Homo sapiens
  heavy chain complementarity determining region 3 for antibody 46061
ARPMLRGVMVSDYDY

SEQ ID NO: 92123 - protein, 9 aa, Homo sapiens
  light chain complementarity determining region 3 for antibody 46062
QQYDSYPWT

SEQ ID NO: 92124 - protein, 17 aa, Homo sapiens
  heavy chain complementarity determining region 3 for antibody 46062
AKDIFFGIAVAGTAFDI

SEQ ID NO: 92125 - protein, 9 aa, Homo sapiens
  light chain complementarity determining region 3 for antibody 46063
QQYDSYFET

SEQ ID NO: 92126 - protein, 18 aa, Homo sapiens
  heavy chain complementarity determining region 3 for antibody 46063
ARPPGGNSESGGYYYFVY

SEQ ID NO: 92127 - protein, 9 aa, Homo sapiens
  light chain complementarity determining region 3 for antibody 46064
QQYDSSPWT

SEQ ID NO: 92128 - protein, 13 aa, Homo sapiens
  heavy chain complementarity determining region 3 for antibody 46064
ARGIAVAGIFFQY

SEQ ID NO: 92129 - protein, 9 aa, Homo sapiens
  light chain complementarity determining region 3 for antibody 46065
QQYDSSPFT

SEQ ID NO: 92130 - protein, 14 aa, Homo sapiens
  heavy chain complementarity determining region 3 for antibody 46065
AKDTGWLQFGYFDN

SEQ ID NO: 92131 - protein, 9 aa, Homo sapiens
  light chain complementarity determining region 3 for antibody 46066
QQYDSNSYT

SEQ ID NO: 92132 - protein, 15 aa, Homo sapiens
  heavy chain complementarity determining region 3 for antibody 46066
ARDGGPNTFGSYFDS

SEQ ID NO: 92133 - protein, 9 aa, Homo sapiens
  light chain complementarity determining region 3 for antibody 46067
QQYDSFPVT

SEQ ID NO: 92134 - protein, 21 aa, Homo sapiens
  heavy chain complementarity determining region 3 for antibody 46067
ARVRGAVVEVTSNTDPDFFDV

SEQ ID NO: 92135 - protein, 9 aa, Homo sapiens
  light chain complementarity determining region 3 for antibody 46068
QQYDNTPLT

SEQ ID NO: 92136 - protein, 22 aa, Homo sapiens
  heavy chain complementarity determining region 3 for antibody 46068
ARDRHIIFVRSLRDRIAKYFQH

SEQ ID NO: 92137 - protein, 9 aa, Homo sapiens
  light chain complementarity determining region 3 for antibody 46069
QQYDNSPYT

SEQ ID NO: 92138 - protein, 13 aa, Homo sapiens
  heavy chain complementarity determining region 3 for antibody 46069
ARDSWITLWYFDL

SEQ ID NO: 92139 - protein, 9 aa, Homo sapiens
  light chain complementarity determining region 3 for antibody 46070
QQYDNLPYT

SEQ ID NO: 92140 - protein, 16 aa, Homo sapiens
  heavy chain complementarity determining region 3 for antibody 46070
ASSGYCTGGSCYREGL

SEQ ID NO: 92141 - protein, 9 aa, Homo sapiens
  light chain complementarity determining region 3 for antibody 46071
QQYDNLPWT

SEQ ID NO: 92142 - protein, 16 aa, Homo sapiens
  heavy chain complementarity determining region 3 for antibody 46071
ARDGRLGYDFWSGYDY

SEQ ID NO: 92143 - protein, 8 aa, Homo sapiens
  light chain complementarity determining region 3 for antibody 46072
QQYDNLPV

SEQ ID NO: 92144 - protein, 11 aa, Homo sapiens
  heavy chain complementarity determining region 3 for antibody 46072
ARVGSNWFFDS

SEQ ID NO: 92145 - protein, 9 aa, Homo sapiens
  light chain complementarity determining region 3 for antibody 46073
QQYDNLPLT

SEQ ID NO: 92146 - protein, 14 aa, Homo sapiens
  heavy chain complementarity determining region 3 for antibody 46073
ARLNAQTAHAEFDF

SEQ ID NO: 92147 - protein, 8 aa, Homo sapiens
  light chain complementarity determining region 3 for antibody 46074
QQYDNLLT

SEQ ID NO: 92148 - protein, 17 aa, Homo sapiens
  heavy chain complementarity determining region 3 for antibody 46074
AKDIFFGIAVAGTAFDI

SEQ ID NO: 92149 - protein, 9 aa, Homo sapiens
  light chain complementarity determining region 3 for antibody 46075
QQYDNLLRT

SEQ ID NO: 92150 - protein, 14 aa, Homo sapiens
  heavy chain complementarity determining region 3 for antibody 46075
ARVSPDCSGDCLGY

SEQ ID NO: 92151 - protein, 10 aa, Homo sapiens
  light chain complementarity determining region 3 for antibody 46076
QQYDKWPPWT

SEQ ID NO: 92152 - protein, 18 aa, Homo sapiens
  heavy chain complementarity determining region 3 for antibody 46076
ARDQCSGRSCHSWYPSDF

SEQ ID NO: 92153 - protein, 9 aa, Homo sapiens
  light chain complementarity determining region 3 for antibody 46077
QQYDILPYA

SEQ ID NO: 92154 - protein, 16 aa, Homo sapiens
  heavy chain complementarity determining region 3 for antibody 46077
TRGSMKAAGGSGAFDV

SEQ ID NO: 92155 - protein, 9 aa, Homo sapiens
  light chain complementarity determining region 3 for antibody 46078
QQYCSSPYT

SEQ ID NO: 92156 - protein, 14 aa, Homo sapiens
  heavy chain complementarity determining region 3 for antibody 46078
VCEGSESEEDAFDI

SEQ ID NO: 92157 - protein, 9 aa, Homo sapiens
  light chain complementarity determining region 3 for antibody 46079
QQYATSPLT

SEQ ID NO: 92158 - protein, 18 aa, Homo sapiens
  heavy chain complementarity determining region 3 for antibody 46079
ARWTGSLWFGEFSGWFDP

SEQ ID NO: 92159 - protein, 9 aa, Homo sapiens
  light chain complementarity determining region 3 for antibody 46080
QQYASSRYT

SEQ ID NO: 92160 - protein, 19 aa, Homo sapiens
  heavy chain complementarity determining region 3 for antibody 46080
AHKRFDFRSGYSSWGGFDY

SEQ ID NO: 92161 - protein, 9 aa, Homo sapiens
  light chain complementarity determining region 3 for antibody 46081
QQYAHVMYT

SEQ ID NO: 92162 - protein, 15 aa, Homo sapiens
  heavy chain complementarity determining region 3 for antibody 46081
ARVGILAGGPNWFDP

SEQ ID NO: 92163 - protein, 11 aa, Homo sapiens
  light chain complementarity determining region 3 for antibody 46082
QQWSSWPPAIT

SEQ ID NO: 92164 - protein, 19 aa, Homo sapiens
  heavy chain complementarity determining region 3 for antibody 46082
AKRKGYCSGTSCFPGAFDF

SEQ ID NO: 92165 - protein, 9 aa, Homo sapiens
  light chain complementarity determining region 3 for antibody 46083
QQVYTPPYT

SEQ ID NO: 92166 - protein, 13 aa, Homo sapiens
  heavy chain complementarity determining region 3 for antibody 46083
ARARNYDRISLDF

SEQ ID NO: 92167 - protein, 9 aa, Homo sapiens
  light chain complementarity determining region 3 for antibody 46084
QQVNSYPYS

SEQ ID NO: 92168 - protein, 16 aa, Homo sapiens
  heavy chain complementarity determining region 3 for antibody 46084
TRDRPQWDTCSDEVPI

SEQ ID NO: 92169 - protein, 9 aa, Homo sapiens
  light chain complementarity determining region 3 for antibody 46085
QQVHIYPFT

SEQ ID NO: 92170 - protein, 16 aa, Homo sapiens
  heavy chain complementarity determining region 3 for antibody 46085
ARSAYYYGSGSYLLDY

SEQ ID NO: 92171 - protein, 9 aa, Homo sapiens
  light chain complementarity determining region 3 for antibody 46086
QQTYTARVT

SEQ ID NO: 92172 - protein, 15 aa, Homo sapiens
  heavy chain complementarity determining region 3 for antibody 46086
ARDSFDGSYSGSFDY

SEQ ID NO: 92173 - protein, 9 aa, Homo sapiens
  light chain complementarity determining region 3 for antibody 46087
QQTYSSPYT

SEQ ID NO: 92174 - protein, 14 aa, Homo sapiens
  heavy chain complementarity determining region 3 for antibody 46087
ARQMGTVVTPRFDQ

SEQ ID NO: 92175 - protein, 9 aa, Homo sapiens
  light chain complementarity determining region 3 for antibody 46088
QQTYSPPLT

SEQ ID NO: 92176 - protein, 14 aa, Homo sapiens
  heavy chain complementarity determining region 3 for antibody 46088
ARGRDTSGYSGLDY

SEQ ID NO: 92177 - protein, 9 aa, Homo sapiens
  light chain complementarity determining region 3 for antibody 46089
QQTYSFPLT

SEQ ID NO: 92178 - protein, 20 aa, Homo sapiens
  heavy chain complementarity determining region 3 for antibody 46089
ATARSITWTRNEGLLVSFDH

SEQ ID NO: 92179 - protein, 9 aa, Homo sapiens
  light chain complementarity determining region 3 for antibody 46090
QQTYRTPGT

SEQ ID NO: 92180 - protein, 17 aa, Homo sapiens
  heavy chain complementarity determining region 3 for antibody 46090
VRTGPIVEVPAAIPVDV

SEQ ID NO: 92181 - protein, 13 aa, Homo sapiens
  light chain complementarity determining region 3 for antibody 46091
QQTYMLTYSSWVT

SEQ ID NO: 92182 - protein, 15 aa, Homo sapiens
  heavy chain complementarity determining region 3 for antibody 46091
ARDSFDGSYSGSFDY

SEQ ID NO: 92183 - protein, 9 aa, Homo sapiens
  light chain complementarity determining region 3 for antibody 46092
QQTYKTPYT

SEQ ID NO: 92184 - protein, 19 aa, Homo sapiens
  heavy chain complementarity determining region 3 for antibody 46092
ARRGVCRDGSCPDYGDFFY

SEQ ID NO: 92185 - protein, 10 aa, Homo sapiens
  light chain complementarity determining region 3 for antibody 46093
QQTYITPPWT

SEQ ID NO: 92186 - protein, 16 aa, Homo sapiens
  heavy chain complementarity determining region 3 for antibody 46093
VTDRTGFTMVRGALKH

SEQ ID NO: 92187 - protein, 9 aa, Homo sapiens
  light chain complementarity determining region 3 for antibody 46094
QQTYDTPQT

SEQ ID NO: 92188 - protein, 19 aa, Homo sapiens
  heavy chain complementarity determining region 3 for antibody 46094
ARSRVRGELRSFDPDGFDF

SEQ ID NO: 92189 - protein, 9 aa, Homo sapiens
  light chain complementarity determining region 3 for antibody 46095
QQTNSFPLT

SEQ ID NO: 92190 - protein, 20 aa, Homo sapiens
  heavy chain complementarity determining region 3 for antibody 46095
ARTRVREAIAGHFHRYAMDV

SEQ ID NO: 92191 - protein, 9 aa, Homo sapiens
  light chain complementarity determining region 3 for antibody 46096
QQTHGVPTT

SEQ ID NO: 92192 - protein, 15 aa, Homo sapiens
  heavy chain complementarity determining region 3 for antibody 46096
ATESGVGDCSYWFDT

SEQ ID NO: 92193 - protein, 9 aa, Homo sapiens
  light chain complementarity determining region 3 for antibody 46097
QQTHGVPTT

SEQ ID NO: 92194 - protein, 15 aa, Homo sapiens
  heavy chain complementarity determining region 3 for antibody 46097
ATESGLGDCSYWFDT

SEQ ID NO: 92195 - protein, 9 aa, Homo sapiens
  light chain complementarity determining region 3 for antibody 46098
QQTFSTQST

SEQ ID NO: 92196 - protein, 24 aa, Homo sapiens
  heavy chain complementarity determining region 3 for antibody 46098
ARDRFLGYYDSDVYTPESANGMDV

SEQ ID NO: 92197 - protein, 10 aa, Homo sapiens
  light chain complementarity determining region 3 for antibody 46099
QQSYTTPALT

SEQ ID NO: 92198 - protein, 14 aa, Homo sapiens
  heavy chain complementarity determining region 3 for antibody 46099
ARAYFDSNGYYCDY

SEQ ID NO: 92199 - protein, 9 aa, Homo sapiens
  light chain complementarity determining region 3 for antibody 46100
QQSYTPPWT

SEQ ID NO: 92200 - protein, 14 aa, Homo sapiens
  heavy chain complementarity determining region 3 for antibody 46100
ARDVDDSNYGTFIY

SEQ ID NO: 92201 - protein, 9 aa, Homo sapiens
  light chain complementarity determining region 3 for antibody 46101
QQSYTIPLT

SEQ ID NO: 92202 - protein, 25 aa, Homo sapiens
  heavy chain complementarity determining region 3 for antibody 46101
ARDSGKDPYKDFLSGSEYYYYGLDV

SEQ ID NO: 92203 - protein, 9 aa, Homo sapiens
  light chain complementarity determining region 3 for antibody 46102
QQSYTFPRT

SEQ ID NO: 92204 - protein, 13 aa, Homo sapiens
  heavy chain complementarity determining region 3 for antibody 46102
ARDLENWGDCFDY

SEQ ID NO: 92205 - protein, 9 aa, Homo sapiens
  light chain complementarity determining region 3 for antibody 46103
QQSYSVPLT

SEQ ID NO: 92206 - protein, 23 aa, Homo sapiens
  heavy chain complementarity determining region 3 for antibody 46103
ARDSPVAQKGRPPLDFYLYAMDV

SEQ ID NO: 92207 - protein, 9 aa, Homo sapiens
  light chain complementarity determining region 3 for antibody 46104
QQSYSTPYT

SEQ ID NO: 92208 - protein, 8 aa, Homo sapiens
  heavy chain complementarity determining region 3 for antibody 46104
ASFTMVRV

SEQ ID NO: 92209 - protein, 9 aa, Homo sapiens
  light chain complementarity determining region 3 for antibody 46105
QQSYSTPYT

SEQ ID NO: 92210 - protein, 14 aa, Homo sapiens
  heavy chain complementarity determining region 3 for antibody 46105
ARERVGPTYNWFDP

SEQ ID NO: 92211 - protein, 9 aa, Homo sapiens
  light chain complementarity determining region 3 for antibody 46106
QQSYSTPYT

SEQ ID NO: 92212 - protein, 19 aa, Homo sapiens
  heavy chain complementarity determining region 3 for antibody 46106
AKVPIAGYNDFWSAEEGLF

SEQ ID NO: 92213 - protein, 9 aa, Homo sapiens
  light chain complementarity determining region 3 for antibody 46107
QQSYSTPYT

SEQ ID NO: 92214 - protein, 17 aa, Homo sapiens
  heavy chain complementarity determining region 3 for antibody 46107
AKDMIAEDQGYYYGVDV

SEQ ID NO: 92215 - protein, 9 aa, Homo sapiens
  light chain complementarity determining region 3 for antibody 46108
QQSYSTPWT

SEQ ID NO: 92216 - protein, 10 aa, Homo sapiens
  heavy chain complementarity determining region 3 for antibody 46108
ASGGGYYPDS

SEQ ID NO: 92217 - protein, 9 aa, Homo sapiens
  light chain complementarity determining region 3 for antibody 46109
QQSYSTPVP

SEQ ID NO: 92218 - protein, 14 aa, Homo sapiens
  heavy chain complementarity determining region 3 for antibody 46109
ARISPLTTSYAFDI

SEQ ID NO: 92219 - protein, 9 aa, Homo sapiens
  light chain complementarity determining region 3 for antibody 46110
QQSYSTPRT

SEQ ID NO: 92220 - protein, 17 aa, Homo sapiens
  heavy chain complementarity determining region 3 for antibody 46110
ARAGFKSYYDSSGHYDY

SEQ ID NO: 92221 - protein, 9 aa, Homo sapiens
  light chain complementarity determining region 3 for antibody 46111
QQSYSTPRA

SEQ ID NO: 92222 - protein, 22 aa, Homo sapiens
  heavy chain complementarity determining region 3 for antibody 46111
AREYYARSGSGFHSYSYYGMDV

SEQ ID NO: 92223 - protein, 9 aa, Homo sapiens
  light chain complementarity determining region 3 for antibody 46112
QQSYSTPPT

SEQ ID NO: 92224 - protein, 19 aa, Homo sapiens
  heavy chain complementarity determining region 3 for antibody 46112
ARVRGYCGVSGCLVHWLDY

SEQ ID NO: 92225 - protein, 10 aa, Homo sapiens
  light chain complementarity determining region 3 for antibody 46113
QQSYSTPPFT

SEQ ID NO: 92226 - protein, 17 aa, Homo sapiens
  heavy chain complementarity determining region 3 for antibody 46113
ARGSPISDVLTGNRFDA

SEQ ID NO: 92227 - protein, 9 aa, Homo sapiens
  light chain complementarity determining region 3 for antibody 46114
QQSYSTPLT

SEQ ID NO: 92228 - protein, 13 aa, Homo sapiens
  heavy chain complementarity determining region 3 for antibody 46114
TRDNAQYSDFADF

SEQ ID NO: 92229 - protein, 9 aa, Homo sapiens
  light chain complementarity determining region 3 for antibody 46115
QQSYSTPGT

SEQ ID NO: 92230 - protein, 16 aa, Homo sapiens
  heavy chain complementarity determining region 3 for antibody 46115
ARHPGARIVDATIFDS

SEQ ID NO: 92231 - protein, 10 aa, Homo sapiens
  light chain complementarity determining region 3 for antibody 46116
QQSYSTLLYT

SEQ ID NO: 92232 - protein, 11 aa, Homo sapiens
  heavy chain complementarity determining region 3 for antibody 46116
AKDNNFWPIDY

SEQ ID NO: 92233 - protein, 9 aa, Homo sapiens
  light chain complementarity determining region 3 for antibody 46117
QQSYSTLLT

SEQ ID NO: 92234 - protein, 19 aa, Homo sapiens
  heavy chain complementarity determining region 3 for antibody 46117
TRTGETYYYGSGSPIDFDY

SEQ ID NO: 92235 - protein, 10 aa, Homo sapiens
  light chain complementarity determining region 3 for antibody 46118
QQSYSTLLST

SEQ ID NO: 92236 - protein, 11 aa, Homo sapiens
  heavy chain complementarity determining region 3 for antibody 46118
AKDNNFWTIDY

SEQ ID NO: 92237 - protein, 8 aa, Homo sapiens
  light chain complementarity determining region 3 for antibody 46119
QQSYSTIT

SEQ ID NO: 92238 - protein, 19 aa, Homo sapiens
  heavy chain complementarity determining region 3 for antibody 46119
AREIGAYYGGYSRGEYFQY

SEQ ID NO: 92239 - protein, 9 aa, Homo sapiens
  light chain complementarity determining region 3 for antibody 46120
QQSYSSLYS

SEQ ID NO: 92240 - protein, 18 aa, Homo sapiens
  heavy chain complementarity determining region 3 for antibody 46120
ARVFAYYGSGNYSYYFDY

SEQ ID NO: 92241 - protein, 9 aa, Homo sapiens
  light chain complementarity determining region 3 for antibody 46121
QQSYSRPWT

SEQ ID NO: 92242 - protein, 14 aa, Homo sapiens
  heavy chain complementarity determining region 3 for antibody 46121
ARDHGSSSYVWFDP

SEQ ID NO: 92243 - protein, 9 aa, Homo sapiens
  light chain complementarity determining region 3 for antibody 46122
QQSYSPPFT

SEQ ID NO: 92244 - protein, 33 aa, Homo sapiens
  heavy chain complementarity determining region 3 for antibody 46122
ARDRYLSSRPRPSYDSLTAHGSRDYFYYYGMDL

SEQ ID NO: 92245 - protein, 9 aa, Homo sapiens
  light chain complementarity determining region 3 for antibody 46123
QQSYSAPLS

SEQ ID NO: 92246 - protein, 14 aa, Homo sapiens
  heavy chain complementarity determining region 3 for antibody 46123
ARSADTSGYSRFDF

SEQ ID NO: 92247 - protein, 9 aa, Homo sapiens
  light chain complementarity determining region 3 for antibody 46124
QQSYRAPRT

SEQ ID NO: 92248 - protein, 22 aa, Homo sapiens
  heavy chain complementarity determining region 3 for antibody 46124
ARDSYIGAGSFDGPRPSQGFDL

SEQ ID NO: 92249 - protein, 9 aa, Homo sapiens
  light chain complementarity determining region 3 for antibody 46125
QQSYRAPRP

SEQ ID NO: 92250 - protein, 22 aa, Homo sapiens
  heavy chain complementarity determining region 3 for antibody 46125
ARDSYIGAGSFDGPRPSQGFEL

SEQ ID NO: 92251 - protein, 9 aa, Homo sapiens
  light chain complementarity determining region 3 for antibody 46126
QQSYNTAVT

SEQ ID NO: 92252 - protein, 11 aa, Homo sapiens
  heavy chain complementarity determining region 3 for antibody 46126
ARRLVTTEFDQ

SEQ ID NO: 92253 - protein, 9 aa, Homo sapiens
  light chain complementarity determining region 3 for antibody 46127
QQSYNSPHS

SEQ ID NO: 92254 - protein, 17 aa, Homo sapiens
  heavy chain complementarity determining region 3 for antibody 46127
ATPNVRYSYGYFGAYHL

SEQ ID NO: 92255 - protein, 9 aa, Homo sapiens
  light chain complementarity determining region 3 for antibody 46128
QQSYNPPFT

SEQ ID NO: 92256 - protein, 8 aa, Homo sapiens
  heavy chain complementarity determining region 3 for antibody 46128
VGGDDREY

SEQ ID NO: 92257 - protein, 9 aa, Homo sapiens
  light chain complementarity determining region 3 for antibody 46129
QQSYNIPYT

SEQ ID NO: 92258 - protein, 13 aa, Homo sapiens
  heavy chain complementarity determining region 3 for antibody 46129
ATMTGEAASALDT

SEQ ID NO: 92259 - protein, 9 aa, Homo sapiens
  light chain complementarity determining region 3 for antibody 46130
QQSYLSLIT

SEQ ID NO: 92260 - protein, 15 aa, Homo sapiens
  heavy chain complementarity determining region 3 for antibody 46130
VRGQLGYSGYDTFDY

SEQ ID NO: 92261 - protein, 9 aa, Homo sapiens
  light chain complementarity determining region 3 for antibody 46131
QQSYITPRT

SEQ ID NO: 92262 - protein, 17 aa, Homo sapiens
  heavy chain complementarity determining region 3 for antibody 46131
VRDRRGRVFFGDDAFDV

SEQ ID NO: 92263 - protein, 9 aa, Homo sapiens
  light chain complementarity determining region 3 for antibody 46132
QQSYGSPPT

SEQ ID NO: 92264 - protein, 14 aa, Homo sapiens
  heavy chain complementarity determining region 3 for antibody 46132
VRDEGGTGYSSPRD

SEQ ID NO: 92265 - protein, 9 aa, Homo sapiens
  light chain complementarity determining region 3 for antibody 46133
QQSYGAPYT

SEQ ID NO: 92266 - protein, 13 aa, Homo sapiens
  heavy chain complementarity determining region 3 for antibody 46133
ASAFEYGPGSYIY

SEQ ID NO: 92267 - protein, 9 aa, Homo sapiens
  light chain complementarity determining region 3 for antibody 46134
QQSSSSPWT

SEQ ID NO: 92268 - protein, 9 aa, Homo sapiens
  heavy chain complementarity determining region 3 for antibody 46134
ATGISGWSY

SEQ ID NO: 92269 - protein, 9 aa, Homo sapiens
  light chain complementarity determining region 3 for antibody 46135
QQSSSAPFT

SEQ ID NO: 92270 - protein, 17 aa, Homo sapiens
  heavy chain complementarity determining region 3 for antibody 46135
AKGRPTTTFGAVMPLDS

SEQ ID NO: 92271 - protein, 10 aa, Homo sapiens
  light chain complementarity determining region 3 for antibody 46136
QQSNSNSIYT

SEQ ID NO: 92272 - protein, 16 aa, Homo sapiens
  heavy chain complementarity determining region 3 for antibody 46136
AREGEGAYGEDEYFQH

SEQ ID NO: 92273 - protein, 9 aa, Homo sapiens
  light chain complementarity determining region 3 for antibody 46137
QQSNSFPFT

SEQ ID NO: 92274 - protein, 18 aa, Homo sapiens
  heavy chain complementarity determining region 3 for antibody 46137
AKEISKGSGYFSFAAFDV

SEQ ID NO: 92275 - protein, 9 aa, Homo sapiens
  light chain complementarity determining region 3 for antibody 46138
QQSLGTPRT

SEQ ID NO: 92276 - protein, 16 aa, Homo sapiens
  heavy chain complementarity determining region 3 for antibody 46138
ARGFGDLSDLRDGFDY

SEQ ID NO: 92277 - protein, 9 aa, Homo sapiens
  light chain complementarity determining region 3 for antibody 46139
QQSHTYPYT

SEQ ID NO: 92278 - protein, 18 aa, Homo sapiens
  heavy chain complementarity determining region 3 for antibody 46139
ARDYPAYSSSWYGGTFDY

SEQ ID NO: 92279 - protein, 9 aa, Homo sapiens
  light chain complementarity determining region 3 for antibody 46140
QQSHSTPYT

SEQ ID NO: 92280 - protein, 14 aa, Homo sapiens
  heavy chain complementarity determining region 3 for antibody 46140
AREVFGDAVTWFDP

SEQ ID NO: 92281 - protein, 9 aa, Homo sapiens
  light chain complementarity determining region 3 for antibody 46141
QQSGTAPRP

SEQ ID NO: 92282 - protein, 17 aa, Homo sapiens
  heavy chain complementarity determining region 3 for antibody 46141
AKDVHSRQGYYYYGMDV

SEQ ID NO: 92283 - protein, 9 aa, Homo sapiens
  light chain complementarity determining region 3 for antibody 46142
QQSGSSPWP

SEQ ID NO: 92284 - protein, 13 aa, Homo sapiens
  heavy chain complementarity determining region 3 for antibody 46142
ARVNSGWSSTTDF

SEQ ID NO: 92285 - protein, 9 aa, Homo sapiens
  light chain complementarity determining region 3 for antibody 46143
QQSFSSPRT

SEQ ID NO: 92286 - protein, 15 aa, Homo sapiens
  heavy chain complementarity determining region 3 for antibody 46143
ASEYGNSAGHYFFDY

SEQ ID NO: 92287 - protein, 10 aa, Homo sapiens
  light chain complementarity determining region 3 for antibody 46144
QQSDSTPVLT

SEQ ID NO: 92288 - protein, 17 aa, Homo sapiens
  heavy chain complementarity determining region 3 for antibody 46144
ARKGGYTHGYDADVLEL

SEQ ID NO: 92289 - protein, 10 aa, Homo sapiens
  light chain complementarity determining region 3 for antibody 46145
QQRYSTLLYT

SEQ ID NO: 92290 - protein, 11 aa, Homo sapiens
  heavy chain complementarity determining region 3 for antibody 46145
AKDNNFWTIDY

SEQ ID NO: 92291 - protein, 10 aa, Homo sapiens
  light chain complementarity determining region 3 for antibody 46146
QQRYNWPPFT

SEQ ID NO: 92292 - protein, 11 aa, Homo sapiens
  heavy chain complementarity determining region 3 for antibody 46146
ARGVGSYVFES

SEQ ID NO: 92293 - protein, 10 aa, Homo sapiens
  light chain complementarity determining region 3 for antibody 46147
QQRYNWPPDT

SEQ ID NO: 92294 - protein, 11 aa, Homo sapiens
  heavy chain complementarity determining region 3 for antibody 46147
ARGVGSYVFES

SEQ ID NO: 92295 - protein, 10 aa, Homo sapiens
  light chain complementarity determining region 3 for antibody 46148
QQRYNGPPFT

SEQ ID NO: 92296 - protein, 11 aa, Homo sapiens
  heavy chain complementarity determining region 3 for antibody 46148
ARGVGSYPFDS

SEQ ID NO: 92297 - protein, 10 aa, Homo sapiens
  light chain complementarity determining region 3 for antibody 46149
QQRVTWTPIT

SEQ ID NO: 92298 - protein, 13 aa, Homo sapiens
  heavy chain complementarity determining region 3 for antibody 46149
ARGTAARNGDLDY

SEQ ID NO: 92299 - protein, 8 aa, Homo sapiens
  light chain complementarity determining region 3 for antibody 46150
QQRTLGLS

SEQ ID NO: 92300 - protein, 16 aa, Homo sapiens
  heavy chain complementarity determining region 3 for antibody 46150
ARIPYYYDDNEYPYDY

SEQ ID NO: 92301 - protein, 10 aa, Homo sapiens
  light chain complementarity determining region 3 for antibody 46151
QQRSTWPSIT

SEQ ID NO: 92302 - protein, 20 aa, Homo sapiens
  heavy chain complementarity determining region 3 for antibody 46151
AKDRYYDSSGHNYGINGFDY

SEQ ID NO: 92303 - protein, 10 aa, Homo sapiens
  light chain complementarity determining region 3 for antibody 46152
QQRSTWPPIP

SEQ ID NO: 92304 - protein, 11 aa, Homo sapiens
  heavy chain complementarity determining region 3 for antibody 46152
TTEPRHYYFDY

SEQ ID NO: 92305 - protein, 12 aa, Homo sapiens
  light chain complementarity determining region 3 for antibody 46153
QQRSSWPRGGIT

SEQ ID NO: 92306 - protein, 18 aa, Homo sapiens
  heavy chain complementarity determining region 3 for antibody 46153
TSPERCNKTTCNMGYLNY

SEQ ID NO: 92307 - protein, 11 aa, Homo sapiens
  light chain complementarity determining region 3 for antibody 46154
QQRSSWPPGFT

SEQ ID NO: 92308 - protein, 12 aa, Homo sapiens
  heavy chain complementarity determining region 3 for antibody 46154
ARVGPSTVTLEY

SEQ ID NO: 92309 - protein, 10 aa, Homo sapiens
  light chain complementarity determining region 3 for antibody 46155
QQRSNWPSLT

SEQ ID NO: 92310 - protein, 15 aa, Homo sapiens
  heavy chain complementarity determining region 3 for antibody 46155
ARAAYCGGDCFALDY

SEQ ID NO: 92311 - protein, 10 aa, Homo sapiens
  light chain complementarity determining region 3 for antibody 46156
QQRSNWPPYT

SEQ ID NO: 92312 - protein, 15 aa, Homo sapiens
  heavy chain complementarity determining region 3 for antibody 46156
AKDQGQWLVLGVFDY

SEQ ID NO: 92313 - protein, 10 aa, Homo sapiens
  light chain complementarity determining region 3 for antibody 46157
QQRSNWPPYP

SEQ ID NO: 92314 - protein, 13 aa, Homo sapiens
  heavy chain complementarity determining region 3 for antibody 46157
AREEVIGGSPFDF

SEQ ID NO: 92315 - protein, 10 aa, Homo sapiens
  light chain complementarity determining region 3 for antibody 46158
QQRSNWPPWT

SEQ ID NO: 92316 - protein, 14 aa, Homo sapiens
  heavy chain complementarity determining region 3 for antibody 46158
ARAKDASGFHAFDI

SEQ ID NO: 92317 - protein, 10 aa, Homo sapiens
  light chain complementarity determining region 3 for antibody 46159
QQRSNWPPWT

SEQ ID NO: 92318 - protein, 20 aa, Homo sapiens
  heavy chain complementarity determining region 3 for antibody 46159
AKDGALGYSYGDYYYYGMDI

SEQ ID NO: 92319 - protein, 10 aa, Homo sapiens
  light chain complementarity determining region 3 for antibody 46160
QQRSNWPPVT

SEQ ID NO: 92320 - protein, 16 aa, Homo sapiens
  heavy chain complementarity determining region 3 for antibody 46160
ASALSYCNGGSCHFDY

SEQ ID NO: 92321 - protein, 11 aa, Homo sapiens
  light chain complementarity determining region 3 for antibody 46161
QQRSNWPPRLP

SEQ ID NO: 92322 - protein, 11 aa, Homo sapiens
  heavy chain complementarity determining region 3 for antibody 46161
ARVFENWDSDY

SEQ ID NO: 92323 - protein, 10 aa, Homo sapiens
  light chain complementarity determining region 3 for antibody 46162
QQRSNWPPLP

SEQ ID NO: 92324 - protein, 18 aa, Homo sapiens
  heavy chain complementarity determining region 3 for antibody 46162
ATSAGPEYSGSYYSRADY

SEQ ID NO: 92325 - protein, 10 aa, Homo sapiens
  light chain complementarity determining region 3 for antibody 46163
QQRSNWPPIT

SEQ ID NO: 92326 - protein, 15 aa, Homo sapiens
  heavy chain complementarity determining region 3 for antibody 46163
AKDLSVVVVIMVFDY

SEQ ID NO: 92327 - protein, 10 aa, Homo sapiens
  light chain complementarity determining region 3 for antibody 46164
QQRSNWPPIP

SEQ ID NO: 92328 - protein, 17 aa, Homo sapiens
  heavy chain complementarity determining region 3 for antibody 46164
AAGYHSESLSADEVFDI

SEQ ID NO: 92329 - protein, 10 aa, Homo sapiens
  light chain complementarity determining region 3 for antibody 46165
QQRSNWPPFT

SEQ ID NO: 92330 - protein, 11 aa, Homo sapiens
  heavy chain complementarity determining region 3 for antibody 46165
ARGVGSYPFDS

SEQ ID NO: 92331 - protein, 10 aa, Homo sapiens
  light chain complementarity determining region 3 for antibody 46166
QQRSNWPPCT

SEQ ID NO: 92332 - protein, 16 aa, Homo sapiens
  heavy chain complementarity determining region 3 for antibody 46166
AAFSHLYDSAHMPFDY

SEQ ID NO: 92333 - protein, 9 aa, Homo sapiens
  light chain complementarity determining region 3 for antibody 46167
QQRSNWPLT

SEQ ID NO: 92334 - protein, 22 aa, Homo sapiens
  heavy chain complementarity determining region 3 for antibody 46167
SSRNSGRNSLPLNAPLYWLFDL

SEQ ID NO: 92335 - protein, 9 aa, Homo sapiens
  light chain complementarity determining region 3 for antibody 46168
QQRSNWPLG

SEQ ID NO: 92336 - protein, 17 aa, Homo sapiens
  heavy chain complementarity determining region 3 for antibody 46168
AKDRSATIAAPMARDDY

SEQ ID NO: 92337 - protein, 10 aa, Homo sapiens
  light chain complementarity determining region 3 for antibody 46169
QQRSNWLSLT

SEQ ID NO: 92338 - protein, 15 aa, Homo sapiens
  heavy chain complementarity determining region 3 for antibody 46169
ARVEMPPYSTSEPDY

SEQ ID NO: 92339 - protein, 10 aa, Homo sapiens
  light chain complementarity determining region 3 for antibody 46170
QQRSNWKRLP

SEQ ID NO: 92340 - protein, 16 aa, Homo sapiens
  heavy chain complementarity determining region 3 for antibody 46170
TKCHDFWNGYSYYFDY

SEQ ID NO: 92341 - protein, 8 aa, Homo sapiens
  light chain complementarity determining region 3 for antibody 46171
QQRSNWGT

SEQ ID NO: 92342 - protein, 11 aa, Homo sapiens
  heavy chain complementarity determining region 3 for antibody 46171
ARGNENYYFDY

SEQ ID NO: 92343 - protein, 10 aa, Homo sapiens
  light chain complementarity determining region 3 for antibody 46172
QQRSNRPRGT

SEQ ID NO: 92344 - protein, 9 aa, Homo sapiens
  heavy chain complementarity determining region 3 for antibody 46172
ARVDGYFDY

SEQ ID NO: 92345 - protein, 10 aa, Homo sapiens
  light chain complementarity determining region 3 for antibody 46173
QQRSKWPPRT

SEQ ID NO: 92346 - protein, 9 aa, Homo sapiens
  heavy chain complementarity determining region 3 for antibody 46173
ARVDGYFDY

SEQ ID NO: 92347 - protein, 10 aa, Homo sapiens
  light chain complementarity determining region 3 for antibody 46174
QQRSKRPPLT

SEQ ID NO: 92348 - protein, 9 aa, Homo sapiens
  heavy chain complementarity determining region 3 for antibody 46174
ARVDGYFDY

SEQ ID NO: 92349 - protein, 10 aa, Homo sapiens
  light chain complementarity determining region 3 for antibody 46175
QQRSKRPGVT

SEQ ID NO: 92350 - protein, 13 aa, Homo sapiens
  heavy chain complementarity determining region 3 for antibody 46175
ARDHWDKIAVAAK

SEQ ID NO: 92351 - protein, 9 aa, Homo sapiens
  light chain complementarity determining region 3 for antibody 46176
QQRSIWPLT

SEQ ID NO: 92352 - protein, 16 aa, Homo sapiens
  heavy chain complementarity determining region 3 for antibody 46176
ATGRGYELKTGWYFDL

SEQ ID NO: 92353 - protein, 10 aa, Homo sapiens
  light chain complementarity determining region 3 for antibody 46177
QQRSHWPPYT

SEQ ID NO: 92354 - protein, 18 aa, Homo sapiens
  heavy chain complementarity determining region 3 for antibody 46177
AREENFYDSSGYFGSKDY

SEQ ID NO: 92355 - protein, 9 aa, Homo sapiens
  light chain complementarity determining region 3 for antibody 46178
QQRRTWPPT

SEQ ID NO: 92356 - protein, 17 aa, Homo sapiens
  heavy chain complementarity determining region 3 for antibody 46178
ARSGGSGYRVSFSWFDP

SEQ ID NO: 92357 - protein, 8 aa, Homo sapiens
  light chain complementarity determining region 3 for antibody 46179
QQRRSWLT

SEQ ID NO: 92358 - protein, 13 aa, Homo sapiens
  heavy chain complementarity determining region 3 for antibody 46179
AKEVIAAPGTGES

SEQ ID NO: 92359 - protein, 10 aa, Homo sapiens
  light chain complementarity determining region 3 for antibody 46180
QQRRDWPPIT

SEQ ID NO: 92360 - protein, 18 aa, Homo sapiens
  heavy chain complementarity determining region 3 for antibody 46180
AKDHRGDVSAWLGSFLDP

SEQ ID NO: 92361 - protein, 9 aa, Homo sapiens
  light chain complementarity determining region 3 for antibody 46181
QQRNNWPGT

SEQ ID NO: 92362 - protein, 16 aa, Homo sapiens
  heavy chain complementarity determining region 3 for antibody 46181
AGTSISRAGPAQHFHY

SEQ ID NO: 92363 - protein, 9 aa, Homo sapiens
  light chain complementarity determining region 3 for antibody 46182
QQRNKRPPT

SEQ ID NO: 92364 - protein, 12 aa, Homo sapiens
  heavy chain complementarity determining region 3 for antibody 46182
ARDLGVGKYFDH

SEQ ID NO: 92365 - protein, 9 aa, Homo sapiens
  light chain complementarity determining region 3 for antibody 46183
QQRNFWPIT

SEQ ID NO: 92366 - protein, 18 aa, Homo sapiens
  heavy chain complementarity determining region 3 for antibody 46183
ARGRMVRGVIIGEDYFDS

SEQ ID NO: 92367 - protein, 9 aa, Homo sapiens
  light chain complementarity determining region 3 for antibody 46184
QQRINWPRT

SEQ ID NO: 92368 - protein, 13 aa, Homo sapiens
  heavy chain complementarity determining region 3 for antibody 46184
ARDCTDRRGYFDY

SEQ ID NO: 92369 - protein, 9 aa, Homo sapiens
  light chain complementarity determining region 3 for antibody 46185
QQRHTTPLT

SEQ ID NO: 92370 - protein, 13 aa, Homo sapiens
  heavy chain complementarity determining region 3 for antibody 46185
ARDAYDGDWYFDI

SEQ ID NO: 92371 - protein, 9 aa, Homo sapiens
  light chain complementarity determining region 3 for antibody 46186
QQRGDWPLT

SEQ ID NO: 92372 - protein, 17 aa, Homo sapiens
  heavy chain complementarity determining region 3 for antibody 46186
ATRLGIAPEPHYWYFDL

SEQ ID NO: 92373 - protein, 10 aa, Homo sapiens
  light chain complementarity determining region 3 for antibody 46187
QQRFSTPPYT

SEQ ID NO: 92374 - protein, 20 aa, Homo sapiens
  heavy chain complementarity determining region 3 for antibody 46187
ATLNIRGGYGSGWSAEYFQH

SEQ ID NO: 92375 - protein, 11 aa, Homo sapiens
  light chain complementarity determining region 3 for antibody 46188
QQREEGTNWLT

SEQ ID NO: 92376 - protein, 15 aa, Homo sapiens
  heavy chain complementarity determining region 3 for antibody 46188
ARGGYSSNWYWWFDP

SEQ ID NO: 92377 - protein, 9 aa, Homo sapiens
  light chain complementarity determining region 3 for antibody 46189
QQRDSTPYT

SEQ ID NO: 92378 - protein, 15 aa, Homo sapiens
  heavy chain complementarity determining region 3 for antibody 46189
ARLFLFRGFLVMLDY

SEQ ID NO: 92379 - protein, 8 aa, Homo sapiens
  light chain complementarity determining region 3 for antibody 46190
QQRDDWVT

SEQ ID NO: 92380 - protein, 14 aa, Homo sapiens
  heavy chain complementarity determining region 3 for antibody 46190
ARETSNYGGYVLHF

SEQ ID NO: 92381 - protein, 9 aa, Homo sapiens
  light chain complementarity determining region 3 for antibody 46191
QQPYSPPFT

SEQ ID NO: 92382 - protein, 14 aa, Homo sapiens
  heavy chain complementarity determining region 3 for antibody 46191
ARGRDTSGYSGLDH

SEQ ID NO: 92383 - protein, 8 aa, Homo sapiens
  light chain complementarity determining region 3 for antibody 46192
QQNYIYWT

SEQ ID NO: 92384 - protein, 15 aa, Homo sapiens
  heavy chain complementarity determining region 3 for antibody 46192
ATLPRGYNGFGYFHH

SEQ ID NO: 92385 - protein, 9 aa, Homo sapiens
  light chain complementarity determining region 3 for antibody 46193
QQNYGTPYT

SEQ ID NO: 92386 - protein, 22 aa, Homo sapiens
  heavy chain complementarity determining region 3 for antibody 46193
AKNLFAHRLLPGLLWFGDLSGS

SEQ ID NO: 92387 - protein, 9 aa, Homo sapiens
  light chain complementarity determining region 3 for antibody 46194
QQNYDYPFT

SEQ ID NO: 92388 - protein, 16 aa, Homo sapiens
  heavy chain complementarity determining region 3 for antibody 46194
ARDRPRESSPYCSFIF

SEQ ID NO: 92389 - protein, 8 aa, Homo sapiens
  light chain complementarity determining region 3 for antibody 46195
QQNSSSPT

SEQ ID NO: 92390 - protein, 17 aa, Homo sapiens
  heavy chain complementarity determining region 3 for antibody 46195
AKDVHSRQGYYYYGMDV

SEQ ID NO: 92391 - protein, 10 aa, Homo sapiens
  light chain complementarity determining region 3 for antibody 46196
QQNGSSPPMS

SEQ ID NO: 92392 - protein, 14 aa, Homo sapiens
  heavy chain complementarity determining region 3 for antibody 46196
ARELVVVVAEYFDY

SEQ ID NO: 92393 - protein, 9 aa, Homo sapiens
  light chain complementarity determining region 3 for antibody 46197
QQNGSSPLT

SEQ ID NO: 92394 - protein, 19 aa, Homo sapiens
  heavy chain complementarity determining region 3 for antibody 46197
ATVSTYPSGSLGILGTFDF

SEQ ID NO: 92395 - protein, 9 aa, Homo sapiens
  light chain complementarity determining region 3 for antibody 46198
QQNGRSPRT

SEQ ID NO: 92396 - protein, 15 aa, Homo sapiens
  heavy chain complementarity determining region 3 for antibody 46198
AKDGEFCGSNCYFGS

SEQ ID NO: 92397 - protein, 9 aa, Homo sapiens
  light chain complementarity determining region 3 for antibody 46199
QQLYSYPYT

SEQ ID NO: 92398 - protein, 18 aa, Homo sapiens
  heavy chain complementarity determining region 3 for antibody 46199
ARGGQYCSSTSCYAVLDY

SEQ ID NO: 92399 - protein, 10 aa, Homo sapiens
  light chain complementarity determining region 3 for antibody 46200
QQLNSYPSVT

SEQ ID NO: 92400 - protein, 20 aa, Homo sapiens
  heavy chain complementarity determining region 3 for antibody 46200
ASRYCSGGTCYSVGGDAFDI

SEQ ID NO: 92401 - protein, 9 aa, Homo sapiens
  light chain complementarity determining region 3 for antibody 46201
QQLNSYPRT

SEQ ID NO: 92402 - protein, 17 aa, Homo sapiens
  heavy chain complementarity determining region 3 for antibody 46201
ARDRDSSGWSPLGWFDP

SEQ ID NO: 92403 - protein, 9 aa, Homo sapiens
  light chain complementarity determining region 3 for antibody 46202
QQLNSYPLT

SEQ ID NO: 92404 - protein, 14 aa, Homo sapiens
  heavy chain complementarity determining region 3 for antibody 46202
ARRYYTGGTCPFQY

SEQ ID NO: 92405 - protein, 9 aa, Homo sapiens
  light chain complementarity determining region 3 for antibody 46203
QQLHSYPLT

SEQ ID NO: 92406 - protein, 14 aa, Homo sapiens
  heavy chain complementarity determining region 3 for antibody 46203
ARSPFYDSSTYSDY

SEQ ID NO: 92407 - protein, 9 aa, Homo sapiens
  light chain complementarity determining region 3 for antibody 46204
QQLHKSPWP

SEQ ID NO: 92408 - protein, 14 aa, Homo sapiens
  heavy chain complementarity determining region 3 for antibody 46204
ARAAPEYEWLVPDY

SEQ ID NO: 92409 - protein, 9 aa, Homo sapiens
  light chain complementarity determining region 3 for antibody 46205
QQLHASPWT

SEQ ID NO: 92410 - protein, 18 aa, Homo sapiens
  heavy chain complementarity determining region 3 for antibody 46205
ANDIGGYCNGGSCPGLDS

SEQ ID NO: 92411 - protein, 9 aa, Homo sapiens
  light chain complementarity determining region 3 for antibody 46206
QQHHNLPRT

SEQ ID NO: 92412 - protein, 25 aa, Homo sapiens
  heavy chain complementarity determining region 3 for antibody 46206
ARDRLAVVEAAPPREGYYYYYALDV

SEQ ID NO: 92413 - protein, 9 aa, Homo sapiens
  light chain complementarity determining region 3 for antibody 46207
QQHHILPVT

SEQ ID NO: 92414 - protein, 17 aa, Homo sapiens
  heavy chain complementarity determining region 3 for antibody 46207
ATRYVLIRGVIRKTLDS

SEQ ID NO: 92415 - protein, 9 aa, Homo sapiens
  light chain complementarity determining region 3 for antibody 46208
QQHGSSLQT

SEQ ID NO: 92416 - protein, 19 aa, Homo sapiens
  heavy chain complementarity determining region 3 for antibody 46208
ARGSIDVRAGVEGLVWFDP

SEQ ID NO: 92417 - protein, 9 aa, Homo sapiens
  light chain complementarity determining region 3 for antibody 46209
QQHGNSPVS

SEQ ID NO: 92418 - protein, 6 aa, Homo sapiens
  heavy chain complementarity determining region 3 for antibody 46209
AEIPAL

SEQ ID NO: 92419 - protein, 9 aa, Homo sapiens
  light chain complementarity determining region 3 for antibody 46210
QQHGDLPLT

SEQ ID NO: 92420 - protein, 18 aa, Homo sapiens
  heavy chain complementarity determining region 3 for antibody 46210
RGPLLLWFGDVRDYGMDV

SEQ ID NO: 92421 - protein, 13 aa, Homo sapiens
  light chain complementarity determining region 3 for antibody 46211
QQHCNWHPGTLLA

SEQ ID NO: 92422 - protein, 21 aa, Homo sapiens
  heavy chain complementarity determining region 3 for antibody 46211
AKAPLTRYKVGAATAYWYFDL

SEQ ID NO: 92423 - protein, 8 aa, Homo sapiens
  light chain complementarity determining region 3 for antibody 46212
QQHAESRT

SEQ ID NO: 92424 - protein, 15 aa, Homo sapiens
  heavy chain complementarity determining region 3 for antibody 46212
AKAQVIWGHLYYFES

SEQ ID NO: 92425 - protein, 9 aa, Homo sapiens
  light chain complementarity determining region 3 for antibody 46213
QQGYSTPLT

SEQ ID NO: 92426 - protein, 20 aa, Homo sapiens
  heavy chain complementarity determining region 3 for antibody 46213
ARDPEGVYDSSGYYRPYFDS

SEQ ID NO: 92427 - protein, 9 aa, Homo sapiens
  light chain complementarity determining region 3 for antibody 46214
QQGYSTPGT

SEQ ID NO: 92428 - protein, 12 aa, Homo sapiens
  heavy chain complementarity determining region 3 for antibody 46214
ATRRVLLGTFDI

SEQ ID NO: 92429 - protein, 9 aa, Homo sapiens
  light chain complementarity determining region 3 for antibody 46215
QQGYSFPLP

SEQ ID NO: 92430 - protein, 14 aa, Homo sapiens
  heavy chain complementarity determining region 3 for antibody 46215
ATDPQVDKPDHFDS

SEQ ID NO: 92431 - protein, 9 aa, Homo sapiens
  light chain complementarity determining region 3 for antibody 46216
QQGYGTPWT

SEQ ID NO: 92432 - protein, 21 aa, Homo sapiens
  heavy chain complementarity determining region 3 for antibody 46216
ARVNWGGYDRDPRQPYKWFDL

SEQ ID NO: 92433 - protein, 9 aa, Homo sapiens
  light chain complementarity determining region 3 for antibody 46217
QQGRNFPWP

SEQ ID NO: 92434 - protein, 10 aa, Homo sapiens
  heavy chain complementarity determining region 3 for antibody 46217
ARDHVWAFDS

SEQ ID NO: 92435 - protein, 9 aa, Homo sapiens
  light chain complementarity determining region 3 for antibody 46218
QQGHDFPYT

SEQ ID NO: 92436 - protein, 13 aa, Homo sapiens
  heavy chain complementarity determining region 3 for antibody 46218
VRLNDIHGWPFDY

SEQ ID NO: 92437 - protein, 9 aa, Homo sapiens
  light chain complementarity determining region 3 for antibody 46219
QQGGTSPYT

SEQ ID NO: 92438 - protein, 18 aa, Homo sapiens
  heavy chain complementarity determining region 3 for antibody 46219
ATNYYDSSGYYGSWYFDL

SEQ ID NO: 92439 - protein, 9 aa, Homo sapiens
  light chain complementarity determining region 3 for antibody 46220
QQFRDSLYT

SEQ ID NO: 92440 - protein, 12 aa, Homo sapiens
  heavy chain complementarity determining region 3 for antibody 46220
AHRDTYLYTFDY

SEQ ID NO: 92441 - protein, 9 aa, Homo sapiens
  light chain complementarity determining region 3 for antibody 46221
QQFNQLPPT

SEQ ID NO: 92442 - protein, 16 aa, Homo sapiens
  heavy chain complementarity determining region 3 for antibody 46221
ARIRDKLRGVVGDFDL

SEQ ID NO: 92443 - protein, 9 aa, Homo sapiens
  light chain complementarity determining region 3 for antibody 46222
QQFNDWPWT

SEQ ID NO: 92444 - protein, 15 aa, Homo sapiens
  heavy chain complementarity determining region 3 for antibody 46222
ATFITTEEISGFFDM

SEQ ID NO: 92445 - protein, 9 aa, Homo sapiens
  light chain complementarity determining region 3 for antibody 46223
QQFGSSPYT

SEQ ID NO: 92446 - protein, 15 aa, Homo sapiens
  heavy chain complementarity determining region 3 for antibody 46223
ARGERGYSGPSSFDS

SEQ ID NO: 92447 - protein, 10 aa, Homo sapiens
  light chain complementarity determining region 3 for antibody 46224
QQFGSSPLYT

SEQ ID NO: 92448 - protein, 10 aa, Homo sapiens
  heavy chain complementarity determining region 3 for antibody 46224
AKLGFGELNF

SEQ ID NO: 92449 - protein, 11 aa, Homo sapiens
  light chain complementarity determining region 3 for antibody 46225
QQFGNPPPLYP

SEQ ID NO: 92450 - protein, 11 aa, Homo sapiens
  heavy chain complementarity determining region 3 for antibody 46225
ATYGDYLSFDY

SEQ ID NO: 92451 - protein, 9 aa, Homo sapiens
  light chain complementarity determining region 3 for antibody 46226
QQDYSSPYT

SEQ ID NO: 92452 - protein, 23 aa, Homo sapiens
  heavy chain complementarity determining region 3 for antibody 46226
ARGVTDCSGRNCYGGEVINAFDV

SEQ ID NO: 92453 - protein, 9 aa, Homo sapiens
  light chain complementarity determining region 3 for antibody 46227
QQDVSSLIT

SEQ ID NO: 92454 - protein, 14 aa, Homo sapiens
  heavy chain complementarity determining region 3 for antibody 46227
ARALGFYGHDPFDI

SEQ ID NO: 92455 - protein, 9 aa, Homo sapiens
  light chain complementarity determining region 3 for antibody 46228
QQDGTSPFT

SEQ ID NO: 92456 - protein, 10 aa, Homo sapiens
  heavy chain complementarity determining region 3 for antibody 46228
ARDLGHAFDI

SEQ ID NO: 92457 - protein, 10 aa, Homo sapiens
  light chain complementarity determining region 3 for antibody 46229
QQDGTAPPYT

SEQ ID NO: 92458 - protein, 12 aa, Homo sapiens
  heavy chain complementarity determining region 3 for antibody 46229
ANEVGPAPAYDV

SEQ ID NO: 92459 - protein, 9 aa, Homo sapiens
  light chain complementarity determining region 3 for antibody 46230
QQDGSSPWT

SEQ ID NO: 92460 - protein, 11 aa, Homo sapiens
  heavy chain complementarity determining region 3 for antibody 46230
ARDAQWGWLDP

SEQ ID NO: 92461 - protein, 9 aa, Homo sapiens
  light chain complementarity determining region 3 for antibody 46231
QQDGSSPLT

SEQ ID NO: 92462 - protein, 19 aa, Homo sapiens
  heavy chain complementarity determining region 3 for antibody 46231
ATVSTYPSGSLGILGTFDF

SEQ ID NO: 92463 - protein, 9 aa, Homo sapiens
  light chain complementarity determining region 3 for antibody 46232
QQDGSSPFT

SEQ ID NO: 92464 - protein, 12 aa, Homo sapiens
  heavy chain complementarity determining region 3 for antibody 46232
ARMLGFGSGLAY

SEQ ID NO: 92465 - protein, 9 aa, Homo sapiens
  light chain complementarity determining region 3 for antibody 46233
QQDGSSPFT

SEQ ID NO: 92466 - protein, 10 aa, Homo sapiens
  heavy chain complementarity determining region 3 for antibody 46233
ARLKVGASDY

SEQ ID NO: 92467 - protein, 9 aa, Homo sapiens
  light chain complementarity determining region 3 for antibody 46234
QQDGSSPFT

SEQ ID NO: 92468 - protein, 20 aa, Homo sapiens
  heavy chain complementarity determining region 3 for antibody 46234
ARDDSRPGGHMSGWYGDLDS

SEQ ID NO: 92469 - protein, 10 aa, Homo sapiens
  light chain complementarity determining region 3 for antibody 46235
QQDGSSLTWT

SEQ ID NO: 92470 - protein, 12 aa, Homo sapiens
  heavy chain complementarity determining region 3 for antibody 46235
ARTYYGGWPFDY

SEQ ID NO: 92471 - protein, 8 aa, Homo sapiens
  light chain complementarity determining region 3 for antibody 46236
QQDGSSFT

SEQ ID NO: 92472 - protein, 11 aa, Homo sapiens
  heavy chain complementarity determining region 3 for antibody 46236
TTGLGSGGTNY

SEQ ID NO: 92473 - protein, 10 aa, Homo sapiens
  light chain complementarity determining region 3 for antibody 46237
QQDGSSFPII

SEQ ID NO: 92474 - protein, 18 aa, Homo sapiens
  heavy chain complementarity determining region 3 for antibody 46237
ATEGVYDVWSGYVQFFPH

SEQ ID NO: 92475 - protein, 9 aa, Homo sapiens
  light chain complementarity determining region 3 for antibody 46238
QQDGRSPQT

SEQ ID NO: 92476 - protein, 16 aa, Homo sapiens
  heavy chain complementarity determining region 3 for antibody 46238
ARGSPTVEDFSWPSDL

SEQ ID NO: 92477 - protein, 8 aa, Homo sapiens
  light chain complementarity determining region 3 for antibody 46239
QQDGRSLT

SEQ ID NO: 92478 - protein, 17 aa, Homo sapiens
  heavy chain complementarity determining region 3 for antibody 46239
ASIYDSTGYYYGGYFQH

SEQ ID NO: 92479 - protein, 9 aa, Homo sapiens
  light chain complementarity determining region 3 for antibody 46240
QQDGHSQYT

SEQ ID NO: 92480 - protein, 8 aa, Homo sapiens
  heavy chain complementarity determining region 3 for antibody 46240
ARARYFDY

SEQ ID NO: 92481 - protein, 9 aa, Homo sapiens
  light chain complementarity determining region 3 for antibody 46241
QQDAGSPGT

SEQ ID NO: 92482 - protein, 8 aa, Homo sapiens
  heavy chain complementarity determining region 3 for antibody 46241
ARGLSLDS

SEQ ID NO: 92483 - protein, 8 aa, Homo sapiens
  light chain complementarity determining region 3 for antibody 46242
QQCHDFLS

SEQ ID NO: 92484 - protein, 12 aa, Homo sapiens
  heavy chain complementarity determining region 3 for antibody 46242
ATYYFGSGSFDY

SEQ ID NO: 92485 - protein, 9 aa, Homo sapiens
  light chain complementarity determining region 3 for antibody 46243
QQCGRSPIT

SEQ ID NO: 92486 - protein, 24 aa, Homo sapiens
  heavy chain complementarity determining region 3 for antibody 46243
ARRLSEYYHVSSGFYRADQNFFDS

SEQ ID NO: 92487 - protein, 9 aa, Homo sapiens
  light chain complementarity determining region 3 for antibody 46244
QQANSFPRP

SEQ ID NO: 92488 - protein, 16 aa, Homo sapiens
  heavy chain complementarity determining region 3 for antibody 46244
ARESYSCGGGSCYFDF

SEQ ID NO: 92489 - protein, 9 aa, Homo sapiens
  light chain complementarity determining region 3 for antibody 46245
QQANSFPLT

SEQ ID NO: 92490 - protein, 17 aa, Homo sapiens
  heavy chain complementarity determining region 3 for antibody 46245
TRDSQKEYNGYDWPVVY

SEQ ID NO: 92491 - protein, 9 aa, Homo sapiens
  light chain complementarity determining region 3 for antibody 46246
QQANSFPFT

SEQ ID NO: 92492 - protein, 12 aa, Homo sapiens
  heavy chain complementarity determining region 3 for antibody 46246
VLGVTATGYFDS

SEQ ID NO: 92493 - protein, 9 aa, Homo sapiens
  light chain complementarity determining region 3 for antibody 46247
QQAHSFPYT

SEQ ID NO: 92494 - protein, 14 aa, Homo sapiens
  heavy chain complementarity determining region 3 for antibody 46247
ARSPGSSWNNRFDP

SEQ ID NO: 92495 - protein, 9 aa, Homo sapiens
  light chain complementarity determining region 3 for antibody 46248
QQADNFPLT

SEQ ID NO: 92496 - protein, 15 aa, Homo sapiens
  heavy chain complementarity determining region 3 for antibody 46248
ARGLTTVINRNVFDL

SEQ ID NO: 92497 - protein, 10 aa, Homo sapiens
  light chain complementarity determining region 3 for antibody 46249
QNRPSSTAYT

SEQ ID NO: 92498 - protein, 13 aa, Homo sapiens
  heavy chain complementarity determining region 3 for antibody 46249
ARDSSDYGDPLDH

SEQ ID NO: 92499 - protein, 10 aa, Homo sapiens
  light chain complementarity determining region 3 for antibody 46250
QLYGSSPTWT

SEQ ID NO: 92500 - protein, 9 aa, Homo sapiens
  heavy chain complementarity determining region 3 for antibody 46250
ATGGELLGY

SEQ ID NO: 92501 - protein, 10 aa, Homo sapiens
  light chain complementarity determining region 3 for antibody 46251
QLYGSSFRIT

SEQ ID NO: 92502 - protein, 10 aa, Homo sapiens
  heavy chain complementarity determining region 3 for antibody 46251
GKADWNYVSY

SEQ ID NO: 92503 - protein, 9 aa, Homo sapiens
  light chain complementarity determining region 3 for antibody 46252
QLVISYPLT

SEQ ID NO: 92504 - protein, 15 aa, Homo sapiens
  heavy chain complementarity determining region 3 for antibody 46252
AKTLADPGRLYGFDV

SEQ ID NO: 92505 - protein, 9 aa, Homo sapiens
  light chain complementarity determining region 3 for antibody 46253
QLTYGIPWT

SEQ ID NO: 92506 - protein, 19 aa, Homo sapiens
  heavy chain complementarity determining region 3 for antibody 46253
ARLNNMIRGVTIRGYYFDD

SEQ ID NO: 92507 - protein, 9 aa, Homo sapiens
  light chain complementarity determining region 3 for antibody 46254
QLRSNWLGT

SEQ ID NO: 92508 - protein, 20 aa, Homo sapiens
  heavy chain complementarity determining region 3 for antibody 46254
ATTDLHFYDNSGFYYGWFDP

SEQ ID NO: 92509 - protein, 9 aa, Homo sapiens
  light chain complementarity determining region 3 for antibody 46255
QKYNTAPFT

SEQ ID NO: 92510 - protein, 19 aa, Homo sapiens
  heavy chain complementarity determining region 3 for antibody 46255
ASAMYYYDSSGRYYGGGDY

SEQ ID NO: 92511 - protein, 9 aa, Homo sapiens
  light chain complementarity determining region 3 for antibody 46256
QKYNSAPPT

SEQ ID NO: 92512 - protein, 18 aa, Homo sapiens
  heavy chain complementarity determining region 3 for antibody 46256
ARRNWNCRAGTCFHYFDS

SEQ ID NO: 92513 - protein, 9 aa, Homo sapiens
  light chain complementarity determining region 3 for antibody 46257
QKYNSAPHT

SEQ ID NO: 92514 - protein, 19 aa, Homo sapiens
  heavy chain complementarity determining region 3 for antibody 46257
AREEDFYSGSGQYPGLFDY

SEQ ID NO: 92515 - protein, 11 aa, Homo sapiens
  light chain complementarity determining region 3 for antibody 46258
QKYGTAPPGIA

SEQ ID NO: 92516 - protein, 14 aa, Homo sapiens
  heavy chain complementarity determining region 3 for antibody 46258
ARQTRGGITWSLDS

SEQ ID NO: 92517 - protein, 10 aa, Homo sapiens
  light chain complementarity determining region 3 for antibody 46259
QKYFIAPTWT

SEQ ID NO: 92518 - protein, 14 aa, Homo sapiens
  heavy chain complementarity determining region 3 for antibody 46259
ARAFRRDLLIWGDY

SEQ ID NO: 92519 - protein, 9 aa, Homo sapiens
  light chain complementarity determining region 3 for antibody 46260
QKYDSGSRT

SEQ ID NO: 92520 - protein, 13 aa, Homo sapiens
  heavy chain complementarity determining region 3 for antibody 46260
ARPFVPGYSGFVA

SEQ ID NO: 92521 - protein, 9 aa, Homo sapiens
  light chain complementarity determining region 3 for antibody 46261
QKYDGAPWT

SEQ ID NO: 92522 - protein, 14 aa, Homo sapiens
  heavy chain complementarity determining region 3 for antibody 46261
ARAGMRGGSQLFDY

SEQ ID NO: 92523 - protein, 9 aa, Homo sapiens
  light chain complementarity determining region 3 for antibody 46262
QKYDGAPFA

SEQ ID NO: 92524 - protein, 19 aa, Homo sapiens
  heavy chain complementarity determining region 3 for antibody 46262
ARGVDCVGGDCFSYNWFDP

SEQ ID NO: 92525 - protein, 9 aa, Homo sapiens
  light chain complementarity determining region 3 for antibody 46263
QHYVRSPLT

SEQ ID NO: 92526 - protein, 14 aa, Homo sapiens
  heavy chain complementarity determining region 3 for antibody 46263
ATIPRCASDCYLDY

SEQ ID NO: 92527 - protein, 11 aa, Homo sapiens
  light chain complementarity determining region 3 for antibody 46264
QHYSSYGSTWT

SEQ ID NO: 92528 - protein, 13 aa, Homo sapiens
  heavy chain complementarity determining region 3 for antibody 46264
ARGGLGGLDAFHV

SEQ ID NO: 92529 - protein, 9 aa, Homo sapiens
  light chain complementarity determining region 3 for antibody 46265
QHYSSSSCT

SEQ ID NO: 92530 - protein, 23 aa, Homo sapiens
  heavy chain complementarity determining region 3 for antibody 46265
ARASLRFLVWQRNPKYSYYGMDV

SEQ ID NO: 92531 - protein, 9 aa, Homo sapiens
  light chain complementarity determining region 3 for antibody 46266
QHYNTYSRT

SEQ ID NO: 92532 - protein, 15 aa, Homo sapiens
  heavy chain complementarity determining region 3 for antibody 46266
ARESNYGDNAFGMDV

SEQ ID NO: 92533 - protein, 7 aa, Homo sapiens
  light chain complementarity determining region 3 for antibody 46267
QHYNTWA

SEQ ID NO: 92534 - protein, 12 aa, Homo sapiens
  heavy chain complementarity determining region 3 for antibody 46267
TRERSPPAVADY

SEQ ID NO: 92535 - protein, 10 aa, Homo sapiens
  light chain complementarity determining region 3 for antibody 46268
QHYNNWPPYT

SEQ ID NO: 92536 - protein, 13 aa, Homo sapiens
  heavy chain complementarity determining region 3 for antibody 46268
VRGQVQRYFDSSP

SEQ ID NO: 92537 - protein, 9 aa, Homo sapiens
  light chain complementarity determining region 3 for antibody 46269
QHYLIYPWT

SEQ ID NO: 92538 - protein, 9 aa, Homo sapiens
  heavy chain complementarity determining region 3 for antibody 46269
LNLVRGVFH

SEQ ID NO: 92539 - protein, 9 aa, Homo sapiens
  light chain complementarity determining region 3 for antibody 46270
QHYHDWPPT

SEQ ID NO: 92540 - protein, 25 aa, Homo sapiens
  heavy chain complementarity determining region 3 for antibody 46270
ARTTGLSSYDSRGHYAGVYYNGLDV

SEQ ID NO: 92541 - protein, 9 aa, Homo sapiens
  light chain complementarity determining region 3 for antibody 46271
QHYGYSPYT

SEQ ID NO: 92542 - protein, 14 aa, Homo sapiens
  heavy chain complementarity determining region 3 for antibody 46271
ARDETWAAAGTFDS

SEQ ID NO: 92543 - protein, 11 aa, Homo sapiens
  light chain complementarity determining region 3 for antibody 46272
QHYGTSPPAST

SEQ ID NO: 92544 - protein, 15 aa, Homo sapiens
  heavy chain complementarity determining region 3 for antibody 46272
AREVTSMIEPGGLDI

SEQ ID NO: 92545 - protein, 11 aa, Homo sapiens
  light chain complementarity determining region 3 for antibody 46273
QHYGSSRRIFP

SEQ ID NO: 92546 - protein, 18 aa, Homo sapiens
  heavy chain complementarity determining region 3 for antibody 46273
ARVKLHFDTSGYDNAFDI

SEQ ID NO: 92547 - protein, 9 aa, Homo sapiens
  light chain complementarity determining region 3 for antibody 46274
QHYGSSPWT

SEQ ID NO: 92548 - protein, 17 aa, Homo sapiens
  heavy chain complementarity determining region 3 for antibody 46274
ARGGAYYDSSGYDQFDY

SEQ ID NO: 92549 - protein, 10 aa, Homo sapiens
  light chain complementarity determining region 3 for antibody 46275
QHYGSSPPFT

SEQ ID NO: 92550 - protein, 12 aa, Homo sapiens
  heavy chain complementarity determining region 3 for antibody 46275
ARGWGSGWYLSV

SEQ ID NO: 92551 - protein, 9 aa, Homo sapiens
  light chain complementarity determining region 3 for antibody 46276
QHYGGSPYT

SEQ ID NO: 92552 - protein, 17 aa, Homo sapiens
  heavy chain complementarity determining region 3 for antibody 46276
ARVALSEQWLVLWYFDL

SEQ ID NO: 92553 - protein, 9 aa, Homo sapiens
  light chain complementarity determining region 3 for antibody 46277
QHYCTFPRT

SEQ ID NO: 92554 - protein, 24 aa, Homo sapiens
  heavy chain complementarity determining region 3 for antibody 46277
ARDERTFGIAVAGSHPHYYYGMDV

SEQ ID NO: 92555 - protein, 10 aa, Homo sapiens
  light chain complementarity determining region 3 for antibody 46278
QHYAFSLPLT

SEQ ID NO: 92556 - protein, 17 aa, Homo sapiens
  heavy chain complementarity determining region 3 for antibody 46278
AKDVHSRQGYYYYGMDV

SEQ ID NO: 92557 - protein, 8 aa, Homo sapiens
  light chain complementarity determining region 3 for antibody 46279
QHSYSRPT

SEQ ID NO: 92558 - protein, 17 aa, Homo sapiens
  heavy chain complementarity determining region 3 for antibody 46279
AKDIFFGIAVAGTAFDI

SEQ ID NO: 92559 - protein, 10 aa, Homo sapiens
  light chain complementarity determining region 3 for antibody 46280
QHRYNWPPFT

SEQ ID NO: 92560 - protein, 11 aa, Homo sapiens
  heavy chain complementarity determining region 3 for antibody 46280
ARGVGSYPFDS

SEQ ID NO: 92561 - protein, 9 aa, Homo sapiens
  light chain complementarity determining region 3 for antibody 46281
QHRSHWPYN

SEQ ID NO: 92562 - protein, 13 aa, Homo sapiens
  heavy chain complementarity determining region 3 for antibody 46281
TNFNVWGDDTFDL

SEQ ID NO: 92563 - protein, 8 aa, Homo sapiens
  light chain complementarity determining region 3 for antibody 46282
QHRSDWPP

SEQ ID NO: 92564 - protein, 12 aa, Homo sapiens
  heavy chain complementarity determining region 3 for antibody 46282
VRQSPQNWFYDL

SEQ ID NO: 92565 - protein, 9 aa, Homo sapiens
  light chain complementarity determining region 3 for antibody 46283
QHRNNWPPP

SEQ ID NO: 92566 - protein, 17 aa, Homo sapiens
  heavy chain complementarity determining region 3 for antibody 46283
ASEGGYCYSTSCRYFDY

SEQ ID NO: 92567 - protein, 9 aa, Homo sapiens
  light chain complementarity determining region 3 for antibody 46284
QHRNNWPPA

SEQ ID NO: 92568 - protein, 17 aa, Homo sapiens
  heavy chain complementarity determining region 3 for antibody 46284
AREGGYCVGGGYRWFDL

SEQ ID NO: 92569 - protein, 10 aa, Homo sapiens
  light chain complementarity determining region 3 for antibody 46285
QHLYNWPPLP

SEQ ID NO: 92570 - protein, 24 aa, Homo sapiens
  heavy chain complementarity determining region 3 for antibody 46285
ARVGRFAPFIMMFPTKTHCDGFDI

SEQ ID NO: 92571 - protein, 7 aa, Homo sapiens
  light chain complementarity determining region 3 for antibody 46286
QHLSSFP

SEQ ID NO: 92572 - protein, 19 aa, Homo sapiens
  heavy chain complementarity determining region 3 for antibody 46286
ARRPFGGDGTQTDYYGMDV

SEQ ID NO: 92573 - protein, 9 aa, Homo sapiens
  light chain complementarity determining region 3 for antibody 46287
QHLNAYPFT

SEQ ID NO: 92574 - protein, 22 aa, Homo sapiens
  heavy chain complementarity determining region 3 for antibody 46287
ATDRDFARGVFRETYSPGVLVE

SEQ ID NO: 92575 - protein, 11 aa, Homo sapiens
  light chain complementarity determining region 3 for antibody 46288
QHLISYPRQGT

SEQ ID NO: 92576 - protein, 16 aa, Homo sapiens
  heavy chain complementarity determining region 3 for antibody 46288
ARHVAGVGIKGDVFDI

SEQ ID NO: 92577 - protein, 10 aa, Homo sapiens
  light chain complementarity determining region 3 for antibody 46289
QHHGSSPPIT

SEQ ID NO: 92578 - protein, 17 aa, Homo sapiens
  heavy chain complementarity determining region 3 for antibody 46289
ARKPRELYGSGSHYLDF

SEQ ID NO: 92579 - protein, 9 aa, Homo sapiens
  light chain complementarity determining region 3 for antibody 46290
QHHGGSPYT

SEQ ID NO: 92580 - protein, 17 aa, Homo sapiens
  heavy chain complementarity determining region 3 for antibody 46290
ARVDLSEQWLVLWYFDL

SEQ ID NO: 92581 - protein, 9 aa, Homo sapiens
  light chain complementarity determining region 3 for antibody 46291
QHHDSFPPT

SEQ ID NO: 92582 - protein, 13 aa, Homo sapiens
  heavy chain complementarity determining region 3 for antibody 46291
VRDHGGPWGYFQR

SEQ ID NO: 92583 - protein, 9 aa, Homo sapiens
  light chain complementarity determining region 3 for antibody 46292
QHFDSFPYT

SEQ ID NO: 92584 - protein, 15 aa, Homo sapiens
  heavy chain complementarity determining region 3 for antibody 46292
ARETRYSSRGRAFDI

SEQ ID NO: 92585 - protein, 10 aa, Homo sapiens
  light chain complementarity determining region 3 for antibody 46293
QHFADPPLFT

SEQ ID NO: 92586 - protein, 13 aa, Homo sapiens
  heavy chain complementarity determining region 3 for antibody 46293
VRQSAYDQSGLDY

SEQ ID NO: 92587 - protein, 9 aa, Homo sapiens
  light chain complementarity determining region 3 for antibody 46294
QEYNSAPLA

SEQ ID NO: 92588 - protein, 17 aa, Homo sapiens
  heavy chain complementarity determining region 3 for antibody 46294
AKFVYYGSGRPEDAFDI

SEQ ID NO: 92589 - protein, 10 aa, Homo sapiens
  light chain complementarity determining region 3 for antibody 46295
QEYGSSPLLT

SEQ ID NO: 92590 - protein, 14 aa, Homo sapiens
  heavy chain complementarity determining region 3 for antibody 46295
ARMDGYHSIDAFDI

SEQ ID NO: 92591 - protein, 10 aa, Homo sapiens
  light chain complementarity determining region 3 for antibody 46296
QERSTWPPRA

SEQ ID NO: 92592 - protein, 14 aa, Homo sapiens
  heavy chain complementarity determining region 3 for antibody 46296
AMRGLGSSGYYTDY

SEQ ID NO: 92593 - protein, 6 aa, Homo sapiens
  light chain complementarity determining region 3 for antibody 46297
QENGST

SEQ ID NO: 92594 - protein, 12 aa, Homo sapiens
  heavy chain complementarity determining region 3 for antibody 46297
ARDHITGWALSD

SEQ ID NO: 92595 - protein, 9 aa, Homo sapiens
  light chain complementarity determining region 3 for antibody 46298
MQVLQTPQT

SEQ ID NO: 92596 - protein, 4 aa, Homo sapiens
  heavy chain complementarity determining region 3 for antibody 46298
GMDA

SEQ ID NO: 92597 - protein, 9 aa, Homo sapiens
  light chain complementarity determining region 3 for antibody 46299
MQVLQTPPT

SEQ ID NO: 92598 - protein, 17 aa, Homo sapiens
  heavy chain complementarity determining region 3 for antibody 46299
ARDDIVVVTAIPDAIDI

SEQ ID NO: 92599 - protein, 9 aa, Homo sapiens
  light chain complementarity determining region 3 for antibody 46300
MQVLQTPFT

SEQ ID NO: 92600 - protein, 13 aa, Homo sapiens
  heavy chain complementarity determining region 3 for antibody 46300
ARDGGHWLVGLDY

SEQ ID NO: 92601 - protein, 9 aa, Homo sapiens
  light chain complementarity determining region 3 for antibody 46301
MQTLQTPTT

SEQ ID NO: 92602 - protein, 16 aa, Homo sapiens
  heavy chain complementarity determining region 3 for antibody 46301
ARQHYDSSGYPFYFDL

SEQ ID NO: 92603 - protein, 9 aa, Homo sapiens
  light chain complementarity determining region 3 for antibody 46302
MQTLQTPGT

SEQ ID NO: 92604 - protein, 11 aa, Homo sapiens
  heavy chain complementarity determining region 3 for antibody 46302
ARSSTIGGRDY

SEQ ID NO: 92605 - protein, 9 aa, Homo sapiens
  light chain complementarity determining region 3 for antibody 46303
MQSTYWPPT

SEQ ID NO: 92606 - protein, 29 aa, Homo sapiens
  heavy chain complementarity determining region 3 for antibody 46303
ASGKRWRLGESTLLECPATEDCLHDAFHI

SEQ ID NO: 92607 - protein, 10 aa, Homo sapiens
  light chain complementarity determining region 3 for antibody 46304
MQSLQSPSYT

SEQ ID NO: 92608 - protein, 23 aa, Homo sapiens
  heavy chain complementarity determining region 3 for antibody 46304
ATKLRSFGGGGPYCGGDCYPFDY

SEQ ID NO: 92609 - protein, 9 aa, Homo sapiens
  light chain complementarity determining region 3 for antibody 46305
MQNLQTPYT

SEQ ID NO: 92610 - protein, 19 aa, Homo sapiens
  heavy chain complementarity determining region 3 for antibody 46305
ARGTYYYDSSGYRSSRFDY

SEQ ID NO: 92611 - protein, 9 aa, Homo sapiens
  light chain complementarity determining region 3 for antibody 46306
MQGVESPFT

SEQ ID NO: 92612 - protein, 17 aa, Homo sapiens
  heavy chain complementarity determining region 3 for antibody 46306
ARRGAYASGTYTDYFDY

SEQ ID NO: 92613 - protein, 9 aa, Homo sapiens
  light chain complementarity determining region 3 for antibody 46307
MQGVDRGGT

SEQ ID NO: 92614 - protein, 12 aa, Homo sapiens
  heavy chain complementarity determining region 3 for antibody 46307
ATLGVRWDHFDY

SEQ ID NO: 92615 - protein, 10 aa, Homo sapiens
  light chain complementarity determining region 3 for antibody 46308
MQGTYWPPWT

SEQ ID NO: 92616 - protein, 14 aa, Homo sapiens
  heavy chain complementarity determining region 3 for antibody 46308
AILGYCAGPTCLDY

SEQ ID NO: 92617 - protein, 9 aa, Homo sapiens
  light chain complementarity determining region 3 for antibody 46309
MQGTQWPRT

SEQ ID NO: 92618 - protein, 13 aa, Homo sapiens
  heavy chain complementarity determining region 3 for antibody 46309
TRDPGVFYGGMDV

SEQ ID NO: 92619 - protein, 9 aa, Homo sapiens
  light chain complementarity determining region 3 for antibody 46310
MQGTNWPLT

SEQ ID NO: 92620 - protein, 9 aa, Homo sapiens
  heavy chain complementarity determining region 3 for antibody 46310
TWSNSGGDY

SEQ ID NO: 92621 - protein, 10 aa, Homo sapiens
  light chain complementarity determining region 3 for antibody 46311
MQGTHWPPYT

SEQ ID NO: 92622 - protein, 10 aa, Homo sapiens
  heavy chain complementarity determining region 3 for antibody 46311
AKTDGSGPSS

SEQ ID NO: 92623 - protein, 8 aa, Homo sapiens
  light chain complementarity determining region 3 for antibody 46312
MQGTHRDT

SEQ ID NO: 92624 - protein, 17 aa, Homo sapiens
  heavy chain complementarity determining region 3 for antibody 46312
ARDADYDYVLGSYRFDY

SEQ ID NO: 92625 - protein, 9 aa, Homo sapiens
  light chain complementarity determining region 3 for antibody 46313
MQGTHPPTT

SEQ ID NO: 92626 - protein, 12 aa, Homo sapiens
  heavy chain complementarity determining region 3 for antibody 46313
PTEAPSTGRLDY

SEQ ID NO: 92627 - protein, 9 aa, Homo sapiens
  light chain complementarity determining region 3 for antibody 46314
MQGTHGPWT

SEQ ID NO: 92628 - protein, 19 aa, Homo sapiens
  heavy chain complementarity determining region 3 for antibody 46314
ARDTARYFDWSEEPNTLDI

SEQ ID NO: 92629 - protein, 9 aa, Homo sapiens
  light chain complementarity determining region 3 for antibody 46315
MQGTHGPPT

SEQ ID NO: 92630 - protein, 11 aa, Homo sapiens
  heavy chain complementarity determining region 3 for antibody 46315
ATGPQVTMPQD

SEQ ID NO: 92631 - protein, 9 aa, Homo sapiens
  light chain complementarity determining region 3 for antibody 46316
MQGTHGPLT

SEQ ID NO: 92632 - protein, 9 aa, Homo sapiens
  heavy chain complementarity determining region 3 for antibody 46316
TWSNSGGDY

SEQ ID NO: 92633 - protein, 9 aa, Homo sapiens
  light chain complementarity determining region 3 for antibody 46317
MQGTHGPLT

SEQ ID NO: 92634 - protein, 14 aa, Homo sapiens
  heavy chain complementarity determining region 3 for antibody 46317
ARDPFIAVAGSGDY

SEQ ID NO: 92635 - protein, 9 aa, Homo sapiens
  light chain complementarity determining region 3 for antibody 46318
MQGTHGPHT

SEQ ID NO: 92636 - protein, 11 aa, Homo sapiens
  heavy chain complementarity determining region 3 for antibody 46318
ARDPFFGSLDY

SEQ ID NO: 92637 - protein, 9 aa, Homo sapiens
  light chain complementarity determining region 3 for antibody 46319
MQGTHGPFT

SEQ ID NO: 92638 - protein, 11 aa, Homo sapiens
  heavy chain complementarity determining region 3 for antibody 46319
TRIMRGDDRVY

SEQ ID NO: 92639 - protein, 9 aa, Homo sapiens
  light chain complementarity determining region 3 for antibody 46320
MQGSHWPPT

SEQ ID NO: 92640 - protein, 13 aa, Homo sapiens
  heavy chain complementarity determining region 3 for antibody 46320
ARDLGDGYNSIDH

SEQ ID NO: 92641 - protein, 10 aa, Homo sapiens
  light chain complementarity determining region 3 for antibody 46321
MQGSHWPPGT

SEQ ID NO: 92642 - protein, 11 aa, Homo sapiens
  heavy chain complementarity determining region 3 for antibody 46321
ARDHPGVGIDY

SEQ ID NO: 92643 - protein, 9 aa, Homo sapiens
  light chain complementarity determining region 3 for antibody 46322
MQGRQTLFT

SEQ ID NO: 92644 - protein, 13 aa, Homo sapiens
  heavy chain complementarity determining region 3 for antibody 46322
AGGGFHYGYAFDH

SEQ ID NO: 92645 - protein, 8 aa, Homo sapiens
  light chain complementarity determining region 3 for antibody 46323
MQGLQTPP

SEQ ID NO: 92646 - protein, 11 aa, Homo sapiens
  heavy chain complementarity determining region 3 for antibody 46323
AKANNLYGAEY

SEQ ID NO: 92647 - protein, 9 aa, Homo sapiens
  light chain complementarity determining region 3 for antibody 46324
MQGLQTPIT

SEQ ID NO: 92648 - protein, 16 aa, Homo sapiens
  heavy chain complementarity determining region 3 for antibody 46324
ARDSLSCTGGHCYFVQ

SEQ ID NO: 92649 - protein, 9 aa, Homo sapiens
  light chain complementarity determining region 3 for antibody 46325
MQGLQTPGT

SEQ ID NO: 92650 - protein, 14 aa, Homo sapiens
  heavy chain complementarity determining region 3 for antibody 46325
AREDSTGGYYGMDV

SEQ ID NO: 92651 - protein, 9 aa, Homo sapiens
  light chain complementarity determining region 3 for antibody 46326
MQGLQIPLT

SEQ ID NO: 92652 - protein, 17 aa, Homo sapiens
  heavy chain complementarity determining region 3 for antibody 46326
AKDIRRGYGSGTDALDY

SEQ ID NO: 92653 - protein, 9 aa, Homo sapiens
  light chain complementarity determining region 3 for antibody 46327
MQGIQRPYT

SEQ ID NO: 92654 - protein, 17 aa, Homo sapiens
  heavy chain complementarity determining region 3 for antibody 46327
AKDIFFAIAVAGTAFDI

SEQ ID NO: 92655 - protein, 9 aa, Homo sapiens
  light chain complementarity determining region 3 for antibody 46328
MQGAHWPRT

SEQ ID NO: 92656 - protein, 10 aa, Homo sapiens
  heavy chain complementarity determining region 3 for antibody 46328
VTGTLGPTMG

SEQ ID NO: 92657 - protein, 9 aa, Homo sapiens
  light chain complementarity determining region 3 for antibody 46329
MQGAHWPAT

SEQ ID NO: 92658 - protein, 21 aa, Homo sapiens
  heavy chain complementarity determining region 3 for antibody 46329
ARDAPTRPFFWFGELSPNFDH

SEQ ID NO: 92659 - protein, 10 aa, Homo sapiens
  light chain complementarity determining region 3 for antibody 46330
MQAVQTPGGT

SEQ ID NO: 92660 - protein, 17 aa, Homo sapiens
  heavy chain complementarity determining region 3 for antibody 46330
VKAAYYYDATTYYTHHY

SEQ ID NO: 92661 - protein, 9 aa, Homo sapiens
  light chain complementarity determining region 3 for antibody 46331
MQALRTRLT

SEQ ID NO: 92662 - protein, 23 aa, Homo sapiens
  heavy chain complementarity determining region 3 for antibody 46331
ARVSQNLGECSGTDCYGINAFDP

SEQ ID NO: 92663 - protein, 8 aa, Homo sapiens
  light chain complementarity determining region 3 for antibody 46332
MQALQTRV

SEQ ID NO: 92664 - protein, 20 aa, Homo sapiens
  heavy chain complementarity determining region 3 for antibody 46332
ARERGRHSSGPLHYYFGLDV

SEQ ID NO: 92665 - protein, 9 aa, Homo sapiens
  light chain complementarity determining region 3 for antibody 46333
MQALQTPYT

SEQ ID NO: 92666 - protein, 26 aa, Homo sapiens
  heavy chain complementarity determining region 3 for antibody 46333
ATVGRERSGDIEIVAGPIEGDGAFDF

SEQ ID NO: 92667 - protein, 9 aa, Homo sapiens
  light chain complementarity determining region 3 for antibody 46334
MQALQTPYT

SEQ ID NO: 92668 - protein, 15 aa, Homo sapiens
  heavy chain complementarity determining region 3 for antibody 46334
ATDRGINWAHSRFDS

SEQ ID NO: 92669 - protein, 9 aa, Homo sapiens
  light chain complementarity determining region 3 for antibody 46335
MQALQTPYT

SEQ ID NO: 92670 - protein, 20 aa, Homo sapiens
  heavy chain complementarity determining region 3 for antibody 46335
ARDVGKYYGLGSHRLDAFDF

SEQ ID NO: 92671 - protein, 9 aa, Homo sapiens
  light chain complementarity determining region 3 for antibody 46336
MQALQTPWT

SEQ ID NO: 92672 - protein, 11 aa, Homo sapiens
  heavy chain complementarity determining region 3 for antibody 46336
TKGSGYNALDF

SEQ ID NO: 92673 - protein, 9 aa, Homo sapiens
  light chain complementarity determining region 3 for antibody 46337
MQALQTPWT

SEQ ID NO: 92674 - protein, 16 aa, Homo sapiens
  heavy chain complementarity determining region 3 for antibody 46337
GRARRGEGITFGLIDN

SEQ ID NO: 92675 - protein, 9 aa, Homo sapiens
  light chain complementarity determining region 3 for antibody 46338
MQALQTPWT

SEQ ID NO: 92676 - protein, 14 aa, Homo sapiens
  heavy chain complementarity determining region 3 for antibody 46338
ATRSTNYIRGAVDI

SEQ ID NO: 92677 - protein, 9 aa, Homo sapiens
  light chain complementarity determining region 3 for antibody 46339
MQALQTPWT

SEQ ID NO: 92678 - protein, 13 aa, Homo sapiens
  heavy chain complementarity determining region 3 for antibody 46339
AKVTRFGDQSRKN

SEQ ID NO: 92679 - protein, 9 aa, Homo sapiens
  light chain complementarity determining region 3 for antibody 46340
MQALQTPWT

SEQ ID NO: 92680 - protein, 15 aa, Homo sapiens
  heavy chain complementarity determining region 3 for antibody 46340
AKEGYYLDGSGYCPN

SEQ ID NO: 92681 - protein, 10 aa, Homo sapiens
  light chain complementarity determining region 3 for antibody 46341
MQALQTPWIT

SEQ ID NO: 92682 - protein, 17 aa, Homo sapiens
  heavy chain complementarity determining region 3 for antibody 46341
VRVRDPMVRGTYDAFDI

SEQ ID NO: 92683 - protein, 9 aa, Homo sapiens
  light chain complementarity determining region 3 for antibody 46342
MQALQTPRT

SEQ ID NO: 92684 - protein, 13 aa, Homo sapiens
  heavy chain complementarity determining region 3 for antibody 46342
ARQRGSGDYGLDV

SEQ ID NO: 92685 - protein, 9 aa, Homo sapiens
  light chain complementarity determining region 3 for antibody 46343
MQALQTPRT

SEQ ID NO: 92686 - protein, 30 aa, Homo sapiens
  heavy chain complementarity determining region 3 for antibody 46343
ARGRTRPLNFIDRFGSGTNLPQPEVEWFDP

SEQ ID NO: 92687 - protein, 9 aa, Homo sapiens
  light chain complementarity determining region 3 for antibody 46344
MQALQTPRT

SEQ ID NO: 92688 - protein, 9 aa, Homo sapiens
  heavy chain complementarity determining region 3 for antibody 46344
AKGKDAFAI

SEQ ID NO: 92689 - protein, 9 aa, Homo sapiens
  light chain complementarity determining region 3 for antibody 46345
MQALQTPQT

SEQ ID NO: 92690 - protein, 20 aa, Homo sapiens
  heavy chain complementarity determining region 3 for antibody 46345
ARDPSNIAAPDGYYYYGLDI

SEQ ID NO: 92691 - protein, 10 aa, Homo sapiens
  light chain complementarity determining region 3 for antibody 46346
MQALQTPPYT

SEQ ID NO: 92692 - protein, 15 aa, Homo sapiens
  heavy chain complementarity determining region 3 for antibody 46346
AIGIRYAVTGAFWDY

SEQ ID NO: 92693 - protein, 9 aa, Homo sapiens
  light chain complementarity determining region 3 for antibody 46347
MQALQTPPT

SEQ ID NO: 92694 - protein, 22 aa, Homo sapiens
  heavy chain complementarity determining region 3 for antibody 46347
ASPYDIVTGYYKDVYYYYGMDV

SEQ ID NO: 92695 - protein, 9 aa, Homo sapiens
  light chain complementarity determining region 3 for antibody 46348
MQALQTPPT

SEQ ID NO: 92696 - protein, 15 aa, Homo sapiens
  heavy chain complementarity determining region 3 for antibody 46348
ARGILWFGEGVGLDI

SEQ ID NO: 92697 - protein, 9 aa, Homo sapiens
  light chain complementarity determining region 3 for antibody 46349
MQALQTPPT

SEQ ID NO: 92698 - protein, 16 aa, Homo sapiens
  heavy chain complementarity determining region 3 for antibody 46349
ARDPYCGGGGCSRLDP

SEQ ID NO: 92699 - protein, 10 aa, Homo sapiens
  light chain complementarity determining region 3 for antibody 46350
MQALQTPPLT

SEQ ID NO: 92700 - protein, 17 aa, Homo sapiens
  heavy chain complementarity determining region 3 for antibody 46350
VHSGYYYDSSAYYYPDY

SEQ ID NO: 92701 - protein, 9 aa, Homo sapiens
  light chain complementarity determining region 3 for antibody 46351
MQALQTPPI

SEQ ID NO: 92702 - protein, 15 aa, Homo sapiens
  heavy chain complementarity determining region 3 for antibody 46351
VADYIDRTGNGHPAI

SEQ ID NO: 92703 - protein, 9 aa, Homo sapiens
  light chain complementarity determining region 3 for antibody 46352
MQALQTPMT

SEQ ID NO: 92704 - protein, 15 aa, Homo sapiens
  heavy chain complementarity determining region 3 for antibody 46352
ARRPVGGGNSKTLDY

SEQ ID NO: 92705 - protein, 9 aa, Homo sapiens
  light chain complementarity determining region 3 for antibody 46353
MQALQTPLT

SEQ ID NO: 92706 - protein, 17 aa, Homo sapiens
  heavy chain complementarity determining region 3 for antibody 46353
PCPKALDLLTGLHGMDV

SEQ ID NO: 92707 - protein, 9 aa, Homo sapiens
  light chain complementarity determining region 3 for antibody 46354
MQALQTPLT

SEQ ID NO: 92708 - protein, 16 aa, Homo sapiens
  heavy chain complementarity determining region 3 for antibody 46354
ARRIAGVGSTAHAFDI

SEQ ID NO: 92709 - protein, 9 aa, Homo sapiens
  light chain complementarity determining region 3 for antibody 46355
MQALQTPLT

SEQ ID NO: 92710 - protein, 15 aa, Homo sapiens
  heavy chain complementarity determining region 3 for antibody 46355
ARLGGRLLRSAPFDF

SEQ ID NO: 92711 - protein, 9 aa, Homo sapiens
  light chain complementarity determining region 3 for antibody 46356
MQALQTPLT

SEQ ID NO: 92712 - protein, 7 aa, Homo sapiens
  heavy chain complementarity determining region 3 for antibody 46356
ARDDMDV

SEQ ID NO: 92713 - protein, 9 aa, Homo sapiens
  light chain complementarity determining region 3 for antibody 46357
MQALQTPIT

SEQ ID NO: 92714 - protein, 20 aa, Homo sapiens
  heavy chain complementarity determining region 3 for antibody 46357
ARVPGNYDVLTGYQGGYFHH

SEQ ID NO: 92715 - protein, 10 aa, Homo sapiens
  light chain complementarity determining region 3 for antibody 46358
MQALQTPGVT

SEQ ID NO: 92716 - protein, 22 aa, Homo sapiens
  heavy chain complementarity determining region 3 for antibody 46358
ARDSRRLLTVTRGEYYYFGMDV

SEQ ID NO: 92717 - protein, 9 aa, Homo sapiens
  light chain complementarity determining region 3 for antibody 46359
MQALQTPGA

SEQ ID NO: 92718 - protein, 10 aa, Homo sapiens
  heavy chain complementarity determining region 3 for antibody 46359
TRSKGYGMDV

SEQ ID NO: 92719 - protein, 9 aa, Homo sapiens
  light chain complementarity determining region 3 for antibody 46360
MQALQTPFT

SEQ ID NO: 92720 - protein, 10 aa, Homo sapiens
  heavy chain complementarity determining region 3 for antibody 46360
ARRFLGAFDI

SEQ ID NO: 92721 - protein, 9 aa, Homo sapiens
  light chain complementarity determining region 3 for antibody 46361
MQALQTPFT

SEQ ID NO: 92722 - protein, 16 aa, Homo sapiens
  heavy chain complementarity determining region 3 for antibody 46361
ARGVRYSSAWTYYFDI

SEQ ID NO: 92723 - protein, 9 aa, Homo sapiens
  light chain complementarity determining region 3 for antibody 46362
MQALQTPFT

SEQ ID NO: 92724 - protein, 17 aa, Homo sapiens
  heavy chain complementarity determining region 3 for antibody 46362
AREGGDYGRFFYHGLDV

SEQ ID NO: 92725 - protein, 9 aa, Homo sapiens
  light chain complementarity determining region 3 for antibody 46363
MQALQTPDT

SEQ ID NO: 92726 - protein, 17 aa, Homo sapiens
  heavy chain complementarity determining region 3 for antibody 46363
AKDIFSSNYYGLGVLQH

SEQ ID NO: 92727 - protein, 8 aa, Homo sapiens
  light chain complementarity determining region 3 for antibody 46364
MQALQTLT

SEQ ID NO: 92728 - protein, 20 aa, Homo sapiens
  heavy chain complementarity determining region 3 for antibody 46364
AKDFGGPHFLAGSMGYGMDV

SEQ ID NO: 92729 - protein, 9 aa, Homo sapiens
  light chain complementarity determining region 3 for antibody 46365
MQALQSPGT

SEQ ID NO: 92730 - protein, 12 aa, Homo sapiens
  heavy chain complementarity determining region 3 for antibody 46365
ARNYEHSGYFGY

SEQ ID NO: 92731 - protein, 8 aa, Homo sapiens
  light chain complementarity determining region 3 for antibody 46366
MQALQMLT

SEQ ID NO: 92732 - protein, 16 aa, Homo sapiens
  heavy chain complementarity determining region 3 for antibody 46366
ARDAALGYNGSRALEY

SEQ ID NO: 92733 - protein, 8 aa, Homo sapiens
  light chain complementarity determining region 3 for antibody 46367
MQALQKRT

SEQ ID NO: 92734 - protein, 14 aa, Homo sapiens
  heavy chain complementarity determining region 3 for antibody 46367
TRLFCTGGRCFHDH

SEQ ID NO: 92735 - protein, 8 aa, Homo sapiens
  light chain complementarity determining region 3 for antibody 46368
MQALQIWT

SEQ ID NO: 92736 - protein, 14 aa, Homo sapiens
  heavy chain complementarity determining region 3 for antibody 46368
ARGEAAAGAYYFDS

SEQ ID NO: 92737 - protein, 9 aa, Homo sapiens
  light chain complementarity determining region 3 for antibody 46369
MQALQIPWT

SEQ ID NO: 92738 - protein, 16 aa, Homo sapiens
  heavy chain complementarity determining region 3 for antibody 46369
ARVGVNWDLGSNGFDI

SEQ ID NO: 92739 - protein, 9 aa, Homo sapiens
  light chain complementarity determining region 3 for antibody 46370
MQALQIPPT

SEQ ID NO: 92740 - protein, 17 aa, Homo sapiens
  heavy chain complementarity determining region 3 for antibody 46370
AKDPTGGNYHILPGYVQ

SEQ ID NO: 92741 - protein, 9 aa, Homo sapiens
  light chain complementarity determining region 3 for antibody 46371
MQALQIPLT

SEQ ID NO: 92742 - protein, 12 aa, Homo sapiens
  heavy chain complementarity determining region 3 for antibody 46371
ARGRVGGNSFDQ

SEQ ID NO: 92743 - protein, 9 aa, Homo sapiens
  light chain complementarity determining region 3 for antibody 46372
MQALQAPYT

SEQ ID NO: 92744 - protein, 11 aa, Homo sapiens
  heavy chain complementarity determining region 3 for antibody 46372
ARDTALYGLDV

SEQ ID NO: 92745 - protein, 9 aa, Homo sapiens
  light chain complementarity determining region 3 for antibody 46373
MQALQAPRT

SEQ ID NO: 92746 - protein, 21 aa, Homo sapiens
  heavy chain complementarity determining region 3 for antibody 46373
ARGQSGYSYGPQNYYYFGMDV

SEQ ID NO: 92747 - protein, 10 aa, Homo sapiens
  light chain complementarity determining region 3 for antibody 46374
MQALQAPPYT

SEQ ID NO: 92748 - protein, 22 aa, Homo sapiens
  heavy chain complementarity determining region 3 for antibody 46374
TRARHYDSSGSNNAWVSYGLDV

SEQ ID NO: 92749 - protein, 9 aa, Homo sapiens
  light chain complementarity determining region 3 for antibody 46375
MQALNSPQT

SEQ ID NO: 92750 - protein, 21 aa, Homo sapiens
  heavy chain complementarity determining region 3 for antibody 46375
ARGQFRQVVEGVQYQSYGLDV

SEQ ID NO: 92751 - protein, 9 aa, Homo sapiens
  light chain complementarity determining region 3 for antibody 46376
MQALKTPGT

SEQ ID NO: 92752 - protein, 18 aa, Homo sapiens
  heavy chain complementarity determining region 3 for antibody 46376
AASGRYFFQNSGPLGFGY

SEQ ID NO: 92753 - protein, 9 aa, Homo sapiens
  light chain complementarity determining region 3 for antibody 46377
MQALHIPFT

SEQ ID NO: 92754 - protein, 12 aa, Homo sapiens
  heavy chain complementarity determining region 3 for antibody 46377
ARGRVGGNSFDQ

SEQ ID NO: 92755 - protein, 9 aa, Homo sapiens
  light chain complementarity determining region 3 for antibody 46378
MQALETPPT

SEQ ID NO: 92756 - protein, 14 aa, Homo sapiens
  heavy chain complementarity determining region 3 for antibody 46378
ARGSASIGVRYFDS

SEQ ID NO: 92757 - protein, 9 aa, Homo sapiens
  light chain complementarity determining region 3 for antibody 46379
MQALETPIT

SEQ ID NO: 92758 - protein, 15 aa, Homo sapiens
  heavy chain complementarity determining region 3 for antibody 46379
ASSEQTDYNYYGMDV

SEQ ID NO: 92759 - protein, 9 aa, Homo sapiens
  light chain complementarity determining region 3 for antibody 46380
MPGTHWPLT

SEQ ID NO: 92760 - protein, 9 aa, Homo sapiens
  heavy chain complementarity determining region 3 for antibody 46380
TWSNSGGDY

SEQ ID NO: 92761 - protein, 9 aa, Homo sapiens
  light chain complementarity determining region 3 for antibody 46381
MPALQIPFT

SEQ ID NO: 92762 - protein, 12 aa, Homo sapiens
  heavy chain complementarity determining region 3 for antibody 46381
ARGRVGGNSFDQ

SEQ ID NO: 92763 - protein, 9 aa, Homo sapiens
  light chain complementarity determining region 3 for antibody 46382
MHALQVPRT

SEQ ID NO: 92764 - protein, 22 aa, Homo sapiens
  heavy chain complementarity determining region 3 for antibody 46382
ARDLEWFGELVYLRGYFYAMDV

SEQ ID NO: 92765 - protein, 8 aa, Homo sapiens
  light chain complementarity determining region 3 for antibody 46383
LQYVNSPT

SEQ ID NO: 92766 - protein, 11 aa, Homo sapiens
  heavy chain complementarity determining region 3 for antibody 46383
SMGGGLGVSHR

SEQ ID NO: 92767 - protein, 9 aa, Homo sapiens
  light chain complementarity determining region 3 for antibody 46384
LQYNTYPWT

SEQ ID NO: 92768 - protein, 19 aa, Homo sapiens
  heavy chain complementarity determining region 3 for antibody 46384
VRGTWVVVSASGDDDPPRI

SEQ ID NO: 92769 - protein, 9 aa, Homo sapiens
  light chain complementarity determining region 3 for antibody 46385
LQYNKYPRT

SEQ ID NO: 92770 - protein, 6 aa, Homo sapiens
  heavy chain complementarity determining region 3 for antibody 46385
SLSLNS

SEQ ID NO: 92771 - protein, 9 aa, Homo sapiens
  light chain complementarity determining region 3 for antibody 46386
LQYGGTSYT

SEQ ID NO: 92772 - protein, 15 aa, Homo sapiens
  heavy chain complementarity determining region 3 for antibody 46386
ARVALVEWFLTPLDY

SEQ ID NO: 92773 - protein, 9 aa, Homo sapiens
  light chain complementarity determining region 3 for antibody 46387
LQLSAYPPT

SEQ ID NO: 92774 - protein, 16 aa, Homo sapiens
  heavy chain complementarity determining region 3 for antibody 46387
ARDDGGYTDRNRRFDH

SEQ ID NO: 92775 - protein, 9 aa, Homo sapiens
  light chain complementarity determining region 3 for antibody 46388
LQHNNYQWT

SEQ ID NO: 92776 - protein, 21 aa, Homo sapiens
  heavy chain complementarity determining region 3 for antibody 46388
GRSVGLPIPQIWRSPAGWIDP

SEQ ID NO: 92777 - protein, 9 aa, Homo sapiens
  light chain complementarity determining region 3 for antibody 46389
LQHDSYPWT

SEQ ID NO: 92778 - protein, 20 aa, Homo sapiens
  heavy chain complementarity determining region 3 for antibody 46389
AKLVFGGSGSYSFVMGAFDI

SEQ ID NO: 92779 - protein, 9 aa, Homo sapiens
  light chain complementarity determining region 3 for antibody 46390
LQDYSFPPT

SEQ ID NO: 92780 - protein, 17 aa, Homo sapiens
  heavy chain complementarity determining region 3 for antibody 46390
ARGAEHRRVRRYYGLDV

SEQ ID NO: 92781 - protein, 9 aa, Homo sapiens
  light chain complementarity determining region 3 for antibody 46391
LQDYNYPYT

SEQ ID NO: 92782 - protein, 19 aa, Homo sapiens
  heavy chain complementarity determining region 3 for antibody 46391
VKGKEDDAGGYLKDDPFDV

SEQ ID NO: 92783 - protein, 9 aa, Homo sapiens
  light chain complementarity determining region 3 for antibody 46392
LQDYNYPRT

SEQ ID NO: 92784 - protein, 19 aa, Homo sapiens
  heavy chain complementarity determining region 3 for antibody 46392
ARDSHFIMMVDAGHYGLDL

SEQ ID NO: 92785 - protein, 9 aa, Homo sapiens
  light chain complementarity determining region 3 for antibody 46393
LQDYAYPWT

SEQ ID NO: 92786 - protein, 15 aa, Homo sapiens
  heavy chain complementarity determining region 3 for antibody 46393
ARASTATGSYRRLDF

SEQ ID NO: 92787 - protein, 9 aa, Homo sapiens
  light chain complementarity determining region 3 for antibody 46394
LQDSNYPLT

SEQ ID NO: 92788 - protein, 12 aa, Homo sapiens
  heavy chain complementarity determining region 3 for antibody 46394
VKPVYNSGWYDF

SEQ ID NO: 92789 - protein, 9 aa, Homo sapiens
  light chain complementarity determining region 3 for antibody 46395
LQDDSYPWT

SEQ ID NO: 92790 - protein, 14 aa, Homo sapiens
  heavy chain complementarity determining region 3 for antibody 46395
ARSLGVRMLGYLVY

SEQ ID NO: 92791 - protein, 9 aa, Homo sapiens
  light chain complementarity determining region 3 for antibody 46396
LHHNSYPLT

SEQ ID NO: 92792 - protein, 17 aa, Homo sapiens
  heavy chain complementarity determining region 3 for antibody 46396
ARERNYYDSSGLYFFDY

SEQ ID NO: 92793 - protein, 9 aa, Homo sapiens
  light chain complementarity determining region 3 for antibody 46397
LHDYNYPVH

SEQ ID NO: 92794 - protein, 15 aa, Homo sapiens
  heavy chain complementarity determining region 3 for antibody 46397
ARVTRPAGTWETLDY

SEQ ID NO: 92795 - protein, 9 aa, Homo sapiens
  light chain complementarity determining region 3 for antibody 46398
HQYYSDPHT

SEQ ID NO: 92796 - protein, 15 aa, Homo sapiens
  heavy chain complementarity determining region 3 for antibody 46398
ARPTPESATYRGMDV

SEQ ID NO: 92797 - protein, 8 aa, Homo sapiens
  light chain complementarity determining region 3 for antibody 46399
HQYVTSHT

SEQ ID NO: 92798 - protein, 17 aa, Homo sapiens
  heavy chain complementarity determining region 3 for antibody 46399
ARVTSDYGLGSQGRLDY

SEQ ID NO: 92799 - protein, 9 aa, Homo sapiens
  light chain complementarity determining region 3 for antibody 46400
HQYNSYSWT

SEQ ID NO: 92800 - protein, 16 aa, Homo sapiens
  heavy chain complementarity determining region 3 for antibody 46400
AREGLVVTGIVDPFGI

SEQ ID NO: 92801 - protein, 9 aa, Homo sapiens
  light chain complementarity determining region 3 for antibody 46401
HQYNNWPFT

SEQ ID NO: 92802 - protein, 17 aa, Homo sapiens
  heavy chain complementarity determining region 3 for antibody 46401
ATRLGIAPEPHYWYFDL

SEQ ID NO: 92803 - protein, 9 aa, Homo sapiens
  light chain complementarity determining region 3 for antibody 46402
HQYGTVPET

SEQ ID NO: 92804 - protein, 13 aa, Homo sapiens
  heavy chain complementarity determining region 3 for antibody 46402
ARRGYGDFVREDF

SEQ ID NO: 92805 - protein, 10 aa, Homo sapiens
  light chain complementarity determining region 3 for antibody 46403
HQYGTSPPWT

SEQ ID NO: 92806 - protein, 16 aa, Homo sapiens
  heavy chain complementarity determining region 3 for antibody 46403
ARRQWVRGLFRGGLDY

SEQ ID NO: 92807 - protein, 10 aa, Homo sapiens
  light chain complementarity determining region 3 for antibody 46404
HQYGSSPLYR

SEQ ID NO: 92808 - protein, 12 aa, Homo sapiens
  heavy chain complementarity determining region 3 for antibody 46404
AHSLTSLRAFDI

SEQ ID NO: 92809 - protein, 10 aa, Homo sapiens
  light chain complementarity determining region 3 for antibody 46405
HQYGSSPLSS

SEQ ID NO: 92810 - protein, 12 aa, Homo sapiens
  heavy chain complementarity determining region 3 for antibody 46405
AHSLTSLRAFDI

SEQ ID NO: 92811 - protein, 8 aa, Homo sapiens
  light chain complementarity determining region 3 for antibody 46406
HQYGSKPT

SEQ ID NO: 92812 - protein, 11 aa, Homo sapiens
  heavy chain complementarity determining region 3 for antibody 46406
GRKPTGWPFDY

SEQ ID NO: 92813 - protein, 9 aa, Homo sapiens
  light chain complementarity determining region 3 for antibody 46407
HQYGNSPKM

SEQ ID NO: 92814 - protein, 8 aa, Homo sapiens
  heavy chain complementarity determining region 3 for antibody 46407
VKTGTTEN

SEQ ID NO: 92815 - protein, 9 aa, Homo sapiens
  light chain complementarity determining region 3 for antibody 46408
HQYGDTPRT

SEQ ID NO: 92816 - protein, 16 aa, Homo sapiens
  heavy chain complementarity determining region 3 for antibody 46408
AGLSASGHLAPNTFDV

SEQ ID NO: 92817 - protein, 9 aa, Homo sapiens
  light chain complementarity determining region 3 for antibody 46409
HQYFSSPGT

SEQ ID NO: 92818 - protein, 12 aa, Homo sapiens
  heavy chain complementarity determining region 3 for antibody 46409
TTYAFYGLGRSS

SEQ ID NO: 92819 - protein, 9 aa, Homo sapiens
  light chain complementarity determining region 3 for antibody 46410
HQYASPPLP

SEQ ID NO: 92820 - protein, 10 aa, Homo sapiens
  heavy chain complementarity determining region 3 for antibody 46410
AHGAGWTHDI

SEQ ID NO: 92821 - protein, 9 aa, Homo sapiens
  light chain complementarity determining region 3 for antibody 46411
HQYASDPRT

SEQ ID NO: 92822 - protein, 14 aa, Homo sapiens
  heavy chain complementarity determining region 3 for antibody 46411
ARAVADFQGGGLDP

SEQ ID NO: 92823 - protein, 9 aa, Homo sapiens
  light chain complementarity determining region 3 for antibody 46412
HQTGGLPYT

SEQ ID NO: 92824 - protein, 15 aa, Homo sapiens
  heavy chain complementarity determining region 3 for antibody 46412
AKGDSGYESLGDFDY

SEQ ID NO: 92825 - protein, 9 aa, Homo sapiens
  light chain complementarity determining region 3 for antibody 46413
HQSSSTPQT

SEQ ID NO: 92826 - protein, 14 aa, Homo sapiens
  heavy chain complementarity determining region 3 for antibody 46413
ASRTSGQVWNALDL

SEQ ID NO: 92827 - protein, 9 aa, Homo sapiens
  light chain complementarity determining region 3 for antibody 46414
HQSSSLSWT

SEQ ID NO: 92828 - protein, 19 aa, Homo sapiens
  heavy chain complementarity determining region 3 for antibody 46414
ARVEPTLWEQLDVGHYSDH

SEQ ID NO: 92829 - protein, 9 aa, Homo sapiens
  light chain complementarity determining region 3 for antibody 46415
HQSNILPYT

SEQ ID NO: 92830 - protein, 16 aa, Homo sapiens
  heavy chain complementarity determining region 3 for antibody 46415
ARKERAGDGGGHGFDV

SEQ ID NO: 92831 - protein, 10 aa, Homo sapiens
  light chain complementarity determining region 3 for antibody 46416
HQRYNWPPFT

SEQ ID NO: 92832 - protein, 11 aa, Homo sapiens
  heavy chain complementarity determining region 3 for antibody 46416
ARGVGSYPFDS

SEQ ID NO: 92833 - protein, 9 aa, Homo sapiens
  light chain complementarity determining region 3 for antibody 46417
HQRSNWPRT

SEQ ID NO: 92834 - protein, 16 aa, Homo sapiens
  heavy chain complementarity determining region 3 for antibody 46417
ARDYIGFGAPIYYFDY

SEQ ID NO: 92835 - protein, 10 aa, Homo sapiens
  light chain complementarity determining region 3 for antibody 46418
HQRSNRPPFT

SEQ ID NO: 92836 - protein, 12 aa, Homo sapiens
  heavy chain complementarity determining region 3 for antibody 46418
ARREIAAAGLDF

SEQ ID NO: 92837 - protein, 9 aa, Homo sapiens
  light chain complementarity determining region 3 for antibody 46419
HQRGSLPIT

SEQ ID NO: 92838 - protein, 16 aa, Homo sapiens
  heavy chain complementarity determining region 3 for antibody 46419
ARVFGSGTYHSDYFDN

SEQ ID NO: 92839 - protein, 9 aa, Homo sapiens
  light chain complementarity determining region 3 for antibody 46420
HHHAYAPLT

SEQ ID NO: 92840 - protein, 10 aa, Homo sapiens
  heavy chain complementarity determining region 3 for antibody 46420
ARTSGWLGDY

SEQ ID NO: 92841 - protein, 9 aa, Homo sapiens
  light chain complementarity determining region 3 for antibody 46421
EQYGNSPRT

SEQ ID NO: 92842 - protein, 9 aa, Homo sapiens
  heavy chain complementarity determining region 3 for antibody 46421
TREYSAFDV

SEQ ID NO: 92843 - protein, 9 aa, Homo sapiens
  light chain complementarity determining region 3 for antibody 46422
EQSYNTPRT

SEQ ID NO: 92844 - protein, 11 aa, Homo sapiens
  heavy chain complementarity determining region 3 for antibody 46422
ARDNGLLEFDY

SEQ ID NO: 92845 - protein, 9 aa, Homo sapiens
  light chain complementarity determining region 3 for antibody 46423
EQSFSFPFT

SEQ ID NO: 92846 - protein, 21 aa, Homo sapiens
  heavy chain complementarity determining region 3 for antibody 46423
ARGPEIYDSSAHTYYYYGMDV

SEQ ID NO: 92847 - protein, 9 aa, Homo sapiens
  light chain complementarity determining region 3 for antibody 46424
VQYNRSPRT

SEQ ID NO: 92848 - protein, 6 aa, Homo sapiens
  heavy chain complementarity determining region 3 for antibody 46424
TRALDY

SEQ ID NO: 92849 - protein, 10 aa, Homo sapiens
  light chain complementarity determining region 3 for antibody 46425
VQGTHWPPNT

SEQ ID NO: 92850 - protein, 11 aa, Homo sapiens
  heavy chain complementarity determining region 3 for antibody 46425
ATDWGSSGWVR

SEQ ID NO: 92851 - protein, 11 aa, Homo sapiens
  light chain complementarity determining region 3 for antibody 46426
TQYNNWPLLYT

SEQ ID NO: 92852 - protein, 15 aa, Homo sapiens
  heavy chain complementarity determining region 3 for antibody 46426
AREERAPASLDYLDY

SEQ ID NO: 92853 - protein, 10 aa, Homo sapiens
  light chain complementarity determining region 3 for antibody 46427
RQYGGSPPIT

SEQ ID NO: 92854 - protein, 18 aa, Homo sapiens
  heavy chain complementarity determining region 3 for antibody 46427
ARDEVYCASTSCYDTFDY

SEQ ID NO: 92855 - protein, 9 aa, Homo sapiens
  light chain complementarity determining region 3 for antibody 46428
RQSYSLPRT

SEQ ID NO: 92856 - protein, 18 aa, Homo sapiens
  heavy chain complementarity determining region 3 for antibody 46428
ARGHYFDSSGYLHPAFDY

SEQ ID NO: 92857 - protein, 9 aa, Homo sapiens
  light chain complementarity determining region 3 for antibody 46429
RQRSNWPLT

SEQ ID NO: 92858 - protein, 14 aa, Homo sapiens
  heavy chain complementarity determining region 3 for antibody 46429
ARHGAAGRIAWFDP

SEQ ID NO: 92859 - protein, 9 aa, Homo sapiens
  light chain complementarity determining region 3 for antibody 46430
RQRKNWPWT

SEQ ID NO: 92860 - protein, 12 aa, Homo sapiens
  heavy chain complementarity determining region 3 for antibody 46430
ARVGGPRLPLDY

SEQ ID NO: 92861 - protein, 9 aa, Homo sapiens
  light chain complementarity determining region 3 for antibody 46431
RQGLQAPPT

SEQ ID NO: 92862 - protein, 14 aa, Homo sapiens
  heavy chain complementarity determining region 3 for antibody 46431
AKDLKVDGVWDIDY

SEQ ID NO: 92863 - protein, 9 aa, Homo sapiens
  light chain complementarity determining region 3 for antibody 46432
RQDTHWPRT

SEQ ID NO: 92864 - protein, 7 aa, Homo sapiens
  heavy chain complementarity determining region 3 for antibody 46432
ARDSTDF

SEQ ID NO: 92865 - protein, 9 aa, Homo sapiens
  light chain complementarity determining region 3 for antibody 46433
RQALQTPRT

SEQ ID NO: 92866 - protein, 11 aa, Homo sapiens
  heavy chain complementarity determining region 3 for antibody 46433
GVVVTPDYVDY

SEQ ID NO: 92867 - protein, 9 aa, Homo sapiens
  light chain complementarity determining region 3 for antibody 46434
RQALQTPGT

SEQ ID NO: 92868 - protein, 18 aa, Homo sapiens
  heavy chain complementarity determining region 3 for antibody 46434
AASGRYFFQNSGPLGFGY

SEQ ID NO: 92869 - protein, 9 aa, Homo sapiens
  light chain complementarity determining region 3 for antibody 46435
QYYGSSPYT

SEQ ID NO: 92870 - protein, 11 aa, Homo sapiens
  heavy chain complementarity determining region 3 for antibody 46435
AKFVADYAVGH

SEQ ID NO: 92871 - protein, 8 aa, Homo sapiens
  light chain complementarity determining region 3 for antibody 46436
QYRSNWLT

SEQ ID NO: 92872 - protein, 17 aa, Homo sapiens
  heavy chain complementarity determining region 3 for antibody 46436
ARDTVAIGSMGYYGLDV

SEQ ID NO: 92873 - protein, 9 aa, Homo sapiens
  light chain complementarity determining region 3 for antibody 46437
QVYGSSPPT

SEQ ID NO: 92874 - protein, 18 aa, Homo sapiens
  heavy chain complementarity determining region 3 for antibody 46437
ARDGGGYNHGSSGAYLDY

SEQ ID NO: 92875 - protein, 9 aa, Homo sapiens
  light chain complementarity determining region 3 for antibody 46438
QRYIRAPWT

SEQ ID NO: 92876 - protein, 12 aa, Homo sapiens
  heavy chain complementarity determining region 3 for antibody 46438
ARGRLGILPADY

SEQ ID NO: 92877 - protein, 9 aa, Homo sapiens
  light chain complementarity determining region 3 for antibody 46439
QRYGYSLFT

SEQ ID NO: 92878 - protein, 17 aa, Homo sapiens
  heavy chain complementarity determining region 3 for antibody 46439
GKDYPTREKAAGHWFDP

SEQ ID NO: 92879 - protein, 11 aa, Homo sapiens
  light chain complementarity determining region 3 for antibody 46440
QRYGSSPPGST

SEQ ID NO: 92880 - protein, 25 aa, Homo sapiens
  heavy chain complementarity determining region 3 for antibody 46440
AKDKAREMAVLNWGPKKYYYYGMDV

SEQ ID NO: 92881 - protein, 10 aa, Homo sapiens
  light chain complementarity determining region 3 for antibody 46441
QRYGSSPMST

SEQ ID NO: 92882 - protein, 13 aa, Homo sapiens
  heavy chain complementarity determining region 3 for antibody 46441
ARYNLEYYDAFDL

SEQ ID NO: 92883 - protein, 11 aa, Homo sapiens
  light chain complementarity determining region 3 for antibody 46442
QRYGSSLPMYP

SEQ ID NO: 92884 - protein, 16 aa, Homo sapiens
  heavy chain complementarity determining region 3 for antibody 46442
ARVGGTSGKNFRELDY

SEQ ID NO: 92885 - protein, 10 aa, Homo sapiens
  light chain complementarity determining region 3 for antibody 46443
QRYGRSPPYP

SEQ ID NO: 92886 - protein, 15 aa, Homo sapiens
  heavy chain complementarity determining region 3 for antibody 46443
ARDQWLLLPGGFFDS

SEQ ID NO: 92887 - protein, 9 aa, Homo sapiens
  light chain complementarity determining region 3 for antibody 46444
QRYGFSLFP

SEQ ID NO: 92888 - protein, 17 aa, Homo sapiens
  heavy chain complementarity determining region 3 for antibody 46444
AKDFPSRQLAAAHWFDP

SEQ ID NO: 92889 - protein, 9 aa, Homo sapiens
  light chain complementarity determining region 3 for antibody 46445
QRTYSPPLT

SEQ ID NO: 92890 - protein, 15 aa, Homo sapiens
  heavy chain complementarity determining region 3 for antibody 46445
ARAVAGTAGASGMDV

SEQ ID NO: 92891 - protein, 9 aa, Homo sapiens
  light chain complementarity determining region 3 for antibody 46446
QRQNSAPLP

SEQ ID NO: 92892 - protein, 10 aa, Homo sapiens
  heavy chain complementarity determining region 3 for antibody 46446
ARDEGYFGTS

SEQ ID NO: 92893 - protein, 8 aa, Homo sapiens
  light chain complementarity determining region 3 for antibody 46447
QRDGRSLT

SEQ ID NO: 92894 - protein, 12 aa, Homo sapiens
  heavy chain complementarity determining region 3 for antibody 46447
ARLWIGTGPFDN

SEQ ID NO: 92895 - protein, 9 aa, Homo sapiens
  light chain complementarity determining region 3 for antibody 46448
QQYYTYPLT

SEQ ID NO: 92896 - protein, 16 aa, Homo sapiens
  heavy chain complementarity determining region 3 for antibody 46448
AKLDDFWSGHAMGIDF

SEQ ID NO: 92897 - protein, 9 aa, Homo sapiens
  light chain complementarity determining region 3 for antibody 46449
QQYYTYPFA

SEQ ID NO: 92898 - protein, 15 aa, Homo sapiens
  heavy chain complementarity determining region 3 for antibody 46449
AKDAVGGTTLKAFDF

SEQ ID NO: 92899 - protein, 11 aa, Homo sapiens
  light chain complementarity determining region 3 for antibody 46450
QQYYTSPPGYP

SEQ ID NO: 92900 - protein, 14 aa, Homo sapiens
  heavy chain complementarity determining region 3 for antibody 46450
ARCTSSSRKRSFDQ

SEQ ID NO: 92901 - protein, 9 aa, Homo sapiens
  light chain complementarity determining region 3 for antibody 46451
QQYYTFPPT

SEQ ID NO: 92902 - protein, 14 aa, Homo sapiens
  heavy chain complementarity determining region 3 for antibody 46451
ARKGLSAVPGYFDN

SEQ ID NO: 92903 - protein, 9 aa, Homo sapiens
  light chain complementarity determining region 3 for antibody 46452
QQYYSYPWT

SEQ ID NO: 92904 - protein, 12 aa, Homo sapiens
  heavy chain complementarity determining region 3 for antibody 46452
ARDRLSHYGMDV

SEQ ID NO: 92905 - protein, 9 aa, Homo sapiens
  light chain complementarity determining region 3 for antibody 46453
QQYYSYPPT

SEQ ID NO: 92906 - protein, 13 aa, Homo sapiens
  heavy chain complementarity determining region 3 for antibody 46453
ARDSGAGKYGVDV

SEQ ID NO: 92907 - protein, 9 aa, Homo sapiens
  light chain complementarity determining region 3 for antibody 46454
QQYYSYPLT

SEQ ID NO: 92908 - protein, 14 aa, Homo sapiens
  heavy chain complementarity determining region 3 for antibody 46454
ARRYYDSSGYPLDY

SEQ ID NO: 92909 - protein, 9 aa, Homo sapiens
  light chain complementarity determining region 3 for antibody 46455
QQYYSTPYT

SEQ ID NO: 92910 - protein, 16 aa, Homo sapiens
  heavy chain complementarity determining region 3 for antibody 46455
ARARWDRGIAVAGFDY

SEQ ID NO: 92911 - protein, 10 aa, Homo sapiens
  light chain complementarity determining region 3 for antibody 46456
QQYYSTPMYT

SEQ ID NO: 92912 - protein, 16 aa, Homo sapiens
  heavy chain complementarity determining region 3 for antibody 46456
ASPFSIDGVAVRAFDI

SEQ ID NO: 92913 - protein, 9 aa, Homo sapiens
  light chain complementarity determining region 3 for antibody 46457
QQYYSTPLT

SEQ ID NO: 92914 - protein, 15 aa, Homo sapiens
  heavy chain complementarity determining region 3 for antibody 46457
AREANWGGGEGWFDP

SEQ ID NO: 92915 - protein, 9 aa, Homo sapiens
  light chain complementarity determining region 3 for antibody 46458
QQYYSTPHT

SEQ ID NO: 92916 - protein, 13 aa, Homo sapiens
  heavy chain complementarity determining region 3 for antibody 46458
ARMYSSGWSPFDS

SEQ ID NO: 92917 - protein, 9 aa, Homo sapiens
  light chain complementarity determining region 3 for antibody 46459
QQYYSTPGT

SEQ ID NO: 92918 - protein, 12 aa, Homo sapiens
  heavy chain complementarity determining region 3 for antibody 46459
ARCRSYVNWFDP

SEQ ID NO: 92919 - protein, 9 aa, Homo sapiens
  light chain complementarity determining region 3 for antibody 46460
QQYYSTPFT

SEQ ID NO: 92920 - protein, 11 aa, Homo sapiens
  heavy chain complementarity determining region 3 for antibody 46460
ARTDSRWAFDI

SEQ ID NO: 92921 - protein, 10 aa, Homo sapiens
  light chain complementarity determining region 3 for antibody 46461
QQYYSTLSFT

SEQ ID NO: 92922 - protein, 20 aa, Homo sapiens
  heavy chain complementarity determining region 3 for antibody 46461
ARRAVLPDYNDYSGLYGMDV

SEQ ID NO: 92923 - protein, 9 aa, Homo sapiens
  light chain complementarity determining region 3 for antibody 46462
QQYYSPPVT

SEQ ID NO: 92924 - protein, 16 aa, Homo sapiens
  heavy chain complementarity determining region 3 for antibody 46462
ARLTESSGYHGEGSDI

SEQ ID NO: 92925 - protein, 9 aa, Homo sapiens
  light chain complementarity determining region 3 for antibody 46463
QQYYSPPRT

SEQ ID NO: 92926 - protein, 18 aa, Homo sapiens
  heavy chain complementarity determining region 3 for antibody 46463
AREGWGSGLGGQGPGFDY

SEQ ID NO: 92927 - protein, 9 aa, Homo sapiens
  light chain complementarity determining region 3 for antibody 46464
QQYYSIPLT

SEQ ID NO: 92928 - protein, 6 aa, Homo sapiens
  heavy chain complementarity determining region 3 for antibody 46464
STWGYK

SEQ ID NO: 92929 - protein, 9 aa, Homo sapiens
  light chain complementarity determining region 3 for antibody 46465
QQYYSFPWT

SEQ ID NO: 92930 - protein, 23 aa, Homo sapiens
  heavy chain complementarity determining region 3 for antibody 46465
ARGVSIAAAGGGIPVYGTFYFDY

SEQ ID NO: 92931 - protein, 9 aa, Homo sapiens
  light chain complementarity determining region 3 for antibody 46466
QQYYNYPPT

SEQ ID NO: 92932 - protein, 10 aa, Homo sapiens
  heavy chain complementarity determining region 3 for antibody 46466
ARDRVGATVY

SEQ ID NO: 92933 - protein, 9 aa, Homo sapiens
  light chain complementarity determining region 3 for antibody 46467
QQYYNYPIT

SEQ ID NO: 92934 - protein, 15 aa, Homo sapiens
  heavy chain complementarity determining region 3 for antibody 46467
ARGLDSSGWADAFDL

SEQ ID NO: 92935 - protein, 10 aa, Homo sapiens
  light chain complementarity determining region 3 for antibody 46468
QQYYNWPPYT

SEQ ID NO: 92936 - protein, 11 aa, Homo sapiens
  heavy chain complementarity determining region 3 for antibody 46468
AKDYGNSWFDY

SEQ ID NO: 92937 - protein, 9 aa, Homo sapiens
  light chain complementarity determining region 3 for antibody 46469
QQYYNLLFT

SEQ ID NO: 92938 - protein, 20 aa, Homo sapiens
  heavy chain complementarity determining region 3 for antibody 46469
ARHAVGPCSGATCYLYAFDL

SEQ ID NO: 92939 - protein, 9 aa, Homo sapiens
  light chain complementarity determining region 3 for antibody 46470
QQYYNIPLT

SEQ ID NO: 92940 - protein, 17 aa, Homo sapiens
  heavy chain complementarity determining region 3 for antibody 46470
ARKSYYYNSASYGWFDP

SEQ ID NO: 92941 - protein, 9 aa, Homo sapiens
  light chain complementarity determining region 3 for antibody 46471
QQYYITPMT

SEQ ID NO: 92942 - protein, 14 aa, Homo sapiens
  heavy chain complementarity determining region 3 for antibody 46471
ARDFGISRPWYLDY

SEQ ID NO: 92943 - protein, 10 aa, Homo sapiens
  light chain complementarity determining region 3 for antibody 46472
QQYYIIPQYT

SEQ ID NO: 92944 - protein, 17 aa, Homo sapiens
  heavy chain complementarity determining region 3 for antibody 46472
VREFINSRGDYTGALDL

SEQ ID NO: 92945 - protein, 9 aa, Homo sapiens
  light chain complementarity determining region 3 for antibody 46473
QQYYGNPWT

SEQ ID NO: 92946 - protein, 14 aa, Homo sapiens
  heavy chain complementarity determining region 3 for antibody 46473
ARGDSDGHAWHFEF

SEQ ID NO: 92947 - protein, 9 aa, Homo sapiens
  light chain complementarity determining region 3 for antibody 46474
QQYYGAPLT

SEQ ID NO: 92948 - protein, 14 aa, Homo sapiens
  heavy chain complementarity determining region 3 for antibody 46474
VRGGGGPVGFLLDH

SEQ ID NO: 92949 - protein, 10 aa, Homo sapiens
  light chain complementarity determining region 3 for antibody 46475
QQYYDWPPQT

SEQ ID NO: 92950 - protein, 14 aa, Homo sapiens
  heavy chain complementarity determining region 3 for antibody 46475
ARDRIDMLRGYLDN

SEQ ID NO: 92951 - protein, 9 aa, Homo sapiens
  light chain complementarity determining region 3 for antibody 46476
QQYVTSPVT

SEQ ID NO: 92952 - protein, 15 aa, Homo sapiens
  heavy chain complementarity determining region 3 for antibody 46476
ARGIHDGSGRPFFDH

SEQ ID NO: 92953 - protein, 10 aa, Homo sapiens
  light chain complementarity determining region 3 for antibody 46477
QQYVRSRSWT

SEQ ID NO: 92954 - protein, 18 aa, Homo sapiens
  heavy chain complementarity determining region 3 for antibody 46477
ARSIVEVVTGTTEPRMDV

SEQ ID NO: 92955 - protein, 8 aa, Homo sapiens
  light chain complementarity determining region 3 for antibody 46478
QQYVRSPT

SEQ ID NO: 92956 - protein, 11 aa, Homo sapiens
  heavy chain complementarity determining region 3 for antibody 46478
TTGGSYAPFDI

SEQ ID NO: 92957 - protein, 8 aa, Homo sapiens
  light chain complementarity determining region 3 for antibody 46479
QQYVRSHP

SEQ ID NO: 92958 - protein, 11 aa, Homo sapiens
  heavy chain complementarity determining region 3 for antibody 46479
TTGGSYAPFDI

SEQ ID NO: 92959 - protein, 9 aa, Homo sapiens
  light chain complementarity determining region 3 for antibody 46480
QQYVNPLYT

SEQ ID NO: 92960 - protein, 17 aa, Homo sapiens
  heavy chain complementarity determining region 3 for antibody 46480
AKWSFRGRGEYGQGFDS

SEQ ID NO: 92961 - protein, 9 aa, Homo sapiens
  light chain complementarity determining region 3 for antibody 46481
QQYVNLPLT

SEQ ID NO: 92962 - protein, 19 aa, Homo sapiens
  heavy chain complementarity determining region 3 for antibody 46481
TRGAHIVVVTSFHTYNVDY

SEQ ID NO: 92963 - protein, 9 aa, Homo sapiens
  light chain complementarity determining region 3 for antibody 46482
QQYVDSPLT

SEQ ID NO: 92964 - protein, 12 aa, Homo sapiens
  heavy chain complementarity determining region 3 for antibody 46482
ASGSKGFGESHY

SEQ ID NO: 92965 - protein, 9 aa, Homo sapiens
  light chain complementarity determining region 3 for antibody 46483
QQYTTYPLT

SEQ ID NO: 92966 - protein, 13 aa, Homo sapiens
  heavy chain complementarity determining region 3 for antibody 46483
TRGSSHGNDAFDI

SEQ ID NO: 92967 - protein, 11 aa, Homo sapiens
  light chain complementarity determining region 3 for antibody 46484
QQYTGWPPAGT

SEQ ID NO: 92968 - protein, 14 aa, Homo sapiens
  heavy chain complementarity determining region 3 for antibody 46484
ARPQPGNFYHGMDV

SEQ ID NO: 92969 - protein, 10 aa, Homo sapiens
  light chain complementarity determining region 3 for antibody 46485
QQYSTTPMYT

SEQ ID NO: 92970 - protein, 18 aa, Homo sapiens
  heavy chain complementarity determining region 3 for antibody 46485
AKDEGAHPSEYGFWYLAL

SEQ ID NO: 92971 - protein, 10 aa, Homo sapiens
  light chain complementarity determining region 3 for antibody 46486
QQYSTSPPWT

SEQ ID NO: 92972 - protein, 20 aa, Homo sapiens
  heavy chain complementarity determining region 3 for antibody 46486
VRSHWPNYGSGNHYNRGFDP

SEQ ID NO: 92973 - protein, 9 aa, Homo sapiens
  light chain complementarity determining region 3 for antibody 46487
QQYSTFPLS

SEQ ID NO: 92974 - protein, 15 aa, Homo sapiens
  heavy chain complementarity determining region 3 for antibody 46487
ARGSRSGHYYYGMDV

SEQ ID NO: 92975 - protein, 10 aa, Homo sapiens
  light chain complementarity determining region 3 for antibody 46488
QQYSSWPPLA

SEQ ID NO: 92976 - protein, 15 aa, Homo sapiens
  heavy chain complementarity determining region 3 for antibody 46488
ARNLEQWQVNHFFDS

SEQ ID NO: 92977 - protein, 9 aa, Homo sapiens
  light chain complementarity determining region 3 for antibody 46489
QQYSSTPWT

SEQ ID NO: 92978 - protein, 18 aa, Homo sapiens
  heavy chain complementarity determining region 3 for antibody 46489
ARDIGFGVRGIKRGHFDH

SEQ ID NO: 92979 - protein, 9 aa, Homo sapiens
  light chain complementarity determining region 3 for antibody 46490
QQYSSTPNT

SEQ ID NO: 92980 - protein, 21 aa, Homo sapiens
  heavy chain complementarity determining region 3 for antibody 46490
AREKIWGHHGDDTPGAPYFDF

SEQ ID NO: 92981 - protein, 9 aa, Homo sapiens
  light chain complementarity determining region 3 for antibody 46491
QQYSSSPLT

SEQ ID NO: 92982 - protein, 15 aa, Homo sapiens
  heavy chain complementarity determining region 3 for antibody 46491
ATGRIVAAKNVHFDY

SEQ ID NO: 92983 - protein, 10 aa, Homo sapiens
  light chain complementarity determining region 3 for antibody 46492
QQYSPSPPWT

SEQ ID NO: 92984 - protein, 16 aa, Homo sapiens
  heavy chain complementarity determining region 3 for antibody 46492
ARRQWVRGLSRGGLDS

SEQ ID NO: 92985 - protein, 9 aa, Homo sapiens
  light chain complementarity determining region 3 for antibody 46493
QQYSNSPRT

SEQ ID NO: 92986 - protein, 17 aa, Homo sapiens
  heavy chain complementarity determining region 3 for antibody 46493
ARDGMPSKRWPDNFFDA

SEQ ID NO: 92987 - protein, 9 aa, Homo sapiens
  light chain complementarity determining region 3 for antibody 46494
QQYSNSPRP

SEQ ID NO: 92988 - protein, 15 aa, Homo sapiens
  heavy chain complementarity determining region 3 for antibody 46494
AGDLAGSRQGGWFDP

SEQ ID NO: 92989 - protein, 9 aa, Homo sapiens
  light chain complementarity determining region 3 for antibody 46495
QQYSISLFF

SEQ ID NO: 92990 - protein, 19 aa, Homo sapiens
  heavy chain complementarity determining region 3 for antibody 46495
VSGLGESGDHEGVGYTGDH

SEQ ID NO: 92991 - protein, 9 aa, Homo sapiens
  light chain complementarity determining region 3 for antibody 46496
QQYSGFPYT

SEQ ID NO: 92992 - protein, 27 aa, Homo sapiens
  heavy chain complementarity determining region 3 for antibody 46496
VTDQGEVIGVDMGPPPMVRRASGWFGP

SEQ ID NO: 92993 - protein, 9 aa, Homo sapiens
  light chain complementarity determining region 3 for antibody 46497
QQYRSYMWT

SEQ ID NO: 92994 - protein, 10 aa, Homo sapiens
  heavy chain complementarity determining region 3 for antibody 46497
ASLGVAGTHS

SEQ ID NO: 92995 - protein, 8 aa, Homo sapiens
  light chain complementarity determining region 3 for antibody 46498
QQYRRSFP

SEQ ID NO: 92996 - protein, 13 aa, Homo sapiens
  heavy chain complementarity determining region 3 for antibody 46498
ATESGWYQGAFDI

SEQ ID NO: 92997 - protein, 8 aa, Homo sapiens
  light chain complementarity determining region 3 for antibody 46499
QQYRASFP

SEQ ID NO: 92998 - protein, 13 aa, Homo sapiens
  heavy chain complementarity determining region 3 for antibody 46499
ATESGRYQGAFDF

SEQ ID NO: 92999 - protein, 9 aa, Homo sapiens
  light chain complementarity determining region 3 for antibody 46500
QQYPNYPII

SEQ ID NO: 93000 - protein, 16 aa, Homo sapiens
  heavy chain complementarity determining region 3 for antibody 46500
ARSAEGAVIPRWFGEF

SEQ ID NO: 93001 - protein, 9 aa, Homo sapiens
  light chain complementarity determining region 3 for antibody 46501
QQYNYWPLT

SEQ ID NO: 93002 - protein, 13 aa, Homo sapiens
  heavy chain complementarity determining region 3 for antibody 46501
ARARDVVGDPFDS

SEQ ID NO: 93003 - protein, 10 aa, Homo sapiens
  light chain complementarity determining region 3 for antibody 46502
QQYNWFSRRT

SEQ ID NO: 93004 - protein, 14 aa, Homo sapiens
  heavy chain complementarity determining region 3 for antibody 46502
ATDLTYASGIGLGV

SEQ ID NO: 93005 - protein, 10 aa, Homo sapiens
  light chain complementarity determining region 3 for antibody 46503
QQYNTWPPLT

SEQ ID NO: 93006 - protein, 14 aa, Homo sapiens
  heavy chain complementarity determining region 3 for antibody 46503
ARSLWAAPGTPPAY

SEQ ID NO: 93007 - protein, 8 aa, Homo sapiens
  light chain complementarity determining region 3 for antibody 46504
QQYNSYWT

SEQ ID NO: 93008 - protein, 15 aa, Homo sapiens
  heavy chain complementarity determining region 3 for antibody 46504
ARDHYAGSSGGSFDV

SEQ ID NO: 93009 - protein, 8 aa, Homo sapiens
  light chain complementarity determining region 3 for antibody 46505
QQYNSYWT

SEQ ID NO: 93010 - protein, 16 aa, Homo sapiens
  heavy chain complementarity determining region 3 for antibody 46505
AKDQGGSSVAMTVFDQ

SEQ ID NO: 93011 - protein, 8 aa, Homo sapiens
  light chain complementarity determining region 3 for antibody 46506
QQYNSYWP

SEQ ID NO: 93012 - protein, 19 aa, Homo sapiens
  heavy chain complementarity determining region 3 for antibody 46506
AREAGYCSGDSCIQGWFDP

SEQ ID NO: 93013 - protein, 7 aa, Homo sapiens
  light chain complementarity determining region 3 for antibody 46507
QQYNSYT

SEQ ID NO: 93014 - protein, 12 aa, Homo sapiens
  heavy chain complementarity determining region 3 for antibody 46507
ASRKDPYSSFDL

SEQ ID NO: 93015 - protein, 9 aa, Homo sapiens
  light chain complementarity determining region 3 for antibody 46508
QQYNSYSYT

SEQ ID NO: 93016 - protein, 18 aa, Homo sapiens
  heavy chain complementarity determining region 3 for antibody 46508
ATLPWYYSDSSGRDGLDI

SEQ ID NO: 93017 - protein, 9 aa, Homo sapiens
  light chain complementarity determining region 3 for antibody 46509
QQYNSYSYT

SEQ ID NO: 93018 - protein, 11 aa, Homo sapiens
  heavy chain complementarity determining region 3 for antibody 46509
AREVGGRWFDY

SEQ ID NO: 93019 - protein, 9 aa, Homo sapiens
  light chain complementarity determining region 3 for antibody 46510
QQYNSYSYI

SEQ ID NO: 93020 - protein, 11 aa, Homo sapiens
  heavy chain complementarity determining region 3 for antibody 46510
ARENGEDGFDI

SEQ ID NO: 93021 - protein, 9 aa, Homo sapiens
  light chain complementarity determining region 3 for antibody 46511
QQYNSYSWT

SEQ ID NO: 93022 - protein, 15 aa, Homo sapiens
  heavy chain complementarity determining region 3 for antibody 46511
ARDPYYGGRIGGIDV

SEQ ID NO: 93023 - protein, 8 aa, Homo sapiens
  light chain complementarity determining region 3 for antibody 46512
QQYNSYST

SEQ ID NO: 93024 - protein, 22 aa, Homo sapiens
  heavy chain complementarity determining region 3 for antibody 46512
ARRRTLPRDCSAGSCYHGAFDY

SEQ ID NO: 93025 - protein, 9 aa, Homo sapiens
  light chain complementarity determining region 3 for antibody 46513
QQYNSYSAT

SEQ ID NO: 93026 - protein, 13 aa, Homo sapiens
  heavy chain complementarity determining region 3 for antibody 46513
ARKGDQKSSAYDI

SEQ ID NO: 93027 - protein, 8 aa, Homo sapiens
  light chain complementarity determining region 3 for antibody 46514
QQYNSYSA

SEQ ID NO: 93028 - protein, 15 aa, Homo sapiens
  heavy chain complementarity determining region 3 for antibody 46514
ARGQNLVRMHDALDF

SEQ ID NO: 93029 - protein, 8 aa, Homo sapiens
  light chain complementarity determining region 3 for antibody 46515
QQYNSYRP

SEQ ID NO: 93030 - protein, 13 aa, Homo sapiens
  heavy chain complementarity determining region 3 for antibody 46515
ARESGSGWPYFEY

SEQ ID NO: 93031 - protein, 9 aa, Homo sapiens
  light chain complementarity determining region 3 for antibody 46516
QQYNSYPWT

SEQ ID NO: 93032 - protein, 18 aa, Homo sapiens
  heavy chain complementarity determining region 3 for antibody 46516
AREGWGDGLRGQRPGFDY

SEQ ID NO: 93033 - protein, 10 aa, Homo sapiens
  light chain complementarity determining region 3 for antibody 46517
QQYNSYPPWT

SEQ ID NO: 93034 - protein, 21 aa, Homo sapiens
  heavy chain complementarity determining region 3 for antibody 46517
TRDKGEGADFRYGYSFGAFDI

SEQ ID NO: 93035 - protein, 9 aa, Homo sapiens
  light chain complementarity determining region 3 for antibody 46518
QQYNSYPPP

SEQ ID NO: 93036 - protein, 29 aa, Homo sapiens
  heavy chain complementarity determining region 3 for antibody 46518
ARDRGRGFPPPRGRYDRSSYYPLDHGLDV

SEQ ID NO: 93037 - protein, 9 aa, Homo sapiens
  light chain complementarity determining region 3 for antibody 46519
QQYNSYPLT

SEQ ID NO: 93038 - protein, 16 aa, Homo sapiens
  heavy chain complementarity determining region 3 for antibody 46519
ARSHFKSKTGSYYFDS

SEQ ID NO: 93039 - protein, 9 aa, Homo sapiens
  light chain complementarity determining region 3 for antibody 46520
QQYNSYPHT

SEQ ID NO: 93040 - protein, 26 aa, Homo sapiens
  heavy chain complementarity determining region 3 for antibody 46520
ARDPEGGYYYEPSGVYGNYYYYGMDV

SEQ ID NO: 93041 - protein, 9 aa, Homo sapiens
  light chain complementarity determining region 3 for antibody 46521
QQYNSYLGT

SEQ ID NO: 93042 - protein, 18 aa, Homo sapiens
  heavy chain complementarity determining region 3 for antibody 46521
ARGYYDLLTGYYVKGVDY

SEQ ID NO: 93043 - protein, 7 aa, Homo sapiens
  light chain complementarity determining region 3 for antibody 46522
QQYNSWT

SEQ ID NO: 93044 - protein, 14 aa, Homo sapiens
  heavy chain complementarity determining region 3 for antibody 46522
ARMRLDRGSYFIDY

SEQ ID NO: 93045 - protein, 10 aa, Homo sapiens
  light chain complementarity determining region 3 for antibody 46523
QQYNSVSPYT

SEQ ID NO: 93046 - protein, 15 aa, Homo sapiens
  heavy chain complementarity determining region 3 for antibody 46523
ALSCGGHCNSVPGRY

SEQ ID NO: 93047 - protein, 10 aa, Homo sapiens
  light chain complementarity determining region 3 for antibody 46524
QQYNSFFPVT

SEQ ID NO: 93048 - protein, 14 aa, Homo sapiens
  heavy chain complementarity determining region 3 for antibody 46524
ARRVAVAGMWYFDL

SEQ ID NO: 93049 - protein, 9 aa, Homo sapiens
  light chain complementarity determining region 3 for antibody 46525
QQYNSAPRT

SEQ ID NO: 93050 - protein, 9 aa, Homo sapiens
  heavy chain complementarity determining region 3 for antibody 46525
ATGREIDLF

SEQ ID NO: 93051 - protein, 9 aa, Homo sapiens
  light chain complementarity determining region 3 for antibody 46526
QQYNRYPPT

SEQ ID NO: 93052 - protein, 18 aa, Homo sapiens
  heavy chain complementarity determining region 3 for antibody 46526
VKEDCGGDCYVGLDVFDI

SEQ ID NO: 93053 - protein, 8 aa, Homo sapiens
  light chain complementarity determining region 3 for antibody 46527
QQYNRYLS

SEQ ID NO: 93054 - protein, 15 aa, Homo sapiens
  heavy chain complementarity determining region 3 for antibody 46527
AKSTVTTMSGGHVGS

SEQ ID NO: 93055 - protein, 9 aa, Homo sapiens
  light chain complementarity determining region 3 for antibody 46528
QQYNRDSWT

SEQ ID NO: 93056 - protein, 13 aa, Homo sapiens
  heavy chain complementarity determining region 3 for antibody 46528
ARGPDYDPGCLDY

SEQ ID NO: 93057 - protein, 9 aa, Homo sapiens
  light chain complementarity determining region 3 for antibody 46529
QQYNRAPWT

SEQ ID NO: 93058 - protein, 12 aa, Homo sapiens
  heavy chain complementarity determining region 3 for antibody 46529
ATRAGITAIPDY

SEQ ID NO: 93059 - protein, 8 aa, Homo sapiens
  light chain complementarity determining region 3 for antibody 46530
QQYNNYST

SEQ ID NO: 93060 - protein, 16 aa, Homo sapiens
  heavy chain complementarity determining region 3 for antibody 46530
AKEAHITMVRSITTGY

SEQ ID NO: 93061 - protein, 10 aa, Homo sapiens
  light chain complementarity determining region 3 for antibody 46531
QQYNNYPMST

SEQ ID NO: 93062 - protein, 14 aa, Homo sapiens
  heavy chain complementarity determining region 3 for antibody 46531
VKDRIWQWLVPFAY

SEQ ID NO: 93063 - protein, 9 aa, Homo sapiens
  light chain complementarity determining region 3 for antibody 46532
QQYNNWPYT

SEQ ID NO: 93064 - protein, 10 aa, Homo sapiens
  heavy chain complementarity determining region 3 for antibody 46532
VVGVGVEMDS

SEQ ID NO: 93065 - protein, 9 aa, Homo sapiens
  light chain complementarity determining region 3 for antibody 46533
QQYNNWPYT

SEQ ID NO: 93066 - protein, 12 aa, Homo sapiens
  heavy chain complementarity determining region 3 for antibody 46533
ARALISHDAFDI

SEQ ID NO: 93067 - protein, 10 aa, Homo sapiens [sequence omitted]

SEQ ID NO: 93068 - protein, 15 aa, Homo sapiens
  heavy chain complementarity determining region 3 for antibody 46534
ARDAYEGSYLGYFDL

SEQ ID NO: 93069 - protein, 9 aa, Homo sapiens
  light chain complementarity determining region 3 for antibody 46535
QQYNNWPRT

SEQ ID NO: 93070 - protein, 12 aa, Homo sapiens
  heavy chain complementarity determining region 3 for antibody 46535
ARRVAGPRHFDY

SEQ ID NO: 93071 - protein, 10 aa, Homo sapiens
  light chain complementarity determining region 3 for antibody 46536
QQYNNWPPYT

SEQ ID NO: 93072 - protein, 18 aa, Homo sapiens
  heavy chain complementarity determining region 3 for antibody 46536
AGYDYDDTGYTVAGFFEF

SEQ ID NO: 93073 - protein, 10 aa, Homo sapiens [sequence omitted]

SEQ ID NO: 93074 - protein, 20 aa, Homo sapiens
  heavy chain complementarity determining region 3 for antibody 46537
ARGPWIVVAVSMPGEDYFNQ

SEQ ID NO: 93075 - protein, 10 aa, Homo sapiens
  light chain complementarity determining region 3 for antibody 46538
QQYNNWPPWA

SEQ ID NO: 93076 - protein, 13 aa, Homo sapiens
  heavy chain complementarity determining region 3 for antibody 46538
ARALGGSYAYLDF

SEQ ID NO: 93077 - protein, 11 aa, Homo sapiens
  light chain complementarity determining region 3 for antibody 46539
QQYNNWPPVLT

SEQ ID NO: 93078 - protein, 11 aa, Homo sapiens
  heavy chain complementarity determining region 3 for antibody 46539
ARFLANSGLDY

SEQ ID NO: 93079 - protein, 11 aa, Homo sapiens
  light chain complementarity determining region 3 for antibody 46540
QQYNNWPPMYP

SEQ ID NO: 93080 - protein, 13 aa, Homo sapiens
  heavy chain complementarity determining region 3 for antibody 46540
ARDPPGPDGAFNL

SEQ ID NO: 93081 - protein, 10 aa, Homo sapiens
  light chain complementarity determining region 3 for antibody 46541
QQYNNWPPIT

SEQ ID NO: 93082 - protein, 24 aa, Homo sapiens
  heavy chain complementarity determining region 3 for antibody 46541
ARQGTANLIAAAPSGPQYNYGIDV

SEQ ID NO: 93083 - protein, 10 aa, Homo sapiens
  light chain complementarity determining region 3 for antibody 46542
QQYNNWPPGT

SEQ ID NO: 93084 - protein, 15 aa, Homo sapiens
  heavy chain complementarity determining region 3 for antibody 46542
AKIGRQWLVWGYFDY

SEQ ID NO: 93085 - protein, 11 aa, Homo sapiens
  light chain complementarity determining region 3 for antibody 46543
QQYNNWPPEYT

SEQ ID NO: 93086 - protein, 16 aa, Homo sapiens
  heavy chain complementarity determining region 3 for antibody 46543
ARGGPQSFTYLDAFDI

SEQ ID NO: 93087 - protein, 11 aa, Homo sapiens
  light chain complementarity determining region 3 for antibody 46544
QQYNNWPPAGT

SEQ ID NO: 93088 - protein, 13 aa, Homo sapiens
  heavy chain complementarity determining region 3 for antibody 46544
ARDTSGGYNYFDY

SEQ ID NO: 93089 - protein, 9 aa, Homo sapiens
  light chain complementarity determining region 3 for antibody 46545
QQYNNWPIT

SEQ ID NO: 93090 - protein, 17 aa, Homo sapiens
  heavy chain complementarity determining region 3 for antibody 46545
ASRPSSSRGNYYAIFDY

SEQ ID NO: 93091 - protein, 9 aa, Homo sapiens
  light chain complementarity determining region 3 for antibody 46546
QQYNNWPGT

SEQ ID NO: 93092 - protein, 20 aa, Homo sapiens
  heavy chain complementarity determining region 3 for antibody 46546
ARDATPYYDFLTEAPDAFDM

SEQ ID NO: 93093 - protein, 9 aa, Homo sapiens
  light chain complementarity determining region 3 for antibody 46547
QQYNNWEWT

SEQ ID NO: 93094 - protein, 15 aa, Homo sapiens
  heavy chain complementarity determining region 3 for antibody 46547
AREYCTGGTCYPGNY

SEQ ID NO: 93095 - protein, 8 aa, Homo sapiens
  light chain complementarity determining region 3 for antibody 46548
QQYNNWCT

SEQ ID NO: 93096 - protein, 20 aa, Homo sapiens
  heavy chain complementarity determining region 3 for antibody 46548
ARDSYSINMLGLSLTGAFDF

SEQ ID NO: 93097 - protein, 9 aa, Homo sapiens
  light chain complementarity determining region 3 for antibody 46549
QQYNNFPYT

SEQ ID NO: 93098 - protein, 13 aa, Homo sapiens
  heavy chain complementarity determining region 3 for antibody 46549
ARFSSLSGLGLQD

SEQ ID NO: 93099 - protein, 10 aa, Homo sapiens
  light chain complementarity determining region 3 for antibody 46550
QQYNKWPLFT

SEQ ID NO: 93100 - protein, 12 aa, Homo sapiens
  heavy chain complementarity determining region 3 for antibody 46550
ARTFGYVRPFDF

SEQ ID NO: 93101 - protein, 9 aa, Homo sapiens
  light chain complementarity determining region 3 for antibody 46551
QQYNKRPLT

SEQ ID NO: 93102 - protein, 16 aa, Homo sapiens
  heavy chain complementarity determining region 3 for antibody 46551
ARLTESSGYHDEGFDI

SEQ ID NO: 93103 - protein, 9 aa, Homo sapiens
  light chain complementarity determining region 3 for antibody 46552
QQYNGYSYT

SEQ ID NO: 93104 - protein, 16 aa, Homo sapiens
  heavy chain complementarity determining region 3 for antibody 46552
ARATIRSNWFWTPFEY

SEQ ID NO: 93105 - protein, 8 aa, Homo sapiens
  light chain complementarity determining region 3 for antibody 46553
QQYNGYST

SEQ ID NO: 93106 - protein, 16 aa, Homo sapiens
  heavy chain complementarity determining region 3 for antibody 46553
ARGHRGFGELSLSLDY

SEQ ID NO: 93107 - protein, 9 aa, Homo sapiens
  light chain complementarity determining region 3 for antibody 46554
QQYNGYPFT

SEQ ID NO: 93108 - protein, 14 aa, Homo sapiens
  heavy chain complementarity determining region 3 for antibody 46554
ASHYYDYTGYYPWP

SEQ ID NO: 93109 - protein, 9 aa, Homo sapiens
  light chain complementarity determining region 3 for antibody 46555
QQYNGWPPT

SEQ ID NO: 93110 - protein, 14 aa, Homo sapiens
  heavy chain complementarity determining region 3 for antibody 46555
ARARSHGLLVYFDY

SEQ ID NO: 93111 - protein, 9 aa, Homo sapiens
  light chain complementarity determining region 3 for antibody 46556
QQYNDWPYT

SEQ ID NO: 93112 - protein, 8 aa, Homo sapiens
  heavy chain complementarity determining region 3 for antibody 46556
ARRYYFDY

SEQ ID NO: 93113 - protein, 9 aa, Homo sapiens
  light chain complementarity determining region 3 for antibody 46557
QQYNDWPQT

SEQ ID NO: 93114 - protein, 14 aa, Homo sapiens
  heavy chain complementarity determining region 3 for antibody 46557
ARALGRGYSYGYFS

SEQ ID NO: 93115 - protein, 10 aa, Homo sapiens
  light chain complementarity determining region 3 for antibody 46558
QQYNDWPPYT

SEQ ID NO: 93116 - protein, 15 aa, Homo sapiens
  heavy chain complementarity determining region 3 for antibody 46558
ARYNLGSLLFDPFDH

SEQ ID NO: 93117 - protein, 10 aa, Homo sapiens
  light chain complementarity determining region 3 for antibody 46559
QQYNDWPPWT

SEQ ID NO: 93118 - protein, 18 aa, Homo sapiens
  heavy chain complementarity determining region 3 for antibody 46559
VKVAHCVGACRWGGPLDY

SEQ ID NO: 93119 - protein, 8 aa, Homo sapiens
  light chain complementarity determining region 3 for antibody 46560
QQYNDWHT

SEQ ID NO: 93120 - protein, 14 aa, Homo sapiens
  heavy chain complementarity determining region 3 for antibody 46560
ARDGGGSSSWKVDY

SEQ ID NO: 93121 - protein, 9 aa, Homo sapiens
  light chain complementarity determining region 3 for antibody 46561
QQYNDHGVP

SEQ ID NO: 93122 - protein, 9 aa, Homo sapiens
  heavy chain complementarity determining region 3 for antibody 46561
ARGPIHFDY

SEQ ID NO: 93123 - protein, 8 aa, Homo sapiens
  light chain complementarity determining region 3 for antibody 46562
QQYLNTRT

SEQ ID NO: 93124 - protein, 19 aa, Homo sapiens
  heavy chain complementarity determining region 3 for antibody 46562
ARDKRGGPRHYDPSGYLDH

SEQ ID NO: 93125 - protein, 9 aa, Homo sapiens
  light chain complementarity determining region 3 for antibody 46563
QQYLITPVT

SEQ ID NO: 93126 - protein, 11 aa, Homo sapiens
  heavy chain complementarity determining region 3 for antibody 46563
AKIEGGGFAGY

SEQ ID NO: 93127 - protein, 9 aa, Homo sapiens
  light chain complementarity determining region 3 for antibody 46564
QQYKTYYRT

SEQ ID NO: 93128 - protein, 16 aa, Homo sapiens
  heavy chain complementarity determining region 3 for antibody 46564
GRLYHYDSGSYSPSDY

SEQ ID NO: 93129 - protein, 8 aa, Homo sapiens
  light chain complementarity determining region 3 for antibody 46565
QQYKSWPT

SEQ ID NO: 93130 - protein, 16 aa, Homo sapiens
  heavy chain complementarity determining region 3 for antibody 46565
AREVGGGYGEPQYFDD

SEQ ID NO: 93131 - protein, 9 aa, Homo sapiens
  light chain complementarity determining region 3 for antibody 46566
QQYKSWPLT

SEQ ID NO: 93132 - protein, 11 aa, Homo sapiens
  heavy chain complementarity determining region 3 for antibody 46566
AAATRWLAFDS

SEQ ID NO: 93133 - protein, 9 aa, Homo sapiens
  light chain complementarity determining region 3 for antibody 46567
QQYKSFPLP

SEQ ID NO: 93134 - protein, 12 aa, Homo sapiens
  heavy chain complementarity determining region 3 for antibody 46567
TRSPRGDYFFEY

SEQ ID NO: 93135 - protein, 9 aa, Homo sapiens
  light chain complementarity determining region 3 for antibody 46568
QQYKSFPIT

SEQ ID NO: 93136 - protein, 10 aa, Homo sapiens
  heavy chain complementarity determining region 3 for antibody 46568
ARWYNGPFDF

SEQ ID NO: 93137 - protein, 9 aa, Homo sapiens
  light chain complementarity determining region 3 for antibody 46569
QQYKRYANT

SEQ ID NO: 93138 - protein, 14 aa, Homo sapiens
  heavy chain complementarity determining region 3 for antibody 46569
AKDGSGSYSTYFDH

SEQ ID NO: 93139 - protein, 10 aa, Homo sapiens
  light chain complementarity determining region 3 for antibody 46570
QQYKDWPPWT

SEQ ID NO: 93140 - protein, 17 aa, Homo sapiens
  heavy chain complementarity determining region 3 for antibody 46570
ATSPDDRYGYNFYYFDF

SEQ ID NO: 93141 - protein, 8 aa, Homo sapiens
  light chain complementarity determining region 3 for antibody 46571
QQYIYWWT

SEQ ID NO: 93142 - protein, 11 aa, Homo sapiens
  heavy chain complementarity determining region 3 for antibody 46571
ARLSVVNYFDY

SEQ ID NO: 93143 - protein, 8 aa, Homo sapiens
  light chain complementarity determining region 3 for antibody 46572
QQYHSYFS

SEQ ID NO: 93144 - protein, 22 aa, Homo sapiens
  heavy chain complementarity determining region 3 for antibody 46572
ARAAGGESVVGPRGHFYYNMDV

SEQ ID NO: 93145 - protein, 9 aa, Homo sapiens
  light chain complementarity determining region 3 for antibody 46573
QQYHKSPWT

SEQ ID NO: 93146 - protein, 14 aa, Homo sapiens
  heavy chain complementarity determining region 3 for antibody 46573
ARPDDGNLGNAFDI

SEQ ID NO: 93147 - protein, 9 aa, Homo sapiens
  light chain complementarity determining region 3 for antibody 46574
QQYHDYSLT

SEQ ID NO: 93148 - protein, 14 aa, Homo sapiens
  heavy chain complementarity determining region 3 for antibody 46574
ARGDLVDSSSHYDY

SEQ ID NO: 93149 - protein, 9 aa, Homo sapiens
  light chain complementarity determining region 3 for antibody 46575
QQYHDLPFT

SEQ ID NO: 93150 - protein, 18 aa, Homo sapiens
  heavy chain complementarity determining region 3 for antibody 46575
ARQIGYGDYASYHGYCDL

SEQ ID NO: 93151 - protein, 9 aa, Homo sapiens
  light chain complementarity determining region 3 for antibody 46576
QQYGYSPFA

SEQ ID NO: 93152 - protein, 16 aa, Homo sapiens
  heavy chain complementarity determining region 3 for antibody 46576
AKTSRGAVTGPPYFNY

SEQ ID NO: 93153 - protein, 9 aa, Homo sapiens
  light chain complementarity determining region 3 for antibody 46577
QQYGTSSWP

SEQ ID NO: 93154 - protein, 16 aa, Homo sapiens
  heavy chain complementarity determining region 3 for antibody 46577
ARNGRTCSRGICSCDY

SEQ ID NO: 93155 - protein, 9 aa, Homo sapiens
  light chain complementarity determining region 3 for antibody 46578
QQYGTSSRT

SEQ ID NO: 93156 - protein, 22 aa, Homo sapiens
  heavy chain complementarity determining region 3 for antibody 46578
AREYYARSGSGFHSYSYYGMDV

SEQ ID NO: 93157 - protein, 9 aa, Homo sapiens
  light chain complementarity determining region 3 for antibody 46579
QQYGTSPYT

SEQ ID NO: 93158 - protein, 20 aa, Homo sapiens
  heavy chain complementarity determining region 3 for antibody 46579
TKESYYFDSSSYYVTVGFDP

SEQ ID NO: 93159 - protein, 9 aa, Homo sapiens
  light chain complementarity determining region 3 for antibody 46580
QQYGTSPYT

SEQ ID NO: 93160 - protein, 14 aa, Homo sapiens
  heavy chain complementarity determining region 3 for antibody 46580
ARDPHSGSGSYFDY

SEQ ID NO: 93161 - protein, 9 aa, Homo sapiens
  light chain complementarity determining region 3 for antibody 46581
QQYGTSPWT

SEQ ID NO: 93162 - protein, 19 aa, Homo sapiens
  heavy chain complementarity determining region 3 for antibody 46581
ARGQYDTTSRYYFYYPMDV

SEQ ID NO: 93163 - protein, 10 aa, Homo sapiens
  light chain complementarity determining region 3 for antibody 46582
QQYGTSPPYT

SEQ ID NO: 93164 - protein, 12 aa, Homo sapiens
  heavy chain complementarity determining region 3 for antibody 46582
ANEVGPAPAYDV

SEQ ID NO: 93165 - protein, 10 aa, Homo sapiens
  light chain complementarity determining region 3 for antibody 46583
QQYGTSPPWT

SEQ ID NO: 93166 - protein, 20 aa, Homo sapiens
  heavy chain complementarity determining region 3 for antibody 46583
AHGRRFSVKPDGSGFYYFDY

SEQ ID NO: 93167 - protein, 9 aa, Homo sapiens
  light chain complementarity determining region 3 for antibody 46584
QQYGTSPPT

SEQ ID NO: 93168 - protein, 13 aa, Homo sapiens
  heavy chain complementarity determining region 3 for antibody 46584
ARVDRGWYEGFGL

SEQ ID NO: 93169 - protein, 11 aa, Homo sapiens
  light chain complementarity determining region 3 for antibody 46585
QQYGTSPPRPP

SEQ ID NO: 93170 - protein, 9 aa, Homo sapiens
  heavy chain complementarity determining region 3 for antibody 46585
ARGSTALGY

SEQ ID NO: 93171 - protein, 10 aa, Homo sapiens
  light chain complementarity determining region 3 for antibody 46586
QQYGTSPPGT

SEQ ID NO: 93172 - protein, 16 aa, Homo sapiens
  heavy chain complementarity determining region 3 for antibody 46586
ARRQWVRGLFRGGLDY

SEQ ID NO: 93173 - protein, 9 aa, Homo sapiens
  light chain complementarity determining region 3 for antibody 46587
QQYGTSPFN

SEQ ID NO: 93174 - protein, 9 aa, Homo sapiens
  heavy chain complementarity determining region 3 for antibody 46587
ARGAGSLSY

SEQ ID NO: 93175 - protein, 9 aa, Homo sapiens
  light chain complementarity determining region 3 for antibody 46588
QQYGTSLLT

SEQ ID NO: 93176 - protein, 17 aa, Homo sapiens
  heavy chain complementarity determining region 3 for antibody 46588
ARSTSIRRHFGGQGFDS

SEQ ID NO: 93177 - protein, 9 aa, Homo sapiens
  light chain complementarity determining region 3 for antibody 46589
QQYGTLPFT

SEQ ID NO: 93178 - protein, 9 aa, Homo sapiens
  heavy chain complementarity determining region 3 for antibody 46589
ARGAGSLSY

SEQ ID NO: 93179 - protein, 9 aa, Homo sapiens
  light chain complementarity determining region 3 for antibody 46590
QQYGTAPRM

SEQ ID NO: 93180 - protein, 12 aa, Homo sapiens
  heavy chain complementarity determining region 3 for antibody 46590
ARGSTYDPTFDY

SEQ ID NO: 93181 - protein, 10 aa, Homo sapiens
  light chain complementarity determining region 3 for antibody 46591
QQYGTAPPYP

SEQ ID NO: 93182 - protein, 16 aa, Homo sapiens
  heavy chain complementarity determining region 3 for antibody 46591
ARGWIGDVLWFGDLLY

SEQ ID NO: 93183 - protein, 9 aa, Homo sapiens
  light chain complementarity determining region 3 for antibody 46592
QQYGSTPLT

SEQ ID NO: 93184 - protein, 12 aa, Homo sapiens
  heavy chain complementarity determining region 3 for antibody 46592
ARNGYSSSWYRN

SEQ ID NO: 93185 - protein, 9 aa, Homo sapiens
  light chain complementarity determining region 3 for antibody 46593
QQYGSSTFT

SEQ ID NO: 93186 - protein, 10 aa, Homo sapiens
  heavy chain complementarity determining region 3 for antibody 46593
AKVGMDGFGP

SEQ ID NO: 93187 - protein, 9 aa, Homo sapiens
  light chain complementarity determining region 3 for antibody 46594
QQYGSSSWR

SEQ ID NO: 93188 - protein, 19 aa, Homo sapiens
  heavy chain complementarity determining region 3 for antibody 46594
ARRPATPRFLEWLPDASDI

SEQ ID NO: 93189 - protein, 9 aa, Homo sapiens
  light chain complementarity determining region 3 for antibody 46595
QQYGSSSSP

SEQ ID NO: 93190 - protein, 7 aa, Homo sapiens
  heavy chain complementarity determining region 3 for antibody 46595
ASPYFDL

SEQ ID NO: 93191 - protein, 10 aa, Homo sapiens
  light chain complementarity determining region 3 for antibody 46596
QQYGSSSRGT

SEQ ID NO: 93192 - protein, 20 aa, Homo sapiens
  heavy chain complementarity determining region 3 for antibody 46596
ARLGFCTGDHCWAKVWFFDL

SEQ ID NO: 93193 - protein, 9 aa, Homo sapiens
  light chain complementarity determining region 3 for antibody 46597
QQYGSSSLP

SEQ ID NO: 93194 - protein, 13 aa, Homo sapiens
  heavy chain complementarity determining region 3 for antibody 46597
ATESGSYYGGLDY

SEQ ID NO: 93195 - protein, 9 aa, Homo sapiens
  light chain complementarity determining region 3 for antibody 46598
QQYGSSSIT

SEQ ID NO: 93196 - protein, 17 aa, Homo sapiens
  heavy chain complementarity determining region 3 for antibody 46598
VRGSWQWMVPDVYSVDY

SEQ ID NO: 93197 - protein, 9 aa, Homo sapiens
  light chain complementarity determining region 3 for antibody 46599
QQYGSSSIT

SEQ ID NO: 93198 - protein, 13 aa, Homo sapiens
  heavy chain complementarity determining region 3 for antibody 46599
VKEYFMVFDAFDM

SEQ ID NO: 93199 - protein, 10 aa, Homo sapiens
  light chain complementarity determining region 3 for antibody 46600
QQYGSSPYVR

SEQ ID NO: 93200 - protein, 15 aa, Homo sapiens
  heavy chain complementarity determining region 3 for antibody 46600
ARDIGGDSGYGYFEY

SEQ ID NO: 93201 - protein, 9 aa, Homo sapiens
  light chain complementarity determining region 3 for antibody 46601
QQYGSSPYT

SEQ ID NO: 93202 - protein, 18 aa, Homo sapiens
  heavy chain complementarity determining region 3 for antibody 46601
VTAPSANYFDSSVAYGGF

SEQ ID NO: 93203 - protein, 9 aa, Homo sapiens
  light chain complementarity determining region 3 for antibody 46602
QQYGSSPYT

SEQ ID NO: 93204 - protein, 17 aa, Homo sapiens
  heavy chain complementarity determining region 3 for antibody 46602
ARPPLRYYDRSGYPFGY

SEQ ID NO: 93205 - protein, 9 aa, Homo sapiens
  light chain complementarity determining region 3 for antibody 46603
QQYGSSPYP

SEQ ID NO: 93206 - protein, 16 aa, Homo sapiens
  heavy chain complementarity determining region 3 for antibody 46603
ATRGPSHYGAGTYLAA

SEQ ID NO: 93207 - protein, 10 aa, Homo sapiens
  light chain complementarity determining region 3 for antibody 46604
QQYGSSPYGT

SEQ ID NO: 93208 - protein, 15 aa, Homo sapiens
  heavy chain complementarity determining region 3 for antibody 46604
ARDIGGDSGYGYFEY

SEQ ID NO: 93209 - protein, 9 aa, Homo sapiens
  light chain complementarity determining region 3 for antibody 46605
QQYGSSPWT

SEQ ID NO: 93210 - protein, 17 aa, Homo sapiens
  heavy chain complementarity determining region 3 for antibody 46605
ARGGAYYDSSGYAQFDY

SEQ ID NO: 93211 - protein, 10 aa, Homo sapiens
  light chain complementarity determining region 3 for antibody 46606
QQYGSSPSIT

SEQ ID NO: 93212 - protein, 13 aa, Homo sapiens
  heavy chain complementarity determining region 3 for antibody 46606
ATTRSSWYNPIDY

SEQ ID NO: 93213 - protein, 10 aa, Homo sapiens
  light chain complementarity determining region 3 for antibody 46607
QQYGSSPRYT

SEQ ID NO: 93214 - protein, 15 aa, Homo sapiens
  heavy chain complementarity determining region 3 for antibody 46607
ARGGYYDSSGDAFDI

SEQ ID NO: 93215 - protein, 9 aa, Homo sapiens
  light chain complementarity determining region 3 for antibody 46608
QQYGSSPRT

SEQ ID NO: 93216 - protein, 17 aa, Homo sapiens
  heavy chain complementarity determining region 3 for antibody 46608
ARVRYYDNKNWYWAMDV

SEQ ID NO: 93217 - protein, 9 aa, Homo sapiens
  light chain complementarity determining region 3 for antibody 46609
QQYGSSPRT

SEQ ID NO: 93218 - protein, 12 aa, Homo sapiens
  heavy chain complementarity determining region 3 for antibody 46609
ARSGYTVTPFDH

SEQ ID NO: 93219 - protein, 9 aa, Homo sapiens
  light chain complementarity determining region 3 for antibody 46610
QQYGSSPRT

SEQ ID NO: 93220 - protein, 13 aa, Homo sapiens
  heavy chain complementarity determining region 3 for antibody 46610
ARMALMYDSSLGH

SEQ ID NO: 93221 - protein, 9 aa, Homo sapiens
  light chain complementarity determining region 3 for antibody 46611
QQYGSSPRT

SEQ ID NO: 93222 - protein, 14 aa, Homo sapiens
  heavy chain complementarity determining region 3 for antibody 46611
ARDGGVGAAGAFDI

SEQ ID NO: 93223 - protein, 10 aa, Homo sapiens
  light chain complementarity determining region 3 for antibody 46612
QQYGSSPRPT

SEQ ID NO: 93224 - protein, 17 aa, Homo sapiens
  heavy chain complementarity determining region 3 for antibody 46612
TRALRGYSTGWHGLFGY

SEQ ID NO: 93225 - protein, 9 aa, Homo sapiens
  light chain complementarity determining region 3 for antibody 46613
QQYGSSPRP

SEQ ID NO: 93226 - protein, 16 aa, Homo sapiens
  heavy chain complementarity determining region 3 for antibody 46613
AKDLRKLGSGWRFMDV

SEQ ID NO: 93227 - protein, 10 aa, Homo sapiens
  light chain complementarity determining region 3 for antibody 46614
QQYGSSPRDT

SEQ ID NO: 93228 - protein, 12 aa, Homo sapiens
  heavy chain complementarity determining region 3 for antibody 46614
ARGGSGGTAFDY

SEQ ID NO: 93229 - protein, 9 aa, Homo sapiens
  light chain complementarity determining region 3 for antibody 46615
QQYGSSPQT

SEQ ID NO: 93230 - protein, 14 aa, Homo sapiens
  heavy chain complementarity determining region 3 for antibody 46615
ARGDSSGYLPHFGY

SEQ ID NO: 93231 - protein, 10 aa, Homo sapiens
  light chain complementarity determining region 3 for antibody 46616
QQYGSSPPWT

SEQ ID NO: 93232 - protein, 10 aa, Homo sapiens
  heavy chain complementarity determining region 3 for antibody 46616
ARISKWFGGT

SEQ ID NO: 93233 - protein, 12 aa, Homo sapiens
  light chain complementarity determining region 3 for antibody 46617
QQYGSSPPWPGT

SEQ ID NO: 93234 - protein, 14 aa, Homo sapiens
  heavy chain complementarity determining region 3 for antibody 46617
VRGGSSGYYHQLDY

SEQ ID NO: 93235 - protein, 11 aa, Homo sapiens
  light chain complementarity determining region 3 for antibody 46618
QQYGSSPPMST

SEQ ID NO: 93236 - protein, 11 aa, Homo sapiens
  heavy chain complementarity determining region 3 for antibody 46618
ARSDGAVAGGH

SEQ ID NO: 93237 - protein, 11 aa, Homo sapiens
  light chain complementarity determining region 3 for antibody 46619
QQYGSSPPMNT

SEQ ID NO: 93238 - protein, 19 aa, Homo sapiens
  heavy chain complementarity determining region 3 for antibody 46619
ARDGGLVVVPAATRSYFDF

SEQ ID NO: 93239 - protein, 9 aa, Homo sapiens
  light chain complementarity determining region 3 for antibody 46620
QQYGSSPPA

SEQ ID NO: 93240 - protein, 15 aa, Homo sapiens
  heavy chain complementarity determining region 3 for antibody 46620
ARERSYGNVVPYFDY

SEQ ID NO: 93241 - protein, 9 aa, Homo sapiens
  light chain complementarity determining region 3 for antibody 46621
QQYGSSPLT

SEQ ID NO: 93242 - protein, 19 aa, Homo sapiens
  heavy chain complementarity determining region 3 for antibody 46621
ARETVITVVGVFIKGGMDV

SEQ ID NO: 93243 - protein, 9 aa, Homo sapiens
  light chain complementarity determining region 3 for antibody 46622
QQYGSSPLT

SEQ ID NO: 93244 - protein, 11 aa, Homo sapiens
  heavy chain complementarity determining region 3 for antibody 46622
AREGNYKPHDY

SEQ ID NO: 93245 - protein, 9 aa, Homo sapiens
  light chain complementarity determining region 3 for antibody 46623
QQYGSSPLT

SEQ ID NO: 93246 - protein, 15 aa, Homo sapiens
  heavy chain complementarity determining region 3 for antibody 46623
AKSQSPFLDIDIFNM

SEQ ID NO: 93247 - protein, 9 aa, Homo sapiens
  light chain complementarity determining region 3 for antibody 46624
QQYGSSPLT

SEQ ID NO: 93248 - protein, 16 aa, Homo sapiens
  heavy chain complementarity determining region 3 for antibody 46624
AKGDRDGLWFGELPDH

SEQ ID NO: 93249 - protein, 9 aa, Homo sapiens
  light chain complementarity determining region 3 for antibody 46625
QQYGSSPLT

SEQ ID NO: 93250 - protein, 17 aa, Homo sapiens
  heavy chain complementarity determining region 3 for antibody 46625
AKDVHSRQGKYYYGMDV

SEQ ID NO: 93251 - protein, 11 aa, Homo sapiens
  light chain complementarity determining region 3 for antibody 46626
QQYGSSPLAYT

SEQ ID NO: 93252 - protein, 14 aa, Homo sapiens
  heavy chain complementarity determining region 3 for antibody 46626
ARRGALGNLRYFDY

SEQ ID NO: 93253 - protein, 10 aa, Homo sapiens
  light chain complementarity determining region 3 for antibody 46627
QQYGSSPKNT

SEQ ID NO: 93254 - protein, 24 aa, Homo sapiens
  heavy chain complementarity determining region 3 for antibody 46627
ARDRGTGDSSGWYSSSYYYYAMDV

SEQ ID NO: 93255 - protein, 9 aa, Homo sapiens
  light chain complementarity determining region 3 for antibody 46628
QQYGSSPIT

SEQ ID NO: 93256 - protein, 14 aa, Homo sapiens
  heavy chain complementarity determining region 3 for antibody 46628
ARPRDNSGYFAFDL

SEQ ID NO: 93257 - protein, 9 aa, Homo sapiens
  light chain complementarity determining region 3 for antibody 46629
QQYGSSPGT

SEQ ID NO: 93258 - protein, 15 aa, Homo sapiens
  heavy chain complementarity determining region 3 for antibody 46629
ARGLFPMEDASGSDR

SEQ ID NO: 93259 - protein, 9 aa, Homo sapiens
  light chain complementarity determining region 3 for antibody 46630
QQYGSSPGT

SEQ ID NO: 93260 - protein, 17 aa, Homo sapiens
  heavy chain complementarity determining region 3 for antibody 46630
ARGGAYYDSSGYDQFDY

SEQ ID NO: 93261 - protein, 9 aa, Homo sapiens
  light chain complementarity determining region 3 for antibody 46631
QQYGSSPFT

SEQ ID NO: 93262 - protein, 15 aa, Homo sapiens
  heavy chain complementarity determining region 3 for antibody 46631
ARVLLVGFEEYYFDY

SEQ ID NO: 93263 - protein, 9 aa, Homo sapiens
  light chain complementarity determining region 3 for antibody 46632
QQYGSSPFT

SEQ ID NO: 93264 - protein, 15 aa, Homo sapiens
  heavy chain complementarity determining region 3 for antibody 46632
AKDGAPMGFGEFYFF

SEQ ID NO: 93265 - protein, 9 aa, Homo sapiens
  light chain complementarity determining region 3 for antibody 46633
QQYGSSPFP

SEQ ID NO: 93266 - protein, 16 aa, Homo sapiens
  heavy chain complementarity determining region 3 for antibody 46633
VRFGPDTVTLRDAFDI

SEQ ID NO: 93267 - protein, 8 aa, Homo sapiens
  light chain complementarity determining region 3 for antibody 46634
QQYGSSPF

SEQ ID NO: 93268 - protein, 11 aa, Homo sapiens
  heavy chain complementarity determining region 3 for antibody 46634
ARGTTLVGAQD

SEQ ID NO: 93269 - protein, 9 aa, Homo sapiens
  light chain complementarity determining region 3 for antibody 46635
QQYGSSPAT

SEQ ID NO: 93270 - protein, 15 aa, Homo sapiens
  heavy chain complementarity determining region 3 for antibody 46635
VKDSSGWYWDDVFDV

SEQ ID NO: 93271 - protein, 10 aa, Homo sapiens
  light chain complementarity determining region 3 for antibody 46636
QQYGSSLTGT

SEQ ID NO: 93272 - protein, 12 aa, Homo sapiens
  heavy chain complementarity determining region 3 for antibody 46636
ARTYYGGWPFDY

SEQ ID NO: 93273 - protein, 9 aa, Homo sapiens
  light chain complementarity determining region 3 for antibody 46637
QQYGSSLIT

SEQ ID NO: 93274 - protein, 14 aa, Homo sapiens
  heavy chain complementarity determining region 3 for antibody 46637
ARALGFYGHDPFDI

SEQ ID NO: 93275 - protein, 9 aa, Homo sapiens
  light chain complementarity determining region 3 for antibody 46638
QQYGSSGRT

SEQ ID NO: 93276 - protein, 14 aa, Homo sapiens
  heavy chain complementarity determining region 3 for antibody 46638
ARDAPSYNYGAFDY

SEQ ID NO: 93277 - protein, 8 aa, Homo sapiens
  light chain complementarity determining region 3 for antibody 46639
QQYGSSFT

SEQ ID NO: 93278 - protein, 11 aa, Homo sapiens
  heavy chain complementarity determining region 3 for antibody 46639
TTGLGSGGTDY

SEQ ID NO: 93279 - protein, 8 aa, Homo sapiens
  light chain complementarity determining region 3 for antibody 46640
QQYGSSFP

SEQ ID NO: 93280 - protein, 11 aa, Homo sapiens
  heavy chain complementarity determining region 3 for antibody 46640
TTGLGSGGTNY

SEQ ID NO: 93281 - protein, 9 aa, Homo sapiens
  light chain complementarity determining region 3 for antibody 46641
QQYGSSFLT

SEQ ID NO: 93282 - protein, 6 aa, Homo sapiens
  heavy chain complementarity determining region 3 for antibody 46641
STHLVF

SEQ ID NO: 93283 - protein, 9 aa, Homo sapiens
  light chain complementarity determining region 3 for antibody 46642
QQYGSSFLT

SEQ ID NO: 93284 - protein, 15 aa, Homo sapiens
  heavy chain complementarity determining region 3 for antibody 46642
ARWGNDNGDYGRLDF

SEQ ID NO: 93285 - protein, 10 aa, Homo sapiens
  light chain complementarity determining region 3 for antibody 46643
QQYGSSFGNT

SEQ ID NO: 93286 - protein, 13 aa, Homo sapiens
  heavy chain complementarity determining region 3 for antibody 46643
ARGFYDTTGPFDY

SEQ ID NO: 93287 - protein, 9 aa, Homo sapiens
  light chain complementarity determining region 3 for antibody 46644
QQYGSPPRT

SEQ ID NO: 93288 - protein, 18 aa, Homo sapiens
  heavy chain complementarity determining region 3 for antibody 46644
ARVYGDFEGAYYYYGMDV

SEQ ID NO: 93289 - protein, 9 aa, Homo sapiens
  light chain complementarity determining region 3 for antibody 46645
QQYGSLPYT

SEQ ID NO: 93290 - protein, 10 aa, Homo sapiens
  heavy chain complementarity determining region 3 for antibody 46645
AREPNGAFDI

SEQ ID NO: 93291 - protein, 9 aa, Homo sapiens
  light chain complementarity determining region 3 for antibody 46646
QQYGSLPKT

SEQ ID NO: 93292 - protein, 23 aa, Homo sapiens
  heavy chain complementarity determining region 3 for antibody 46646
ARDDPVPVPMEEDGDYYYYGLDV

SEQ ID NO: 93293 - protein, 9 aa, Homo sapiens
  light chain complementarity determining region 3 for antibody 46647
QQYGSLPFT

SEQ ID NO: 93294 - protein, 12 aa, Homo sapiens
  heavy chain complementarity determining region 3 for antibody 46647
ARMLGFGSGLAY

SEQ ID NO: 93295 - protein, 9 aa, Homo sapiens
  light chain complementarity determining region 3 for antibody 46648
QQYGSLPFT

SEQ ID NO: 93296 - protein, 21 aa, Homo sapiens
  heavy chain complementarity determining region 3 for antibody 46648
ARAGRRGGGYKLIRAPDAFDV

SEQ ID NO: 93297 - protein, 9 aa, Homo sapiens
  light chain complementarity determining region 3 for antibody 46649
QQYGSLLRT

SEQ ID NO: 93298 - protein, 18 aa, Homo sapiens
  heavy chain complementarity determining region 3 for antibody 46649
GRDLVTTFGGVIIIPMDV

SEQ ID NO: 93299 - protein, 9 aa, Homo sapiens
  light chain complementarity determining region 3 for antibody 46650
QQYGSFPDS

SEQ ID NO: 93300 - protein, 17 aa, Homo sapiens
  heavy chain complementarity determining region 3 for antibody 46650
AREAFDSDVDDFHGLDV

SEQ ID NO: 93301 - protein, 9 aa, Homo sapiens
  light chain complementarity determining region 3 for antibody 46651
QQYGRTPLT

SEQ ID NO: 93302 - protein, 25 aa, Homo sapiens
  heavy chain complementarity determining region 3 for antibody 46651
ARDSDLGEYDEDGYYFPFKYYGMDV

SEQ ID NO: 93303 - protein, 9 aa, Homo sapiens
  light chain complementarity determining region 3 for antibody 46652
QQYGRSPWT

SEQ ID NO: 93304 - protein, 13 aa, Homo sapiens
  heavy chain complementarity determining region 3 for antibody 46652
ARHPLVRGVIIDY

SEQ ID NO: 93305 - protein, 9 aa, Homo sapiens
  light chain complementarity determining region 3 for antibody 46653
QQYGRSPRT

SEQ ID NO: 93306 - protein, 15 aa, Homo sapiens
  heavy chain complementarity determining region 3 for antibody 46653
AKDGEVCGSNCYFGS

SEQ ID NO: 93307 - protein, 9 aa, Homo sapiens
  light chain complementarity determining region 3 for antibody 46654
QQYGRSPRT

SEQ ID NO: 93308 - protein, 15 aa, Homo sapiens
  heavy chain complementarity determining region 3 for antibody 46654
AKDGELCGSNCYFGS

SEQ ID NO: 93309 - protein, 9 aa, Homo sapiens
  light chain complementarity determining region 3 for antibody 46655
QQYGRSPRT

SEQ ID NO: 93310 - protein, 15 aa, Homo sapiens
  heavy chain complementarity determining region 3 for antibody 46655
AKDGEFCGSNGYFGS

SEQ ID NO: 93311 - protein, 9 aa, Homo sapiens
  light chain complementarity determining region 3 for antibody 46656
QQYGRSPRT

SEQ ID NO: 93312 - protein, 15 aa, Homo sapiens
  heavy chain complementarity determining region 3 for antibody 46656
AKDGEFCGSNCYFGP

SEQ ID NO: 93313 - protein, 9 aa, Homo sapiens
  light chain complementarity determining region 3 for antibody 46657
QQYGRSPRK

SEQ ID NO: 93314 - protein, 15 aa, Homo sapiens
  heavy chain complementarity determining region 3 for antibody 46657
AKDGEFCGSNCYFGS

SEQ ID NO: 93315 - protein, 9 aa, Homo sapiens
  light chain complementarity determining region 3 for antibody 46658
QQYGRSPRA

SEQ ID NO: 93316 - protein, 15 aa, Homo sapiens
  heavy chain complementarity determining region 3 for antibody 46658
AKDGEFCGSNCYFGS

SEQ ID NO: 93317 - protein, 9 aa, Homo sapiens
  light chain complementarity determining region 3 for antibody 46659
QQYGRSPQT

SEQ ID NO: 93318 - protein, 12 aa, Homo sapiens
  heavy chain complementarity determining region 3 for antibody 46659
ARNGYSSSWYRN

SEQ ID NO: 93319 - protein, 9 aa, Homo sapiens
  light chain complementarity determining region 3 for antibody 46660
QQYGRSPLT

SEQ ID NO: 93320 - protein, 20 aa, Homo sapiens
  heavy chain complementarity determining region 3 for antibody 46660
AKDPGYCSGGTCSPWNWFDS

SEQ ID NO: 93321 - protein, 9 aa, Homo sapiens
  light chain complementarity determining region 3 for antibody 46661
QQYGRSPKT

SEQ ID NO: 93322 - protein, 16 aa, Homo sapiens
  heavy chain complementarity determining region 3 for antibody 46661
ARERANQFGVNDAFDI

SEQ ID NO: 93323 - protein, 8 aa, Homo sapiens
  light chain complementarity determining region 3 for antibody 46662
QQYGRSPG

SEQ ID NO: 93324 - protein, 17 aa, Homo sapiens
  heavy chain complementarity determining region 3 for antibody 46662
ASQYYYDSGAYKDAFDI

SEQ ID NO: 93325 - protein, 9 aa, Homo sapiens
  light chain complementarity determining region 3 for antibody 46663
QQYGRSPET

SEQ ID NO: 93326 - protein, 15 aa, Homo sapiens
  heavy chain complementarity determining region 3 for antibody 46663
ARRYCSYTICYALDY

SEQ ID NO: 93327 - protein, 9 aa, Homo sapiens
  light chain complementarity determining region 3 for antibody 46664
QQYGRSLYT

SEQ ID NO: 93328 - protein, 16 aa, Homo sapiens
  heavy chain complementarity determining region 3 for antibody 46664
ARAKHYGDYYYYGMDA

SEQ ID NO: 93329 - protein, 9 aa, Homo sapiens
  light chain complementarity determining region 3 for antibody 46665
QQYGRSHRT

SEQ ID NO: 93330 - protein, 15 aa, Homo sapiens
  heavy chain complementarity determining region 3 for antibody 46665
AKDGEFCGSNCYFGS

SEQ ID NO: 93331 - protein, 9 aa, Homo sapiens
  light chain complementarity determining region 3 for antibody 46666
QQYGRAPHT

SEQ ID NO: 93332 - protein, 12 aa, Homo sapiens
  heavy chain complementarity determining region 3 for antibody 46666
TALWYYSESSGH

SEQ ID NO: 93333 - protein, 9 aa, Homo sapiens
  light chain complementarity determining region 3 for antibody 46667
QQYGRAPFT

SEQ ID NO: 93334 - protein, 18 aa, Homo sapiens
  heavy chain complementarity determining region 3 for antibody 46667
AKAPLRACRGPSCYPLDP

SEQ ID NO: 93335 - protein, 10 aa, Homo sapiens
  light chain complementarity determining region 3 for antibody 46668
QQYGPSLTWT

SEQ ID NO: 93336 - protein, 12 aa, Homo sapiens
  heavy chain complementarity determining region 3 for antibody 46668
AVGYGSGWYWGD

SEQ ID NO: 93337 - protein, 9 aa, Homo sapiens
  light chain complementarity determining region 3 for antibody 46669
QQYGNSRIP

SEQ ID NO: 93338 - protein, 9 aa, Homo sapiens
  heavy chain complementarity determining region 3 for antibody 46669
ARGNWNYGY

SEQ ID NO: 93339 - protein, 9 aa, Homo sapiens
  light chain complementarity determining region 3 for antibody 46670
QQYGNSPST

SEQ ID NO: 93340 - protein, 25 aa, Homo sapiens
  heavy chain complementarity determining region 3 for antibody 46670
ARDSDLGEYDEDGYYFPFKYYGMDV

SEQ ID NO: 93341 - protein, 9 aa, Homo sapiens
  light chain complementarity determining region 3 for antibody 46671
QQYGNSPLT

SEQ ID NO: 93342 - protein, 13 aa, Homo sapiens
  heavy chain complementarity determining region 3 for antibody 46671
AKHKSVYDGSGVI

SEQ ID NO: 93343 - protein, 10 aa, Homo sapiens
  light chain complementarity determining region 3 for antibody 46672
QQYGNSPLFT

SEQ ID NO: 93344 - protein, 20 aa, Homo sapiens
  heavy chain complementarity determining region 3 for antibody 46672
ARWAGRVADSFPFVTFPLDF

SEQ ID NO: 93345 - protein, 10 aa, Homo sapiens
  light chain complementarity determining region 3 for antibody 46673
QQYGNSPEGT

SEQ ID NO: 93346 - protein, 14 aa, Homo sapiens
  heavy chain complementarity determining region 3 for antibody 46673
ARKSIRGSWSGFDV

SEQ ID NO: 93347 - protein, 9 aa, Homo sapiens
  light chain complementarity determining region 3 for antibody 46674
QQYGNSALT

SEQ ID NO: 93348 - protein, 12 aa, Homo sapiens
  heavy chain complementarity determining region 3 for antibody 46674
ARVASGFDPFDY

SEQ ID NO: 93349 - protein, 8 aa, Homo sapiens
  light chain complementarity determining region 3 for antibody 46675
QQYGNPRT

SEQ ID NO: 93350 - protein, 15 aa, Homo sapiens
  heavy chain complementarity determining region 3 for antibody 46675
AKTDYCSAANCPFDS

SEQ ID NO: 93351 - protein, 9 aa, Homo sapiens
  light chain complementarity determining region 3 for antibody 46676
QQYGNPPLT

SEQ ID NO: 93352 - protein, 11 aa, Homo sapiens
  heavy chain complementarity determining region 3 for antibody 46676
AYRFRADHFDY

SEQ ID NO: 93353 - protein, 9 aa, Homo sapiens
  light chain complementarity determining region 3 for antibody 46677
QQYGMSPRT

SEQ ID NO: 93354 - protein, 15 aa, Homo sapiens
  heavy chain complementarity determining region 3 for antibody 46677
AKDGEFCGSNCYFGS

SEQ ID NO: 93355 - protein, 10 aa, Homo sapiens
  light chain complementarity determining region 3 for antibody 46678
QQYGMSPPLT

SEQ ID NO: 93356 - protein, 10 aa, Homo sapiens
  heavy chain complementarity determining region 3 for antibody 46678
GRPYYYAFDI

SEQ ID NO: 93357 - protein, 9 aa, Homo sapiens
  light chain complementarity determining region 3 for antibody 46679
QQYGISPYT

SEQ ID NO: 93358 - protein, 13 aa, Homo sapiens
  heavy chain complementarity determining region 3 for antibody 46679
TTYWTTVPRVGGP

SEQ ID NO: 93359 - protein, 9 aa, Homo sapiens
  light chain complementarity determining region 3 for antibody 46680
QQYGISPRT

SEQ ID NO: 93360 - protein, 23 aa, Homo sapiens
  heavy chain complementarity determining region 3 for antibody 46680
ARGKRLTDVVMVRTVTLPSPLEY

SEQ ID NO: 93361 - protein, 9 aa, Homo sapiens
  light chain complementarity determining region 3 for antibody 46681
QQYGHSQYT

SEQ ID NO: 93362 - protein, 19 aa, Homo sapiens
  heavy chain complementarity determining region 3 for antibody 46681
ASQPRNTIFGLLLPGHFAY

SEQ ID NO: 93363 - protein, 9 aa, Homo sapiens
  light chain complementarity determining region 3 for antibody 46682
QQYGHSPYT

SEQ ID NO: 93364 - protein, 8 aa, Homo sapiens
  heavy chain complementarity determining region 3 for antibody 46682
ARARYFDY

SEQ ID NO: 93365 - protein, 9 aa, Homo sapiens
  light chain complementarity determining region 3 for antibody 46683
QQYGGSVTT

SEQ ID NO: 93366 - protein, 15 aa, Homo sapiens
  heavy chain complementarity determining region 3 for antibody 46683
ARFFPNYYDSSYFDF

SEQ ID NO: 93367 - protein, 8 aa, Homo sapiens
  light chain complementarity determining region 3 for antibody 46684
QQYGGSPS

SEQ ID NO: 93368 - protein, 16 aa, Homo sapiens
  heavy chain complementarity determining region 3 for antibody 46684
ATSKPSDYYGGSYFDN

SEQ ID NO: 93369 - protein, 10 aa, Homo sapiens
  light chain complementarity determining region 3 for antibody 46685
QQYGGSPRYG

SEQ ID NO: 93370 - protein, 10 aa, Homo sapiens
  heavy chain complementarity determining region 3 for antibody 46685
AASDTAQFRY

SEQ ID NO: 93371 - protein, 10 aa, Homo sapiens
  light chain complementarity determining region 3 for antibody 46686
QQYGGSPRNT

SEQ ID NO: 93372 - protein, 15 aa, Homo sapiens
  heavy chain complementarity determining region 3 for antibody 46686
ARLGWVRGDYGPIDY

SEQ ID NO: 93373 - protein, 11 aa, Homo sapiens
  light chain complementarity determining region 3 for antibody 46687
QQYGGSPRMYP

SEQ ID NO: 93374 - protein, 17 aa, Homo sapiens
  heavy chain complementarity determining region 3 for antibody 46687
AFWNGLDSGWFSGPLDY

SEQ ID NO: 93375 - protein, 11 aa, Homo sapiens
  light chain complementarity determining region 3 for antibody 46688
QQYGGSPPMST

SEQ ID NO: 93376 - protein, 16 aa, Homo sapiens
  heavy chain complementarity determining region 3 for antibody 46688
VRAMFCGDWCYRGFDK

SEQ ID NO: 93377 - protein, 11 aa, Homo sapiens
  light chain complementarity determining region 3 for antibody 46689
QQYGGSPPMNT

SEQ ID NO: 93378 - protein, 16 aa, Homo sapiens
  heavy chain complementarity determining region 3 for antibody 46689
VRAMFCGDWCYRGFDK

SEQ ID NO: 93379 - protein, 9 aa, Homo sapiens
  light chain complementarity determining region 3 for antibody 46690
QQYGGSPGT

SEQ ID NO: 93380 - protein, 13 aa, Homo sapiens
  heavy chain complementarity determining region 3 for antibody 46690
AKSQTGDQPYFDH

SEQ ID NO: 93381 - protein, 10 aa, Homo sapiens
  light chain complementarity determining region 3 for antibody 46691
QQYGGSLSLS

SEQ ID NO: 93382 - protein, 17 aa, Homo sapiens
  heavy chain complementarity determining region 3 for antibody 46691
ARVDLNEQWLVLWFFDL

SEQ ID NO: 93383 - protein, 10 aa, Homo sapiens
  light chain complementarity determining region 3 for antibody 46692
QQYGGSLSFT

SEQ ID NO: 93384 - protein, 15 aa, Homo sapiens
  heavy chain complementarity determining region 3 for antibody 46692
ARVALVEWYLTPFDF

SEQ ID NO: 93385 - protein, 9 aa, Homo sapiens
  light chain complementarity determining region 3 for antibody 46693
QQYGGSGTT

SEQ ID NO: 93386 - protein, 15 aa, Homo sapiens
  heavy chain complementarity determining region 3 for antibody 46693
ARFFPNYYDSSYFDL

SEQ ID NO: 93387 - protein, 8 aa, Homo sapiens
  light chain complementarity determining region 3 for antibody 46694
QQYGFPFT

SEQ ID NO: 93388 - protein, 12 aa, Homo sapiens
  heavy chain complementarity determining region 3 for antibody 46694
ARAHSARWYAAY

SEQ ID NO: 93389 - protein, 6 aa, Homo sapiens
  light chain complementarity determining region 3 for antibody 46695
QQYGET

SEQ ID NO: 93390 - protein, 12 aa, Homo sapiens
  heavy chain complementarity determining region 3 for antibody 46695
ARDHSSGWSLAN

SEQ ID NO: 93391 - protein, 9 aa, Homo sapiens
  light chain complementarity determining region 3 for antibody 46696
QQYGDSTLT

SEQ ID NO: 93392 - protein, 22 aa, Homo sapiens
  heavy chain complementarity determining region 3 for antibody 46696
ARGRRPYGNYVYPLTPYSFFDY

SEQ ID NO: 93393 - protein, 9 aa, Homo sapiens
  light chain complementarity determining region 3 for antibody 46697
QQYGDSPYT

SEQ ID NO: 93394 - protein, 22 aa, Homo sapiens
  heavy chain complementarity determining region 3 for antibody 46697
TRRRPTGRTSFRRGGRQGAFDI

SEQ ID NO: 93395 - protein, 9 aa, Homo sapiens
  light chain complementarity determining region 3 for antibody 46698
QQYGDSPVT

SEQ ID NO: 93396 - protein, 15 aa, Homo sapiens
  heavy chain complementarity determining region 3 for antibody 46698
ARLSYDFLTAYYIDL

SEQ ID NO: 93397 - protein, 9 aa, Homo sapiens
  light chain complementarity determining region 3 for antibody 46699
QQYGDSPGT

SEQ ID NO: 93398 - protein, 11 aa, Homo sapiens
  heavy chain complementarity determining region 3 for antibody 46699
ARIDVTVGYDI

SEQ ID NO: 93399 - protein, 9 aa, Homo sapiens
  light chain complementarity determining region 3 for antibody 46700
QQYFTYPLT

SEQ ID NO: 93400 - protein, 16 aa, Homo sapiens
  heavy chain complementarity determining region 3 for antibody 46700
ARDHDNSGWPYNWFDP

SEQ ID NO: 93401 - protein, 10 aa, Homo sapiens
  light chain complementarity determining region 3 for antibody 46701
QQYFSTPPNT

SEQ ID NO: 93402 - protein, 16 aa, Homo sapiens
  heavy chain complementarity determining region 3 for antibody 46701
ARHITSGGWEHDAFDI

SEQ ID NO: 93403 - protein, 8 aa, Homo sapiens
  light chain complementarity determining region 3 for antibody 46702
QQYESTWT

SEQ ID NO: 93404 - protein, 14 aa, Homo sapiens
  heavy chain complementarity determining region 3 for antibody 46702
ARGLQGNGWEPFEY

SEQ ID NO: 93405 - protein, 8 aa, Homo sapiens
  light chain complementarity determining region 3 for antibody 46703
QQYESLPA

SEQ ID NO: 93406 - protein, 10 aa, Homo sapiens
  heavy chain complementarity determining region 3 for antibody 46703
ARGTDYAFDY

SEQ ID NO: 93407 - protein, 9 aa, Homo sapiens
  light chain complementarity determining region 3 for antibody 46704
QQYENVPGT

SEQ ID NO: 93408 - protein, 18 aa, Homo sapiens
  heavy chain complementarity determining region 3 for antibody 46704
AKDRSYFDYVSGSYRFDY

SEQ ID NO: 93409 - protein, 9 aa, Homo sapiens
  light chain complementarity determining region 3 for antibody 46705
QQYENLPLT

SEQ ID NO: 93410 - protein, 21 aa, Homo sapiens
  heavy chain complementarity determining region 3 for antibody 46705
ARVGHCSGGGCFSYDYHNMGV

SEQ ID NO: 93411 - protein, 10 aa, Homo sapiens
  light chain complementarity determining region 3 for antibody 46706
QQYDYWPPVT

SEQ ID NO: 93412 - protein, 21 aa, Homo sapiens
  heavy chain complementarity determining region 3 for antibody 46706
GREWLYCNEGRCHTDGGFVDL

SEQ ID NO: 93413 - protein, 10 aa, Homo sapiens
  light chain complementarity determining region 3 for antibody 46707
QQYDVWPPWT

SEQ ID NO: 93414 - protein, 17 aa, Homo sapiens
  heavy chain complementarity determining region 3 for antibody 46707
ARGQGFPDLGIYWYFDL

SEQ ID NO: 93415 - protein, 9 aa, Homo sapiens
  light chain complementarity determining region 3 for antibody 46708
QQYDTYPWT

SEQ ID NO: 93416 - protein, 15 aa, Homo sapiens
  heavy chain complementarity determining region 3 for antibody 46708
ARDQYRVGESNYFDL

SEQ ID NO: 93417 - protein, 8 aa, Homo sapiens
  light chain complementarity determining region 3 for antibody 46709
QQYDTTSS

SEQ ID NO: 93418 - protein, 16 aa, Homo sapiens
  heavy chain complementarity determining region 3 for antibody 46709
ARVISKWESILDAFKM

SEQ ID NO: 93419 - protein, 9 aa, Homo sapiens
  light chain complementarity determining region 3 for antibody 46710
QQYDTSSWT

SEQ ID NO: 93420 - protein, 17 aa, Homo sapiens
  heavy chain complementarity determining region 3 for antibody 46710
AKDIFFAIAVAGTAFDI

SEQ ID NO: 93421 - protein, 9 aa, Homo sapiens
  light chain complementarity determining region 3 for antibody 46711
QQYDTSPWT

SEQ ID NO: 93422 - protein, 16 aa, Homo sapiens
  heavy chain complementarity determining region 3 for antibody 46711
ARLSGDWGSAPHFFDT

SEQ ID NO: 93423 - protein, 12 aa, Homo sapiens
  light chain complementarity determining region 3 for antibody 46712
QQYDTSPRSGWT

SEQ ID NO: 93424 - protein, 17 aa, Homo sapiens
  heavy chain complementarity determining region 3 for antibody 46712
AREAFDSDVDDFHGLDV

SEQ ID NO: 93425 - protein, 11 aa, Homo sapiens
  light chain complementarity determining region 3 for antibody 46713
QQYDTSPPGYT

SEQ ID NO: 93426 - protein, 14 aa, Homo sapiens
  heavy chain complementarity determining region 3 for antibody 46713
ARETSNSRKRSFDH

SEQ ID NO: 93427 - protein, 10 aa, Homo sapiens
  light chain complementarity determining region 3 for antibody 46714
QQYDTRPPLT

SEQ ID NO: 93428 - protein, 12 aa, Homo sapiens
  heavy chain complementarity determining region 3 for antibody 46714
ARYNWSNGAFDI

SEQ ID NO: 93429 - protein, 8 aa, Homo sapiens
  light chain complementarity determining region 3 for antibody 46715
QQYDTNSS

SEQ ID NO: 93430 - protein, 16 aa, Homo sapiens
  heavy chain complementarity determining region 3 for antibody 46715
ARVISKWESILDAFEM

SEQ ID NO: 93431 - protein, 9 aa, Homo sapiens
  light chain complementarity determining region 3 for antibody 46716
QQYDTAPWT

SEQ ID NO: 93432 - protein, 14 aa, Homo sapiens
  heavy chain complementarity determining region 3 for antibody 46716
ARARPSVTTSHFED

SEQ ID NO: 93433 - protein, 9 aa, Homo sapiens
  light chain complementarity determining region 3 for antibody 46717
QQYDSYPYT

SEQ ID NO: 93434 - protein, 24 aa, Homo sapiens
  heavy chain complementarity determining region 3 for antibody 46717
ARRNPYYESVWGRSRYFREPVFDR

SEQ ID NO: 93435 - protein, 9 aa, Homo sapiens
  light chain complementarity determining region 3 for antibody 46718
QQYDSYPYT

SEQ ID NO: 93436 - protein, 14 aa, Homo sapiens
  heavy chain complementarity determining region 3 for antibody 46718
ARLKTGGYMYESSI

SEQ ID NO: 93437 - protein, 9 aa, Homo sapiens
  light chain complementarity determining region 3 for antibody 46719
QQYDSYPYT

SEQ ID NO: 93438 - protein, 13 aa, Homo sapiens
  heavy chain complementarity determining region 3 for antibody 46719
ARGIGDPRGVINY

SEQ ID NO: 93439 - protein, 9 aa, Homo sapiens
  light chain complementarity determining region 3 for antibody 46720
QQYDSYPRT

SEQ ID NO: 93440 - protein, 17 aa, Homo sapiens
  heavy chain complementarity determining region 3 for antibody 46720
ATVHVAAGPHYNYGMNV

SEQ ID NO: 93441 - protein, 9 aa, Homo sapiens
  light chain complementarity determining region 3 for antibody 46721
QQYDSYPFP

SEQ ID NO: 93442 - protein, 16 aa, Homo sapiens
  heavy chain complementarity determining region 3 for antibody 46721
VRAHRDVGSWYRYFDL

SEQ ID NO: 93443 - protein, 10 aa, Homo sapiens
  light chain complementarity determining region 3 for antibody 46722
QQYDSWPSFT

SEQ ID NO: 93444 - protein, 8 aa, Homo sapiens
  heavy chain complementarity determining region 3 for antibody 46722
NYGTGMSY

SEQ ID NO: 93445 - protein, 9 aa, Homo sapiens
  light chain complementarity determining region 3 for antibody 46723
QQYDSVPLT

SEQ ID NO: 93446 - protein, 20 aa, Homo sapiens
  heavy chain complementarity determining region 3 for antibody 46723
ATVFRGLGNSAHFVGGAFDI

SEQ ID NO: 93447 - protein, 7 aa, Homo sapiens
  light chain complementarity determining region 3 for antibody 46724
QQYDSST

SEQ ID NO: 93448 - protein, 15 aa, Homo sapiens
  heavy chain complementarity determining region 3 for antibody 46724
ARIRMAVVRRDAFDI

SEQ ID NO: 93449 - protein, 9 aa, Homo sapiens
  light chain complementarity determining region 3 for antibody 46725
QQYDSSPRT

SEQ ID NO: 93450 - protein, 16 aa, Homo sapiens
  heavy chain complementarity determining region 3 for antibody 46725
ARSKVDSSSWYSSLDY

SEQ ID NO: 93451 - protein, 9 aa, Homo sapiens
  light chain complementarity determining region 3 for antibody 46726
QQYDSSLWT

SEQ ID NO: 93452 - protein, 12 aa, Homo sapiens
  heavy chain complementarity determining region 3 for antibody 46726
ARDFGLYQEPDS

SEQ ID NO: 93453 - protein, 10 aa, Homo sapiens
  light chain complementarity determining region 3 for antibody 46727
QQYDSLPPWT

SEQ ID NO: 93454 - protein, 11 aa, Homo sapiens
  heavy chain complementarity determining region 3 for antibody 46727
ARGGGSDPFHI

SEQ ID NO: 93455 - protein, 9 aa, Homo sapiens
  light chain complementarity determining region 3 for antibody 46728
QQYDSFSYT

SEQ ID NO: 93456 - protein, 13 aa, Homo sapiens
  heavy chain complementarity determining region 3 for antibody 46728
SRFAGGDSPTYDH

SEQ ID NO: 93457 - protein, 9 aa, Homo sapiens
  light chain complementarity determining region 3 for antibody 46729
QQYDSFPWT

SEQ ID NO: 93458 - protein, 13 aa, Homo sapiens
  heavy chain complementarity determining region 3 for antibody 46729
ARIFYDDTAFRDY

SEQ ID NO: 93459 - protein, 9 aa, Homo sapiens
  light chain complementarity determining region 3 for antibody 46730
QQYDSAPAT

SEQ ID NO: 93460 - protein, 11 aa, Homo sapiens
  heavy chain complementarity determining region 3 for antibody 46730
AKDPSSGPSDY

SEQ ID NO: 93461 - protein, 9 aa, Homo sapiens
  light chain complementarity determining region 3 for antibody 46731
QQYDRTPFT

SEQ ID NO: 93462 - protein, 20 aa, Homo sapiens
  heavy chain complementarity determining region 3 for antibody 46731
TTDVYCSRTNCQPNGGAFDV

SEQ ID NO: 93463 - protein, 10 aa, Homo sapiens
  light chain complementarity determining region 3 for antibody 46732
QQYDNWPPYP

SEQ ID NO: 93464 - protein, 17 aa, Homo sapiens
  heavy chain complementarity determining region 3 for antibody 46732
AVVYYYVSSGSNSAFDI

SEQ ID NO: 93465 - protein, 9 aa, Homo sapiens
  light chain complementarity determining region 3 for antibody 46733
QQYDNLPYT

SEQ ID NO: 93466 - protein, 20 aa, Homo sapiens
  heavy chain complementarity determining region 3 for antibody 46733
VRHGQGDHKTRGYEFNGMDV

SEQ ID NO: 93467 - protein, 10 aa, Homo sapiens
  light chain complementarity determining region 3 for antibody 46734
QQYDNLPRVT

SEQ ID NO: 93468 - protein, 14 aa, Homo sapiens
  heavy chain complementarity determining region 3 for antibody 46734
GRDQGPAMAERSDY

SEQ ID NO: 93469 - protein, 9 aa, Homo sapiens
  light chain complementarity determining region 3 for antibody 46735
QQYDNLPLT

SEQ ID NO: 93470 - protein, 17 aa, Homo sapiens
  heavy chain complementarity determining region 3 for antibody 46735
ASLRQGYYYDNSGIADY

SEQ ID NO: 93471 - protein, 9 aa, Homo sapiens
  light chain complementarity determining region 3 for antibody 46736
QQYDNLPIT

SEQ ID NO: 93472 - protein, 23 aa, Homo sapiens
  heavy chain complementarity determining region 3 for antibody 46736
ARHRMRRYDFWNGPSVHYYAMDV

SEQ ID NO: 93473 - protein, 9 aa, Homo sapiens
  light chain complementarity determining region 3 for antibody 46737
QQYDNLFVT

SEQ ID NO: 93474 - protein, 19 aa, Homo sapiens
  heavy chain complementarity determining region 3 for antibody 46737
ARSPAQYCSGGTCYSPFDY

SEQ ID NO: 93475 - protein, 8 aa, Homo sapiens
  light chain complementarity determining region 3 for antibody 46738
QQYDNLCT

SEQ ID NO: 93476 - protein, 10 aa, Homo sapiens
  heavy chain complementarity determining region 3 for antibody 46738
TWVGVSWFAS

SEQ ID NO: 93477 - protein, 9 aa, Homo sapiens
  light chain complementarity determining region 3 for antibody 46739
QQYDNIPYT

SEQ ID NO: 93478 - protein, 15 aa, Homo sapiens
  heavy chain complementarity determining region 3 for antibody 46739
ARTRIAVAGEDAFDI

SEQ ID NO: 93479 - protein, 10 aa, Homo sapiens
  light chain complementarity determining region 3 for antibody 46740
QQYDNIPLYT

SEQ ID NO: 93480 - protein, 16 aa, Homo sapiens
  heavy chain complementarity determining region 3 for antibody 46740
AREVADSNTWGWHFDL

SEQ ID NO: 93481 - protein, 9 aa, Homo sapiens
  light chain complementarity determining region 3 for antibody 46741
QQYDNIPIT

SEQ ID NO: 93482 - protein, 24 aa, Homo sapiens
  heavy chain complementarity determining region 3 for antibody 46741
ARHRMRRYDFWNGPSVHYYYAMDV

SEQ ID NO: 93483 - protein, 8 aa, Homo sapiens
  light chain complementarity determining region 3 for antibody 46742
QQYDMWPP

SEQ ID NO: 93484 - protein, 16 aa, Homo sapiens
  heavy chain complementarity determining region 3 for antibody 46742
ARHLGGRHGVRSVLGH

SEQ ID NO: 93485 - protein, 8 aa, Homo sapiens
  light chain complementarity determining region 3 for antibody 46743
QQYDMGPT

SEQ ID NO: 93486 - protein, 16 aa, Homo sapiens
  heavy chain complementarity determining region 3 for antibody 46743
ARHLGGRHGVRSVLGH

SEQ ID NO: 93487 - protein, 9 aa, Homo sapiens
  light chain complementarity determining region 3 for antibody 46744
QQYDLLPPT

SEQ ID NO: 93488 - protein, 21 aa, Homo sapiens
  heavy chain complementarity determining region 3 for antibody 46744
ARGLHIVAVTSILRGFWYFGL

SEQ ID NO: 93489 - protein, 8 aa, Homo sapiens
  light chain complementarity determining region 3 for antibody 46745
QQYDIWPT

SEQ ID NO: 93490 - protein, 16 aa, Homo sapiens
  heavy chain complementarity determining region 3 for antibody 46745
ARHLGGRHGVRSVLGH

SEQ ID NO: 93491 - protein, 9 aa, Homo sapiens
  light chain complementarity determining region 3 for antibody 46746
QQYDHFLVT

SEQ ID NO: 93492 - protein, 18 aa, Homo sapiens
  heavy chain complementarity determining region 3 for antibody 46746
AKDKYYDSTGYYYWYFDL

SEQ ID NO: 93493 - protein, 12 aa, Homo sapiens
  light chain complementarity determining region 3 for antibody 46747
QQYDGLPPGRNI

SEQ ID NO: 93494 - protein, 20 aa, Homo sapiens
  heavy chain complementarity determining region 3 for antibody 46747
ARGHPMWFGATRNKNYYFDN

SEQ ID NO: 93495 - protein, 9 aa, Homo sapiens
  light chain complementarity determining region 3 for antibody 46748
QQYDGFPWT

SEQ ID NO: 93496 - protein, 13 aa, Homo sapiens
  heavy chain complementarity determining region 3 for antibody 46748
ARIFYGDTAFRDY

SEQ ID NO: 93497 - protein, 9 aa, Homo sapiens
  light chain complementarity determining region 3 for antibody 46749
QQYDDPPRT

SEQ ID NO: 93498 - protein, 17 aa, Homo sapiens
  heavy chain complementarity determining region 3 for antibody 46749
TKDFFVRRTVALDAFDI

SEQ ID NO: 93499 - protein, 9 aa, Homo sapiens
  light chain complementarity determining region 3 for antibody 46750
QQYDDLRAA

SEQ ID NO: 93500 - protein, 13 aa, Homo sapiens
  heavy chain complementarity determining region 3 for antibody 46750
TRGYFDWLSAYDY

SEQ ID NO: 93501 - protein, 9 aa, Homo sapiens
  light chain complementarity determining region 3 for antibody 46751
QQYDDFSLP

SEQ ID NO: 93502 - protein, 17 aa, Homo sapiens
  heavy chain complementarity determining region 3 for antibody 46751
ARHYNYDSSSYYVGFNY

SEQ ID NO: 93503 - protein, 9 aa, Homo sapiens
  light chain complementarity determining region 3 for antibody 46752
QQYDAYPPT

SEQ ID NO: 93504 - protein, 13 aa, Homo sapiens
  heavy chain complementarity determining region 3 for antibody 46752
ARRDYSVSYTFDS

SEQ ID NO: 93505 - protein, 9 aa, Homo sapiens
  light chain complementarity determining region 3 for antibody 46753
QQYCSSPPT

SEQ ID NO: 93506 - protein, 22 aa, Homo sapiens
  heavy chain complementarity determining region 3 for antibody 46753
ARVWGLYYSSWYGPGHYYGMDV

SEQ ID NO: 93507 - protein, 8 aa, Homo sapiens
  light chain complementarity determining region 3 for antibody 46754
QQYCDSFP

SEQ ID NO: 93508 - protein, 13 aa, Homo sapiens
  heavy chain complementarity determining region 3 for antibody 46754
ATESGSYQGAFDI

SEQ ID NO: 93509 - protein, 9 aa, Homo sapiens
  light chain complementarity determining region 3 for antibody 46755
QQYATSPTT

SEQ ID NO: 93510 - protein, 16 aa, Homo sapiens
  heavy chain complementarity determining region 3 for antibody 46755
AKDRANYYETSGPFDY

SEQ ID NO: 93511 - protein, 9 aa, Homo sapiens
  light chain complementarity determining region 3 for antibody 46756
QQYATSPRT

SEQ ID NO: 93512 - protein, 15 aa, Homo sapiens
  heavy chain complementarity determining region 3 for antibody 46756
ARDGNVLATGYPLDY

SEQ ID NO: 93513 - protein, 9 aa, Homo sapiens
  light chain complementarity determining region 3 for antibody 46757
QQYATSPLT

SEQ ID NO: 93514 - protein, 10 aa, Homo sapiens
  heavy chain complementarity determining region 3 for antibody 46757
TLGGGWLVDY

SEQ ID NO: 93515 - protein, 9 aa, Homo sapiens
  light chain complementarity determining region 3 for antibody 46758
QQYASSPVP

SEQ ID NO: 93516 - protein, 20 aa, Homo sapiens
  heavy chain complementarity determining region 3 for antibody 46758
ARDLHPMFSSGWYLSKALEY

SEQ ID NO: 93517 - protein, 9 aa, Homo sapiens
  light chain complementarity determining region 3 for antibody 46759
QQYASSPRT

SEQ ID NO: 93518 - protein, 8 aa, Homo sapiens
  heavy chain complementarity determining region 3 for antibody 46759
ARNNAFDI

SEQ ID NO: 93519 - protein, 9 aa, Homo sapiens
  light chain complementarity determining region 3 for antibody 46760
QQYASAPYP

SEQ ID NO: 93520 - protein, 19 aa, Homo sapiens
  heavy chain complementarity determining region 3 for antibody 46760
AKDMSHDLLTGYPNDAFDI

SEQ ID NO: 93521 - protein, 9 aa, Homo sapiens
  light chain complementarity determining region 3 for antibody 46761
QQYARAPYT

SEQ ID NO: 93522 - protein, 19 aa, Homo sapiens
  heavy chain complementarity determining region 3 for antibody 46761
AKDMSHDLLTGYPNDAFDI

SEQ ID NO: 93523 - protein, 11 aa, Homo sapiens
  light chain complementarity determining region 3 for antibody 46762
QQYAPSPEKYT

SEQ ID NO: 93524 - protein, 13 aa, Homo sapiens
  heavy chain complementarity determining region 3 for antibody 46762
AREEMIGGSPFDF

SEQ ID NO: 93525 - protein, 9 aa, Homo sapiens
  light chain complementarity determining region 3 for antibody 46763
QQYANLPYT

SEQ ID NO: 93526 - protein, 11 aa, Homo sapiens
  heavy chain complementarity determining region 3 for antibody 46763
ARRGVTGAAEF

SEQ ID NO: 93527 - protein, 8 aa, Homo sapiens
  light chain complementarity determining region 3 for antibody 46764
QQYANLLT

SEQ ID NO: 93528 - protein, 15 aa, Homo sapiens
  heavy chain complementarity determining region 3 for antibody 46764
TRPRGRGSSGWHDEC

SEQ ID NO: 93529 - protein, 8 aa, Homo sapiens
  light chain complementarity determining region 3 for antibody 46765
QQYAMWPT

SEQ ID NO: 93530 - protein, 16 aa, Homo sapiens
  heavy chain complementarity determining region 3 for antibody 46765
ARHLGGRHGVRSVLGH

SEQ ID NO: 93531 - protein, 8 aa, Homo sapiens
  light chain complementarity determining region 3 for antibody 46766
QQYAGSWT

SEQ ID NO: 93532 - protein, 16 aa, Homo sapiens
  heavy chain complementarity determining region 3 for antibody 46766
AASICTGGSCYPGVDH

SEQ ID NO: 93533 - protein, 9 aa, Homo sapiens
  light chain complementarity determining region 3 for antibody 46767
QQYAGSPTT

SEQ ID NO: 93534 - protein, 14 aa, Homo sapiens
  heavy chain complementarity determining region 3 for antibody 46767
STQYCSGGSCYLVD

SEQ ID NO: 93535 - protein, 9 aa, Homo sapiens
  light chain complementarity determining region 3 for antibody 46768
QQYAGSPLT

SEQ ID NO: 93536 - protein, 11 aa, Homo sapiens
  heavy chain complementarity determining region 3 for antibody 46768
ARRGVTPALDI

SEQ ID NO: 93537 - protein, 9 aa, Homo sapiens
  light chain complementarity determining region 3 for antibody 46769
QQYADSAIR

SEQ ID NO: 93538 - protein, 9 aa, Homo sapiens
  heavy chain complementarity determining region 3 for antibody 46769
GLFTGGRDY

SEQ ID NO: 93539 - protein, 9 aa, Homo sapiens
  light chain complementarity determining region 3 for antibody 46770
QQWNKWPLT

SEQ ID NO: 93540 - protein, 15 aa, Homo sapiens
  heavy chain complementarity determining region 3 for antibody 46770
ARDGGSSSWNNYFDF

SEQ ID NO: 93541 - protein, 9 aa, Homo sapiens
  light chain complementarity determining region 3 for antibody 46771
QQVNSYPRT

SEQ ID NO: 93542 - protein, 15 aa, Homo sapiens
  heavy chain complementarity determining region 3 for antibody 46771
ARERDSYYSYYGMDV

SEQ ID NO: 93543 - protein, 9 aa, Homo sapiens
  light chain complementarity determining region 3 for antibody 46772
QQVNSFPFT

SEQ ID NO: 93544 - protein, 24 aa, Homo sapiens
  heavy chain complementarity determining region 3 for antibody 46772
AKSLYMPAPGHSLTGSISIYALDV

SEQ ID NO: 93545 - protein, 9 aa, Homo sapiens
  light chain complementarity determining region 3 for antibody 46773
QQVNDFPLT

SEQ ID NO: 93546 - protein, 11 aa, Homo sapiens
  heavy chain complementarity determining region 3 for antibody 46773
GRHIAWRGIDA

SEQ ID NO: 93547 - protein, 9 aa, Homo sapiens
  light chain complementarity determining region 3 for antibody 46774
QQVHIYPFT

SEQ ID NO: 93548 - protein, 12 aa, Homo sapiens
  heavy chain complementarity determining region 3 for antibody 46774
ARPLDGDFGFDP

SEQ ID NO: 93549 - protein, 9 aa, Homo sapiens
  light chain complementarity determining region 3 for antibody 46775
QQVGSAPLT

SEQ ID NO: 93550 - protein, 15 aa, Homo sapiens
  heavy chain complementarity determining region 3 for antibody 46775
ARAPGSSSRYAYFDY

SEQ ID NO: 93551 - protein, 8 aa, Homo sapiens
  light chain complementarity determining region 3 for antibody 46776
QQVGDSQT

SEQ ID NO: 93552 - protein, 14 aa, Homo sapiens
  heavy chain complementarity determining region 3 for antibody 46776
ARDSEYNGPYLYQH

SEQ ID NO: 93553 - protein, 9 aa, Homo sapiens
  light chain complementarity determining region 3 for antibody 46777
QQTYTPPFT

SEQ ID NO: 93554 - protein, 19 aa, Homo sapiens
  heavy chain complementarity determining region 3 for antibody 46777
ARGDIRPFDWTHYHFGMDV

SEQ ID NO: 93555 - protein, 9 aa, Homo sapiens
  light chain complementarity determining region 3 for antibody 46778
QQTYSTPWT

SEQ ID NO: 93556 - protein, 18 aa, Homo sapiens
  heavy chain complementarity determining region 3 for antibody 46778
AKHTPAGSGWSGRDALDI

SEQ ID NO: 93557 - protein, 9 aa, Homo sapiens
  light chain complementarity determining region 3 for antibody 46779
QQTYSTPRP

SEQ ID NO: 93558 - protein, 14 aa, Homo sapiens
  heavy chain complementarity determining region 3 for antibody 46779
ARVAHFHGVGPLDY

SEQ ID NO: 93559 - protein, 9 aa, Homo sapiens
  light chain complementarity determining region 3 for antibody 46780
QQTYSTPQA

SEQ ID NO: 93560 - protein, 15 aa, Homo sapiens
  heavy chain complementarity determining region 3 for antibody 46780
ATPDALTKDYYGSDV

SEQ ID NO: 93561 - protein, 9 aa, Homo sapiens
  light chain complementarity determining region 3 for antibody 46781
QQTYSTPGT

SEQ ID NO: 93562 - protein, 15 aa, Homo sapiens
  heavy chain complementarity determining region 3 for antibody 46781
AKDRVGYSGYDAFDI

SEQ ID NO: 93563 - protein, 9 aa, Homo sapiens
  light chain complementarity determining region 3 for antibody 46782
QQTYSPPYP

SEQ ID NO: 93564 - protein, 13 aa, Homo sapiens
  heavy chain complementarity determining region 3 for antibody 46782
TRSGDNDFWRFDY

SEQ ID NO: 93565 - protein, 9 aa, Homo sapiens
  light chain complementarity determining region 3 for antibody 46783
QQTYSPPFT

SEQ ID NO: 93566 - protein, 22 aa, Homo sapiens
  heavy chain complementarity determining region 3 for antibody 46783
AREGLCTSSSCYVVNHDNGMDV

SEQ ID NO: 93567 - protein, 9 aa, Homo sapiens
  light chain complementarity determining region 3 for antibody 46784
QQTYRTPLT

SEQ ID NO: 93568 - protein, 16 aa, Homo sapiens
  heavy chain complementarity determining region 3 for antibody 46784
ARLRQRAIRRWYGLDV

SEQ ID NO: 93569 - protein, 9 aa, Homo sapiens
  light chain complementarity determining region 3 for antibody 46785
QQTYRTLAT

SEQ ID NO: 93570 - protein, 17 aa, Homo sapiens
  heavy chain complementarity determining region 3 for antibody 46785
ARPTIMGATSSYYGTDV

SEQ ID NO: 93571 - protein, 13 aa, Homo sapiens
  light chain complementarity determining region 3 for antibody 46786
QQTYMLNNNGRVT

SEQ ID NO: 93572 - protein, 15 aa, Homo sapiens
  heavy chain complementarity determining region 3 for antibody 46786
ARDSFDGSYSGSFDY

SEQ ID NO: 93573 - protein, 10 aa, Homo sapiens
  light chain complementarity determining region 3 for antibody 46787
QQTYETPRWP

SEQ ID NO: 93574 - protein, 21 aa, Homo sapiens
  heavy chain complementarity determining region 3 for antibody 46787
ARDQRGGIAAAGVPHKNCLDS

SEQ ID NO: 93575 - protein, 8 aa, Homo sapiens
  light chain complementarity determining region 3 for antibody 46788
QQTYATVS

SEQ ID NO: 93576 - protein, 9 aa, Homo sapiens
  heavy chain complementarity determining region 3 for antibody 46788
ARGDYYFDY

SEQ ID NO: 93577 - protein, 11 aa, Homo sapiens
  light chain complementarity determining region 3 for antibody 46789
QQTNSFPQGVI

SEQ ID NO: 93578 - protein, 14 aa, Homo sapiens
  heavy chain complementarity determining region 3 for antibody 46789
ARDTGVRDPGYFDL

SEQ ID NO: 93579 - protein, 9 aa, Homo sapiens
  light chain complementarity determining region 3 for antibody 46790
QQTDRAPRT

SEQ ID NO: 93580 - protein, 13 aa, Homo sapiens
  heavy chain complementarity determining region 3 for antibody 46790
VRDKVEGPTILDY

SEQ ID NO: 93581 - protein, 9 aa, Homo sapiens
  light chain complementarity determining region 3 for antibody 46791
QQSYTVSQT

SEQ ID NO: 93582 - protein, 24 aa, Homo sapiens
  heavy chain complementarity determining region 3 for antibody 46791
ARGSLTYYYDNSGYYYAPGDAFEI

SEQ ID NO: 93583 - protein, 9 aa, Homo sapiens
  light chain complementarity determining region 3 for antibody 46792
QQSYTTPQT

SEQ ID NO: 93584 - protein, 21 aa, Homo sapiens
  heavy chain complementarity determining region 3 for antibody 46792
ARDLKLTSYYYDSSDDHYFGY

SEQ ID NO: 93585 - protein, 9 aa, Homo sapiens
  light chain complementarity determining region 3 for antibody 46793
QQSYTTPQP

SEQ ID NO: 93586 - protein, 21 aa, Homo sapiens
  heavy chain complementarity determining region 3 for antibody 46793
ARDLKLTSYYYDSSDDHYFDY

SEQ ID NO: 93587 - protein, 10 aa, Homo sapiens
  light chain complementarity determining region 3 for antibody 46794
QQSYTTPLLS

SEQ ID NO: 93588 - protein, 14 aa, Homo sapiens
  heavy chain complementarity determining region 3 for antibody 46794
ARGYYDSSGYYVDH

SEQ ID NO: 93589 - protein, 9 aa, Homo sapiens
  light chain complementarity determining region 3 for antibody 46795
QQSYTTPLI

SEQ ID NO: 93590 - protein, 14 aa, Homo sapiens
  heavy chain complementarity determining region 3 for antibody 46795
AREVRHRAHYALDV

SEQ ID NO: 93591 - protein, 10 aa, Homo sapiens
  light chain complementarity determining region 3 for antibody 46796
QQSYTTPIFT

SEQ ID NO: 93592 - protein, 17 aa, Homo sapiens
  heavy chain complementarity determining region 3 for antibody 46796
AVYTSTDGIFNKDAFDI

SEQ ID NO: 93593 - protein, 9 aa, Homo sapiens
  light chain complementarity determining region 3 for antibody 46797
QQSYSVPWT

SEQ ID NO: 93594 - protein, 18 aa, Homo sapiens
  heavy chain complementarity determining region 3 for antibody 46797
AREVDSYNGDAYYNIFDY

SEQ ID NO: 93595 - protein, 9 aa, Homo sapiens
  light chain complementarity determining region 3 for antibody 46798
QQSYSVPRT

SEQ ID NO: 93596 - protein, 14 aa, Homo sapiens
  heavy chain complementarity determining region 3 for antibody 46798
ARDNHSRGPGYFDY

SEQ ID NO: 93597 - protein, 9 aa, Homo sapiens
  light chain complementarity determining region 3 for antibody 46799
QQSYSVPFT

SEQ ID NO: 93598 - protein, 24 aa, Homo sapiens
  heavy chain complementarity determining region 3 for antibody 46799
ARILGRRYCSGGVCYFYHYNGLDV

SEQ ID NO: 93599 - protein, 9 aa, Homo sapiens
  light chain complementarity determining region 3 for antibody 46800
QQSYSTWWT

SEQ ID NO: 93600 - protein, 13 aa, Homo sapiens
  heavy chain complementarity determining region 3 for antibody 46800
VRTTMPASGWFDH

SEQ ID NO: 93601 - protein, 9 aa, Homo sapiens
  light chain complementarity determining region 3 for antibody 46801
QQSYSTWGT

SEQ ID NO: 93602 - protein, 13 aa, Homo sapiens
  heavy chain complementarity determining region 3 for antibody 46801
VRTTMLASGWFDH

SEQ ID NO: 93603 - protein, 9 aa, Homo sapiens
  light chain complementarity determining region 3 for antibody 46802
QQSYSTPYT

SEQ ID NO: 93604 - protein, 14 aa, Homo sapiens
  heavy chain complementarity determining region 3 for antibody 46802
AGARGYSGYGGCDH

SEQ ID NO: 93605 - protein, 9 aa, Homo sapiens
  light chain complementarity determining region 3 for antibody 46803
QQSYSTPYP

SEQ ID NO: 93606 - protein, 13 aa, Homo sapiens
  heavy chain complementarity determining region 3 for antibody 46803
ARVVEMATTIFDY

SEQ ID NO: 93607 - protein, 9 aa, Homo sapiens
  light chain complementarity determining region 3 for antibody 46804
QQSYSTPWT

SEQ ID NO: 93608 - protein, 19 aa, Homo sapiens
  heavy chain complementarity determining region 3 for antibody 46804
ATLGRIQLWSKGGMGAFDI

SEQ ID NO: 93609 - protein, 9 aa, Homo sapiens
  light chain complementarity determining region 3 for antibody 46805
QQSYSTPWT

SEQ ID NO: 93610 - protein, 13 aa, Homo sapiens
  heavy chain complementarity determining region 3 for antibody 46805
ASGIAAAGYYFDY

SEQ ID NO: 93611 - protein, 9 aa, Homo sapiens
  light chain complementarity determining region 3 for antibody 46806
QQSYSTPWT

SEQ ID NO: 93612 - protein, 14 aa, Homo sapiens
  heavy chain complementarity determining region 3 for antibody 46806
ARALDRYGDYEIDS

SEQ ID NO: 93613 - protein, 10 aa, Homo sapiens
  light chain complementarity determining region 3 for antibody 46807
QQSYSTPSLP

SEQ ID NO: 93614 - protein, 19 aa, Homo sapiens
  heavy chain complementarity determining region 3 for antibody 46807
ARDRDQNKDGSFNHSALDV

SEQ ID NO: 93615 - protein, 9 aa, Homo sapiens
  light chain complementarity determining region 3 for antibody 46808
QQSYSTPRT

SEQ ID NO: 93616 - protein, 10 aa, Homo sapiens
  heavy chain complementarity determining region 3 for antibody 46808
ASGGGYYPDS

SEQ ID NO: 93617 - protein, 9 aa, Homo sapiens
  light chain complementarity determining region 3 for antibody 46809
QQSYSTPRT

SEQ ID NO: 93618 - protein, 15 aa, Homo sapiens
  heavy chain complementarity determining region 3 for antibody 46809
ARGEVGAGLKYLFDL

SEQ ID NO: 93619 - protein, 9 aa, Homo sapiens
  light chain complementarity determining region 3 for antibody 46810
QQSYSTPPT

SEQ ID NO: 93620 - protein, 22 aa, Homo sapiens
  heavy chain complementarity determining region 3 for antibody 46810
ATYGRLEGMVRGIPSLFWFFDL

SEQ ID NO: 93621 - protein, 9 aa, Homo sapiens
  light chain complementarity determining region 3 for antibody 46811
QQSYSTPPT

SEQ ID NO: 93622 - protein, 13 aa, Homo sapiens
  heavy chain complementarity determining region 3 for antibody 46811
ATNSGSYPNCLDP

SEQ ID NO: 93623 - protein, 9 aa, Homo sapiens
  light chain complementarity determining region 3 for antibody 46812
QQSYSTPPS

SEQ ID NO: 93624 - protein, 14 aa, Homo sapiens
  heavy chain complementarity determining region 3 for antibody 46812
ARSSDTSGYSRFDY

SEQ ID NO: 93625 - protein, 9 aa, Homo sapiens
  light chain complementarity determining region 3 for antibody 46813
QQSYSTPPP

SEQ ID NO: 93626 - protein, 12 aa, Homo sapiens
  heavy chain complementarity determining region 3 for antibody 46813
TRDSGSYSDPDY

SEQ ID NO: 93627 - protein, 10 aa, Homo sapiens
  light chain complementarity determining region 3 for antibody 46814
QQSYSTPPLT

SEQ ID NO: 93628 - protein, 12 aa, Homo sapiens
  heavy chain complementarity determining region 3 for antibody 46814
ARNSYEAQQLDF

SEQ ID NO: 93629 - protein, 10 aa, Homo sapiens
  light chain complementarity determining region 3 for antibody 46815
QQSYSTPPIT

SEQ ID NO: 93630 - protein, 8 aa, Homo sapiens
  heavy chain complementarity determining region 3 for antibody 46815
ACMSAPGT

SEQ ID NO: 93631 - protein, 10 aa, Homo sapiens
  light chain complementarity determining region 3 for antibody 46816
QQSYSTPPFT

SEQ ID NO: 93632 - protein, 17 aa, Homo sapiens
  heavy chain complementarity determining region 3 for antibody 46816
ARGAPISEVLTGNRFDA

SEQ ID NO: 93633 - protein, 10 aa, Homo sapiens
  light chain complementarity determining region 3 for antibody 46817
QQSYSTPLYT

SEQ ID NO: 93634 - protein, 14 aa, Homo sapiens
  heavy chain complementarity determining region 3 for antibody 46817
ARRRRLGGSYYFDV

SEQ ID NO: 93635 - protein, 9 aa, Homo sapiens
  light chain complementarity determining region 3 for antibody 46818
QQSYSTPLT

SEQ ID NO: 93636 - protein, 16 aa, Homo sapiens
  heavy chain complementarity determining region 3 for antibody 46818
ATHAVVVEATLDAFDL

SEQ ID NO: 93637 - protein, 9 aa, Homo sapiens
  light chain complementarity determining region 3 for antibody 46819
QQSYSTPLT

SEQ ID NO: 93638 - protein, 18 aa, Homo sapiens
  heavy chain complementarity determining region 3 for antibody 46819
ASAVRGYRYGFEPPPFED

SEQ ID NO: 93639 - protein, 9 aa, Homo sapiens
  light chain complementarity determining region 3 for antibody 46820
QQSYSTPHT

SEQ ID NO: 93640 - protein, 17 aa, Homo sapiens
  heavy chain complementarity determining region 3 for antibody 46820
ATLAANDFLNGADGFDV

SEQ ID NO: 93641 - protein, 10 aa, Homo sapiens
  light chain complementarity determining region 3 for antibody 46821
QQSYSTLMYT

SEQ ID NO: 93642 - protein, 21 aa, Homo sapiens
  heavy chain complementarity determining region 3 for antibody 46821
ARQTAAYCSGGSCYSLNAFDI

SEQ ID NO: 93643 - protein, 10 aa, Homo sapiens
  light chain complementarity determining region 3 for antibody 46822
QQSYSTLLYP

SEQ ID NO: 93644 - protein, 11 aa, Homo sapiens
  heavy chain complementarity determining region 3 for antibody 46822
AKDNNFWTIDY

SEQ ID NO: 93645 - protein, 10 aa, Homo sapiens
  light chain complementarity determining region 3 for antibody 46823
QQSYSTLLNT

SEQ ID NO: 93646 - protein, 11 aa, Homo sapiens
  heavy chain complementarity determining region 3 for antibody 46823
AKDNNFWTIDY

SEQ ID NO: 93647 - protein, 9 aa, Homo sapiens
  light chain complementarity determining region 3 for antibody 46824
QQSYSTLFT

SEQ ID NO: 93648 - protein, 13 aa, Homo sapiens
  heavy chain complementarity determining region 3 for antibody 46824
ARTIAAAGIQFDH

SEQ ID NO: 93649 - protein, 9 aa, Homo sapiens
  light chain complementarity determining region 3 for antibody 46825
QQSYSSRYT

SEQ ID NO: 93650 - protein, 20 aa, Homo sapiens
  heavy chain complementarity determining region 3 for antibody 46825
ARVSGVYDSYRRTDLFYFDY

SEQ ID NO: 93651 - protein, 9 aa, Homo sapiens
  light chain complementarity determining region 3 for antibody 46826
QQSYSSPNT

SEQ ID NO: 93652 - protein, 13 aa, Homo sapiens
  heavy chain complementarity determining region 3 for antibody 46826
ARSPSPGVHGFDS

SEQ ID NO: 93653 - protein, 9 aa, Homo sapiens
  light chain complementarity determining region 3 for antibody 46827
QQSYSSFRT

SEQ ID NO: 93654 - protein, 14 aa, Homo sapiens
  heavy chain complementarity determining region 3 for antibody 46827
ARRYCSGETCPEDY

SEQ ID NO: 93655 - protein, 9 aa, Homo sapiens
  light chain complementarity determining region 3 for antibody 46828
QQSYSRPWT

SEQ ID NO: 93656 - protein, 18 aa, Homo sapiens
  heavy chain complementarity determining region 3 for antibody 46828
ARGGESKSGWDQVAYLED

SEQ ID NO: 93657 - protein, 9 aa, Homo sapiens
  light chain complementarity determining region 3 for antibody 46829
QQSYSRPIT

SEQ ID NO: 93658 - protein, 12 aa, Homo sapiens
  heavy chain complementarity determining region 3 for antibody 46829
TRSKGIHIWFDP

SEQ ID NO: 93659 - protein, 9 aa, Homo sapiens
  light chain complementarity determining region 3 for antibody 46830
QQSYSPPWT

SEQ ID NO: 93660 - protein, 10 aa, Homo sapiens
  heavy chain complementarity determining region 3 for antibody 46830
ATGGIDAFDF

SEQ ID NO: 93661 - protein, 9 aa, Homo sapiens
  light chain complementarity determining region 3 for antibody 46831
QQSYSPPLT

SEQ ID NO: 93662 - protein, 15 aa, Homo sapiens
  heavy chain complementarity determining region 3 for antibody 46831
ATIFGSGTYRRGLYY

SEQ ID NO: 93663 - protein, 9 aa, Homo sapiens
  light chain complementarity determining region 3 for antibody 46832
QQSYSPPFT

SEQ ID NO: 93664 - protein, 14 aa, Homo sapiens
  heavy chain complementarity determining region 3 for antibody 46832
ASSDDSSGYSAMDV

SEQ ID NO: 93665 - protein, 9 aa, Homo sapiens
  light chain complementarity determining region 3 for antibody 46833
QQSYSNPVT

SEQ ID NO: 93666 - protein, 11 aa, Homo sapiens
  heavy chain complementarity determining region 3 for antibody 46833
ARGGNWEYFDY

SEQ ID NO: 93667 - protein, 9 aa, Homo sapiens
  light chain complementarity determining region 3 for antibody 46834
QQSYSLPLT

SEQ ID NO: 93668 - protein, 14 aa, Homo sapiens
  heavy chain complementarity determining region 3 for antibody 46834
ARDMERAVAADLDY

SEQ ID NO: 93669 - protein, 9 aa, Homo sapiens
  light chain complementarity determining region 3 for antibody 46835
QQSYSIPLT

SEQ ID NO: 93670 - protein, 12 aa, Homo sapiens
  heavy chain complementarity determining region 3 for antibody 46835
TWSSLVSLWSGD

SEQ ID NO: 93671 - protein, 9 aa, Homo sapiens
  light chain complementarity determining region 3 for antibody 46836
QQSYSHPYT

SEQ ID NO: 93672 - protein, 21 aa, Homo sapiens
  heavy chain complementarity determining region 3 for antibody 46836
VRGRFAGSGYVYGAENDAFDM

SEQ ID NO: 93673 - protein, 9 aa, Homo sapiens
  light chain complementarity determining region 3 for antibody 46837
QQSYSHPFT

SEQ ID NO: 93674 - protein, 14 aa, Homo sapiens
  heavy chain complementarity determining region 3 for antibody 46837
ARGRDTSGYSGLDD

SEQ ID NO: 93675 - protein, 13 aa, Homo sapiens
  light chain complementarity determining region 3 for antibody 46838
QQSYSGAHSGPDR

SEQ ID NO: 93676 - protein, 18 aa, Homo sapiens
  heavy chain complementarity determining region 3 for antibody 46838
VRVRCGGGDCFPGSYFDY

SEQ ID NO: 93677 - protein, 9 aa, Homo sapiens
  light chain complementarity determining region 3 for antibody 46839
QQSYSFPSS

SEQ ID NO: 93678 - protein, 16 aa, Homo sapiens
  heavy chain complementarity determining region 3 for antibody 46839
ARDNLLGDYSRSACDS

SEQ ID NO: 93679 - protein, 9 aa, Homo sapiens
  light chain complementarity determining region 3 for antibody 46840
QQSYSAPHT

SEQ ID NO: 93680 - protein, 19 aa, Homo sapiens
  heavy chain complementarity determining region 3 for antibody 46840
ATYMRNWPELGGGRYSIDV

SEQ ID NO: 93681 - protein, 10 aa, Homo sapiens
  light chain complementarity determining region 3 for antibody 46841
QQSYRTPPYP

SEQ ID NO: 93682 - protein, 14 aa, Homo sapiens
  heavy chain complementarity determining region 3 for antibody 46841
TTDGGITARPIFAS

SEQ ID NO: 93683 - protein, 9 aa, Homo sapiens
  light chain complementarity determining region 3 for antibody 46842
QQSYRTPLT

SEQ ID NO: 93684 - protein, 17 aa, Homo sapiens
  heavy chain complementarity determining region 3 for antibody 46842
ARGFGRTSSYYYYGMDV

SEQ ID NO: 93685 - protein, 9 aa, Homo sapiens
  light chain complementarity determining region 3 for antibody 46843
QQSYRMLYT

SEQ ID NO: 93686 - protein, 19 aa, Homo sapiens
  heavy chain complementarity determining region 3 for antibody 46843
AREDDRYDNNVYSWLGFDY

SEQ ID NO: 93687 - protein, 9 aa, Homo sapiens
  light chain complementarity determining region 3 for antibody 46844
QQSYNTPWT

SEQ ID NO: 93688 - protein, 12 aa, Homo sapiens
  heavy chain complementarity determining region 3 for antibody 46844
GGERFGVFAIAY

SEQ ID NO: 93689 - protein, 9 aa, Homo sapiens
  light chain complementarity determining region 3 for antibody 46845
QQSYNTPQT

SEQ ID NO: 93690 - protein, 15 aa, Homo sapiens
  heavy chain complementarity determining region 3 for antibody 46845
AREITMVRGGGWFDS

SEQ ID NO: 93691 - protein, 9 aa, Homo sapiens
  light chain complementarity determining region 3 for antibody 46846
QQSYKTPWT

SEQ ID NO: 93692 - protein, 12 aa, Homo sapiens
  heavy chain complementarity determining region 3 for antibody 46846
VRVGPSTVALEY

SEQ ID NO: 93693 - protein, 9 aa, Homo sapiens
  light chain complementarity determining region 3 for antibody 46847
QQSYITPQT

SEQ ID NO: 93694 - protein, 18 aa, Homo sapiens
  heavy chain complementarity determining region 3 for antibody 46847
ARDKTGYTSGSYAGGLDS

SEQ ID NO: 93695 - protein, 9 aa, Homo sapiens
  light chain complementarity determining region 3 for antibody 46848
QQSYITLLT

SEQ ID NO: 93696 - protein, 12 aa, Homo sapiens
  heavy chain complementarity determining region 3 for antibody 46848
SRDPPTVNALDY

SEQ ID NO: 93697 - protein, 8 aa, Homo sapiens
  light chain complementarity determining region 3 for antibody 46849
QQSYITAT

SEQ ID NO: 93698 - protein, 16 aa, Homo sapiens
  heavy chain complementarity determining region 3 for antibody 46849
AHRPYWGSGSYYAFDY

SEQ ID NO: 93699 - protein, 9 aa, Homo sapiens
  light chain complementarity determining region 3 for antibody 46850
QQSYIPPRT

SEQ ID NO: 93700 - protein, 21 aa, Homo sapiens
  heavy chain complementarity determining region 3 for antibody 46850
AQLAVGVPPTTGFGHYYGLDV

SEQ ID NO: 93701 - protein, 9 aa, Homo sapiens
  light chain complementarity determining region 3 for antibody 46851
QQSYGTPRP

SEQ ID NO: 93702 - protein, 16 aa, Homo sapiens
  heavy chain complementarity determining region 3 for antibody 46851
ARDAGVVDGTGTYFDY

SEQ ID NO: 93703 - protein, 9 aa, Homo sapiens
  light chain complementarity determining region 3 for antibody 46852
QQSYGTPFT

SEQ ID NO: 93704 - protein, 15 aa, Homo sapiens
  heavy chain complementarity determining region 3 for antibody 46852
ATDRGAVAGRHYFDF

SEQ ID NO: 93705 - protein, 9 aa, Homo sapiens
  light chain complementarity determining region 3 for antibody 46853
QQSYGPPLT

SEQ ID NO: 93706 - protein, 20 aa, Homo sapiens
  heavy chain complementarity determining region 3 for antibody 46853
SRDPEGIHDSSGYYKAAFYD

SEQ ID NO: 93707 - protein, 9 aa, Homo sapiens
  light chain complementarity determining region 3 for antibody 46854
QQSYGAPYT

SEQ ID NO: 93708 - protein, 13 aa, Homo sapiens
  heavy chain complementarity determining region 3 for antibody 46854
TSAFEYGSGSLIS

SEQ ID NO: 93709 - protein, 9 aa, Homo sapiens
  light chain complementarity determining region 3 for antibody 46855
QQSYCAPYT

SEQ ID NO: 93710 - protein, 17 aa, Homo sapiens
  heavy chain complementarity determining region 3 for antibody 46855
ACTPSIAAGGSYWYFDL

SEQ ID NO: 93711 - protein, 9 aa, Homo sapiens
  light chain complementarity determining region 3 for antibody 46856
QQSYAVPWT

SEQ ID NO: 93712 - protein, 18 aa, Homo sapiens
  heavy chain complementarity determining region 3 for antibody 46856
TRTGAGDGYNYANYGMDV

SEQ ID NO: 93713 - protein, 9 aa, Homo sapiens
  light chain complementarity determining region 3 for antibody 46857
QQSYATPFT

SEQ ID NO: 93714 - protein, 20 aa, Homo sapiens
  heavy chain complementarity determining region 3 for antibody 46857
ARDPEGVHDSYGYYRTYFDY

SEQ ID NO: 93715 - protein, 9 aa, Homo sapiens
  light chain complementarity determining region 3 for antibody 46858
QQSSSIPYT

SEQ ID NO: 93716 - protein, 16 aa, Homo sapiens
  heavy chain complementarity determining region 3 for antibody 46858
ARHSRRSANWGPPFDS

SEQ ID NO: 93717 - protein, 9 aa, Homo sapiens
  light chain complementarity determining region 3 for antibody 46859
QQSSNTPWT

SEQ ID NO: 93718 - protein, 18 aa, Homo sapiens
  heavy chain complementarity determining region 3 for antibody 46859
VKVANCVGDCKWGGTLDY

SEQ ID NO: 93719 - protein, 9 aa, Homo sapiens
  light chain complementarity determining region 3 for antibody 46860
QQSSFSPLP

SEQ ID NO: 93720 - protein, 10 aa, Homo sapiens
  heavy chain complementarity determining region 3 for antibody 46860
ARGTGWLPDH

SEQ ID NO: 93721 - protein, 9 aa, Homo sapiens
  light chain complementarity determining region 3 for antibody 46861
QQSLSVPET

SEQ ID NO: 93722 - protein, 12 aa, Homo sapiens
  heavy chain complementarity determining region 3 for antibody 46861
ASDSLEWNYFDN

SEQ ID NO: 93723 - protein, 9 aa, Homo sapiens
  light chain complementarity determining region 3 for antibody 46862
QQSHTIPPT

SEQ ID NO: 93724 - protein, 15 aa, Homo sapiens
  heavy chain complementarity determining region 3 for antibody 46862
ARGSDLEDPPGAFDL

SEQ ID NO: 93725 - protein, 9 aa, Homo sapiens
  light chain complementarity determining region 3 for antibody 46863
QQSHSWPLT

SEQ ID NO: 93726 - protein, 13 aa, Homo sapiens
  heavy chain complementarity determining region 3 for antibody 46863
ARDTPKIHRRFDF

SEQ ID NO: 93727 - protein, 10 aa, Homo sapiens
  light chain complementarity determining region 3 for antibody 46864
QQSHSTPPVT

SEQ ID NO: 93728 - protein, 15 aa, Homo sapiens
  heavy chain complementarity determining region 3 for antibody 46864
ARRSRQVQKIDAFDI

SEQ ID NO: 93729 - protein, 9 aa, Homo sapiens
  light chain complementarity determining region 3 for antibody 46865
QQSHSTPCS

SEQ ID NO: 93730 - protein, 18 aa, Homo sapiens
  heavy chain complementarity determining region 3 for antibody 46865
AGPASVTWGGNHYYYMDV

SEQ ID NO: 93731 - protein, 11 aa, Homo sapiens
  light chain complementarity determining region 3 for antibody 46866
QQSHMTLRMST

SEQ ID NO: 93732 - protein, 14 aa, Homo sapiens
  heavy chain complementarity determining region 3 for antibody 46866
ARPRGSGWVSAFDI

SEQ ID NO: 93733 - protein, 11 aa, Homo sapiens
  light chain complementarity determining region 3 for antibody 46867
QQSHMTLRLYT

SEQ ID NO: 93734 - protein, 14 aa, Homo sapiens
  heavy chain complementarity determining region 3 for antibody 46867
ARPRGSGWVSAFDI

SEQ ID NO: 93735 - protein, 9 aa, Homo sapiens
  light chain complementarity determining region 3 for antibody 46868
QQSGSSPWK

SEQ ID NO: 93736 - protein, 13 aa, Homo sapiens
  heavy chain complementarity determining region 3 for antibody 46868
ARVNSGWSSTTDF

SEQ ID NO: 93737 - protein, 9 aa, Homo sapiens
  light chain complementarity determining region 3 for antibody 46869
QQSGSSPRT

SEQ ID NO: 93738 - protein, 13 aa, Homo sapiens
  heavy chain complementarity determining region 3 for antibody 46869
ARVNSGWSSTTDF

SEQ ID NO: 93739 - protein, 9 aa, Homo sapiens
  light chain complementarity determining region 3 for antibody 46870
QQSFTPPWT

SEQ ID NO: 93740 - protein, 13 aa, Homo sapiens
  heavy chain complementarity determining region 3 for antibody 46870
VRAADGTQGVFDY

SEQ ID NO: 93741 - protein, 9 aa, Homo sapiens
  light chain complementarity determining region 3 for antibody 46871
QQSFSTPPN

SEQ ID NO: 93742 - protein, 15 aa, Homo sapiens
  heavy chain complementarity determining region 3 for antibody 46871
ARDQSDFWSGYYLDY

SEQ ID NO: 93743 - protein, 9 aa, Homo sapiens
  light chain complementarity determining region 3 for antibody 46872
QQSFSIPYT

SEQ ID NO: 93744 - protein, 14 aa, Homo sapiens
  heavy chain complementarity determining region 3 for antibody 46872
TRTPYHGDYEVFDF

SEQ ID NO: 93745 - protein, 9 aa, Homo sapiens
  light chain complementarity determining region 3 for antibody 46873
QQSFSFPLT

SEQ ID NO: 93746 - protein, 11 aa, Homo sapiens
  heavy chain complementarity determining region 3 for antibody 46873
ARDRPPDDTSA

SEQ ID NO: 93747 - protein, 10 aa, Homo sapiens
  light chain complementarity determining region 3 for antibody 46874
QQSFNTLSIT

SEQ ID NO: 93748 - protein, 13 aa, Homo sapiens
  heavy chain complementarity determining region 3 for antibody 46874
VRDFEFGSGCYDY

SEQ ID NO: 93749 - protein, 9 aa, Homo sapiens
  light chain complementarity determining region 3 for antibody 46875
QQSFKTPWP

SEQ ID NO: 93750 - protein, 19 aa, Homo sapiens
  heavy chain complementarity determining region 3 for antibody 46875
ARVSDLGERDGYNYDSFDI

SEQ ID NO: 93751 - protein, 9 aa, Homo sapiens
  light chain complementarity determining region 3 for antibody 46876
QQSFAIPLT

SEQ ID NO: 93752 - protein, 17 aa, Homo sapiens
  heavy chain complementarity determining region 3 for antibody 46876
AKAGGNTRPDYYYGMDV

SEQ ID NO: 93753 - protein, 9 aa, Homo sapiens
  light chain complementarity determining region 3 for antibody 46877
QQSDYPPLT

SEQ ID NO: 93754 - protein, 14 aa, Homo sapiens
  heavy chain complementarity determining region 3 for antibody 46877
STERIIGFGEADQL

SEQ ID NO: 93755 - protein, 9 aa, Homo sapiens
  light chain complementarity determining region 3 for antibody 46878
QQSDSIPLT

SEQ ID NO: 93756 - protein, 14 aa, Homo sapiens
  heavy chain complementarity determining region 3 for antibody 46878
ARSSDTSGYSSKLT

SEQ ID NO: 93757 - protein, 9 aa, Homo sapiens
  light chain complementarity determining region 3 for antibody 46879
QQRYWAPYT

SEQ ID NO: 93758 - protein, 17 aa, Homo sapiens
  heavy chain complementarity determining region 3 for antibody 46879
ACTPSIAAGGSYWYFDL

SEQ ID NO: 93759 - protein, 9 aa, Homo sapiens
  light chain complementarity determining region 3 for antibody 46880
QQRYTTPWT

SEQ ID NO: 93760 - protein, 12 aa, Homo sapiens
  heavy chain complementarity determining region 3 for antibody 46880
AKGRDYEVKFDS

SEQ ID NO: 93761 - protein, 9 aa, Homo sapiens
  light chain complementarity determining region 3 for antibody 46881
QQRYSTPWT

SEQ ID NO: 93762 - protein, 14 aa, Homo sapiens
  heavy chain complementarity determining region 3 for antibody 46881
ARGRLRGGGTAGDY

SEQ ID NO: 93763 - protein, 9 aa, Homo sapiens
  light chain complementarity determining region 3 for antibody 46882
QQRYSTPFT

SEQ ID NO: 93764 - protein, 15 aa, Homo sapiens
  heavy chain complementarity determining region 3 for antibody 46882
AKGRLGGKGSGYLVY

SEQ ID NO: 93765 - protein, 9 aa, Homo sapiens
  light chain complementarity determining region 3 for antibody 46883
QQRYSTPET

SEQ ID NO: 93766 - protein, 12 aa, Homo sapiens
  heavy chain complementarity determining region 3 for antibody 46883
VRDRASSGLLDS

SEQ ID NO: 93767 - protein, 10 aa, Homo sapiens
  light chain complementarity determining region 3 for antibody 46884
QQRYNWPPYP

SEQ ID NO: 93768 - protein, 15 aa, Homo sapiens
  heavy chain complementarity determining region 3 for antibody 46884
ARGATSGYQEYYFDY

SEQ ID NO: 93769 - protein, 10 aa, Homo sapiens
  light chain complementarity determining region 3 for antibody 46885
QQRYNWPPST

SEQ ID NO: 93770 - protein, 11 aa, Homo sapiens
  heavy chain complementarity determining region 3 for antibody 46885
ARGVGSYVFES

SEQ ID NO: 93771 - protein, 10 aa, Homo sapiens
  light chain complementarity determining region 3 for antibody 46886
QQRYNWPPFT

SEQ ID NO: 93772 - protein, 11 aa, Homo sapiens
  heavy chain complementarity determining region 3 for antibody 46886
SRGVGSYPFDS

SEQ ID NO: 93773 - protein, 10 aa, Homo sapiens
  light chain complementarity determining region 3 for antibody 46887
QQRYNRPPFT

SEQ ID NO: 93774 - protein, 11 aa, Homo sapiens
  heavy chain complementarity determining region 3 for antibody 46887
ARGVGSYPFDS

SEQ ID NO: 93775 - protein, 10 aa, Homo sapiens
  light chain complementarity determining region 3 for antibody 46888
QQRYNCPPYT

SEQ ID NO: 93776 - protein, 11 aa, Homo sapiens
  heavy chain complementarity determining region 3 for antibody 46888
ARGVGSYVFES

SEQ ID NO: 93777 - protein, 9 aa, Homo sapiens
  light chain complementarity determining region 3 for antibody 46889
QQRTNWPPV

SEQ ID NO: 93778 - protein, 11 aa, Homo sapiens
  heavy chain complementarity determining region 3 for antibody 46889
VKWRSSGWYDY

SEQ ID NO: 93779 - protein, 10 aa, Homo sapiens
  light chain complementarity determining region 3 for antibody 46890
QQRTNWPPPT

SEQ ID NO: 93780 - protein, 12 aa, Homo sapiens
  heavy chain complementarity determining region 3 for antibody 46890
ARDMHTSAVGDF

SEQ ID NO: 93781 - protein, 11 aa, Homo sapiens
  light chain complementarity determining region 3 for antibody 46891
QQRTNWPPGIT

SEQ ID NO: 93782 - protein, 10 aa, Homo sapiens
  heavy chain complementarity determining region 3 for antibody 46891
AGGDGESFDF

SEQ ID NO: 93783 - protein, 8 aa, Homo sapiens
  light chain complementarity determining region 3 for antibody 46892
QQRTEGLP

SEQ ID NO: 93784 - protein, 13 aa, Homo sapiens
  heavy chain complementarity determining region 3 for antibody 46892
ARDLGEGAVPDES

SEQ ID NO: 93785 - protein, 9 aa, Homo sapiens
  light chain complementarity determining region 3 for antibody 46893
QQRSTWPGT

SEQ ID NO: 93786 - protein, 9 aa, Homo sapiens
  heavy chain complementarity determining region 3 for antibody 46893
SREYGADHF

SEQ ID NO: 93787 - protein, 9 aa, Homo sapiens
  light chain complementarity determining region 3 for antibody 46894
QQRSSWSWT

SEQ ID NO: 93788 - protein, 14 aa, Homo sapiens
  heavy chain complementarity determining region 3 for antibody 46894
VGEPDYGDLNGFDI

SEQ ID NO: 93789 - protein, 8 aa, Homo sapiens
  light chain complementarity determining region 3 for antibody 46895
QQRSSWIP

SEQ ID NO: 93790 - protein, 20 aa, Homo sapiens
  heavy chain complementarity determining region 3 for antibody 46895
ARDQVFCSGGNCFGFDYFDP

SEQ ID NO: 93791 - protein, 8 aa, Homo sapiens
  light chain complementarity determining region 3 for antibody 46896
QQRSSWFT

SEQ ID NO: 93792 - protein, 20 aa, Homo sapiens
  heavy chain complementarity determining region 3 for antibody 46896
ARDQVFCSGGNCFGFDYFDP

SEQ ID NO: 93793 - protein, 9 aa, Homo sapiens
  light chain complementarity determining region 3 for antibody 46897
QQRSNWRYT

SEQ ID NO: 93794 - protein, 13 aa, Homo sapiens
  heavy chain complementarity determining region 3 for antibody 46897
AKEMKGLRGAFDI

SEQ ID NO: 93795 - protein, 9 aa, Homo sapiens
  light chain complementarity determining region 3 for antibody 46898
QQRSNWQYT

SEQ ID NO: 93796 - protein, 15 aa, Homo sapiens
  heavy chain complementarity determining region 3 for antibody 46898
ARDPGYTNGYWYFDL

SEQ ID NO: 93797 - protein, 9 aa, Homo sapiens
  light chain complementarity determining region 3 for antibody 46899
QQRSNWPVT

SEQ ID NO: 93798 - protein, 17 aa, Homo sapiens
  heavy chain complementarity determining region 3 for antibody 46899
AAGYHSESFFADDAFDL

SEQ ID NO: 93799 - protein, 9 aa, Homo sapiens
  light chain complementarity determining region 3 for antibody 46900
QQRSNWPQT

SEQ ID NO: 93800 - protein, 10 aa, Homo sapiens
  heavy chain complementarity determining region 3 for antibody 46900
VCFTSSCPGY

SEQ ID NO: 93801 - protein, 10 aa, Homo sapiens
  light chain complementarity determining region 3 for antibody 46901
QQRSNWPPYT

SEQ ID NO: 93802 - protein, 12 aa, Homo sapiens
  heavy chain complementarity determining region 3 for antibody 46901
VGSLTERDAFDV

SEQ ID NO: 93803 - protein, 10 aa, Homo sapiens
  light chain complementarity determining region 3 for antibody 46902
QQRSNWPPYP

SEQ ID NO: 93804 - protein, 13 aa, Homo sapiens
  heavy chain complementarity determining region 3 for antibody 46902
AREGYYGSGEFDL

SEQ ID NO: 93805 - protein, 11 aa, Homo sapiens
  light chain complementarity determining region 3 for antibody 46903
QQRSNWPPVFP

SEQ ID NO: 93806 - protein, 14 aa, Homo sapiens
  heavy chain complementarity determining region 3 for antibody 46903
TRHPTVGGPVGFDT

SEQ ID NO: 93807 - protein, 10 aa, Homo sapiens
  light chain complementarity determining region 3 for antibody 46904
QQRSNWPPTT

SEQ ID NO: 93808 - protein, 12 aa, Homo sapiens
  heavy chain complementarity determining region 3 for antibody 46904
VKSGYSNGWYGH

SEQ ID NO: 93809 - protein, 11 aa, Homo sapiens
  light chain complementarity determining region 3 for antibody 46905
QQRSNWPPTGT

SEQ ID NO: 93810 - protein, 11 aa, Homo sapiens
  heavy chain complementarity determining region 3 for antibody 46905
ARVGDWNDLEY

SEQ ID NO: 93811 - protein, 9 aa, Homo sapiens
  light chain complementarity determining region 3 for antibody 46906
QQRSNWPPT

SEQ ID NO: 93812 - protein, 12 aa, Homo sapiens
  heavy chain complementarity determining region 3 for antibody 46906
AGDRGSHKWSYY

SEQ ID NO: 93813 - protein, 11 aa, Homo sapiens
  light chain complementarity determining region 3 for antibody 46907
QQRSNWPPRYT

SEQ ID NO: 93814 - protein, 16 aa, Homo sapiens
  heavy chain complementarity determining region 3 for antibody 46907
ARQPWTRFGHPAAFDL

SEQ ID NO: 93815 - protein, 10 aa, Homo sapiens
  light chain complementarity determining region 3 for antibody 46908
QQRSNWPPRT

SEQ ID NO: 93816 - protein, 11 aa, Homo sapiens
  heavy chain complementarity determining region 3 for antibody 46908
AGWRPTRHFDY

SEQ ID NO: 93817 - protein, 10 aa, Homo sapiens
  light chain complementarity determining region 3 for antibody 46909
QQRSNWPPPT

SEQ ID NO: 93818 - protein, 11 aa, Homo sapiens
  heavy chain complementarity determining region 3 for antibody 46909
AGWRPTRHFDY

SEQ ID NO: 93819 - protein, 11 aa, Homo sapiens
  light chain complementarity determining region 3 for antibody 46910
QQRSNWPPLYI

SEQ ID NO: 93820 - protein, 18 aa, Homo sapiens
  heavy chain complementarity determining region 3 for antibody 46910
AARGANCGGACYYWYFDV

SEQ ID NO: 93821 - protein, 10 aa, Homo sapiens
  light chain complementarity determining region 3 for antibody 46911
QQRSNWPPLT

SEQ ID NO: 93822 - protein, 15 aa, Homo sapiens
  heavy chain complementarity determining region 3 for antibody 46911
ARAVPDYGDYGYFDY

SEQ ID NO: 93823 - protein, 10 aa, Homo sapiens
  light chain complementarity determining region 3 for antibody 46912
QQRSNWPPKT

SEQ ID NO: 93824 - protein, 12 aa, Homo sapiens
  heavy chain complementarity determining region 3 for antibody 46912
VKSGYSNGWYGH

SEQ ID NO: 93825 - protein, 11 aa, Homo sapiens
  light chain complementarity determining region 3 for antibody 46913
QQRSNWPPKGM

SEQ ID NO: 93826 - protein, 18 aa, Homo sapiens
  heavy chain complementarity determining region 3 for antibody 46913
TRDRDDPLNGFGISVFDL

SEQ ID NO: 93827 - protein, 10 aa, Homo sapiens
  light chain complementarity determining region 3 for antibody 46914
QQRSNWPPIT

SEQ ID NO: 93828 - protein, 17 aa, Homo sapiens
  heavy chain complementarity determining region 3 for antibody 46914
AAGYHSESLSADDVFDM

SEQ ID NO: 93829 - protein, 10 aa, Homo sapiens
  light chain complementarity determining region 3 for antibody 46915
QQRSNWPPIP

SEQ ID NO: 93830 - protein, 17 aa, Homo sapiens
  heavy chain complementarity determining region 3 for antibody 46915
ARSRGITMVRGAYYFDY

SEQ ID NO: 93831 - protein, 10 aa, Homo sapiens
  light chain complementarity determining region 3 for antibody 46916
QQRSNWPPIP

SEQ ID NO: 93832 - protein, 13 aa, Homo sapiens
  heavy chain complementarity determining region 3 for antibody 46916
ARDYGDSYWHFDL

SEQ ID NO: 93833 - protein, 11 aa, Homo sapiens
  light chain complementarity determining region 3 for antibody 46917
QQRSNWPPGFT

SEQ ID NO: 93834 - protein, 12 aa, Homo sapiens
  heavy chain complementarity determining region 3 for antibody 46917
ARVGPSTVTLEY

SEQ ID NO: 93835 - protein, 11 aa, Homo sapiens
  light chain complementarity determining region 3 for antibody 46918
QQRSNWPPGFT

SEQ ID NO: 93836 - protein, 20 aa, Homo sapiens
  heavy chain complementarity determining region 3 for antibody 46918
ARGPDVSGKSAYPYYYGLDV

SEQ ID NO: 93837 - protein, 10 aa, Homo sapiens
  light chain complementarity determining region 3 for antibody 46919
QQRSNWPPFT

SEQ ID NO: 93838 - protein, 16 aa, Homo sapiens
  heavy chain complementarity determining region 3 for antibody 46919
ARDCGGSSGCHRYFDH

SEQ ID NO: 93839 - protein, 9 aa, Homo sapiens
  light chain complementarity determining region 3 for antibody 46920
QQRSNWPPA

SEQ ID NO: 93840 - protein, 13 aa, Homo sapiens
  heavy chain complementarity determining region 3 for antibody 46920
ARSQLLNLDAFDF

SEQ ID NO: 93841 - protein, 9 aa, Homo sapiens
  light chain complementarity determining region 3 for antibody 46921
QQRSNWPLT

SEQ ID NO: 93842 - protein, 13 aa, Homo sapiens
  heavy chain complementarity determining region 3 for antibody 46921
LFRDGSNSVPFDV

SEQ ID NO: 93843 - protein, 9 aa, Homo sapiens
  light chain complementarity determining region 3 for antibody 46922
QQRSNWPLT

SEQ ID NO: 93844 - protein, 23 aa, Homo sapiens
  heavy chain complementarity determining region 3 for antibody 46922
ARLGPVSRDFWSSYYRYKYGMDV

SEQ ID NO: 93845 - protein, 9 aa, Homo sapiens
  light chain complementarity determining region 3 for antibody 46923
QQRSNWPLT

SEQ ID NO: 93846 - protein, 13 aa, Homo sapiens
  heavy chain complementarity determining region 3 for antibody 46923
ARGVPHLGKSFDV

SEQ ID NO: 93847 - protein, 9 aa, Homo sapiens
  light chain complementarity determining region 3 for antibody 46924
QQRSNWLIT

SEQ ID NO: 93848 - protein, 13 aa, Homo sapiens
  heavy chain complementarity determining region 3 for antibody 46924
ARADIAAAAVFDY

SEQ ID NO: 93849 - protein, 8 aa, Homo sapiens
  light chain complementarity determining region 3 for antibody 46925
QQRSNWGT

SEQ ID NO: 93850 - protein, 19 aa, Homo sapiens
  heavy chain complementarity determining region 3 for antibody 46925
VQESPYCRGSDCRLYYFDH

SEQ ID NO: 93851 - protein, 6 aa, Homo sapiens
  light chain complementarity determining region 3 for antibody 46926
QQRSNL

SEQ ID NO: 93852 - protein, 18 aa, Homo sapiens
  heavy chain complementarity determining region 3 for antibody 46926
ARGADTDSSGFYCGAFDI

SEQ ID NO: 93853 - protein, 10 aa, Homo sapiens
  light chain complementarity determining region 3 for antibody 46927
QQRSKWPPWP

SEQ ID NO: 93854 - protein, 14 aa, Homo sapiens
  heavy chain complementarity determining region 3 for antibody 46927
ARDRAMVRGDGIDY

SEQ ID NO: 93855 - protein, 10 aa, Homo sapiens
  light chain complementarity determining region 3 for antibody 46928
QQRSKWPPLT

SEQ ID NO: 93856 - protein, 9 aa, Homo sapiens
  heavy chain complementarity determining region 3 for antibody 46928
AKVDGYFDY

SEQ ID NO: 93857 - protein, 10 aa, Homo sapiens
  light chain complementarity determining region 3 for antibody 46929
QQRSKWPPIT

SEQ ID NO: 93858 - protein, 9 aa, Homo sapiens
  heavy chain complementarity determining region 3 for antibody 46929
ARVDGYFDY

SEQ ID NO: 93859 - protein, 11 aa, Homo sapiens
  light chain complementarity determining region 3 for antibody 46930
QQRSIWPRMYT

SEQ ID NO: 93860 - protein, 16 aa, Homo sapiens
  heavy chain complementarity determining region 3 for antibody 46930
GRFKNIDSGTNFVRDY

SEQ ID NO: 93861 - protein, 10 aa, Homo sapiens
  light chain complementarity determining region 3 for antibody 46931
QQRSIWPPLT

SEQ ID NO: 93862 - protein, 14 aa, Homo sapiens
  heavy chain complementarity determining region 3 for antibody 46931
ARGKSAAGQAAFDI

SEQ ID NO: 93863 - protein, 8 aa, Homo sapiens
  light chain complementarity determining region 3 for antibody 46932
QQRSDLFT

SEQ ID NO: 93864 - protein, 18 aa, Homo sapiens
  heavy chain complementarity determining region 3 for antibody 46932
AKATARHCSGYNCYYFDY

SEQ ID NO: 93865 - protein, 11 aa, Homo sapiens
  light chain complementarity determining region 3 for antibody 46933
QQRQPRSNWRT

SEQ ID NO: 93866 - protein, 15 aa, Homo sapiens
  heavy chain complementarity determining region 3 for antibody 46933
ARGGYSSSWYYWFDP

SEQ ID NO: 93867 - protein, 11 aa, Homo sapiens
  light chain complementarity determining region 3 for antibody 46934
QQRQGSTNWLN

SEQ ID NO: 93868 - protein, 15 aa, Homo sapiens
  heavy chain complementarity determining region 3 for antibody 46934
ARGGYSSNWYWWFDP

SEQ ID NO: 93869 - protein, 11 aa, Homo sapiens
  light chain complementarity determining region 3 for antibody 46935
QQRQESTNWPN

SEQ ID NO: 93870 - protein, 15 aa, Homo sapiens
  heavy chain complementarity determining region 3 for antibody 46935
ARGGYSSNWYWWFDP

SEQ ID NO: 93871 - protein, 11 aa, Homo sapiens
  light chain complementarity determining region 3 for antibody 46936
QQRQESTHWLN

SEQ ID NO: 93872 - protein, 15 aa, Homo sapiens
  heavy chain complementarity determining region 3 for antibody 46936
ARGGYSSNWYWWFDP

SEQ ID NO: 93873 - protein, 11 aa, Homo sapiens
  light chain complementarity determining region 3 for antibody 46937
QQRPESTNWLN

SEQ ID NO: 93874 - protein, 15 aa, Homo sapiens
  heavy chain complementarity determining region 3 for antibody 46937
ARGGYSSNWYWWFDP

SEQ ID NO: 93875 - protein, 11 aa, Homo sapiens
  light chain complementarity determining region 3 for antibody 46938
QQRNTWPPLFT

SEQ ID NO: 93876 - protein, 20 aa, Homo sapiens
  heavy chain complementarity determining region 3 for antibody 46938
ARMANSFVGGVVVTHDAFDI

SEQ ID NO: 93877 - protein, 9 aa, Homo sapiens
  light chain complementarity determining region 3 for antibody 46939
QQRNSWPLT

SEQ ID NO: 93878 - protein, 16 aa, Homo sapiens
  heavy chain complementarity determining region 3 for antibody 46939
VRGFWHSGSYREYFHY

SEQ ID NO: 93879 - protein, 9 aa, Homo sapiens
  light chain complementarity determining region 3 for antibody 46940
QQRNNWRGT

SEQ ID NO: 93880 - protein, 17 aa, Homo sapiens
  heavy chain complementarity determining region 3 for antibody 46940
ARDSGYSSGWGSGPFDI

SEQ ID NO: 93881 - protein, 9 aa, Homo sapiens
  light chain complementarity determining region 3 for antibody 46941
QQRNNWPPT

SEQ ID NO: 93882 - protein, 13 aa, Homo sapiens
  heavy chain complementarity determining region 3 for antibody 46941
ARDMDDSGDLFDY

SEQ ID NO: 93883 - protein, 10 aa, Homo sapiens
  light chain complementarity determining region 3 for antibody 46942
QQRNNWPPIT

SEQ ID NO: 93884 - protein, 17 aa, Homo sapiens
  heavy chain complementarity determining region 3 for antibody 46942
AAGYHSKSFFADDAFDL

SEQ ID NO: 93885 - protein, 9 aa, Homo sapiens
  light chain complementarity determining region 3 for antibody 46943
QQRNNWPFT

SEQ ID NO: 93886 - protein, 15 aa, Homo sapiens
  heavy chain complementarity determining region 3 for antibody 46943
ARLRENIVVTGILDY

SEQ ID NO: 93887 - protein, 9 aa, Homo sapiens
  light chain complementarity determining region 3 for antibody 46944
QQRNNLGVT

SEQ ID NO: 93888 - protein, 16 aa, Homo sapiens
  heavy chain complementarity determining region 3 for antibody 46944
ARGLSIIRGVMSPFDL

SEQ ID NO: 93889 - protein, 10 aa, Homo sapiens
  light chain complementarity determining region 3 for antibody 46945
QQRNDWPPVT

SEQ ID NO: 93890 - protein, 12 aa, Homo sapiens
  heavy chain complementarity determining region 3 for antibody 46945
VRDGSSGWHFDY

SEQ ID NO: 93891 - protein, 9 aa, Homo sapiens
  light chain complementarity determining region 3 for antibody 46946
QQRHTWRYT

SEQ ID NO: 93892 - protein, 11 aa, Homo sapiens
  heavy chain complementarity determining region 3 for antibody 46946
AREAYGTTTDY

SEQ ID NO: 93893 - protein, 8 aa, Homo sapiens
  light chain complementarity determining region 3 for antibody 46947
QQRGDWPT

SEQ ID NO: 93894 - protein, 17 aa, Homo sapiens
  heavy chain complementarity determining region 3 for antibody 46947
ARDVGPRRSLLHNAFDI

SEQ ID NO: 93895 - protein, 9 aa, Homo sapiens
  light chain complementarity determining region 3 for antibody 46948
QQRFSTPRT

SEQ ID NO: 93896 - protein, 19 aa, Homo sapiens
  heavy chain complementarity determining region 3 for antibody 46948
AKDWGGCSGTNCYMAYFDF

SEQ ID NO: 93897 - protein, 10 aa, Homo sapiens
  light chain complementarity determining region 3 for antibody 46949
QQRDNWPPWP

SEQ ID NO: 93898 - protein, 15 aa, Homo sapiens
  heavy chain complementarity determining region 3 for antibody 46949
ARDAPLGVGGRGFDI

SEQ ID NO: 93899 - protein, 10 aa, Homo sapiens
  light chain complementarity determining region 3 for antibody 46950
QQRASWPPAP

SEQ ID NO: 93900 - protein, 12 aa, Homo sapiens
  heavy chain complementarity determining region 3 for antibody 46950
TRAYPQYTVSIN

SEQ ID NO: 93901 - protein, 8 aa, Homo sapiens
  light chain complementarity determining region 3 for antibody 46951
QQRAEWVT

SEQ ID NO: 93902 - protein, 21 aa, Homo sapiens
  heavy chain complementarity determining region 3 for antibody 46951
ARNDPDNIEDGGTSHFNYFAQ

SEQ ID NO: 93903 - protein, 9 aa, Homo sapiens
  light chain complementarity determining region 3 for antibody 46952
QQRAEWPLT

SEQ ID NO: 93904 - protein, 17 aa, Homo sapiens
  heavy chain complementarity determining region 3 for antibody 46952
ARDGSHRGLGSNYYFDF

SEQ ID NO: 93905 - protein, 9 aa, Homo sapiens
  light chain complementarity determining region 3 for antibody 46953
QQPYSPPFT

SEQ ID NO: 93906 - protein, 14 aa, Homo sapiens
  heavy chain complementarity determining region 3 for antibody 46953
ARGRDTSGYSGLDY

SEQ ID NO: 93907 - protein, 9 aa, Homo sapiens
  light chain complementarity determining region 3 for antibody 46954
QQNYNTPRT

SEQ ID NO: 93908 - protein, 12 aa, Homo sapiens
  heavy chain complementarity determining region 3 for antibody 46954
ARNGGGSYGMDV

SEQ ID NO: 93909 - protein, 9 aa, Homo sapiens
  light chain complementarity determining region 3 for antibody 46955
QQNYILPLT

SEQ ID NO: 93910 - protein, 17 aa, Homo sapiens
  heavy chain complementarity determining region 3 for antibody 46955
ARDGGYGDSFPSDSFDI

SEQ ID NO: 93911 - protein, 9 aa, Homo sapiens
  light chain complementarity determining region 3 for antibody 46956
QQNYIAPYT

SEQ ID NO: 93912 - protein, 16 aa, Homo sapiens
  heavy chain complementarity determining region 3 for antibody 46956
AKDKRSGRPIPVGLDV

SEQ ID NO: 93913 - protein, 8 aa, Homo sapiens
  light chain complementarity determining region 3 for antibody 46957
QQNKSYSA

SEQ ID NO: 93914 - protein, 15 aa, Homo sapiens
  heavy chain complementarity determining region 3 for antibody 46957
ARGQNLVRMHDALDF

SEQ ID NO: 93915 - protein, 9 aa, Homo sapiens
  light chain complementarity determining region 3 for antibody 46958
QQNGTSMYI

SEQ ID NO: 93916 - protein, 10 aa, Homo sapiens
  heavy chain complementarity determining region 3 for antibody 46958
TRSEGYGMDV

SEQ ID NO: 93917 - protein, 9 aa, Homo sapiens
  light chain complementarity determining region 3 for antibody 46959
QQNGSSPQT

SEQ ID NO: 93918 - protein, 12 aa, Homo sapiens
  heavy chain complementarity determining region 3 for antibody 46959
ARNGYSSSWYRN

SEQ ID NO: 93919 - protein, 9 aa, Homo sapiens
  light chain complementarity determining region 3 for antibody 46960
QQNGRSAWT

SEQ ID NO: 93920 - protein, 15 aa, Homo sapiens
  heavy chain complementarity determining region 3 for antibody 46960
ARLHSSSFGNHAFDI

SEQ ID NO: 93921 - protein, 9 aa, Homo sapiens
  light chain complementarity determining region 3 for antibody 46961
QQNGDSPWT

SEQ ID NO: 93922 - protein, 11 aa, Homo sapiens
  heavy chain complementarity determining region 3 for antibody 46961
ARIDVTVGYDI

SEQ ID NO: 93923 - protein, 9 aa, Homo sapiens
  light chain complementarity determining region 3 for antibody 46962
QQNDNLPIT

SEQ ID NO: 93924 - protein, 24 aa, Homo sapiens
  heavy chain complementarity determining region 3 for antibody 46962
ARHRMRRYDFWNGPSVHYYYAMDV

SEQ ID NO: 93925 - protein, 9 aa, Homo sapiens
  light chain complementarity determining region 3 for antibody 46963
QQNCSSPLT

SEQ ID NO: 93926 - protein, 22 aa, Homo sapiens
  heavy chain complementarity determining region 3 for antibody 46963
ARVWGLYYSSWYGPGHYYGMDV

SEQ ID NO: 93927 - protein, 8 aa, Homo sapiens
  light chain complementarity determining region 3 for antibody 46964
QQLSTYVV

SEQ ID NO: 93928 - protein, 10 aa, Homo sapiens
  heavy chain complementarity determining region 3 for antibody 46964
ARGPWPGFDP

SEQ ID NO: 93929 - protein, 9 aa, Homo sapiens
  light chain complementarity determining region 3 for antibody 46965
QQLNSYPRT

SEQ ID NO: 93930 - protein, 11 aa, Homo sapiens
  heavy chain complementarity determining region 3 for antibody 46965
ARGDYGDYLVH

SEQ ID NO: 93931 - protein, 9 aa, Homo sapiens
  light chain complementarity determining region 3 for antibody 46966
QQLNSYPLT

SEQ ID NO: 93932 - protein, 10 aa, Homo sapiens
  heavy chain complementarity determining region 3 for antibody 46966
ARHKQWLVHY

SEQ ID NO: 93933 - protein, 9 aa, Homo sapiens
  light chain complementarity determining region 3 for antibody 46967
QQLNSYPLT

SEQ ID NO: 93934 - protein, 24 aa, Homo sapiens
  heavy chain complementarity determining region 3 for antibody 46967
ARGDIIVEAAATGPKYYYYYGMDV

SEQ ID NO: 93935 - protein, 9 aa, Homo sapiens
  light chain complementarity determining region 3 for antibody 46968
QQLLTSPNT

SEQ ID NO: 93936 - protein, 16 aa, Homo sapiens
  heavy chain complementarity determining region 3 for antibody 46968
GKEFYLVTGGSWGLDH

SEQ ID NO: 93937 - protein, 10 aa, Homo sapiens
  light chain complementarity determining region 3 for antibody 46969
QQLKSFPRGF

SEQ ID NO: 93938 - protein, 15 aa, Homo sapiens
  heavy chain complementarity determining region 3 for antibody 46969
ARAQVIWGQLYYFDS

SEQ ID NO: 93939 - protein, 9 aa, Homo sapiens
  light chain complementarity determining region 3 for antibody 46970
QQLHALPWP

SEQ ID NO: 93940 - protein, 18 aa, Homo sapiens
  heavy chain complementarity determining region 3 for antibody 46970
ANDVGGYCSGGSCPGLDS

SEQ ID NO: 93941 - protein, 9 aa, Homo sapiens
  light chain complementarity determining region 3 for antibody 46971
QQLGSSPCP

SEQ ID NO: 93942 - protein, 18 aa, Homo sapiens
  heavy chain complementarity determining region 3 for antibody 46971
ARESRDTVLLPALNWFDP

SEQ ID NO: 93943 - protein, 9 aa, Homo sapiens
  light chain complementarity determining region 3 for antibody 46972
QQLESYPRT

SEQ ID NO: 93944 - protein, 17 aa, Homo sapiens
  heavy chain complementarity determining region 3 for antibody 46972
ARDGDTSGWSPLGWFDS

SEQ ID NO: 93945 - protein, 9 aa, Homo sapiens
  light chain complementarity determining region 3 for antibody 46973
QQLDSYPRT

SEQ ID NO: 93946 - protein, 17 aa, Homo sapiens
  heavy chain complementarity determining region 3 for antibody 46973
ARDGDSSGWSPLGWFDS

SEQ ID NO: 93947 - protein, 9 aa, Homo sapiens
  light chain complementarity determining region 3 for antibody 46974
QQLDSYPFT

SEQ ID NO: 93948 - protein, 7 aa, Homo sapiens
  heavy chain complementarity determining region 3 for antibody 46974
AKEVFGQ

SEQ ID NO: 93949 - protein, 9 aa, Homo sapiens
  light chain complementarity determining region 3 for antibody 46975
QQLDAVPCT

SEQ ID NO: 93950 - protein, 15 aa, Homo sapiens
  heavy chain complementarity determining region 3 for antibody 46975
TRRGDLDGDTSGCDS

SEQ ID NO: 93951 - protein, 8 aa, Homo sapiens
  light chain complementarity determining region 3 for antibody 46976
QQHVSSGS

SEQ ID NO: 93952 - protein, 13 aa, Homo sapiens
  heavy chain complementarity determining region 3 for antibody 46976
VRTWFGELSHFDF

SEQ ID NO: 93953 - protein, 8 aa, Homo sapiens
  light chain complementarity determining region 3 for antibody 46977
QQHSDLFT

SEQ ID NO: 93954 - protein, 18 aa, Homo sapiens
  heavy chain complementarity determining region 3 for antibody 46977
AKGPVGSCSSRKCYHFDS

SEQ ID NO: 93955 - protein, 10 aa, Homo sapiens
  light chain complementarity determining region 3 for antibody 46978
QQHNSWPPLT

SEQ ID NO: 93956 - protein, 14 aa, Homo sapiens
  heavy chain complementarity determining region 3 for antibody 46978
ARSQWEAPGTPPAV

SEQ ID NO: 93957 - protein, 9 aa, Homo sapiens
  light chain complementarity determining region 3 for antibody 46979
QQHNSFPYT

SEQ ID NO: 93958 - protein, 17 aa, Homo sapiens
  heavy chain complementarity determining region 3 for antibody 46979
ARDTSALGPYGSGILDI

SEQ ID NO: 93959 - protein, 11 aa, Homo sapiens
  light chain complementarity determining region 3 for antibody 46980
QQHKNWPPKWT

SEQ ID NO: 93960 - protein, 15 aa, Homo sapiens
  heavy chain complementarity determining region 3 for antibody 46980
ARDKFYDSGYYPFDY

SEQ ID NO: 93961 - protein, 8 aa, Homo sapiens
  light chain complementarity determining region 3 for antibody 46981
QQHGSSVS

SEQ ID NO: 93962 - protein, 13 aa, Homo sapiens
  heavy chain complementarity determining region 3 for antibody 46981
VRTWFGELSHFDF

SEQ ID NO: 93963 - protein, 9 aa, Homo sapiens
  light chain complementarity determining region 3 for antibody 46982
QQHGSSPWT

SEQ ID NO: 93964 - protein, 17 aa, Homo sapiens
  heavy chain complementarity determining region 3 for antibody 46982
ARGGAYYDSSGYDQFDY

SEQ ID NO: 93965 - protein, 10 aa, Homo sapiens
  light chain complementarity determining region 3 for antibody 46983
QQHGSSPTWT

SEQ ID NO: 93966 - protein, 9 aa, Homo sapiens
  heavy chain complementarity determining region 3 for antibody 46983
ARGEYSSTH

SEQ ID NO: 93967 - protein, 9 aa, Homo sapiens
  light chain complementarity determining region 3 for antibody 46984
QQHGSSPRT

SEQ ID NO: 93968 - protein, 16 aa, Homo sapiens
  heavy chain complementarity determining region 3 for antibody 46984
ARWSTGDQKSVYGLDV

SEQ ID NO: 93969 - protein, 10 aa, Homo sapiens
  light chain complementarity determining region 3 for antibody 46985
QQHGSSPKGT

SEQ ID NO: 93970 - protein, 9 aa, Homo sapiens
  heavy chain complementarity determining region 3 for antibody 46985
ARGEYSSTH

SEQ ID NO: 93971 - protein, 8 aa, Homo sapiens
  light chain complementarity determining region 3 for antibody 46986
QQHDTNSS

SEQ ID NO: 93972 - protein, 16 aa, Homo sapiens
  heavy chain complementarity determining region 3 for antibody 46986
ARVISKWESILDAFKM

SEQ ID NO: 93973 - protein, 9 aa, Homo sapiens
  light chain complementarity determining region 3 for antibody 46987
QQHDSLPIT

SEQ ID NO: 93974 - protein, 15 aa, Homo sapiens
  heavy chain complementarity determining region 3 for antibody 46987
AGDPSRLVVGGYFDH

SEQ ID NO: 93975 - protein, 8 aa, Homo sapiens
  light chain complementarity determining region 3 for antibody 46988
QQHADSRT

SEQ ID NO: 93976 - protein, 15 aa, Homo sapiens
  heavy chain complementarity determining region 3 for antibody 46988
AKAQVIWGHLYYFES

SEQ ID NO: 93977 - protein, 9 aa, Homo sapiens
  light chain complementarity determining region 3 for antibody 46989
QQGYSTPFT

SEQ ID NO: 93978 - protein, 15 aa, Homo sapiens
  heavy chain complementarity determining region 3 for antibody 46989
ARAQVIWGQLYYFDL

SEQ ID NO: 93979 - protein, 9 aa, Homo sapiens
  light chain complementarity determining region 3 for antibody 46990
QQGYSPPQT

SEQ ID NO: 93980 - protein, 22 aa, Homo sapiens
  heavy chain complementarity determining region 3 for antibody 46990
ARAPPRDYDTSGNYLGVYYFDY

SEQ ID NO: 93981 - protein, 9 aa, Homo sapiens
  light chain complementarity determining region 3 for antibody 46991
QQGYSPPFI

SEQ ID NO: 93982 - protein, 15 aa, Homo sapiens
  heavy chain complementarity determining region 3 for antibody 46991
TRAQVIWGQLYYFDY

SEQ ID NO: 93983 - protein, 9 aa, Homo sapiens
  light chain complementarity determining region 3 for antibody 46992
QQGYSFPHT

SEQ ID NO: 93984 - protein, 16 aa, Homo sapiens
  heavy chain complementarity determining region 3 for antibody 46992
ARPGLPSSYGSSSYRH

SEQ ID NO: 93985 - protein, 9 aa, Homo sapiens
  light chain complementarity determining region 3 for antibody 46993
QQGSTWPPS

SEQ ID NO: 93986 - protein, 13 aa, Homo sapiens
  heavy chain complementarity determining region 3 for antibody 46993
ARDFPGYPSNFDF

SEQ ID NO: 93987 - protein, 10 aa, Homo sapiens
  light chain complementarity determining region 3 for antibody 46994
QQGSSFPQLT

SEQ ID NO: 93988 - protein, 17 aa, Homo sapiens
  heavy chain complementarity determining region 3 for antibody 46994
ARIPADYGGNAEYYFDY

SEQ ID NO: 93989 - protein, 9 aa, Homo sapiens
  light chain complementarity determining region 3 for antibody 46995
QQGSRTPLT

SEQ ID NO: 93990 - protein, 11 aa, Homo sapiens
  heavy chain complementarity determining region 3 for antibody 46995
GRGHYSFRIET

SEQ ID NO: 93991 - protein, 9 aa, Homo sapiens
  light chain complementarity determining region 3 for antibody 46996
QQGSNFPWT

SEQ ID NO: 93992 - protein, 10 aa, Homo sapiens
  heavy chain complementarity determining region 3 for antibody 46996
ARDHVWAFDS

SEQ ID NO: 93993 - protein, 9 aa, Homo sapiens
  light chain complementarity determining region 3 for antibody 46997
QQGRNFPGT

SEQ ID NO: 93994 - protein, 10 aa, Homo sapiens
  heavy chain complementarity determining region 3 for antibody 46997
ARDHVWAFDS

SEQ ID NO: 93995 - protein, 8 aa, Homo sapiens
  light chain complementarity determining region 3 for antibody 46998
QQGNSSWT

SEQ ID NO: 93996 - protein, 13 aa, Homo sapiens
  heavy chain complementarity determining region 3 for antibody 46998
AKVKVVGVWLFDL

SEQ ID NO: 93997 - protein, 10 aa, Homo sapiens
  light chain complementarity determining region 3 for antibody 46999
QQGGTSPPWT

SEQ ID NO: 93998 - protein, 12 aa, Homo sapiens
  heavy chain complementarity determining region 3 for antibody 46999
ARGGSSGYQLDY

SEQ ID NO: 93999 - protein, 9 aa, Homo sapiens
  light chain complementarity determining region 3 for antibody 47000
QQFYSTPLT

SEQ ID NO: 94000 - protein, 16 aa, Homo sapiens
  heavy chain complementarity determining region 3 for antibody 47000
AGLALTGVGGRGWIDA

SEQ ID NO: 94001 - protein, 9 aa, Homo sapiens
  light chain complementarity determining region 3 for antibody 47001
QQFNTYPLT

SEQ ID NO: 94002 - protein, 18 aa, Homo sapiens
  heavy chain complementarity determining region 3 for antibody 47001
ARGPYCSGETCYSQYFDS

SEQ ID NO: 94003 - protein, 10 aa, Homo sapiens
  light chain complementarity determining region 3 for antibody 47002
QQFNSWPPFT

SEQ ID NO: 94004 - protein, 17 aa, Homo sapiens
  heavy chain complementarity determining region 3 for antibody 47002
ARDPVVVQVGANTFCDH

SEQ ID NO: 94005 - protein, 8 aa, Homo sapiens
  light chain complementarity determining region 3 for antibody 47003
QQFNNWYT

SEQ ID NO: 94006 - protein, 14 aa, Homo sapiens
  heavy chain complementarity determining region 3 for antibody 47003
AKEGDYDSSGYFDY

SEQ ID NO: 94007 - protein, 9 aa, Homo sapiens
  light chain complementarity determining region 3 for antibody 47004
QQFNIYPFT

SEQ ID NO: 94008 - protein, 14 aa, Homo sapiens
  heavy chain complementarity determining region 3 for antibody 47004
AKAKDSSGYHSFDY

SEQ ID NO: 94009 - protein, 10 aa, Homo sapiens
  light chain complementarity determining region 3 for antibody 47005
QQFGSTLTYG

SEQ ID NO: 94010 - protein, 11 aa, Homo sapiens
  heavy chain complementarity determining region 3 for antibody 47005
ARISSDDAFDI

SEQ ID NO: 94011 - protein, 8 aa, Homo sapiens
  light chain complementarity determining region 3 for antibody 47006
QQFGSSWT

SEQ ID NO: 94012 - protein, 12 aa, Homo sapiens
  heavy chain complementarity determining region 3 for antibody 47006
ARFNFNDYGMDV

SEQ ID NO: 94013 - protein, 9 aa, Homo sapiens
  light chain complementarity determining region 3 for antibody 47007
QQFGSSFWT

SEQ ID NO: 94014 - protein, 15 aa, Homo sapiens
  heavy chain complementarity determining region 3 for antibody 47007
ARHVARDDTGYFHDY

SEQ ID NO: 94015 - protein, 6 aa, Homo sapiens
  light chain complementarity determining region 3 for antibody 47008
QQFGRT

SEQ ID NO: 94016 - protein, 12 aa, Homo sapiens
  heavy chain complementarity determining region 3 for antibody 47008
AILPQLDDGFDI

SEQ ID NO: 94017 - protein, 9 aa, Homo sapiens
  light chain complementarity determining region 3 for antibody 47009
QQFGGAPRP

SEQ ID NO: 94018 - protein, 16 aa, Homo sapiens
  heavy chain complementarity determining region 3 for antibody 47009
ARDPRGGVAVPADFNY

SEQ ID NO: 94019 - protein, 9 aa, Homo sapiens
  light chain complementarity determining region 3 for antibody 47010
QQFDTSPVT

SEQ ID NO: 94020 - protein, 14 aa, Homo sapiens
  heavy chain complementarity determining region 3 for antibody 47010
ARIPIKSRGLTTDS

SEQ ID NO: 94021 - protein, 9 aa, Homo sapiens
  light chain complementarity determining region 3 for antibody 47011
QQFDTSPVP

SEQ ID NO: 94022 - protein, 14 aa, Homo sapiens
  heavy chain complementarity determining region 3 for antibody 47011
ARIPIKGRGLTTDS

SEQ ID NO: 94023 - protein, 9 aa, Homo sapiens
  light chain complementarity determining region 3 for antibody 47012
QQFDSSMYT

SEQ ID NO: 94024 - protein, 17 aa, Homo sapiens
  heavy chain complementarity determining region 3 for antibody 47012
ARHYAGYHTSGRYYFDY

SEQ ID NO: 94025 - protein, 10 aa, Homo sapiens
  light chain complementarity determining region 3 for antibody 47013
QQFDDWPAIT

SEQ ID NO: 94026 - protein, 17 aa, Homo sapiens
  heavy chain complementarity determining region 3 for antibody 47013
ARSTNDYSSGWYFAFDL

SEQ ID NO: 94027 - protein, 8 aa, Homo sapiens
  light chain complementarity determining region 3 for antibody 47014
QQFDDLWG

SEQ ID NO: 94028 - protein, 10 aa, Homo sapiens
  heavy chain complementarity determining region 3 for antibody 47014
AKFRGGGLDF

SEQ ID NO: 94029 - protein, 10 aa, Homo sapiens
  light chain complementarity determining region 3 for antibody 47015
QQDYDWPPKT

SEQ ID NO: 94030 - protein, 14 aa, Homo sapiens
  heavy chain complementarity determining region 3 for antibody 47015
ARDRIDMLRGYLDN

SEQ ID NO: 94031 - protein, 8 aa, Homo sapiens
  light chain complementarity determining region 3 for antibody 47016
QQDRSSFP

SEQ ID NO: 94032 - protein, 13 aa, Homo sapiens
  heavy chain complementarity determining region 3 for antibody 47016
ATESGWYQGAFDT

SEQ ID NO: 94033 - protein, 9 aa, Homo sapiens
  light chain complementarity determining region 3 for antibody 47017
QQDGSSPYT

SEQ ID NO: 94034 - protein, 10 aa, Homo sapiens
  heavy chain complementarity determining region 3 for antibody 47017
ARSSSGWYLY

SEQ ID NO: 94035 - protein, 9 aa, Homo sapiens
  light chain complementarity determining region 3 for antibody 47018
QQDGSSPWT

SEQ ID NO: 94036 - protein, 15 aa, Homo sapiens
  heavy chain complementarity determining region 3 for antibody 47018
AREDVWGSGSAGFDY

SEQ ID NO: 94037 - protein, 9 aa, Homo sapiens
  light chain complementarity determining region 3 for antibody 47019
QQDGSSPSS

SEQ ID NO: 94038 - protein, 15 aa, Homo sapiens
  heavy chain complementarity determining region 3 for antibody 47019
ARGIVRFLRVDAFDI

SEQ ID NO: 94039 - protein, 9 aa, Homo sapiens
  light chain complementarity determining region 3 for antibody 47020
QQDGSSPQT

SEQ ID NO: 94040 - protein, 12 aa, Homo sapiens
  heavy chain complementarity determining region 3 for antibody 47020
ARNGYSSSWYRN

SEQ ID NO: 94041 - protein, 9 aa, Homo sapiens
  light chain complementarity determining region 3 for antibody 47021
QQDGSSPQA

SEQ ID NO: 94042 - protein, 16 aa, Homo sapiens
  heavy chain complementarity determining region 3 for antibody 47021
ARDREGFRYGLDASDI

SEQ ID NO: 94043 - protein, 9 aa, Homo sapiens
  light chain complementarity determining region 3 for antibody 47022
QQDGSSPPT

SEQ ID NO: 94044 - protein, 10 aa, Homo sapiens
  heavy chain complementarity determining region 3 for antibody 47022
ARGIHNGFDV

SEQ ID NO: 94045 - protein, 9 aa, Homo sapiens
  light chain complementarity determining region 3 for antibody 47023
QQDGSSPIT

SEQ ID NO: 94046 - protein, 15 aa, Homo sapiens
  heavy chain complementarity determining region 3 for antibody 47023
ARVLLVGFEEYYFDY

SEQ ID NO: 94047 - protein, 9 aa, Homo sapiens
  light chain complementarity determining region 3 for antibody 47024
QQDGSSPIT

SEQ ID NO: 94048 - protein, 14 aa, Homo sapiens
  heavy chain complementarity determining region 3 for antibody 47024
ARVAVDTVPGEPGA

SEQ ID NO: 94049 - protein, 9 aa, Homo sapiens
  light chain complementarity determining region 3 for antibody 47025
QQDGSSPGT

SEQ ID NO: 94050 - protein, 15 aa, Homo sapiens
  heavy chain complementarity determining region 3 for antibody 47025
ARGLFPMEDASGSYR

SEQ ID NO: 94051 - protein, 9 aa, Homo sapiens
  light chain complementarity determining region 3 for antibody 47026
QQDGSSPET

SEQ ID NO: 94052 - protein, 15 aa, Homo sapiens
  heavy chain complementarity determining region 3 for antibody 47026
VKDSSGWYWDDVFDV

SEQ ID NO: 94053 - protein, 9 aa, Homo sapiens
  light chain complementarity determining region 3 for antibody 47027
QQDGSSLWT

SEQ ID NO: 94054 - protein, 14 aa, Homo sapiens
  heavy chain complementarity determining region 3 for antibody 47027
ARGYFYGSGLGMDV

SEQ ID NO: 94055 - protein, 9 aa, Homo sapiens
  light chain complementarity determining region 3 for antibody 47028
QQDGSQPYT

SEQ ID NO: 94056 - protein, 13 aa, Homo sapiens
  heavy chain complementarity determining region 3 for antibody 47028
ARVAVPGKGYFQH

SEQ ID NO: 94057 - protein, 10 aa, Homo sapiens
  light chain complementarity determining region 3 for antibody 47029
QQDGSPPGFT

SEQ ID NO: 94058 - protein, 16 aa, Homo sapiens
  heavy chain complementarity determining region 3 for antibody 47029
ARGVVVPRGRMGYFDY

SEQ ID NO: 94059 - protein, 8 aa, Homo sapiens
  light chain complementarity determining region 3 for antibody 47030
QQDGSNRS

SEQ ID NO: 94060 - protein, 21 aa, Homo sapiens
  heavy chain complementarity determining region 3 for antibody 47030
ARPGGDGDSDDGAIGVGSFDI

SEQ ID NO: 94061 - protein, 10 aa, Homo sapiens
  light chain complementarity determining region 3 for antibody 47031
QQDGRSPSIT

SEQ ID NO: 94062 - protein, 15 aa, Homo sapiens
  heavy chain complementarity determining region 3 for antibody 47031
ARGALTAAALVYFDF

SEQ ID NO: 94063 - protein, 9 aa, Homo sapiens
  light chain complementarity determining region 3 for antibody 47032
QQDGNSPRT

SEQ ID NO: 94064 - protein, 23 aa, Homo sapiens
  heavy chain complementarity determining region 3 for antibody 47032
ARGRKLSSITMIRAVTLNSPLEY

SEQ ID NO: 94065 - protein, 9 aa, Homo sapiens
  light chain complementarity determining region 3 for antibody 47033
QQDGDSPWT

SEQ ID NO: 94066 - protein, 11 aa, Homo sapiens
  heavy chain complementarity determining region 3 for antibody 47033
ARIDVTVGYDI

SEQ ID NO: 94067 - protein, 9 aa, Homo sapiens
  light chain complementarity determining region 3 for antibody 47034
QQDGDSPVT

SEQ ID NO: 94068 - protein, 15 aa, Homo sapiens
  heavy chain complementarity determining region 3 for antibody 47034
ARLSYDFLTAYYIDL

SEQ ID NO: 94069 - protein, 9 aa, Homo sapiens
  light chain complementarity determining region 3 for antibody 47035
QQDGDLPIT

SEQ ID NO: 94070 - protein, 16 aa, Homo sapiens
  heavy chain complementarity determining region 3 for antibody 47035
ARGGYQYYFDSSGLDY

SEQ ID NO: 94071 - protein, 9 aa, Homo sapiens
  light chain complementarity determining region 3 for antibody 47036
QQDDRSSVT

SEQ ID NO: 94072 - protein, 15 aa, Homo sapiens
  heavy chain complementarity determining region 3 for antibody 47036
VRAQVIWGQLYYFDY

SEQ ID NO: 94073 - protein, 9 aa, Homo sapiens
  light chain complementarity determining region 3 for antibody 47037
QQDDISPFT

SEQ ID NO: 94074 - protein, 19 aa, Homo sapiens
  heavy chain complementarity determining region 3 for antibody 47037
ARQGVAAGLKFYYYYAMDV

SEQ ID NO: 94075 - protein, 9 aa, Homo sapiens
  light chain complementarity determining region 3 for antibody 47038
QQDASSSWT

SEQ ID NO: 94076 - protein, 16 aa, Homo sapiens
  heavy chain complementarity determining region 3 for antibody 47038
ARVSDMSGEYSLAFDI

SEQ ID NO: 94077 - protein, 9 aa, Homo sapiens
  light chain complementarity determining region 3 for antibody 47039
QQCYTPPPT

SEQ ID NO: 94078 - protein, 13 aa, Homo sapiens
  heavy chain complementarity determining region 3 for antibody 47039
AHNDYTISDAFDV

SEQ ID NO: 94079 - protein, 9 aa, Homo sapiens
  light chain complementarity determining region 3 for antibody 47040
QQCGVSPIT

SEQ ID NO: 94080 - protein, 12 aa, Homo sapiens
  heavy chain complementarity determining region 3 for antibody 47040
ARDRNFPDTFDI

SEQ ID NO: 94081 - protein, 9 aa, Homo sapiens
  light chain complementarity determining region 3 for antibody 47041
QQCGTSPYP

SEQ ID NO: 94082 - protein, 18 aa, Homo sapiens
  heavy chain complementarity determining region 3 for antibody 47041
ATNYYDSSGYYGSWYFDL

SEQ ID NO: 94083 - protein, 10 aa, Homo sapiens
  light chain complementarity determining region 3 for antibody 47042
QQCGTSPPGT

SEQ ID NO: 94084 - protein, 12 aa, Homo sapiens
  heavy chain complementarity determining region 3 for antibody 47042
ARGGSSGYQLDY

SEQ ID NO: 94085 - protein, 9 aa, Homo sapiens
  light chain complementarity determining region 3 for antibody 47043
QQCDNLPIT

SEQ ID NO: 94086 - protein, 14 aa, Homo sapiens
  heavy chain complementarity determining region 3 for antibody 47043
ARDSVTQQSHGLDV

SEQ ID NO: 94087 - protein, 10 aa, Homo sapiens
  light chain complementarity determining region 3 for antibody 47044
QQCDIFPPYT

SEQ ID NO: 94088 - protein, 11 aa, Homo sapiens
  heavy chain complementarity determining region 3 for antibody 47044
ARVRGSGLFDY

SEQ ID NO: 94089 - protein, 9 aa, Homo sapiens
  light chain complementarity determining region 3 for antibody 47045
QQCATSPLP

SEQ ID NO: 94090 - protein, 11 aa, Homo sapiens
  heavy chain complementarity determining region 3 for antibody 47045
VRDRGWLQHDY

SEQ ID NO: 94091 - protein, 9 aa, Homo sapiens
  light chain complementarity determining region 3 for antibody 47046
QQASRIPHT

SEQ ID NO: 94092 - protein, 13 aa, Homo sapiens
  heavy chain complementarity determining region 3 for antibody 47046
AHKLTGVGTFFDY

SEQ ID NO: 94093 - protein, 9 aa, Homo sapiens
  light chain complementarity determining region 3 for antibody 47047
QQASGFPPT

SEQ ID NO: 94094 - protein, 20 aa, Homo sapiens
  heavy chain complementarity determining region 3 for antibody 47047
ARMAVQFHDSGGFFRYYIDN

SEQ ID NO: 94095 - protein, 9 aa, Homo sapiens
  light chain complementarity determining region 3 for antibody 47048
QQANSLPLP

SEQ ID NO: 94096 - protein, 17 aa, Homo sapiens
  heavy chain complementarity determining region 3 for antibody 47048
ARGRLPHNQQEDNWFDP

SEQ ID NO: 94097 - protein, 9 aa, Homo sapiens
  light chain complementarity determining region 3 for antibody 47049
QQANSFPYT

SEQ ID NO: 94098 - protein, 12 aa, Homo sapiens
  heavy chain complementarity determining region 3 for antibody 47049
ARLGGEGNVLDI

SEQ ID NO: 94099 - protein, 9 aa, Homo sapiens
  light chain complementarity determining region 3 for antibody 47050
QQANSFPYT

SEQ ID NO: 94100 - protein, 17 aa, Homo sapiens
  heavy chain complementarity determining region 3 for antibody 47050
AKDVHSRQGYYYYGMDV

SEQ ID NO: 94101 - protein, 9 aa, Homo sapiens
  light chain complementarity determining region 3 for antibody 47051
QQANSFPPT

SEQ ID NO: 94102 - protein, 9 aa, Homo sapiens
  heavy chain complementarity determining region 3 for antibody 47051
ASGNYFFDH

SEQ ID NO: 94103 - protein, 9 aa, Homo sapiens
  light chain complementarity determining region 3 for antibody 47052
QQANSFPLT

SEQ ID NO: 94104 - protein, 14 aa, Homo sapiens
  heavy chain complementarity determining region 3 for antibody 47052
ASTTDWTARGAFDI

SEQ ID NO: 94105 - protein, 9 aa, Homo sapiens
  light chain complementarity determining region 3 for antibody 47053
QQANSFPIP

SEQ ID NO: 94106 - protein, 11 aa, Homo sapiens
  heavy chain complementarity determining region 3 for antibody 47053
ARGGYGSGLDY

SEQ ID NO: 94107 - protein, 9 aa, Homo sapiens
  light chain complementarity determining region 3 for antibody 47054
QQANSFPFT

SEQ ID NO: 94108 - protein, 13 aa, Homo sapiens
  heavy chain complementarity determining region 3 for antibody 47054
ARGTGGNYKMFDS

SEQ ID NO: 94109 - protein, 9 aa, Homo sapiens
  light chain complementarity determining region 3 for antibody 47055
QQANSFPCS

SEQ ID NO: 94110 - protein, 11 aa, Homo sapiens
  heavy chain complementarity determining region 3 for antibody 47055
ARSSSAAVADH

SEQ ID NO: 94111 - protein, 9 aa, Homo sapiens
  light chain complementarity determining region 3 for antibody 47056
QQANNFPIT

SEQ ID NO: 94112 - protein, 15 aa, Homo sapiens
  heavy chain complementarity determining region 3 for antibody 47056
ARDKDTAMITDAFDT

SEQ ID NO: 94113 - protein, 9 aa, Homo sapiens
  light chain complementarity determining region 3 for antibody 47057
QQANIFPYT

SEQ ID NO: 94114 - protein, 16 aa, Homo sapiens
  heavy chain complementarity determining region 3 for antibody 47057
AHIPMVRGVMLDAFDI

SEQ ID NO: 94115 - protein, 9 aa, Homo sapiens
  light chain complementarity determining region 3 for antibody 47058
QQAKSFPLS

SEQ ID NO: 94116 - protein, 14 aa, Homo sapiens
  heavy chain complementarity determining region 3 for antibody 47058
ARGPVGIAAASFDF

SEQ ID NO: 94117 - protein, 9 aa, Homo sapiens
  light chain complementarity determining region 3 for antibody 47059
QQAKSFPAT

SEQ ID NO: 94118 - protein, 15 aa, Homo sapiens
  heavy chain complementarity determining region 3 for antibody 47059
ARWGNDNGDYGRLDS

SEQ ID NO: 94119 - protein, 9 aa, Homo sapiens
  light chain complementarity determining region 3 for antibody 47060
QQAHSFPWT

SEQ ID NO: 94120 - protein, 15 aa, Homo sapiens
  heavy chain complementarity determining region 3 for antibody 47060
VRDAAISESWYYFDH

SEQ ID NO: 94121 - protein, 9 aa, Homo sapiens
  light chain complementarity determining region 3 for antibody 47061
QQAHSFPRK

SEQ ID NO: 94122 - protein, 13 aa, Homo sapiens
  heavy chain complementarity determining region 3 for antibody 47061
ATSHDYGDSALDS

SEQ ID NO: 94123 - protein, 9 aa, Homo sapiens
  light chain complementarity determining region 3 for antibody 47062
QPYGSSPFT

SEQ ID NO: 94124 - protein, 12 aa, Homo sapiens
  heavy chain complementarity determining region 3 for antibody 47062
ARMLGFGSGLAY

SEQ ID NO: 94125 - protein, 9 aa, Homo sapiens
  light chain complementarity determining region 3 for antibody 47063
QPYGPSPQA

SEQ ID NO: 94126 - protein, 13 aa, Homo sapiens
  heavy chain complementarity determining region 3 for antibody 47063
AAGSSTNSYYFDH

SEQ ID NO: 94127 - protein, 9 aa, Homo sapiens
  light chain complementarity determining region 3 for antibody 47064
QPYDIFPLT

SEQ ID NO: 94128 - protein, 12 aa, Homo sapiens
  heavy chain complementarity determining region 3 for antibody 47064
TTDRSYGYYSPH

SEQ ID NO: 94129 - protein, 9 aa, Homo sapiens
  light chain complementarity determining region 3 for antibody 47065
QPRSNWPLT

SEQ ID NO: 94130 - protein, 14 aa, Homo sapiens
  heavy chain complementarity determining region 3 for antibody 47065
ARHGAAGRIAWFDP

SEQ ID NO: 94131 - protein, 9 aa, Homo sapiens
  light chain complementarity determining region 3 for antibody 47066
QNYNTGSGR

SEQ ID NO: 94132 - protein, 18 aa, Homo sapiens
  heavy chain complementarity determining region 3 for antibody 47066
ARDCGDDCQVTSHWYFDF

SEQ ID NO: 94133 - protein, 10 aa, Homo sapiens
  light chain complementarity determining region 3 for antibody 47067
QLYTNSPMYT

SEQ ID NO: 94134 - protein, 19 aa, Homo sapiens
  heavy chain complementarity determining region 3 for antibody 47067
ARDDWQQRLKYYYYHGMDV

SEQ ID NO: 94135 - protein, 9 aa, Homo sapiens
  light chain complementarity determining region 3 for antibody 47068
QLYNDYPFT

SEQ ID NO: 94136 - protein, 13 aa, Homo sapiens
  heavy chain complementarity determining region 3 for antibody 47068
ARIPRYSSGWSDY

SEQ ID NO: 94137 - protein, 10 aa, Homo sapiens
  light chain complementarity determining region 3 for antibody 47069
QLYGTSRMYT

SEQ ID NO: 94138 - protein, 17 aa, Homo sapiens
  heavy chain complementarity determining region 3 for antibody 47069
VKDHCGGDCGNDPYFDS

SEQ ID NO: 94139 - protein, 11 aa, Homo sapiens
  light chain complementarity determining region 3 for antibody 47070
QLYETSPPGYP

SEQ ID NO: 94140 - protein, 14 aa, Homo sapiens
  heavy chain complementarity determining region 3 for antibody 47070
ARENRISRKRSFDQ

SEQ ID NO: 94141 - protein, 11 aa, Homo sapiens
  light chain complementarity determining region 3 for antibody 47071
QLRSNWPTGDT

SEQ ID NO: 94142 - protein, 12 aa, Homo sapiens
  heavy chain complementarity determining region 3 for antibody 47071
ARDGVGATHFDY

SEQ ID NO: 94143 - protein, 10 aa, Homo sapiens
  light chain complementarity determining region 3 for antibody 47072
QLLNSYPPYP

SEQ ID NO: 94144 - protein, 17 aa, Homo sapiens
  heavy chain complementarity determining region 3 for antibody 47072
ARQGLVTDQLLVRAGDS

SEQ ID NO: 94145 - protein, 10 aa, Homo sapiens
  light chain complementarity determining region 3 for antibody 47073
QLFGSTFRIT

SEQ ID NO: 94146 - protein, 10 aa, Homo sapiens
  heavy chain complementarity determining region 3 for antibody 47073
GKANWNSVSY

SEQ ID NO: 94147 - protein, 9 aa, Homo sapiens
  light chain complementarity determining region 3 for antibody 47074
QKYNSASFI

SEQ ID NO: 94148 - protein, 16 aa, Homo sapiens
  heavy chain complementarity determining region 3 for antibody 47074
ARHDHTDHGDPNWFDP

SEQ ID NO: 94149 - protein, 9 aa, Homo sapiens
  light chain complementarity determining region 3 for antibody 47075
QKYNSAPLT

SEQ ID NO: 94150 - protein, 15 aa, Homo sapiens
  heavy chain complementarity determining region 3 for antibody 47075
ATSGPGAVVGSTLDF

SEQ ID NO: 94151 - protein, 9 aa, Homo sapiens
  light chain complementarity determining region 3 for antibody 47076
QKYNSAPLT

SEQ ID NO: 94152 - protein, 12 aa, Homo sapiens
  heavy chain complementarity determining region 3 for antibody 47076
ATERFRAYYFDY

SEQ ID NO: 94153 - protein, 9 aa, Homo sapiens
  light chain complementarity determining region 3 for antibody 47077
QKYNSAPLA

SEQ ID NO: 94154 - protein, 17 aa, Homo sapiens
  heavy chain complementarity determining region 3 for antibody 47077
AKFVYYGSGRPEDAFDI

SEQ ID NO: 94155 - protein, 10 aa, Homo sapiens
  light chain complementarity determining region 3 for antibody 47078
QKYNSAPGWT

SEQ ID NO: 94156 - protein, 12 aa, Homo sapiens
  heavy chain complementarity determining region 3 for antibody 47078
ARQDALGTYPPD

SEQ ID NO: 94157 - protein, 9 aa, Homo sapiens
  light chain complementarity determining region 3 for antibody 47079
QKYNRDPFT

SEQ ID NO: 94158 - protein, 17 aa, Homo sapiens
  heavy chain complementarity determining region 3 for antibody 47079
ARGGAYYDSSGYDQFDY

SEQ ID NO: 94159 - protein, 9 aa, Homo sapiens
  light chain complementarity determining region 3 for antibody 47080
QKYNRAPLT

SEQ ID NO: 94160 - protein, 17 aa, Homo sapiens
  heavy chain complementarity determining region 3 for antibody 47080
ARGGAYYDSSGYDQFDY

SEQ ID NO: 94161 - protein, 9 aa, Homo sapiens
  light chain complementarity determining region 3 for antibody 47081
QKYNRAPGT

SEQ ID NO: 94162 - protein, 12 aa, Homo sapiens
  heavy chain complementarity determining region 3 for antibody 47081
ATRAGITAIPDY

SEQ ID NO: 94163 - protein, 9 aa, Homo sapiens
  light chain complementarity determining region 3 for antibody 47082
QKYNIAPET

SEQ ID NO: 94164 - protein, 5 aa, Homo sapiens
  heavy chain complementarity determining region 3 for antibody 47082
ARIYE

SEQ ID NO: 94165 - protein, 10 aa, Homo sapiens
  light chain complementarity determining region 3 for antibody 47083
QKYGSSPRGT

SEQ ID NO: 94166 - protein, 12 aa, Homo sapiens
  heavy chain complementarity determining region 3 for antibody 47083
TRDRFSDDFRDY

SEQ ID NO: 94167 - protein, 9 aa, Homo sapiens
  light chain complementarity determining region 3 for antibody 47084
QKYDSVPFT

SEQ ID NO: 94168 - protein, 14 aa, Homo sapiens
  heavy chain complementarity determining region 3 for antibody 47084
ASINGPPPTYALDY

SEQ ID NO: 94169 - protein, 9 aa, Homo sapiens
  light chain complementarity determining region 3 for antibody 47085
QKNNSVPRT

SEQ ID NO: 94170 - protein, 13 aa, Homo sapiens
  heavy chain complementarity determining region 3 for antibody 47085
GRGGQLAATGIDY

SEQ ID NO: 94171 - protein, 9 aa, Homo sapiens
  light chain complementarity determining region 3 for antibody 47086
QKNNSVPFT

SEQ ID NO: 94172 - protein, 14 aa, Homo sapiens
  heavy chain complementarity determining region 3 for antibody 47086
AREVAGPGPQPLDY

SEQ ID NO: 94173 - protein, 9 aa, Homo sapiens
  light chain complementarity determining region 3 for antibody 47087
QKNNSAPQT

SEQ ID NO: 94174 - protein, 17 aa, Homo sapiens
  heavy chain complementarity determining region 3 for antibody 47087
AKDVHSRQGYYYYGMDV

SEQ ID NO: 94175 - protein, 9 aa, Homo sapiens
  light chain complementarity determining region 3 for antibody 47088
QKNNSAPLT

SEQ ID NO: 94176 - protein, 11 aa, Homo sapiens
  heavy chain complementarity determining region 3 for antibody 47088
ARKGTSAAVDY

SEQ ID NO: 94177 - protein, 9 aa, Homo sapiens
  light chain complementarity determining region 3 for antibody 47089
QKNNRAPWT

SEQ ID NO: 94178 - protein, 12 aa, Homo sapiens
  heavy chain complementarity determining region 3 for antibody 47089
ATRAGITAIPDY

SEQ ID NO: 94179 - protein, 9 aa, Homo sapiens
  light chain complementarity determining region 3 for antibody 47090
QKNDRAPLT

SEQ ID NO: 94180 - protein, 10 aa, Homo sapiens
  heavy chain complementarity determining region 3 for antibody 47090
ARDEGYFGTS

SEQ ID NO: 94181 - protein, 9 aa, Homo sapiens
  light chain complementarity determining region 3 for antibody 47091
QKHNSVPLT

SEQ ID NO: 94182 - protein, 10 aa, Homo sapiens
  heavy chain complementarity determining region 3 for antibody 47091
AKEVSDTFDY

SEQ ID NO: 94183 - protein, 11 aa, Homo sapiens
  light chain complementarity determining region 3 for antibody 47092
QKFYNWPPRVA

SEQ ID NO: 94184 - protein, 13 aa, Homo sapiens
  heavy chain complementarity determining region 3 for antibody 47092
AKVYDWGLWTFDI

SEQ ID NO: 94185 - protein, 9 aa, Homo sapiens
  light chain complementarity determining region 3 for antibody 47093
QKDNRAPFT

SEQ ID NO: 94186 - protein, 17 aa, Homo sapiens
  heavy chain complementarity determining region 3 for antibody 47093
ARGGAYYDSSGYDQFDY

SEQ ID NO: 94187 - protein, 10 aa, Homo sapiens
  light chain complementarity determining region 3 for antibody 47094
QHYYSTSPFT

SEQ ID NO: 94188 - protein, 12 aa, Homo sapiens
  heavy chain complementarity determining region 3 for antibody 47094
ARGGYDGYYFVH

SEQ ID NO: 94189 - protein, 9 aa, Homo sapiens
  light chain complementarity determining region 3 for antibody 47095
QHYYNTPLT

SEQ ID NO: 94190 - protein, 21 aa, Homo sapiens
  heavy chain complementarity determining region 3 for antibody 47095
ARDAPVSRPYSSGWYSSAFDY

SEQ ID NO: 94191 - protein, 10 aa, Homo sapiens
  light chain complementarity determining region 3 for antibody 47096
QHYYNLPPYS

SEQ ID NO: 94192 - protein, 19 aa, Homo sapiens
  heavy chain complementarity determining region 3 for antibody 47096
ARITASVDRGTYYTVPLDY

SEQ ID NO: 94193 - protein, 9 aa, Homo sapiens
  light chain complementarity determining region 3 for antibody 47097
QHYYGTPRT

SEQ ID NO: 94194 - protein, 9 aa, Homo sapiens
  heavy chain complementarity determining region 3 for antibody 47097
VRANPLLES

SEQ ID NO: 94195 - protein, 9 aa, Homo sapiens
  light chain complementarity determining region 3 for antibody 47098
QHYTKWPFA

SEQ ID NO: 94196 - protein, 11 aa, Homo sapiens
  heavy chain complementarity determining region 3 for antibody 47098
ASGYRGHNIDH

SEQ ID NO: 94197 - protein, 9 aa, Homo sapiens
  light chain complementarity determining region 3 for antibody 47099
QHYTHWPYS

SEQ ID NO: 94198 - protein, 12 aa, Homo sapiens
  heavy chain complementarity determining region 3 for antibody 47099
AGSLRSSGDFDF

SEQ ID NO: 94199 - protein, 10 aa, Homo sapiens
  light chain complementarity determining region 3 for antibody 47100
QHYSSYSPLT

SEQ ID NO: 94200 - protein, 14 aa, Homo sapiens
  heavy chain complementarity determining region 3 for antibody 47100
ARGPIEGAATPLDY

SEQ ID NO: 94201 - protein, 8 aa, Homo sapiens
  light chain complementarity determining region 3 for antibody 47101
QHYRDPFP

SEQ ID NO: 94202 - protein, 13 aa, Homo sapiens
  heavy chain complementarity determining region 3 for antibody 47101
ATESGSYQGAFDI

SEQ ID NO: 94203 - protein, 9 aa, Homo sapiens
  light chain complementarity determining region 3 for antibody 47102
QHYNTYSRT

SEQ ID NO: 94204 - protein, 14 aa, Homo sapiens
  heavy chain complementarity determining region 3 for antibody 47102
AGERTPKQLGAFDI

SEQ ID NO: 94205 - protein, 9 aa, Homo sapiens
  light chain complementarity determining region 3 for antibody 47103
QHYNTYSAT

SEQ ID NO: 94206 - protein, 18 aa, Homo sapiens
  heavy chain complementarity determining region 3 for antibody 47103
ARGFGESLPSHYYYGMDV

SEQ ID NO: 94207 - protein, 9 aa, Homo sapiens
  light chain complementarity determining region 3 for antibody 47104
QHYNNYPPA

SEQ ID NO: 94208 - protein, 17 aa, Homo sapiens
  heavy chain complementarity determining region 3 for antibody 47104
ARGGVWGSNRSLGGFDY

SEQ ID NO: 94209 - protein, 10 aa, Homo sapiens
  light chain complementarity determining region 3 for antibody 47105
QHYNNWPPLT

SEQ ID NO: 94210 - protein, 10 aa, Homo sapiens
  heavy chain complementarity determining region 3 for antibody 47105
ARQVHGDYDI

SEQ ID NO: 94211 - protein, 9 aa, Homo sapiens
  light chain complementarity determining region 3 for antibody 47106
QHYLIYPWT

SEQ ID NO: 94212 - protein, 9 aa, Homo sapiens
  heavy chain complementarity determining region 3 for antibody 47106
LNLVRGVVH

SEQ ID NO: 94213 - protein, 9 aa, Homo sapiens
  light chain complementarity determining region 3 for antibody 47107
QHYKNYPYT

SEQ ID NO: 94214 - protein, 18 aa, Homo sapiens
  heavy chain complementarity determining region 3 for antibody 47107
ARDLEVNSAGWYGGGFDY

SEQ ID NO: 94215 - protein, 11 aa, Homo sapiens
  light chain complementarity determining region 3 for antibody 47108
QHYIAWPRPLT

SEQ ID NO: 94216 - protein, 18 aa, Homo sapiens
  heavy chain complementarity determining region 3 for antibody 47108
AKIGFGMYNNDWVWYFDS

SEQ ID NO: 94217 - protein, 9 aa, Homo sapiens
  light chain complementarity determining region 3 for antibody 47109
QHYIASPLT

SEQ ID NO: 94218 - protein, 12 aa, Homo sapiens
  heavy chain complementarity determining region 3 for antibody 47109
ARWGDGYNGGYY

SEQ ID NO: 94219 - protein, 9 aa, Homo sapiens
  light chain complementarity determining region 3 for antibody 47110
QHYGTSPWT

SEQ ID NO: 94220 - protein, 20 aa, Homo sapiens
  heavy chain complementarity determining region 3 for antibody 47110
AAARITMIEGLRGTYSGLDV

SEQ ID NO: 94221 - protein, 10 aa, Homo sapiens
  light chain complementarity determining region 3 for antibody 47111
QHYGSSPQLP

SEQ ID NO: 94222 - protein, 12 aa, Homo sapiens
  heavy chain complementarity determining region 3 for antibody 47111
ARHGIEVPGLDS

SEQ ID NO: 94223 - protein, 10 aa, Homo sapiens
  light chain complementarity determining region 3 for antibody 47112
QHYGSSPPWR

SEQ ID NO: 94224 - protein, 15 aa, Homo sapiens
  heavy chain complementarity determining region 3 for antibody 47112
ARDPTMITVSRYFDL

SEQ ID NO: 94225 - protein, 10 aa, Homo sapiens
  light chain complementarity determining region 3 for antibody 47113
QHYGSSPPGT

SEQ ID NO: 94226 - protein, 15 aa, Homo sapiens
  heavy chain complementarity determining region 3 for antibody 47113
ARDPTMITVSRYFDL

SEQ ID NO: 94227 - protein, 9 aa, Homo sapiens
  light chain complementarity determining region 3 for antibody 47114
QHYGSSPIN

SEQ ID NO: 94228 - protein, 16 aa, Homo sapiens
  heavy chain complementarity determining region 3 for antibody 47114
ATGSSKGLLIRATFDY

SEQ ID NO: 94229 - protein, 10 aa, Homo sapiens
  light chain complementarity determining region 3 for antibody 47115
QHYGSSPGLP

SEQ ID NO: 94230 - protein, 13 aa, Homo sapiens
  heavy chain complementarity determining region 3 for antibody 47115
STNRAVRGAMGHS

SEQ ID NO: 94231 - protein, 10 aa, Homo sapiens
  light chain complementarity determining region 3 for antibody 47116
QHYGSSPGLP

SEQ ID NO: 94232 - protein, 17 aa, Homo sapiens
  heavy chain complementarity determining region 3 for antibody 47116
ARDRWYYGSGNYYPSDY

SEQ ID NO: 94233 - protein, 9 aa, Homo sapiens
  light chain complementarity determining region 3 for antibody 47117
QHYGSSLWT

SEQ ID NO: 94234 - protein, 17 aa, Homo sapiens
  heavy chain complementarity determining region 3 for antibody 47117
ARDQPRRGNVVTALLDY

SEQ ID NO: 94235 - protein, 8 aa, Homo sapiens
  light chain complementarity determining region 3 for antibody 47118
QHYGNSLT

SEQ ID NO: 94236 - protein, 18 aa, Homo sapiens
  heavy chain complementarity determining region 3 for antibody 47118
ARDSRDLLIASPGGSIDI

SEQ ID NO: 94237 - protein, 9 aa, Homo sapiens
  light chain complementarity determining region 3 for antibody 47119
QHYGGSPYN

SEQ ID NO: 94238 - protein, 17 aa, Homo sapiens
  heavy chain complementarity determining region 3 for antibody 47119
ARVDLSEQWLVLWYFDL

SEQ ID NO: 94239 - protein, 9 aa, Homo sapiens
  light chain complementarity determining region 3 for antibody 47120
QHYGGSPQT

SEQ ID NO: 94240 - protein, 13 aa, Homo sapiens
  heavy chain complementarity determining region 3 for antibody 47120
SSHIVVVPSALDP

SEQ ID NO: 94241 - protein, 10 aa, Homo sapiens
  light chain complementarity determining region 3 for antibody 47121
QHYGGSPLGT

SEQ ID NO: 94242 - protein, 14 aa, Homo sapiens
  heavy chain complementarity determining region 3 for antibody 47121
ARDAITGSPDYFDY

SEQ ID NO: 94243 - protein, 10 aa, Homo sapiens
  light chain complementarity determining region 3 for antibody 47122
QHYGDSYPGT

SEQ ID NO: 94244 - protein, 16 aa, Homo sapiens
  heavy chain complementarity determining region 3 for antibody 47122
TRVSSGWYWGPDAFDV

SEQ ID NO: 94245 - protein, 9 aa, Homo sapiens
  light chain complementarity determining region 3 for antibody 47123
QHYGDSPWT

SEQ ID NO: 94246 - protein, 11 aa, Homo sapiens
  heavy chain complementarity determining region 3 for antibody 47123
ARIDVTVGYDI

SEQ ID NO: 94247 - protein, 9 aa, Homo sapiens
  light chain complementarity determining region 3 for antibody 47124
QHYFGTPPA

SEQ ID NO: 94248 - protein, 16 aa, Homo sapiens
  heavy chain complementarity determining region 3 for antibody 47124
ARDKVVTARLAYHLDS

SEQ ID NO: 94249 - protein, 9 aa, Homo sapiens
  light chain complementarity determining region 3 for antibody 47125
QHYESTHRT

SEQ ID NO: 94250 - protein, 11 aa, Homo sapiens
  heavy chain complementarity determining region 3 for antibody 47125
ATFRGRSDFAN

SEQ ID NO: 94251 - protein, 9 aa, Homo sapiens
  light chain complementarity determining region 3 for antibody 47126
QHYDNTQAT

SEQ ID NO: 94252 - protein, 13 aa, Homo sapiens
  heavy chain complementarity determining region 3 for antibody 47126
ARHLGYGDFAFKL

SEQ ID NO: 94253 - protein, 8 aa, Homo sapiens
  light chain complementarity determining region 3 for antibody 47127
QHYCDSFP

SEQ ID NO: 94254 - protein, 13 aa, Homo sapiens
  heavy chain complementarity determining region 3 for antibody 47127
ATESGSYQGAFDI

SEQ ID NO: 94255 - protein, 9 aa, Homo sapiens
  light chain complementarity determining region 3 for antibody 47128
QHYAGSPLP

SEQ ID NO: 94256 - protein, 11 aa, Homo sapiens
  heavy chain complementarity determining region 3 for antibody 47128
ARKETSRALDV

SEQ ID NO: 94257 - protein, 9 aa, Homo sapiens
  light chain complementarity determining region 3 for antibody 47129
QHSYSTPFT

SEQ ID NO: 94258 - protein, 13 aa, Homo sapiens
  heavy chain complementarity determining region 3 for antibody 47129
ASPRRYDYGDFDY

SEQ ID NO: 94259 - protein, 9 aa, Homo sapiens
  light chain complementarity determining region 3 for antibody 47130
QHSYRTPRT

SEQ ID NO: 94260 - protein, 20 aa, Homo sapiens
  heavy chain complementarity determining region 3 for antibody 47130
AREGVLARRRGLTPNRAMDV

SEQ ID NO: 94261 - protein, 10 aa, Homo sapiens
  light chain complementarity determining region 3 for antibody 47131
QHRSYWPPWT

SEQ ID NO: 94262 - protein, 14 aa, Homo sapiens
  heavy chain complementarity determining region 3 for antibody 47131
ARSRDTSGFSDFDY

SEQ ID NO: 94263 - protein, 12 aa, Homo sapiens
  light chain complementarity determining region 3 for antibody 47132
QHRSNWPPGPPT

SEQ ID NO: 94264 - protein, 15 aa, Homo sapiens
  heavy chain complementarity determining region 3 for antibody 47132
VKDSSGWYWDDVFDV

SEQ ID NO: 94265 - protein, 12 aa, Homo sapiens
  light chain complementarity determining region 3 for antibody 47133
QHRSNWPPGPPP

SEQ ID NO: 94266 - protein, 15 aa, Homo sapiens
  heavy chain complementarity determining region 3 for antibody 47133
VKDSSGWYWDDVFDV

SEQ ID NO: 94267 - protein, 10 aa, Homo sapiens
  light chain complementarity determining region 3 for antibody 47134
QHRSKWPPLT

SEQ ID NO: 94268 - protein, 9 aa, Homo sapiens
  heavy chain complementarity determining region 3 for antibody 47134
ARVDGYFDY

SEQ ID NO: 94269 - protein, 9 aa, Homo sapiens
  light chain complementarity determining region 3 for antibody 47135
QHRNSWPHT

SEQ ID NO: 94270 - protein, 15 aa, Homo sapiens
  heavy chain complementarity determining region 3 for antibody 47135
AKEGYYPDGSGYCPN

SEQ ID NO: 94271 - protein, 9 aa, Homo sapiens
  light chain complementarity determining region 3 for antibody 47136
QHRNGWPPA

SEQ ID NO: 94272 - protein, 13 aa, Homo sapiens
  heavy chain complementarity determining region 3 for antibody 47136
ARENYLLSWAFDY

SEQ ID NO: 94273 - protein, 10 aa, Homo sapiens
  light chain complementarity determining region 3 for antibody 47137
QHLNTYPPVP

SEQ ID NO: 94274 - protein, 15 aa, Homo sapiens
  heavy chain complementarity determining region 3 for antibody 47137
AKDFRPHIQRGGLDY

SEQ ID NO: 94275 - protein, 9 aa, Homo sapiens
  light chain complementarity determining region 3 for antibody 47138
QHLNSHMYT

SEQ ID NO: 94276 - protein, 20 aa, Homo sapiens
  heavy chain complementarity determining region 3 for antibody 47138
ARFPHYCGGGSCHYYNWFDP

SEQ ID NO: 94277 - protein, 10 aa, Homo sapiens
  light chain complementarity determining region 3 for antibody 47139
QHHNNWPSWT

SEQ ID NO: 94278 - protein, 19 aa, Homo sapiens
  heavy chain complementarity determining region 3 for antibody 47139
VWADYFNSGNYDFTDGKDV

SEQ ID NO: 94279 - protein, 9 aa, Homo sapiens
  light chain complementarity determining region 3 for antibody 47140
QHHGSPPLT

SEQ ID NO: 94280 - protein, 14 aa, Homo sapiens
  heavy chain complementarity determining region 3 for antibody 47140
ARASGDYYIEAFDV

SEQ ID NO: 94281 - protein, 9 aa, Homo sapiens
  light chain complementarity determining region 3 for antibody 47141
QHDNNWPLT

SEQ ID NO: 94282 - protein, 17 aa, Homo sapiens
  heavy chain complementarity determining region 3 for antibody 47141
AKSLPTGSGAFSWYFDL

SEQ ID NO: 94283 - protein, 8 aa, Homo sapiens
  light chain complementarity determining region 3 for antibody 47142
QFYGRSPT

SEQ ID NO: 94284 - protein, 16 aa, Homo sapiens
  heavy chain complementarity determining region 3 for antibody 47142
ARDGHSSGWHVRYFDS

SEQ ID NO: 94285 - protein, 7 aa, Homo sapiens
  light chain complementarity determining region 3 for antibody 47143
QEYSTWT

SEQ ID NO: 94286 - protein, 19 aa, Homo sapiens
  heavy chain complementarity determining region 3 for antibody 47143
AKDRLAVMRNFGEVGHLDS

SEQ ID NO: 94287 - protein, 10 aa, Homo sapiens
  light chain complementarity determining region 3 for antibody 47144
QEYQSWPPGA

SEQ ID NO: 94288 - protein, 6 aa, Homo sapiens
  heavy chain complementarity determining region 3 for antibody 47144
ANGYFY

SEQ ID NO: 94289 - protein, 9 aa, Homo sapiens
  light chain complementarity determining region 3 for antibody 47145
QEYKSSSHS

SEQ ID NO: 94290 - protein, 17 aa, Homo sapiens
  heavy chain complementarity determining region 3 for antibody 47145
ARMAYYDSSGLYGYFDL

SEQ ID NO: 94291 - protein, 9 aa, Homo sapiens
  light chain complementarity determining region 3 for antibody 47146
QEYDTYSPT

SEQ ID NO: 94292 - protein, 13 aa, Homo sapiens
  heavy chain complementarity determining region 3 for antibody 47146
ATYSGTYDRPFDL

SEQ ID NO: 94293 - protein, 10 aa, Homo sapiens
  light chain complementarity determining region 3 for antibody 47147
QESYSPPRPT

SEQ ID NO: 94294 - protein, 13 aa, Homo sapiens
  heavy chain complementarity determining region 3 for antibody 47147
ARSGYYGSGEFDF

SEQ ID NO: 94295 - protein, 9 aa, Homo sapiens
  light chain complementarity determining region 3 for antibody 47148
QESYSPPFP

SEQ ID NO: 94296 - protein, 15 aa, Homo sapiens
  heavy chain complementarity determining region 3 for antibody 47148
AKDIGTYSDNLTPDY

SEQ ID NO: 94297 - protein, 8 aa, Homo sapiens
  light chain complementarity determining region 3 for antibody 47149
QERTNWPT

SEQ ID NO: 94298 - protein, 10 aa, Homo sapiens
  heavy chain complementarity determining region 3 for antibody 47149
AKRNTYYFDY

SEQ ID NO: 94299 - protein, 10 aa, Homo sapiens
  light chain complementarity determining region 3 for antibody 47150
QERSTWPPRG

SEQ ID NO: 94300 - protein, 14 aa, Homo sapiens
  heavy chain complementarity determining region 3 for antibody 47150
AMRGLGSSGYYTDY

SEQ ID NO: 94301 - protein, 7 aa, Homo sapiens
  light chain complementarity determining region 3 for antibody 47151
QELETYA

SEQ ID NO: 94302 - protein, 17 aa, Homo sapiens
  heavy chain complementarity determining region 3 for antibody 47151
VKDMGPPFGSGLDAFDI

SEQ ID NO: 94303 - protein, 9 aa, Homo sapiens
  light chain complementarity determining region 3 for antibody 47152
QEFASSPST

SEQ ID NO: 94304 - protein, 11 aa, Homo sapiens
  heavy chain complementarity determining region 3 for antibody 47152
AKVGTVRSFDY

SEQ ID NO: 94305 - protein, 9 aa, Homo sapiens
  light chain complementarity determining region 3 for antibody 47153
QDYGNSPWT

SEQ ID NO: 94306 - protein, 14 aa, Homo sapiens
  heavy chain complementarity determining region 3 for antibody 47153
VRDLRSRILEAGNY

SEQ ID NO: 94307 - protein, 10 aa, Homo sapiens
  light chain complementarity determining region 3 for antibody 47154
QATYSTPSIT

SEQ ID NO: 94308 - protein, 15 aa, Homo sapiens
  heavy chain complementarity determining region 3 for antibody 47154
ARDPGWTQTSYYFDY

SEQ ID NO: 94309 - protein, 9 aa, Homo sapiens
  light chain complementarity determining region 3 for antibody 47155
PQYNSFPYT

SEQ ID NO: 94310 - protein, 13 aa, Homo sapiens
  heavy chain complementarity determining region 3 for antibody 47155
ARGGRGIGGYPDY

SEQ ID NO: 94311 - protein, 11 aa, Homo sapiens
  light chain complementarity determining region 3 for antibody 47156
PQYNHWPLLYT

SEQ ID NO: 94312 - protein, 15 aa, Homo sapiens
  heavy chain complementarity determining region 3 for antibody 47156
AREERAPASLDYLDY

SEQ ID NO: 94313 - protein, 9 aa, Homo sapiens
  light chain complementarity determining region 3 for antibody 47157
PQYKSFPLT

SEQ ID NO: 94314 - protein, 12 aa, Homo sapiens
  heavy chain complementarity determining region 3 for antibody 47157
TRSPRGDYFFEY

SEQ ID NO: 94315 - protein, 10 aa, Homo sapiens
  light chain complementarity determining region 3 for antibody 47158
PQRYNWPPFT

SEQ ID NO: 94316 - protein, 11 aa, Homo sapiens
  heavy chain complementarity determining region 3 for antibody 47158
ARGVGSYPFDS

SEQ ID NO: 94317 - protein, 9 aa, Homo sapiens
  light chain complementarity determining region 3 for antibody 47159
PQRYNWPLT

SEQ ID NO: 94318 - protein, 13 aa, Homo sapiens
  heavy chain complementarity determining region 3 for antibody 47159
ARVNRMAARYFDL

SEQ ID NO: 94319 - protein, 11 aa, Homo sapiens
  light chain complementarity determining region 3 for antibody 47160
PQRNNFPAEYT

SEQ ID NO: 94320 - protein, 15 aa, Homo sapiens
  heavy chain complementarity determining region 3 for antibody 47160
AREGVERLTISAFDL

SEQ ID NO: 94321 - protein, 9 aa, Homo sapiens
  light chain complementarity determining region 3 for antibody 47161
MRHTHWPHT

SEQ ID NO: 94322 - protein, 12 aa, Homo sapiens
  heavy chain complementarity determining region 3 for antibody 47161
VKWGGEVYGGNV

SEQ ID NO: 94323 - protein, 8 aa, Homo sapiens
  light chain complementarity determining region 3 for antibody 47162
MRALQTPG

SEQ ID NO: 94324 - protein, 19 aa, Homo sapiens
  heavy chain complementarity determining region 3 for antibody 47162
ANFGSGNFYNVRYYYGMDV

SEQ ID NO: 94325 - protein, 9 aa, Homo sapiens
  light chain complementarity determining region 3 for antibody 47163
MQVLQTPQT

SEQ ID NO: 94326 - protein, 20 aa, Homo sapiens
  heavy chain complementarity determining region 3 for antibody 47163
SSGGYFYDSPGSSVLDYFDY

SEQ ID NO: 94327 - protein, 9 aa, Homo sapiens
  light chain complementarity determining region 3 for antibody 47164
MQVLQTPLP

SEQ ID NO: 94328 - protein, 12 aa, Homo sapiens
  heavy chain complementarity determining region 3 for antibody 47164
ARWSHSDRIFDS

SEQ ID NO: 94329 - protein, 9 aa, Homo sapiens
  light chain complementarity determining region 3 for antibody 47165
MQVLQTPHG

SEQ ID NO: 94330 - protein, 12 aa, Homo sapiens
  heavy chain complementarity determining region 3 for antibody 47165
TKDRTGFPSLYY

SEQ ID NO: 94331 - protein, 9 aa, Homo sapiens
  light chain complementarity determining region 3 for antibody 47166
MQTSPWPHT

SEQ ID NO: 94332 - protein, 15 aa, Homo sapiens
  heavy chain complementarity determining region 3 for antibody 47166
ARGGRGPGMAHCFDL

SEQ ID NO: 94333 - protein, 9 aa, Homo sapiens
  light chain complementarity determining region 3 for antibody 47167
MQTLQTPPA

SEQ ID NO: 94334 - protein, 12 aa, Homo sapiens
  heavy chain complementarity determining region 3 for antibody 47167
ARDLYSTWSLGY

SEQ ID NO: 94335 - protein, 9 aa, Homo sapiens
  light chain complementarity determining region 3 for antibody 47168
MQTLQIPVT

SEQ ID NO: 94336 - protein, 15 aa, Homo sapiens
  heavy chain complementarity determining region 3 for antibody 47168
ARSRWDLVFRRPFHI

SEQ ID NO: 94337 - protein, 9 aa, Homo sapiens
  light chain complementarity determining region 3 for antibody 47169
MQTLQIPRT

SEQ ID NO: 94338 - protein, 9 aa, Homo sapiens
  heavy chain complementarity determining region 3 for antibody 47169
ARAVPGMDV

SEQ ID NO: 94339 - protein, 9 aa, Homo sapiens
  light chain complementarity determining region 3 for antibody 47170
MQTLETPPT

SEQ ID NO: 94340 - protein, 11 aa, Homo sapiens
  heavy chain complementarity determining region 3 for antibody 47170
TRTDWERDLRD

SEQ ID NO: 94341 - protein, 9 aa, Homo sapiens
  light chain complementarity determining region 3 for antibody 47171
MQSTHWPHT

SEQ ID NO: 94342 - protein, 8 aa, Homo sapiens
  heavy chain complementarity determining region 3 for antibody 47171
VSWAETSD

SEQ ID NO: 94343 - protein, 10 aa, Homo sapiens
  light chain complementarity determining region 3 for antibody 47172
MQSLQTPPGT

SEQ ID NO: 94344 - protein, 21 aa, Homo sapiens
  heavy chain complementarity determining region 3 for antibody 47172
ARDEFVVVLAGEMPDKRGLDV

SEQ ID NO: 94345 - protein, 9 aa, Homo sapiens
  light chain complementarity determining region 3 for antibody 47173
MQSLQTLFT

SEQ ID NO: 94346 - protein, 14 aa, Homo sapiens
  heavy chain complementarity determining region 3 for antibody 47173
AREFYVAGTRWFDP

SEQ ID NO: 94347 - protein, 9 aa, Homo sapiens
  light chain complementarity determining region 3 for antibody 47174
MQSLQSPGT

SEQ ID NO: 94348 - protein, 15 aa, Homo sapiens
  heavy chain complementarity determining region 3 for antibody 47174
AREDSADASAWFPRG

SEQ ID NO: 94349 - protein, 9 aa, Homo sapiens
  light chain complementarity determining region 3 for antibody 47175
MQSLQGPPI

SEQ ID NO: 94350 - protein, 15 aa, Homo sapiens
  heavy chain complementarity determining region 3 for antibody 47175
VADYIDPTGNGHPAV

SEQ ID NO: 94351 - protein, 9 aa, Homo sapiens
  light chain complementarity determining region 3 for antibody 47176
MQPLQTPYT

SEQ ID NO: 94352 - protein, 15 aa, Homo sapiens
  heavy chain complementarity determining region 3 for antibody 47176
ARVRYNTIWPVGFDP

SEQ ID NO: 94353 - protein, 9 aa, Homo sapiens
  light chain complementarity determining region 3 for antibody 47177
MQPLQTPLT

SEQ ID NO: 94354 - protein, 17 aa, Homo sapiens
  heavy chain complementarity determining region 3 for antibody 47177
ARVADHFFDAPNDALDI

SEQ ID NO: 94355 - protein, 9 aa, Homo sapiens
  light chain complementarity determining region 3 for antibody 47178
MQNTHWPPL

SEQ ID NO: 94356 - protein, 20 aa, Homo sapiens
  heavy chain complementarity determining region 3 for antibody 47178
ARGEQYCSGGDCSDLSAFDV

SEQ ID NO: 94357 - protein, 8 aa, Homo sapiens
  light chain complementarity determining region 3 for antibody 47179
MQGVQPSP

SEQ ID NO: 94358 - protein, 7 aa, Homo sapiens
  heavy chain complementarity determining region 3 for antibody 47179
ATKMGDY

SEQ ID NO: 94359 - protein, 9 aa, Homo sapiens
  light chain complementarity determining region 3 for antibody 47180
MQGVDGGRT

SEQ ID NO: 94360 - protein, 12 aa, Homo sapiens
  heavy chain complementarity determining region 3 for antibody 47180
ATLGVRWDHFDY

SEQ ID NO: 94361 - protein, 8 aa, Homo sapiens
  light chain complementarity determining region 3 for antibody 47181
MQGTYWPT

SEQ ID NO: 94362 - protein, 9 aa, Homo sapiens
  heavy chain complementarity determining region 3 for antibody 47181
ARVDGYFDY

SEQ ID NO: 94363 - protein, 8 aa, Homo sapiens
  light chain complementarity determining region 3 for antibody 47182
MQGTYWPA

SEQ ID NO: 94364 - protein, 11 aa, Homo sapiens
  heavy chain complementarity determining region 3 for antibody 47182
ARDAMPNNADY

SEQ ID NO: 94365 - protein, 9 aa, Homo sapiens
  light chain complementarity determining region 3 for antibody 47183
MQGTQWPYT

SEQ ID NO: 94366 - protein, 20 aa, Homo sapiens
  heavy chain complementarity determining region 3 for antibody 47183
ARERIITMVRGVIINYGMDV

SEQ ID NO: 94367 - protein, 9 aa, Homo sapiens
  light chain complementarity determining region 3 for antibody 47184
MQGTQWPWT

SEQ ID NO: 94368 - protein, 15 aa, Homo sapiens
  heavy chain complementarity determining region 3 for antibody 47184
VRFPPDLDIVGMIDS

SEQ ID NO: 94369 - protein, 10 aa, Homo sapiens
  light chain complementarity determining region 3 for antibody 47185
MQGTPWPPYT

SEQ ID NO: 94370 - protein, 15 aa, Homo sapiens
  heavy chain complementarity determining region 3 for antibody 47185
ARTEYIWGSDGAFDI

SEQ ID NO: 94371 - protein, 9 aa, Homo sapiens
  light chain complementarity determining region 3 for antibody 47186
MQGTPWPPT

SEQ ID NO: 94372 - protein, 14 aa, Homo sapiens
  heavy chain complementarity determining region 3 for antibody 47186
ARDLRQWLVSAFDI

SEQ ID NO: 94373 - protein, 9 aa, Homo sapiens
  light chain complementarity determining region 3 for antibody 47187
MQGTNWPGT

SEQ ID NO: 94374 - protein, 6 aa, Homo sapiens
  heavy chain complementarity determining region 3 for antibody 47187
VRTSSY

SEQ ID NO: 94375 - protein, 8 aa, Homo sapiens
  light chain complementarity determining region 3 for antibody 47188
MQGTHWYP

SEQ ID NO: 94376 - protein, 12 aa, Homo sapiens
  heavy chain complementarity determining region 3 for antibody 47188
ARLQPVDDAYDI

SEQ ID NO: 94377 - protein, 9 aa, Homo sapiens
  light chain complementarity determining region 3 for antibody 47189
MQGTHWSHT

SEQ ID NO: 94378 - protein, 9 aa, Homo sapiens
  heavy chain complementarity determining region 3 for antibody 47189
ARGASAADY

SEQ ID NO: 94379 - protein, 9 aa, Homo sapiens
  light chain complementarity determining region 3 for antibody 47190
MQGTHWRYT

SEQ ID NO: 94380 - protein, 11 aa, Homo sapiens
  heavy chain complementarity determining region 3 for antibody 47190
VRDGESGGAHY

SEQ ID NO: 94381 - protein, 9 aa, Homo sapiens
  light chain complementarity determining region 3 for antibody 47191
MQGTHWPYT

SEQ ID NO: 94382 - protein, 14 aa, Homo sapiens
  heavy chain complementarity determining region 3 for antibody 47191
ARERSTVGGPYLDY

SEQ ID NO: 94383 - protein, 9 aa, Homo sapiens
  light chain complementarity determining region 3 for antibody 47192
MQGTHWPWR

SEQ ID NO: 94384 - protein, 22 aa, Homo sapiens
  heavy chain complementarity determining region 3 for antibody 47192
ASRHCHSTGCISSYYYYYGIHV

SEQ ID NO: 94385 - protein, 9 aa, Homo sapiens
  light chain complementarity determining region 3 for antibody 47193
MQGTHWPRT

SEQ ID NO: 94386 - protein, 18 aa, Homo sapiens
  heavy chain complementarity determining region 3 for antibody 47193
VLAGGRGGYSTLSEGDFK

SEQ ID NO: 94387 - protein, 10 aa, Homo sapiens
  light chain complementarity determining region 3 for antibody 47194
MQGTHWPPWT

SEQ ID NO: 94388 - protein, 18 aa, Homo sapiens
  heavy chain complementarity determining region 3 for antibody 47194
VKEGWLMGLAVAGTSEDY

SEQ ID NO: 94389 - protein, 10 aa, Homo sapiens
  light chain complementarity determining region 3 for antibody 47195
MQGTHWPPWT

SEQ ID NO: 94390 - protein, 11 aa, Homo sapiens
  heavy chain complementarity determining region 3 for antibody 47195
GGFYHGGPCGY

SEQ ID NO: 94391 - protein, 10 aa, Homo sapiens
  light chain complementarity determining region 3 for antibody 47196
MQGTHWPPGT

SEQ ID NO: 94392 - protein, 17 aa, Homo sapiens
  heavy chain complementarity determining region 3 for antibody 47196
VRDGYTASGRRNAPGAN

SEQ ID NO: 94393 - protein, 10 aa, Homo sapiens
  light chain complementarity determining region 3 for antibody 47197
MQGTHWPPGT

SEQ ID NO: 94394 - protein, 11 aa, Homo sapiens
  heavy chain complementarity determining region 3 for antibody 47197
ASVHSGYRFDY

SEQ ID NO: 94395 - protein, 10 aa, Homo sapiens
  light chain complementarity determining region 3 for antibody 47198
MQGTHWPPGT

SEQ ID NO: 94396 - protein, 18 aa, Homo sapiens
  heavy chain complementarity determining region 3 for antibody 47198
ARDQSRQLVRDYYYNMDL

SEQ ID NO: 94397 - protein, 10 aa, Homo sapiens
  light chain complementarity determining region 3 for antibody 47199
MQGTHWPPDT

SEQ ID NO: 94398 - protein, 15 aa, Homo sapiens
  heavy chain complementarity determining region 3 for antibody 47199
ARTEYIWGSDGAFDI

SEQ ID NO: 94399 - protein, 9 aa, Homo sapiens
  light chain complementarity determining region 3 for antibody 47200
MQGTHWPLT

SEQ ID NO: 94400 - protein, 16 aa, Homo sapiens
  heavy chain complementarity determining region 3 for antibody 47200
GRDAAVSVGSSDTFDV

SEQ ID NO: 94401 - protein, 9 aa, Homo sapiens
  light chain complementarity determining region 3 for antibody 47201
MQGTHWPGT

SEQ ID NO: 94402 - protein, 15 aa, Homo sapiens
  heavy chain complementarity determining region 3 for antibody 47201
ARAQVIWGQLYYFDS

SEQ ID NO: 94403 - protein, 9 aa, Homo sapiens
  light chain complementarity determining region 3 for antibody 47202
MQGTHWLST

SEQ ID NO: 94404 - protein, 8 aa, Homo sapiens
  heavy chain complementarity determining region 3 for antibody 47202
ARYYDRLV

SEQ ID NO: 94405 - protein, 8 aa, Homo sapiens
  light chain complementarity determining region 3 for antibody 47203
MQGTHRYP

SEQ ID NO: 94406 - protein, 17 aa, Homo sapiens
  heavy chain complementarity determining region 3 for antibody 47203
ARDADYDYVLGSYRFDY

SEQ ID NO: 94407 - protein, 9 aa, Homo sapiens
  light chain complementarity determining region 3 for antibody 47204
MQGTHGPYT

SEQ ID NO: 94408 - protein, 11 aa, Homo sapiens
  heavy chain complementarity determining region 3 for antibody 47204
ARAGDPGAVDI

SEQ ID NO: 94409 - protein, 10 aa, Homo sapiens
  light chain complementarity determining region 3 for antibody 47205
MQGTHGPRGT

SEQ ID NO: 94410 - protein, 12 aa, Homo sapiens
  heavy chain complementarity determining region 3 for antibody 47205
ARKAIAAGGTDC

SEQ ID NO: 94411 - protein, 10 aa, Homo sapiens
  light chain complementarity determining region 3 for antibody 47206
MQGTHGPPWT

SEQ ID NO: 94412 - protein, 17 aa, Homo sapiens
  heavy chain complementarity determining region 3 for antibody 47206
VRDGYTASGRRNAPGAN

SEQ ID NO: 94413 - protein, 9 aa, Homo sapiens
  light chain complementarity determining region 3 for antibody 47207
MQGTHGPLT

SEQ ID NO: 94414 - protein, 10 aa, Homo sapiens
  heavy chain complementarity determining region 3 for antibody 47207
ARDFGGPRDY

SEQ ID NO: 94415 - protein, 9 aa, Homo sapiens
  light chain complementarity determining region 3 for antibody 47208
MQGTHGPGT

SEQ ID NO: 94416 - protein, 6 aa, Homo sapiens
  heavy chain complementarity determining region 3 for antibody 47208
VRTSSY

SEQ ID NO: 94417 - protein, 9 aa, Homo sapiens
  light chain complementarity determining region 3 for antibody 47209
MQGTFGPWT

SEQ ID NO: 94418 - protein, 14 aa, Homo sapiens
  heavy chain complementarity determining region 3 for antibody 47209
ARLGDAGSYGHFDL

SEQ ID NO: 94419 - protein, 9 aa, Homo sapiens
  light chain complementarity determining region 3 for antibody 47210
MQGTDWPHT

SEQ ID NO: 94420 - protein, 13 aa, Homo sapiens
  heavy chain complementarity determining region 3 for antibody 47210
VRGGQGKGDYFDY

SEQ ID NO: 94421 - protein, 9 aa, Homo sapiens
  light chain complementarity determining region 3 for antibody 47211
MQGSYGLYT

SEQ ID NO: 94422 - protein, 11 aa, Homo sapiens
  heavy chain complementarity determining region 3 for antibody 47211
VATSPEMDSDY

SEQ ID NO: 94423 - protein, 8 aa, Homo sapiens
  light chain complementarity determining region 3 for antibody 47212
MQGSHWPW

SEQ ID NO: 94424 - protein, 8 aa, Homo sapiens
  heavy chain complementarity determining region 3 for antibody 47212
ATWGRSDF

SEQ ID NO: 94425 - protein, 9 aa, Homo sapiens
  light chain complementarity determining region 3 for antibody 47213
MQGSHWPPT

SEQ ID NO: 94426 - protein, 21 aa, Homo sapiens
  heavy chain complementarity determining region 3 for antibody 47213
ARLHRHYYDRSGNYVDDGFDV

SEQ ID NO: 94427 - protein, 10 aa, Homo sapiens
  light chain complementarity determining region 3 for antibody 47214
MQGSHWPPRT

SEQ ID NO: 94428 - protein, 11 aa, Homo sapiens
  heavy chain complementarity determining region 3 for antibody 47214
ARDHPGVGIDY

SEQ ID NO: 94429 - protein, 10 aa, Homo sapiens
  light chain complementarity determining region 3 for antibody 47215
MQGSHGPPWT

SEQ ID NO: 94430 - protein, 11 aa, Homo sapiens
  heavy chain complementarity determining region 3 for antibody 47215
ARDHPGVGIDY

SEQ ID NO: 94431 - protein, 9 aa, Homo sapiens
  light chain complementarity determining region 3 for antibody 47216
MQGSHGPLT

SEQ ID NO: 94432 - protein, 21 aa, Homo sapiens
  heavy chain complementarity determining region 3 for antibody 47216
ARLHRHYYDRSGNYVDDGFDV

SEQ ID NO: 94433 - protein, 9 aa, Homo sapiens
  light chain complementarity determining region 3 for antibody 47217
MQGLQTPYT

SEQ ID NO: 94434 - protein, 14 aa, Homo sapiens
  heavy chain complementarity determining region 3 for antibody 47217
TTDLDYSSDWPRNR

SEQ ID NO: 94435 - protein, 8 aa, Homo sapiens
  light chain complementarity determining region 3 for antibody 47218
MQGLQTPT

SEQ ID NO: 94436 - protein, 11 aa, Homo sapiens
  heavy chain complementarity determining region 3 for antibody 47218
AKANNLYGAEY

SEQ ID NO: 94437 - protein, 9 aa, Homo sapiens
  light chain complementarity determining region 3 for antibody 47219
MQGLQTPRT

SEQ ID NO: 94438 - protein, 24 aa, Homo sapiens
  heavy chain complementarity determining region 3 for antibody 47219
VKDGGSYYDSSGYFYGGMFGAFDN

SEQ ID NO: 94439 - protein, 9 aa, Homo sapiens
  light chain complementarity determining region 3 for antibody 47220
MQGLQTPQT

SEQ ID NO: 94440 - protein, 20 aa, Homo sapiens
  heavy chain complementarity determining region 3 for antibody 47220
SSGGYFYDSPGSSVLDYFDH

SEQ ID NO: 94441 - protein, 9 aa, Homo sapiens
  light chain complementarity determining region 3 for antibody 47221
MQGLQTPLT

SEQ ID NO: 94442 - protein, 11 aa, Homo sapiens
  heavy chain complementarity determining region 3 for antibody 47221
TREGGYGAFDY

SEQ ID NO: 94443 - protein, 9 aa, Homo sapiens
  light chain complementarity determining region 3 for antibody 47222
MQGLQTPLT

SEQ ID NO: 94444 - protein, 15 aa, Homo sapiens
  heavy chain complementarity determining region 3 for antibody 47222
ARARSGPKAGYCFDY

SEQ ID NO: 94445 - protein, 9 aa, Homo sapiens
  light chain complementarity determining region 3 for antibody 47223
MQGLQTPIT

SEQ ID NO: 94446 - protein, 14 aa, Homo sapiens
  heavy chain complementarity determining region 3 for antibody 47223
GRDQSRAGPTTFDL

SEQ ID NO: 94447 - protein, 9 aa, Homo sapiens
  light chain complementarity determining region 3 for antibody 47224
MQGLQTPGT

SEQ ID NO: 94448 - protein, 12 aa, Homo sapiens
  heavy chain complementarity determining region 3 for antibody 47224
ARDLGYTSGWRL

SEQ ID NO: 94449 - protein, 9 aa, Homo sapiens
  light chain complementarity determining region 3 for antibody 47225
MQGLQSPHT

SEQ ID NO: 94450 - protein, 14 aa, Homo sapiens
  heavy chain complementarity determining region 3 for antibody 47225
AKDRVLWFGEGMDV

SEQ ID NO: 94451 - protein, 9 aa, Homo sapiens
  light chain complementarity determining region 3 for antibody 47226
MQGLHVPRT

SEQ ID NO: 94452 - protein, 15 aa, Homo sapiens
  heavy chain complementarity determining region 3 for antibody 47226
TKGAKTGGYYYGMDA

SEQ ID NO: 94453 - protein, 9 aa, Homo sapiens
  light chain complementarity determining region 3 for antibody 47227
MQGIHWPRT

SEQ ID NO: 94454 - protein, 15 aa, Homo sapiens
  heavy chain complementarity determining region 3 for antibody 47227
TRPYSGYDPRDIFDI

SEQ ID NO: 94455 - protein, 9 aa, Homo sapiens
  light chain complementarity determining region 3 for antibody 47228
MQGIEGPRT

SEQ ID NO: 94456 - protein, 9 aa, Homo sapiens
  heavy chain complementarity determining region 3 for antibody 47228
GTGFGESEQ

SEQ ID NO: 94457 - protein, 9 aa, Homo sapiens
  light chain complementarity determining region 3 for antibody 47229
MQDTHGPPT

SEQ ID NO: 94458 - protein, 21 aa, Homo sapiens
  heavy chain complementarity determining region 3 for antibody 47229
SRGAWEKKTISSHPDDGAFDI

SEQ ID NO: 94459 - protein, 9 aa, Homo sapiens
  light chain complementarity determining region 3 for antibody 47230
MQAVQTPPT

SEQ ID NO: 94460 - protein, 18 aa, Homo sapiens
  heavy chain complementarity determining region 3 for antibody 47230
ARTLPDVTAAGYGRALGY

SEQ ID NO: 94461 - protein, 9 aa, Homo sapiens
  light chain complementarity determining region 3 for antibody 47231
MQAVLTPNT

SEQ ID NO: 94462 - protein, 19 aa, Homo sapiens
  heavy chain complementarity determining region 3 for antibody 47231
AKLRCSGASCLEHSYGMDV

SEQ ID NO: 94463 - protein, 9 aa, Homo sapiens
  light chain complementarity determining region 3 for antibody 47232
MQATQWPFT

SEQ ID NO: 94464 - protein, 11 aa, Homo sapiens
  heavy chain complementarity determining region 3 for antibody 47232
AGEMRGITPSY

SEQ ID NO: 94465 - protein, 10 aa, Homo sapiens
  light chain complementarity determining region 3 for antibody 47233
MQATHWPPWT

SEQ ID NO: 94466 - protein, 20 aa, Homo sapiens
  heavy chain complementarity determining region 3 for antibody 47233
ASGGYSGSPGLYYYYYAMAV

SEQ ID NO: 94467 - protein, 10 aa, Homo sapiens
  light chain complementarity determining region 3 for antibody 47234
MQATHWPLST

SEQ ID NO: 94468 - protein, 11 aa, Homo sapiens
  heavy chain complementarity determining region 3 for antibody 47234
VRGVGRYRPDY

SEQ ID NO: 94469 - protein, 10 aa, Homo sapiens
  light chain complementarity determining region 3 for antibody 47235
MQATHWPLNT

SEQ ID NO: 94470 - protein, 11 aa, Homo sapiens
  heavy chain complementarity determining region 3 for antibody 47235
VRGVGRYRPDY

SEQ ID NO: 94471 - protein, 9 aa, Homo sapiens
  light chain complementarity determining region 3 for antibody 47236
MQATHGPHT

SEQ ID NO: 94472 - protein, 8 aa, Homo sapiens
  heavy chain complementarity determining region 3 for antibody 47236
ASGGWAGF

SEQ ID NO: 94473 - protein, 9 aa, Homo sapiens
  light chain complementarity determining region 3 for antibody 47237
MQAQQIPGS

SEQ ID NO: 94474 - protein, 10 aa, Homo sapiens
  heavy chain complementarity determining region 3 for antibody 47237
AREFRNAFDF

SEQ ID NO: 94475 - protein, 9 aa, Homo sapiens
  light chain complementarity determining region 3 for antibody 47238
MQALQTPYT

SEQ ID NO: 94476 - protein, 16 aa, Homo sapiens
  heavy chain complementarity determining region 3 for antibody 47238
ARHRAAGGNYYYGMDV

SEQ ID NO: 94477 - protein, 9 aa, Homo sapiens
  light chain complementarity determining region 3 for antibody 47239
MQALQTPWT

SEQ ID NO: 94478 - protein, 13 aa, Homo sapiens
  heavy chain complementarity determining region 3 for antibody 47239
ARSSCSGGSCSRT

SEQ ID NO: 94479 - protein, 9 aa, Homo sapiens
  light chain complementarity determining region 3 for antibody 47240
MQALQTPWT

SEQ ID NO: 94480 - protein, 16 aa, Homo sapiens
  heavy chain complementarity determining region 3 for antibody 47240
ARDLRYGYGGISQGDY

SEQ ID NO: 94481 - protein, 9 aa, Homo sapiens
  light chain complementarity determining region 3 for antibody 47241
MQALQTPWT

SEQ ID NO: 94482 - protein, 10 aa, Homo sapiens
  heavy chain complementarity determining region 3 for antibody 47241
ARDLGGGRGY

SEQ ID NO: 94483 - protein, 9 aa, Homo sapiens
  light chain complementarity determining region 3 for antibody 47242
MQALQTPWT

SEQ ID NO: 94484 - protein, 15 aa, Homo sapiens
  heavy chain complementarity determining region 3 for antibody 47242
AKAVDYDGKGAYFQH

SEQ ID NO: 94485 - protein, 9 aa, Homo sapiens
  light chain complementarity determining region 3 for antibody 47243
MQALQTPVT

SEQ ID NO: 94486 - protein, 17 aa, Homo sapiens
  heavy chain complementarity determining region 3 for antibody 47243
ATTYYYARTGVFDAFKT

SEQ ID NO: 94487 - protein, 10 aa, Homo sapiens
  light chain complementarity determining region 3 for antibody 47244
MQALQTPPYT

SEQ ID NO: 94488 - protein, 17 aa, Homo sapiens
  heavy chain complementarity determining region 3 for antibody 47244
AKARAYCAADCYLDFDY

SEQ ID NO: 94489 - protein, 9 aa, Homo sapiens
  light chain complementarity determining region 3 for antibody 47245
MQALQTPPT

SEQ ID NO: 94490 - protein, 16 aa, Homo sapiens
  heavy chain complementarity determining region 3 for antibody 47245
ARHWGGRSYGSGSSEY

SEQ ID NO: 94491 - protein, 9 aa, Homo sapiens
  light chain complementarity determining region 3 for antibody 47246
MQALQTPPT

SEQ ID NO: 94492 - protein, 18 aa, Homo sapiens
  heavy chain complementarity determining region 3 for antibody 47246
ARGLYCIGTSCYSNWFDP

SEQ ID NO: 94493 - protein, 9 aa, Homo sapiens
  light chain complementarity determining region 3 for antibody 47247
MQALQTPPT

SEQ ID NO: 94494 - protein, 12 aa, Homo sapiens
  heavy chain complementarity determining region 3 for antibody 47247
AKDSAQKWELLD

SEQ ID NO: 94495 - protein, 9 aa, Homo sapiens
  light chain complementarity determining region 3 for antibody 47248
MQALQTPPD

SEQ ID NO: 94496 - protein, 18 aa, Homo sapiens
  heavy chain complementarity determining region 3 for antibody 47248
ARRWGPRDVASPGGTRDY

SEQ ID NO: 94497 - protein, 9 aa, Homo sapiens
  light chain complementarity determining region 3 for antibody 47249
MQALQTPNT

SEQ ID NO: 94498 - protein, 17 aa, Homo sapiens
  heavy chain complementarity determining region 3 for antibody 47249
AKGGSEEILVADYGMDV

SEQ ID NO: 94499 - protein, 9 aa, Homo sapiens
  light chain complementarity determining region 3 for antibody 47250
MQALQTPLT

SEQ ID NO: 94500 - protein, 13 aa, Homo sapiens
  heavy chain complementarity determining region 3 for antibody 47250
ARVASRFWAPKGT

SEQ ID NO: 94501 - protein, 9 aa, Homo sapiens
  light chain complementarity determining region 3 for antibody 47251
MQALQTPLT

SEQ ID NO: 94502 - protein, 26 aa, Homo sapiens
  heavy chain complementarity determining region 3 for antibody 47251
ARGPIHCSGGSCSSGPTYFHYYAMDV

SEQ ID NO: 94503 - protein, 10 aa, Homo sapiens
  light chain complementarity determining region 3 for antibody 47252
MQALQTPIFT

SEQ ID NO: 94504 - protein, 17 aa, Homo sapiens
  heavy chain complementarity determining region 3 for antibody 47252
ARLRRMVRGVTSDAFDI

SEQ ID NO: 94505 - protein, 10 aa, Homo sapiens
  light chain complementarity determining region 3 for antibody 47253
MQALQTPGYT

SEQ ID NO: 94506 - protein, 15 aa, Homo sapiens
  heavy chain complementarity determining region 3 for antibody 47253
VRAQVIWGQLYYFDY

SEQ ID NO: 94507 - protein, 10 aa, Homo sapiens
  light chain complementarity determining region 3 for antibody 47254
MQALQTPGVT

SEQ ID NO: 94508 - protein, 17 aa, Homo sapiens
  heavy chain complementarity determining region 3 for antibody 47254
VKAAYYYDGTTYYTHHY

SEQ ID NO: 94509 - protein, 9 aa, Homo sapiens
  light chain complementarity determining region 3 for antibody 47255
MQALQTPGT

SEQ ID NO: 94510 - protein, 11 aa, Homo sapiens
  heavy chain complementarity determining region 3 for antibody 47255
ASSRDRYYFDY

SEQ ID NO: 94511 - protein, 9 aa, Homo sapiens
  light chain complementarity determining region 3 for antibody 47256
MQALQTPGT

SEQ ID NO: 94512 - protein, 15 aa, Homo sapiens
  heavy chain complementarity determining region 3 for antibody 47256
ARSPLTIFYYSGMDV

SEQ ID NO: 94513 - protein, 9 aa, Homo sapiens
  light chain complementarity determining region 3 for antibody 47257
MQALQTPGT

SEQ ID NO: 94514 - protein, 14 aa, Homo sapiens
  heavy chain complementarity determining region 3 for antibody 47257
ARSKWAAPGTPPEY

SEQ ID NO: 94515 - protein, 10 aa, Homo sapiens
  light chain complementarity determining region 3 for antibody 47258
MQALQTPGGT

SEQ ID NO: 94516 - protein, 17 aa, Homo sapiens
  heavy chain complementarity determining region 3 for antibody 47258
VKAAYYYDGTTYYTHHY

SEQ ID NO: 94517 - protein, 9 aa, Homo sapiens
  light chain complementarity determining region 3 for antibody 47259
MQALQTPFT

SEQ ID NO: 94518 - protein, 27 aa, Homo sapiens
  heavy chain complementarity determining region 3 for antibody 47259
ARGVPSRGRSGTYYNVGGPSYYYGLDV

SEQ ID NO: 94519 - protein, 9 aa, Homo sapiens
  light chain complementarity determining region 3 for antibody 47260
MQALQTPFS

SEQ ID NO: 94520 - protein, 11 aa, Homo sapiens
  heavy chain complementarity determining region 3 for antibody 47260
ARSSSDFDLDY

SEQ ID NO: 94521 - protein, 9 aa, Homo sapiens
  light chain complementarity determining region 3 for antibody 47261
MQALQTLRT

SEQ ID NO: 94522 - protein, 20 aa, Homo sapiens
  heavy chain complementarity determining region 3 for antibody 47261
ARGPHGSGRSSYPYYYGLDA

SEQ ID NO: 94523 - protein, 8 aa, Homo sapiens
  light chain complementarity determining region 3 for antibody 47262
MQALQTLP

SEQ ID NO: 94524 - protein, 16 aa, Homo sapiens
  heavy chain complementarity determining region 3 for antibody 47262
AKAGWLVGYDLSRGCA

SEQ ID NO: 94525 - protein, 9 aa, Homo sapiens
  light chain complementarity determining region 3 for antibody 47263
MQALQTLFT

SEQ ID NO: 94526 - protein, 21 aa, Homo sapiens
  heavy chain complementarity determining region 3 for antibody 47263
ANEGSRVGGTTNRYYYSGVDV

SEQ ID NO: 94527 - protein, 9 aa, Homo sapiens
  light chain complementarity determining region 3 for antibody 47264
MQALQSPWP

SEQ ID NO: 94528 - protein, 12 aa, Homo sapiens
  heavy chain complementarity determining region 3 for antibody 47264
ARNYEHSGYFGY

SEQ ID NO: 94529 - protein, 9 aa, Homo sapiens
  light chain complementarity determining region 3 for antibody 47265
MQALQSPPT

SEQ ID NO: 94530 - protein, 18 aa, Homo sapiens
  heavy chain complementarity determining region 3 for antibody 47265
AKSPKYSGTYYYYDGMDV

SEQ ID NO: 94531 - protein, 9 aa, Homo sapiens
  light chain complementarity determining region 3 for antibody 47266
MQALQPPVT

SEQ ID NO: 94532 - protein, 12 aa, Homo sapiens
  heavy chain complementarity determining region 3 for antibody 47266
TRGTTGDMTTVT

SEQ ID NO: 94533 - protein, 9 aa, Homo sapiens
  light chain complementarity determining region 3 for antibody 47267
MQALQPPGT

SEQ ID NO: 94534 - protein, 18 aa, Homo sapiens
  heavy chain complementarity determining region 3 for antibody 47267
AASGRYFFQNSGPLGFGY

SEQ ID NO: 94535 - protein, 8 aa, Homo sapiens
  light chain complementarity determining region 3 for antibody 47268
MQALQPNT

SEQ ID NO: 94536 - protein, 14 aa, Homo sapiens
  heavy chain complementarity determining region 3 for antibody 47268
ARVRSEVYSSSPDY

SEQ ID NO: 94537 - protein, 8 aa, Homo sapiens
  light chain complementarity determining region 3 for antibody 47269
MQALQNPG

SEQ ID NO: 94538 - protein, 19 aa, Homo sapiens
  heavy chain complementarity determining region 3 for antibody 47269
ANFGSGNFYNVRYYYGMDV

SEQ ID NO: 94539 - protein, 9 aa, Homo sapiens
  light chain complementarity determining region 3 for antibody 47270
MQALQIPRT

SEQ ID NO: 94540 - protein, 18 aa, Homo sapiens
  heavy chain complementarity determining region 3 for antibody 47270
ARVLEVNARINYYNGLDV

SEQ ID NO: 94541 - protein, 9 aa, Homo sapiens
  light chain complementarity determining region 3 for antibody 47271
MQALQIPIT

SEQ ID NO: 94542 - protein, 16 aa, Homo sapiens
  heavy chain complementarity determining region 3 for antibody 47271
ARYYYESSGYSHWFDP

SEQ ID NO: 94543 - protein, 9 aa, Homo sapiens
  light chain complementarity determining region 3 for antibody 47272
MQALQIPGT

SEQ ID NO: 94544 - protein, 18 aa, Homo sapiens
  heavy chain complementarity determining region 3 for antibody 47272
AASGRYFFQNSGPLGFGY

SEQ ID NO: 94545 - protein, 9 aa, Homo sapiens
  light chain complementarity determining region 3 for antibody 47273
MQALQIPFT

SEQ ID NO: 94546 - protein, 12 aa, Homo sapiens
  heavy chain complementarity determining region 3 for antibody 47273
ARGRVGGNSFDH

SEQ ID NO: 94547 - protein, 9 aa, Homo sapiens
  light chain complementarity determining region 3 for antibody 47274
MQALQIPFP

SEQ ID NO: 94548 - protein, 12 aa, Homo sapiens
  heavy chain complementarity determining region 3 for antibody 47274
ARGRVGGNSFDQ

SEQ ID NO: 94549 - protein, 9 aa, Homo sapiens
  light chain complementarity determining region 3 for antibody 47275
MQALKLPGT

SEQ ID NO: 94550 - protein, 13 aa, Homo sapiens
  heavy chain complementarity determining region 3 for antibody 47275
ARDHEGSGWEFDY

SEQ ID NO: 94551 - protein, 9 aa, Homo sapiens
  light chain complementarity determining region 3 for antibody 47276
MQALATPIT

SEQ ID NO: 94552 - protein, 10 aa, Homo sapiens
  heavy chain complementarity determining region 3 for antibody 47276
ARYNSYDFEY

SEQ ID NO: 94553 - protein, 9 aa, Homo sapiens
  light chain complementarity determining region 3 for antibody 47277
MQAKQWPWT

SEQ ID NO: 94554 - protein, 11 aa, Homo sapiens
  heavy chain complementarity determining region 3 for antibody 47277
MVTGWAASFDY

SEQ ID NO: 94555 - protein, 8 aa, Homo sapiens
  light chain complementarity determining region 3 for antibody 47278
MQAIQALT

SEQ ID NO: 94556 - protein, 14 aa, Homo sapiens
  heavy chain complementarity determining region 3 for antibody 47278
VGQLGPATYPDFHH

SEQ ID NO: 94557 - protein, 9 aa, Homo sapiens
  light chain complementarity determining region 3 for antibody 47279
MQAAHGPHT

SEQ ID NO: 94558 - protein, 12 aa, Homo sapiens
  heavy chain complementarity determining region 3 for antibody 47279
ARGARDSSGVDY

SEQ ID NO: 94559 - protein, 11 aa, Homo sapiens
  light chain complementarity determining region 3 for antibody 47280
MHGTHWPPMYP

SEQ ID NO: 94560 - protein, 7 aa, Homo sapiens
  heavy chain complementarity determining region 3 for antibody 47280
MTPAGSD

SEQ ID NO: 94561 - protein, 9 aa, Homo sapiens
  light chain complementarity determining region 3 for antibody 47281
MHALQTPWT

SEQ ID NO: 94562 - protein, 17 aa, Homo sapiens
  heavy chain complementarity determining region 3 for antibody 47281
VRVRDPMVRGTYDAFDI

SEQ ID NO: 94563 - protein, 9 aa, Homo sapiens
  light chain complementarity determining region 3 for antibody 47282
MEALQSPVT

SEQ ID NO: 94564 - protein, 16 aa, Homo sapiens
  heavy chain complementarity determining region 3 for antibody 47282
VRHTKTRVGGPYSFDY

SEQ ID NO: 94565 - protein, 9 aa, Homo sapiens
  light chain complementarity determining region 3 for antibody 47283
MEALETPYT

SEQ ID NO: 94566 - protein, 16 aa, Homo sapiens
  heavy chain complementarity determining region 3 for antibody 47283
ARGAWSGHDWGWYFDF

SEQ ID NO: 94567 - protein, 9 aa, Homo sapiens
  light chain complementarity determining region 3 for antibody 47284
LQYNTYPYA

SEQ ID NO: 94568 - protein, 12 aa, Homo sapiens
  heavy chain complementarity determining region 3 for antibody 47284
TPARGSGLGMDV

SEQ ID NO: 94569 - protein, 9 aa, Homo sapiens
  light chain complementarity determining region 3 for antibody 47285
LQYNNYPGA

SEQ ID NO: 94570 - protein, 15 aa, Homo sapiens
  heavy chain complementarity determining region 3 for antibody 47285
ARPTPESATYRGMDV

SEQ ID NO: 94571 - protein, 9 aa, Homo sapiens
  light chain complementarity determining region 3 for antibody 47286
LQYLSLPRT

SEQ ID NO: 94572 - protein, 16 aa, Homo sapiens
  heavy chain complementarity determining region 3 for antibody 47286
ARGLYGSGGHSNPFDC

SEQ ID NO: 94573 - protein, 9 aa, Homo sapiens
  light chain complementarity determining region 3 for antibody 47287
LQVHNYPFT

SEQ ID NO: 94574 - protein, 16 aa, Homo sapiens
  heavy chain complementarity determining region 3 for antibody 47287
SYQPPSGTVQPLLSDY

SEQ ID NO: 94575 - protein, 8 aa, Homo sapiens
  light chain complementarity determining region 3 for antibody 47288
LQRSSPFT

SEQ ID NO: 94576 - protein, 15 aa, Homo sapiens
  heavy chain complementarity determining region 3 for antibody 47288
ARDRSMIVVDDAFDL

SEQ ID NO: 94577 - protein, 9 aa, Homo sapiens
  light chain complementarity determining region 3 for antibody 47289
LQRSDWPIT

SEQ ID NO: 94578 - protein, 10 aa, Homo sapiens
  heavy chain complementarity determining region 3 for antibody 47289
VRVHRWDLDY

SEQ ID NO: 94579 - protein, 9 aa, Homo sapiens
  light chain complementarity determining region 3 for antibody 47290
LQRNSFPLT

SEQ ID NO: 94580 - protein, 16 aa, Homo sapiens
  heavy chain complementarity determining region 3 for antibody 47290
ARGPTKYSSSLEYFQH

SEQ ID NO: 94581 - protein, 10 aa, Homo sapiens
  light chain complementarity determining region 3 for antibody 47291
LQRANWPPLT

SEQ ID NO: 94582 - protein, 21 aa, Homo sapiens
  heavy chain complementarity determining region 3 for antibody 47291
AKDLTYYDILTGDYTTRPFDY

SEQ ID NO: 94583 - protein, 9 aa, Homo sapiens
  light chain complementarity determining region 3 for antibody 47292
LQHYPLPWA

SEQ ID NO: 94584 - protein, 13 aa, Homo sapiens
  heavy chain complementarity determining region 3 for antibody 47292
ARAIHDDKVPFQN

SEQ ID NO: 94585 - protein, 9 aa, Homo sapiens
  light chain complementarity determining region 3 for antibody 47293
LQHYIYPRT

SEQ ID NO: 94586 - protein, 14 aa, Homo sapiens
  heavy chain complementarity determining region 3 for antibody 47293
ARRGALGNLRYFDY

SEQ ID NO: 94587 - protein, 9 aa, Homo sapiens
  light chain complementarity determining region 3 for antibody 47294
LQHYDYPWT

SEQ ID NO: 94588 - protein, 14 aa, Homo sapiens
  heavy chain complementarity determining region 3 for antibody 47294
TTDLVGGHAPHNGY

SEQ ID NO: 94589 - protein, 9 aa, Homo sapiens
  light chain complementarity determining region 3 for antibody 47295
LQHSSGPGT

SEQ ID NO: 94590 - protein, 11 aa, Homo sapiens
  heavy chain complementarity determining region 3 for antibody 47295
ARVGRGGPNDY

SEQ ID NO: 94591 - protein, 9 aa, Homo sapiens
  light chain complementarity determining region 3 for antibody 47296
LQHNNFPLP

SEQ ID NO: 94592 - protein, 15 aa, Homo sapiens
  heavy chain complementarity determining region 3 for antibody 47296
GRDLSIAGTDYGIDY

SEQ ID NO: 94593 - protein, 9 aa, Homo sapiens
  light chain complementarity determining region 3 for antibody 47297
LQHKTTPST

SEQ ID NO: 94594 - protein, 15 aa, Homo sapiens
  heavy chain complementarity determining region 3 for antibody 47297
TTDQGNHTAYYRTDY

SEQ ID NO: 94595 - protein, 9 aa, Homo sapiens
  light chain complementarity determining region 3 for antibody 47298
LQHGNFPWT

SEQ ID NO: 94596 - protein, 12 aa, Homo sapiens
  heavy chain complementarity determining region 3 for antibody 47298
AKDLSDYYGPDY

SEQ ID NO: 94597 - protein, 9 aa, Homo sapiens
  light chain complementarity determining region 3 for antibody 47299
LQHETHPGS

SEQ ID NO: 94598 - protein, 17 aa, Homo sapiens
  heavy chain complementarity determining region 3 for antibody 47299
ASRGPAYSGYDWGFFDH

SEQ ID NO: 94599 - protein, 10 aa, Homo sapiens
  light chain complementarity determining region 3 for antibody 47300
LQHDSSFTWT

SEQ ID NO: 94600 - protein, 12 aa, Homo sapiens
  heavy chain complementarity determining region 3 for antibody 47300
ARRNGGISPLDH

SEQ ID NO: 94601 - protein, 9 aa, Homo sapiens
  light chain complementarity determining region 3 for antibody 47301
LQHDNFFWT

SEQ ID NO: 94602 - protein, 14 aa, Homo sapiens
  heavy chain complementarity determining region 3 for antibody 47301
ARDRRQWQHDGFDI

SEQ ID NO: 94603 - protein, 10 aa, Homo sapiens
  light chain complementarity determining region 3 for antibody 47302
LQGTQGPPWT

SEQ ID NO: 94604 - protein, 11 aa, Homo sapiens
  heavy chain complementarity determining region 3 for antibody 47302
VRDHPGIGIDY

SEQ ID NO: 94605 - protein, 9 aa, Homo sapiens
  light chain complementarity determining region 3 for antibody 47303
LQDYSYPRT

SEQ ID NO: 94606 - protein, 18 aa, Homo sapiens
  heavy chain complementarity determining region 3 for antibody 47303
ARDANPKYGSGVYDGFDV

SEQ ID NO: 94607 - protein, 9 aa, Homo sapiens
  light chain complementarity determining region 3 for antibody 47304
LQDYNYPRT

SEQ ID NO: 94608 - protein, 18 aa, Homo sapiens
  heavy chain complementarity determining region 3 for antibody 47304
ARDWTYSDSNIYYYRFDY

SEQ ID NO: 94609 - protein, 9 aa, Homo sapiens
  light chain complementarity determining region 3 for antibody 47305
LQDYNYPLT

SEQ ID NO: 94610 - protein, 23 aa, Homo sapiens
  heavy chain complementarity determining region 3 for antibody 47305
SRGRTYYFDGSGYPDFYFYLMDV

SEQ ID NO: 94611 - protein, 9 aa, Homo sapiens
  light chain complementarity determining region 3 for antibody 47306
LQDYNYPIT

SEQ ID NO: 94612 - protein, 12 aa, Homo sapiens
  heavy chain complementarity determining region 3 for antibody 47306
AGLKRGPWDFEF

SEQ ID NO: 94613 - protein, 9 aa, Homo sapiens
  light chain complementarity determining region 3 for antibody 47307
LQDYDYPWT

SEQ ID NO: 94614 - protein, 13 aa, Homo sapiens
  heavy chain complementarity determining region 3 for antibody 47307
ARVYWIEPLVFDI

SEQ ID NO: 94615 - protein, 9 aa, Homo sapiens
  light chain complementarity determining region 3 for antibody 47308
LQDYAYPHT

SEQ ID NO: 94616 - protein, 14 aa, Homo sapiens
  heavy chain complementarity determining region 3 for antibody 47308
ARRNLLSGYSTFDY

SEQ ID NO: 94617 - protein, 9 aa, Homo sapiens
  light chain complementarity determining region 3 for antibody 47309
LQALQTPGT

SEQ ID NO: 94618 - protein, 18 aa, Homo sapiens
  heavy chain complementarity determining region 3 for antibody 47309
AASGRYFFQNSGPLGFGY

SEQ ID NO: 94619 - protein, 9 aa, Homo sapiens
  light chain complementarity determining region 3 for antibody 47310
LQALHAPGT

SEQ ID NO: 94620 - protein, 18 aa, Homo sapiens
  heavy chain complementarity determining region 3 for antibody 47310
ARHSGLGLRPESYYGMDV

SEQ ID NO: 94621 - protein, 9 aa, Homo sapiens
  light chain complementarity determining region 3 for antibody 47311
LPYNNYPWA

SEQ ID NO: 94622 - protein, 15 aa, Homo sapiens
  heavy chain complementarity determining region 3 for antibody 47311
ARPTPESATYRGMDV

SEQ ID NO: 94623 - protein, 11 aa, Homo sapiens
  light chain complementarity determining region 3 for antibody 47312
LHYNIYSLMYT

SEQ ID NO: 94624 - protein, 18 aa, Homo sapiens
  heavy chain complementarity determining region 3 for antibody 47312
SRGAMSGVALTGTLPPTD

SEQ ID NO: 94625 - protein, 9 aa, Homo sapiens
  light chain complementarity determining region 3 for antibody 47313
LHYGSDSNT

SEQ ID NO: 94626 - protein, 11 aa, Homo sapiens
  heavy chain complementarity determining region 3 for antibody 47313
AKDSPSGAFDY

SEQ ID NO: 94627 - protein, 10 aa, Homo sapiens
  light chain complementarity determining region 3 for antibody 47314
LEYGNWPPLP

SEQ ID NO: 94628 - protein, 16 aa, Homo sapiens
  heavy chain complementarity determining region 3 for antibody 47314
ATMSRDYVSGSYYPDY

SEQ ID NO: 94629 - protein, 10 aa, Homo sapiens
  light chain complementarity determining region 3 for antibody 47315
LEGTHWPPAT

SEQ ID NO: 94630 - protein, 19 aa, Homo sapiens
  heavy chain complementarity determining region 3 for antibody 47315
SRDQSRPEANGWGIKSFDV

SEQ ID NO: 94631 - protein, 8 aa, Homo sapiens
  light chain complementarity determining region 3 for antibody 47316
LEGTHSPT

SEQ ID NO: 94632 - protein, 11 aa, Homo sapiens
  heavy chain complementarity determining region 3 for antibody 47316
ARDPGWGAFDV

SEQ ID NO: 94633 - protein, 8 aa, Homo sapiens
  light chain complementarity determining region 3 for antibody 47317
KQYNNYWT

SEQ ID NO: 94634 - protein, 18 aa, Homo sapiens
  heavy chain complementarity determining region 3 for antibody 47317
ARSGYFDSRASYHREFDY

SEQ ID NO: 94635 - protein, 9 aa, Homo sapiens
  light chain complementarity determining region 3 for antibody 47318
IQTLQTRLT

SEQ ID NO: 94636 - protein, 11 aa, Homo sapiens
  heavy chain complementarity determining region 3 for antibody 47318
ARALLGSSLDY

SEQ ID NO: 94637 - protein, 9 aa, Homo sapiens
  light chain complementarity determining region 3 for antibody 47319
IQGTHWPGT

SEQ ID NO: 94638 - protein, 17 aa, Homo sapiens
  heavy chain complementarity determining region 3 for antibody 47319
ARAQSHYSGSHIGGFDP

SEQ ID NO: 94639 - protein, 9 aa, Homo sapiens
  light chain complementarity determining region 3 for antibody 47320
HYYGGTPQA

SEQ ID NO: 94640 - protein, 10 aa, Homo sapiens
  heavy chain complementarity determining region 3 for antibody 47320
VLSTTKWGPS

SEQ ID NO: 94641 - protein, 9 aa, Homo sapiens
  light chain complementarity determining region 3 for antibody 47321
HYRCDWPLT

SEQ ID NO: 94642 - protein, 11 aa, Homo sapiens
  heavy chain complementarity determining region 3 for antibody 47321
ARFAVVDDMDV

SEQ ID NO: 94643 - protein, 10 aa, Homo sapiens
  light chain complementarity determining region 3 for antibody 47322
HRYGRSPPYP

SEQ ID NO: 94644 - protein, 19 aa, Homo sapiens
  heavy chain complementarity determining region 3 for antibody 47322
VKGSGYSASWISSNDGFDV

SEQ ID NO: 94645 - protein, 9 aa, Homo sapiens
  light chain complementarity determining region 3 for antibody 47323
HQYYSTPWT

SEQ ID NO: 94646 - protein, 15 aa, Homo sapiens
  heavy chain complementarity determining region 3 for antibody 47323
ARDIRQKAVFGTYDH

SEQ ID NO: 94647 - protein, 9 aa, Homo sapiens
  light chain complementarity determining region 3 for antibody 47324
HQYYGTPFT

SEQ ID NO: 94648 - protein, 12 aa, Homo sapiens
  heavy chain complementarity determining region 3 for antibody 47324
VREGDGWNNFDY

SEQ ID NO: 94649 - protein, 9 aa, Homo sapiens
  light chain complementarity determining region 3 for antibody 47325
HQYYDSPWT

SEQ ID NO: 94650 - protein, 11 aa, Homo sapiens
  heavy chain complementarity determining region 3 for antibody 47325
ARGRDSWKAGY

SEQ ID NO: 94651 - protein, 10 aa, Homo sapiens
  light chain complementarity determining region 3 for antibody 47326
HQYSTSPPWP

SEQ ID NO: 94652 - protein, 16 aa, Homo sapiens
  heavy chain complementarity determining region 3 for antibody 47326
ARRQWVRGLFRGGLDS

SEQ ID NO: 94653 - protein, 9 aa, Homo sapiens
  light chain complementarity determining region 3 for antibody 47327
HQYSNLPQT

SEQ ID NO: 94654 - protein, 9 aa, Homo sapiens
  heavy chain complementarity determining region 3 for antibody 47327
TTEQWEFYY

SEQ ID NO: 94655 - protein, 9 aa, Homo sapiens
  light chain complementarity determining region 3 for antibody 47328
HQYGTSPWT

SEQ ID NO: 94656 - protein, 14 aa, Homo sapiens
  heavy chain complementarity determining region 3 for antibody 47328
ASGPPGRYYGAFDV

SEQ ID NO: 94657 - protein, 9 aa, Homo sapiens
  light chain complementarity determining region 3 for antibody 47329
HQYGSSPWT

SEQ ID NO: 94658 - protein, 17 aa, Homo sapiens
  heavy chain complementarity determining region 3 for antibody 47329
ARGGAYYDSSGYDQFDY

SEQ ID NO: 94659 - protein, 10 aa, Homo sapiens
  light chain complementarity determining region 3 for antibody 47330
HQYGSSLSIP

SEQ ID NO: 94660 - protein, 13 aa, Homo sapiens
  heavy chain complementarity determining region 3 for antibody 47330
AREGDYGGLYFDY

SEQ ID NO: 94661 - protein, 9 aa, Homo sapiens
  light chain complementarity determining region 3 for antibody 47331
HQYGRSPRT

SEQ ID NO: 94662 - protein, 13 aa, Homo sapiens
  heavy chain complementarity determining region 3 for antibody 47331
ATESGSYYGGLDY

SEQ ID NO: 94663 - protein, 9 aa, Homo sapiens
  light chain complementarity determining region 3 for antibody 47332
HQYGRSLGT

SEQ ID NO: 94664 - protein, 17 aa, Homo sapiens
  heavy chain complementarity determining region 3 for antibody 47332
ARYISGWHPERDYGLDV

SEQ ID NO: 94665 - protein, 9 aa, Homo sapiens
  light chain complementarity determining region 3 for antibody 47333
HQYGDPPRT

SEQ ID NO: 94666 - protein, 16 aa, Homo sapiens
  heavy chain complementarity determining region 3 for antibody 47333
AGLSASGHLAPNTFDV

SEQ ID NO: 94667 - protein, 9 aa, Homo sapiens
  light chain complementarity determining region 3 for antibody 47334
HQYDRSPPT

SEQ ID NO: 94668 - protein, 13 aa, Homo sapiens
  heavy chain complementarity determining region 3 for antibody 47334
ARRQTYTNYAFDI

SEQ ID NO: 94669 - protein, 9 aa, Homo sapiens
  light chain complementarity determining region 3 for antibody 47335
HQYATLPET

SEQ ID NO: 94670 - protein, 13 aa, Homo sapiens
  heavy chain complementarity determining region 3 for antibody 47335
VRRGYGDFVREDF

SEQ ID NO: 94671 - protein, 9 aa, Homo sapiens
  light chain complementarity determining region 3 for antibody 47336
HQYASSVVT

SEQ ID NO: 94672 - protein, 17 aa, Homo sapiens
  heavy chain complementarity determining region 3 for antibody 47336
ATPQQQLIQAITARLDF

SEQ ID NO: 94673 - protein, 9 aa, Homo sapiens
  light chain complementarity determining region 3 for antibody 47337
HQYASSVVP

SEQ ID NO: 94674 - protein, 17 aa, Homo sapiens
  heavy chain complementarity determining region 3 for antibody 47337
ATPQQQLIQAITDRLDF

SEQ ID NO: 94675 - protein, 9 aa, Homo sapiens
  light chain complementarity determining region 3 for antibody 47338
HQYASSVFT

SEQ ID NO: 94676 - protein, 17 aa, Homo sapiens
  heavy chain complementarity determining region 3 for antibody 47338
ATPQQQLIQAITDRLDF

SEQ ID NO: 94677 - protein, 9 aa, Homo sapiens
  light chain complementarity determining region 3 for antibody 47339
HQYASSPYT

SEQ ID NO: 94678 - protein, 13 aa, Homo sapiens
  heavy chain complementarity determining region 3 for antibody 47339
ARGGYSGFAIFSV

SEQ ID NO: 94679 - protein, 9 aa, Homo sapiens
  light chain complementarity determining region 3 for antibody 47340
HQYAATPWT

SEQ ID NO: 94680 - protein, 11 aa, Homo sapiens
  heavy chain complementarity determining region 3 for antibody 47340
VGGWDEKKNGY

SEQ ID NO: 94681 - protein, 9 aa, Homo sapiens
  light chain complementarity determining region 3 for antibody 47341
HQTYSHVHS

SEQ ID NO: 94682 - protein, 15 aa, Homo sapiens
  heavy chain complementarity determining region 3 for antibody 47341
ASSIHETSGFNWFDL

SEQ ID NO: 94683 - protein, 9 aa, Homo sapiens
  light chain complementarity determining region 3 for antibody 47342
HQSYNFPRT

SEQ ID NO: 94684 - protein, 14 aa, Homo sapiens
  heavy chain complementarity determining region 3 for antibody 47342
ASSRDTSGYSSSDY

SEQ ID NO: 94685 - protein, 8 aa, Homo sapiens
  light chain complementarity determining region 3 for antibody 47343
HQSSSRLT

SEQ ID NO: 94686 - protein, 8 aa, Homo sapiens
  heavy chain complementarity determining region 3 for antibody 47343
AATKAGGY

SEQ ID NO: 94687 - protein, 8 aa, Homo sapiens
  light chain complementarity determining region 3 for antibody 47344
HQSSSRFT

SEQ ID NO: 94688 - protein, 8 aa, Homo sapiens
  heavy chain complementarity determining region 3 for antibody 47344
AATKAGGY

SEQ ID NO: 94689 - protein, 9 aa, Homo sapiens
  light chain complementarity determining region 3 for antibody 47345
HQSSSLPIT

SEQ ID NO: 94690 - protein, 23 aa, Homo sapiens
  heavy chain complementarity determining region 3 for antibody 47345
ARQWEVLQKTHNVYKPTLGLFDY

SEQ ID NO: 94691 - protein, 9 aa, Homo sapiens
  light chain complementarity determining region 3 for antibody 47346
HQSDSAPLT

SEQ ID NO: 94692 - protein, 10 aa, Homo sapiens
  heavy chain complementarity determining region 3 for antibody 47346
ASGLGWESGY

SEQ ID NO: 94693 - protein, 10 aa, Homo sapiens
  light chain complementarity determining region 3 for antibody 47347
HQRSSWPLLP

SEQ ID NO: 94694 - protein, 16 aa, Homo sapiens
  heavy chain complementarity determining region 3 for antibody 47347
AREMQHDLQHLGWLDP

SEQ ID NO: 94695 - protein, 9 aa, Homo sapiens
  light chain complementarity determining region 3 for antibody 47348
HQRSNWPRT

SEQ ID NO: 94696 - protein, 8 aa, Homo sapiens
  heavy chain complementarity determining region 3 for antibody 47348
VRDGYKHR

SEQ ID NO: 94697 - protein, 9 aa, Homo sapiens
  light chain complementarity determining region 3 for antibody 47349
HQRSNWPLP

SEQ ID NO: 94698 - protein, 15 aa, Homo sapiens
  heavy chain complementarity determining region 3 for antibody 47349
ARAFRTSGIYYNSDY

SEQ ID NO: 94699 - protein, 9 aa, Homo sapiens
  light chain complementarity determining region 3 for antibody 47350
HQRSNWPGT

SEQ ID NO: 94700 - protein, 16 aa, Homo sapiens
  heavy chain complementarity determining region 3 for antibody 47350
ARDYIGFGAPIYYFDY

SEQ ID NO: 94701 - protein, 9 aa, Homo sapiens
  light chain complementarity determining region 3 for antibody 47351
HQRSLSPQT

SEQ ID NO: 94702 - protein, 17 aa, Homo sapiens
  heavy chain complementarity determining region 3 for antibody 47351
ARHVGNAGVTDEDWMDP

SEQ ID NO: 94703 - protein, 8 aa, Homo sapiens
  light chain complementarity determining region 3 for antibody 47352
HQRSGLPT

SEQ ID NO: 94704 - protein, 18 aa, Homo sapiens
  heavy chain complementarity determining region 3 for antibody 47352
ARDAITFGGVLLRGHFDY

SEQ ID NO: 94705 - protein, 9 aa, Homo sapiens
  light chain complementarity determining region 3 for antibody 47353
HQRSDLPWT

SEQ ID NO: 94706 - protein, 13 aa, Homo sapiens
  heavy chain complementarity determining region 3 for antibody 47353
ARLVAQTRVPFDS

SEQ ID NO: 94707 - protein, 9 aa, Homo sapiens
  light chain complementarity determining region 3 for antibody 47354
HQPHSLPST

SEQ ID NO: 94708 - protein, 11 aa, Homo sapiens
  heavy chain complementarity determining region 3 for antibody 47354
ATGYSSSWYDF

SEQ ID NO: 94709 - protein, 9 aa, Homo sapiens
  light chain complementarity determining region 3 for antibody 47355
HQHNNWPLT

SEQ ID NO: 94710 - protein, 19 aa, Homo sapiens
  heavy chain complementarity determining region 3 for antibody 47355
ASARLPDYYDSSAQQAFDI

SEQ ID NO: 94711 - protein, 9 aa, Homo sapiens
  light chain complementarity determining region 3 for antibody 47356
HQHAYPPLT

SEQ ID NO: 94712 - protein, 10 aa, Homo sapiens
  heavy chain complementarity determining region 3 for antibody 47356
ARTSGWLGDY

SEQ ID NO: 94713 - protein, 9 aa, Homo sapiens
  light chain complementarity determining region 3 for antibody 47357
HQDGTSRQT

SEQ ID NO: 94714 - protein, 15 aa, Homo sapiens
  heavy chain complementarity determining region 3 for antibody 47357
AREMIRGVSEDALDV

SEQ ID NO: 94715 - protein, 9 aa, Homo sapiens
  light chain complementarity determining region 3 for antibody 47358
HQDGTAPET

SEQ ID NO: 94716 - protein, 5 aa, Homo sapiens
  heavy chain complementarity determining region 3 for antibody 47358
VRWGH

SEQ ID NO: 94717 - protein, 9 aa, Homo sapiens
  light chain complementarity determining region 3 for antibody 47359
HQDGSSPRT

SEQ ID NO: 94718 - protein, 13 aa, Homo sapiens
  heavy chain complementarity determining region 3 for antibody 47359
ATESGSYYGGLDY

SEQ ID NO: 94719 - protein, 9 aa, Homo sapiens
  light chain complementarity determining region 3 for antibody 47360
HKYNSVPFT

SEQ ID NO: 94720 - protein, 14 aa, Homo sapiens
  heavy chain complementarity determining region 3 for antibody 47360
AREVAGPGPQPLDY

SEQ ID NO: 94721 - protein, 9 aa, Homo sapiens
  light chain complementarity determining region 3 for antibody 47361
HHYSTSPRT

SEQ ID NO: 94722 - protein, 17 aa, Homo sapiens
  heavy chain complementarity determining region 3 for antibody 47361
VKPRETYSSGWVDAFEM

SEQ ID NO: 94723 - protein, 9 aa, Homo sapiens
  light chain complementarity determining region 3 for antibody 47362
HHYKNYPQT

SEQ ID NO: 94724 - protein, 21 aa, Homo sapiens
  heavy chain complementarity determining region 3 for antibody 47362
AKDAPVFRPYSSGWYSSAFDS

SEQ ID NO: 94725 - protein, 9 aa, Homo sapiens
  light chain complementarity determining region 3 for antibody 47363
HHYGTSPRT

SEQ ID NO: 94726 - protein, 13 aa, Homo sapiens
  heavy chain complementarity determining region 3 for antibody 47363
ATESGSYYGGLDY

SEQ ID NO: 94727 - protein, 9 aa, Homo sapiens
  light chain complementarity determining region 3 for antibody 47364
HHYGTSPIT

SEQ ID NO: 94728 - protein, 15 aa, Homo sapiens
  heavy chain complementarity determining region 3 for antibody 47364
ASEYTSAWSRNFFDY

SEQ ID NO: 94729 - protein, 9 aa, Homo sapiens
  light chain complementarity determining region 3 for antibody 47365
HHYDNLPGT

SEQ ID NO: 94730 - protein, 14 aa, Homo sapiens
  heavy chain complementarity determining region 3 for antibody 47365
ARKLFVRTAAEFDY

SEQ ID NO: 94731 - protein, 9 aa, Homo sapiens
  light chain complementarity determining region 3 for antibody 47366
GQYNRYPRT

SEQ ID NO: 94732 - protein, 6 aa, Homo sapiens
  heavy chain complementarity determining region 3 for antibody 47366
TRALDY

SEQ ID NO: 94733 - protein, 9 aa, Homo sapiens
  light chain complementarity determining region 3 for antibody 47367
FQYESWPLT

SEQ ID NO: 94734 - protein, 12 aa, Homo sapiens
  heavy chain complementarity determining region 3 for antibody 47367
ARSFHDVVTFDF

SEQ ID NO: 94735 - protein, 9 aa, Homo sapiens
  light chain complementarity determining region 3 for antibody 47368
FQTLLTPRT

SEQ ID NO: 94736 - protein, 9 aa, Homo sapiens
  heavy chain complementarity determining region 3 for antibody 47368
ARAVPGLDY

SEQ ID NO: 94737 - protein, 9 aa, Homo sapiens
  light chain complementarity determining region 3 for antibody 47369
EQYNDWPYT

SEQ ID NO: 94738 - protein, 8 aa, Homo sapiens
  heavy chain complementarity determining region 3 for antibody 47369
TTNPQEGH

SEQ ID NO: 94739 - protein, 9 aa, Homo sapiens
  light chain complementarity determining region 3 for antibody 47370
EQTSRTLGT

SEQ ID NO: 94740 - protein, 15 aa, Homo sapiens
  heavy chain complementarity determining region 3 for antibody 47370
ATYSNSWYSSPLFDY

SEQ ID NO: 94741 - protein, 9 aa, Homo sapiens
  light chain complementarity determining region 3 for antibody 47371
VQYNSYPRT

SEQ ID NO: 94742 - protein, 6 aa, Homo sapiens
  heavy chain complementarity determining region 3 for antibody 47371
TRALDY

SEQ ID NO: 94743 - protein, 9 aa, Homo sapiens
  light chain complementarity determining region 3 for antibody 47372
VQYNRYPRP

SEQ ID NO: 94744 - protein, 6 aa, Homo sapiens
  heavy chain complementarity determining region 3 for antibody 47372
TRALDY

SEQ ID NO: 94745 - protein, 8 aa, Homo sapiens
  light chain complementarity determining region 3 for antibody 47373
VQGTHGPP

SEQ ID NO: 94746 - protein, 12 aa, Homo sapiens
  heavy chain complementarity determining region 3 for antibody 47373
ARDYSTGDIPGY

SEQ ID NO: 94747 - protein, 8 aa, Homo sapiens
  light chain complementarity determining region 3 for antibody 47374
VQDLQTPT

SEQ ID NO: 94748 - protein, 11 aa, Homo sapiens
  heavy chain complementarity determining region 3 for antibody 47374
VRVAIVAAKAA

SEQ ID NO: 94749 - protein, 9 aa, Homo sapiens
  light chain complementarity determining region 3 for antibody 47375
VPYNRYPRT

SEQ ID NO: 94750 - protein, 6 aa, Homo sapiens
  heavy chain complementarity determining region 3 for antibody 47375
TRALDY

SEQ ID NO: 94751 - protein, 9 aa, Homo sapiens
  light chain complementarity determining region 3 for antibody 47376
TQALQTPTT

SEQ ID NO: 94752 - protein, 13 aa, Homo sapiens
  heavy chain complementarity determining region 3 for antibody 47376
AMVVDYGDHGFDY

SEQ ID NO: 94753 - protein, 10 aa, Homo sapiens
  light chain complementarity determining region 3 for antibody 47377
TQALQTPPTT

SEQ ID NO: 94754 - protein, 16 aa, Homo sapiens
  heavy chain complementarity determining region 3 for antibody 47377
AREGWHRGYMYGGFDY

SEQ ID NO: 94755 - protein, 9 aa, Homo sapiens
  light chain complementarity determining region 3 for antibody 47378
TQALQPPIT

SEQ ID NO: 94756 - protein, 13 aa, Homo sapiens
  heavy chain complementarity determining region 3 for antibody 47378
AMVVDYGDHGFDY

SEQ ID NO: 94757 - protein, 9 aa, Homo sapiens
  light chain complementarity determining region 3 for antibody 47379
TQALQIPFT

SEQ ID NO: 94758 - protein, 12 aa, Homo sapiens
  heavy chain complementarity determining region 3 for antibody 47379
ARGRVGGNSFDQ

SEQ ID NO: 94759 - protein, 9 aa, Homo sapiens
  light chain complementarity determining region 3 for antibody 47380
RQYNNWPQT

SEQ ID NO: 94760 - protein, 16 aa, Homo sapiens
  heavy chain complementarity determining region 3 for antibody 47380
ARPSGAAGPRLSGLDV

SEQ ID NO: 94761 - protein, 9 aa, Homo sapiens
  light chain complementarity determining region 3 for antibody 47381
RQYGSSPPT

SEQ ID NO: 94762 - protein, 10 aa, Homo sapiens
  heavy chain complementarity determining region 3 for antibody 47381
ARGIHNGFDV

SEQ ID NO: 94763 - protein, 10 aa, Homo sapiens
  light chain complementarity determining region 3 for antibody 47382
RQYGGSPPIT

SEQ ID NO: 94764 - protein, 18 aa, Homo sapiens
  heavy chain complementarity determining region 3 for antibody 47382
ARDEVYCTSTSCYDAFDY

SEQ ID NO: 94765 - protein, 9 aa, Homo sapiens
  light chain complementarity determining region 3 for antibody 47383
RQYGDSPWT

SEQ ID NO: 94766 - protein, 11 aa, Homo sapiens
  heavy chain complementarity determining region 3 for antibody 47383
ARIDVTVGYDI

SEQ ID NO: 94767 - protein, 9 aa, Homo sapiens
  light chain complementarity determining region 3 for antibody 47384
RQYDNLPPA

SEQ ID NO: 94768 - protein, 11 aa, Homo sapiens
  heavy chain complementarity determining region 3 for antibody 47384
TRDRGPVTCAY

SEQ ID NO: 94769 - protein, 10 aa, Homo sapiens
  light chain complementarity determining region 3 for antibody 47385
RQRYNWPPYT

SEQ ID NO: 94770 - protein, 11 aa, Homo sapiens
  heavy chain complementarity determining region 3 for antibody 47385
ARGVGSYVFES

SEQ ID NO: 94771 - protein, 10 aa, Homo sapiens
  light chain complementarity determining region 3 for antibody 47386
RQRYNWPPFT

SEQ ID NO: 94772 - protein, 11 aa, Homo sapiens
  heavy chain complementarity determining region 3 for antibody 47386
ARGVGSYPFDS

SEQ ID NO: 94773 - protein, 9 aa, Homo sapiens
  light chain complementarity determining region 3 for antibody 47387
RQRSNWPFT

SEQ ID NO: 94774 - protein, 16 aa, Homo sapiens
  heavy chain complementarity determining region 3 for antibody 47387
ARELARRNTYYHAFEI

SEQ ID NO: 94775 - protein, 9 aa, Homo sapiens
  light chain complementarity determining region 3 for antibody 47388
RQRNSYPIP

SEQ ID NO: 94776 - protein, 11 aa, Homo sapiens
  heavy chain complementarity determining region 3 for antibody 47388
VRASSQYYLDY

SEQ ID NO: 94777 - protein, 9 aa, Homo sapiens
  light chain complementarity determining region 3 for antibody 47389
RQPLQIPRT

SEQ ID NO: 94778 - protein, 14 aa, Homo sapiens
  heavy chain complementarity determining region 3 for antibody 47389
ARGDGSDYYLPLAY

SEQ ID NO: 94779 - protein, 9 aa, Homo sapiens
  light chain complementarity determining region 3 for antibody 47390
RQLNSYPRT

SEQ ID NO: 94780 - protein, 32 aa, Homo sapiens; identical to SEQ ID NO: 81498
  heavy chain complementarity determining region 3 for antibody 47390

SEQ ID NO: 94781 - protein, 9 aa, Homo sapiens
  light chain complementarity determining region 3 for antibody 47391
RQLNRYPLT

SEQ ID NO: 94782 - protein, 16 aa, Homo sapiens
  heavy chain complementarity determining region 3 for antibody 47391
VRGWQVAIDISGYFDL

SEQ ID NO: 94783 - protein, 9 aa, Homo sapiens
  light chain complementarity determining region 3 for antibody 47392
RQGYNFPLT

SEQ ID NO: 94784 - protein, 18 aa, Homo sapiens
  heavy chain complementarity determining region 3 for antibody 47392
ARKHTRSSIRDITDAFDL

SEQ ID NO: 94785 - protein, 9 aa, Homo sapiens
  light chain complementarity determining region 3 for antibody 47393
RQGTHWPQT

SEQ ID NO: 94786 - protein, 13 aa, Homo sapiens
  heavy chain complementarity determining region 3 for antibody 47393
ARTGQWLGGQYDY

SEQ ID NO: 94787 - protein, 10 aa, Homo sapiens
  light chain complementarity determining region 3 for antibody 47394
RQGTHWPPIT

SEQ ID NO: 94788 - protein, 8 aa, Homo sapiens
  heavy chain complementarity determining region 3 for antibody 47394
ARGETTDN

SEQ ID NO: 94789 - protein, 9 aa, Homo sapiens
  light chain complementarity determining region 3 for antibody 47395
RQGTHWPGT

SEQ ID NO: 94790 - protein, 15 aa, Homo sapiens
  heavy chain complementarity determining region 3 for antibody 47395
AKDHSPYSSSSDFDY

SEQ ID NO: 94791 - protein, 9 aa, Homo sapiens
  light chain complementarity determining region 3 for antibody 47396
RQGTHGRRT

SEQ ID NO: 94792 - protein, 9 aa, Homo sapiens
  heavy chain complementarity determining region 3 for antibody 47396
ARGGAWFDY

SEQ ID NO: 94793 - protein, 8 aa, Homo sapiens
  light chain complementarity determining region 3 for antibody 47397
RQGSHWPS

SEQ ID NO: 94794 - protein, 8 aa, Homo sapiens
  heavy chain complementarity determining region 3 for antibody 47397
ATWGRSDF

SEQ ID NO: 94795 - protein, 9 aa, Homo sapiens
  light chain complementarity determining region 3 for antibody 47398
RQGLQTPWT

SEQ ID NO: 94796 - protein, 14 aa, Homo sapiens
  heavy chain complementarity determining region 3 for antibody 47398
AREDSAVGYYGMDV

SEQ ID NO: 94797 - protein, 8 aa, Homo sapiens
  light chain complementarity determining region 3 for antibody 47399
RQFGDSQT

SEQ ID NO: 94798 - protein, 14 aa, Homo sapiens
  heavy chain complementarity determining region 3 for antibody 47399
ARDSEYNGPYLYQH

SEQ ID NO: 94799 - protein, 10 aa, Homo sapiens
  light chain complementarity determining region 3 for antibody 47400
RQDGGSPPIT

SEQ ID NO: 94800 - protein, 18 aa, Homo sapiens
  heavy chain complementarity determining region 3 for antibody 47400
ARDEVYCTSTSCYDTFDY

SEQ ID NO: 94801 - protein, 9 aa, Homo sapiens
  light chain complementarity determining region 3 for antibody 47401
RQALQTPRT

SEQ ID NO: 94802 - protein, 11 aa, Homo sapiens
  heavy chain complementarity determining region 3 for antibody 47401
VREGVVAGSVS

SEQ ID NO: 94803 - protein, 8 aa, Homo sapiens
  light chain complementarity determining region 3 for antibody 47402
RQALQTPG

SEQ ID NO: 94804 - protein, 19 aa, Homo sapiens
  heavy chain complementarity determining region 3 for antibody 47402
ANFGSGNFYNVRYYYGMDV

SEQ ID NO: 94805 - protein, 9 aa, Homo sapiens
  light chain complementarity determining region 3 for antibody 47403
RQALQSPPT

SEQ ID NO: 94806 - protein, 22 aa, Homo sapiens
  heavy chain complementarity determining region 3 for antibody 47403
ARGQIAAAGITRGQYFYYGMDV

SEQ ID NO: 94807 - protein, 9 aa, Homo sapiens
  light chain complementarity determining region 3 for antibody 47404
RQAKSLPLT

SEQ ID NO: 94808 - protein, 8 aa, Homo sapiens
  heavy chain complementarity determining region 3 for antibody 47404
ARRNWFDP

SEQ ID NO: 94809 - protein, 8 aa, Homo sapiens
  light chain complementarity determining region 3 for antibody 47405
QYYHDLWT

SEQ ID NO: 94810 - protein, 9 aa, Homo sapiens
  heavy chain complementarity determining region 3 for antibody 47405
ATEEYYFSN

SEQ ID NO: 94811 - protein, 8 aa, Homo sapiens
  light chain complementarity determining region 3 for antibody 47406
QYYGSPPG

SEQ ID NO: 94812 - protein, 9 aa, Homo sapiens
  heavy chain complementarity determining region 3 for antibody 47406
ARGYDAFDF

SEQ ID NO: 94813 - protein, 9 aa, Homo sapiens
  light chain complementarity determining region 3 for antibody 47407
QYYGSFLCS

SEQ ID NO: 94814 - protein, 19 aa, Homo sapiens
  heavy chain complementarity determining region 3 for antibody 47407
ARVRGFSLLVAVIPDAFDI

SEQ ID NO: 94815 - protein, 9 aa, Homo sapiens
  light chain complementarity determining region 3 for antibody 47408
QYYGRSLCS

SEQ ID NO: 94816 - protein, 19 aa, Homo sapiens
  heavy chain complementarity determining region 3 for antibody 47408
ARVRGFSLLVAVIPDAFDI

SEQ ID NO: 94817 - protein, 10 aa, Homo sapiens
  light chain complementarity determining region 3 for antibody 47409
QYYETSRGFT

SEQ ID NO: 94818 - protein, 9 aa, Homo sapiens
  heavy chain complementarity determining region 3 for antibody 47409
ARGSGWFHL

SEQ ID NO: 94819 - protein, 8 aa, Homo sapiens
  light chain complementarity determining region 3 for antibody 47410
QYRSNWPT

SEQ ID NO: 94820 - protein, 17 aa, Homo sapiens
  heavy chain complementarity determining region 3 for antibody 47410
ARDTVAIGSMGYYGLDV

SEQ ID NO: 94821 - protein, 9 aa, Homo sapiens
  light chain complementarity determining region 3 for antibody 47411
QYRSNWLFP

SEQ ID NO: 94822 - protein, 13 aa, Homo sapiens
  heavy chain complementarity determining region 3 for antibody 47411
VALSLAVADGADY

SEQ ID NO: 94823 - protein, 11 aa, Homo sapiens
  light chain complementarity determining region 3 for antibody 47412
QYFHPSPPSSP

SEQ ID NO: 94824 - protein, 10 aa, Homo sapiens
  heavy chain complementarity determining region 3 for antibody 47412
ARDWVVGAIE

SEQ ID NO: 94825 - protein, 11 aa, Homo sapiens
  light chain complementarity determining region 3 for antibody 47413
QWYDNIPPWLT

SEQ ID NO: 94826 - protein, 15 aa, Homo sapiens
  heavy chain complementarity determining region 3 for antibody 47413
ARGPGVLAVKGVFDH

SEQ ID NO: 94827 - protein, 9 aa, Homo sapiens
  light chain complementarity determining region 3 for antibody 47414
QVYGRSPQT

SEQ ID NO: 94828 - protein, 18 aa, Homo sapiens
  heavy chain complementarity determining region 3 for antibody 47414
ARDGGGYNHGSSGAYLDY

SEQ ID NO: 94829 - protein, 8 aa, Homo sapiens
  light chain complementarity determining region 3 for antibody 47415
QVYGGSHT

SEQ ID NO: 94830 - protein, 12 aa, Homo sapiens
  heavy chain complementarity determining region 3 for antibody 47415
VLDGGSVHGFDI

SEQ ID NO: 94831 - protein, 8 aa, Homo sapiens
  light chain complementarity determining region 3 for antibody 47416
QVSYTALT

SEQ ID NO: 94832 - protein, 15 aa, Homo sapiens
  heavy chain complementarity determining region 3 for antibody 47416
ARQGGQRVRGYYSDY

SEQ ID NO: 94833 - protein, 8 aa, Homo sapiens
  light chain complementarity determining region 3 for antibody 47417
QVGHTPPL

SEQ ID NO: 94834 - protein, 14 aa, Homo sapiens
  heavy chain complementarity determining region 3 for antibody 47417
ARAEFGHDYWPFDF

SEQ ID NO: 94835 - protein, 8 aa, Homo sapiens
  light chain complementarity determining region 3 for antibody 47418
QVFGTALT

SEQ ID NO: 94836 - protein, 16 aa, Homo sapiens
  heavy chain complementarity determining region 3 for antibody 47418
ARSLYFGSGNVIFFGS

SEQ ID NO: 94837 - protein, 9 aa, Homo sapiens
  light chain complementarity determining region 3 for antibody 47419
QTYNSAPLT

SEQ ID NO: 94838 - protein, 14 aa, Homo sapiens
  heavy chain complementarity determining region 3 for antibody 47419
AKDWMGIFLYYFDS

SEQ ID NO: 94839 - protein, 11 aa, Homo sapiens
  light chain complementarity determining region 3 for antibody 47420
QSQYSNPPMYA

SEQ ID NO: 94840 - protein, 15 aa, Homo sapiens
  heavy chain complementarity determining region 3 for antibody 47420
TTLNYGDYVSDAFGL

SEQ ID NO: 94841 - protein, 9 aa, Homo sapiens
  light chain complementarity determining region 3 for antibody 47421
QRYTGAPLT

SEQ ID NO: 94842 - protein, 11 aa, Homo sapiens
  heavy chain complementarity determining region 3 for antibody 47421
ARRGVTPALDI

SEQ ID NO: 94843 - protein, 9 aa, Homo sapiens
  light chain complementarity determining region 3 for antibody 47422
QRYNTQSRT

SEQ ID NO: 94844 - protein, 15 aa, Homo sapiens
  heavy chain complementarity determining region 3 for antibody 47422
AREVVRGHSYWELDY

SEQ ID NO: 94845 - protein, 9 aa, Homo sapiens
  light chain complementarity determining region 3 for antibody 47423
QRYNSWPWP

SEQ ID NO: 94846 - protein, 19 aa, Homo sapiens
  heavy chain complementarity determining region 3 for antibody 47423
VKVQMESRGYTYGRAPGDY

SEQ ID NO: 94847 - protein, 9 aa, Homo sapiens
  light chain complementarity determining region 3 for antibody 47424
QRYNRAPLT

SEQ ID NO: 94848 - protein, 20 aa, Homo sapiens
  heavy chain complementarity determining region 3 for antibody 47424
ARGPAGFRERPYFHYFGLDV

SEQ ID NO: 94849 - protein, 10 aa, Homo sapiens
  light chain complementarity determining region 3 for antibody 47425
QRYNGYDRIT

SEQ ID NO: 94850 - protein, 18 aa, Homo sapiens
  heavy chain complementarity determining region 3 for antibody 47425
ARASRGGSGTSYQYYFDY

SEQ ID NO: 94851 - protein, 9 aa, Homo sapiens
  light chain complementarity determining region 3 for antibody 47426
QRYNDYPLT

SEQ ID NO: 94852 - protein, 13 aa, Homo sapiens
  heavy chain complementarity determining region 3 for antibody 47426
ARIPRYSSGWSDY

SEQ ID NO: 94853 - protein, 10 aa, Homo sapiens
  light chain complementarity determining region 3 for antibody 47427
QRYGSSPMDT

SEQ ID NO: 94854 - protein, 13 aa, Homo sapiens
  heavy chain complementarity determining region 3 for antibody 47427
ARYNLEYYDAFDL

SEQ ID NO: 94855 - protein, 9 aa, Homo sapiens
  light chain complementarity determining region 3 for antibody 47428
QRYGSSPGT

SEQ ID NO: 94856 - protein, 21 aa, Homo sapiens
  heavy chain complementarity determining region 3 for antibody 47428
ARAPLGYCTGGTCNFGEYFQQ

SEQ ID NO: 94857 - protein, 11 aa, Homo sapiens
  light chain complementarity determining region 3 for antibody 47429
QRYGSSLPLYT

SEQ ID NO: 94858 - protein, 16 aa, Homo sapiens
  heavy chain complementarity determining region 3 for antibody 47429
ARVGGTSGKNFRELDY

SEQ ID NO: 94859 - protein, 9 aa, Homo sapiens
  light chain complementarity determining region 3 for antibody 47430
QRYGSSGGT

SEQ ID NO: 94860 - protein, 17 aa, Homo sapiens
  heavy chain complementarity determining region 3 for antibody 47430
ARDSAPREGYFDDYFDS

SEQ ID NO: 94861 - protein, 10 aa, Homo sapiens
  light chain complementarity determining region 3 for antibody 47431
QRYGRSPPYA

SEQ ID NO: 94862 - protein, 15 aa, Homo sapiens
  heavy chain complementarity determining region 3 for antibody 47431
ARDQWLLLPGGFFDS

SEQ ID NO: 94863 - protein, 10 aa, Homo sapiens
  light chain complementarity determining region 3 for antibody 47432
QRYGRSPPST

SEQ ID NO: 94864 - protein, 15 aa, Homo sapiens
  heavy chain complementarity determining region 3 for antibody 47432
ARDQWLLLPGGFFDS

SEQ ID NO: 94865 - protein, 10 aa, Homo sapiens
  light chain complementarity determining region 3 for antibody 47433
QRYGASPPWR

SEQ ID NO: 94866 - protein, 14 aa, Homo sapiens
  heavy chain complementarity determining region 3 for antibody 47433
ASTIGYSDGPGGDY

SEQ ID NO: 94867 - protein, 9 aa, Homo sapiens
  light chain complementarity determining region 3 for antibody 47434
QRYGASPLI

SEQ ID NO: 94868 - protein, 12 aa, Homo sapiens
  heavy chain complementarity determining region 3 for antibody 47434
ARMGGSYFAFLY

SEQ ID NO: 94869 - protein, 9 aa, Homo sapiens
  light chain complementarity determining region 3 for antibody 47435
QRYDSAPRT

SEQ ID NO: 94870 - protein, 11 aa, Homo sapiens
  heavy chain complementarity determining region 3 for antibody 47435
AQDIFASSWLH

SEQ ID NO: 94871 - protein, 8 aa, Homo sapiens
  light chain complementarity determining region 3 for antibody 47436
QRYDRPIT

SEQ ID NO: 94872 - protein, 16 aa, Homo sapiens
  heavy chain complementarity determining region 3 for antibody 47436
ARDFGTSVTSRGYFDF

SEQ ID NO: 94873 - protein, 8 aa, Homo sapiens
  light chain complementarity determining region 3 for antibody 47437
QRYDNLYA

SEQ ID NO: 94874 - protein, 18 aa, Homo sapiens
  heavy chain complementarity determining region 3 for antibody 47437
VRDRSCTASNCYFDAFDV

SEQ ID NO: 94875 - protein, 9 aa, Homo sapiens
  light chain complementarity determining region 3 for antibody 47438
QRYDGYSET

SEQ ID NO: 94876 - protein, 16 aa, Homo sapiens
  heavy chain complementarity determining region 3 for antibody 47438
ARALTGRYSYGYRLDY

SEQ ID NO: 94877 - protein, 9 aa, Homo sapiens
  light chain complementarity determining region 3 for antibody 47439
QRVNNVPLT

SEQ ID NO: 94878 - protein, 17 aa, Homo sapiens
  heavy chain complementarity determining region 3 for antibody 47439
AKGASVRGVIPDNLLKD

SEQ ID NO: 94879 - protein, 9 aa, Homo sapiens
  light chain complementarity determining region 3 for antibody 47440
QRSFTNPPT

SEQ ID NO: 94880 - protein, 18 aa, Homo sapiens
  heavy chain complementarity determining region 3 for antibody 47440
AREKDVFVGYVSYNWFDP

SEQ ID NO: 94881 - protein, 10 aa, Homo sapiens
  light chain complementarity determining region 3 for antibody 47441
QRRSTWPPGT

SEQ ID NO: 94882 - protein, 14 aa, Homo sapiens
  heavy chain complementarity determining region 3 for antibody 47441
ASHQAIAVAAVVDY

SEQ ID NO: 94883 - protein, 9 aa, Homo sapiens
  light chain complementarity determining region 3 for antibody 47442
QRQNSDPLT

SEQ ID NO: 94884 - protein, 10 aa, Homo sapiens
  heavy chain complementarity determining region 3 for antibody 47442
ARDEGYFGTW

SEQ ID NO: 94885 - protein, 9 aa, Homo sapiens
  light chain complementarity determining region 3 for antibody 47443
QRQNRAPFT

SEQ ID NO: 94886 - protein, 10 aa, Homo sapiens
  heavy chain complementarity determining region 3 for antibody 47443
ARDEGYFGTS

SEQ ID NO: 94887 - protein, 9 aa, Homo sapiens
  light chain complementarity determining region 3 for antibody 47444
QRQDRAPLP

SEQ ID NO: 94888 - protein, 10 aa, Homo sapiens
  heavy chain complementarity determining region 3 for antibody 47444
ARDEGYFGTS

SEQ ID NO: 94889 - protein, 9 aa, Homo sapiens
  light chain complementarity determining region 3 for antibody 47445
QRLNNYPPT

SEQ ID NO: 94890 - protein, 8 aa, Homo sapiens
  heavy chain complementarity determining region 3 for antibody 47445
TRGGDFDY

SEQ ID NO: 94891 - protein, 9 aa, Homo sapiens
  light chain complementarity determining region 3 for antibody 47446
QRHNTLPVT

SEQ ID NO: 94892 - protein, 14 aa, Homo sapiens
  heavy chain complementarity determining region 3 for antibody 47446
VATSTLIVAHYFDY

SEQ ID NO: 94893 - protein, 10 aa, Homo sapiens
  light chain complementarity determining region 3 for antibody 47447
QRHGRSPPYP

SEQ ID NO: 94894 - protein, 15 aa, Homo sapiens
  heavy chain complementarity determining region 3 for antibody 47447
ARDQWLLLPGGFFDS

SEQ ID NO: 94895 - protein, 9 aa, Homo sapiens
  light chain complementarity determining region 3 for antibody 47448
QRDNDYPFT

SEQ ID NO: 94896 - protein, 13 aa, Homo sapiens
  heavy chain complementarity determining region 3 for antibody 47448
ARIPRYSSGWSDY

SEQ ID NO: 94897 - protein, 10 aa, Homo sapiens
  light chain complementarity determining region 3 for antibody 47449
QRDGASPPWR

SEQ ID NO: 94898 - protein, 14 aa, Homo sapiens
  heavy chain complementarity determining region 3 for antibody 47449
ASTIGYSDGPGGDY

SEQ ID NO: 94899 - protein, 10 aa, Homo sapiens
  light chain complementarity determining region 3 for antibody 47450
QQYYVTPPFP

SEQ ID NO: 94900 - protein, 17 aa, Homo sapiens
  heavy chain complementarity determining region 3 for antibody 47450
AKDAYSTTWPASVPFDS

SEQ ID NO: 94901 - protein, 9 aa, Homo sapiens
  light chain complementarity determining region 3 for antibody 47451
QQYYTYPLT

SEQ ID NO: 94902 - protein, 10 aa, Homo sapiens
  heavy chain complementarity determining region 3 for antibody 47451
AREDFWRLDL

SEQ ID NO: 94903 - protein, 9 aa, Homo sapiens
  light chain complementarity determining region 3 for antibody 47452
QQYYTYPFT

SEQ ID NO: 94904 - protein, 15 aa, Homo sapiens
  heavy chain complementarity determining region 3 for antibody 47452
AKDAVGGTTLKAFDF

SEQ ID NO: 94905 - protein, 9 aa, Homo sapiens
  light chain complementarity determining region 3 for antibody 47453
QQYYTTSYT

SEQ ID NO: 94906 - protein, 13 aa, Homo sapiens
  heavy chain complementarity determining region 3 for antibody 47453
ARLKQQLGYLFDY

SEQ ID NO: 94907 - protein, 9 aa, Homo sapiens
  light chain complementarity determining region 3 for antibody 47454
QQYYTTPYT

SEQ ID NO: 94908 - protein, 16 aa, Homo sapiens
  heavy chain complementarity determining region 3 for antibody 47454
VRTLPGRDGYNWPFDY

SEQ ID NO: 94909 - protein, 9 aa, Homo sapiens
  light chain complementarity determining region 3 for antibody 47455
QQYYTTPYT

SEQ ID NO: 94910 - protein, 15 aa, Homo sapiens
  heavy chain complementarity determining region 3 for antibody 47455
ARYQGGGEGRRYIEL

SEQ ID NO: 94911 - protein, 9 aa, Homo sapiens
  light chain complementarity determining region 3 for antibody 47456
QQYYTTPWT

SEQ ID NO: 94912 - protein, 20 aa, Homo sapiens
  heavy chain complementarity determining region 3 for antibody 47456
ARFRWSGDGIWADNYYGLDV

SEQ ID NO: 94913 - protein, 9 aa, Homo sapiens
  light chain complementarity determining region 3 for antibody 47457
QQYYTTPWT

SEQ ID NO: 94914 - protein, 16 aa, Homo sapiens
  heavy chain complementarity determining region 3 for antibody 47457
ARDSTTLSDFWSGSDT

SEQ ID NO: 94915 - protein, 8 aa, Homo sapiens
  light chain complementarity determining region 3 for antibody 47458
QQYYTTPS

SEQ ID NO: 94916 - protein, 16 aa, Homo sapiens
  heavy chain complementarity determining region 3 for antibody 47458
TTGPRDYHGYSFYFDP

SEQ ID NO: 94917 - protein, 9 aa, Homo sapiens
  light chain complementarity determining region 3 for antibody 47459
QQYYTTPST

SEQ ID NO: 94918 - protein, 15 aa, Homo sapiens
  heavy chain complementarity determining region 3 for antibody 47459
ARYQGGGEGRRYIEL

SEQ ID NO: 94919 - protein, 9 aa, Homo sapiens
  light chain complementarity determining region 3 for antibody 47460
QQYYTTPPT

SEQ ID NO: 94920 - protein, 11 aa, Homo sapiens
  heavy chain complementarity determining region 3 for antibody 47460
ARKPTRMALDY

SEQ ID NO: 94921 - protein, 10 aa, Homo sapiens
  light chain complementarity determining region 3 for antibody 47461
QQYYTSPPWT

SEQ ID NO: 94922 - protein, 17 aa, Homo sapiens
  heavy chain complementarity determining region 3 for antibody 47461
ARGLLAHLDWLPFWFDP

SEQ ID NO: 94923 - protein, 11 aa, Homo sapiens
  light chain complementarity determining region 3 for antibody 47462
QQYYTSPPGNT

SEQ ID NO: 94924 - protein, 14 aa, Homo sapiens
  heavy chain complementarity determining region 3 for antibody 47462
ARCTSSSRKRSFDQ

SEQ ID NO: 94925 - protein, 11 aa, Homo sapiens
  light chain complementarity determining region 3 for antibody 47463
QQYYTSPPGNP

SEQ ID NO: 94926 - protein, 14 aa, Homo sapiens
  heavy chain complementarity determining region 3 for antibody 47463
ARCTSSSRKRSFDQ

SEQ ID NO: 94927 - protein, 9 aa, Homo sapiens
  light chain complementarity determining region 3 for antibody 47464
QQYYTPPYT

SEQ ID NO: 94928 - protein, 15 aa, Homo sapiens
  heavy chain complementarity determining region 3 for antibody 47464
ARYQGGGEGRRYIEL

SEQ ID NO: 94929 - protein, 9 aa, Homo sapiens
  light chain complementarity determining region 3 for antibody 47465
QQYYTAPYT

SEQ ID NO: 94930 - protein, 11 aa, Homo sapiens
  heavy chain complementarity determining region 3 for antibody 47465
ARTQGSGPGGF

SEQ ID NO: 94931 - protein, 9 aa, Homo sapiens
  light chain complementarity determining region 3 for antibody 47466
QQYYSYPRT

SEQ ID NO: 94932 - protein, 22 aa, Homo sapiens
  heavy chain complementarity determining region 3 for antibody 47466
ARGEYLSDGTDYLWLTDEYFQH

SEQ ID NO: 94933 - protein, 9 aa, Homo sapiens
  light chain complementarity determining region 3 for antibody 47467
QQYYSYPPT

SEQ ID NO: 94934 - protein, 14 aa, Homo sapiens
  heavy chain complementarity determining region 3 for antibody 47467
ARGRIDFGYSSFDY

SEQ ID NO: 94935 - protein, 9 aa, Homo sapiens
  light chain complementarity determining region 3 for antibody 47468
QQYYSYPLT

SEQ ID NO: 94936 - protein, 20 aa, Homo sapiens
  heavy chain complementarity determining region 3 for antibody 47468
ARAPRRRRTVTTRGGDAFDI

SEQ ID NO: 94937 - protein, 8 aa, Homo sapiens
  light chain complementarity determining region 3 for antibody 47469
QQYYSYLT

SEQ ID NO: 94938 - protein, 15 aa, Homo sapiens
  heavy chain complementarity determining region 3 for antibody 47469
ARGPAYYDDSGFFDF

SEQ ID NO: 94939 - protein, 9 aa, Homo sapiens
  light chain complementarity determining region 3 for antibody 47470
QQYYSVPPT

SEQ ID NO: 94940 - protein, 19 aa, Homo sapiens
  heavy chain complementarity determining region 3 for antibody 47470
ARSYSSSSPYYTSFYYFDY

SEQ ID NO: 94941 - protein, 9 aa, Homo sapiens
  light chain complementarity determining region 3 for antibody 47471
QQYYSTPWT

SEQ ID NO: 94942 - protein, 20 aa, Homo sapiens
  heavy chain complementarity determining region 3 for antibody 47471
MGRDADYYESRDQALLGFDF

SEQ ID NO: 94943 - protein, 9 aa, Homo sapiens
  light chain complementarity determining region 3 for antibody 47472
QQYYSTPWS

SEQ ID NO: 94944 - protein, 17 aa, Homo sapiens
  heavy chain complementarity determining region 3 for antibody 47472
AHTGKLQYHVYPPYFAH

SEQ ID NO: 94945 - protein, 9 aa, Homo sapiens
  light chain complementarity determining region 3 for antibody 47473
QQYYSTPRT

SEQ ID NO: 94946 - protein, 15 aa, Homo sapiens
  heavy chain complementarity determining region 3 for antibody 47473
AREANWGGGEGWFDP

SEQ ID NO: 94947 - protein, 9 aa, Homo sapiens
  light chain complementarity determining region 3 for antibody 47474
QQYYSTPRT

SEQ ID NO: 94948 - protein, 17 aa, Homo sapiens
  heavy chain complementarity determining region 3 for antibody 47474
ARDPPSTNSWFRGYFDS

SEQ ID NO: 94949 - protein, 9 aa, Homo sapiens
  light chain complementarity determining region 3 for antibody 47475
QQYYSTPQT

SEQ ID NO: 94950 - protein, 18 aa, Homo sapiens
  heavy chain complementarity determining region 3 for antibody 47475
ARGRPPRRTGTGVGGFDS

SEQ ID NO: 94951 - protein, 10 aa, Homo sapiens
  light chain complementarity determining region 3 for antibody 47476
QQYYSTPPWT

SEQ ID NO: 94952 - protein, 25 aa, Homo sapiens
  heavy chain complementarity determining region 3 for antibody 47476
ARILRIPFHSDSSDYLQGTHGGFDT

SEQ ID NO: 94953 - protein, 9 aa, Homo sapiens
  light chain complementarity determining region 3 for antibody 47477
QQYYSTPPT

SEQ ID NO: 94954 - protein, 13 aa, Homo sapiens
  heavy chain complementarity determining region 3 for antibody 47477
ARMYSSGWSPFDS

SEQ ID NO: 94955 - protein, 9 aa, Homo sapiens
  light chain complementarity determining region 3 for antibody 47478
QQYYSTPLT

SEQ ID NO: 94956 - protein, 11 aa, Homo sapiens
  heavy chain complementarity determining region 3 for antibody 47478
VKDLTAGGADY

SEQ ID NO: 94957 - protein, 9 aa, Homo sapiens
  light chain complementarity determining region 3 for antibody 47479
QQYYSTPLT

SEQ ID NO: 94958 - protein, 13 aa, Homo sapiens
  heavy chain complementarity determining region 3 for antibody 47479
AKERDYYDSSLDD

SEQ ID NO: 94959 - protein, 9 aa, Homo sapiens
  light chain complementarity determining region 3 for antibody 47480
QQYYSTPFT

SEQ ID NO: 94960 - protein, 24 aa, Homo sapiens
  heavy chain complementarity determining region 3 for antibody 47480
ARSQVGGYMLRVIKGYYYQYGMDV

SEQ ID NO: 94961 - protein, 9 aa, Homo sapiens
  light chain complementarity determining region 3 for antibody 47481
QQYYSSQWT

SEQ ID NO: 94962 - protein, 19 aa, Homo sapiens
  heavy chain complementarity determining region 3 for antibody 47481
ARGLYSGSRDHYYYYGLDV

SEQ ID NO: 94963 - protein, 9 aa, Homo sapiens
  light chain complementarity determining region 3 for antibody 47482
QQYYSSPYT

SEQ ID NO: 94964 - protein, 23 aa, Homo sapiens
  heavy chain complementarity determining region 3 for antibody 47482
ARGVTDCSGHNCYGGEVINAFDV

SEQ ID NO: 94965 - protein, 9 aa, Homo sapiens
  light chain complementarity determining region 3 for antibody 47483
QQYYSSPVT

SEQ ID NO: 94966 - protein, 16 aa, Homo sapiens
  heavy chain complementarity determining region 3 for antibody 47483
ARLTESSGYHDEGSDI

SEQ ID NO: 94967 - protein, 9 aa, Homo sapiens
  light chain complementarity determining region 3 for antibody 47484
QQYYSSPST

SEQ ID NO: 94968 - protein, 23 aa, Homo sapiens
  heavy chain complementarity determining region 3 for antibody 47484
ARGVTDCSGRNCYGGEVINAFDV

SEQ ID NO: 94969 - protein, 9 aa, Homo sapiens
  light chain complementarity determining region 3 for antibody 47485
QQYYSSPRT

SEQ ID NO: 94970 - protein, 15 aa, Homo sapiens
  heavy chain complementarity determining region 3 for antibody 47485
ARDVLGGSGNLYFDF

SEQ ID NO: 94971 - protein, 9 aa, Homo sapiens
  light chain complementarity determining region 3 for antibody 47486
QQYYSSPHT

SEQ ID NO: 94972 - protein, 23 aa, Homo sapiens
  heavy chain complementarity determining region 3 for antibody 47486
ARGVTDCSGRNCYGGEVINAFDV

SEQ ID NO: 94973 - protein, 9 aa, Homo sapiens
  light chain complementarity determining region 3 for antibody 47487
QQYYSSPGA

SEQ ID NO: 94974 - protein, 15 aa, Homo sapiens
  heavy chain complementarity determining region 3 for antibody 47487
AKGVYGGSLRSSFDF

SEQ ID NO: 94975 - protein, 9 aa, Homo sapiens
  light chain complementarity determining region 3 for antibody 47488
QQYYSSPFT

SEQ ID NO: 94976 - protein, 13 aa, Homo sapiens
  heavy chain complementarity determining region 3 for antibody 47488
ARGRTYDRDGLDP

SEQ ID NO: 94977 - protein, 9 aa, Homo sapiens
  light chain complementarity determining region 3 for antibody 47489
QQYYSSHRT

SEQ ID NO: 94978 - protein, 11 aa, Homo sapiens
  heavy chain complementarity determining region 3 for antibody 47489
ARDSRYRGYDL

SEQ ID NO: 94979 - protein, 9 aa, Homo sapiens
  light chain complementarity determining region 3 for antibody 47490
QQYYSRQWT

SEQ ID NO: 94980 - protein, 12 aa, Homo sapiens
  heavy chain complementarity determining region 3 for antibody 47490
TPARGSGLGMDV

SEQ ID NO: 94981 - protein, 9 aa, Homo sapiens
  light chain complementarity determining region 3 for antibody 47491
QQYYSPPYT

SEQ ID NO: 94982 - protein, 11 aa, Homo sapiens
  heavy chain complementarity determining region 3 for antibody 47491
ARVPSGDPFDY

SEQ ID NO: 94983 - protein, 9 aa, Homo sapiens
  light chain complementarity determining region 3 for antibody 47492
QQYYSPPYT

SEQ ID NO: 94984 - protein, 13 aa, Homo sapiens
  heavy chain complementarity determining region 3 for antibody 47492
ARGIVGAEYYFDY

SEQ ID NO: 94985 - protein, 9 aa, Homo sapiens
  light chain complementarity determining region 3 for antibody 47493
QQYYSPPLT

SEQ ID NO: 94986 - protein, 9 aa, Homo sapiens
  heavy chain complementarity determining region 3 for antibody 47493
AGDGDVLDY

SEQ ID NO: 94987 - protein, 10 aa, Homo sapiens
  light chain complementarity determining region 3 for antibody 47494
QQYYSNPPGT

SEQ ID NO: 94988 - protein, 10 aa, Homo sapiens
  heavy chain complementarity determining region 3 for antibody 47494
ARERQRALDY

SEQ ID NO: 94989 - protein, 9 aa, Homo sapiens
  light chain complementarity determining region 3 for antibody 47495
QQYYSNPLT

SEQ ID NO: 94990 - protein, 15 aa, Homo sapiens
  heavy chain complementarity determining region 3 for antibody 47495
ARAPGGDYIDWYFDL

SEQ ID NO: 94991 - protein, 9 aa, Homo sapiens
  light chain complementarity determining region 3 for antibody 47496
QQYYSIPPT

SEQ ID NO: 94992 - protein, 20 aa, Homo sapiens
  heavy chain complementarity determining region 3 for antibody 47496
ARDATITSGGTYNYLGWFDP

SEQ ID NO: 94993 - protein, 8 aa, Homo sapiens
  light chain complementarity determining region 3 for antibody 47497
QQYYSCCP

SEQ ID NO: 94994 - protein, 14 aa, Homo sapiens
  heavy chain complementarity determining region 3 for antibody 47497
ARYTPIHGGYYFDY

SEQ ID NO: 94995 - protein, 9 aa, Homo sapiens
  light chain complementarity determining region 3 for antibody 47498
QQYYSAPFT

SEQ ID NO: 94996 - protein, 14 aa, Homo sapiens
  heavy chain complementarity determining region 3 for antibody 47498
AHSQGLGAAHYFDY

SEQ ID NO: 94997 - protein, 9 aa, Homo sapiens
  light chain complementarity determining region 3 for antibody 47499
QQYYRTPRT

SEQ ID NO: 94998 - protein, 21 aa, Homo sapiens
  heavy chain complementarity determining region 3 for antibody 47499
TAPSGANDYGDDYGDYVLPDH

SEQ ID NO: 94999 - protein, 9 aa, Homo sapiens
  light chain complementarity determining region 3 for antibody 47500
QQYYRSPYT

SEQ ID NO: 95000 - protein, 15 aa, Homo sapiens
  heavy chain complementarity determining region 3 for antibody 47500
ARDLRSLASNDAFNI

SEQ ID NO: 95001 - protein, 9 aa, Homo sapiens
  light chain complementarity determining region 3 for antibody 47501
QQYYRSPYT

SEQ ID NO: 95002 - protein, 9 aa, Homo sapiens
  heavy chain complementarity determining region 3 for antibody 47501
ARDDETWGN

SEQ ID NO: 95003 - protein, 9 aa, Homo sapiens
  light chain complementarity determining region 3 for antibody 47502
QQYYRSPIT

SEQ ID NO: 95004 - protein, 11 aa, Homo sapiens
  heavy chain complementarity determining region 3 for antibody 47502
ARGGSYSPLFL

SEQ ID NO: 95005 - protein, 9 aa, Homo sapiens
  light chain complementarity determining region 3 for antibody 47503
QQYYRRPLT

SEQ ID NO: 95006 - protein, 14 aa, Homo sapiens
  heavy chain complementarity determining region 3 for antibody 47503
TRRPLEHGWGIGDY

SEQ ID NO: 95007 - protein, 8 aa, Homo sapiens
  light chain complementarity determining region 3 for antibody 47504
QQYYRLFT

SEQ ID NO: 95008 - protein, 14 aa, Homo sapiens
  heavy chain complementarity determining region 3 for antibody 47504
ATSLGWCDGGSCVD

SEQ ID NO: 95009 - protein, 9 aa, Homo sapiens
  light chain complementarity determining region 3 for antibody 47505
QQYYRGPLT

SEQ ID NO: 95010 - protein, 14 aa, Homo sapiens
  heavy chain complementarity determining region 3 for antibody 47505
TRRPLEHGWGIGDY

SEQ ID NO: 95011 - protein, 9 aa, Homo sapiens
  light chain complementarity determining region 3 for antibody 47506
QQYYNYAYT

SEQ ID NO: 95012 - protein, 10 aa, Homo sapiens
  heavy chain complementarity determining region 3 for antibody 47506
ARDGGFGAVD

SEQ ID NO: 95013 - protein, 9 aa, Homo sapiens
  light chain complementarity determining region 3 for antibody 47507
QQYYNTPYT

SEQ ID NO: 95014 - protein, 14 aa, Homo sapiens
  heavy chain complementarity determining region 3 for antibody 47507
ARGGRLATADKFDF

SEQ ID NO: 95015 - protein, 9 aa, Homo sapiens
  light chain complementarity determining region 3 for antibody 47508
QQYYNTPRT

SEQ ID NO: 95016 - protein, 18 aa, Homo sapiens
  heavy chain complementarity determining region 3 for antibody 47508
ARESGTPDSSGFDWYFDL

SEQ ID NO: 95017 - protein, 9 aa, Homo sapiens
  light chain complementarity determining region 3 for antibody 47509
QQYYNTPRK

SEQ ID NO: 95018 - protein, 11 aa, Homo sapiens
  heavy chain complementarity determining region 3 for antibody 47509
ARKGFHAPLDV

SEQ ID NO: 95019 - protein, 9 aa, Homo sapiens
  light chain complementarity determining region 3 for antibody 47510
QQYYNNPRT

SEQ ID NO: 95020 - protein, 11 aa, Homo sapiens
  heavy chain complementarity determining region 3 for antibody 47510
ARKGFHAPLDV

SEQ ID NO: 95021 - protein, 9 aa, Homo sapiens
  light chain complementarity determining region 3 for antibody 47511
QQYYNNPPT

SEQ ID NO: 95022 - protein, 14 aa, Homo sapiens
  heavy chain complementarity determining region 3 for antibody 47511
ARQEYSNIWHAVDH

SEQ ID NO: 95023 - protein, 9 aa, Homo sapiens
  light chain complementarity determining region 3 for antibody 47512
QQYYNLPYT

SEQ ID NO: 95024 - protein, 11 aa, Homo sapiens
  heavy chain complementarity determining region 3 for antibody 47512
ARGLSAGLFDY

SEQ ID NO: 95025 - protein, 9 aa, Homo sapiens
  light chain complementarity determining region 3 for antibody 47513
QQYYITPMP

SEQ ID NO: 95026 - protein, 12 aa, Homo sapiens
  heavy chain complementarity determining region 3 for antibody 47513
ARVTYILGPIDH

SEQ ID NO: 95027 - protein, 9 aa, Homo sapiens
  light chain complementarity determining region 3 for antibody 47514
QQYYITPMN

SEQ ID NO: 95028 - protein, 12 aa, Homo sapiens
  heavy chain complementarity determining region 3 for antibody 47514
ARVTYILGPIDH

SEQ ID NO: 95029 - protein, 10 aa, Homo sapiens
  light chain complementarity determining region 3 for antibody 47515
QQYYISPQYN

SEQ ID NO: 95030 - protein, 17 aa, Homo sapiens
  heavy chain complementarity determining region 3 for antibody 47515
VREFINSRGDYTGALDL

SEQ ID NO: 95031 - protein, 10 aa, Homo sapiens
  light chain complementarity determining region 3 for antibody 47516
QQYYIRPQYT

SEQ ID NO: 95032 - protein, 17 aa, Homo sapiens
  heavy chain complementarity determining region 3 for antibody 47516
VREFINSRGDYTGALDL

SEQ ID NO: 95033 - protein, 9 aa, Homo sapiens
  light chain complementarity determining region 3 for antibody 47517
QQYYILPYS

SEQ ID NO: 95034 - protein, 14 aa, Homo sapiens
  heavy chain complementarity determining region 3 for antibody 47517
ARGGDRDGNPYLDY

SEQ ID NO: 95035 - protein, 9 aa, Homo sapiens
  light chain complementarity determining region 3 for antibody 47518
QQYYGYPYT

SEQ ID NO: 95036 - protein, 15 aa, Homo sapiens
  heavy chain complementarity determining region 3 for antibody 47518
ARDFGGSGWYNYFDP

SEQ ID NO: 95037 - protein, 9 aa, Homo sapiens
  light chain complementarity determining region 3 for antibody 47519
QQYYGYPWT

SEQ ID NO: 95038 - protein, 12 aa, Homo sapiens
  heavy chain complementarity determining region 3 for antibody 47519
ARDRLSHYGLDV

SEQ ID NO: 95039 - protein, 9 aa, Homo sapiens
  light chain complementarity determining region 3 for antibody 47520
QQYYGTPRT

SEQ ID NO: 95040 - protein, 16 aa, Homo sapiens
  heavy chain complementarity determining region 3 for antibody 47520
ARVANVASAGKAYFPH

SEQ ID NO: 95041 - protein, 9 aa, Homo sapiens
  light chain complementarity determining region 3 for antibody 47521
QQYYGTART

SEQ ID NO: 95042 - protein, 11 aa, Homo sapiens
  heavy chain complementarity determining region 3 for antibody 47521
AKSGDGNWFES

SEQ ID NO: 95043 - protein, 10 aa, Homo sapiens
  light chain complementarity determining region 3 for antibody 47522
QQYYGGPPGS

SEQ ID NO: 95044 - protein, 16 aa, Homo sapiens
  heavy chain complementarity determining region 3 for antibody 47522
AKDRSGCSGGNCYSDS

SEQ ID NO: 95045 - protein, 9 aa, Homo sapiens
  light chain complementarity determining region 3 for antibody 47523
QQYYGAPLS

SEQ ID NO: 95046 - protein, 10 aa, Homo sapiens
  heavy chain complementarity determining region 3 for antibody 47523
AKDSYSKADY

SEQ ID NO: 95047 - protein, 10 aa, Homo sapiens
  light chain complementarity determining region 3 for antibody 47524
QQYYDTPTWT

SEQ ID NO: 95048 - protein, 9 aa, Homo sapiens
  heavy chain complementarity determining region 3 for antibody 47524
ARVTGYFDY

SEQ ID NO: 95049 - protein, 10 aa, Homo sapiens
  light chain complementarity determining region 3 for antibody 47525
QQYYDLPPKT

SEQ ID NO: 95050 - protein, 14 aa, Homo sapiens
  heavy chain complementarity determining region 3 for antibody 47525
ARDRIDMLRGYLDN

SEQ ID NO: 95051 - protein, 9 aa, Homo sapiens
  light chain complementarity determining region 3 for antibody 47526
QQYYDIPRT

SEQ ID NO: 95052 - protein, 19 aa, Homo sapiens
  heavy chain complementarity determining region 3 for antibody 47526
ARGRSITLEGVIVIPGFDY

SEQ ID NO: 95053 - protein, 9 aa, Homo sapiens
  light chain complementarity determining region 3 for antibody 47527
QQYYDAPHT

SEQ ID NO: 95054 - protein, 12 aa, Homo sapiens
  heavy chain complementarity determining region 3 for antibody 47527
ARDVPAISRFDH

SEQ ID NO: 95055 - protein, 9 aa, Homo sapiens
  light chain complementarity determining region 3 for antibody 47528
QQYYCTPYT

SEQ ID NO: 95056 - protein, 11 aa, Homo sapiens
  heavy chain complementarity determining region 3 for antibody 47528
ARNTLMAYIDY

SEQ ID NO: 95057 - protein, 9 aa, Homo sapiens
  light chain complementarity determining region 3 for antibody 47529
QQYYATPYT

SEQ ID NO: 95058 - protein, 18 aa, Homo sapiens
  heavy chain complementarity determining region 3 for antibody 47529
ARDREPFFGSGTYRLPEY

SEQ ID NO: 95059 - protein, 9 aa, Homo sapiens
  light chain complementarity determining region 3 for antibody 47530
QQYVSYPWT

SEQ ID NO: 95060 - protein, 11 aa, Homo sapiens
  heavy chain complementarity determining region 3 for antibody 47530
AKDFSNRPHTP

SEQ ID NO: 95061 - protein, 9 aa, Homo sapiens
  light chain complementarity determining region 3 for antibody 47531
QQYVSSPRT

SEQ ID NO: 95062 - protein, 15 aa, Homo sapiens
  heavy chain complementarity determining region 3 for antibody 47531
VREPGITTSDWYFDP

SEQ ID NO: 95063 - protein, 9 aa, Homo sapiens
  light chain complementarity determining region 3 for antibody 47532
QQYVSSPRT

SEQ ID NO: 95064 - protein, 15 aa, Homo sapiens
  heavy chain complementarity determining region 3 for antibody 47532
VRDPGITTADWYFDL

SEQ ID NO: 95065 - protein, 9 aa, Homo sapiens
  light chain complementarity determining region 3 for antibody 47533
QQYVSPPDT

SEQ ID NO: 95066 - protein, 20 aa, Homo sapiens
  heavy chain complementarity determining region 3 for antibody 47533
ARDLDISVLPGVTDDDGFDI

SEQ ID NO: 95067 - protein, 9 aa, Homo sapiens
  light chain complementarity determining region 3 for antibody 47534
QQYVRPPYT

SEQ ID NO: 95068 - protein, 20 aa, Homo sapiens
  heavy chain complementarity determining region 3 for antibody 47534
ARDLDISVLPGVTDDDGFDI

SEQ ID NO: 95069 - protein, 9 aa, Homo sapiens
  light chain complementarity determining region 3 for antibody 47535
QQYVGSPVT

SEQ ID NO: 95070 - protein, 15 aa, Homo sapiens
  heavy chain complementarity determining region 3 for antibody 47535
ARLGESTMVRGVMEV

SEQ ID NO: 95071 - protein, 9 aa, Homo sapiens
  light chain complementarity determining region 3 for antibody 47536
QQYVGSPGT

SEQ ID NO: 95072 - protein, 11 aa, Homo sapiens
  heavy chain complementarity determining region 3 for antibody 47536
ARGDYVGGFYF

SEQ ID NO: 95073 - protein, 9 aa, Homo sapiens
  light chain complementarity determining region 3 for antibody 47537
QQYVATPET

SEQ ID NO: 95074 - protein, 16 aa, Homo sapiens
  heavy chain complementarity determining region 3 for antibody 47537
ARTPVRREYNYGHFDS

SEQ ID NO: 95075 - protein, 9 aa, Homo sapiens
  light chain complementarity determining region 3 for antibody 47538
QQYTTYPLT

SEQ ID NO: 95076 - protein, 13 aa, Homo sapiens
  heavy chain complementarity determining region 3 for antibody 47538
ARGFSHGNDAFDI

SEQ ID NO: 95077 - protein, 10 aa, Homo sapiens
  light chain complementarity determining region 3 for antibody 47539
QQYTTSPPLT

SEQ ID NO: 95078 - protein, 16 aa, Homo sapiens
  heavy chain complementarity determining region 3 for antibody 47539
ARRQWVRGLYKGGLDF

SEQ ID NO: 95079 - protein, 10 aa, Homo sapiens
  light chain complementarity determining region 3 for antibody 47540
QQYTTSPPGT

SEQ ID NO: 95080 - protein, 16 aa, Homo sapiens
  heavy chain complementarity determining region 3 for antibody 47540
ARRQWVRGLYKGGLDF

SEQ ID NO: 95081 - protein, 8 aa, Homo sapiens
  light chain complementarity determining region 3 for antibody 47541
QQYTSDPA

SEQ ID NO: 95082 - protein, 20 aa, Homo sapiens
  heavy chain complementarity determining region 3 for antibody 47541
ARTLEGASWSHDVYYYAMDV

SEQ ID NO: 95083 - protein, 9 aa, Homo sapiens
  light chain complementarity determining region 3 for antibody 47542
QQYTNYPWT

SEQ ID NO: 95084 - protein, 14 aa, Homo sapiens
  heavy chain complementarity determining region 3 for antibody 47542
HPRASGFQLEYTDF

SEQ ID NO: 95085 - protein, 9 aa, Homo sapiens
  light chain complementarity determining region 3 for antibody 47543
QQYTNLPIT

SEQ ID NO: 95086 - protein, 11 aa, Homo sapiens
  heavy chain complementarity determining region 3 for antibody 47543
AIDRALIGFDD

SEQ ID NO: 95087 - protein, 11 aa, Homo sapiens
  light chain complementarity determining region 3 for antibody 47544
QQYTGWPPAGT

SEQ ID NO: 95088 - protein, 9 aa, Homo sapiens
  heavy chain complementarity determining region 3 for antibody 47544
VTDEGHMDV

SEQ ID NO: 95089 - protein, 11 aa, Homo sapiens
  light chain complementarity determining region 3 for antibody 47545
QQYTGWPPAGR

SEQ ID NO: 95090 - protein, 14 aa, Homo sapiens
  heavy chain complementarity determining region 3 for antibody 47545
ARPQPGNFYHGMDV

SEQ ID NO: 95091 - protein, 9 aa, Homo sapiens
  light chain complementarity determining region 3 for antibody 47546
QQYTGAPLT

SEQ ID NO: 95092 - protein, 11 aa, Homo sapiens
  heavy chain complementarity determining region 3 for antibody 47546
ARRGVTPALGI

SEQ ID NO: 95093 - protein, 8 aa, Homo sapiens
  light chain complementarity determining region 3 for antibody 47547
QQYTDLLT

SEQ ID NO: 95094 - protein, 12 aa, Homo sapiens
  heavy chain complementarity determining region 3 for antibody 47547
ARDTAGRVMGQY

SEQ ID NO: 95095 - protein, 8 aa, Homo sapiens
  light chain complementarity determining region 3 for antibody 47548
QQYTDLLT

SEQ ID NO: 95096 - protein, 12 aa, Homo sapiens
  heavy chain complementarity determining region 3 for antibody 47548
ARDTAGGVMGHY

SEQ ID NO: 95097 - protein, 8 aa, Homo sapiens
  light chain complementarity determining region 3 for antibody 47549
QQYTDLLP

SEQ ID NO: 95098 - protein, 12 aa, Homo sapiens
  heavy chain complementarity determining region 3 for antibody 47549
ARDTAGGVMGQY

SEQ ID NO: 95099 - protein, 8 aa, Homo sapiens
  light chain complementarity determining region 3 for antibody 47550
QQYSYYRP

SEQ ID NO: 95100 - protein, 20 aa, Homo sapiens
  heavy chain complementarity determining region 3 for antibody 47550
ARDGHKNYYDSNGYLGYFDA

SEQ ID NO: 95101 - protein, 9 aa, Homo sapiens
  light chain complementarity determining region 3 for antibody 47551
QQYSVYPLS

SEQ ID NO: 95102 - protein, 11 aa, Homo sapiens
  heavy chain complementarity determining region 3 for antibody 47551
ARGGGDGQFDY

SEQ ID NO: 95103 - protein, 9 aa, Homo sapiens
  light chain complementarity determining region 3 for antibody 47552
QQYSVYPLS

SEQ ID NO: 95104 - protein, 11 aa, Homo sapiens
  heavy chain complementarity determining region 3 for antibody 47552
AGGGGDGQFDY

SEQ ID NO: 95105 - protein, 8 aa, Homo sapiens
  light chain complementarity determining region 3 for antibody 47553
QQYSTYST

SEQ ID NO: 95106 - protein, 13 aa, Homo sapiens
  heavy chain complementarity determining region 3 for antibody 47553
ARDATMGFDAFDL

SEQ ID NO: 95107 - protein, 9 aa, Homo sapiens
  light chain complementarity determining region 3 for antibody 47554
QQYSTSFPS

SEQ ID NO: 95108 - protein, 14 aa, Homo sapiens
  heavy chain complementarity determining region 3 for antibody 47554
ARGASGWPPGAFII

SEQ ID NO: 95109 - protein, 9 aa, Homo sapiens
  light chain complementarity determining region 3 for antibody 47555
QQYSSYSRT

SEQ ID NO: 95110 - protein, 23 aa, Homo sapiens
  heavy chain complementarity determining region 3 for antibody 47555
ARGSPRMYYSDSGSYVRPTHFDY

SEQ ID NO: 95111 - protein, 9 aa, Homo sapiens
  light chain complementarity determining region 3 for antibody 47556
QQYSSYPYT

SEQ ID NO: 95112 - protein, 28 aa, Homo sapiens
  heavy chain complementarity determining region 3 for antibody 47556
GRDCRVDDVGFDFWSGEDTPPEKFQVDI

SEQ ID NO: 95113 - protein, 9 aa, Homo sapiens
  light chain complementarity determining region 3 for antibody 47557
QQYSSYPYT

SEQ ID NO: 95114 - protein, 28 aa, Homo sapiens
  heavy chain complementarity determining region 3 for antibody 47557
GRDCRIDGVGFDFWSGEDTPPEKFQVDI

SEQ ID NO: 95115 - protein, 8 aa, Homo sapiens
  light chain complementarity determining region 3 for antibody 47558
QQYSSWRT

SEQ ID NO: 95116 - protein, 14 aa, Homo sapiens
  heavy chain complementarity determining region 3 for antibody 47558
ARLEIVVIPPAKNR

SEQ ID NO: 95117 - protein, 10 aa, Homo sapiens
  light chain complementarity determining region 3 for antibody 47559
QQYSSWPPYT

SEQ ID NO: 95118 - protein, 12 aa, Homo sapiens
  heavy chain complementarity determining region 3 for antibody 47559
ARSTLANGLFDS

SEQ ID NO: 95119 - protein, 10 aa, Homo sapiens
  light chain complementarity determining region 3 for antibody 47560
QQYSSWPGLT

SEQ ID NO: 95120 - protein, 13 aa, Homo sapiens
  heavy chain complementarity determining region 3 for antibody 47560
ARLGPLSYGYLDS

SEQ ID NO: 95121 - protein, 10 aa, Homo sapiens
  light chain complementarity determining region 3 for antibody 47561
QQYSSSSGWT

SEQ ID NO: 95122 - protein, 11 aa, Homo sapiens
  heavy chain complementarity determining region 3 for antibody 47561
VKHLTSGTFDY

SEQ ID NO: 95123 - protein, 9 aa, Homo sapiens
  light chain complementarity determining region 3 for antibody 47562
QQYSSSPIT

SEQ ID NO: 95124 - protein, 9 aa, Homo sapiens
  heavy chain complementarity determining region 3 for antibody 47562
VRWGQPFDY

SEQ ID NO: 95125 - protein, 8 aa, Homo sapiens
  light chain complementarity determining region 3 for antibody 47563
QQYSSSLT

SEQ ID NO: 95126 - protein, 13 aa, Homo sapiens
  heavy chain complementarity determining region 3 for antibody 47563
ARVVAGDFDVFDI

SEQ ID NO: 95127 - protein, 8 aa, Homo sapiens
  light chain complementarity determining region 3 for antibody 47564
QQYSSSFP

SEQ ID NO: 95128 - protein, 13 aa, Homo sapiens
  heavy chain complementarity determining region 3 for antibody 47564
ATESGWYQGAFDI

SEQ ID NO: 95129 - protein, 10 aa, Homo sapiens
  light chain complementarity determining region 3 for antibody 47565
QQYSSPPLYT

SEQ ID NO: 95130 - protein, 10 aa, Homo sapiens
  heavy chain complementarity determining region 3 for antibody 47565
ASSILTGYPS

SEQ ID NO: 95131 - protein, 9 aa, Homo sapiens
  light chain complementarity determining region 3 for antibody 47566
QQYSSNLVT

SEQ ID NO: 95132 - protein, 13 aa, Homo sapiens
  heavy chain complementarity determining region 3 for antibody 47566
ARDRLGATDAFDI

SEQ ID NO: 95133 - protein, 9 aa, Homo sapiens
  light chain complementarity determining region 3 for antibody 47567
QQYSSLPLT

SEQ ID NO: 95134 - protein, 16 aa, Homo sapiens
  heavy chain complementarity determining region 3 for antibody 47567
ARRPCEAVGKPGRFDS

SEQ ID NO: 95135 - protein, 9 aa, Homo sapiens
  light chain complementarity determining region 3 for antibody 47568
QQYSSLPLT

SEQ ID NO: 95136 - protein, 17 aa, Homo sapiens
  heavy chain complementarity determining region 3 for antibody 47568
ARDSYSDGSDFYDVFDM

SEQ ID NO: 95137 - protein, 9 aa, Homo sapiens
  light chain complementarity determining region 3 for antibody 47569
QQYSSHSAT

SEQ ID NO: 95138 - protein, 13 aa, Homo sapiens
  heavy chain complementarity determining region 3 for antibody 47569
AREGYYGSGEFDL

SEQ ID NO: 95139 - protein, 9 aa, Homo sapiens
  light chain complementarity determining region 3 for antibody 47570
QQYSRSPGT

SEQ ID NO: 95140 - protein, 18 aa, Homo sapiens
  heavy chain complementarity determining region 3 for antibody 47570
ARVVERCSGGKCHYVFDH

SEQ ID NO: 95141 - protein, 9 aa, Homo sapiens
  light chain complementarity determining region 3 for antibody 47571
QQYSRSLWT

SEQ ID NO: 95142 - protein, 19 aa, Homo sapiens
  heavy chain complementarity determining region 3 for antibody 47571
ARDDFHSDSSGGYFRFFDP

SEQ ID NO: 95143 - protein, 10 aa, Homo sapiens
  light chain complementarity determining region 3 for antibody 47572
QQYSPPPMYT

SEQ ID NO: 95144 - protein, 10 aa, Homo sapiens
  heavy chain complementarity determining region 3 for antibody 47572
ASSILTGYPS

SEQ ID NO: 95145 - protein, 9 aa, Homo sapiens
  light chain complementarity determining region 3 for antibody 47573
QQYSNSPWP

SEQ ID NO: 95146 - protein, 17 aa, Homo sapiens
  heavy chain complementarity determining region 3 for antibody 47573
ARDGMPSKRWPDNFFDA

SEQ ID NO: 95147 - protein, 9 aa, Homo sapiens
  light chain complementarity determining region 3 for antibody 47574
QQYSNSPLT

SEQ ID NO: 95148 - protein, 15 aa, Homo sapiens
  heavy chain complementarity determining region 3 for antibody 47574
AGDLAGSRQGGWFDP

SEQ ID NO: 95149 - protein, 11 aa, Homo sapiens
  light chain complementarity determining region 3 for antibody 47575
QQYSKWPPMYP

SEQ ID NO: 95150 - protein, 12 aa, Homo sapiens
  heavy chain complementarity determining region 3 for antibody 47575
VKDGDTDYYLDL

SEQ ID NO: 95151 - protein, 8 aa, Homo sapiens
  light chain complementarity determining region 3 for antibody 47576
QQYSGWGT

SEQ ID NO: 95152 - protein, 11 aa, Homo sapiens
  heavy chain complementarity determining region 3 for antibody 47576
TRERFQWLATY

SEQ ID NO: 95153 - protein, 9 aa, Homo sapiens
  light chain complementarity determining region 3 for antibody 47577
QQYSGPLFT

SEQ ID NO: 95154 - protein, 10 aa, Homo sapiens
  heavy chain complementarity determining region 3 for antibody 47577
AAPDGGSYNH

SEQ ID NO: 95155 - protein, 8 aa, Homo sapiens
  light chain complementarity determining region 3 for antibody 47578
QQYSGFWS

SEQ ID NO: 95156 - protein, 21 aa, Homo sapiens
  heavy chain complementarity determining region 3 for antibody 47578
ARQHTYFGNSGFKFPEGYFDL

SEQ ID NO: 95157 - protein, 8 aa, Homo sapiens
  light chain complementarity determining region 3 for antibody 47579
QQYSDYWT

SEQ ID NO: 95158 - protein, 17 aa, Homo sapiens
  heavy chain complementarity determining region 3 for antibody 47579
ASGAYDSGNKKTPGFDH

SEQ ID NO: 95159 - protein, 9 aa, Homo sapiens
  light chain complementarity determining region 3 for antibody 47580
QQYSDYPLT

SEQ ID NO: 95160 - protein, 13 aa, Homo sapiens
  heavy chain complementarity determining region 3 for antibody 47580
TRDISVRLDAGDY

SEQ ID NO: 95161 - protein, 9 aa, Homo sapiens
  light chain complementarity determining region 3 for antibody 47581
QQYSDYPLP

SEQ ID NO: 95162 - protein, 13 aa, Homo sapiens
  heavy chain complementarity determining region 3 for antibody 47581
TRDISVRLDTGDY

SEQ ID NO: 95163 - protein, 9 aa, Homo sapiens
  light chain complementarity determining region 3 for antibody 47582
QQYSDYPIT

SEQ ID NO: 95164 - protein, 13 aa, Homo sapiens
  heavy chain complementarity determining region 3 for antibody 47582
ANFDSSMFPIFED

SEQ ID NO: 95165 - protein, 10 aa, Homo sapiens
  light chain complementarity determining region 3 for antibody 47583
QQYSDPPLYS

SEQ ID NO: 95166 - protein, 10 aa, Homo sapiens
  heavy chain complementarity determining region 3 for antibody 47583
ARAGYYCLND

SEQ ID NO: 95167 - protein, 11 aa, Homo sapiens
  light chain complementarity determining region 3 for antibody 47584
QQYSASSSPFT

SEQ ID NO: 95168 - protein, 15 aa, Homo sapiens
  heavy chain complementarity determining region 3 for antibody 47584
ARWGNDNGDYGRLDS

SEQ ID NO: 95169 - protein, 11 aa, Homo sapiens
  light chain complementarity determining region 3 for antibody 47585
QQYSASSSPFT

SEQ ID NO: 95170 - protein, 15 aa, Homo sapiens
  heavy chain complementarity determining region 3 for antibody 47585
ARAQVIWGQLYYFDS

SEQ ID NO: 95171 - protein, 8 aa, Homo sapiens
  light chain complementarity determining region 3 for antibody 47586
QQYRSSLP

SEQ ID NO: 95172 - protein, 13 aa, Homo sapiens
  heavy chain complementarity determining region 3 for antibody 47586
ATESGWYQGAFDI

SEQ ID NO: 95173 - protein, 8 aa, Homo sapiens
  light chain complementarity determining region 3 for antibody 47587
QQYRSSFP

SEQ ID NO: 95174 - protein, 13 aa, Homo sapiens
  heavy chain complementarity determining region 3 for antibody 47587
ATKSGWYQGAFDI

SEQ ID NO: 95175 - protein, 8 aa, Homo sapiens
  light chain complementarity determining region 3 for antibody 47588
QQYRSSFP

SEQ ID NO: 95176 - protein, 13 aa, Homo sapiens
  heavy chain complementarity determining region 3 for antibody 47588
ATESGWSQGAFDI

SEQ ID NO: 95177 - protein, 8 aa, Homo sapiens
  light chain complementarity determining region 3 for antibody 47589
QQYRSSFP

SEQ ID NO: 95178 - protein, 13 aa, Homo sapiens
  heavy chain complementarity determining region 3 for antibody 47589
ATESGWHQGAFDI

SEQ ID NO: 95179 - protein, 8 aa, Homo sapiens
  light chain complementarity determining region 3 for antibody 47590
QQYRSPFP

SEQ ID NO: 95180 - protein, 15 aa, Homo sapiens
  heavy chain complementarity determining region 3 for antibody 47590
AKVSHRLSSDISFES

SEQ ID NO: 95181 - protein, 9 aa, Homo sapiens
  light chain complementarity determining region 3 for antibody 47591
QQYRSLPYT

SEQ ID NO: 95182 - protein, 24 aa, Homo sapiens
  heavy chain complementarity determining region 3 for antibody 47591
TPDLVVVTATTHNPLHEGPADSDY

SEQ ID NO: 95183 - protein, 10 aa, Homo sapiens
  light chain complementarity determining region 3 for antibody 47592
QQYRRYSPYT

SEQ ID NO: 95184 - protein, 11 aa, Homo sapiens
  heavy chain complementarity determining region 3 for antibody 47592
AKGEMATIFDY

SEQ ID NO: 95185 - protein, 9 aa, Homo sapiens
  light chain complementarity determining region 3 for antibody 47593
QQYRNTPLP

SEQ ID NO: 95186 - protein, 18 aa, Homo sapiens
  heavy chain complementarity determining region 3 for antibody 47593
AKDFAGYGSSYSYYGLDV

SEQ ID NO: 95187 - protein, 8 aa, Homo sapiens
  light chain complementarity determining region 3 for antibody 47594
QQYRGFWT

SEQ ID NO: 95188 - protein, 21 aa, Homo sapiens
  heavy chain complementarity determining region 3 for antibody 47594
ARQHTYFGNSGFKFPEGYFDL

SEQ ID NO: 95189 - protein, 9 aa, Homo sapiens
  light chain complementarity determining region 3 for antibody 47595
QQYREYPYP

SEQ ID NO: 95190 - protein, 14 aa, Homo sapiens
  heavy chain complementarity determining region 3 for antibody 47595
ARHASSWARTPFDS

SEQ ID NO: 95191 - protein, 8 aa, Homo sapiens
  light chain complementarity determining region 3 for antibody 47596
QQYRDSFT

SEQ ID NO: 95192 - protein, 13 aa, Homo sapiens
  heavy chain complementarity determining region 3 for antibody 47596
ATESGSYQGAFDI

SEQ ID NO: 95193 - protein, 9 aa, Homo sapiens
  light chain complementarity determining region 3 for antibody 47597
QQYRDPPYT

SEQ ID NO: 95194 - protein, 15 aa, Homo sapiens
  heavy chain complementarity determining region 3 for antibody 47597
ARPSPAALGFDVFDI

SEQ ID NO: 95195 - protein, 8 aa, Homo sapiens
  light chain complementarity determining region 3 for antibody 47598
QQYRDPFP

SEQ ID NO: 95196 - protein, 13 aa, Homo sapiens
  heavy chain complementarity determining region 3 for antibody 47598
ATESGSYQGAFDI

SEQ ID NO: 95197 - protein, 8 aa, Homo sapiens
  light chain complementarity determining region 3 for antibody 47599
QQYRASFP

SEQ ID NO: 95198 - protein, 13 aa, Homo sapiens
  heavy chain complementarity determining region 3 for antibody 47599
ATESGRYQGAFDI

SEQ ID NO: 95199 - protein, 8 aa, Homo sapiens
  light chain complementarity determining region 3 for antibody 47600
QQYQTYWS

SEQ ID NO: 95200 - protein, 9 aa, Homo sapiens
  heavy chain complementarity determining region 3 for antibody 47600
VCLGMTPPV

SEQ ID NO: 95201 - protein, 9 aa, Homo sapiens
  light chain complementarity determining region 3 for antibody 47601
QQYQSYPFT

SEQ ID NO: 95202 - protein, 17 aa, Homo sapiens
  heavy chain complementarity determining region 3 for antibody 47601
ARESRDSEETTPWPLDY

SEQ ID NO: 95203 - protein, 9 aa, Homo sapiens
  light chain complementarity determining region 3 for antibody 47602
QQYNYLPIT

SEQ ID NO: 95204 - protein, 15 aa, Homo sapiens
  heavy chain complementarity determining region 3 for antibody 47602
ARPPHAFTGENYFSF

SEQ ID NO: 95205 - protein, 9 aa, Homo sapiens
  light chain complementarity determining region 3 for antibody 47603
QQYNVYPYT

SEQ ID NO: 95206 - protein, 19 aa, Homo sapiens
  heavy chain complementarity determining region 3 for antibody 47603
ARGPCGGDCYAYHYQAMDV

SEQ ID NO: 95207 - protein, 9 aa, Homo sapiens
  light chain complementarity determining region 3 for antibody 47604
QQYNVWPPT

SEQ ID NO: 95208 - protein, 14 aa, Homo sapiens
  heavy chain complementarity determining region 3 for antibody 47604
ARARSPGLLVYFDY

SEQ ID NO: 95209 - protein, 9 aa, Homo sapiens
  light chain complementarity determining region 3 for antibody 47605
QQYNVHGVT

SEQ ID NO: 95210 - protein, 9 aa, Homo sapiens
  heavy chain complementarity determining region 3 for antibody 47605
ARGPIHFDY

SEQ ID NO: 95211 - protein, 9 aa, Homo sapiens
  light chain complementarity determining region 3 for antibody 47606
QQYNTYSYT

SEQ ID NO: 95212 - protein, 17 aa, Homo sapiens
  heavy chain complementarity determining region 3 for antibody 47606
ATDPPQILSRVPYYFDN

SEQ ID NO: 95213 - protein, 11 aa, Homo sapiens
  light chain complementarity determining region 3 for antibody 47607
QQYNTYSLGLT

SEQ ID NO: 95214 - protein, 21 aa, Homo sapiens
  heavy chain complementarity determining region 3 for antibody 47607
ARDAPVSRPYSSGWYSSAFDY

SEQ ID NO: 95215 - protein, 9 aa, Homo sapiens
  light chain complementarity determining region 3 for antibody 47608
QQYNTYSCT

SEQ ID NO: 95216 - protein, 11 aa, Homo sapiens
  heavy chain complementarity determining region 3 for antibody 47608
ARSLDWDPFDI

SEQ ID NO: 95217 - protein, 9 aa, Homo sapiens
  light chain complementarity determining region 3 for antibody 47609
QQYNTYPWS

SEQ ID NO: 95218 - protein, 17 aa, Homo sapiens
  heavy chain complementarity determining region 3 for antibody 47609
ARTIYDTSWSSLGYFDY

SEQ ID NO: 95219 - protein, 9 aa, Homo sapiens
  light chain complementarity determining region 3 for antibody 47610
QQYNTYPPT

SEQ ID NO: 95220 - protein, 12 aa, Homo sapiens
  heavy chain complementarity determining region 3 for antibody 47610
ACGFTMSRWGGY

SEQ ID NO: 95221 - protein, 9 aa, Homo sapiens
  light chain complementarity determining region 3 for antibody 47611
QQYNTYPLT

SEQ ID NO: 95222 - protein, 10 aa, Homo sapiens
  heavy chain complementarity determining region 3 for antibody 47611
ASEVAGPFDP

SEQ ID NO: 95223 - protein, 9 aa, Homo sapiens
  light chain complementarity determining region 3 for antibody 47612
QQYNTYPLP

SEQ ID NO: 95224 - protein, 11 aa, Homo sapiens
  heavy chain complementarity determining region 3 for antibody 47612
ARVNGGGGFSD

SEQ ID NO: 95225 - protein, 9 aa, Homo sapiens
  light chain complementarity determining region 3 for antibody 47613
QQYNTYPIT

SEQ ID NO: 95226 - protein, 15 aa, Homo sapiens
  heavy chain complementarity determining region 3 for antibody 47613
RTTLLVVITEDYFDY

SEQ ID NO: 95227 - protein, 8 aa, Homo sapiens
  light chain complementarity determining region 3 for antibody 47614
QQYNTYAT

SEQ ID NO: 95228 - protein, 16 aa, Homo sapiens
  heavy chain complementarity determining region 3 for antibody 47614
ARASGPGHGTGIILGT

SEQ ID NO: 95229 - protein, 10 aa, Homo sapiens
  light chain complementarity determining region 3 for antibody 47615
QQYNTWPPWP

SEQ ID NO: 95230 - protein, 13 aa, Homo sapiens
  heavy chain complementarity determining region 3 for antibody 47615
AKDLATVITAFDV

SEQ ID NO: 95231 - protein, 10 aa, Homo sapiens
  light chain complementarity determining region 3 for antibody 47616
QQYNTWPPGT

SEQ ID NO: 95232 - protein, 13 aa, Homo sapiens
  heavy chain complementarity determining region 3 for antibody 47616
AKDLATVITAFDV

SEQ ID NO: 95233 - protein, 8 aa, Homo sapiens
  light chain complementarity determining region 3 for antibody 47617
QQYNSYYT

SEQ ID NO: 95234 - protein, 11 aa, Homo sapiens
  heavy chain complementarity determining region 3 for antibody 47617
AIDRALIGFDD

SEQ ID NO: 95235 - protein, 8 aa, Homo sapiens
  light chain complementarity determining region 3 for antibody 47618
QQYNSYYN

SEQ ID NO: 95236 - protein, 7 aa, Homo sapiens
  heavy chain complementarity determining region 3 for antibody 47618
ATVDFFF

SEQ ID NO: 95237 - protein, 8 aa, Homo sapiens
  light chain complementarity determining region 3 for antibody 47619
QQYNSYWT

SEQ ID NO: 95238 - protein, 13 aa, Homo sapiens
  heavy chain complementarity determining region 3 for antibody 47619
ARDPTTVTGKCDY

SEQ ID NO: 95239 - protein, 9 aa, Homo sapiens
  light chain complementarity determining region 3 for antibody 47620
QQYNSYTRT

SEQ ID NO: 95240 - protein, 17 aa, Homo sapiens
  heavy chain complementarity determining region 3 for antibody 47620
AKDVHSRQGYYYYGMDV

SEQ ID NO: 95241 - protein, 9 aa, Homo sapiens
  light chain complementarity determining region 3 for antibody 47621
QQYNSYSYT

SEQ ID NO: 95242 - protein, 16 aa, Homo sapiens
  heavy chain complementarity determining region 3 for antibody 47621
TTVHYNYYDSPEASDI

SEQ ID NO: 95243 - protein, 9 aa, Homo sapiens
  light chain complementarity determining region 3 for antibody 47622
QQYNSYSYP

SEQ ID NO: 95244 - protein, 11 aa, Homo sapiens
  heavy chain complementarity determining region 3 for antibody 47622
AREVGGRGFDY

SEQ ID NO: 95245 - protein, 9 aa, Homo sapiens
  light chain complementarity determining region 3 for antibody 47623
QQYNSYSYI

SEQ ID NO: 95246 - protein, 11 aa, Homo sapiens
  heavy chain complementarity determining region 3 for antibody 47623
ARESGEDGFDV

SEQ ID NO: 95247 - protein, 9 aa, Homo sapiens
  light chain complementarity determining region 3 for antibody 47624
QQYNSYSWT

SEQ ID NO: 95248 - protein, 15 aa, Homo sapiens
  heavy chain complementarity determining region 3 for antibody 47624
ASLLRGYSHGFYFVY

SEQ ID NO: 95249 - protein, 8 aa, Homo sapiens
  light chain complementarity determining region 3 for antibody 47625
QQYNSYST

SEQ ID NO: 95250 - protein, 16 aa, Homo sapiens
  heavy chain complementarity determining region 3 for antibody 47625
AVSLRGGSGWYGPIHH

SEQ ID NO: 95251 - protein, 9 aa, Homo sapiens
  light chain complementarity determining region 3 for antibody 47626
QQYNSYSST

SEQ ID NO: 95252 - protein, 21 aa, Homo sapiens
  heavy chain complementarity determining region 3 for antibody 47626
ARDAPPLEVYSSGYVFRGMDV

SEQ ID NO: 95253 - protein, 9 aa, Homo sapiens
  light chain complementarity determining region 3 for antibody 47627
QQYNSYSRT

SEQ ID NO: 95254 - protein, 6 aa, Homo sapiens
  heavy chain complementarity determining region 3 for antibody 47627
TSPGDS

SEQ ID NO: 95255 - protein, 9 aa, Homo sapiens
  light chain complementarity determining region 3 for antibody 47628
QQYNSYSRT

SEQ ID NO: 95256 - protein, 11 aa, Homo sapiens
  heavy chain complementarity determining region 3 for antibody 47628
ARSPDIGTTDY

SEQ ID NO: 95257 - protein, 9 aa, Homo sapiens
  light chain complementarity determining region 3 for antibody 47629
QQYNSYSRS

SEQ ID NO: 95258 - protein, 16 aa, Homo sapiens
  heavy chain complementarity determining region 3 for antibody 47629
VNSDRRQLVLGVLIDY

SEQ ID NO: 95259 - protein, 9 aa, Homo sapiens
  light chain complementarity determining region 3 for antibody 47630
QQYNSYSRP

SEQ ID NO: 95260 - protein, 17 aa, Homo sapiens
  heavy chain complementarity determining region 3 for antibody 47630
AKDVHSRQGYYYYGMDV

SEQ ID NO: 95261 - protein, 10 aa, Homo sapiens
  light chain complementarity determining region 3 for antibody 47631
QQYNSYSPYT

SEQ ID NO: 95262 - protein, 16 aa, Homo sapiens
  heavy chain complementarity determining region 3 for antibody 47631
VRGVEALGSAYTWFDP

SEQ ID NO: 95263 - protein, 10 aa, Homo sapiens
  light chain complementarity determining region 3 for antibody 47632
QQYNSYSPYT

SEQ ID NO: 95264 - protein, 15 aa, Homo sapiens
  heavy chain complementarity determining region 3 for antibody 47632
AGHSGYNYYSDPFDI

SEQ ID NO: 95265 - protein, 9 aa, Homo sapiens
  light chain complementarity determining region 3 for antibody 47633
QQYNSYSLT

SEQ ID NO: 95266 - protein, 17 aa, Homo sapiens
  heavy chain complementarity determining region 3 for antibody 47633
AKDIFFGIAVAGTAFDI

SEQ ID NO: 95267 - protein, 10 aa, Homo sapiens
  light chain complementarity determining region 3 for antibody 47634
QQYNSYSLLT

SEQ ID NO: 95268 - protein, 13 aa, Homo sapiens
  heavy chain complementarity determining region 3 for antibody 47634
ARGGSVDPLLCHS

SEQ ID NO: 95269 - protein, 10 aa, Homo sapiens
  light chain complementarity determining region 3 for antibody 47635
QQYNSYSLLT

SEQ ID NO: 95270 - protein, 13 aa, Homo sapiens
  heavy chain complementarity determining region 3 for antibody 47635
ARGGSVDHLLCHS

SEQ ID NO: 95271 - protein, 9 aa, Homo sapiens
  light chain complementarity determining region 3 for antibody 47636
QQYNSYSDP

SEQ ID NO: 95272 - protein, 13 aa, Homo sapiens
  heavy chain complementarity determining region 3 for antibody 47636
ARKGDQKSSAYDI

SEQ ID NO: 95273 - protein, 10 aa, Homo sapiens
  light chain complementarity determining region 3 for antibody 47637
QQYNSYSAWT

SEQ ID NO: 95274 - protein, 13 aa, Homo sapiens
  heavy chain complementarity determining region 3 for antibody 47637
ARDATYGGHSFGY

SEQ ID NO: 95275 - protein, 8 aa, Homo sapiens
  light chain complementarity determining region 3 for antibody 47638
QQYNSYRT

SEQ ID NO: 95276 - protein, 15 aa, Homo sapiens
  heavy chain complementarity determining region 3 for antibody 47638
ATGGIAVGGSYAMDV

SEQ ID NO: 95277 - protein, 8 aa, Homo sapiens
  light chain complementarity determining region 3 for antibody 47639
QQYNSYRT

SEQ ID NO: 95278 - protein, 21 aa, Homo sapiens
  heavy chain complementarity determining region 3 for antibody 47639
ATASNNAMFGVVPYFYYGMDV

SEQ ID NO: 95279 - protein, 8 aa, Homo sapiens
  light chain complementarity determining region 3 for antibody 47640
QQYNSYRT

SEQ ID NO: 95280 - protein, 20 aa, Homo sapiens
  heavy chain complementarity determining region 3 for antibody 47640
ARDPPTYDHDSSGSGDVIDI

SEQ ID NO: 95281 - protein, 9 aa, Homo sapiens
  light chain complementarity determining region 3 for antibody 47641
QQYNSYPYT

SEQ ID NO: 95282 - protein, 11 aa, Homo sapiens
  heavy chain complementarity determining region 3 for antibody 47641
VHSRDSSGWDY

SEQ ID NO: 95283 - protein, 9 aa, Homo sapiens
  light chain complementarity determining region 3 for antibody 47642
QQYNSYPYT

SEQ ID NO: 95284 - protein, 11 aa, Homo sapiens
  heavy chain complementarity determining region 3 for antibody 47642
TRYGSGKSLDY

SEQ ID NO: 95285 - protein, 9 aa, Homo sapiens
  light chain complementarity determining region 3 for antibody 47643
QQYNSYPYT

SEQ ID NO: 95286 - protein, 18 aa, Homo sapiens
  heavy chain complementarity determining region 3 for antibody 47643
AGGYRPGVAASGFIHFDN

SEQ ID NO: 95287 - protein, 9 aa, Homo sapiens
  light chain complementarity determining region 3 for antibody 47644
QQYNSYPWT

SEQ ID NO: 95288 - protein, 18 aa, Homo sapiens
  heavy chain complementarity determining region 3 for antibody 47644
TRDLGYASGWYFQAYFHH

SEQ ID NO: 95289 - protein, 9 aa, Homo sapiens
  light chain complementarity determining region 3 for antibody 47645
QQYNSYPWP

SEQ ID NO: 95290 - protein, 13 aa, Homo sapiens
  heavy chain complementarity determining region 3 for antibody 47645
ATSSGDFYKDFDY

SEQ ID NO: 95291 - protein, 9 aa, Homo sapiens
  light chain complementarity determining region 3 for antibody 47646
QQYNSYPVP

SEQ ID NO: 95292 - protein, 20 aa, Homo sapiens
  heavy chain complementarity determining region 3 for antibody 47646
ASGGDSGSPGLYYYYYAMAV

SEQ ID NO: 95293 - protein, 9 aa, Homo sapiens
  light chain complementarity determining region 3 for antibody 47647
QQYNSYPRT

SEQ ID NO: 95294 - protein, 14 aa, Homo sapiens
  heavy chain complementarity determining region 3 for antibody 47647
AREKGRYGDYLFDN

SEQ ID NO: 95295 - protein, 9 aa, Homo sapiens
  light chain complementarity determining region 3 for antibody 47648
QQYNSYPRT

SEQ ID NO: 95296 - protein, 12 aa, Homo sapiens
  heavy chain complementarity determining region 3 for antibody 47648
ARDLRATGTFDS

SEQ ID NO: 95297 - protein, 9 aa, Homo sapiens
  light chain complementarity determining region 3 for antibody 47649
QQYNSYPRP

SEQ ID NO: 95298 - protein, 20 aa, Homo sapiens
  heavy chain complementarity determining region 3 for antibody 47649
ARERDLLTGYTEEGYFGMDV

SEQ ID NO: 95299 - protein, 9 aa, Homo sapiens
  light chain complementarity determining region 3 for antibody 47650
QQYNSYPPT

SEQ ID NO: 95300 - protein, 11 aa, Homo sapiens
  heavy chain complementarity determining region 3 for antibody 47650
ARGWRDNSFDY

SEQ ID NO: 95301 - protein, 9 aa, Homo sapiens
  light chain complementarity determining region 3 for antibody 47651
QQYNSYPPT

SEQ ID NO: 95302 - protein, 15 aa, Homo sapiens
  heavy chain complementarity determining region 3 for antibody 47651
AKYRGSSAHYSPFDC

SEQ ID NO: 95303 - protein, 9 aa, Homo sapiens
  light chain complementarity determining region 3 for antibody 47652
QQYNSYPLT

SEQ ID NO: 95304 - protein, 14 aa, Homo sapiens
  heavy chain complementarity determining region 3 for antibody 47652
VKARYTNTWEPFDY

SEQ ID NO: 95305 - protein, 9 aa, Homo sapiens
  light chain complementarity determining region 3 for antibody 47653
QQYNSYPLT

SEQ ID NO: 95306 - protein, 10 aa, Homo sapiens
  heavy chain complementarity determining region 3 for antibody 47653
SKDTDYVIDY

SEQ ID NO: 95307 - protein, 9 aa, Homo sapiens
  light chain complementarity determining region 3 for antibody 47654
QQYNSYPLT

SEQ ID NO: 95308 - protein, 8 aa, Homo sapiens
  heavy chain complementarity determining region 3 for antibody 47654
ASPIAEVH

SEQ ID NO: 95309 - protein, 9 aa, Homo sapiens
  light chain complementarity determining region 3 for antibody 47655
QQYNSYPLS

SEQ ID NO: 95310 - protein, 21 aa, Homo sapiens
  heavy chain complementarity determining region 3 for antibody 47655
ARGGVVTGMPTDRDPEYYFDY

SEQ ID NO: 95311 - protein, 9 aa, Homo sapiens
  light chain complementarity determining region 3 for antibody 47656
QQYNSYPKK

SEQ ID NO: 95312 - protein, 15 aa, Homo sapiens
  heavy chain complementarity determining region 3 for antibody 47656
ARLKSLRGAIGAFDI

SEQ ID NO: 95313 - protein, 9 aa, Homo sapiens
  light chain complementarity determining region 3 for antibody 47657
QQYNSYPGT

SEQ ID NO: 95314 - protein, 19 aa, Homo sapiens
  heavy chain complementarity determining region 3 for antibody 47657
ARAGSAVAGIGILRHGMDV

SEQ ID NO: 95315 - protein, 9 aa, Homo sapiens
  light chain complementarity determining region 3 for antibody 47658
QQYNSYPFT

SEQ ID NO: 95316 - protein, 19 aa, Homo sapiens
  heavy chain complementarity determining region 3 for antibody 47658
AREFQPLYGDYGRGQRLDH

SEQ ID NO: 95317 - protein, 9 aa, Homo sapiens
  light chain complementarity determining region 3 for antibody 47659
QQYNSYPDT

SEQ ID NO: 95318 - protein, 13 aa, Homo sapiens
  heavy chain complementarity determining region 3 for antibody 47659
ARRQTYTNYAFDI

SEQ ID NO: 95319 - protein, 7 aa, Homo sapiens
  light chain complementarity determining region 3 for antibody 47660
QQYNSYP

SEQ ID NO: 95320 - protein, 12 aa, Homo sapiens
  heavy chain complementarity determining region 3 for antibody 47660
ASRKDAYTSLDF

SEQ ID NO: 95321 - protein, 7 aa, Homo sapiens
  light chain complementarity determining region 3 for antibody 47661
QQYNSYP

SEQ ID NO: 95322 - protein, 19 aa, Homo sapiens
  heavy chain complementarity determining region 3 for antibody 47661
ARVVYDSRDTKSVEDAFDI

SEQ ID NO: 95323 - protein, 9 aa, Homo sapiens
  light chain complementarity determining region 3 for antibody 47662
QQYNSYLLT

SEQ ID NO: 95324 - protein, 18 aa, Homo sapiens
  heavy chain complementarity determining region 3 for antibody 47662
ARHEAAGRFAGGWNPADS

SEQ ID NO: 95325 - protein, 9 aa, Homo sapiens
  light chain complementarity determining region 3 for antibody 47663
QQYNSYLFA

SEQ ID NO: 95326 - protein, 16 aa, Homo sapiens
  heavy chain complementarity determining region 3 for antibody 47663
ARMQPIRLGAPDAFDI

SEQ ID NO: 95327 - protein, 8 aa, Homo sapiens
  light chain complementarity determining region 3 for antibody 47664
QQYNSWPV

SEQ ID NO: 95328 - protein, 15 aa, Homo sapiens
  heavy chain complementarity determining region 3 for antibody 47664
AKGLFGYQSGDSFDS

SEQ ID NO: 95329 - protein, 8 aa, Homo sapiens
  light chain complementarity determining region 3 for antibody 47665
QQYNSWPT

SEQ ID NO: 95330 - protein, 18 aa, Homo sapiens
  heavy chain complementarity determining region 3 for antibody 47665
ARRLFFSNCGDYVGWFDP

SEQ ID NO: 95331 - protein, 10 aa, Homo sapiens
  light chain complementarity determining region 3 for antibody 47666
QQYNSWPPPT

SEQ ID NO: 95332 - protein, 14 aa, Homo sapiens
  heavy chain complementarity determining region 3 for antibody 47666
ARSQWGAPGTPPAY

SEQ ID NO: 95333 - protein, 10 aa, Homo sapiens
  light chain complementarity determining region 3 for antibody 47667
QQYNSWPPPT

SEQ ID NO: 95334 - protein, 14 aa, Homo sapiens
  heavy chain complementarity determining region 3 for antibody 47667
ARSQWEAPGTPPAV

SEQ ID NO: 95335 - protein, 10 aa, Homo sapiens
  light chain complementarity determining region 3 for antibody 47668
QQYNSWPPLT

SEQ ID NO: 95336 - protein, 14 aa, Homo sapiens
  heavy chain complementarity determining region 3 for antibody 47668
ARSKWTAPGTPPEY

SEQ ID NO: 95337 - protein, 9 aa, Homo sapiens
  light chain complementarity determining region 3 for antibody 47669
QQYNSWPLT

SEQ ID NO: 95338 - protein, 13 aa, Homo sapiens
  heavy chain complementarity determining region 3 for antibody 47669
VKHIVYSGSLTDY

SEQ ID NO: 95339 - protein, 9 aa, Homo sapiens
  light chain complementarity determining region 3 for antibody 47670
QQYNSWPLT

SEQ ID NO: 95340 - protein, 14 aa, Homo sapiens
  heavy chain complementarity determining region 3 for antibody 47670
ARSPAAAGTGWLDP

SEQ ID NO: 95341 - protein, 9 aa, Homo sapiens
  light chain complementarity determining region 3 for antibody 47671
QQYNSVPLT

SEQ ID NO: 95342 - protein, 9 aa, Homo sapiens
  heavy chain complementarity determining region 3 for antibody 47671
ARHLGPNDY

SEQ ID NO: 95343 - protein, 9 aa, Homo sapiens
  light chain complementarity determining region 3 for antibody 47672
QQYNSVPFT

SEQ ID NO: 95344 - protein, 14 aa, Homo sapiens
  heavy chain complementarity determining region 3 for antibody 47672
AREIAGPGPQPLDY

SEQ ID NO: 95345 - protein, 10 aa, Homo sapiens
  light chain complementarity determining region 3 for antibody 47673
QQYNSTSIYT

SEQ ID NO: 95346 - protein, 16 aa, Homo sapiens
  heavy chain complementarity determining region 3 for antibody 47673
AREGEGAYGEDEYFQH

SEQ ID NO: 95347 - protein, 9 aa, Homo sapiens
  light chain complementarity determining region 3 for antibody 47674
QQYNSSQWT

SEQ ID NO: 95348 - protein, 21 aa, Homo sapiens
  heavy chain complementarity determining region 3 for antibody 47674
ARDHAAFSDYRVRPNYYAMDV

SEQ ID NO: 95349 - protein, 9 aa, Homo sapiens
  light chain complementarity determining region 3 for antibody 47675
QQYNSSPWT

SEQ ID NO: 95350 - protein, 18 aa, Homo sapiens
  heavy chain complementarity determining region 3 for antibody 47675
TRDLGYASGWYFQAYFQH

SEQ ID NO: 95351 - protein, 9 aa, Homo sapiens
  light chain complementarity determining region 3 for antibody 47676
QQYNSSPRT

SEQ ID NO: 95352 - protein, 19 aa, Homo sapiens
  heavy chain complementarity determining region 3 for antibody 47676
AGSEGATKDDYYYYYGMDV

SEQ ID NO: 95353 - protein, 9 aa, Homo sapiens
  light chain complementarity determining region 3 for antibody 47677
QQYNSSPLT

SEQ ID NO: 95354 - protein, 12 aa, Homo sapiens
  heavy chain complementarity determining region 3 for antibody 47677
ANARTGFDWFDP

SEQ ID NO: 95355 - protein, 8 aa, Homo sapiens
  light chain complementarity determining region 3 for antibody 47678
QQYNSRWR

SEQ ID NO: 95356 - protein, 14 aa, Homo sapiens
  heavy chain complementarity determining region 3 for antibody 47678
ARDGGRLLYDAFDL

SEQ ID NO: 95357 - protein, 6 aa, Homo sapiens
  light chain complementarity determining region 3 for antibody 47679
QQYNSP

SEQ ID NO: 95358 - protein, 12 aa, Homo sapiens
  heavy chain complementarity determining region 3 for antibody 47679
VRRTSAAGPFDC

SEQ ID NO: 95359 - protein, 10 aa, Homo sapiens
  light chain complementarity determining region 3 for antibody 47680
QQYNSNSIYP

SEQ ID NO: 95360 - protein, 16 aa, Homo sapiens
  heavy chain complementarity determining region 3 for antibody 47680
AREGEGAYGEDEYFQH

SEQ ID NO: 95361 - protein, 10 aa, Homo sapiens
  light chain complementarity determining region 3 for antibody 47681
QQYNSNPIYT

SEQ ID NO: 95362 - protein, 16 aa, Homo sapiens
  heavy chain complementarity determining region 3 for antibody 47681
AREGEGAYGEDEYFQH

SEQ ID NO: 95363 - protein, 9 aa, Homo sapiens
  light chain complementarity determining region 3 for antibody 47682
QQYNSNFPT

SEQ ID NO: 95364 - protein, 15 aa, Homo sapiens
  heavy chain complementarity determining region 3 for antibody 47682
ARESGGDGYRDAFDI

SEQ ID NO: 95365 - protein, 8 aa, Homo sapiens
  light chain complementarity determining region 3 for antibody 47683
QQYNSLWT

SEQ ID NO: 95366 - protein, 18 aa, Homo sapiens
  heavy chain complementarity determining region 3 for antibody 47683
ALTTRYSSGWYLGRVVDY

SEQ ID NO: 95367 - protein, 8 aa, Homo sapiens
  light chain complementarity determining region 3 for antibody 47684
QQYNSLWP

SEQ ID NO: 95368 - protein, 18 aa, Homo sapiens
  heavy chain complementarity determining region 3 for antibody 47684
TLTTRYSSGWYLGRVVDY

SEQ ID NO: 95369 - protein, 9 aa, Homo sapiens
  light chain complementarity determining region 3 for antibody 47685
QQYNSHPRT

SEQ ID NO: 95370 - protein, 18 aa, Homo sapiens
  heavy chain complementarity determining region 3 for antibody 47685
AREFLRYFDSSKAYNLDD

SEQ ID NO: 95371 - protein, 10 aa, Homo sapiens
  light chain complementarity determining region 3 for antibody 47686
QQYNSFSPFT

SEQ ID NO: 95372 - protein, 14 aa, Homo sapiens
  heavy chain complementarity determining region 3 for antibody 47686
ARRVAVAGMWYFDL

SEQ ID NO: 95373 - protein, 10 aa, Homo sapiens
  light chain complementarity determining region 3 for antibody 47687
QQYNSFSLLT

SEQ ID NO: 95374 - protein, 13 aa, Homo sapiens
  heavy chain complementarity determining region 3 for antibody 47687
ARGGSVDQLLCHS

SEQ ID NO: 95375 - protein, 9 aa, Homo sapiens
  light chain complementarity determining region 3 for antibody 47688
QQYNSFPYT

SEQ ID NO: 95376 - protein, 9 aa, Homo sapiens
  heavy chain complementarity determining region 3 for antibody 47688
TRGPGLLCF

SEQ ID NO: 95377 - protein, 9 aa, Homo sapiens
  light chain complementarity determining region 3 for antibody 47689
QQYNSFPNT

SEQ ID NO: 95378 - protein, 17 aa, Homo sapiens
  heavy chain complementarity determining region 3 for antibody 47689
ARDTSALGPYGSGILDI

SEQ ID NO: 95379 - protein, 9 aa, Homo sapiens
  light chain complementarity determining region 3 for antibody 47690
QQYNSDSAT

SEQ ID NO: 95380 - protein, 14 aa, Homo sapiens
  heavy chain complementarity determining region 3 for antibody 47690
ATKKHRVAPAGFHP

SEQ ID NO: 95381 - protein, 9 aa, Homo sapiens
  light chain complementarity determining region 3 for antibody 47691
QQYNSDPGT

SEQ ID NO: 95382 - protein, 17 aa, Homo sapiens
  heavy chain complementarity determining region 3 for antibody 47691
ARGAVAGFQWFGDHFDY

SEQ ID NO: 95383 - protein, 10 aa, Homo sapiens
  light chain complementarity determining region 3 for antibody 47692
QQYNSAPQVT

SEQ ID NO: 95384 - protein, 16 aa, Homo sapiens
  heavy chain complementarity determining region 3 for antibody 47692
ARAWGGSGDHMYTLAS

SEQ ID NO: 95385 - protein, 9 aa, Homo sapiens
  light chain complementarity determining region 3 for antibody 47693
QQYNSAPQT

SEQ ID NO: 95386 - protein, 13 aa, Homo sapiens
  heavy chain complementarity determining region 3 for antibody 47693
AHSSGLEGPAFDI

SEQ ID NO: 95387 - protein, 9 aa, Homo sapiens
  light chain complementarity determining region 3 for antibody 47694
QQYNSAPLT

SEQ ID NO: 95388 - protein, 12 aa, Homo sapiens
  heavy chain complementarity determining region 3 for antibody 47694
ATERFRAYYFDY

SEQ ID NO: 95389 - protein, 9 aa, Homo sapiens
  light chain complementarity determining region 3 for antibody 47695
QQYNSAPFT

SEQ ID NO: 95390 - protein, 14 aa, Homo sapiens
  heavy chain complementarity determining region 3 for antibody 47695
ARKQWMVQYRAFDV

SEQ ID NO: 95391 - protein, 8 aa, Homo sapiens
  light chain complementarity determining region 3 for antibody 47696
QQYNRYST

SEQ ID NO: 95392 - protein, 12 aa, Homo sapiens
  heavy chain complementarity determining region 3 for antibody 47696
AGTRGGTSIYAS

SEQ ID NO: 95393 - protein, 8 aa, Homo sapiens
  light chain complementarity determining region 3 for antibody 47697
QQYNRYLT

SEQ ID NO: 95394 - protein, 14 aa, Homo sapiens
  heavy chain complementarity determining region 3 for antibody 47697
AHGRREGNTRIFDQ

SEQ ID NO: 95395 - protein, 10 aa, Homo sapiens
  light chain complementarity determining region 3 for antibody 47698
QQYNRNSIYT

SEQ ID NO: 95396 - protein, 16 aa, Homo sapiens
  heavy chain complementarity determining region 3 for antibody 47698
AREGEGAYGEDEYFQH

SEQ ID NO: 95397 - protein, 9 aa, Homo sapiens
  light chain complementarity determining region 3 for antibody 47699
QQYNRNALT

SEQ ID NO: 95398 - protein, 12 aa, Homo sapiens
  heavy chain complementarity determining region 3 for antibody 47699
ARIRYFDWFVDS

SEQ ID NO: 95399 - protein, 9 aa, Homo sapiens
  light chain complementarity determining region 3 for antibody 47700
QQYNRAPFT

SEQ ID NO: 95400 - protein, 17 aa, Homo sapiens
  heavy chain complementarity determining region 3 for antibody 47700
ARGGAYYDSSGYDQFDY

SEQ ID NO: 95401 - protein, 9 aa, Homo sapiens
  light chain complementarity determining region 3 for antibody 47701
QQYNNYYVT

SEQ ID NO: 95402 - protein, 18 aa, Homo sapiens
  heavy chain complementarity determining region 3 for antibody 47701
ARAGGRIGCSGGRCPSDY

SEQ ID NO: 95403 - protein, 8 aa, Homo sapiens
  light chain complementarity determining region 3 for antibody 47702
QQYNNYWL

SEQ ID NO: 95404 - protein, 16 aa, Homo sapiens
  heavy chain complementarity determining region 3 for antibody 47702
ALQRRSYSSDWYGVRY

SEQ ID NO: 95405 - protein, 10 aa, Homo sapiens
  light chain complementarity determining region 3 for antibody 47703
QQYNNYSPAP

SEQ ID NO: 95406 - protein, 19 aa, Homo sapiens
  heavy chain complementarity determining region 3 for antibody 47703
ARESEFSYDNSGYLRPFDY

SEQ ID NO: 95407 - protein, 9 aa, Homo sapiens
  light chain complementarity determining region 3 for antibody 47704
QQYNNYPFT

SEQ ID NO: 95408 - protein, 14 aa, Homo sapiens
  heavy chain complementarity determining region 3 for antibody 47704
AKAKDSSGYDLFDF

SEQ ID NO: 95409 - protein, 10 aa, Homo sapiens
  light chain complementarity determining region 3 for antibody 47705
QQYNNYATWT

SEQ ID NO: 95410 - protein, 13 aa, Homo sapiens
  heavy chain complementarity determining region 3 for antibody 47705
ARQKSVYDDSGFV

SEQ ID NO: 95411 - protein, 8 aa, Homo sapiens
  light chain complementarity determining region 3 for antibody 47706
QQYNNWYT

SEQ ID NO: 95412 - protein, 14 aa, Homo sapiens
  heavy chain complementarity determining region 3 for antibody 47706
ARSSTGSYSLHFDY

SEQ ID NO: 95413 - protein, 8 aa, Homo sapiens
  light chain complementarity determining region 3 for antibody 47707
QQYNNWYP

SEQ ID NO: 95414 - protein, 14 aa, Homo sapiens
  heavy chain complementarity determining region 3 for antibody 47707
AKEGDYDSSGYFDY

SEQ ID NO: 95415 - protein, 8 aa, Homo sapiens
  light chain complementarity determining region 3 for antibody 47708
QQYNNWYN

SEQ ID NO: 95416 - protein, 14 aa, Homo sapiens
  heavy chain complementarity determining region 3 for antibody 47708
AKEGDYDSSGYFDY

SEQ ID NO: 95417 - protein, 8 aa, Homo sapiens
  light chain complementarity determining region 3 for antibody 47709
QQYNNWWT

SEQ ID NO: 95418 - protein, 14 aa, Homo sapiens
  heavy chain complementarity determining region 3 for antibody 47709
ARINYYDGGGSVDY

SEQ ID NO: 95419 - protein, 8 aa, Homo sapiens
  light chain complementarity determining region 3 for antibody 47710
QQYNNWST

SEQ ID NO: 95420 - protein, 14 aa, Homo sapiens
  heavy chain complementarity determining region 3 for antibody 47710
AKEGDYDSSGYFDY

SEQ ID NO: 95421 - protein, 10 aa, Homo sapiens
  light chain complementarity determining region 3 for antibody 47711
QQYNNWPTYT

SEQ ID NO: 95422 - protein, 14 aa, Homo sapiens
  heavy chain complementarity determining region 3 for antibody 47711
ACLIVVALPDVTDI

SEQ ID NO: 95423 - protein, 8 aa, Homo sapiens
  light chain complementarity determining region 3 for antibody 47712
QQYNNWPT

SEQ ID NO: 95424 - protein, 13 aa, Homo sapiens
  heavy chain complementarity determining region 3 for antibody 47712
ASRNDGDYHLIDY

SEQ ID NO: 95425 - protein, 9 aa, Homo sapiens
  light chain complementarity determining region 3 for antibody 47713
QQYNNWPRT

SEQ ID NO: 95426 - protein, 12 aa, Homo sapiens
  heavy chain complementarity determining region 3 for antibody 47713
ATWEWLLLKEDY

SEQ ID NO: 95427 - protein, 9 aa, Homo sapiens
  light chain complementarity determining region 3 for antibody 47714
QQYNNWPRT

SEQ ID NO: 95428 - protein, 20 aa, Homo sapiens
  heavy chain complementarity determining region 3 for antibody 47714
ARTGYRYFASGRYNQDAYDV

SEQ ID NO: 95429 - protein, 9 aa, Homo sapiens
  light chain complementarity determining region 3 for antibody 47715
QQYNNWPRT

SEQ ID NO: 95430 - protein, 12 aa, Homo sapiens
  heavy chain complementarity determining region 3 for antibody 47715
ARRPYSSGWFRD

SEQ ID NO: 95431 - protein, 9 aa, Homo sapiens
  light chain complementarity determining region 3 for antibody 47716
QQYNNWPRT

SEQ ID NO: 95432 - protein, 14 aa, Homo sapiens
  heavy chain complementarity determining region 3 for antibody 47716
ARHPREAIHWYFDL

SEQ ID NO: 95433 - protein, 9 aa, Homo sapiens
  light chain complementarity determining region 3 for antibody 47717
QQYNNWPRT

SEQ ID NO: 95434 - protein, 17 aa, Homo sapiens
  heavy chain complementarity determining region 3 for antibody 47717
ARDWYCPSLNCHDVFDV

SEQ ID NO: 95435 - protein, 9 aa, Homo sapiens
  light chain complementarity determining region 3 for antibody 47718
QQYNNWPQT

SEQ ID NO: 95436 - protein, 16 aa, Homo sapiens
  heavy chain complementarity determining region 3 for antibody 47718
ARPSGAAGHRLSGLDV

SEQ ID NO: 95437 - protein, 10 aa, Homo sapiens
  light chain complementarity determining region 3 for antibody 47719
QQYNNWPPYT

SEQ ID NO: 95438 - protein, 11 aa, Homo sapiens
  heavy chain complementarity determining region 3 for antibody 47719
ATGGLRVVFGP

SEQ ID NO: 95439 - protein, 10 aa, Homo sapiens [sequence omitted]

SEQ ID NO: 95440 - protein, 9 aa, Homo sapiens
  heavy chain complementarity determining region 3 for antibody 47720
ARGGNSWRY

SEQ ID NO: 95441 - protein, 10 aa, Homo sapiens [sequence omitted]

SEQ ID NO: 95442 - protein, 18 aa, Homo sapiens
  heavy chain complementarity determining region 3 for antibody 47721
ARDRYYDSIGYYDWAFDV

SEQ ID NO: 95443 - protein, 10 aa, Homo sapiens [sequence omitted]

SEQ ID NO: 95444 - protein, 13 aa, Homo sapiens
  heavy chain complementarity determining region 3 for antibody 47722
ARDLFTSTVINDY

SEQ ID NO: 95445 - protein, 10 aa, Homo sapiens [sequence omitted]

SEQ ID NO: 95446 - protein, 13 aa, Homo sapiens
  heavy chain complementarity determining region 3 for antibody 47723
AKSPRELEGPSDY

SEQ ID NO: 95447 - protein, 10 aa, Homo sapiens
  light chain complementarity determining region 3 for antibody 47724
QQYNNWPPWK

SEQ ID NO: 95448 - protein, 13 aa, Homo sapiens
  heavy chain complementarity determining region 3 for antibody 47724
ARRNGGSRDAFDV

SEQ ID NO: 95449 - protein, 11 aa, Homo sapiens
  light chain complementarity determining region 3 for antibody 47725
QQYNNWPPVYT

SEQ ID NO: 95450 - protein, 15 aa, Homo sapiens
  heavy chain complementarity determining region 3 for antibody 47725
ASAHSSNSFHRYFDF

SEQ ID NO: 95451 - protein, 10 aa, Homo sapiens
  light chain complementarity determining region 3 for antibody 47726
QQYNNWPPST

SEQ ID NO: 95452 - protein, 11 aa, Homo sapiens
  heavy chain complementarity determining region 3 for antibody 47726
ATGGLRVVFGP

SEQ ID NO: 95453 - protein, 10 aa, Homo sapiens
  light chain complementarity determining region 3 for antibody 47727
QQYNNWPPRA

SEQ ID NO: 95454 - protein, 13 aa, Homo sapiens
  heavy chain complementarity determining region 3 for antibody 47727
ARTLGGSYAYLDF

SEQ ID NO: 95455 - protein, 10 aa, Homo sapiens
  light chain complementarity determining region 3 for antibody 47728
QQYNNWPPNT

SEQ ID NO: 95456 - protein, 16 aa, Homo sapiens
  heavy chain complementarity determining region 3 for antibody 47728
AREVADSNTWGWHFDL

SEQ ID NO: 95457 - protein, 11 aa, Homo sapiens
  light chain complementarity determining region 3 for antibody 47729
QQYNNWPPMYI

SEQ ID NO: 95458 - protein, 13 aa, Homo sapiens
  heavy chain complementarity determining region 3 for antibody 47729
ARDPPGPDGAFNL

SEQ ID NO: 95459 - protein, 10 aa, Homo sapiens
  light chain complementarity determining region 3 for antibody 47730
QQYNNWPPLT

SEQ ID NO: 95460 - protein, 8 aa, Homo sapiens
  heavy chain complementarity determining region 3 for antibody 47730
ARGGDLDY

SEQ ID NO: 95461 - protein, 10 aa, Homo sapiens
  light chain complementarity determining region 3 for antibody 47731
QQYNNWPPLT

SEQ ID NO: 95462 - protein, 20 aa, Homo sapiens
  heavy chain complementarity determining region 3 for antibody 47731
ARAEAALWFGKLLYPGWLDP

SEQ ID NO: 95463 - protein, 10 aa, Homo sapiens
  light chain complementarity determining region 3 for antibody 47732
QQYNNWPPLT

SEQ ID NO: 95464 - protein, 10 aa, Homo sapiens
  heavy chain complementarity determining region 3 for antibody 47732
AGRALTTWLY

SEQ ID NO: 95465 - protein, 11 aa, Homo sapiens
  light chain complementarity determining region 3 for antibody 47733
QQYNNWPPGYT

SEQ ID NO: 95466 - protein, 15 aa, Homo sapiens
  heavy chain complementarity determining region 3 for antibody 47733
ASAHSSNSFHRYFDF

SEQ ID NO: 95467 - protein, 10 aa, Homo sapiens
  light chain complementarity determining region 3 for antibody 47734
QQYNNWPPGT

SEQ ID NO: 95468 - protein, 17 aa, Homo sapiens
  heavy chain complementarity determining region 3 for antibody 47734
ARDGGSGYSYGLGFGDY

SEQ ID NO: 95469 - protein, 10 aa, Homo sapiens
  light chain complementarity determining region 3 for antibody 47735
QQYNNWPPGT

SEQ ID NO: 95470 - protein, 16 aa, Homo sapiens
  heavy chain complementarity determining region 3 for antibody 47735
AKTRDLLLGLAHPFEY

SEQ ID NO: 95471 - protein, 11 aa, Homo sapiens
  light chain complementarity determining region 3 for antibody 47736
QQYNNWPPAHP

SEQ ID NO: 95472 - protein, 13 aa, Homo sapiens
  heavy chain complementarity determining region 3 for antibody 47736
VRGQLAAAGVFDF

SEQ ID NO: 95473 - protein, 9 aa, Homo sapiens
  light chain complementarity determining region 3 for antibody 47737
QQYNNWPLT

SEQ ID NO: 95474 - protein, 12 aa, Homo sapiens
  heavy chain complementarity determining region 3 for antibody 47737
VRDVTSGWAFDY

SEQ ID NO: 95475 - protein, 9 aa, Homo sapiens
  light chain complementarity determining region 3 for antibody 47738
QQYNNWPLT

SEQ ID NO: 95476 - protein, 18 aa, Homo sapiens
  heavy chain complementarity determining region 3 for antibody 47738
AREPPIFYYYDSSGYLDY

SEQ ID NO: 95477 - protein, 9 aa, Homo sapiens
  light chain complementarity determining region 3 for antibody 47739
QQYNNWPGA

SEQ ID NO: 95478 - protein, 9 aa, Homo sapiens
  heavy chain complementarity determining region 3 for antibody 47739
VRDKWGIDY

SEQ ID NO: 95479 - protein, 9 aa, Homo sapiens
  light chain complementarity determining region 3 for antibody 47740
QQYNNWLYT

SEQ ID NO: 95480 - protein, 12 aa, Homo sapiens
  heavy chain complementarity determining region 3 for antibody 47740
AKEVGYVSGYDF

SEQ ID NO: 95481 - protein, 9 aa, Homo sapiens
  light chain complementarity determining region 3 for antibody 47741
QQYNNWLWT

SEQ ID NO: 95482 - protein, 20 aa, Homo sapiens
  heavy chain complementarity determining region 3 for antibody 47741
APLPYCSSTRCYHYSYGLDV

SEQ ID NO: 95483 - protein, 10 aa, Homo sapiens
  light chain complementarity determining region 3 for antibody 47742
QQYNNRSPWT

SEQ ID NO: 95484 - protein, 16 aa, Homo sapiens
  heavy chain complementarity determining region 3 for antibody 47742
AKDFRNYAYDSGPFGD

SEQ ID NO: 95485 - protein, 10 aa, Homo sapiens
  light chain complementarity determining region 3 for antibody 47743
QQYNNRPPLT

SEQ ID NO: 95486 - protein, 8 aa, Homo sapiens
  heavy chain complementarity determining region 3 for antibody 47743
VRRFALDL

SEQ ID NO: 95487 - protein, 9 aa, Homo sapiens
  light chain complementarity determining region 3 for antibody 47744
QQYNNFYRT

SEQ ID NO: 95488 - protein, 16 aa, Homo sapiens
  heavy chain complementarity determining region 3 for antibody 47744
AIVVGNVAAAGEYFHQ

SEQ ID NO: 95489 - protein, 9 aa, Homo sapiens
  light chain complementarity determining region 3 for antibody 47745
QQYNNFLWT

SEQ ID NO: 95490 - protein, 13 aa, Homo sapiens
  heavy chain complementarity determining region 3 for antibody 47745
VSHSSVRGNWNVA

SEQ ID NO: 95491 - protein, 9 aa, Homo sapiens
  light chain complementarity determining region 3 for antibody 47746
QQYNKWPRT

SEQ ID NO: 95492 - protein, 14 aa, Homo sapiens
  heavy chain complementarity determining region 3 for antibody 47746
ASTTDILAATYFDY

SEQ ID NO: 95493 - protein, 10 aa, Homo sapiens
  light chain complementarity determining region 3 for antibody 47747
QQYNKWPPYT

SEQ ID NO: 95494 - protein, 15 aa, Homo sapiens
  heavy chain complementarity determining region 3 for antibody 47747
ARAYSGGWYADYFDC

SEQ ID NO: 95495 - protein, 10 aa, Homo sapiens
  light chain complementarity determining region 3 for antibody 47748
QQYNKWPLTT

SEQ ID NO: 95496 - protein, 19 aa, Homo sapiens
  heavy chain complementarity determining region 3 for antibody 47748
GRLSELERRLSEYYYAMDV

SEQ ID NO: 95497 - protein, 9 aa, Homo sapiens
  light chain complementarity determining region 3 for antibody 47749
QQYNKWPLP

SEQ ID NO: 95498 - protein, 16 aa, Homo sapiens
  heavy chain complementarity determining region 3 for antibody 47749
ARLTESSGYHDEGFDI

SEQ ID NO: 95499 - protein, 9 aa, Homo sapiens
  light chain complementarity determining region 3 for antibody 47750
QQYNKGPLT

SEQ ID NO: 95500 - protein, 14 aa, Homo sapiens
  heavy chain complementarity determining region 3 for antibody 47750
ARGHAVAATAWFDL

SEQ ID NO: 95501 - protein, 9 aa, Homo sapiens
  light chain complementarity determining region 3 for antibody 47751
QQYNIWPFT

SEQ ID NO: 95502 - protein, 18 aa, Homo sapiens
  heavy chain complementarity determining region 3 for antibody 47751
ARAGCADGCYPDRVAFDF

SEQ ID NO: 95503 - protein, 9 aa, Homo sapiens
  light chain complementarity determining region 3 for antibody 47752
QQYNIFPYP

SEQ ID NO: 95504 - protein, 14 aa, Homo sapiens
  heavy chain complementarity determining region 3 for antibody 47752
AKERGYNGRTTFDY

SEQ ID NO: 95505 - protein, 8 aa, Homo sapiens
  light chain complementarity determining region 3 for antibody 47753
QQYNGYWT

SEQ ID NO: 95506 - protein, 14 aa, Homo sapiens
  heavy chain complementarity determining region 3 for antibody 47753
AHGRREGNTRIFDQ

SEQ ID NO: 95507 - protein, 11 aa, Homo sapiens
  light chain complementarity determining region 3 for antibody 47754
QQYNGYSPIFT

SEQ ID NO: 95508 - protein, 15 aa, Homo sapiens
  heavy chain complementarity determining region 3 for antibody 47754
ARERFCTSTNCPFDY

SEQ ID NO: 95509 - protein, 9 aa, Homo sapiens
  light chain complementarity determining region 3 for antibody 47755
QQYNGYSLT

SEQ ID NO: 95510 - protein, 18 aa, Homo sapiens
  heavy chain complementarity determining region 3 for antibody 47755
ARDHIGRVDSARFWYFDF

SEQ ID NO: 95511 - protein, 9 aa, Homo sapiens
  light chain complementarity determining region 3 for antibody 47756
QQYNGYPYT

SEQ ID NO: 95512 - protein, 12 aa, Homo sapiens
  heavy chain complementarity determining region 3 for antibody 47756
ATNGANSWYGDS

SEQ ID NO: 95513 - protein, 9 aa, Homo sapiens
  light chain complementarity determining region 3 for antibody 47757
QQYNGYPHT

SEQ ID NO: 95514 - protein, 18 aa, Homo sapiens
  heavy chain complementarity determining region 3 for antibody 47757
VKDVSPAHKLWSTGGLDY

SEQ ID NO: 95515 - protein, 9 aa, Homo sapiens
  light chain complementarity determining region 3 for antibody 47758
QQYNGASRT

SEQ ID NO: 95516 - protein, 17 aa, Homo sapiens
  heavy chain complementarity determining region 3 for antibody 47758
ARDPVFRSMVRGVIPGY

SEQ ID NO: 95517 - protein, 9 aa, Homo sapiens
  light chain complementarity determining region 3 for antibody 47759
QQYNGAPLT

SEQ ID NO: 95518 - protein, 11 aa, Homo sapiens
  heavy chain complementarity determining region 3 for antibody 47759
ARRGVTPALDI

SEQ ID NO: 95519 - protein, 8 aa, Homo sapiens
  light chain complementarity determining region 3 for antibody 47760
QQYNFYTS

SEQ ID NO: 95520 - protein, 12 aa, Homo sapiens
  heavy chain complementarity determining region 3 for antibody 47760
TREDSGDFYFDH

SEQ ID NO: 95521 - protein, 8 aa, Homo sapiens
  light chain complementarity determining region 3 for antibody 47761
QQYNFLWT

SEQ ID NO: 95522 - protein, 10 aa, Homo sapiens
  heavy chain complementarity determining region 3 for antibody 47761
ATDRRSVVHI

SEQ ID NO: 95523 - protein, 8 aa, Homo sapiens
  light chain complementarity determining region 3 for antibody 47762
QQYNDYSP

SEQ ID NO: 95524 - protein, 17 aa, Homo sapiens
  heavy chain complementarity determining region 3 for antibody 47762
ARAVGYYDSSGYRYFDY

SEQ ID NO: 95525 - protein, 9 aa, Homo sapiens
  light chain complementarity determining region 3 for antibody 47763
QQYNDWPYT

SEQ ID NO: 95526 - protein, 19 aa, Homo sapiens
  heavy chain complementarity determining region 3 for antibody 47763
TREKTYDSLWNSYHWAGDY

SEQ ID NO: 95527 - protein, 9 aa, Homo sapiens
  light chain complementarity determining region 3 for antibody 47764
QQYNDWPWT

SEQ ID NO: 95528 - protein, 15 aa, Homo sapiens
  heavy chain complementarity determining region 3 for antibody 47764
ARVGYSFGNLSAFDI

SEQ ID NO: 95529 - protein, 9 aa, Homo sapiens
  light chain complementarity determining region 3 for antibody 47765
QQYNDWPLT

SEQ ID NO: 95530 - protein, 21 aa, Homo sapiens
  heavy chain complementarity determining region 3 for antibody 47765
VRGGGPKNRFLEWLPSRPFDS

SEQ ID NO: 95531 - protein, 9 aa, Homo sapiens
  light chain complementarity determining region 3 for antibody 47766
QQYNDWPAT

SEQ ID NO: 95532 - protein, 9 aa, Homo sapiens
  heavy chain complementarity determining region 3 for antibody 47766
AGGEVYFDY

SEQ ID NO: 95533 - protein, 10 aa, Homo sapiens
  light chain complementarity determining region 3 for antibody 47767
QQYNDWPACT

SEQ ID NO: 95534 - protein, 15 aa, Homo sapiens
  heavy chain complementarity determining region 3 for antibody 47767
SRPLSIGGLYSGSQY

SEQ ID NO: 95535 - protein, 8 aa, Homo sapiens
  light chain complementarity determining region 3 for antibody 47768
QQYNDWHT

SEQ ID NO: 95536 - protein, 8 aa, Homo sapiens
  heavy chain complementarity determining region 3 for antibody 47768
ARTPLLDF

SEQ ID NO: 95537 - protein, 8 aa, Homo sapiens
  light chain complementarity determining region 3 for antibody 47769
QQYNDRAA

SEQ ID NO: 95538 - protein, 15 aa, Homo sapiens
  heavy chain complementarity determining region 3 for antibody 47769
ARPPLGGSFYFGMDV

SEQ ID NO: 95539 - protein, 8 aa, Homo sapiens
  light chain complementarity determining region 3 for antibody 47770
QQYNDLLT

SEQ ID NO: 95540 - protein, 12 aa, Homo sapiens
  heavy chain complementarity determining region 3 for antibody 47770
ARDTAGGVMGQY

SEQ ID NO: 95541 - protein, 9 aa, Homo sapiens
  light chain complementarity determining region 3 for antibody 47771
QQYNDHGVT

SEQ ID NO: 95542 - protein, 9 aa, Homo sapiens
  heavy chain complementarity determining region 3 for antibody 47771
VRGPIHFDY

SEQ ID NO: 95543 - protein, 9 aa, Homo sapiens
  light chain complementarity determining region 3 for antibody 47772
QQYNDHGGT

SEQ ID NO: 95544 - protein, 9 aa, Homo sapiens
  heavy chain complementarity determining region 3 for antibody 47772
ARGPIHFDY

SEQ ID NO: 95545 - protein, 9 aa, Homo sapiens
  light chain complementarity determining region 3 for antibody 47773
QQYNDFPYT

SEQ ID NO: 95546 - protein, 24 aa, Homo sapiens
  heavy chain complementarity determining region 3 for antibody 47773
AKEAFSYGTGTTNYRGPIPPAFDD

SEQ ID NO: 95547 - protein, 9 aa, Homo sapiens
  light chain complementarity determining region 3 for antibody 47774
QQYNDAPWT

SEQ ID NO: 95548 - protein, 16 aa, Homo sapiens
  heavy chain complementarity determining region 3 for antibody 47774
AKKGGHVAATGNYFDL

SEQ ID NO: 95549 - protein, 9 aa, Homo sapiens
  light chain complementarity determining region 3 for antibody 47775
QQYNAYPWM

SEQ ID NO: 95550 - protein, 19 aa, Homo sapiens
  heavy chain complementarity determining region 3 for antibody 47775
ARGRTPGIALPGSRHSFDF

SEQ ID NO: 95551 - protein, 9 aa, Homo sapiens
  light chain complementarity determining region 3 for antibody 47776
QQYNAYPWL

SEQ ID NO: 95552 - protein, 19 aa, Homo sapiens
  heavy chain complementarity determining region 3 for antibody 47776
ARGRTPGIALPGSRHYFDF

SEQ ID NO: 95553 - protein, 9 aa, Homo sapiens
  light chain complementarity determining region 3 for antibody 47777
QQYLTSPGT

SEQ ID NO: 95554 - protein, 20 aa, Homo sapiens
  heavy chain complementarity determining region 3 for antibody 47777
AREALSWVALGETPPCGFDY

SEQ ID NO: 95555 - protein, 9 aa, Homo sapiens
  light chain complementarity determining region 3 for antibody 47778
QQYLNSPLT

SEQ ID NO: 95556 - protein, 13 aa, Homo sapiens
  heavy chain complementarity determining region 3 for antibody 47778
AKDPSGNYGSWVH

SEQ ID NO: 95557 - protein, 8 aa, Homo sapiens
  light chain complementarity determining region 3 for antibody 47779
QQYLGNPT

SEQ ID NO: 95558 - protein, 13 aa, Homo sapiens
  heavy chain complementarity determining region 3 for antibody 47779
ARYCGGDCSPLDY

SEQ ID NO: 95559 - protein, 9 aa, Homo sapiens
  light chain complementarity determining region 3 for antibody 47780
QQYKTYPRT

SEQ ID NO: 95560 - protein, 18 aa, Homo sapiens
  heavy chain complementarity determining region 3 for antibody 47780
AHKTVWHDYDSKGGAFDI

SEQ ID NO: 95561 - protein, 9 aa, Homo sapiens
  light chain complementarity determining region 3 for antibody 47781
QQYKTFPIT

SEQ ID NO: 95562 - protein, 14 aa, Homo sapiens
  heavy chain complementarity determining region 3 for antibody 47781
ARAGKGWRSGAFDI

SEQ ID NO: 95563 - protein, 8 aa, Homo sapiens
  light chain complementarity determining region 3 for antibody 47782
QQYKSYSA

SEQ ID NO: 95564 - protein, 15 aa, Homo sapiens
  heavy chain complementarity determining region 3 for antibody 47782
ARGQNLVRMHDAFDF

SEQ ID NO: 95565 - protein, 9 aa, Homo sapiens
  light chain complementarity determining region 3 for antibody 47783
QQYKSYPYT

SEQ ID NO: 95566 - protein, 19 aa, Homo sapiens
  heavy chain complementarity determining region 3 for antibody 47783
AREKFGDGSGSYGGSEFDY

SEQ ID NO: 95567 - protein, 8 aa, Homo sapiens
  light chain complementarity determining region 3 for antibody 47784
QQYKSYPT

SEQ ID NO: 95568 - protein, 21 aa, Homo sapiens
  heavy chain complementarity determining region 3 for antibody 47784
ARDGSNYYGSGSYYSEGVSTY

SEQ ID NO: 95569 - protein, 9 aa, Homo sapiens
  light chain complementarity determining region 3 for antibody 47785
QQYKSFPWK

SEQ ID NO: 95570 - protein, 16 aa, Homo sapiens
  heavy chain complementarity determining region 3 for antibody 47785
ARLKRGGGSQQYYFDS

SEQ ID NO: 95571 - protein, 9 aa, Homo sapiens
  light chain complementarity determining region 3 for antibody 47786
QQYKSFPLT

SEQ ID NO: 95572 - protein, 12 aa, Homo sapiens
  heavy chain complementarity determining region 3 for antibody 47786
TRAPSGDYFFEY

SEQ ID NO: 95573 - protein, 9 aa, Homo sapiens
  light chain complementarity determining region 3 for antibody 47787
QQYKSFPLT

SEQ ID NO: 95574 - protein, 12 aa, Homo sapiens
  heavy chain complementarity determining region 3 for antibody 47787
TGSPRGDYFFEY

SEQ ID NO: 95575 - protein, 9 aa, Homo sapiens
  light chain complementarity determining region 3 for antibody 47788
QQYKSFPGT

SEQ ID NO: 95576 - protein, 16 aa, Homo sapiens
  heavy chain complementarity determining region 3 for antibody 47788
ARLKRGGGSQQYYFDS

SEQ ID NO: 95577 - protein, 9 aa, Homo sapiens
  light chain complementarity determining region 3 for antibody 47789
QQYKRWPLA

SEQ ID NO: 95578 - protein, 11 aa, Homo sapiens
  heavy chain complementarity determining region 3 for antibody 47789
ARDRGDNYFDS

SEQ ID NO: 95579 - protein, 10 aa, Homo sapiens
  light chain complementarity determining region 3 for antibody 47790
QQYKNWPPRT

SEQ ID NO: 95580 - protein, 21 aa, Homo sapiens
  heavy chain complementarity determining region 3 for antibody 47790
AREGVSGSSWTYLYSYSGMDV

SEQ ID NO: 95581 - protein, 10 aa, Homo sapiens
  light chain complementarity determining region 3 for antibody 47791
QQYKNWPPRP

SEQ ID NO: 95582 - protein, 21 aa, Homo sapiens
  heavy chain complementarity determining region 3 for antibody 47791
AREGVSGSSWTYLYSYSGMDV

SEQ ID NO: 95583 - protein, 10 aa, Homo sapiens
  light chain complementarity determining region 3 for antibody 47792
QQYKISSPWT

SEQ ID NO: 95584 - protein, 13 aa, Homo sapiens
  heavy chain complementarity determining region 3 for antibody 47792
AADSYFSLADLDY

SEQ ID NO: 95585 - protein, 9 aa, Homo sapiens
  light chain complementarity determining region 3 for antibody 47793
QQYKDPSGT

SEQ ID NO: 95586 - protein, 12 aa, Homo sapiens
  heavy chain complementarity determining region 3 for antibody 47793
AMYFEGMGGVGS

SEQ ID NO: 95587 - protein, 9 aa, Homo sapiens
  light chain complementarity determining region 3 for antibody 47794
QQYITFPYT

SEQ ID NO: 95588 - protein, 14 aa, Homo sapiens
  heavy chain complementarity determining region 3 for antibody 47794
AREIAGGRPSRMDY

SEQ ID NO: 95589 - protein, 9 aa, Homo sapiens
  light chain complementarity determining region 3 for antibody 47795
QQYISVPIT

SEQ ID NO: 95590 - protein, 15 aa, Homo sapiens
  heavy chain complementarity determining region 3 for antibody 47795
VKDTGGSPGGWLLDY

SEQ ID NO: 95591 - protein, 9 aa, Homo sapiens
  light chain complementarity determining region 3 for antibody 47796
QQYIRSPYT

SEQ ID NO: 95592 - protein, 14 aa, Homo sapiens
  heavy chain complementarity determining region 3 for antibody 47796
GRHPTTSSWSPFQH

SEQ ID NO: 95593 - protein, 11 aa, Homo sapiens
  light chain complementarity determining region 3 for antibody 47797
QQYINWPPLYT

SEQ ID NO: 95594 - protein, 20 aa, Homo sapiens
  heavy chain complementarity determining region 3 for antibody 47797
ARVLYYGDYVPIRQLMWFDP

SEQ ID NO: 95595 - protein, 10 aa, Homo sapiens
  light chain complementarity determining region 3 for antibody 47798
QQYINWPAIP

SEQ ID NO: 95596 - protein, 17 aa, Homo sapiens
  heavy chain complementarity determining region 3 for antibody 47798
AKDIFFGIAVAGTAFDI

SEQ ID NO: 95597 - protein, 8 aa, Homo sapiens
  light chain complementarity determining region 3 for antibody 47799
QQYIHWWT

SEQ ID NO: 95598 - protein, 11 aa, Homo sapiens
  heavy chain complementarity determining region 3 for antibody 47799
ARLSVVNHFDY

SEQ ID NO: 95599 - protein, 9 aa, Homo sapiens
  light chain complementarity determining region 3 for antibody 47800
QQYHTYSWT

SEQ ID NO: 95600 - protein, 11 aa, Homo sapiens
  heavy chain complementarity determining region 3 for antibody 47800
AGSSGHDAFDM

SEQ ID NO: 95601 - protein, 9 aa, Homo sapiens
  light chain complementarity determining region 3 for antibody 47801
QQYHTTPST

SEQ ID NO: 95602 - protein, 14 aa, Homo sapiens
  heavy chain complementarity determining region 3 for antibody 47801
ALRWGSVYYDVSDV

SEQ ID NO: 95603 - protein, 8 aa, Homo sapiens
  light chain complementarity determining region 3 for antibody 47802
QQYHTFYP

SEQ ID NO: 95604 - protein, 14 aa, Homo sapiens
  heavy chain complementarity determining region 3 for antibody 47802
ARRNYCDDGCLFHP

SEQ ID NO: 95605 - protein, 8 aa, Homo sapiens
  light chain complementarity determining region 3 for antibody 47803
QQYHTFST

SEQ ID NO: 95606 - protein, 14 aa, Homo sapiens
  heavy chain complementarity determining region 3 for antibody 47803
ARRNYCDDGCLFHP

SEQ ID NO: 95607 - protein, 8 aa, Homo sapiens
  light chain complementarity determining region 3 for antibody 47804
QQYHTFSP

SEQ ID NO: 95608 - protein, 14 aa, Homo sapiens
  heavy chain complementarity determining region 3 for antibody 47804
ARRNYCDDGCLFHP

SEQ ID NO: 95609 - protein, 9 aa, Homo sapiens
  light chain complementarity determining region 3 for antibody 47805
QQYHSYSRA

SEQ ID NO: 95610 - protein, 17 aa, Homo sapiens
  heavy chain complementarity determining region 3 for antibody 47805
AKDSATRPVHGGSYFDS

SEQ ID NO: 95611 - protein, 9 aa, Homo sapiens
  light chain complementarity determining region 3 for antibody 47806
QQYHSYPPL

SEQ ID NO: 95612 - protein, 18 aa, Homo sapiens
  heavy chain complementarity determining region 3 for antibody 47806
ASPLDHSGSGNFYYEMDV

SEQ ID NO: 95613 - protein, 9 aa, Homo sapiens
  light chain complementarity determining region 3 for antibody 47807
QQYHSYPLI

SEQ ID NO: 95614 - protein, 16 aa, Homo sapiens
  heavy chain complementarity determining region 3 for antibody 47807
ARAYYFGSGIYPFIDF

SEQ ID NO: 95615 - protein, 10 aa, Homo sapiens
  light chain complementarity determining region 3 for antibody 47808
QQYHSSSPLT

SEQ ID NO: 95616 - protein, 13 aa, Homo sapiens
  heavy chain complementarity determining region 3 for antibody 47808
ARARGLTGTTREH

SEQ ID NO: 95617 - protein, 9 aa, Homo sapiens
  light chain complementarity determining region 3 for antibody 47809
QQYHSSPRT

SEQ ID NO: 95618 - protein, 12 aa, Homo sapiens
  heavy chain complementarity determining region 3 for antibody 47809
ARDEGRVWSLNY

SEQ ID NO: 95619 - protein, 9 aa, Homo sapiens
  light chain complementarity determining region 3 for antibody 47810
QQYHSSPRT

SEQ ID NO: 95620 - protein, 16 aa, Homo sapiens
  heavy chain complementarity determining region 3 for antibody 47810
ARAYGDIEGRLTLIDH

SEQ ID NO: 95621 - protein, 9 aa, Homo sapiens
  light chain complementarity determining region 3 for antibody 47811
QQYHSSNRT

SEQ ID NO: 95622 - protein, 11 aa, Homo sapiens
  heavy chain complementarity determining region 3 for antibody 47811
ARDSRYRGYDL

SEQ ID NO: 95623 - protein, 9 aa, Homo sapiens
  light chain complementarity determining region 3 for antibody 47812
QQYHSSHRP

SEQ ID NO: 95624 - protein, 11 aa, Homo sapiens
  heavy chain complementarity determining region 3 for antibody 47812
ARDSRYRGYDL

SEQ ID NO: 95625 - protein, 8 aa, Homo sapiens
  light chain complementarity determining region 3 for antibody 47813
QQYHSRRP

SEQ ID NO: 95626 - protein, 9 aa, Homo sapiens
  heavy chain complementarity determining region 3 for antibody 47813
ATGGRTYQR

SEQ ID NO: 95627 - protein, 9 aa, Homo sapiens
  light chain complementarity determining region 3 for antibody 47814
QQYHSFPPT

SEQ ID NO: 95628 - protein, 18 aa, Homo sapiens
  heavy chain complementarity determining region 3 for antibody 47814
ARDRRPTGRFRLLLALDP

SEQ ID NO: 95629 - protein, 8 aa, Homo sapiens
  light chain complementarity determining region 3 for antibody 47815
QQYHRGLT

SEQ ID NO: 95630 - protein, 12 aa, Homo sapiens
  heavy chain complementarity determining region 3 for antibody 47815
ARDRVESIRFDH

SEQ ID NO: 95631 - protein, 10 aa, Homo sapiens
  light chain complementarity determining region 3 for antibody 47816
QQYHNWPPLT

SEQ ID NO: 95632 - protein, 15 aa, Homo sapiens
  heavy chain complementarity determining region 3 for antibody 47816
AKDGGGYINRWYRND

SEQ ID NO: 95633 - protein, 9 aa, Homo sapiens
  light chain complementarity determining region 3 for antibody 47817
QQYHNVPYT

SEQ ID NO: 95634 - protein, 16 aa, Homo sapiens
  heavy chain complementarity determining region 3 for antibody 47817
SRHPSPDYGDNSPLDY

SEQ ID NO: 95635 - protein, 9 aa, Homo sapiens
  light chain complementarity determining region 3 for antibody 47818
QQYHNSRLS

SEQ ID NO: 95636 - protein, 16 aa, Homo sapiens
  heavy chain complementarity determining region 3 for antibody 47818
ATRGLGLDDAGTYFAL

SEQ ID NO: 95637 - protein, 9 aa, Homo sapiens
  light chain complementarity determining region 3 for antibody 47819
QQYHNIPYT

SEQ ID NO: 95638 - protein, 16 aa, Homo sapiens
  heavy chain complementarity determining region 3 for antibody 47819
AKAEPPSAAWPWYFDL

SEQ ID NO: 95639 - protein, 8 aa, Homo sapiens
  light chain complementarity determining region 3 for antibody 47820
QQYHHLLT

SEQ ID NO: 95640 - protein, 11 aa, Homo sapiens
  heavy chain complementarity determining region 3 for antibody 47820
ARRRFTDAFDV

SEQ ID NO: 95641 - protein, 9 aa, Homo sapiens
  light chain complementarity determining region 3 for antibody 47821
QQYGYSPYT

SEQ ID NO: 95642 - protein, 22 aa, Homo sapiens
  heavy chain complementarity determining region 3 for antibody 47821
ARRRPTDITKFRQRGRQWAFEI

SEQ ID NO: 95643 - protein, 9 aa, Homo sapiens
  light chain complementarity determining region 3 for antibody 47822
QQYGYSPWT

SEQ ID NO: 95644 - protein, 11 aa, Homo sapiens
  heavy chain complementarity determining region 3 for antibody 47822
ARIDVTVGYDI

SEQ ID NO: 95645 - protein, 9 aa, Homo sapiens
  light chain complementarity determining region 3 for antibody 47823
QQYGYSPFP

SEQ ID NO: 95646 - protein, 16 aa, Homo sapiens
  heavy chain complementarity determining region 3 for antibody 47823
AKTSRGAVTGTPYFNY

SEQ ID NO: 95647 - protein, 9 aa, Homo sapiens
  light chain complementarity determining region 3 for antibody 47824
QQYGVSQLI

SEQ ID NO: 95648 - protein, 17 aa, Homo sapiens
  heavy chain complementarity determining region 3 for antibody 47824
ARFRGTGTYLTHPVVDH

SEQ ID NO: 95649 - protein, 9 aa, Homo sapiens
  light chain complementarity determining region 3 for antibody 47825
QQYGVLPRT

SEQ ID NO: 95650 - protein, 16 aa, Homo sapiens
  heavy chain complementarity determining region 3 for antibody 47825
ARLPPLGSENSLAFDL

SEQ ID NO: 95651 - protein, 9 aa, Homo sapiens
  light chain complementarity determining region 3 for antibody 47826
QQYGTSPWT

SEQ ID NO: 95652 - protein, 9 aa, Homo sapiens
  heavy chain complementarity determining region 3 for antibody 47826
ARGLDSWDF

SEQ ID NO: 95653 - protein, 9 aa, Homo sapiens
  light chain complementarity determining region 3 for antibody 47827
QQYGTSPWT

SEQ ID NO: 95654 - protein, 20 aa, Homo sapiens
  heavy chain complementarity determining region 3 for antibody 47827
AAARITMSEGLRGTYSGLDV

SEQ ID NO: 95655 - protein, 9 aa, Homo sapiens
  light chain complementarity determining region 3 for antibody 47828
QQYGTSPWG

SEQ ID NO: 95656 - protein, 22 aa, Homo sapiens
  heavy chain complementarity determining region 3 for antibody 47828
TRVSIGIYDTVNGYYHPGPMDS

SEQ ID NO: 95657 - protein, 9 aa, Homo sapiens
  light chain complementarity determining region 3 for antibody 47829
QQYGTSPVT

SEQ ID NO: 95658 - protein, 9 aa, Homo sapiens
  heavy chain complementarity determining region 3 for antibody 47829
ARGAGSLSY

SEQ ID NO: 95659 - protein, 11 aa, Homo sapiens
  light chain complementarity determining region 3 for antibody 47830
QQYGTSPRMYI

SEQ ID NO: 95660 - protein, 16 aa, Homo sapiens
  heavy chain complementarity determining region 3 for antibody 47830
ARVSSGYYGATDTFDI

SEQ ID NO: 95661 - protein, 9 aa, Homo sapiens
  light chain complementarity determining region 3 for antibody 47831
QQYGTSPPT

SEQ ID NO: 95662 - protein, 15 aa, Homo sapiens
  heavy chain complementarity determining region 3 for antibody 47831
VADYIDHSGFGHPDV

SEQ ID NO: 95663 - protein, 9 aa, Homo sapiens
  light chain complementarity determining region 3 for antibody 47832
QQYGTSPPT

SEQ ID NO: 95664 - protein, 19 aa, Homo sapiens
  heavy chain complementarity determining region 3 for antibody 47832
ARDIFGVLFRSPGVSWFDP

SEQ ID NO: 95665 - protein, 10 aa, Homo sapiens
  light chain complementarity determining region 3 for antibody 47833
QQYGTSPPPT

SEQ ID NO: 95666 - protein, 16 aa, Homo sapiens
  heavy chain complementarity determining region 3 for antibody 47833
ARPSAPAWTEINALDI

SEQ ID NO: 95667 - protein, 11 aa, Homo sapiens
  light chain complementarity determining region 3 for antibody 47834
QQYGTSPPGSS

SEQ ID NO: 95668 - protein, 12 aa, Homo sapiens
  heavy chain complementarity determining region 3 for antibody 47834
ATSSSHKRSFDE

SEQ ID NO: 95669 - protein, 9 aa, Homo sapiens
  light chain complementarity determining region 3 for antibody 47835
QQYGTSPLT

SEQ ID NO: 95670 - protein, 9 aa, Homo sapiens
  heavy chain complementarity determining region 3 for antibody 47835
ARGAGSLSY

SEQ ID NO: 95671 - protein, 9 aa, Homo sapiens
  light chain complementarity determining region 3 for antibody 47836
QQYGTSPLT

SEQ ID NO: 95672 - protein, 21 aa, Homo sapiens
  heavy chain complementarity determining region 3 for antibody 47836
AKDRHPLLFYFGSGSYYVPDH

SEQ ID NO: 95673 - protein, 9 aa, Homo sapiens
  light chain complementarity determining region 3 for antibody 47837
QQYGTSPGT

SEQ ID NO: 95674 - protein, 9 aa, Homo sapiens
  heavy chain complementarity determining region 3 for antibody 47837
FVTNGGDLK

SEQ ID NO: 95675 - protein, 9 aa, Homo sapiens
  light chain complementarity determining region 3 for antibody 47838
QQYGTSPGA

SEQ ID NO: 95676 - protein, 22 aa, Homo sapiens
  heavy chain complementarity determining region 3 for antibody 47838
TRVSIGIYDTVNGYYHPGPMDS

SEQ ID NO: 95677 - protein, 9 aa, Homo sapiens
  light chain complementarity determining region 3 for antibody 47839
QQYGTSPFT

SEQ ID NO: 95678 - protein, 14 aa, Homo sapiens
  heavy chain complementarity determining region 3 for antibody 47839
ARTWDYAPRGAFDL

SEQ ID NO: 95679 - protein, 9 aa, Homo sapiens
  light chain complementarity determining region 3 for antibody 47840
QQYGTSPFT

SEQ ID NO: 95680 - protein, 18 aa, Homo sapiens
  heavy chain complementarity determining region 3 for antibody 47840
ARGLYCIGTSCYSDWFDP

SEQ ID NO: 95681 - protein, 9 aa, Homo sapiens
  light chain complementarity determining region 3 for antibody 47841
QQYGTSPFT

SEQ ID NO: 95682 - protein, 17 aa, Homo sapiens
  heavy chain complementarity determining region 3 for antibody 47841
AKSSVWLTNYYYFGMDL

SEQ ID NO: 95683 - protein, 9 aa, Homo sapiens
  light chain complementarity determining region 3 for antibody 47842
QQYGTSPFP

SEQ ID NO: 95684 - protein, 17 aa, Homo sapiens
  heavy chain complementarity determining region 3 for antibody 47842
AKSSKWLNNYYYFGLDL

SEQ ID NO: 95685 - protein, 9 aa, Homo sapiens
  light chain complementarity determining region 3 for antibody 47843
QQYGTSPAP

SEQ ID NO: 95686 - protein, 23 aa, Homo sapiens
  heavy chain complementarity determining region 3 for antibody 47843
ARGGLVVVPPSTGYLYTYSPLDI

SEQ ID NO: 95687 - protein, 10 aa, Homo sapiens
  light chain complementarity determining region 3 for antibody 47844
QQYGTSLLYS

SEQ ID NO: 95688 - protein, 14 aa, Homo sapiens
  heavy chain complementarity determining region 3 for antibody 47844
TTDRPYPGMVTFDY

SEQ ID NO: 95689 - protein, 9 aa, Homo sapiens
  light chain complementarity determining region 3 for antibody 47845
QQYGTPPRT

SEQ ID NO: 95690 - protein, 14 aa, Homo sapiens
  heavy chain complementarity determining region 3 for antibody 47845
AKDPSDGGGGYFDS

SEQ ID NO: 95691 - protein, 9 aa, Homo sapiens
  light chain complementarity determining region 3 for antibody 47846
QQYGTPPRT

SEQ ID NO: 95692 - protein, 14 aa, Homo sapiens
  heavy chain complementarity determining region 3 for antibody 47846
AKAPSDDGGGYFDS

SEQ ID NO: 95693 - protein, 10 aa, Homo sapiens
  light chain complementarity determining region 3 for antibody 47847
QQYGTPPPYT

SEQ ID NO: 95694 - protein, 12 aa, Homo sapiens
  heavy chain complementarity determining region 3 for antibody 47847
ANEVGPAPAYDV

SEQ ID NO: 95695 - protein, 10 aa, Homo sapiens
  light chain complementarity determining region 3 for antibody 47848
QQYGTAPTYT

SEQ ID NO: 95696 - protein, 12 aa, Homo sapiens
  heavy chain complementarity determining region 3 for antibody 47848
ANEVGPAPAYDV

SEQ ID NO: 95697 - protein, 10 aa, Homo sapiens
  light chain complementarity determining region 3 for antibody 47849
QQYGTAPPYT

SEQ ID NO: 95698 - protein, 12 aa, Homo sapiens
  heavy chain complementarity determining region 3 for antibody 47849
ASEVGPAPAYDV

SEQ ID NO: 95699 - protein, 10 aa, Homo sapiens
  light chain complementarity determining region 3 for antibody 47850
QQYGTAPPYP

SEQ ID NO: 95700 - protein, 12 aa, Homo sapiens
  heavy chain complementarity determining region 3 for antibody 47850
ANEVGPAPAYDV

SEQ ID NO: 95701 - protein, 10 aa, Homo sapiens
  light chain complementarity determining region 3 for antibody 47851
QQYGTAPPHT

SEQ ID NO: 95702 - protein, 12 aa, Homo sapiens
  heavy chain complementarity determining region 3 for antibody 47851
ANEVGPAPAYDV

SEQ ID NO: 95703 - protein, 11 aa, Homo sapiens
  light chain complementarity determining region 3 for antibody 47852
QQYGTAPPGIA

SEQ ID NO: 95704 - protein, 12 aa, Homo sapiens
  heavy chain complementarity determining region 3 for antibody 47852
AKKIGNFDVFDV

SEQ ID NO: 95705 - protein, 10 aa, Homo sapiens
  light chain complementarity determining region 3 for antibody 47853
QQYGTAPPCT

SEQ ID NO: 95706 - protein, 12 aa, Homo sapiens
  heavy chain complementarity determining region 3 for antibody 47853
ANEVGPAPAYDV

SEQ ID NO: 95707 - protein, 9 aa, Homo sapiens
  light chain complementarity determining region 3 for antibody 47854
QQYGSYPLT

SEQ ID NO: 95708 - protein, 9 aa, Homo sapiens
  heavy chain complementarity determining region 3 for antibody 47854
ATRDGTSSF

SEQ ID NO: 95709 - protein, 9 aa, Homo sapiens
  light chain complementarity determining region 3 for antibody 47855
QQYGSWPGT

SEQ ID NO: 95710 - protein, 15 aa, Homo sapiens
  heavy chain complementarity determining region 3 for antibody 47855
ARDPHSGSYPIAFDI

SEQ ID NO: 95711 - protein, 9 aa, Homo sapiens
  light chain complementarity determining region 3 for antibody 47856
QQYGSTPLT

SEQ ID NO: 95712 - protein, 17 aa, Homo sapiens
  heavy chain complementarity determining region 3 for antibody 47856
ARDVPYTSRYHYWYFDL

SEQ ID NO: 95713 - protein, 9 aa, Homo sapiens
  light chain complementarity determining region 3 for antibody 47857
QQYGSTPLA

SEQ ID NO: 95714 - protein, 17 aa, Homo sapiens
  heavy chain complementarity determining region 3 for antibody 47857
AREGSYTSLYHYWYFDL

SEQ ID NO: 95715 - protein, 9 aa, Homo sapiens
  light chain complementarity determining region 3 for antibody 47858
QQYGSTEVT

SEQ ID NO: 95716 - protein, 16 aa, Homo sapiens
  heavy chain complementarity determining region 3 for antibody 47858
ARTPGIEAAEGWYFDL

SEQ ID NO: 95717 - protein, 9 aa, Homo sapiens
  light chain complementarity determining region 3 for antibody 47859
QQYGSTEFP

SEQ ID NO: 95718 - protein, 16 aa, Homo sapiens
  heavy chain complementarity determining region 3 for antibody 47859
ARTPGIEAAEGWYFDL

SEQ ID NO: 95719 - protein, 8 aa, Homo sapiens
  light chain complementarity determining region 3 for antibody 47860
QQYGSSWT

SEQ ID NO: 95720 - protein, 15 aa, Homo sapiens
  heavy chain complementarity determining region 3 for antibody 47860
ASSINPCGESMPLDY

SEQ ID NO: 95721 - protein, 9 aa, Homo sapiens
  light chain complementarity determining region 3 for antibody 47861
QQYGSSWST

SEQ ID NO: 95722 - protein, 7 aa, Homo sapiens
  heavy chain complementarity determining region 3 for antibody 47861
ASPYFDL

SEQ ID NO: 95723 - protein, 9 aa, Homo sapiens
  light chain complementarity determining region 3 for antibody 47862
QQYGSSVWK

SEQ ID NO: 95724 - protein, 16 aa, Homo sapiens
  heavy chain complementarity determining region 3 for antibody 47862
VRQGSWGVGVGWYVGY

SEQ ID NO: 95725 - protein, 9 aa, Homo sapiens
  light chain complementarity determining region 3 for antibody 47863
QQYGSSTFN

SEQ ID NO: 95726 - protein, 15 aa, Homo sapiens
  heavy chain complementarity determining region 3 for antibody 47863
ARRHSSSRHIKSIDY

SEQ ID NO: 95727 - protein, 9 aa, Homo sapiens
  light chain complementarity determining region 3 for antibody 47864
QQYGSSSWT

SEQ ID NO: 95728 - protein, 19 aa, Homo sapiens
  heavy chain complementarity determining region 3 for antibody 47864
ASRPATPRFLEWLPDASDI

SEQ ID NO: 95729 - protein, 9 aa, Homo sapiens
  light chain complementarity determining region 3 for antibody 47865
QQYGSSSVT

SEQ ID NO: 95730 - protein, 13 aa, Homo sapiens
  heavy chain complementarity determining region 3 for antibody 47865
VRLLSHRTLAGDY

SEQ ID NO: 95731 - protein, 9 aa, Homo sapiens
  light chain complementarity determining region 3 for antibody 47866
QQYGSSSST

SEQ ID NO: 95732 - protein, 7 aa, Homo sapiens
  heavy chain complementarity determining region 3 for antibody 47866
ASPYCDL

SEQ ID NO: 95733 - protein, 9 aa, Homo sapiens
  light chain complementarity determining region 3 for antibody 47867
QQYGSSSST

SEQ ID NO: 95734 - protein, 21 aa, Homo sapiens
  heavy chain complementarity determining region 3 for antibody 47867
ARDAPVSRPYSSTWYSSAFDY

SEQ ID NO: 95735 - protein, 9 aa, Homo sapiens
  light chain complementarity determining region 3 for antibody 47868
QQYGSSSLP

SEQ ID NO: 95736 - protein, 8 aa, Homo sapiens
  heavy chain complementarity determining region 3 for antibody 47868
VTMGTTVA

SEQ ID NO: 95737 - protein, 9 aa, Homo sapiens
  light chain complementarity determining region 3 for antibody 47869
QQYGSSSIT

SEQ ID NO: 95738 - protein, 13 aa, Homo sapiens
  heavy chain complementarity determining region 3 for antibody 47869
VSLLSHRTLAGDY

SEQ ID NO: 95739 - protein, 9 aa, Homo sapiens
  light chain complementarity determining region 3 for antibody 47870
QQYGSSSIT

SEQ ID NO: 95740 - protein, 21 aa, Homo sapiens
  heavy chain complementarity determining region 3 for antibody 47870
ARDAPVSRPYSSAWYSSAFDY

SEQ ID NO: 95741 - protein, 9 aa, Homo sapiens
  light chain complementarity determining region 3 for antibody 47871
QQYGSSSIP

SEQ ID NO: 95742 - protein, 13 aa, Homo sapiens
  heavy chain complementarity determining region 3 for antibody 47871
VRLLSHRTLAGDY

SEQ ID NO: 95743 - protein, 9 aa, Homo sapiens
  light chain complementarity determining region 3 for antibody 47872
QQYGSSSIP

SEQ ID NO: 95744 - protein, 13 aa, Homo sapiens
  heavy chain complementarity determining region 3 for antibody 47872
VKEFFMVFDAFDM

SEQ ID NO: 95745 - protein, 9 aa, Homo sapiens
  light chain complementarity determining region 3 for antibody 47873
QQYGSSSGT

SEQ ID NO: 95746 - protein, 11 aa, Homo sapiens
  heavy chain complementarity determining region 3 for antibody 47873
ASHWNRFDFAY

SEQ ID NO: 95747 - protein, 9 aa, Homo sapiens
  light chain complementarity determining region 3 for antibody 47874
QQYGSSSGT

SEQ ID NO: 95748 - protein, 19 aa, Homo sapiens
  heavy chain complementarity determining region 3 for antibody 47874
ARRPATPRFLEWLPDASDI

SEQ ID NO: 95749 - protein, 9 aa, Homo sapiens
  light chain complementarity determining region 3 for antibody 47875
QQYGSSSFT

SEQ ID NO: 95750 - protein, 13 aa, Homo sapiens
  heavy chain complementarity determining region 3 for antibody 47875
VKEFFLVFDAFDV

SEQ ID NO: 95751 - protein, 9 aa, Homo sapiens
  light chain complementarity determining region 3 for antibody 47876
QQYGSSRYT

SEQ ID NO: 95752 - protein, 20 aa, Homo sapiens
  heavy chain complementarity determining region 3 for antibody 47876
ARVGVVATATHYYYYYGMDV

SEQ ID NO: 95753 - protein, 8 aa, Homo sapiens
  light chain complementarity determining region 3 for antibody 47877
QQYGSSRN

SEQ ID NO: 95754 - protein, 21 aa, Homo sapiens
  heavy chain complementarity determining region 3 for antibody 47877
ARWKGQVSSDWDRGFYPPVDY

SEQ ID NO: 95755 - protein, 9 aa, Homo sapiens
  light chain complementarity determining region 3 for antibody 47878
QQYGSSRGT

SEQ ID NO: 95756 - protein, 18 aa, Homo sapiens
  heavy chain complementarity determining region 3 for antibody 47878
ARGPDHGSSDTVNYFFDL

SEQ ID NO: 95757 - protein, 9 aa, Homo sapiens
  light chain complementarity determining region 3 for antibody 47879
QQYGSSQWT

SEQ ID NO: 95758 - protein, 26 aa, Homo sapiens
  heavy chain complementarity determining region 3 for antibody 47879
ARDHVLGEYDDEDNIYSPGFPTGMDV

SEQ ID NO: 95759 - protein, 9 aa, Homo sapiens
  light chain complementarity determining region 3 for antibody 47880
QQYGSSQWP

SEQ ID NO: 95760 - protein, 24 aa, Homo sapiens
  heavy chain complementarity determining region 3 for antibody 47880
ARDRFLGEYDSDFYIPESANGMDV

SEQ ID NO: 95761 - protein, 9 aa, Homo sapiens
  light chain complementarity determining region 3 for antibody 47881
QQYGSSQLS

SEQ ID NO: 95762 - protein, 18 aa, Homo sapiens
  heavy chain complementarity determining region 3 for antibody 47881
ATILLWFGELLFHYYFDY

SEQ ID NO: 95763 - protein, 9 aa, Homo sapiens
  light chain complementarity determining region 3 for antibody 47882
QQYGSSPYT

SEQ ID NO: 95764 - protein, 15 aa, Homo sapiens
  heavy chain complementarity determining region 3 for antibody 47882
ARRFGLTWNDWYFDH

SEQ ID NO: 95765 - protein, 9 aa, Homo sapiens
  light chain complementarity determining region 3 for antibody 47883
QQYGSSPYP

SEQ ID NO: 95766 - protein, 15 aa, Homo sapiens
  heavy chain complementarity determining region 3 for antibody 47883
ATESGLGDCSYWFDT

SEQ ID NO: 95767 - protein, 9 aa, Homo sapiens
  light chain complementarity determining region 3 for antibody 47884
QQYGSSPYP

SEQ ID NO: 95768 - protein, 9 aa, Homo sapiens
  heavy chain complementarity determining region 3 for antibody 47884
ARGGVAMDV

SEQ ID NO: 95769 - protein, 9 aa, Homo sapiens
  light chain complementarity determining region 3 for antibody 47885
QQYGSSPWT

SEQ ID NO: 95770 - protein, 18 aa, Homo sapiens
  heavy chain complementarity determining region 3 for antibody 47885
ARSPDSDWLSSTPFCFDY

SEQ ID NO: 95771 - protein, 9 aa, Homo sapiens
  light chain complementarity determining region 3 for antibody 47886
QQYGSSPWT

SEQ ID NO: 95772 - protein, 17 aa, Homo sapiens
  heavy chain complementarity determining region 3 for antibody 47886
ARGGAYYDSSGCDQFDY

SEQ ID NO: 95773 - protein, 9 aa, Homo sapiens
  light chain complementarity determining region 3 for antibody 47887
QQYGSSPWT

SEQ ID NO: 95774 - protein, 11 aa, Homo sapiens
  heavy chain complementarity determining region 3 for antibody 47887
ARDAQCGWLDP

SEQ ID NO: 95775 - protein, 9 aa, Homo sapiens
  light chain complementarity determining region 3 for antibody 47888
QQYGSSPWT

SEQ ID NO: 95776 - protein, 13 aa, Homo sapiens
  heavy chain complementarity determining region 3 for antibody 47888
ARAESWSGRLFDY

SEQ ID NO: 95777 - protein, 9 aa, Homo sapiens
  light chain complementarity determining region 3 for antibody 47889
QQYGSSPWT

SEQ ID NO: 95778 - protein, 17 aa, Homo sapiens
  heavy chain complementarity determining region 3 for antibody 47889
AGGGAYYDSSGYDQFDY

SEQ ID NO: 95779 - protein, 9 aa, Homo sapiens
  light chain complementarity determining region 3 for antibody 47890
QQYGSSPWT

SEQ ID NO: 95780 - protein, 11 aa, Homo sapiens
  heavy chain complementarity determining region 3 for antibody 47890
AGAHRLEGFTR

SEQ ID NO: 95781 - protein, 9 aa, Homo sapiens
  light chain complementarity determining region 3 for antibody 47891
QQYGSSPWT

SEQ ID NO: 95782 - protein, 18 aa, Homo sapiens
  heavy chain complementarity determining region 3 for antibody 47891
ACAPAYGNYAGQNYGMDV

SEQ ID NO: 95783 - protein, 9 aa, Homo sapiens
  light chain complementarity determining region 3 for antibody 47892
QQYGSSPWP

SEQ ID NO: 95784 - protein, 17 aa, Homo sapiens
  heavy chain complementarity determining region 3 for antibody 47892
ARDDSGYGRRYLSAFDI

SEQ ID NO: 95785 - protein, 9 aa, Homo sapiens
  light chain complementarity determining region 3 for antibody 47893
QQYGSSPWP

SEQ ID NO: 95786 - protein, 18 aa, Homo sapiens
  heavy chain complementarity determining region 3 for antibody 47893
AHATRVPGTRAGIYYFDY

SEQ ID NO: 95787 - protein, 9 aa, Homo sapiens
  light chain complementarity determining region 3 for antibody 47894
QQYGSSPWK

SEQ ID NO: 95788 - protein, 17 aa, Homo sapiens
  heavy chain complementarity determining region 3 for antibody 47894
ARGGAYYDSSGYDQFDY

SEQ ID NO: 95789 - protein, 9 aa, Homo sapiens
  light chain complementarity determining region 3 for antibody 47895
QQYGSSPWA

SEQ ID NO: 95790 - protein, 17 aa, Homo sapiens
  heavy chain complementarity determining region 3 for antibody 47895
ARGGAYYDSSGYDQFDY

SEQ ID NO: 95791 - protein, 9 aa, Homo sapiens
  light chain complementarity determining region 3 for antibody 47896
QQYGSSPVT

SEQ ID NO: 95792 - protein, 14 aa, Homo sapiens
  heavy chain complementarity determining region 3 for antibody 47896
ARPEVYSSGWYGSV

SEQ ID NO: 95793 - protein, 9 aa, Homo sapiens
  light chain complementarity determining region 3 for antibody 47897
QQYGSSPVP

SEQ ID NO: 95794 - protein, 16 aa, Homo sapiens
  heavy chain complementarity determining region 3 for antibody 47897
ARHTVNGWAMVKIFDS

SEQ ID NO: 95795 - protein, 9 aa, Homo sapiens
  light chain complementarity determining region 3 for antibody 47898
QQYGSSPTT

SEQ ID NO: 95796 - protein, 18 aa, Homo sapiens
  heavy chain complementarity determining region 3 for antibody 47898
ARGGDRPGSGSYFSDFDY

SEQ ID NO: 95797 - protein, 10 aa, Homo sapiens
  light chain complementarity determining region 3 for antibody 47899
QQYGSSPSYT

SEQ ID NO: 95798 - protein, 15 aa, Homo sapiens
  heavy chain complementarity determining region 3 for antibody 47899
VKARHDYGDFVYFKE

SEQ ID NO: 95799 - protein, 10 aa, Homo sapiens
  light chain complementarity determining region 3 for antibody 47900
QQYGSSPSWT

SEQ ID NO: 95800 - protein, 14 aa, Homo sapiens
  heavy chain complementarity determining region 3 for antibody 47900
ARVHPNMMQIYFQH

SEQ ID NO: 95801 - protein, 9 aa, Homo sapiens
  light chain complementarity determining region 3 for antibody 47901
QQYGSSPST

SEQ ID NO: 95802 - protein, 15 aa, Homo sapiens
  heavy chain complementarity determining region 3 for antibody 47901
ATESGLGDCSYWFDT

SEQ ID NO: 95803 - protein, 9 aa, Homo sapiens
  light chain complementarity determining region 3 for antibody 47902
QQYGSSPST

SEQ ID NO: 95804 - protein, 15 aa, Homo sapiens
  heavy chain complementarity determining region 3 for antibody 47902
ARVLLVGFEEYYFDY

SEQ ID NO: 95805 - protein, 9 aa, Homo sapiens
  light chain complementarity determining region 3 for antibody 47903
QQYGSSPST

SEQ ID NO: 95806 - protein, 15 aa, Homo sapiens
  heavy chain complementarity determining region 3 for antibody 47903
AILSRDDFKQYYFDY

SEQ ID NO: 95807 - protein, 9 aa, Homo sapiens
  light chain complementarity determining region 3 for antibody 47904
QQYGSSPSS

SEQ ID NO: 95808 - protein, 15 aa, Homo sapiens
  heavy chain complementarity determining region 3 for antibody 47904
AGGIVRFLRVDAFDI

SEQ ID NO: 95809 - protein, 9 aa, Homo sapiens
  light chain complementarity determining region 3 for antibody 47905
QQYGSSPSP

SEQ ID NO: 95810 - protein, 18 aa, Homo sapiens
  heavy chain complementarity determining region 3 for antibody 47905
ASASLRSIFGINLYYFQS

SEQ ID NO: 95811 - protein, 10 aa, Homo sapiens
  light chain complementarity determining region 3 for antibody 47906
QQYGSSPRYS

SEQ ID NO: 95812 - protein, 16 aa, Homo sapiens
  heavy chain complementarity determining region 3 for antibody 47906
ARVMWVRGLMTPAFDY

SEQ ID NO: 95813 - protein, 10 aa, Homo sapiens
  light chain complementarity determining region 3 for antibody 47907
QQYGSSPRYP

SEQ ID NO: 95814 - protein, 17 aa, Homo sapiens
  heavy chain complementarity determining region 3 for antibody 47907
VKHQEASTNWVRYALDM

SEQ ID NO: 95815 - protein, 10 aa, Homo sapiens
  light chain complementarity determining region 3 for antibody 47908
QQYGSSPRWP

SEQ ID NO: 95816 - protein, 18 aa, Homo sapiens
  heavy chain complementarity determining region 3 for antibody 47908
ARCVNEGKCADSGHATNI

SEQ ID NO: 95817 - protein, 9 aa, Homo sapiens
  light chain complementarity determining region 3 for antibody 47909
QQYGSSPRT

SEQ ID NO: 95818 - protein, 14 aa, Homo sapiens
  heavy chain complementarity determining region 3 for antibody 47909
VRGIAVAGLGYFDY

SEQ ID NO: 95819 - protein, 9 aa, Homo sapiens
  light chain complementarity determining region 3 for antibody 47910
QQYGSSPRT

SEQ ID NO: 95820 - protein, 15 aa, Homo sapiens
  heavy chain complementarity determining region 3 for antibody 47910
VRDSNYYDSSGFFDY

SEQ ID NO: 95821 - protein, 9 aa, Homo sapiens
  light chain complementarity determining region 3 for antibody 47911
QQYGSSPRT

SEQ ID NO: 95822 - protein, 15 aa, Homo sapiens
  heavy chain complementarity determining region 3 for antibody 47911
ARGPPVVSLAGLFDF

SEQ ID NO: 95823 - protein, 9 aa, Homo sapiens
  light chain complementarity determining region 3 for antibody 47912
QQYGSSPRT

SEQ ID NO: 95824 - protein, 15 aa, Homo sapiens
  heavy chain complementarity determining region 3 for antibody 47912
ARGHDFWSGYYPFDS

SEQ ID NO: 95825 - protein, 9 aa, Homo sapiens
  light chain complementarity determining region 3 for antibody 47913
QQYGSSPRT

SEQ ID NO: 95826 - protein, 15 aa, Homo sapiens
  heavy chain complementarity determining region 3 for antibody 47913
AREDVWGSGSAGFDY

SEQ ID NO: 95827 - protein, 9 aa, Homo sapiens
  light chain complementarity determining region 3 for antibody 47914
QQYGSSPRT

SEQ ID NO: 95828 - protein, 17 aa, Homo sapiens
  heavy chain complementarity determining region 3 for antibody 47914
AKEMDCSGGTCYSVIDH

SEQ ID NO: 95829 - protein, 10 aa, Homo sapiens
  light chain complementarity determining region 3 for antibody 47915
QQYGSSPRRT

SEQ ID NO: 95830 - protein, 17 aa, Homo sapiens
  heavy chain complementarity determining region 3 for antibody 47915
ARDQRAAARYRRSWFDP

SEQ ID NO: 95831 - protein, 9 aa, Homo sapiens
  light chain complementarity determining region 3 for antibody 47916
QQYGSSPRP

SEQ ID NO: 95832 - protein, 17 aa, Homo sapiens
  heavy chain complementarity determining region 3 for antibody 47916
ARMASSDSSGYFGYFEL

SEQ ID NO: 95833 - protein, 9 aa, Homo sapiens
  light chain complementarity determining region 3 for antibody 47917
QQYGSSPRK

SEQ ID NO: 95834 - protein, 15 aa, Homo sapiens
  heavy chain complementarity determining region 3 for antibody 47917
ARVDSAMGGYYGMDV

SEQ ID NO: 95835 - protein, 10 aa, Homo sapiens
  light chain complementarity determining region 3 for antibody 47918
QQYGSSPRGT

SEQ ID NO: 95836 - protein, 18 aa, Homo sapiens
  heavy chain complementarity determining region 3 for antibody 47918
ARCVNEGKCADSGHATNI

SEQ ID NO: 95837 - protein, 9 aa, Homo sapiens
  light chain complementarity determining region 3 for antibody 47919
QQYGSSPRA

SEQ ID NO: 95838 - protein, 11 aa, Homo sapiens
  heavy chain complementarity determining region 3 for antibody 47919
ARGNFYYGIDV

SEQ ID NO: 95839 - protein, 9 aa, Homo sapiens
  light chain complementarity determining region 3 for antibody 47920
QQYGSSPQT

SEQ ID NO: 95840 - protein, 12 aa, Homo sapiens
  heavy chain complementarity determining region 3 for antibody 47920
ARNGYSSSWYRD

SEQ ID NO: 95841 - protein, 9 aa, Homo sapiens
  light chain complementarity determining region 3 for antibody 47921
QQYGSSPQT

SEQ ID NO: 95842 - protein, 12 aa, Homo sapiens
  heavy chain complementarity determining region 3 for antibody 47921
ARNGDSSSWYRN

SEQ ID NO: 95843 - protein, 9 aa, Homo sapiens
  light chain complementarity determining region 3 for antibody 47922
QQYGSSPQT

SEQ ID NO: 95844 - protein, 13 aa, Homo sapiens
  heavy chain complementarity determining region 3 for antibody 47922
ARLPDISGWPFDL

SEQ ID NO: 95845 - protein, 9 aa, Homo sapiens
  light chain complementarity determining region 3 for antibody 47923
QQYGSSPQP

SEQ ID NO: 95846 - protein, 12 aa, Homo sapiens
  heavy chain complementarity determining region 3 for antibody 47923
ARNGYSSSWYRN

SEQ ID NO: 95847 - protein, 10 aa, Homo sapiens
  light chain complementarity determining region 3 for antibody 47924
QQYGSSPQFT

SEQ ID NO: 95848 - protein, 16 aa, Homo sapiens
  heavy chain complementarity determining region 3 for antibody 47924
ARLFYSGATYSGAFDI

SEQ ID NO: 95849 - protein, 10 aa, Homo sapiens
  light chain complementarity determining region 3 for antibody 47925
QQYGSSPPWT

SEQ ID NO: 95850 - protein, 12 aa, Homo sapiens
  heavy chain complementarity determining region 3 for antibody 47925
ARSFRTVGGFDY

SEQ ID NO: 95851 - protein, 10 aa, Homo sapiens
  light chain complementarity determining region 3 for antibody 47926
QQYGSSPPWT

SEQ ID NO: 95852 - protein, 14 aa, Homo sapiens
  heavy chain complementarity determining region 3 for antibody 47926
ARGVNSGHYHQFDY

SEQ ID NO: 95853 - protein, 10 aa, Homo sapiens
  light chain complementarity determining region 3 for antibody 47927
QQYGSSPPWT

SEQ ID NO: 95854 - protein, 24 aa, Homo sapiens
  heavy chain complementarity determining region 3 for antibody 47927
ARDGLGTISGVPENLYYYCFALDV

SEQ ID NO: 95855 - protein, 10 aa, Homo sapiens
  light chain complementarity determining region 3 for antibody 47928
QQYGSSPPWR

SEQ ID NO: 95856 - protein, 14 aa, Homo sapiens
  heavy chain complementarity determining region 3 for antibody 47928
ARGGNSGHYHQFDY

SEQ ID NO: 95857 - protein, 12 aa, Homo sapiens
  light chain complementarity determining region 3 for antibody 47929
QQYGSSPPWPGR

SEQ ID NO: 95858 - protein, 14 aa, Homo sapiens
  heavy chain complementarity determining region 3 for antibody 47929
VRGGSSGYYHQLDY

SEQ ID NO: 95859 - protein, 10 aa, Homo sapiens
  light chain complementarity determining region 3 for antibody 47930
QQYGSSPPWP

SEQ ID NO: 95860 - protein, 24 aa, Homo sapiens
  heavy chain complementarity determining region 3 for antibody 47930
ARDGLGTISGVPENLYYYYFALDV

SEQ ID NO: 95861 - protein, 10 aa, Homo sapiens
  light chain complementarity determining region 3 for antibody 47931
QQYGSSPPVA

SEQ ID NO: 95862 - protein, 19 aa, Homo sapiens
  heavy chain complementarity determining region 3 for antibody 47931
VRDNYDYWSGRPSAGYFDY

SEQ ID NO: 95863 - protein, 9 aa, Homo sapiens
  light chain complementarity determining region 3 for antibody 47932
QQYGSSPPT

SEQ ID NO: 95864 - protein, 16 aa, Homo sapiens
  heavy chain complementarity determining region 3 for antibody 47932
VRDLPPRAASDTAYDV

SEQ ID NO: 95865 - protein, 9 aa, Homo sapiens
  light chain complementarity determining region 3 for antibody 47933
QQYGSSPPT

SEQ ID NO: 95866 - protein, 16 aa, Homo sapiens
  heavy chain complementarity determining region 3 for antibody 47933
VRDLPPMAASATAYDV

SEQ ID NO: 95867 - protein, 9 aa, Homo sapiens
  light chain complementarity determining region 3 for antibody 47934
QQYGSSPPT

SEQ ID NO: 95868 - protein, 16 aa, Homo sapiens
  heavy chain complementarity determining region 3 for antibody 47934
VRDLHPMAASDTAYDV

SEQ ID NO: 95869 - protein, 9 aa, Homo sapiens
  light chain complementarity determining region 3 for antibody 47935
QQYGSSPPT

SEQ ID NO: 95870 - protein, 16 aa, Homo sapiens
  heavy chain complementarity determining region 3 for antibody 47935
VRDLHPMAASDIAYDV

SEQ ID NO: 95871 - protein, 9 aa, Homo sapiens
  light chain complementarity determining region 3 for antibody 47936
QQYGSSPPT

SEQ ID NO: 95872 - protein, 13 aa, Homo sapiens
  heavy chain complementarity determining region 3 for antibody 47936
ASHRGYHFGYLDY

SEQ ID NO: 95873 - protein, 10 aa, Homo sapiens
  light chain complementarity determining region 3 for antibody 47937
QQYGSSPPRT

SEQ ID NO: 95874 - protein, 14 aa, Homo sapiens
  heavy chain complementarity determining region 3 for antibody 47937
ARGGNSGHYHQFDY

SEQ ID NO: 95875 - protein, 9 aa, Homo sapiens
  light chain complementarity determining region 3 for antibody 47938
QQYGSSPPN

SEQ ID NO: 95876 - protein, 14 aa, Homo sapiens
  heavy chain complementarity determining region 3 for antibody 47938
VRHAAPGRYDASDI

SEQ ID NO: 95877 - protein, 10 aa, Homo sapiens
  light chain complementarity determining region 3 for antibody 47939
QQYGSSPPNT

SEQ ID NO: 95878 - protein, 15 aa, Homo sapiens
  heavy chain complementarity determining region 3 for antibody 47939
ARAPGDYNLLSPLSD

SEQ ID NO: 95879 - protein, 11 aa, Homo sapiens
  light chain complementarity determining region 3 for antibody 47940
QQYGSSPPMYT

SEQ ID NO: 95880 - protein, 16 aa, Homo sapiens
  heavy chain complementarity determining region 3 for antibody 47940
VRVHGVYYYYYSGLGV

SEQ ID NO: 95881 - protein, 11 aa, Homo sapiens
  light chain complementarity determining region 3 for antibody 47941
QQYGSSPPMYP

SEQ ID NO: 95882 - protein, 11 aa, Homo sapiens
  heavy chain complementarity determining region 3 for antibody 47941
ARSDGAVAGGH

SEQ ID NO: 95883 - protein, 11 aa, Homo sapiens
  light chain complementarity determining region 3 for antibody 47942
QQYGSSPPMSP

SEQ ID NO: 95884 - protein, 11 aa, Homo sapiens
  heavy chain complementarity determining region 3 for antibody 47942
ARSDGAVAGGH

SEQ ID NO: 95885 - protein, 10 aa, Homo sapiens
  light chain complementarity determining region 3 for antibody 47943
QQYGSSPPMG

SEQ ID NO: 95886 - protein, 14 aa, Homo sapiens
  heavy chain complementarity determining region 3 for antibody 47943
ARELVVVVAEYFDY

SEQ ID NO: 95887 - protein, 11 aa, Homo sapiens
  light chain complementarity determining region 3 for antibody 47944
QQYGSSPPMDT

SEQ ID NO: 95888 - protein, 11 aa, Homo sapiens
  heavy chain complementarity determining region 3 for antibody 47944
ARSDGAVAGGH

SEQ ID NO: 95889 - protein, 10 aa, Homo sapiens
  light chain complementarity determining region 3 for antibody 47945
QQYGSSPPLT

SEQ ID NO: 95890 - protein, 22 aa, Homo sapiens
  heavy chain complementarity determining region 3 for antibody 47945
ARGAPDSYDTRNYYHGGRFIDS

SEQ ID NO: 95891 - protein, 10 aa, Homo sapiens
  light chain complementarity determining region 3 for antibody 47946
QQYGSSPPLT

SEQ ID NO: 95892 - protein, 14 aa, Homo sapiens
  heavy chain complementarity determining region 3 for antibody 47946
ARDPVETDMINFDY

SEQ ID NO: 95893 - protein, 11 aa, Homo sapiens
  light chain complementarity determining region 3 for antibody 47947
QQYGSSPPLSP

SEQ ID NO: 95894 - protein, 16 aa, Homo sapiens
  heavy chain complementarity determining region 3 for antibody 47947
VRVHGVYYYYYYGLGV

SEQ ID NO: 95895 - protein, 10 aa, Homo sapiens
  light chain complementarity determining region 3 for antibody 47948
QQYGSSPPIT

SEQ ID NO: 95896 - protein, 14 aa, Homo sapiens
  heavy chain complementarity determining region 3 for antibody 47948
ARDPVETDMSNFDY

SEQ ID NO: 95897 - protein, 10 aa, Homo sapiens
  light chain complementarity determining region 3 for antibody 47949
QQYGSSPPGT

SEQ ID NO: 95898 - protein, 14 aa, Homo sapiens
  heavy chain complementarity determining region 3 for antibody 47949
ATGGSSGYNQPFDS

SEQ ID NO: 95899 - protein, 10 aa, Homo sapiens
  light chain complementarity determining region 3 for antibody 47950
QQYGSSPPGT

SEQ ID NO: 95900 - protein, 14 aa, Homo sapiens
  heavy chain complementarity determining region 3 for antibody 47950
ARGGNSGHYHQFDY

SEQ ID NO: 95901 - protein, 10 aa, Homo sapiens
  light chain complementarity determining region 3 for antibody 47951
QQYGSSPPGT

SEQ ID NO: 95902 - protein, 24 aa, Homo sapiens
  heavy chain complementarity determining region 3 for antibody 47951
ARDGLGTISGVPENLYYYYFALDV

SEQ ID NO: 95903 - protein, 11 aa, Homo sapiens
  light chain complementarity determining region 3 for antibody 47952
QQYGSSPPGNT

SEQ ID NO: 95904 - protein, 25 aa, Homo sapiens
  heavy chain complementarity determining region 3 for antibody 47952
TKDKAREMATLNWGPKSYYYYGMDV

SEQ ID NO: 95905 - protein, 11 aa, Homo sapiens
  light chain complementarity determining region 3 for antibody 47953
QQYGSSPPGDT

SEQ ID NO: 95906 - protein, 16 aa, Homo sapiens
  heavy chain complementarity determining region 3 for antibody 47953
AKEYDFWSAYYSAVDY

SEQ ID NO: 95907 - protein, 8 aa, Homo sapiens
  light chain complementarity determining region 3 for antibody 47954
QQYGSSPP

SEQ ID NO: 95908 - protein, 14 aa, Homo sapiens
  heavy chain complementarity determining region 3 for antibody 47954
ARGAGRSSSLPFDY

SEQ ID NO: 95909 - protein, 10 aa, Homo sapiens
  light chain complementarity determining region 3 for antibody 47955
QQYGSSPPAP

SEQ ID NO: 95910 - protein, 11 aa, Homo sapiens
  heavy chain complementarity determining region 3 for antibody 47955
ARHGSEMELDS

SEQ ID NO: 95911 - protein, 8 aa, Homo sapiens
  light chain complementarity determining region 3 for antibody 47956
QQYGSSPP

SEQ ID NO: 95912 - protein, 13 aa, Homo sapiens
  heavy chain complementarity determining region 3 for antibody 47956
AKIGRIGVWYFDL

SEQ ID NO: 95913 - protein, 10 aa, Homo sapiens
  light chain complementarity determining region 3 for antibody 47957
QQYGSSPMYP

SEQ ID NO: 95914 - protein, 18 aa, Homo sapiens
  heavy chain complementarity determining region 3 for antibody 47957
ARDSDLDYESDGEDYLDY

SEQ ID NO: 95915 - protein, 10 aa, Homo sapiens
  light chain complementarity determining region 3 for antibody 47958
QQYGSSPMDT

SEQ ID NO: 95916 - protein, 21 aa, Homo sapiens
  heavy chain complementarity determining region 3 for antibody 47958
ARNQWLLTSDTSYYYYYAMDV

SEQ ID NO: 95917 - protein, 10 aa, Homo sapiens
  light chain complementarity determining region 3 for antibody 47959
QQYGSSPLWG

SEQ ID NO: 95918 - protein, 13 aa, Homo sapiens
  heavy chain complementarity determining region 3 for antibody 47959
TRGAVEPTTWVDF

SEQ ID NO: 95919 - protein, 9 aa, Homo sapiens
  light chain complementarity determining region 3 for antibody 47960
QQYGSSPLT

SEQ ID NO: 95920 - protein, 16 aa, Homo sapiens
  heavy chain complementarity determining region 3 for antibody 47960
TRGLPLVRGVISPMDV

SEQ ID NO: 95921 - protein, 9 aa, Homo sapiens
  light chain complementarity determining region 3 for antibody 47961
QQYGSSPLT

SEQ ID NO: 95922 - protein, 14 aa, Homo sapiens
  heavy chain complementarity determining region 3 for antibody 47961
SREAHTLGSSCFDS

SEQ ID NO: 95923 - protein, 9 aa, Homo sapiens
  light chain complementarity determining region 3 for antibody 47962
QQYGSSPLT

SEQ ID NO: 95924 - protein, 19 aa, Homo sapiens
  heavy chain complementarity determining region 3 for antibody 47962
ATVSTYPSGSLGILGAFDF

SEQ ID NO: 95925 - protein, 9 aa, Homo sapiens
  light chain complementarity determining region 3 for antibody 47963
QQYGSSPLT

SEQ ID NO: 95926 - protein, 21 aa, Homo sapiens
  heavy chain complementarity determining region 3 for antibody 47963
ARVGRQYCRGGSCYSEVAPDY

SEQ ID NO: 95927 - protein, 9 aa, Homo sapiens
  light chain complementarity determining region 3 for antibody 47964
QQYGSSPLT

SEQ ID NO: 95928 - protein, 17 aa, Homo sapiens
  heavy chain complementarity determining region 3 for antibody 47964
ARGGAYYDSSGYDQFDY

SEQ ID NO: 95929 - protein, 9 aa, Homo sapiens
  light chain complementarity determining region 3 for antibody 47965
QQYGSSPLT

SEQ ID NO: 95930 - protein, 10 aa, Homo sapiens
  heavy chain complementarity determining region 3 for antibody 47965
AMEFHSWFDS

SEQ ID NO: 95931 - protein, 9 aa, Homo sapiens
  light chain complementarity determining region 3 for antibody 47966
QQYGSSPLP

SEQ ID NO: 95932 - protein, 12 aa, Homo sapiens
  heavy chain complementarity determining region 3 for antibody 47966
ETLGLMVFADDY

SEQ ID NO: 95933 - protein, 9 aa, Homo sapiens
  light chain complementarity determining region 3 for antibody 47967
QQYGSSPLP

SEQ ID NO: 95934 - protein, 15 aa, Homo sapiens
  heavy chain complementarity determining region 3 for antibody 47967
ARYKTYCGGGCSFDD

SEQ ID NO: 95935 - protein, 9 aa, Homo sapiens
  light chain complementarity determining region 3 for antibody 47968
QQYGSSPLP

SEQ ID NO: 95936 - protein, 12 aa, Homo sapiens
  heavy chain complementarity determining region 3 for antibody 47968
ARHPDHHPAFDL

SEQ ID NO: 95937 - protein, 9 aa, Homo sapiens
  light chain complementarity determining region 3 for antibody 47969
QQYGSSPLP

SEQ ID NO: 95938 - protein, 15 aa, Homo sapiens
  heavy chain complementarity determining region 3 for antibody 47969
ARGHDFWSGYYPFDS

SEQ ID NO: 95939 - protein, 10 aa, Homo sapiens
  light chain complementarity determining region 3 for antibody 47970
QQYGSSPKYP

SEQ ID NO: 95940 - protein, 24 aa, Homo sapiens
  heavy chain complementarity determining region 3 for antibody 47970
ARDRGTGDSSGWYSSSYYYYAMDV

SEQ ID NO: 95941 - protein, 9 aa, Homo sapiens
  light chain complementarity determining region 3 for antibody 47971
QQYGSSPIT

SEQ ID NO: 95942 - protein, 15 aa, Homo sapiens
  heavy chain complementarity determining region 3 for antibody 47971
ARVLLVGFEEYSFDY

SEQ ID NO: 95943 - protein, 9 aa, Homo sapiens
  light chain complementarity determining region 3 for antibody 47972
QQYGSSPIT

SEQ ID NO: 95944 - protein, 13 aa, Homo sapiens
  heavy chain complementarity determining region 3 for antibody 47972
ARTQLGLGWYFDF

SEQ ID NO: 95945 - protein, 9 aa, Homo sapiens
  light chain complementarity determining region 3 for antibody 47973
QQYGSSPIP

SEQ ID NO: 95946 - protein, 15 aa, Homo sapiens
  heavy chain complementarity determining region 3 for antibody 47973
AREPRTSSGYMPSGY

SEQ ID NO: 95947 - protein, 9 aa, Homo sapiens
  light chain complementarity determining region 3 for antibody 47974
QQYGSSPIP

SEQ ID NO: 95948 - protein, 15 aa, Homo sapiens
  heavy chain complementarity determining region 3 for antibody 47974
ARDGFSSDWFGAFDI

SEQ ID NO: 95949 - protein, 9 aa, Homo sapiens
  light chain complementarity determining region 3 for antibody 47975
QQYGSSPGT

SEQ ID NO: 95950 - protein, 13 aa, Homo sapiens
  heavy chain complementarity determining region 3 for antibody 47975
ARVDILTGYHFDY

SEQ ID NO: 95951 - protein, 9 aa, Homo sapiens
  light chain complementarity determining region 3 for antibody 47976
QQYGSSPGT

SEQ ID NO: 95952 - protein, 15 aa, Homo sapiens
  heavy chain complementarity determining region 3 for antibody 47976
ARGLFPMEDASGSYT

SEQ ID NO: 95953 - protein, 9 aa, Homo sapiens
  light chain complementarity determining region 3 for antibody 47977
QQYGSSPGT

SEQ ID NO: 95954 - protein, 14 aa, Homo sapiens
  heavy chain complementarity determining region 3 for antibody 47977
ARGAGWLRDPSHDY

SEQ ID NO: 95955 - protein, 9 aa, Homo sapiens
  light chain complementarity determining region 3 for antibody 47978
QQYGSSPGT

SEQ ID NO: 95956 - protein, 11 aa, Homo sapiens
  heavy chain complementarity determining region 3 for antibody 47978
ARDRGSGWYAY

SEQ ID NO: 95957 - protein, 10 aa, Homo sapiens
  light chain complementarity determining region 3 for antibody 47979
QQYGSSPGRT

SEQ ID NO: 95958 - protein, 17 aa, Homo sapiens
  heavy chain complementarity determining region 3 for antibody 47979
ARGGDYGSFTAYSRIDH

SEQ ID NO: 95959 - protein, 10 aa, Homo sapiens
  light chain complementarity determining region 3 for antibody 47980
QQYGSSPGFT

SEQ ID NO: 95960 - protein, 16 aa, Homo sapiens
  heavy chain complementarity determining region 3 for antibody 47980
AKRDILTGSVGNWFDP

SEQ ID NO: 95961 - protein, 9 aa, Homo sapiens
  light chain complementarity determining region 3 for antibody 47981
QQYGSSPFT

SEQ ID NO: 95962 - protein, 16 aa, Homo sapiens
  heavy chain complementarity determining region 3 for antibody 47981
ATMYTSGWSDTSFFDH

SEQ ID NO: 95963 - protein, 9 aa, Homo sapiens
  light chain complementarity determining region 3 for antibody 47982
QQYGSSPFT

SEQ ID NO: 95964 - protein, 15 aa, Homo sapiens
  heavy chain complementarity determining region 3 for antibody 47982
ATESGLGDCSYWFDT

SEQ ID NO: 95965 - protein, 9 aa, Homo sapiens
  light chain complementarity determining region 3 for antibody 47983
QQYGSSPFT

SEQ ID NO: 95966 - protein, 18 aa, Homo sapiens
  heavy chain complementarity determining region 3 for antibody 47983
ARHLRRGSALGHFYAMDV

SEQ ID NO: 95967 - protein, 9 aa, Homo sapiens
  light chain complementarity determining region 3 for antibody 47984
QQYGSSPFT

SEQ ID NO: 95968 - protein, 20 aa, Homo sapiens
  heavy chain complementarity determining region 3 for antibody 47984
ARDDSRAGGHMSGWYGDLDS

SEQ ID NO: 95969 - protein, 9 aa, Homo sapiens
  light chain complementarity determining region 3 for antibody 47985
QQYGSSPFP

SEQ ID NO: 95970 - protein, 10 aa, Homo sapiens
  heavy chain complementarity determining region 3 for antibody 47985
LYMSDAWGEH

SEQ ID NO: 95971 - protein, 9 aa, Homo sapiens
  light chain complementarity determining region 3 for antibody 47986
QQYGSSPFP

SEQ ID NO: 95972 - protein, 12 aa, Homo sapiens
  heavy chain complementarity determining region 3 for antibody 47986
ARMLGFGSGLAY

SEQ ID NO: 95973 - protein, 9 aa, Homo sapiens
  light chain complementarity determining region 3 for antibody 47987
QQYGSSPFP

SEQ ID NO: 95974 - protein, 7 aa, Homo sapiens
  heavy chain complementarity determining region 3 for antibody 47987
ARGGSDY

SEQ ID NO: 95975 - protein, 9 aa, Homo sapiens
  light chain complementarity determining region 3 for antibody 47988
QQYGSSPFP

SEQ ID NO: 95976 - protein, 18 aa, Homo sapiens
  heavy chain complementarity determining region 3 for antibody 47988
AARGANCGGDCYYWYFDL

SEQ ID NO: 95977 - protein, 9 aa, Homo sapiens
  light chain complementarity determining region 3 for antibody 47989
QQYGSSPDT

SEQ ID NO: 95978 - protein, 16 aa, Homo sapiens
  heavy chain complementarity determining region 3 for antibody 47989
ARDQSGGWQRLGGFDP

SEQ ID NO: 95979 - protein, 10 aa, Homo sapiens
  light chain complementarity determining region 3 for antibody 47990
QQYGSSPALT

SEQ ID NO: 95980 - protein, 14 aa, Homo sapiens
  heavy chain complementarity determining region 3 for antibody 47990
ARGIDSSWPARFDL

SEQ ID NO: 95981 - protein, 10 aa, Homo sapiens
  light chain complementarity determining region 3 for antibody 47991
QQYGSSPAGT

SEQ ID NO: 95982 - protein, 12 aa, Homo sapiens
  heavy chain complementarity determining region 3 for antibody 47991
ARAQTTVTTADS

SEQ ID NO: 95983 - protein, 9 aa, Homo sapiens
  light chain complementarity determining region 3 for antibody 47992
QQYGSSLWT

SEQ ID NO: 95984 - protein, 16 aa, Homo sapiens
  heavy chain complementarity determining region 3 for antibody 47992
ARDFGVSRTENWYFDL

SEQ ID NO: 95985 - protein, 9 aa, Homo sapiens
  light chain complementarity determining region 3 for antibody 47993
QQYGSSLWP

SEQ ID NO: 95986 - protein, 13 aa, Homo sapiens
  heavy chain complementarity determining region 3 for antibody 47993
ARDDLLADNGFDY

SEQ ID NO: 95987 - protein, 8 aa, Homo sapiens
  light chain complementarity determining region 3 for antibody 47994
QQYGSSLS

SEQ ID NO: 95988 - protein, 15 aa, Homo sapiens
  heavy chain complementarity determining region 3 for antibody 47994
ARGYLSKWGSEYFQY

SEQ ID NO: 95989 - protein, 10 aa, Homo sapiens
  light chain complementarity determining region 3 for antibody 47995
QQYGSSLPIT

SEQ ID NO: 95990 - protein, 22 aa, Homo sapiens
  heavy chain complementarity determining region 3 for antibody 47995
AHRRLTLEFLETHPKTKNWFNP

SEQ ID NO: 95991 - protein, 9 aa, Homo sapiens
  light chain complementarity determining region 3 for antibody 47996
QQYGSSLGT

SEQ ID NO: 95992 - protein, 17 aa, Homo sapiens
  heavy chain complementarity determining region 3 for antibody 47996
VRDWRWYRGTFPYYFDE

SEQ ID NO: 95993 - protein, 9 aa, Homo sapiens
  light chain complementarity determining region 3 for antibody 47997
QQYGSSLCT

SEQ ID NO: 95994 - protein, 19 aa, Homo sapiens
  heavy chain complementarity determining region 3 for antibody 47997
ATGLGESGDYEGRGYTRDY

SEQ ID NO: 95995 - protein, 9 aa, Homo sapiens
  light chain complementarity determining region 3 for antibody 47998
QQYGSSGYP

SEQ ID NO: 95996 - protein, 17 aa, Homo sapiens
  heavy chain complementarity determining region 3 for antibody 47998
ARGWGYTYGFNPITFDS

SEQ ID NO: 95997 - protein, 8 aa, Homo sapiens
  light chain complementarity determining region 3 for antibody 47999
QQYGSSFT

SEQ ID NO: 95998 - protein, 18 aa, Homo sapiens
  heavy chain complementarity determining region 3 for antibody 47999
IRARSYVDTSGYHGAFDM

SEQ ID NO: 95999 - protein, 10 aa, Homo sapiens
  light chain complementarity determining region 3 for antibody 48000
QQYGSSFGDT

SEQ ID NO: 96000 - protein, 13 aa, Homo sapiens
  heavy chain complementarity determining region 3 for antibody 48000
ARGFYDTTGPFDY

SEQ ID NO: 96001 - protein, 8 aa, Homo sapiens
  light chain complementarity determining region 3 for antibody 48001
QQYGSSAT

SEQ ID NO: 96002 - protein, 13 aa, Homo sapiens
  heavy chain complementarity determining region 3 for antibody 48001
AKIFVVAQWCFDL

SEQ ID NO: 96003 - protein, 9 aa, Homo sapiens
  light chain complementarity determining region 3 for antibody 48002
QQYGSQRDT

SEQ ID NO: 96004 - protein, 17 aa, Homo sapiens
  heavy chain complementarity determining region 3 for antibody 48002
AKDIFFGIAVAGTAFDI

SEQ ID NO: 96005 - protein, 9 aa, Homo sapiens
  light chain complementarity determining region 3 for antibody 48003
QQYGSQPYP

SEQ ID NO: 96006 - protein, 13 aa, Homo sapiens
  heavy chain complementarity determining region 3 for antibody 48003
ARVAVPGMGYFQH

SEQ ID NO: 96007 - protein, 9 aa, Homo sapiens
  light chain complementarity determining region 3 for antibody 48004
QQYGSQPST

SEQ ID NO: 96008 - protein, 13 aa, Homo sapiens
  heavy chain complementarity determining region 3 for antibody 48004
ARVAVPGKGYFQH

SEQ ID NO: 96009 - protein, 9 aa, Homo sapiens
  light chain complementarity determining region 3 for antibody 48005
QQYGSPTFT

SEQ ID NO: 96010 - protein, 15 aa, Homo sapiens
  heavy chain complementarity determining region 3 for antibody 48005
ARRHSSSRHIKSIDY

SEQ ID NO: 96011 - protein, 9 aa, Homo sapiens
  light chain complementarity determining region 3 for antibody 48006
QQYGSPPYT

SEQ ID NO: 96012 - protein, 20 aa, Homo sapiens
  heavy chain complementarity determining region 3 for antibody 48006
ARGSHIVVVTSIGAAEYFQH

SEQ ID NO: 96013 - protein, 10 aa, Homo sapiens
  light chain complementarity determining region 3 for antibody 48007
QQYGSPPLLT

SEQ ID NO: 96014 - protein, 18 aa, Homo sapiens
  heavy chain complementarity determining region 3 for antibody 48007
AKAPPARSGYYRYWYFDL

SEQ ID NO: 96015 - protein, 9 aa, Homo sapiens
  light chain complementarity determining region 3 for antibody 48008
QQYGSPPKT

SEQ ID NO: 96016 - protein, 18 aa, Homo sapiens
  heavy chain complementarity determining region 3 for antibody 48008
ARGGDRPGSGSYFSDFDY

SEQ ID NO: 96017 - protein, 9 aa, Homo sapiens
  light chain complementarity determining region 3 for antibody 48009
QQYGSPPHT

SEQ ID NO: 96018 - protein, 13 aa, Homo sapiens
  heavy chain complementarity determining region 3 for antibody 48009
ARGGQSWDWYFDV

SEQ ID NO: 96019 - protein, 9 aa, Homo sapiens
  light chain complementarity determining region 3 for antibody 48010
QQYGSPLDT

SEQ ID NO: 96020 - protein, 17 aa, Homo sapiens
  heavy chain complementarity determining region 3 for antibody 48010
AKVLWSGDALHIGPFDF

SEQ ID NO: 96021 - protein, 9 aa, Homo sapiens
  light chain complementarity determining region 3 for antibody 48011
QQYGSLVKT

SEQ ID NO: 96022 - protein, 18 aa, Homo sapiens
  heavy chain complementarity determining region 3 for antibody 48011
TRDQYTSDWKERDEFFQH

SEQ ID NO: 96023 - protein, 9 aa, Homo sapiens
  light chain complementarity determining region 3 for antibody 48012
QQYGSLPWT

SEQ ID NO: 96024 - protein, 17 aa, Homo sapiens
  heavy chain complementarity determining region 3 for antibody 48012
ARGGGSGWWIQPDGFDI

SEQ ID NO: 96025 - protein, 9 aa, Homo sapiens
  light chain complementarity determining region 3 for antibody 48013
QQYGSLPWT

SEQ ID NO: 96026 - protein, 17 aa, Homo sapiens
  heavy chain complementarity determining region 3 for antibody 48013
ARGGAYYDSSGYDQFDY

SEQ ID NO: 96027 - protein, 9 aa, Homo sapiens
  light chain complementarity determining region 3 for antibody 48014
QQYGSLPST

SEQ ID NO: 96028 - protein, 18 aa, Homo sapiens
  heavy chain complementarity determining region 3 for antibody 48014
ASASLRSIFGINLYYFQS

SEQ ID NO: 96029 - protein, 9 aa, Homo sapiens
  light chain complementarity determining region 3 for antibody 48015
QQYGSLPRT

SEQ ID NO: 96030 - protein, 18 aa, Homo sapiens
  heavy chain complementarity determining region 3 for antibody 48015
ASYHIVVVVDADPDAFHI

SEQ ID NO: 96031 - protein, 9 aa, Homo sapiens
  light chain complementarity determining region 3 for antibody 48016
QQYGSLPRT

SEQ ID NO: 96032 - protein, 12 aa, Homo sapiens
  heavy chain complementarity determining region 3 for antibody 48016
ARNPYGSGSMGY

SEQ ID NO: 96033 - protein, 9 aa, Homo sapiens
  light chain complementarity determining region 3 for antibody 48017
QQYGSLPPT

SEQ ID NO: 96034 - protein, 15 aa, Homo sapiens
  heavy chain complementarity determining region 3 for antibody 48017
AHRPNYYDKAGAFDI

SEQ ID NO: 96035 - protein, 10 aa, Homo sapiens
  light chain complementarity determining region 3 for antibody 48018
QQYGSLPPGT

SEQ ID NO: 96036 - protein, 13 aa, Homo sapiens
  heavy chain complementarity determining region 3 for antibody 48018
ARKRGYSYGYLDY

SEQ ID NO: 96037 - protein, 9 aa, Homo sapiens
  light chain complementarity determining region 3 for antibody 48019
QQYGSLPIT

SEQ ID NO: 96038 - protein, 15 aa, Homo sapiens
  heavy chain complementarity determining region 3 for antibody 48019
AHRPNYYDKAGAFDI

SEQ ID NO: 96039 - protein, 8 aa, Homo sapiens
  light chain complementarity determining region 3 for antibody 48020
QQYGSLGT

SEQ ID NO: 96040 - protein, 13 aa, Homo sapiens
  heavy chain complementarity determining region 3 for antibody 48020
ARQPGYSSSWFDY

SEQ ID NO: 96041 - protein, 8 aa, Homo sapiens
  light chain complementarity determining region 3 for antibody 48021
QQYGSLFT

SEQ ID NO: 96042 - protein, 17 aa, Homo sapiens
  heavy chain complementarity determining region 3 for antibody 48021
AKDIFFGIAVAGTAFDI

SEQ ID NO: 96043 - protein, 8 aa, Homo sapiens
  light chain complementarity determining region 3 for antibody 48022
QQYGSKSP

SEQ ID NO: 96044 - protein, 18 aa, Homo sapiens
  heavy chain complementarity determining region 3 for antibody 48022
TRDGRGYGDSGFIWYFDL

SEQ ID NO: 96045 - protein, 9 aa, Homo sapiens
  light chain complementarity determining region 3 for antibody 48023
QQYGSHPTT

SEQ ID NO: 96046 - protein, 16 aa, Homo sapiens
  heavy chain complementarity determining region 3 for antibody 48023
ARQSDGSGYYSGTFDI

SEQ ID NO: 96047 - protein, 9 aa, Homo sapiens
  light chain complementarity determining region 3 for antibody 48024
QQYGSGGVT

SEQ ID NO: 96048 - protein, 15 aa, Homo sapiens
  heavy chain complementarity determining region 3 for antibody 48024
ARARLPDRMLYAFDV

SEQ ID NO: 96049 - protein, 9 aa, Homo sapiens
  light chain complementarity determining region 3 for antibody 48025
QQYGSFPYR

SEQ ID NO: 96050 - protein, 17 aa, Homo sapiens
  heavy chain complementarity determining region 3 for antibody 48025
AREAFDSDVDDFHGLDV

SEQ ID NO: 96051 - protein, 8 aa, Homo sapiens
  light chain complementarity determining region 3 for antibody 48026
QQYGSFFT

SEQ ID NO: 96052 - protein, 14 aa, Homo sapiens
  heavy chain complementarity determining region 3 for antibody 48026
ARHGHRSAWSYFDY

SEQ ID NO: 96053 - protein, 8 aa, Homo sapiens
  light chain complementarity determining region 3 for antibody 48027
QQYGSFFP

SEQ ID NO: 96054 - protein, 14 aa, Homo sapiens
  heavy chain complementarity determining region 3 for antibody 48027
ARHGHSSAWSYFDN

SEQ ID NO: 96055 - protein, 9 aa, Homo sapiens
  light chain complementarity determining region 3 for antibody 48028
QQYGSAPRT

SEQ ID NO: 96056 - protein, 12 aa, Homo sapiens
  heavy chain complementarity determining region 3 for antibody 48028
ARGTNPYDAFDI

SEQ ID NO: 96057 - protein, 9 aa, Homo sapiens
  light chain complementarity determining region 3 for antibody 48029
QQYGRSRRT

SEQ ID NO: 96058 - protein, 15 aa, Homo sapiens
  heavy chain complementarity determining region 3 for antibody 48029
AKDGEFCGSNCYFGS

SEQ ID NO: 96059 - protein, 9 aa, Homo sapiens
  light chain complementarity determining region 3 for antibody 48030
QQYGRSRGT

SEQ ID NO: 96060 - protein, 11 aa, Homo sapiens
  heavy chain complementarity determining region 3 for antibody 48030
AAVTMHDAFDL

SEQ ID NO: 96061 - protein, 9 aa, Homo sapiens
  light chain complementarity determining region 3 for antibody 48031
QQYGRSPWT

SEQ ID NO: 96062 - protein, 15 aa, Homo sapiens
  heavy chain complementarity determining region 3 for antibody 48031
AKDGEFCGSNCYFGS

SEQ ID NO: 96063 - protein, 9 aa, Homo sapiens
  light chain complementarity determining region 3 for antibody 48032
QQYGRSPWR

SEQ ID NO: 96064 - protein, 18 aa, Homo sapiens
  heavy chain complementarity determining region 3 for antibody 48032
ATMPSLAEPGRIYWYFDL

SEQ ID NO: 96065 - protein, 9 aa, Homo sapiens
  light chain complementarity determining region 3 for antibody 48033
QQYGRSPVT

SEQ ID NO: 96066 - protein, 18 aa, Homo sapiens
  heavy chain complementarity determining region 3 for antibody 48033
ARVVERCSGGKCHYVFDH

SEQ ID NO: 96067 - protein, 8 aa, Homo sapiens
  light chain complementarity determining region 3 for antibody 48034
QQYGRSPT

SEQ ID NO: 96068 - protein, 17 aa, Homo sapiens
  heavy chain complementarity determining region 3 for antibody 48034
ASIYDSTGYYYGGYFQH

SEQ ID NO: 96069 - protein, 8 aa, Homo sapiens
  light chain complementarity determining region 3 for antibody 48035
QQYGRSPT

SEQ ID NO: 96070 - protein, 14 aa, Homo sapiens
  heavy chain complementarity determining region 3 for antibody 48035
ARGAGRSSSLPFDY

SEQ ID NO: 96071 - protein, 10 aa, Homo sapiens
  light chain complementarity determining region 3 for antibody 48036
QQYGRSPSTT

SEQ ID NO: 96072 - protein, 15 aa, Homo sapiens
  heavy chain complementarity determining region 3 for antibody 48036
ARGALTAAALVYFDF

SEQ ID NO: 96073 - protein, 9 aa, Homo sapiens
  light chain complementarity determining region 3 for antibody 48037
QQYGRSPRT

SEQ ID NO: 96074 - protein, 15 aa, Homo sapiens
  heavy chain complementarity determining region 3 for antibody 48037
AKDWEFCGSNCYFGS

SEQ ID NO: 96075 - protein, 9 aa, Homo sapiens
  light chain complementarity determining region 3 for antibody 48038
QQYGRSPRT

SEQ ID NO: 96076 - protein, 15 aa, Homo sapiens
  heavy chain complementarity determining region 3 for antibody 48038
AKDGEFCGSNCYFGY

SEQ ID NO: 96077 - protein, 9 aa, Homo sapiens
  light chain complementarity determining region 3 for antibody 48039
QQYGRSPRT

SEQ ID NO: 96078 - protein, 15 aa, Homo sapiens
  heavy chain complementarity determining region 3 for antibody 48039
AKDGEFCGSNCYFDS

SEQ ID NO: 96079 - protein, 9 aa, Homo sapiens
  light chain complementarity determining region 3 for antibody 48040
QQYGRSPRT

SEQ ID NO: 96080 - protein, 15 aa, Homo sapiens
  heavy chain complementarity determining region 3 for antibody 48040
AKDGECCGSNCYFGS

SEQ ID NO: 96081 - protein, 10 aa, Homo sapiens
  light chain complementarity determining region 3 for antibody 48041
QQYGRSPPWT

SEQ ID NO: 96082 - protein, 17 aa, Homo sapiens
  heavy chain complementarity determining region 3 for antibody 48041
AKDIFFAIAVAGTAFDI

SEQ ID NO: 96083 - protein, 10 aa, Homo sapiens
  light chain complementarity determining region 3 for antibody 48042
QQYGRSPPIT

SEQ ID NO: 96084 - protein, 14 aa, Homo sapiens
  heavy chain complementarity determining region 3 for antibody 48042
ARDPVETDMINFDY

SEQ ID NO: 96085 - protein, 9 aa, Homo sapiens
  light chain complementarity determining region 3 for antibody 48043
QQYGRSPLT

SEQ ID NO: 96086 - protein, 16 aa, Homo sapiens
  heavy chain complementarity determining region 3 for antibody 48043
ARSSDYADDFDDAFDV

SEQ ID NO: 96087 - protein, 9 aa, Homo sapiens
  light chain complementarity determining region 3 for antibody 48044
QQYGRSPLT

SEQ ID NO: 96088 - protein, 15 aa, Homo sapiens
  heavy chain complementarity determining region 3 for antibody 48044
ARGHDFWSGYYPFDS

SEQ ID NO: 96089 - protein, 9 aa, Homo sapiens
  light chain complementarity determining region 3 for antibody 48045
QQYGRSPLT

SEQ ID NO: 96090 - protein, 15 aa, Homo sapiens
  heavy chain complementarity determining region 3 for antibody 48045
AKDGEFCGSNCYFGS

SEQ ID NO: 96091 - protein, 10 aa, Homo sapiens
  light chain complementarity determining region 3 for antibody 48046
QQYGRSPLIT

SEQ ID NO: 96092 - protein, 20 aa, Homo sapiens
  heavy chain complementarity determining region 3 for antibody 48046
AHSYAPVWGSYRYHYYGMDV

SEQ ID NO: 96093 - protein, 9 aa, Homo sapiens
  light chain complementarity determining region 3 for antibody 48047
QQYGRSPFT

SEQ ID NO: 96094 - protein, 15 aa, Homo sapiens
  heavy chain complementarity determining region 3 for antibody 48047
ARDPDCGSVSCYYAY

SEQ ID NO: 96095 - protein, 9 aa, Homo sapiens
  light chain complementarity determining region 3 for antibody 48048
QQYGRSPDT

SEQ ID NO: 96096 - protein, 12 aa, Homo sapiens
  heavy chain complementarity determining region 3 for antibody 48048
VKNYYASGRLDD

SEQ ID NO: 96097 - protein, 10 aa, Homo sapiens
  light chain complementarity determining region 3 for antibody 48049
QQYGRSPAIT

SEQ ID NO: 96098 - protein, 15 aa, Homo sapiens
  heavy chain complementarity determining region 3 for antibody 48049
ARGALTAAALVYFDF

SEQ ID NO: 96099 - protein, 8 aa, Homo sapiens
  light chain complementarity determining region 3 for antibody 48050
QQYGRSIT

SEQ ID NO: 96100 - protein, 14 aa, Homo sapiens
  heavy chain complementarity determining region 3 for antibody 48050
TRSPGGGGGGYSQH

SEQ ID NO: 96101 - protein, 8 aa, Homo sapiens
  light chain complementarity determining region 3 for antibody 48051
QQYGRSHT

SEQ ID NO: 96102 - protein, 11 aa, Homo sapiens
  heavy chain complementarity determining region 3 for antibody 48051
TTGGSYAPFDI

SEQ ID NO: 96103 - protein, 8 aa, Homo sapiens
  light chain complementarity determining region 3 for antibody 48052
QQYGRSFT

SEQ ID NO: 96104 - protein, 18 aa, Homo sapiens
  heavy chain complementarity determining region 3 for antibody 48052
IRARSYVDTSGYHGAFDR

SEQ ID NO: 96105 - protein, 9 aa, Homo sapiens
  light chain complementarity determining region 3 for antibody 48053
QQYGRSART

SEQ ID NO: 96106 - protein, 15 aa, Homo sapiens
  heavy chain complementarity determining region 3 for antibody 48053
ARLHSSSFGNHAFDI

SEQ ID NO: 96107 - protein, 9 aa, Homo sapiens
  light chain complementarity determining region 3 for antibody 48054
QQYGRPRVT

SEQ ID NO: 96108 - protein, 11 aa, Homo sapiens
  heavy chain complementarity determining region 3 for antibody 48054
AAVTMHDAFDL

SEQ ID NO: 96109 - protein, 10 aa, Homo sapiens
  light chain complementarity determining region 3 for antibody 48055
QQYGRPPSIT

SEQ ID NO: 96110 - protein, 15 aa, Homo sapiens
  heavy chain complementarity determining region 3 for antibody 48055
ARGALTAAALVYFDF

SEQ ID NO: 96111 - protein, 9 aa, Homo sapiens
  light chain complementarity determining region 3 for antibody 48056
QQYGRPPLI

SEQ ID NO: 96112 - protein, 15 aa, Homo sapiens
  heavy chain complementarity determining region 3 for antibody 48056
ARHMIQWGVFAPLDP

SEQ ID NO: 96113 - protein, 8 aa, Homo sapiens
  light chain complementarity determining region 3 for antibody 48057
QQYGRKSP

SEQ ID NO: 96114 - protein, 18 aa, Homo sapiens
  heavy chain complementarity determining region 3 for antibody 48057
TRDGRGYGDYGFIWYFDL

SEQ ID NO: 96115 - protein, 9 aa, Homo sapiens
  light chain complementarity determining region 3 for antibody 48058
QQYGRIVKT

SEQ ID NO: 96116 - protein, 18 aa, Homo sapiens
  heavy chain complementarity determining region 3 for antibody 48058
TRDQYTSDWKERDEFFQH

SEQ ID NO: 96117 - protein, 10 aa, Homo sapiens
  light chain complementarity determining region 3 for antibody 48059
QQYGREPPLT

SEQ ID NO: 96118 - protein, 9 aa, Homo sapiens
  heavy chain complementarity determining region 3 for antibody 48059
ARELGYCDD

SEQ ID NO: 96119 - protein, 9 aa, Homo sapiens
  light chain complementarity determining region 3 for antibody 48060
QQYGRAPQT

SEQ ID NO: 96120 - protein, 16 aa, Homo sapiens
  heavy chain complementarity determining region 3 for antibody 48060
ARGSPTVEDFSWPSDL

SEQ ID NO: 96121 - protein, 10 aa, Homo sapiens
  light chain complementarity determining region 3 for antibody 48061
QQYGRAPPPT

SEQ ID NO: 96122 - protein, 9 aa, Homo sapiens
  heavy chain complementarity determining region 3 for antibody 48061
ARELGYCDD

SEQ ID NO: 96123 - protein, 9 aa, Homo sapiens
  light chain complementarity determining region 3 for antibody 48062
QQYGRAPPD

SEQ ID NO: 96124 - protein, 14 aa, Homo sapiens
  heavy chain complementarity determining region 3 for antibody 48062
ARDHTMPHYWYFDL

SEQ ID NO: 96125 - protein, 8 aa, Homo sapiens
  light chain complementarity determining region 3 for antibody 48063
QQYGPSWT

SEQ ID NO: 96126 - protein, 21 aa, Homo sapiens
  heavy chain complementarity determining region 3 for antibody 48063
GRQRNFEGDSGFKFPEGYFDL

SEQ ID NO: 96127 - protein, 9 aa, Homo sapiens
  light chain complementarity determining region 3 for antibody 48064
QQYGPSPRP

SEQ ID NO: 96128 - protein, 14 aa, Homo sapiens
  heavy chain complementarity determining region 3 for antibody 48064
AREMPDPGAWYFDL

SEQ ID NO: 96129 - protein, 11 aa, Homo sapiens
  light chain complementarity determining region 3 for antibody 48065
QQYGPSGPGYT

SEQ ID NO: 96130 - protein, 13 aa, Homo sapiens
  heavy chain complementarity determining region 3 for antibody 48065
TIDYYNPSGDFDY

SEQ ID NO: 96131 - protein, 9 aa, Homo sapiens
  light chain complementarity determining region 3 for antibody 48066
QQYGNVPRR

SEQ ID NO: 96132 - protein, 8 aa, Homo sapiens
  heavy chain complementarity determining region 3 for antibody 48066
ARGEAVDC

SEQ ID NO: 96133 - protein, 8 aa, Homo sapiens
  light chain complementarity determining region 3 for antibody 48067
QQYGNTLT

SEQ ID NO: 96134 - protein, 20 aa, Homo sapiens
  heavy chain complementarity determining region 3 for antibody 48067
AREVDGPRKGQQVLRYYFDL

SEQ ID NO: 96135 - protein, 8 aa, Homo sapiens
  light chain complementarity determining region 3 for antibody 48068
QQYGNSRT

SEQ ID NO: 96136 - protein, 15 aa, Homo sapiens
  heavy chain complementarity determining region 3 for antibody 48068
AKTDDCSAANCPFDS

SEQ ID NO: 96137 - protein, 9 aa, Homo sapiens
  light chain complementarity determining region 3 for antibody 48069
QQYGNSRIT

SEQ ID NO: 96138 - protein, 9 aa, Homo sapiens
  heavy chain complementarity determining region 3 for antibody 48069
ARGNWNYEY

SEQ ID NO: 96139 - protein, 9 aa, Homo sapiens
  light chain complementarity determining region 3 for antibody 48070
QQYGNSRFT

SEQ ID NO: 96140 - protein, 9 aa, Homo sapiens
  heavy chain complementarity determining region 3 for antibody 48070
ARGNWNYGY

SEQ ID NO: 96141 - protein, 9 aa, Homo sapiens
  light chain complementarity determining region 3 for antibody 48071
QQYGNSPYT

SEQ ID NO: 96142 - protein, 19 aa, Homo sapiens
  heavy chain complementarity determining region 3 for antibody 48071
AHKEDYRSGTGTAVDAFDV

SEQ ID NO: 96143 - protein, 9 aa, Homo sapiens
  light chain complementarity determining region 3 for antibody 48072
QQYGNSPWT

SEQ ID NO: 96144 - protein, 21 aa, Homo sapiens
  heavy chain complementarity determining region 3 for antibody 48072
ASWRIVYDFSTGYHPAGPFDI

SEQ ID NO: 96145 - protein, 9 aa, Homo sapiens
  light chain complementarity determining region 3 for antibody 48073
QQYGNSPWT

SEQ ID NO: 96146 - protein, 11 aa, Homo sapiens
  heavy chain complementarity determining region 3 for antibody 48073
ARIDVTVGYDI

SEQ ID NO: 96147 - protein, 9 aa, Homo sapiens
  light chain complementarity determining region 3 for antibody 48074
QQYGNSPWT

SEQ ID NO: 96148 - protein, 18 aa, Homo sapiens
  heavy chain complementarity determining region 3 for antibody 48074
ARGGYGGNSGHHYYGMDV

SEQ ID NO: 96149 - protein, 9 aa, Homo sapiens
  light chain complementarity determining region 3 for antibody 48075
QQYGNSPWT

SEQ ID NO: 96150 - protein, 17 aa, Homo sapiens
  heavy chain complementarity determining region 3 for antibody 48075
ALAGVAVPGRIQWYFDL

SEQ ID NO: 96151 - protein, 9 aa, Homo sapiens
  light chain complementarity determining region 3 for antibody 48076
QQYGNSPWT

SEQ ID NO: 96152 - protein, 13 aa, Homo sapiens
  heavy chain complementarity determining region 3 for antibody 48076
AFSTADALDALDV

SEQ ID NO: 96153 - protein, 11 aa, Homo sapiens
  light chain complementarity determining region 3 for antibody 48077
QQYGNSPVMST

SEQ ID NO: 96154 - protein, 15 aa, Homo sapiens
  heavy chain complementarity determining region 3 for antibody 48077
AKDRLIAATSTPLDH

SEQ ID NO: 96155 - protein, 9 aa, Homo sapiens
  light chain complementarity determining region 3 for antibody 48078
QQYGNSPRP

SEQ ID NO: 96156 - protein, 23 aa, Homo sapiens
  heavy chain complementarity determining region 3 for antibody 48078
ARGRKLSSITMIRAVTLNSPLDY

SEQ ID NO: 96157 - protein, 9 aa, Homo sapiens
  light chain complementarity determining region 3 for antibody 48079
QQYGNSPRP

SEQ ID NO: 96158 - protein, 14 aa, Homo sapiens
  heavy chain complementarity determining region 3 for antibody 48079
ARDSGYYGTGSFFF

SEQ ID NO: 96159 - protein, 9 aa, Homo sapiens
  light chain complementarity determining region 3 for antibody 48080
QQYGNSPLT

SEQ ID NO: 96160 - protein, 17 aa, Homo sapiens
  heavy chain complementarity determining region 3 for antibody 48080
ALASVAVPGRIQWYFDL

SEQ ID NO: 96161 - protein, 9 aa, Homo sapiens
  light chain complementarity determining region 3 for antibody 48081
QQYGNSPLT

SEQ ID NO: 96162 - protein, 13 aa, Homo sapiens
  heavy chain complementarity determining region 3 for antibody 48081
AKHKSVYDGSGYI

SEQ ID NO: 96163 - protein, 9 aa, Homo sapiens
  light chain complementarity determining region 3 for antibody 48082
QQYGNSPLP

SEQ ID NO: 96164 - protein, 13 aa, Homo sapiens
  heavy chain complementarity determining region 3 for antibody 48082
AHSQWLVLDVFDF

SEQ ID NO: 96165 - protein, 10 aa, Homo sapiens
  light chain complementarity determining region 3 for antibody 48083
QQYGNSPLFT

SEQ ID NO: 96166 - protein, 11 aa, Homo sapiens
  heavy chain complementarity determining region 3 for antibody 48083
ARYRGASGTDY

SEQ ID NO: 96167 - protein, 9 aa, Homo sapiens
  light chain complementarity determining region 3 for antibody 48084
QQYGNSPFT

SEQ ID NO: 96168 - protein, 10 aa, Homo sapiens
  heavy chain complementarity determining region 3 for antibody 48084
ARDLGHAFDI

SEQ ID NO: 96169 - protein, 10 aa, Homo sapiens
  light chain complementarity determining region 3 for antibody 48085
QQYGNSPEGT

SEQ ID NO: 96170 - protein, 14 aa, Homo sapiens
  heavy chain complementarity determining region 3 for antibody 48085
ARKSIRGSWRGFDI

SEQ ID NO: 96171 - protein, 10 aa, Homo sapiens
  light chain complementarity determining region 3 for antibody 48086
QQYGNSPAPT

SEQ ID NO: 96172 - protein, 17 aa, Homo sapiens
  heavy chain complementarity determining region 3 for antibody 48086
ARESDLSSWSSYYGLEV

SEQ ID NO: 96173 - protein, 8 aa, Homo sapiens
  light chain complementarity determining region 3 for antibody 48087
QQYGNSDT

SEQ ID NO: 96174 - protein, 16 aa, Homo sapiens
  heavy chain complementarity determining region 3 for antibody 48087
SRHFLDYHGSGSYVQH

SEQ ID NO: 96175 - protein, 9 aa, Homo sapiens
  light chain complementarity determining region 3 for antibody 48088
QQYGNFPRT

SEQ ID NO: 96176 - protein, 22 aa, Homo sapiens
  heavy chain complementarity determining region 3 for antibody 48088
ARDPGPSLQFLEWLDGEDAFDI

SEQ ID NO: 96177 - protein, 9 aa, Homo sapiens
  light chain complementarity determining region 3 for antibody 48089
QQYGNEPRT

SEQ ID NO: 96178 - protein, 8 aa, Homo sapiens
  heavy chain complementarity determining region 3 for antibody 48089
ARGEAVDC

SEQ ID NO: 96179 - protein, 8 aa, Homo sapiens
  light chain complementarity determining region 3 for antibody 48090
QQYGLSLT

SEQ ID NO: 96180 - protein, 17 aa, Homo sapiens
  heavy chain complementarity determining region 3 for antibody 48090
ASIYDSTGYYYGGYFQH

SEQ ID NO: 96181 - protein, 9 aa, Homo sapiens
  light chain complementarity determining region 3 for antibody 48091
QQYGKSPLT

SEQ ID NO: 96182 - protein, 11 aa, Homo sapiens
  heavy chain complementarity determining region 3 for antibody 48091
AREGNYKPHDY

SEQ ID NO: 96183 - protein, 9 aa, Homo sapiens
  light chain complementarity determining region 3 for antibody 48092
QQYGISPIT

SEQ ID NO: 96184 - protein, 14 aa, Homo sapiens
  heavy chain complementarity determining region 3 for antibody 48092
ARVAVDTVPGEPGA

SEQ ID NO: 96185 - protein, 9 aa, Homo sapiens
  light chain complementarity determining region 3 for antibody 48093
QQYGISPIT

SEQ ID NO: 96186 - protein, 13 aa, Homo sapiens
  heavy chain complementarity determining region 3 for antibody 48093
ARTQLWLGWYFDF

SEQ ID NO: 96187 - protein, 9 aa, Homo sapiens
  light chain complementarity determining region 3 for antibody 48094
QQYGISPFT

SEQ ID NO: 96188 - protein, 12 aa, Homo sapiens
  heavy chain complementarity determining region 3 for antibody 48094
ARMLGFGSGLAY

SEQ ID NO: 96189 - protein, 9 aa, Homo sapiens
  light chain complementarity determining region 3 for antibody 48095
QQYGHSQYP

SEQ ID NO: 96190 - protein, 8 aa, Homo sapiens
  heavy chain complementarity determining region 3 for antibody 48095
ARARYFDY

SEQ ID NO: 96191 - protein, 9 aa, Homo sapiens
  light chain complementarity determining region 3 for antibody 48096
QQYGHSQSP

SEQ ID NO: 96192 - protein, 8 aa, Homo sapiens
  heavy chain complementarity determining region 3 for antibody 48096
ARARYFDY

SEQ ID NO: 96193 - protein, 9 aa, Homo sapiens
  light chain complementarity determining region 3 for antibody 48097
QQYGHSQDT

SEQ ID NO: 96194 - protein, 8 aa, Homo sapiens
  heavy chain complementarity determining region 3 for antibody 48097
ARARYFDY

SEQ ID NO: 96195 - protein, 9 aa, Homo sapiens
  light chain complementarity determining region 3 for antibody 48098
QQYGHSPGT

SEQ ID NO: 96196 - protein, 15 aa, Homo sapiens
  heavy chain complementarity determining region 3 for antibody 48098
AKVMTGHAIDCHFDY

SEQ ID NO: 96197 - protein, 9 aa, Homo sapiens
  light chain complementarity determining region 3 for antibody 48099
QQYGGSTRT

SEQ ID NO: 96198 - protein, 21 aa, Homo sapiens
  heavy chain complementarity determining region 3 for antibody 48099
ARDSNCVGGFCHSYYYYGMDA

SEQ ID NO: 96199 - protein, 9 aa, Homo sapiens
  light chain complementarity determining region 3 for antibody 48100
QQYGGSPYT

SEQ ID NO: 96200 - protein, 13 aa, Homo sapiens
  heavy chain complementarity determining region 3 for antibody 48100
ARAKGSGWLPPGH

SEQ ID NO: 96201 - protein, 10 aa, Homo sapiens
  light chain complementarity determining region 3 for antibody 48101
QQYGGSPTWT

SEQ ID NO: 96202 - protein, 14 aa, Homo sapiens
  heavy chain complementarity determining region 3 for antibody 48101
AKTSRLFEWLPLDY

SEQ ID NO: 96203 - protein, 10 aa, Homo sapiens
  light chain complementarity determining region 3 for antibody 48102
QQYGGSPTWR

SEQ ID NO: 96204 - protein, 17 aa, Homo sapiens
  heavy chain complementarity determining region 3 for antibody 48102
ARAPTGLYGNGYWYFGV

SEQ ID NO: 96205 - protein, 8 aa, Homo sapiens
  light chain complementarity determining region 3 for antibody 48103
QQYGGSPT

SEQ ID NO: 96206 - protein, 9 aa, Homo sapiens
  heavy chain complementarity determining region 3 for antibody 48103
ARWNEGSDY

SEQ ID NO: 96207 - protein, 10 aa, Homo sapiens
  light chain complementarity determining region 3 for antibody 48104
QQYGGSPRYS

SEQ ID NO: 96208 - protein, 10 aa, Homo sapiens
  heavy chain complementarity determining region 3 for antibody 48104
AASDTAQLRY

SEQ ID NO: 96209 - protein, 10 aa, Homo sapiens
  light chain complementarity determining region 3 for antibody 48105
QQYGGSPRYP

SEQ ID NO: 96210 - protein, 16 aa, Homo sapiens
  heavy chain complementarity determining region 3 for antibody 48105
ARVIWVRGLMTPAFDY

SEQ ID NO: 96211 - protein, 10 aa, Homo sapiens
  light chain complementarity determining region 3 for antibody 48106
QQYGGSPRTT

SEQ ID NO: 96212 - protein, 15 aa, Homo sapiens
  heavy chain complementarity determining region 3 for antibody 48106
ARLGWVRGDYGPIDY

SEQ ID NO: 96213 - protein, 9 aa, Homo sapiens
  light chain complementarity determining region 3 for antibody 48107
QQYGGSPRT

SEQ ID NO: 96214 - protein, 23 aa, Homo sapiens
  heavy chain complementarity determining region 3 for antibody 48107
AREWGTVTIPGTFDGVSPGSLKD

SEQ ID NO: 96215 - protein, 10 aa, Homo sapiens
  light chain complementarity determining region 3 for antibody 48108
QQYGGSPRSS

SEQ ID NO: 96216 - protein, 10 aa, Homo sapiens
  heavy chain complementarity determining region 3 for antibody 48108
AASDTAQFRY

SEQ ID NO: 96217 - protein, 10 aa, Homo sapiens
  light chain complementarity determining region 3 for antibody 48109
QQYGGSPRNS

SEQ ID NO: 96218 - protein, 10 aa, Homo sapiens
  heavy chain complementarity determining region 3 for antibody 48109
AASDTAQFRY

SEQ ID NO: 96219 - protein, 11 aa, Homo sapiens
  light chain complementarity determining region 3 for antibody 48110
QQYGGSPRMST

SEQ ID NO: 96220 - protein, 17 aa, Homo sapiens
  heavy chain complementarity determining region 3 for antibody 48110
AFWNGLDSGWFSGPLDY

SEQ ID NO: 96221 - protein, 11 aa, Homo sapiens
  light chain complementarity determining region 3 for antibody 48111
QQYGGSPRMSP

SEQ ID NO: 96222 - protein, 17 aa, Homo sapiens
  heavy chain complementarity determining region 3 for antibody 48111
AYWNGLDSGWFSGPLDY

SEQ ID NO: 96223 - protein, 10 aa, Homo sapiens
  light chain complementarity determining region 3 for antibody 48112
QQYGGSPRDS

SEQ ID NO: 96224 - protein, 10 aa, Homo sapiens
  heavy chain complementarity determining region 3 for antibody 48112
AASDTAQFRY

SEQ ID NO: 96225 - protein, 10 aa, Homo sapiens
  light chain complementarity determining region 3 for antibody 48113
QQYGGSPQYT

SEQ ID NO: 96226 - protein, 15 aa, Homo sapiens
  heavy chain complementarity determining region 3 for antibody 48113
ARDDRSASRWHSLDS

SEQ ID NO: 96227 - protein, 10 aa, Homo sapiens
  light chain complementarity determining region 3 for antibody 48114
QQYGGSPQYT

SEQ ID NO: 96228 - protein, 15 aa, Homo sapiens
  heavy chain complementarity determining region 3 for antibody 48114
ARDDRFATRFHSLDN

SEQ ID NO: 96229 - protein, 10 aa, Homo sapiens
  light chain complementarity determining region 3 for antibody 48115
QQYGGSPQYP

SEQ ID NO: 96230 - protein, 15 aa, Homo sapiens
  heavy chain complementarity determining region 3 for antibody 48115
ARDDRFASRWHSLDS

SEQ ID NO: 96231 - protein, 10 aa, Homo sapiens
  light chain complementarity determining region 3 for antibody 48116
QQYGGSPQYI

SEQ ID NO: 96232 - protein, 15 aa, Homo sapiens
  heavy chain complementarity determining region 3 for antibody 48116
ARDDRFASRWHSLDS

SEQ ID NO: 96233 - protein, 10 aa, Homo sapiens
  light chain complementarity determining region 3 for antibody 48117
QQYGGSPQNT

SEQ ID NO: 96234 - protein, 15 aa, Homo sapiens
  heavy chain complementarity determining region 3 for antibody 48117
ARDDRFATKFHSLDN

SEQ ID NO: 96235 - protein, 10 aa, Homo sapiens
  light chain complementarity determining region 3 for antibody 48118
QQYGGSPPYT

SEQ ID NO: 96236 - protein, 16 aa, Homo sapiens
  heavy chain complementarity determining region 3 for antibody 48118
VRVGTIFGLVRPYFDY

SEQ ID NO: 96237 - protein, 10 aa, Homo sapiens
  light chain complementarity determining region 3 for antibody 48119
QQYGGSPPYP

SEQ ID NO: 96238 - protein, 16 aa, Homo sapiens
  heavy chain complementarity determining region 3 for antibody 48119
VRVGTIFGLVRHYFDY

SEQ ID NO: 96239 - protein, 9 aa, Homo sapiens
  light chain complementarity determining region 3 for antibody 48120
QQYGGSPPT

SEQ ID NO: 96240 - protein, 15 aa, Homo sapiens
  heavy chain complementarity determining region 3 for antibody 48120
ARQPNYGDSSWYFDL

SEQ ID NO: 96241 - protein, 10 aa, Homo sapiens
  light chain complementarity determining region 3 for antibody 48121
QQYGGSPPGT

SEQ ID NO: 96242 - protein, 14 aa, Homo sapiens
  heavy chain complementarity determining region 3 for antibody 48121
ARGGNSTYYHQFDY

SEQ ID NO: 96243 - protein, 10 aa, Homo sapiens
  light chain complementarity determining region 3 for antibody 48122
QQYGGSPPGT

SEQ ID NO: 96244 - protein, 14 aa, Homo sapiens
  heavy chain complementarity determining region 3 for antibody 48122
AKTSRLFEWLPLDY

SEQ ID NO: 96245 - protein, 10 aa, Homo sapiens
  light chain complementarity determining region 3 for antibody 48123
QQYGGSPLYI

SEQ ID NO: 96246 - protein, 18 aa, Homo sapiens
  heavy chain complementarity determining region 3 for antibody 48123
ARDHGTALRTSNLRAFDI

SEQ ID NO: 96247 - protein, 10 aa, Homo sapiens
  light chain complementarity determining region 3 for antibody 48124
QQYGGSPLVT

SEQ ID NO: 96248 - protein, 21 aa, Homo sapiens
  heavy chain complementarity determining region 3 for antibody 48124
ARDSTVVRGAPSHVSYYCLDV

SEQ ID NO: 96249 - protein, 9 aa, Homo sapiens
  light chain complementarity determining region 3 for antibody 48125
QQYGGSPLT

SEQ ID NO: 96250 - protein, 19 aa, Homo sapiens
  heavy chain complementarity determining region 3 for antibody 48125
ATVSTYPSGSLGILGTFDF

SEQ ID NO: 96251 - protein, 9 aa, Homo sapiens
  light chain complementarity determining region 3 for antibody 48126
QQYGGSPLT

SEQ ID NO: 96252 - protein, 16 aa, Homo sapiens
  heavy chain complementarity determining region 3 for antibody 48126
ARISDYADDFDDAFDV

SEQ ID NO: 96253 - protein, 10 aa, Homo sapiens
  light chain complementarity determining region 3 for antibody 48127
QQYGGSPLGT

SEQ ID NO: 96254 - protein, 21 aa, Homo sapiens
  heavy chain complementarity determining region 3 for antibody 48127
ARDSTVVRGAPSHFSYYCLDV

SEQ ID NO: 96255 - protein, 10 aa, Homo sapiens
  light chain complementarity determining region 3 for antibody 48128
QQYGGSPLFP

SEQ ID NO: 96256 - protein, 16 aa, Homo sapiens
  heavy chain complementarity determining region 3 for antibody 48128
ARDPRYIASGSNGMDV

SEQ ID NO: 96257 - protein, 10 aa, Homo sapiens
  light chain complementarity determining region 3 for antibody 48129
QQYGGSPGNI

SEQ ID NO: 96258 - protein, 15 aa, Homo sapiens
  heavy chain complementarity determining region 3 for antibody 48129
ARLTWIRGDYGPIDY

SEQ ID NO: 96259 - protein, 10 aa, Homo sapiens
  light chain complementarity determining region 3 for antibody 48130
QQYGGSLSLS

SEQ ID NO: 96260 - protein, 17 aa, Homo sapiens
  heavy chain complementarity determining region 3 for antibody 48130
ARVALSEQWLVLWFFDL

SEQ ID NO: 96261 - protein, 10 aa, Homo sapiens
  light chain complementarity determining region 3 for antibody 48131
QQYGGSLSLP

SEQ ID NO: 96262 - protein, 17 aa, Homo sapiens
  heavy chain complementarity determining region 3 for antibody 48131
ARVDLSEQWLVLWFFDL

SEQ ID NO: 96263 - protein, 10 aa, Homo sapiens
  light chain complementarity determining region 3 for antibody 48132
QQYGGSIPLT

SEQ ID NO: 96264 - protein, 12 aa, Homo sapiens
  heavy chain complementarity determining region 3 for antibody 48132
MRVLDSRSAGYH

SEQ ID NO: 96265 - protein, 10 aa, Homo sapiens
  light chain complementarity determining region 3 for antibody 48133
QQYGGSHPYP

SEQ ID NO: 96266 - protein, 11 aa, Homo sapiens
  heavy chain complementarity determining region 3 for antibody 48133
ARGPSGGNFDY

SEQ ID NO: 96267 - protein, 8 aa, Homo sapiens
  light chain complementarity determining region 3 for antibody 48134
QQYGGRDT

SEQ ID NO: 96268 - protein, 18 aa, Homo sapiens
  heavy chain complementarity determining region 3 for antibody 48134
ARAPIIMMLGGGPHGMDV

SEQ ID NO: 96269 - protein, 10 aa, Homo sapiens
  light chain complementarity determining region 3 for antibody 48135
QQYGGPPPVT

SEQ ID NO: 96270 - protein, 17 aa, Homo sapiens
  heavy chain complementarity determining region 3 for antibody 48135
ARVQNYFNNSGWGDFDY

SEQ ID NO: 96271 - protein, 9 aa, Homo sapiens
  light chain complementarity determining region 3 for antibody 48136
QQYGGPPGT

SEQ ID NO: 96272 - protein, 16 aa, Homo sapiens
  heavy chain complementarity determining region 3 for antibody 48136
AKGDSTIDNYHYGMDV

SEQ ID NO: 96273 - protein, 9 aa, Homo sapiens
  light chain complementarity determining region 3 for antibody 48137
QQYGGLPST

SEQ ID NO: 96274 - protein, 11 aa, Homo sapiens
  heavy chain complementarity determining region 3 for antibody 48137
ARKPTGMAFDC

SEQ ID NO: 96275 - protein, 9 aa, Homo sapiens
  light chain complementarity determining region 3 for antibody 48138
QQYGGLPRT

SEQ ID NO: 96276 - protein, 10 aa, Homo sapiens
  heavy chain complementarity determining region 3 for antibody 48138
SSIAADGKGY

SEQ ID NO: 96277 - protein, 10 aa, Homo sapiens
  light chain complementarity determining region 3 for antibody 48139
QQYGGAPRYT

SEQ ID NO: 96278 - protein, 15 aa, Homo sapiens
  heavy chain complementarity determining region 3 for antibody 48139
ARLGWVRGDYGPIDY

SEQ ID NO: 96279 - protein, 9 aa, Homo sapiens
  light chain complementarity determining region 3 for antibody 48140
QQYGFSSRT

SEQ ID NO: 96280 - protein, 13 aa, Homo sapiens
  heavy chain complementarity determining region 3 for antibody 48140
AKTSHDFNDAFDV

SEQ ID NO: 96281 - protein, 9 aa, Homo sapiens
  light chain complementarity determining region 3 for antibody 48141
QQYGFPSWT

SEQ ID NO: 96282 - protein, 13 aa, Homo sapiens
  heavy chain complementarity determining region 3 for antibody 48141
AKTSHDFNDAFDV

SEQ ID NO: 96283 - protein, 6 aa, Homo sapiens
  light chain complementarity determining region 3 for antibody 48142
QQYGET

SEQ ID NO: 96284 - protein, 12 aa, Homo sapiens
  heavy chain complementarity determining region 3 for antibody 48142
ARDHSSGWPLSN

SEQ ID NO: 96285 - protein, 6 aa, Homo sapiens
  light chain complementarity determining region 3 for antibody 48143
QQYGET

SEQ ID NO: 96286 - protein, 12 aa, Homo sapiens
  heavy chain complementarity determining region 3 for antibody 48143
ARDHISGWSLSN

SEQ ID NO: 96287 - protein, 9 aa, Homo sapiens
  light chain complementarity determining region 3 for antibody 48144
QQYGESPWT

SEQ ID NO: 96288 - protein, 11 aa, Homo sapiens
  heavy chain complementarity determining region 3 for antibody 48144
ARIDVTVGYDI

SEQ ID NO: 96289 - protein, 8 aa, Homo sapiens
  light chain complementarity determining region 3 for antibody 48145
QQYGDVKP

SEQ ID NO: 96290 - protein, 10 aa, Homo sapiens
  heavy chain complementarity determining region 3 for antibody 48145
AREGLGGFDY

SEQ ID NO: 96291 - protein, 6 aa, Homo sapiens
  light chain complementarity determining region 3 for antibody 48146
QQYGDT

SEQ ID NO: 96292 - protein, 12 aa, Homo sapiens
  heavy chain complementarity determining region 3 for antibody 48146
ARDHSSGWSLSN

SEQ ID NO: 96293 - protein, 9 aa, Homo sapiens
  light chain complementarity determining region 3 for antibody 48147
QQYGDSPWT

SEQ ID NO: 96294 - protein, 11 aa, Homo sapiens
  heavy chain complementarity determining region 3 for antibody 48147
ARIDVTVGCDI

SEQ ID NO: 96295 - protein, 9 aa, Homo sapiens
  light chain complementarity determining region 3 for antibody 48148
QQYGDSPRT

SEQ ID NO: 96296 - protein, 13 aa, Homo sapiens
  heavy chain complementarity determining region 3 for antibody 48148
AREANIHSPAFDK

SEQ ID NO: 96297 - protein, 9 aa, Homo sapiens
  light chain complementarity determining region 3 for antibody 48149
QQYGDSPLT

SEQ ID NO: 96298 - protein, 12 aa, Homo sapiens
  heavy chain complementarity determining region 3 for antibody 48149
ASGSKGFGESHY

SEQ ID NO: 96299 - protein, 9 aa, Homo sapiens
  light chain complementarity determining region 3 for antibody 48150
QQYGDSPIT

SEQ ID NO: 96300 - protein, 17 aa, Homo sapiens
  heavy chain complementarity determining region 3 for antibody 48150
VRIGGASGLYVAEYFQH

SEQ ID NO: 96301 - protein, 9 aa, Homo sapiens
  light chain complementarity determining region 3 for antibody 48151
QQYGDSPGT

SEQ ID NO: 96302 - protein, 13 aa, Homo sapiens
  heavy chain complementarity determining region 3 for antibody 48151
AREANIHSPAFDK

SEQ ID NO: 96303 - protein, 8 aa, Homo sapiens
  light chain complementarity determining region 3 for antibody 48152
QQYGDSMT

SEQ ID NO: 96304 - protein, 16 aa, Homo sapiens
  heavy chain complementarity determining region 3 for antibody 48152
ARGLSIIRGVMSPFDL

SEQ ID NO: 96305 - protein, 9 aa, Homo sapiens
  light chain complementarity determining region 3 for antibody 48153
QQYGDSLRT

SEQ ID NO: 96306 - protein, 6 aa, Homo sapiens
  heavy chain complementarity determining region 3 for antibody 48153
VVDLSY

SEQ ID NO: 96307 - protein, 8 aa, Homo sapiens
  light chain complementarity determining region 3 for antibody 48154
QQYGDSFP

SEQ ID NO: 96308 - protein, 13 aa, Homo sapiens
  heavy chain complementarity determining region 3 for antibody 48154
ATESGSYQGAFDI

SEQ ID NO: 96309 - protein, 10 aa, Homo sapiens
  light chain complementarity determining region 3 for antibody 48155
QQYGCSPLVT

SEQ ID NO: 96310 - protein, 21 aa, Homo sapiens
  heavy chain complementarity determining region 3 for antibody 48155
ARDSTVVRGAPSHFSYYCLDV

SEQ ID NO: 96311 - protein, 9 aa, Homo sapiens
  light chain complementarity determining region 3 for antibody 48156
QQYGCSPLT

SEQ ID NO: 96312 - protein, 19 aa, Homo sapiens
  heavy chain complementarity determining region 3 for antibody 48156
ATVSTYPSGSLGILGTFDF

SEQ ID NO: 96313 - protein, 9 aa, Homo sapiens
  light chain complementarity determining region 3 for antibody 48157
QQYGASPRT

SEQ ID NO: 96314 - protein, 19 aa, Homo sapiens
  heavy chain complementarity determining region 3 for antibody 48157
AHAMSHILLGGTANSPLDF

SEQ ID NO: 96315 - protein, 11 aa, Homo sapiens
  light chain complementarity determining region 3 for antibody 48158
QQYGASPRRYP

SEQ ID NO: 96316 - protein, 17 aa, Homo sapiens
  heavy chain complementarity determining region 3 for antibody 48158
AIWFGRNSGWFSGPFDF

SEQ ID NO: 96317 - protein, 11 aa, Homo sapiens
  light chain complementarity determining region 3 for antibody 48159
QQYGASPRMNP

SEQ ID NO: 96318 - protein, 17 aa, Homo sapiens
  heavy chain complementarity determining region 3 for antibody 48159
AIWFGRNSGWFSGPFDF

SEQ ID NO: 96319 - protein, 9 aa, Homo sapiens
  light chain complementarity determining region 3 for antibody 48160
QQYGASPPT

SEQ ID NO: 96320 - protein, 26 aa, Homo sapiens
  heavy chain complementarity determining region 3 for antibody 48160
ASGPAFPFLEWVARGRPPVAPLYFDS

SEQ ID NO: 96321 - protein, 9 aa, Homo sapiens
  light chain complementarity determining region 3 for antibody 48161
QQYGASPLL

SEQ ID NO: 96322 - protein, 12 aa, Homo sapiens
  heavy chain complementarity determining region 3 for antibody 48161
ARMGGSYFAFLY

SEQ ID NO: 96323 - protein, 9 aa, Homo sapiens
  light chain complementarity determining region 3 for antibody 48162
QQYGASPLI

SEQ ID NO: 96324 - protein, 12 aa, Homo sapiens
  heavy chain complementarity determining region 3 for antibody 48162
ARMGGSYFAFHY

SEQ ID NO: 96325 - protein, 9 aa, Homo sapiens
  light chain complementarity determining region 3 for antibody 48163
QQYFTTSGT

SEQ ID NO: 96326 - protein, 11 aa, Homo sapiens
  heavy chain complementarity determining region 3 for antibody 48163
TTGGSYAPFDV

SEQ ID NO: 96327 - protein, 10 aa, Homo sapiens
  light chain complementarity determining region 3 for antibody 48164
QQYFTTPPWT

SEQ ID NO: 96328 - protein, 11 aa, Homo sapiens
  heavy chain complementarity determining region 3 for antibody 48164
ARHGPHSANDC

SEQ ID NO: 96329 - protein, 8 aa, Homo sapiens
  light chain complementarity determining region 3 for antibody 48165
QQYFTLSR

SEQ ID NO: 96330 - protein, 18 aa, Homo sapiens
  heavy chain complementarity determining region 3 for antibody 48165
ATRADNCGGDCYYWYFDL

SEQ ID NO: 96331 - protein, 9 aa, Homo sapiens
  light chain complementarity determining region 3 for antibody 48166
QQYFSYPYT

SEQ ID NO: 96332 - protein, 21 aa, Homo sapiens
  heavy chain complementarity determining region 3 for antibody 48166
YTVGVIPDYCTPPACDIQWAY

SEQ ID NO: 96333 - protein, 9 aa, Homo sapiens
  light chain complementarity determining region 3 for antibody 48167
QQYFSYPYT

SEQ ID NO: 96334 - protein, 14 aa, Homo sapiens
  heavy chain complementarity determining region 3 for antibody 48167
TTGQDLLFYHGVDV

SEQ ID NO: 96335 - protein, 9 aa, Homo sapiens
  light chain complementarity determining region 3 for antibody 48168
QQYFSAPVT

SEQ ID NO: 96336 - protein, 13 aa, Homo sapiens
  heavy chain complementarity determining region 3 for antibody 48168
ARRKDGYNYCFDY

SEQ ID NO: 96337 - protein, 9 aa, Homo sapiens
  light chain complementarity determining region 3 for antibody 48169
QQYFRSPWT

SEQ ID NO: 96338 - protein, 14 aa, Homo sapiens
  heavy chain complementarity determining region 3 for antibody 48169
ARVFIGTAAVLFDI

SEQ ID NO: 96339 - protein, 9 aa, Homo sapiens
  light chain complementarity determining region 3 for antibody 48170
QQYFRSPGT

SEQ ID NO: 96340 - protein, 14 aa, Homo sapiens
  heavy chain complementarity determining region 3 for antibody 48170
ARVFIGTAAVLFDI

SEQ ID NO: 96341 - protein, 9 aa, Homo sapiens
  light chain complementarity determining region 3 for antibody 48171
QQYFNTPCT

SEQ ID NO: 96342 - protein, 13 aa, Homo sapiens
  heavy chain complementarity determining region 3 for antibody 48171
ARAAGLGSNTFDL

SEQ ID NO: 96343 - protein, 9 aa, Homo sapiens
  light chain complementarity determining region 3 for antibody 48172
QQYFDPPYT

SEQ ID NO: 96344 - protein, 9 aa, Homo sapiens
  heavy chain complementarity determining region 3 for antibody 48172
ARDTRAIDF

SEQ ID NO: 96345 - protein, 9 aa, Homo sapiens
  light chain complementarity determining region 3 for antibody 48173
QQYEYLPVP

SEQ ID NO: 96346 - protein, 15 aa, Homo sapiens
  heavy chain complementarity determining region 3 for antibody 48173
TRVRETYYYDSNGDY

SEQ ID NO: 96347 - protein, 10 aa, Homo sapiens
  light chain complementarity determining region 3 for antibody 48174
QQYETYSEDT

SEQ ID NO: 96348 - protein, 18 aa, Homo sapiens
  heavy chain complementarity determining region 3 for antibody 48174
ARGKGGRGSAWFPYYFDN

SEQ ID NO: 96349 - protein, 9 aa, Homo sapiens
  light chain complementarity determining region 3 for antibody 48175
QQYETYPFP

SEQ ID NO: 96350 - protein, 13 aa, Homo sapiens
  heavy chain complementarity determining region 3 for antibody 48175
ARGSSAIIVGHNF

SEQ ID NO: 96351 - protein, 9 aa, Homo sapiens
  light chain complementarity determining region 3 for antibody 48176
QQYESLPPT

SEQ ID NO: 96352 - protein, 12 aa, Homo sapiens
  heavy chain complementarity determining region 3 for antibody 48176
VRDRVAGDAFDP

SEQ ID NO: 96353 - protein, 9 aa, Homo sapiens
  light chain complementarity determining region 3 for antibody 48177
QQYENLPIT

SEQ ID NO: 96354 - protein, 12 aa, Homo sapiens
  heavy chain complementarity determining region 3 for antibody 48177
TAFYPGAGYFHH

SEQ ID NO: 96355 - protein, 9 aa, Homo sapiens
  light chain complementarity determining region 3 for antibody 48178
QQYENFPLT

SEQ ID NO: 96356 - protein, 13 aa, Homo sapiens
  heavy chain complementarity determining region 3 for antibody 48178
ARDVSHGSSSSDL

SEQ ID NO: 96357 - protein, 9 aa, Homo sapiens
  light chain complementarity determining region 3 for antibody 48179
QQYENFPIT

SEQ ID NO: 96358 - protein, 10 aa, Homo sapiens
  heavy chain complementarity determining region 3 for antibody 48179
AKATSDLIDF

SEQ ID NO: 96359 - protein, 9 aa, Homo sapiens
  light chain complementarity determining region 3 for antibody 48180
QQYEKDPPA

SEQ ID NO: 96360 - protein, 18 aa, Homo sapiens
  heavy chain complementarity determining region 3 for antibody 48180
ARSHTVVVSYYYYYAMDV

SEQ ID NO: 96361 - protein, 9 aa, Homo sapiens
  light chain complementarity determining region 3 for antibody 48181
QQYEGLPYT

SEQ ID NO: 96362 - protein, 15 aa, Homo sapiens
  heavy chain complementarity determining region 3 for antibody 48181
LRASYYSDSRGATHH

SEQ ID NO: 96363 - protein, 9 aa, Homo sapiens
  light chain complementarity determining region 3 for antibody 48182
QQYEGLPYT

SEQ ID NO: 96364 - protein, 15 aa, Homo sapiens
  heavy chain complementarity determining region 3 for antibody 48182
LRASYYSDSRGAPQQ

SEQ ID NO: 96365 - protein, 9 aa, Homo sapiens
  light chain complementarity determining region 3 for antibody 48183
QQYEASPGT

SEQ ID NO: 96366 - protein, 19 aa, Homo sapiens
  heavy chain complementarity determining region 3 for antibody 48183
ARLNHHYSPESRYKGWLDT

SEQ ID NO: 96367 - protein, 10 aa, Homo sapiens
  light chain complementarity determining region 3 for antibody 48184
QQYDYLPALT

SEQ ID NO: 96368 - protein, 11 aa, Homo sapiens
  heavy chain complementarity determining region 3 for antibody 48184
ARGNFYYGIDV

SEQ ID NO: 96369 - protein, 8 aa, Homo sapiens
  light chain complementarity determining region 3 for antibody 48185
QQYDYIPA

SEQ ID NO: 96370 - protein, 12 aa, Homo sapiens
  heavy chain complementarity determining region 3 for antibody 48185
ARSNWNIIAFDL

SEQ ID NO: 96371 - protein, 8 aa, Homo sapiens
  light chain complementarity determining region 3 for antibody 48186
QQYDYFPA

SEQ ID NO: 96372 - protein, 12 aa, Homo sapiens
  heavy chain complementarity determining region 3 for antibody 48186
ARSNWNIIAFDL

SEQ ID NO: 96373 - protein, 10 aa, Homo sapiens
  light chain complementarity determining region 3 for antibody 48187
QQYDVLRGNT

SEQ ID NO: 96374 - protein, 11 aa, Homo sapiens
  heavy chain complementarity determining region 3 for antibody 48187
AAVTMHDAFDL

SEQ ID NO: 96375 - protein, 9 aa, Homo sapiens
  light chain complementarity determining region 3 for antibody 48188
QQYDVFPRT

SEQ ID NO: 96376 - protein, 16 aa, Homo sapiens
  heavy chain complementarity determining region 3 for antibody 48188
AKGRRVKSAYDCPFDH

SEQ ID NO: 96377 - protein, 9 aa, Homo sapiens
  light chain complementarity determining region 3 for antibody 48189
QQYDTYSWT

SEQ ID NO: 96378 - protein, 16 aa, Homo sapiens
  heavy chain complementarity determining region 3 for antibody 48189
ASLGGAHYYGSGSHYF

SEQ ID NO: 96379 - protein, 9 aa, Homo sapiens
  light chain complementarity determining region 3 for antibody 48190
QQYDTYSVT

SEQ ID NO: 96380 - protein, 21 aa, Homo sapiens
  heavy chain complementarity determining region 3 for antibody 48190
ARVRGAVVVEQDDTDPDVFAI

SEQ ID NO: 96381 - protein, 9 aa, Homo sapiens
  light chain complementarity determining region 3 for antibody 48191
QQYDTYLGT

SEQ ID NO: 96382 - protein, 14 aa, Homo sapiens
  heavy chain complementarity determining region 3 for antibody 48191
ASSYIAGAGTYFDF

SEQ ID NO: 96383 - protein, 8 aa, Homo sapiens
  light chain complementarity determining region 3 for antibody 48192
QQYDTWPS

SEQ ID NO: 96384 - protein, 12 aa, Homo sapiens
  heavy chain complementarity determining region 3 for antibody 48192
ARGDRDYDAFDV

SEQ ID NO: 96385 - protein, 9 aa, Homo sapiens
  light chain complementarity determining region 3 for antibody 48193
QQYDTSPWT

SEQ ID NO: 96386 - protein, 16 aa, Homo sapiens
  heavy chain complementarity determining region 3 for antibody 48193
TTIYYNYYESPDVFDL

SEQ ID NO: 96387 - protein, 9 aa, Homo sapiens
  light chain complementarity determining region 3 for antibody 48194
QQYDTSPRP

SEQ ID NO: 96388 - protein, 13 aa, Homo sapiens
  heavy chain complementarity determining region 3 for antibody 48194
AREVGSGWYYFDY

SEQ ID NO: 96389 - protein, 11 aa, Homo sapiens
  light chain complementarity determining region 3 for antibody 48195
QQYDTSPPSLT

SEQ ID NO: 96390 - protein, 14 aa, Homo sapiens
  heavy chain complementarity determining region 3 for antibody 48195
ARSYDTSGYSALDY

SEQ ID NO: 96391 - protein, 11 aa, Homo sapiens
  light chain complementarity determining region 3 for antibody 48196
QQYDTSPPSLP

SEQ ID NO: 96392 - protein, 14 aa, Homo sapiens
  heavy chain complementarity determining region 3 for antibody 48196
ARSYDTSGYSALDY

SEQ ID NO: 96393 - protein, 11 aa, Homo sapiens
  light chain complementarity determining region 3 for antibody 48197
QQYDTSPPGNP

SEQ ID NO: 96394 - protein, 14 aa, Homo sapiens
  heavy chain complementarity determining region 3 for antibody 48197
ARETSNSRKRSFDQ

SEQ ID NO: 96395 - protein, 11 aa, Homo sapiens
  light chain complementarity determining region 3 for antibody 48198
QQYDTSPPGHT

SEQ ID NO: 96396 - protein, 14 aa, Homo sapiens
  heavy chain complementarity determining region 3 for antibody 48198
ARETSNSRKRSFDQ

SEQ ID NO: 96397 - protein, 11 aa, Homo sapiens
  light chain complementarity determining region 3 for antibody 48199
QQYDTSPPGDP

SEQ ID NO: 96398 - protein, 14 aa, Homo sapiens
  heavy chain complementarity determining region 3 for antibody 48199
ARETSNSRKRSFDQ

SEQ ID NO: 96399 - protein, 9 aa, Homo sapiens
  light chain complementarity determining region 3 for antibody 48200
QQYDTSPLA

SEQ ID NO: 96400 - protein, 18 aa, Homo sapiens
  heavy chain complementarity determining region 3 for antibody 48200
ARPGYCTGGSCYFGAFDI

SEQ ID NO: 96401 - protein, 9 aa, Homo sapiens
  light chain complementarity determining region 3 for antibody 48201
QQYDTSPGT

SEQ ID NO: 96402 - protein, 16 aa, Homo sapiens
  heavy chain complementarity determining region 3 for antibody 48201
ARLSGGWGSAPHFFDT

SEQ ID NO: 96403 - protein, 9 aa, Homo sapiens
  light chain complementarity determining region 3 for antibody 48202
QQYDTSPET

SEQ ID NO: 96404 - protein, 14 aa, Homo sapiens
  heavy chain complementarity determining region 3 for antibody 48202
AGKKQMVQYFGLGV

SEQ ID NO: 96405 - protein, 9 aa, Homo sapiens
  light chain complementarity determining region 3 for antibody 48203
QQYDTPPWT

SEQ ID NO: 96406 - protein, 13 aa, Homo sapiens
  heavy chain complementarity determining region 3 for antibody 48203
ARETRIHLPAFEY

SEQ ID NO: 96407 - protein, 8 aa, Homo sapiens
  light chain complementarity determining region 3 for antibody 48204
QQYDTNSS

SEQ ID NO: 96408 - protein, 16 aa, Homo sapiens
  heavy chain complementarity determining region 3 for antibody 48204
ARVISKWESILDAFKI

SEQ ID NO: 96409 - protein, 8 aa, Homo sapiens
  light chain complementarity determining region 3 for antibody 48205
QQYDTNSS

SEQ ID NO: 96410 - protein, 16 aa, Homo sapiens
  heavy chain complementarity determining region 3 for antibody 48205
ARVISKWEAILDAFKM

SEQ ID NO: 96411 - protein, 8 aa, Homo sapiens
  light chain complementarity determining region 3 for antibody 48206
QQYDTNPS

SEQ ID NO: 96412 - protein, 16 aa, Homo sapiens
  heavy chain complementarity determining region 3 for antibody 48206
ARVISKWESILDAFKM

SEQ ID NO: 96413 - protein, 8 aa, Homo sapiens
  light chain complementarity determining region 3 for antibody 48207
QQYDTNFS

SEQ ID NO: 96414 - protein, 16 aa, Homo sapiens
  heavy chain complementarity determining region 3 for antibody 48207
ARVISKWESILDAFKM

SEQ ID NO: 96415 - protein, 10 aa, Homo sapiens
  light chain complementarity determining region 3 for antibody 48208
QQYDTLVRST

SEQ ID NO: 96416 - protein, 13 aa, Homo sapiens
  heavy chain complementarity determining region 3 for antibody 48208
ARTVAGTLFAFDP

SEQ ID NO: 96417 - protein, 8 aa, Homo sapiens
  light chain complementarity determining region 3 for antibody 48209
QQYDTIIT

SEQ ID NO: 96418 - protein, 14 aa, Homo sapiens
  heavy chain complementarity determining region 3 for antibody 48209
ARARGRQLFGLMPY

SEQ ID NO: 96419 - protein, 9 aa, Homo sapiens
  light chain complementarity determining region 3 for antibody 48210
QQYDTFPWT

SEQ ID NO: 96420 - protein, 19 aa, Homo sapiens
  heavy chain complementarity determining region 3 for antibody 48210
SRMRVTVSRGVYQHDAFDI

SEQ ID NO: 96421 - protein, 9 aa, Homo sapiens
  light chain complementarity determining region 3 for antibody 48211
QQYDTFPLP

SEQ ID NO: 96422 - protein, 14 aa, Homo sapiens
  heavy chain complementarity determining region 3 for antibody 48211
AKAFGTTPADFFDS

SEQ ID NO: 96423 - protein, 9 aa, Homo sapiens
  light chain complementarity determining region 3 for antibody 48212
QQYDSYPYT

SEQ ID NO: 96424 - protein, 24 aa, Homo sapiens
  heavy chain complementarity determining region 3 for antibody 48212
ARRKPYYEAVWGRSRYFREPVFDR

SEQ ID NO: 96425 - protein, 9 aa, Homo sapiens
  light chain complementarity determining region 3 for antibody 48213
QQYDSYPYT

SEQ ID NO: 96426 - protein, 18 aa, Homo sapiens
  heavy chain complementarity determining region 3 for antibody 48213
ARGEFCSTTRCPNDAFDL

SEQ ID NO: 96427 - protein, 9 aa, Homo sapiens
  light chain complementarity determining region 3 for antibody 48214
QQYDSYPWT

SEQ ID NO: 96428 - protein, 13 aa, Homo sapiens
  heavy chain complementarity determining region 3 for antibody 48214
VRQSSGSIKAVDV

SEQ ID NO: 96429 - protein, 9 aa, Homo sapiens
  light chain complementarity determining region 3 for antibody 48215
QQYDSYPWT

SEQ ID NO: 96430 - protein, 16 aa, Homo sapiens
  heavy chain complementarity determining region 3 for antibody 48215
ARVAVDGYNYVGYFDY

SEQ ID NO: 96431 - protein, 9 aa, Homo sapiens
  light chain complementarity determining region 3 for antibody 48216
QQYDSYPPT

SEQ ID NO: 96432 - protein, 16 aa, Homo sapiens
  heavy chain complementarity determining region 3 for antibody 48216
ARGGGYSCGQWYYFDY

SEQ ID NO: 96433 - protein, 9 aa, Homo sapiens
  light chain complementarity determining region 3 for antibody 48217
QQYDSYPLT

SEQ ID NO: 96434 - protein, 14 aa, Homo sapiens
  heavy chain complementarity determining region 3 for antibody 48217
ARGAFGDHRGLLAN

SEQ ID NO: 96435 - protein, 9 aa, Homo sapiens
  light chain complementarity determining region 3 for antibody 48218
QQYDSYPIT

SEQ ID NO: 96436 - protein, 16 aa, Homo sapiens
  heavy chain complementarity determining region 3 for antibody 48218
VRAHRDVGSWYRYFDL

SEQ ID NO: 96437 - protein, 9 aa, Homo sapiens
  light chain complementarity determining region 3 for antibody 48219
QQYDSYPFT

SEQ ID NO: 96438 - protein, 16 aa, Homo sapiens
  heavy chain complementarity determining region 3 for antibody 48219
AKVQPRYSLNYSPFDH

SEQ ID NO: 96439 - protein, 9 aa, Homo sapiens
  light chain complementarity determining region 3 for antibody 48220
QQYDSYLWT

SEQ ID NO: 96440 - protein, 17 aa, Homo sapiens
  heavy chain complementarity determining region 3 for antibody 48220
TTHLETNSGTYYHLLDY

SEQ ID NO: 96441 - protein, 9 aa, Homo sapiens
  light chain complementarity determining region 3 for antibody 48221
QQYDSSSYP

SEQ ID NO: 96442 - protein, 13 aa, Homo sapiens
  heavy chain complementarity determining region 3 for antibody 48221
VRQPIAAAGVIDH

SEQ ID NO: 96443 - protein, 9 aa, Homo sapiens
  light chain complementarity determining region 3 for antibody 48222
QQYDSSPWT

SEQ ID NO: 96444 - protein, 18 aa, Homo sapiens
  heavy chain complementarity determining region 3 for antibody 48222
ARPSHRHGSGWPDWFFDL

SEQ ID NO: 96445 - protein, 9 aa, Homo sapiens
  light chain complementarity determining region 3 for antibody 48223
QQYDSSPRS

SEQ ID NO: 96446 - protein, 16 aa, Homo sapiens
  heavy chain complementarity determining region 3 for antibody 48223
ARIKVDSSSWYSSLDY

SEQ ID NO: 96447 - protein, 10 aa, Homo sapiens
  light chain complementarity determining region 3 for antibody 48224
QQYDSSPPPT

SEQ ID NO: 96448 - protein, 16 aa, Homo sapiens
  heavy chain complementarity determining region 3 for antibody 48224
ATDISYGSEMGYYFDY

SEQ ID NO: 96449 - protein, 10 aa, Homo sapiens
  light chain complementarity determining region 3 for antibody 48225
QQYDSSPPLP

SEQ ID NO: 96450 - protein, 16 aa, Homo sapiens
  heavy chain complementarity determining region 3 for antibody 48225
ATDISYGSEMGYYFDY

SEQ ID NO: 96451 - protein, 9 aa, Homo sapiens
  light chain complementarity determining region 3 for antibody 48226
QQYDSSPLP

SEQ ID NO: 96452 - protein, 18 aa, Homo sapiens
  heavy chain complementarity determining region 3 for antibody 48226
ARSSGYSGYDPSLDALDV

SEQ ID NO: 96453 - protein, 9 aa, Homo sapiens
  light chain complementarity determining region 3 for antibody 48227
QQYDSSPGT

SEQ ID NO: 96454 - protein, 12 aa, Homo sapiens
  heavy chain complementarity determining region 3 for antibody 48227
ARGLRLGWGLDY

SEQ ID NO: 96455 - protein, 9 aa, Homo sapiens
  light chain complementarity determining region 3 for antibody 48228
QQYDSSLVT

SEQ ID NO: 96456 - protein, 16 aa, Homo sapiens
  heavy chain complementarity determining region 3 for antibody 48228
ARGLPLVRGVFSPMDV

SEQ ID NO: 96457 - protein, 9 aa, Homo sapiens
  light chain complementarity determining region 3 for antibody 48229
QQYDSPSYA

SEQ ID NO: 96458 - protein, 13 aa, Homo sapiens
  heavy chain complementarity determining region 3 for antibody 48229
ARDGDHSVYDLDY

SEQ ID NO: 96459 - protein, 9 aa, Homo sapiens
  light chain complementarity determining region 3 for antibody 48230
QQYDSPPFT

SEQ ID NO: 96460 - protein, 17 aa, Homo sapiens
  heavy chain complementarity determining region 3 for antibody 48230
AKDVHSRQGYYYYGMDV

SEQ ID NO: 96461 - protein, 7 aa, Homo sapiens
  light chain complementarity determining region 3 for antibody 48231
QQYDSLT

SEQ ID NO: 96462 - protein, 15 aa, Homo sapiens
  heavy chain complementarity determining region 3 for antibody 48231
ARIRMAVVLRDAFDI

SEQ ID NO: 96463 - protein, 9 aa, Homo sapiens
  light chain complementarity determining region 3 for antibody 48232
QQYDSLPYT

SEQ ID NO: 96464 - protein, 16 aa, Homo sapiens
  heavy chain complementarity determining region 3 for antibody 48232
ARPPNTIFGLVRGFDP

SEQ ID NO: 96465 - protein, 9 aa, Homo sapiens
  light chain complementarity determining region 3 for antibody 48233
QQYDSLPWT

SEQ ID NO: 96466 - protein, 12 aa, Homo sapiens
  heavy chain complementarity determining region 3 for antibody 48233
ARGLRLGWGLDY

SEQ ID NO: 96467 - protein, 9 aa, Homo sapiens
  light chain complementarity determining region 3 for antibody 48234
QQYDSLPLT

SEQ ID NO: 96468 - protein, 12 aa, Homo sapiens
  heavy chain complementarity determining region 3 for antibody 48234
ARVGIAARHFDY

SEQ ID NO: 96469 - protein, 9 aa, Homo sapiens
  light chain complementarity determining region 3 for antibody 48235
QQYDSLPLP

SEQ ID NO: 96470 - protein, 18 aa, Homo sapiens
  heavy chain complementarity determining region 3 for antibody 48235
ARDPARGGGWSYYHGMDV

SEQ ID NO: 96471 - protein, 9 aa, Homo sapiens
  light chain complementarity determining region 3 for antibody 48236
QQYDSIPYT

SEQ ID NO: 96472 - protein, 16 aa, Homo sapiens
  heavy chain complementarity determining region 3 for antibody 48236
ARHPNTIFGLVRGFDP

SEQ ID NO: 96473 - protein, 9 aa, Homo sapiens
  light chain complementarity determining region 3 for antibody 48237
QQYDSFPYT

SEQ ID NO: 96474 - protein, 17 aa, Homo sapiens
  heavy chain complementarity determining region 3 for antibody 48237
AREDYDSDVDEYRGLDV

SEQ ID NO: 96475 - protein, 9 aa, Homo sapiens
  light chain complementarity determining region 3 for antibody 48238
QQYDRSSGT

SEQ ID NO: 96476 - protein, 15 aa, Homo sapiens
  heavy chain complementarity determining region 3 for antibody 48238
VRAQVIWGQLYYFDY

SEQ ID NO: 96477 - protein, 9 aa, Homo sapiens
  light chain complementarity determining region 3 for antibody 48239
QQYDRPPLT

SEQ ID NO: 96478 - protein, 16 aa, Homo sapiens
  heavy chain complementarity determining region 3 for antibody 48239
ATDLSYGLEMGYYFEH

SEQ ID NO: 96479 - protein, 9 aa, Homo sapiens
  light chain complementarity determining region 3 for antibody 48240
QQYDRPPLP

SEQ ID NO: 96480 - protein, 16 aa, Homo sapiens
  heavy chain complementarity determining region 3 for antibody 48240
ATDLSYGSEMGYYFEH

SEQ ID NO: 96481 - protein, 8 aa, Homo sapiens
  light chain complementarity determining region 3 for antibody 48241
QQYDRLPT

SEQ ID NO: 96482 - protein, 17 aa, Homo sapiens
  heavy chain complementarity determining region 3 for antibody 48241
AVPTLGDHDGLPAAFNI

SEQ ID NO: 96483 - protein, 11 aa, Homo sapiens
  light chain complementarity determining region 3 for antibody 48242
QQYDRLPPRLT

SEQ ID NO: 96484 - protein, 13 aa, Homo sapiens
  heavy chain complementarity determining region 3 for antibody 48242
ATALGIAVAALEF

SEQ ID NO: 96485 - protein, 9 aa, Homo sapiens
  light chain complementarity determining region 3 for antibody 48243
QQYDRDSPT

SEQ ID NO: 96486 - protein, 13 aa, Homo sapiens
  heavy chain complementarity determining region 3 for antibody 48243
ARSYGYSNTWYDY

SEQ ID NO: 96487 - protein, 9 aa, Homo sapiens
  light chain complementarity determining region 3 for antibody 48244
QQYDNYPWT

SEQ ID NO: 96488 - protein, 13 aa, Homo sapiens
  heavy chain complementarity determining region 3 for antibody 48244
ARTSCGGGYGMDV

SEQ ID NO: 96489 - protein, 8 aa, Homo sapiens
  light chain complementarity determining region 3 for antibody 48245
QQYDNWYT

SEQ ID NO: 96490 - protein, 17 aa, Homo sapiens
  heavy chain complementarity determining region 3 for antibody 48245
AKDIFFGIAVAGTAFDI

SEQ ID NO: 96491 - protein, 9 aa, Homo sapiens
  light chain complementarity determining region 3 for antibody 48246
QQYDNWPRT

SEQ ID NO: 96492 - protein, 20 aa, Homo sapiens
  heavy chain complementarity determining region 3 for antibody 48246
ARLPDFFAGGYHYVNCHYDF

SEQ ID NO: 96493 - protein, 10 aa, Homo sapiens
  light chain complementarity determining region 3 for antibody 48247
QQYDNWPPYT

SEQ ID NO: 96494 - protein, 9 aa, Homo sapiens
  heavy chain complementarity determining region 3 for antibody 48247
ARRPDYFDY

SEQ ID NO: 96495 - protein, 10 aa, Homo sapiens
  light chain complementarity determining region 3 for antibody 48248
QQYDNWPPPT

SEQ ID NO: 96496 - protein, 17 aa, Homo sapiens
  heavy chain complementarity determining region 3 for antibody 48248
ARIYTGREDYVDEAFDI

SEQ ID NO: 96497 - protein, 9 aa, Homo sapiens
  light chain complementarity determining region 3 for antibody 48249
QQYDNWPGT

SEQ ID NO: 96498 - protein, 14 aa, Homo sapiens
  heavy chain complementarity determining region 3 for antibody 48249
ARGRTVTTVEYLDY

SEQ ID NO: 96499 - protein, 9 aa, Homo sapiens
  light chain complementarity determining region 3 for antibody 48250
QQYDNVPYT

SEQ ID NO: 96500 - protein, 18 aa, Homo sapiens
  heavy chain complementarity determining region 3 for antibody 48250
TPEWIYYESGGYWTPFDY

SEQ ID NO: 96501 - protein, 9 aa, Homo sapiens
  light chain complementarity determining region 3 for antibody 48251
QQYDNVPVT

SEQ ID NO: 96502 - protein, 18 aa, Homo sapiens
  heavy chain complementarity determining region 3 for antibody 48251
AKDRSYFDYVSGSYRFDY

SEQ ID NO: 96503 - protein, 9 aa, Homo sapiens
  light chain complementarity determining region 3 for antibody 48252
QQYDNVPFT

SEQ ID NO: 96504 - protein, 6 aa, Homo sapiens
  heavy chain complementarity determining region 3 for antibody 48252
VSLMFA

SEQ ID NO: 96505 - protein, 9 aa, Homo sapiens
  light chain complementarity determining region 3 for antibody 48253
QQYDNTPLT

SEQ ID NO: 96506 - protein, 22 aa, Homo sapiens
  heavy chain complementarity determining region 3 for antibody 48253
ARDRHIIFVRSLRDRIAKYFHH

SEQ ID NO: 96507 - protein, 10 aa, Homo sapiens
  light chain complementarity determining region 3 for antibody 48254
QQYDNSPPGT

SEQ ID NO: 96508 - protein, 15 aa, Homo sapiens
  heavy chain complementarity determining region 3 for antibody 48254
ASGTSGWLNSGGLLD

SEQ ID NO: 96509 - protein, 10 aa, Homo sapiens
  light chain complementarity determining region 3 for antibody 48255
QQYDNRPLYT

SEQ ID NO: 96510 - protein, 16 aa, Homo sapiens
  heavy chain complementarity determining region 3 for antibody 48255
AREVADSNTWGWHFDL

SEQ ID NO: 96511 - protein, 9 aa, Homo sapiens
  light chain complementarity determining region 3 for antibody 48256
QQYDNPPLT

SEQ ID NO: 96512 - protein, 19 aa, Homo sapiens
  heavy chain complementarity determining region 3 for antibody 48256
AHRQGPGSGYYLGGGGFDY

SEQ ID NO: 96513 - protein, 8 aa, Homo sapiens
  light chain complementarity determining region 3 for antibody 48257
QQYDNMPQ

SEQ ID NO: 96514 - protein, 12 aa, Homo sapiens
  heavy chain complementarity determining region 3 for antibody 48257
AKFAGSSDPFDF

SEQ ID NO: 96515 - protein, 9 aa, Homo sapiens
  light chain complementarity determining region 3 for antibody 48258
QQYDNLRLR

SEQ ID NO: 96516 - protein, 11 aa, Homo sapiens
  heavy chain complementarity determining region 3 for antibody 48258
ARVSSGLGNDS

SEQ ID NO: 96517 - protein, 9 aa, Homo sapiens
  light chain complementarity determining region 3 for antibody 48259
QQYDNLPYT

SEQ ID NO: 96518 - protein, 16 aa, Homo sapiens
  heavy chain complementarity determining region 3 for antibody 48259
TGARDGDFWSGYYSDY

SEQ ID NO: 96519 - protein, 9 aa, Homo sapiens
  light chain complementarity determining region 3 for antibody 48260
QQYDNLPYT

SEQ ID NO: 96520 - protein, 17 aa, Homo sapiens
  heavy chain complementarity determining region 3 for antibody 48260
ARMYYYDSSADWDALDI

SEQ ID NO: 96521 - protein, 9 aa, Homo sapiens
  light chain complementarity determining region 3 for antibody 48261
QQYDNLPVH

SEQ ID NO: 96522 - protein, 10 aa, Homo sapiens
  heavy chain complementarity determining region 3 for antibody 48261
ARANSAWWDY

SEQ ID NO: 96523 - protein, 10 aa, Homo sapiens
  light chain complementarity determining region 3 for antibody 48262
QQYDNLPSFT

SEQ ID NO: 96524 - protein, 25 aa, Homo sapiens
  heavy chain complementarity determining region 3 for antibody 48262
ARRDITMVWGATLSPDSGINYAFDI

SEQ ID NO: 96525 - protein, 10 aa, Homo sapiens
  light chain complementarity determining region 3 for antibody 48263
QQYDNLPSFT

SEQ ID NO: 96526 - protein, 13 aa, Homo sapiens
  heavy chain complementarity determining region 3 for antibody 48263
AHTDYYGSGSLDF

SEQ ID NO: 96527 - protein, 10 aa, Homo sapiens
  light chain complementarity determining region 3 for antibody 48264
QQYDNLPPYT

SEQ ID NO: 96528 - protein, 16 aa, Homo sapiens
  heavy chain complementarity determining region 3 for antibody 48264
AIVGYSYGFPARFGQY

SEQ ID NO: 96529 - protein, 10 aa, Homo sapiens
  light chain complementarity determining region 3 for antibody 48265
QQYDNLPPST

SEQ ID NO: 96530 - protein, 16 aa, Homo sapiens
  heavy chain complementarity determining region 3 for antibody 48265
AREKTEQWLVRGTFDY

SEQ ID NO: 96531 - protein, 10 aa, Homo sapiens
  light chain complementarity determining region 3 for antibody 48266
QQYDNLPPRT

SEQ ID NO: 96532 - protein, 19 aa, Homo sapiens
  heavy chain complementarity determining region 3 for antibody 48266
ARGGLRGSGWYKLNYYFDY

SEQ ID NO: 96533 - protein, 10 aa, Homo sapiens
  light chain complementarity determining region 3 for antibody 48267
QQYDNLPPPI

SEQ ID NO: 96534 - protein, 17 aa, Homo sapiens
  heavy chain complementarity determining region 3 for antibody 48267
AKFTPAIYSYTYRGFDS

SEQ ID NO: 96535 - protein, 10 aa, Homo sapiens
  light chain complementarity determining region 3 for antibody 48268
QQYDNLPPLP

SEQ ID NO: 96536 - protein, 11 aa, Homo sapiens
  heavy chain complementarity determining region 3 for antibody 48268
ARDAGGLGIDY

SEQ ID NO: 96537 - protein, 10 aa, Homo sapiens
  light chain complementarity determining region 3 for antibody 48269
QQYDNLPLYT

SEQ ID NO: 96538 - protein, 12 aa, Homo sapiens
  heavy chain complementarity determining region 3 for antibody 48269
VRVFGEFSTLDS

SEQ ID NO: 96539 - protein, 10 aa, Homo sapiens
  light chain complementarity determining region 3 for antibody 48270
QQYDNLPLYA

SEQ ID NO: 96540 - protein, 16 aa, Homo sapiens
  heavy chain complementarity determining region 3 for antibody 48270
AREVADSNTWGWHFDL

SEQ ID NO: 96541 - protein, 9 aa, Homo sapiens
  light chain complementarity determining region 3 for antibody 48271
QQYDNLPLT

SEQ ID NO: 96542 - protein, 19 aa, Homo sapiens
  heavy chain complementarity determining region 3 for antibody 48271
ASPFAQRELSYAPTDAFDI

SEQ ID NO: 96543 - protein, 9 aa, Homo sapiens
  light chain complementarity determining region 3 for antibody 48272
QQYDNLPLT

SEQ ID NO: 96544 - protein, 14 aa, Homo sapiens
  heavy chain complementarity determining region 3 for antibody 48272
ARVGSGISARQLDY

SEQ ID NO: 96545 - protein, 9 aa, Homo sapiens
  light chain complementarity determining region 3 for antibody 48273
QQYDNLPLT

SEQ ID NO: 96546 - protein, 20 aa, Homo sapiens
  heavy chain complementarity determining region 3 for antibody 48273
ARTPYCLGGSCDLAYYGMDV

SEQ ID NO: 96547 - protein, 9 aa, Homo sapiens
  light chain complementarity determining region 3 for antibody 48274
QQYDNLPLT

SEQ ID NO: 96548 - protein, 18 aa, Homo sapiens
  heavy chain complementarity determining region 3 for antibody 48274
ARHSEDTSSWFGHNWLDA

SEQ ID NO: 96549 - protein, 9 aa, Homo sapiens
  light chain complementarity determining region 3 for antibody 48275
QQYDNLPLT

SEQ ID NO: 96550 - protein, 16 aa, Homo sapiens
  heavy chain complementarity determining region 3 for antibody 48275
ARESGRGYGDPQYFDY

SEQ ID NO: 96551 - protein, 9 aa, Homo sapiens
  light chain complementarity determining region 3 for antibody 48276
QQYDNLPLP

SEQ ID NO: 96552 - protein, 17 aa, Homo sapiens
  heavy chain complementarity determining region 3 for antibody 48276
ARDQRAAARYRRSWFDP

SEQ ID NO: 96553 - protein, 9 aa, Homo sapiens
  light chain complementarity determining region 3 for antibody 48277
QQYDNLPIT

SEQ ID NO: 96554 - protein, 12 aa, Homo sapiens
  heavy chain complementarity determining region 3 for antibody 48277
TTFYPGAGYFHH

SEQ ID NO: 96555 - protein, 11 aa, Homo sapiens
  light chain complementarity determining region 3 for antibody 48278
QQYDNLPFAHT

SEQ ID NO: 96556 - protein, 21 aa, Homo sapiens
  heavy chain complementarity determining region 3 for antibody 48278
ARNDPDKKEGGQTYGYNYFEQ

SEQ ID NO: 96557 - protein, 8 aa, Homo sapiens
  light chain complementarity determining region 3 for antibody 48279
QQYDNLLP

SEQ ID NO: 96558 - protein, 11 aa, Homo sapiens
  heavy chain complementarity determining region 3 for antibody 48279
AREYGSGSYQY

SEQ ID NO: 96559 - protein, 9 aa, Homo sapiens
  light chain complementarity determining region 3 for antibody 48280
QQYDNLLFT

SEQ ID NO: 96560 - protein, 11 aa, Homo sapiens
  heavy chain complementarity determining region 3 for antibody 48280
ARDRGYQAFDC

SEQ ID NO: 96561 - protein, 10 aa, Homo sapiens
  light chain complementarity determining region 3 for antibody 48281
QQYDNIPSFT

SEQ ID NO: 96562 - protein, 10 aa, Homo sapiens
  heavy chain complementarity determining region 3 for antibody 48281
ASGGGYTFSD

SEQ ID NO: 96563 - protein, 9 aa, Homo sapiens
  light chain complementarity determining region 3 for antibody 48282
QQYDNIPLT

SEQ ID NO: 96564 - protein, 14 aa, Homo sapiens
  heavy chain complementarity determining region 3 for antibody 48282
ARVGSGISARQLDY

SEQ ID NO: 96565 - protein, 10 aa, Homo sapiens
  light chain complementarity determining region 3 for antibody 48283
QQYDNIPGFT

SEQ ID NO: 96566 - protein, 19 aa, Homo sapiens
  heavy chain complementarity determining region 3 for antibody 48283
ASAGGSSLFRTTWSYQFDY

SEQ ID NO: 96567 - protein, 10 aa, Homo sapiens
  light chain complementarity determining region 3 for antibody 48284
QQYDNHPPSP

SEQ ID NO: 96568 - protein, 18 aa, Homo sapiens
  heavy chain complementarity determining region 3 for antibody 48284
ARARAAVDYVYYYYGLGV

SEQ ID NO: 96569 - protein, 9 aa, Homo sapiens
  light chain complementarity determining region 3 for antibody 48285
QQYDNFPPT

SEQ ID NO: 96570 - protein, 19 aa, Homo sapiens
  heavy chain complementarity determining region 3 for antibody 48285
ARERQSDTSGDYGAPDFDF

SEQ ID NO: 96571 - protein, 10 aa, Homo sapiens
  light chain complementarity determining region 3 for antibody 48286
QQYDNFPPLT

SEQ ID NO: 96572 - protein, 11 aa, Homo sapiens
  heavy chain complementarity determining region 3 for antibody 48286
ARDAGGLGIDY

SEQ ID NO: 96573 - protein, 9 aa, Homo sapiens
  light chain complementarity determining region 3 for antibody 48287
QQYDNFPLT

SEQ ID NO: 96574 - protein, 16 aa, Homo sapiens
  heavy chain complementarity determining region 3 for antibody 48287
ATTNYGRVDGDNSFDY

SEQ ID NO: 96575 - protein, 9 aa, Homo sapiens
  light chain complementarity determining region 3 for antibody 48288
QQYDNFPLT

SEQ ID NO: 96576 - protein, 19 aa, Homo sapiens
  heavy chain complementarity determining region 3 for antibody 48288
ASPCAQRELSYAPTDAFDI

SEQ ID NO: 96577 - protein, 9 aa, Homo sapiens
  light chain complementarity determining region 3 for antibody 48289
QQYDNFPHT

SEQ ID NO: 96578 - protein, 21 aa, Homo sapiens
  heavy chain complementarity determining region 3 for antibody 48289
SRSPSDPMMTFGGIIVPFFDY

SEQ ID NO: 96579 - protein, 9 aa, Homo sapiens
  light chain complementarity determining region 3 for antibody 48290
QQYDNFLVT

SEQ ID NO: 96580 - protein, 15 aa, Homo sapiens
  heavy chain complementarity determining region 3 for antibody 48290
ARGGVYRSGWYGLDF

SEQ ID NO: 96581 - protein, 8 aa, Homo sapiens
  light chain complementarity determining region 3 for antibody 48291
QQYDLYWT

SEQ ID NO: 96582 - protein, 10 aa, Homo sapiens
  heavy chain complementarity determining region 3 for antibody 48291
ATRASFGPPY

SEQ ID NO: 96583 - protein, 9 aa, Homo sapiens
  light chain complementarity determining region 3 for antibody 48292
QQYDLLPPV

SEQ ID NO: 96584 - protein, 16 aa, Homo sapiens
  heavy chain complementarity determining region 3 for antibody 48292
VRMGSSRSYYVGSFDV

SEQ ID NO: 96585 - protein, 9 aa, Homo sapiens
  light chain complementarity determining region 3 for antibody 48293
QQYDLIPPT

SEQ ID NO: 96586 - protein, 21 aa, Homo sapiens
  heavy chain complementarity determining region 3 for antibody 48293
ARGLHIVVVTSILRGFWYFGL

SEQ ID NO: 96587 - protein, 9 aa, Homo sapiens
  light chain complementarity determining region 3 for antibody 48294
QQYDKYPFT

SEQ ID NO: 96588 - protein, 17 aa, Homo sapiens
  heavy chain complementarity determining region 3 for antibody 48294
AKEMDCSGGTCYSVIDH

SEQ ID NO: 96589 - protein, 9 aa, Homo sapiens
  light chain complementarity determining region 3 for antibody 48295
QQYDKLPNT

SEQ ID NO: 96590 - protein, 10 aa, Homo sapiens
  heavy chain complementarity determining region 3 for antibody 48295
ARETGGHYNY

SEQ ID NO: 96591 - protein, 9 aa, Homo sapiens
  light chain complementarity determining region 3 for antibody 48296
QQYDKAPVP

SEQ ID NO: 96592 - protein, 12 aa, Homo sapiens
  heavy chain complementarity determining region 3 for antibody 48296
ARDAMRGGDFDY

SEQ ID NO: 96593 - protein, 9 aa, Homo sapiens
  light chain complementarity determining region 3 for antibody 48297
QQYDISQRP

SEQ ID NO: 96594 - protein, 18 aa, Homo sapiens
  heavy chain complementarity determining region 3 for antibody 48297
ATSVATTVDGYYYYALDV

SEQ ID NO: 96595 - protein, 9 aa, Homo sapiens
  light chain complementarity determining region 3 for antibody 48298
QQYDISPWT

SEQ ID NO: 96596 - protein, 20 aa, Homo sapiens
  heavy chain complementarity determining region 3 for antibody 48298
ARDNYDQVMVTPYYYHGMDV

SEQ ID NO: 96597 - protein, 9 aa, Homo sapiens
  light chain complementarity determining region 3 for antibody 48299
QQYDILPYT

SEQ ID NO: 96598 - protein, 20 aa, Homo sapiens
  heavy chain complementarity determining region 3 for antibody 48299
AREDGYDYDSESAPRNWLDP

SEQ ID NO: 96599 - protein, 9 aa, Homo sapiens
  light chain complementarity determining region 3 for antibody 48300
QQYDIFPPT

SEQ ID NO: 96600 - protein, 12 aa, Homo sapiens
  heavy chain complementarity determining region 3 for antibody 48300
TTDRSYGYYSPH

SEQ ID NO: 96601 - protein, 9 aa, Homo sapiens
  light chain complementarity determining region 3 for antibody 48301
QQYDIFPLT

SEQ ID NO: 96602 - protein, 12 aa, Homo sapiens
  heavy chain complementarity determining region 3 for antibody 48301
TTDRSYGYDSPH

SEQ ID NO: 96603 - protein, 9 aa, Homo sapiens
  light chain complementarity determining region 3 for antibody 48302
QQYDIFPLT

SEQ ID NO: 96604 - protein, 12 aa, Homo sapiens
  heavy chain complementarity determining region 3 for antibody 48302
TTDRSSGYYSPH

SEQ ID NO: 96605 - protein, 8 aa, Homo sapiens
  light chain complementarity determining region 3 for antibody 48303
QQYDHLPP

SEQ ID NO: 96606 - protein, 17 aa, Homo sapiens
  heavy chain complementarity determining region 3 for antibody 48303
AVPTLGDHDGLPAAFNV

SEQ ID NO: 96607 - protein, 9 aa, Homo sapiens
  light chain complementarity determining region 3 for antibody 48304
QQYDHLPLT

SEQ ID NO: 96608 - protein, 19 aa, Homo sapiens
  heavy chain complementarity determining region 3 for antibody 48304
TRGAHIVVVTSFHTYNVDY

SEQ ID NO: 96609 - protein, 10 aa, Homo sapiens
  light chain complementarity determining region 3 for antibody 48305
QQYDHFPRLT

SEQ ID NO: 96610 - protein, 14 aa, Homo sapiens
  heavy chain complementarity determining region 3 for antibody 48305
ARHGQGNWPRTLDL

SEQ ID NO: 96611 - protein, 9 aa, Homo sapiens
  light chain complementarity determining region 3 for antibody 48306
QQYDGTPYT

SEQ ID NO: 96612 - protein, 9 aa, Homo sapiens
  heavy chain complementarity determining region 3 for antibody 48306
ASGGGSYNF

SEQ ID NO: 96613 - protein, 9 aa, Homo sapiens
  light chain complementarity determining region 3 for antibody 48307
QQYDGPPLT

SEQ ID NO: 96614 - protein, 21 aa, Homo sapiens
  heavy chain complementarity determining region 3 for antibody 48307
AKDLHYLNTARPSDQAGGLDD

SEQ ID NO: 96615 - protein, 8 aa, Homo sapiens
  light chain complementarity determining region 3 for antibody 48308
QQYDGLYT

SEQ ID NO: 96616 - protein, 13 aa, Homo sapiens
  heavy chain complementarity determining region 3 for antibody 48308
VTGGVYSSGPLDF

SEQ ID NO: 96617 - protein, 10 aa, Homo sapiens
  light chain complementarity determining region 3 for antibody 48309
QQYDDSPPGT

SEQ ID NO: 96618 - protein, 14 aa, Homo sapiens
  heavy chain complementarity determining region 3 for antibody 48309
VRAGGGMSAGKFDY

SEQ ID NO: 96619 - protein, 10 aa, Homo sapiens
  light chain complementarity determining region 3 for antibody 48310
QQYDDLPPLT

SEQ ID NO: 96620 - protein, 19 aa, Homo sapiens
  heavy chain complementarity determining region 3 for antibody 48310
ARAREGSYREENNYYGFDA

SEQ ID NO: 96621 - protein, 11 aa, Homo sapiens
  light chain complementarity determining region 3 for antibody 48311
QQYDDFLRGFV

SEQ ID NO: 96622 - protein, 12 aa, Homo sapiens
  heavy chain complementarity determining region 3 for antibody 48311
AAPVRGTGFLDY

SEQ ID NO: 96623 - protein, 9 aa, Homo sapiens
  light chain complementarity determining region 3 for antibody 48312
QQYDAYPRT

SEQ ID NO: 96624 - protein, 14 aa, Homo sapiens
  heavy chain complementarity determining region 3 for antibody 48312
ARGLAVASNPPGGY

SEQ ID NO: 96625 - protein, 9 aa, Homo sapiens
  light chain complementarity determining region 3 for antibody 48313
QQYDAVPLT

SEQ ID NO: 96626 - protein, 15 aa, Homo sapiens
  heavy chain complementarity determining region 3 for antibody 48313
ARTGFGLGRYYKMDV

SEQ ID NO: 96627 - protein, 9 aa, Homo sapiens
  light chain complementarity determining region 3 for antibody 48314
QQYCSTALT

SEQ ID NO: 96628 - protein, 12 aa, Homo sapiens
  heavy chain complementarity determining region 3 for antibody 48314
ARVEEYHDTFDI

SEQ ID NO: 96629 - protein, 10 aa, Homo sapiens
  light chain complementarity determining region 3 for antibody 48315
QQYCSSPRIT

SEQ ID NO: 96630 - protein, 17 aa, Homo sapiens
  heavy chain complementarity determining region 3 for antibody 48315
ATDQYYHDSQKDHAFDI

SEQ ID NO: 96631 - protein, 9 aa, Homo sapiens
  light chain complementarity determining region 3 for antibody 48316
QQYCNPPLT

SEQ ID NO: 96632 - protein, 11 aa, Homo sapiens
  heavy chain complementarity determining region 3 for antibody 48316
AYRFRADHFDY

SEQ ID NO: 96633 - protein, 9 aa, Homo sapiens
  light chain complementarity determining region 3 for antibody 48317
QQYCISPLT

SEQ ID NO: 96634 - protein, 22 aa, Homo sapiens
  heavy chain complementarity determining region 3 for antibody 48317
ARVWGLYYSSWYGPGHYYGMDV

SEQ ID NO: 96635 - protein, 10 aa, Homo sapiens
  light chain complementarity determining region 3 for antibody 48318
QQYCGSPRYT

SEQ ID NO: 96636 - protein, 16 aa, Homo sapiens
  heavy chain complementarity determining region 3 for antibody 48318
ARVTWVRGLMTPAFDY

SEQ ID NO: 96637 - protein, 9 aa, Homo sapiens
  light chain complementarity determining region 3 for antibody 48319
QQYATSSVT

SEQ ID NO: 96638 - protein, 12 aa, Homo sapiens
  heavy chain complementarity determining region 3 for antibody 48319
ARDAGQYSYCDH

SEQ ID NO: 96639 - protein, 9 aa, Homo sapiens
  light chain complementarity determining region 3 for antibody 48320
QQYATSPWT

SEQ ID NO: 96640 - protein, 15 aa, Homo sapiens
  heavy chain complementarity determining region 3 for antibody 48320
AREHDSSGYYYYFDL

SEQ ID NO: 96641 - protein, 9 aa, Homo sapiens
  light chain complementarity determining region 3 for antibody 48321
QQYATSPSS

SEQ ID NO: 96642 - protein, 12 aa, Homo sapiens
  heavy chain complementarity determining region 3 for antibody 48321
AREPAEDYYLDF

SEQ ID NO: 96643 - protein, 12 aa, Homo sapiens
  light chain complementarity determining region 3 for antibody 48322
QQYATSPPWPWP

SEQ ID NO: 96644 - protein, 14 aa, Homo sapiens
  heavy chain complementarity determining region 3 for antibody 48322
ARGGTSGYNNQLDY

SEQ ID NO: 96645 - protein, 12 aa, Homo sapiens
  light chain complementarity determining region 3 for antibody 48323
QQYATSPPWPGT

SEQ ID NO: 96646 - protein, 14 aa, Homo sapiens
  heavy chain complementarity determining region 3 for antibody 48323
ARGGTSGYNNQLDY

SEQ ID NO: 96647 - protein, 12 aa, Homo sapiens
  light chain complementarity determining region 3 for antibody 48324
QQYATSPPGPGT

SEQ ID NO: 96648 - protein, 14 aa, Homo sapiens
  heavy chain complementarity determining region 3 for antibody 48324
ARGGTSGYNNQLDY

SEQ ID NO: 96649 - protein, 9 aa, Homo sapiens
  light chain complementarity determining region 3 for antibody 48325
QQYATSPLP

SEQ ID NO: 96650 - protein, 18 aa, Homo sapiens
  heavy chain complementarity determining region 3 for antibody 48325
ARWTGSLWFGEFSGWFDP

SEQ ID NO: 96651 - protein, 9 aa, Homo sapiens
  light chain complementarity determining region 3 for antibody 48326
QQYATSPGT

SEQ ID NO: 96652 - protein, 22 aa, Homo sapiens
  heavy chain complementarity determining region 3 for antibody 48326
AGGEYSYDGSDYLWLPAEYFQH

SEQ ID NO: 96653 - protein, 9 aa, Homo sapiens
  light chain complementarity determining region 3 for antibody 48327
QQYASSPWP

SEQ ID NO: 96654 - protein, 15 aa, Homo sapiens
  heavy chain complementarity determining region 3 for antibody 48327
ARHRNGWRGEFYFDY

SEQ ID NO: 96655 - protein, 9 aa, Homo sapiens
  light chain complementarity determining region 3 for antibody 48328
QQYASPPPT

SEQ ID NO: 96656 - protein, 14 aa, Homo sapiens
  heavy chain complementarity determining region 3 for antibody 48328
GTGDYYDRSGLLDY

SEQ ID NO: 96657 - protein, 9 aa, Homo sapiens
  light chain complementarity determining region 3 for antibody 48329
QQYASAPDT

SEQ ID NO: 96658 - protein, 11 aa, Homo sapiens
  heavy chain complementarity determining region 3 for antibody 48329
AKDPSSGPSDY

SEQ ID NO: 96659 - protein, 11 aa, Homo sapiens
  light chain complementarity determining region 3 for antibody 48330
QQYAPSPEKNT

SEQ ID NO: 96660 - protein, 13 aa, Homo sapiens
  heavy chain complementarity determining region 3 for antibody 48330
AREEMIGGSPFDF

SEQ ID NO: 96661 - protein, 10 aa, Homo sapiens
  light chain complementarity determining region 3 for antibody 48331
QQYANQPPTT

SEQ ID NO: 96662 - protein, 12 aa, Homo sapiens
  heavy chain complementarity determining region 3 for antibody 48331
ARVLDSLSPAFH

SEQ ID NO: 96663 - protein, 8 aa, Homo sapiens
  light chain complementarity determining region 3 for antibody 48332
QQYANLLT

SEQ ID NO: 96664 - protein, 12 aa, Homo sapiens
  heavy chain complementarity determining region 3 for antibody 48332
VRTQWQVLAFDY

SEQ ID NO: 96665 - protein, 10 aa, Homo sapiens
  light chain complementarity determining region 3 for antibody 48333
QQYAKTPPST

SEQ ID NO: 96666 - protein, 12 aa, Homo sapiens
  heavy chain complementarity determining region 3 for antibody 48333
ARVLDSLSPVFH

SEQ ID NO: 96667 - protein, 10 aa, Homo sapiens
  light chain complementarity determining region 3 for antibody 48334
QQYAKPPPIT

SEQ ID NO: 96668 - protein, 12 aa, Homo sapiens
  heavy chain complementarity determining region 3 for antibody 48334
ARVLDSLSPVFH

SEQ ID NO: 96669 - protein, 9 aa, Homo sapiens
  light chain complementarity determining region 3 for antibody 48335
QQYAISPCP

SEQ ID NO: 96670 - protein, 12 aa, Homo sapiens
  heavy chain complementarity determining region 3 for antibody 48335
AQSVTAMRPFHS

SEQ ID NO: 96671 - protein, 9 aa, Homo sapiens
  light chain complementarity determining region 3 for antibody 48336
QQYAISPCN

SEQ ID NO: 96672 - protein, 12 aa, Homo sapiens
  heavy chain complementarity determining region 3 for antibody 48336
AQSVTAMRPFHS

SEQ ID NO: 96673 - protein, 9 aa, Homo sapiens
  light chain complementarity determining region 3 for antibody 48337
QQYAHSPPT

SEQ ID NO: 96674 - protein, 10 aa, Homo sapiens
  heavy chain complementarity determining region 3 for antibody 48337
AIGVGWLIDY

SEQ ID NO: 96675 - protein, 9 aa, Homo sapiens
  light chain complementarity determining region 3 for antibody 48338
QQYAGSPYT

SEQ ID NO: 96676 - protein, 16 aa, Homo sapiens
  heavy chain complementarity determining region 3 for antibody 48338
ATSPRHHRSAAPPWDY

SEQ ID NO: 96677 - protein, 9 aa, Homo sapiens
  light chain complementarity determining region 3 for antibody 48339
QQYAGSPGN

SEQ ID NO: 96678 - protein, 8 aa, Homo sapiens
  heavy chain complementarity determining region 3 for antibody 48339
ARGLSLDS

SEQ ID NO: 96679 - protein, 9 aa, Homo sapiens
  light chain complementarity determining region 3 for antibody 48340
QQYAGPPGT

SEQ ID NO: 96680 - protein, 8 aa, Homo sapiens
  heavy chain complementarity determining region 3 for antibody 48340
ARGLSLDS

SEQ ID NO: 96681 - protein, 8 aa, Homo sapiens
  light chain complementarity determining region 3 for antibody 48341
QQYAFSLP

SEQ ID NO: 96682 - protein, 15 aa, Homo sapiens
  heavy chain complementarity determining region 3 for antibody 48341
ARDAYTSSGTGYLDP

SEQ ID NO: 96683 - protein, 9 aa, Homo sapiens
  light chain complementarity determining region 3 for antibody 48342
QQYADIPIT

SEQ ID NO: 96684 - protein, 15 aa, Homo sapiens
  heavy chain complementarity determining region 3 for antibody 48342
ARDPGRGGSGSKFDY

SEQ ID NO: 96685 - protein, 8 aa, Homo sapiens
  light chain complementarity determining region 3 for antibody 48343
QQYADFFT

SEQ ID NO: 96686 - protein, 13 aa, Homo sapiens
  heavy chain complementarity determining region 3 for antibody 48343
TRVFPWPTMAFDY

SEQ ID NO: 96687 - protein, 9 aa, Homo sapiens
  light chain complementarity determining region 3 for antibody 48344
QQYACSPRT

SEQ ID NO: 96688 - protein, 12 aa, Homo sapiens
  heavy chain complementarity determining region 3 for antibody 48344
ARESSGHSPLDP

SEQ ID NO: 96689 - protein, 9 aa, Homo sapiens
  light chain complementarity determining region 3 for antibody 48345
QQYACSPGT

SEQ ID NO: 96690 - protein, 8 aa, Homo sapiens
  heavy chain complementarity determining region 3 for antibody 48345
ARGLSLDS

SEQ ID NO: 96691 - protein, 9 aa, Homo sapiens
  light chain complementarity determining region 3 for antibody 48346
QQWNSYPLT

SEQ ID NO: 96692 - protein, 17 aa, Homo sapiens
  heavy chain complementarity determining region 3 for antibody 48346
TRSSYDTSGYYLEPFDY

SEQ ID NO: 96693 - protein, 9 aa, Homo sapiens
  light chain complementarity determining region 3 for antibody 48347
QQWDSFPVT

SEQ ID NO: 96694 - protein, 14 aa, Homo sapiens
  heavy chain complementarity determining region 3 for antibody 48347
ARPNFRYGYDAIDF

SEQ ID NO: 96695 - protein, 9 aa, Homo sapiens
  light chain complementarity determining region 3 for antibody 48348
QQVYTPPST

SEQ ID NO: 96696 - protein, 13 aa, Homo sapiens
  heavy chain complementarity determining region 3 for antibody 48348
ARARNYDRISLDF

SEQ ID NO: 96697 - protein, 8 aa, Homo sapiens
  light chain complementarity determining region 3 for antibody 48349
QQVVSSRT

SEQ ID NO: 96698 - protein, 23 aa, Homo sapiens
  heavy chain complementarity determining region 3 for antibody 48349
ARHYRLYYDFWNGYSKAPDAFDI

SEQ ID NO: 96699 - protein, 9 aa, Homo sapiens
  light chain complementarity determining region 3 for antibody 48350
QQVTDFPLT

SEQ ID NO: 96700 - protein, 11 aa, Homo sapiens
  heavy chain complementarity determining region 3 for antibody 48350
GRHIAWRGIDV

SEQ ID NO: 96701 - protein, 9 aa, Homo sapiens
  light chain complementarity determining region 3 for antibody 48351
QQVNSFPIT

SEQ ID NO: 96702 - protein, 18 aa, Homo sapiens
  heavy chain complementarity determining region 3 for antibody 48351
ARSVSYIVSRFAGAYFDY

SEQ ID NO: 96703 - protein, 9 aa, Homo sapiens
  light chain complementarity determining region 3 for antibody 48352
QQVNRFPFT

SEQ ID NO: 96704 - protein, 13 aa, Homo sapiens
  heavy chain complementarity determining region 3 for antibody 48352
ARGTGGNYKMFDS

SEQ ID NO: 96705 - protein, 10 aa, Homo sapiens
  light chain complementarity determining region 3 for antibody 48353
QQVNNWPPTT

SEQ ID NO: 96706 - protein, 16 aa, Homo sapiens
  heavy chain complementarity determining region 3 for antibody 48353
AREVPDRTSSGWSLDL

SEQ ID NO: 96707 - protein, 11 aa, Homo sapiens
  light chain complementarity determining region 3 for antibody 48354
QQVNGYPPMYT

SEQ ID NO: 96708 - protein, 19 aa, Homo sapiens
  heavy chain complementarity determining region 3 for antibody 48354
ARGFREVVSATDAYNWFDP

SEQ ID NO: 96709 - protein, 9 aa, Homo sapiens
  light chain complementarity determining region 3 for antibody 48355
QQVNDFPLP

SEQ ID NO: 96710 - protein, 12 aa, Homo sapiens
  heavy chain complementarity determining region 3 for antibody 48355
AREGLRGVAHDY

SEQ ID NO: 96711 - protein, 9 aa, Homo sapiens
  light chain complementarity determining region 3 for antibody 48356
QQVHIYPYT

SEQ ID NO: 96712 - protein, 12 aa, Homo sapiens
  heavy chain complementarity determining region 3 for antibody 48356
ARPLDGDFGFDP

SEQ ID NO: 96713 - protein, 9 aa, Homo sapiens
  light chain complementarity determining region 3 for antibody 48357
QQVGSSPYT

SEQ ID NO: 96714 - protein, 20 aa, Homo sapiens
  heavy chain complementarity determining region 3 for antibody 48357
AALARYYHDSTGVLELAFDI

SEQ ID NO: 96715 - protein, 9 aa, Homo sapiens
  light chain complementarity determining region 3 for antibody 48358
QQVGGFPRP

SEQ ID NO: 96716 - protein, 16 aa, Homo sapiens
  heavy chain complementarity determining region 3 for antibody 48358
ARGRTRGASLGMATAY

SEQ ID NO: 96717 - protein, 9 aa, Homo sapiens
  light chain complementarity determining region 3 for antibody 48359
QQVDSFPPT

SEQ ID NO: 96718 - protein, 18 aa, Homo sapiens
  heavy chain complementarity determining region 3 for antibody 48359
ARQGDLYRNSSGMFYFDY

SEQ ID NO: 96719 - protein, 6 aa, Homo sapiens
  light chain complementarity determining region 3 for antibody 48360
QQVAET

SEQ ID NO: 96720 - protein, 12 aa, Homo sapiens
  heavy chain complementarity determining region 3 for antibody 48360
ARDHPSGWALAH

SEQ ID NO: 96721 - protein, 9 aa, Homo sapiens
  light chain complementarity determining region 3 for antibody 48361
QQTYVTLFT

SEQ ID NO: 96722 - protein, 13 aa, Homo sapiens
  heavy chain complementarity determining region 3 for antibody 48361
ARDSGTFWEGSDS

SEQ ID NO: 96723 - protein, 9 aa, Homo sapiens
  light chain complementarity determining region 3 for antibody 48362
QQTYTTPRT

SEQ ID NO: 96724 - protein, 21 aa, Homo sapiens
  heavy chain complementarity determining region 3 for antibody 48362
ARVLPPRSYSSGWYTSLTFDY

SEQ ID NO: 96725 - protein, 9 aa, Homo sapiens
  light chain complementarity determining region 3 for antibody 48363
QQTYTSRAT

SEQ ID NO: 96726 - protein, 15 aa, Homo sapiens
  heavy chain complementarity determining region 3 for antibody 48363
ARDSFDGSYSGSFDY

SEQ ID NO: 96727 - protein, 10 aa, Homo sapiens
  light chain complementarity determining region 3 for antibody 48364
QQTYTSPPYS

SEQ ID NO: 96728 - protein, 17 aa, Homo sapiens
  heavy chain complementarity determining region 3 for antibody 48364
ARTYTSTTENYYYGMDV

SEQ ID NO: 96729 - protein, 10 aa, Homo sapiens
  light chain complementarity determining region 3 for antibody 48365
QQTYTDPMYP

SEQ ID NO: 96730 - protein, 12 aa, Homo sapiens
  heavy chain complementarity determining region 3 for antibody 48365
ARTYGSGSFYDY

SEQ ID NO: 96731 - protein, 9 aa, Homo sapiens
  light chain complementarity determining region 3 for antibody 48366
QQTYSTTWT

SEQ ID NO: 96732 - protein, 13 aa, Homo sapiens
  heavy chain complementarity determining region 3 for antibody 48366
ATFRRYSSLWRIF

SEQ ID NO: 96733 - protein, 9 aa, Homo sapiens
  light chain complementarity determining region 3 for antibody 48367
QQTYSTPWT

SEQ ID NO: 96734 - protein, 15 aa, Homo sapiens
  heavy chain complementarity determining region 3 for antibody 48367
ARVRFGVAGTGFFDY

SEQ ID NO: 96735 - protein, 9 aa, Homo sapiens
  light chain complementarity determining region 3 for antibody 48368
QQTYSTPLT

SEQ ID NO: 96736 - protein, 15 aa, Homo sapiens
  heavy chain complementarity determining region 3 for antibody 48368
ARDAYTGSYLGYFDL

SEQ ID NO: 96737 - protein, 9 aa, Homo sapiens
  light chain complementarity determining region 3 for antibody 48369
QQTYSTPFT

SEQ ID NO: 96738 - protein, 14 aa, Homo sapiens
  heavy chain complementarity determining region 3 for antibody 48369
ARGRDTSGYSGLDY

SEQ ID NO: 96739 - protein, 10 aa, Homo sapiens
  light chain complementarity determining region 3 for antibody 48370
QQTYSTPAPT

SEQ ID NO: 96740 - protein, 10 aa, Homo sapiens
  heavy chain complementarity determining region 3 for antibody 48370
ARESDGAFDI

SEQ ID NO: 96741 - protein, 8 aa, Homo sapiens
  light chain complementarity determining region 3 for antibody 48371
QQTYSTLP

SEQ ID NO: 96742 - protein, 8 aa, Homo sapiens
  heavy chain complementarity determining region 3 for antibody 48371
ATGDNFDY

SEQ ID NO: 96743 - protein, 9 aa, Homo sapiens
  light chain complementarity determining region 3 for antibody 48372
QQTYSSPFT

SEQ ID NO: 96744 - protein, 14 aa, Homo sapiens
  heavy chain complementarity determining region 3 for antibody 48372
AKGRDTSGYSAFDI

SEQ ID NO: 96745 - protein, 8 aa, Homo sapiens
  light chain complementarity determining region 3 for antibody 48373
QQTYSSKK

SEQ ID NO: 96746 - protein, 18 aa, Homo sapiens
  heavy chain complementarity determining region 3 for antibody 48373
ARRHYYDGTAFRAEYFDD

SEQ ID NO: 96747 - protein, 9 aa, Homo sapiens
  light chain complementarity determining region 3 for antibody 48374
QQTYSPSFT

SEQ ID NO: 96748 - protein, 14 aa, Homo sapiens
  heavy chain complementarity determining region 3 for antibody 48374
AKGRDTSGYSAFDI

SEQ ID NO: 96749 - protein, 11 aa, Homo sapiens
  light chain complementarity determining region 3 for antibody 48375
QQTYSPPRVFR

SEQ ID NO: 96750 - protein, 18 aa, Homo sapiens
  heavy chain complementarity determining region 3 for antibody 48375
ARQVATTMGGHVYWYFGL

SEQ ID NO: 96751 - protein, 11 aa, Homo sapiens
  light chain complementarity determining region 3 for antibody 48376
QQTYSPPRAFS

SEQ ID NO: 96752 - protein, 18 aa, Homo sapiens
  heavy chain complementarity determining region 3 for antibody 48376
ARQVATTMGGHVYWYFGL

SEQ ID NO: 96753 - protein, 9 aa, Homo sapiens
  light chain complementarity determining region 3 for antibody 48377
QQTYSPPQT

SEQ ID NO: 96754 - protein, 24 aa, Homo sapiens
  heavy chain complementarity determining region 3 for antibody 48377
ARGSLDWYYDGSGYYYAPGDAFDI

SEQ ID NO: 96755 - protein, 9 aa, Homo sapiens
  light chain complementarity determining region 3 for antibody 48378
QQTYSPPQT

SEQ ID NO: 96756 - protein, 24 aa, Homo sapiens
  heavy chain complementarity determining region 3 for antibody 48378
ARGALEWYYDGSGYYYAPGDAFDI

SEQ ID NO: 96757 - protein, 9 aa, Homo sapiens
  light chain complementarity determining region 3 for antibody 48379
QQTYSPPFP

SEQ ID NO: 96758 - protein, 14 aa, Homo sapiens
  heavy chain complementarity determining region 3 for antibody 48379
AKGRDTSGYSAFDI

SEQ ID NO: 96759 - protein, 9 aa, Homo sapiens
  light chain complementarity determining region 3 for antibody 48380
QQTYSPPFN

SEQ ID NO: 96760 - protein, 14 aa, Homo sapiens
  heavy chain complementarity determining region 3 for antibody 48380
ARGRDTSGYSGLDY

SEQ ID NO: 96761 - protein, 9 aa, Homo sapiens
  light chain complementarity determining region 3 for antibody 48381
QQTYSMPYS

SEQ ID NO: 96762 - protein, 17 aa, Homo sapiens
  heavy chain complementarity determining region 3 for antibody 48381
AKDMIAEDQGYYYGVDV

SEQ ID NO: 96763 - protein, 9 aa, Homo sapiens
  light chain complementarity determining region 3 for antibody 48382
QQTYSIPPT

SEQ ID NO: 96764 - protein, 15 aa, Homo sapiens
  heavy chain complementarity determining region 3 for antibody 48382
ARRGAFDWLSDAFDI

SEQ ID NO: 96765 - protein, 8 aa, Homo sapiens
  light chain complementarity determining region 3 for antibody 48383
QQTYSIFT

SEQ ID NO: 96766 - protein, 14 aa, Homo sapiens
  heavy chain complementarity determining region 3 for antibody 48383
ARSLGSEHSYGMDV

SEQ ID NO: 96767 - protein, 9 aa, Homo sapiens
  light chain complementarity determining region 3 for antibody 48384
QQTYSAPLT

SEQ ID NO: 96768 - protein, 19 aa, Homo sapiens
  heavy chain complementarity determining region 3 for antibody 48384
VRERSDDQFCGGGNCPLDY

SEQ ID NO: 96769 - protein, 9 aa, Homo sapiens
  light chain complementarity determining region 3 for antibody 48385
QQTYRTPWT

SEQ ID NO: 96770 - protein, 13 aa, Homo sapiens
  heavy chain complementarity determining region 3 for antibody 48385
ARVFSGYDYYFDY

SEQ ID NO: 96771 - protein, 9 aa, Homo sapiens
  light chain complementarity determining region 3 for antibody 48386
QQTYRTPVP

SEQ ID NO: 96772 - protein, 17 aa, Homo sapiens
  heavy chain complementarity determining region 3 for antibody 48386
VRTGPIVEVPAAIPVDV

SEQ ID NO: 96773 - protein, 9 aa, Homo sapiens
  light chain complementarity determining region 3 for antibody 48387
QQTYRTPGT

SEQ ID NO: 96774 - protein, 11 aa, Homo sapiens
  heavy chain complementarity determining region 3 for antibody 48387
ATGPQVTMPQD

SEQ ID NO: 96775 - protein, 9 aa, Homo sapiens
  light chain complementarity determining region 3 for antibody 48388
QQTYRTPFT

SEQ ID NO: 96776 - protein, 17 aa, Homo sapiens
  heavy chain complementarity determining region 3 for antibody 48388
VRATYFYDRSGYYRFDY

SEQ ID NO: 96777 - protein, 9 aa, Homo sapiens
  light chain complementarity determining region 3 for antibody 48389
QQTYNTPIT

SEQ ID NO: 96778 - protein, 22 aa, Homo sapiens
  heavy chain complementarity determining region 3 for antibody 48389
AASHLEDPMGTTYYSYYRGFHV

SEQ ID NO: 96779 - protein, 9 aa, Homo sapiens
  light chain complementarity determining region 3 for antibody 48390
QQTYNAPDT

SEQ ID NO: 96780 - protein, 18 aa, Homo sapiens
  heavy chain complementarity determining region 3 for antibody 48390
AVLGYCTNSACYFALVDY

SEQ ID NO: 96781 - protein, 13 aa, Homo sapiens
  light chain complementarity determining region 3 for antibody 48391
QQTYMLTNNGGVT

SEQ ID NO: 96782 - protein, 15 aa, Homo sapiens
  heavy chain complementarity determining region 3 for antibody 48391
ARDAFSGSYSGSFDY

SEQ ID NO: 96783 - protein, 13 aa, Homo sapiens
  light chain complementarity determining region 3 for antibody 48392
QQTYMLTNNGGVM

SEQ ID NO: 96784 - protein, 15 aa, Homo sapiens
  heavy chain complementarity determining region 3 for antibody 48392
ARDSFSGSYSGSFDY

SEQ ID NO: 96785 - protein, 8 aa, Homo sapiens
  light chain complementarity determining region 3 for antibody 48393
QQTYLTVS

SEQ ID NO: 96786 - protein, 9 aa, Homo sapiens
  heavy chain complementarity determining region 3 for antibody 48393
ARGDYYFDY

SEQ ID NO: 96787 - protein, 10 aa, Homo sapiens
  light chain complementarity determining region 3 for antibody 48394
QQTYITPPWT

SEQ ID NO: 96788 - protein, 16 aa, Homo sapiens
  heavy chain complementarity determining region 3 for antibody 48394
ATDRTGFTMVRGALKH

SEQ ID NO: 96789 - protein, 9 aa, Homo sapiens
  light chain complementarity determining region 3 for antibody 48395
QQTYDTPIT

SEQ ID NO: 96790 - protein, 18 aa, Homo sapiens
  heavy chain complementarity determining region 3 for antibody 48395
ARDRAPRITMAPLDGMDV

SEQ ID NO: 96791 - protein, 10 aa, Homo sapiens
  light chain complementarity determining region 3 for antibody 48396
QQTSSPPPYT

SEQ ID NO: 96792 - protein, 16 aa, Homo sapiens
  heavy chain complementarity determining region 3 for antibody 48396
APQFGILDHGSGRPEG

SEQ ID NO: 96793 - protein, 11 aa, Homo sapiens
  light chain complementarity determining region 3 for antibody 48397
QQTNSFPQGGI

SEQ ID NO: 96794 - protein, 14 aa, Homo sapiens
  heavy chain complementarity determining region 3 for antibody 48397
ARDTGVRDPGYFDL

SEQ ID NO: 96795 - protein, 9 aa, Homo sapiens
  light chain complementarity determining region 3 for antibody 48398
QQTKRLPIT

SEQ ID NO: 96796 - protein, 16 aa, Homo sapiens
  heavy chain complementarity determining region 3 for antibody 48398
ARERANQFGVNDAFDI

SEQ ID NO: 96797 - protein, 9 aa, Homo sapiens
  light chain complementarity determining region 3 for antibody 48399
QQTHTPFFT

SEQ ID NO: 96798 - protein, 14 aa, Homo sapiens
  heavy chain complementarity determining region 3 for antibody 48399
AKELSAHDYSPLDS

SEQ ID NO: 96799 - protein, 10 aa, Homo sapiens
  light chain complementarity determining region 3 for antibody 48400
QQTFSTSPIT

SEQ ID NO: 96800 - protein, 16 aa, Homo sapiens
  heavy chain complementarity determining region 3 for antibody 48400
ARQGPWTSVVPPHFDH

SEQ ID NO: 96801 - protein, 10 aa, Homo sapiens
  light chain complementarity determining region 3 for antibody 48401
QQTFSPLALT

SEQ ID NO: 96802 - protein, 14 aa, Homo sapiens
  heavy chain complementarity determining region 3 for antibody 48401
ATMTGRDFYNWFDP

SEQ ID NO: 96803 - protein, 9 aa, Homo sapiens
  light chain complementarity determining region 3 for antibody 48402
QQTFRNPLT

SEQ ID NO: 96804 - protein, 21 aa, Homo sapiens
  heavy chain complementarity determining region 3 for antibody 48402
ARLGAAGDDFGDYLYYHGMDV

SEQ ID NO: 96805 - protein, 9 aa, Homo sapiens
  light chain complementarity determining region 3 for antibody 48403
QQTFDTPLT

SEQ ID NO: 96806 - protein, 18 aa, Homo sapiens
  heavy chain complementarity determining region 3 for antibody 48403
ATDGIYCRAGSCYSEGLS

SEQ ID NO: 96807 - protein, 9 aa, Homo sapiens
  light chain complementarity determining region 3 for antibody 48404
QQTDTRPWT

SEQ ID NO: 96808 - protein, 15 aa, Homo sapiens
  heavy chain complementarity determining region 3 for antibody 48404
ARDVGIDYNEGDRDY

SEQ ID NO: 96809 - protein, 9 aa, Homo sapiens
  light chain complementarity determining region 3 for antibody 48405
QQTDTPPGT

SEQ ID NO: 96810 - protein, 17 aa, Homo sapiens
  heavy chain complementarity determining region 3 for antibody 48405
AREVRYCSRTSCSRYDL

SEQ ID NO: 96811 - protein, 8 aa, Homo sapiens
  light chain complementarity determining region 3 for antibody 48406
QQTDSSSS

SEQ ID NO: 96812 - protein, 14 aa, Homo sapiens
  heavy chain complementarity determining region 3 for antibody 48406
AKGPTVTTPYYFDA

SEQ ID NO: 96813 - protein, 9 aa, Homo sapiens
  light chain complementarity determining region 3 for antibody 48407
QQSYYTPHT

SEQ ID NO: 96814 - protein, 12 aa, Homo sapiens
  heavy chain complementarity determining region 3 for antibody 48407
AREIGVRGLIDP

SEQ ID NO: 96815 - protein, 9 aa, Homo sapiens
  light chain complementarity determining region 3 for antibody 48408
QQSYTVPFT

SEQ ID NO: 96816 - protein, 12 aa, Homo sapiens
  heavy chain complementarity determining region 3 for antibody 48408
AIASPETNPFDP

SEQ ID NO: 96817 - protein, 9 aa, Homo sapiens
  light chain complementarity determining region 3 for antibody 48409
QQSYTVLDT

SEQ ID NO: 96818 - protein, 11 aa, Homo sapiens
  heavy chain complementarity determining region 3 for antibody 48409
ARDRTERVFDS

SEQ ID NO: 96819 - protein, 9 aa, Homo sapiens
  light chain complementarity determining region 3 for antibody 48410
QQSYTTPTT

SEQ ID NO: 96820 - protein, 21 aa, Homo sapiens
  heavy chain complementarity determining region 3 for antibody 48410
ARDLKLTSYYYDSSDDHYFDY

SEQ ID NO: 96821 - protein, 9 aa, Homo sapiens
  light chain complementarity determining region 3 for antibody 48411
QQSYTTPQT

SEQ ID NO: 96822 - protein, 19 aa, Homo sapiens
  heavy chain complementarity determining region 3 for antibody 48411
ARENNNYGPSIYYYYGLDV

SEQ ID NO: 96823 - protein, 9 aa, Homo sapiens
  light chain complementarity determining region 3 for antibody 48412
QQSYTTPQT

SEQ ID NO: 96824 - protein, 21 aa, Homo sapiens
  heavy chain complementarity determining region 3 for antibody 48412
ARDLKLTSYYYDSSDDHDFDY

SEQ ID NO: 96825 - protein, 9 aa, Homo sapiens
  light chain complementarity determining region 3 for antibody 48413
QQSYTTPQT

SEQ ID NO: 96826 - protein, 21 aa, Homo sapiens
  heavy chain complementarity determining region 3 for antibody 48413
ARDLKLTAYYYDSSDDHYFDY

SEQ ID NO: 96827 - protein, 9 aa, Homo sapiens
  light chain complementarity determining region 3 for antibody 48414
QQSYTTPQK

SEQ ID NO: 96828 - protein, 21 aa, Homo sapiens
  heavy chain complementarity determining region 3 for antibody 48414
ARDLKLTSYYYDSSDDHYFDY

SEQ ID NO: 96829 - protein, 10 aa, Homo sapiens
  light chain complementarity determining region 3 for antibody 48415
QQSYTTPPWT

SEQ ID NO: 96830 - protein, 23 aa, Homo sapiens
  heavy chain complementarity determining region 3 for antibody 48415
VKDLQLSGYGPLAELNSYNNMDV

SEQ ID NO: 96831 - protein, 9 aa, Homo sapiens
  light chain complementarity determining region 3 for antibody 48416
QQSYTTPPT

SEQ ID NO: 96832 - protein, 18 aa, Homo sapiens
  heavy chain complementarity determining region 3 for antibody 48416
ETEADVMVITTSYNLFDR

SEQ ID NO: 96833 - protein, 9 aa, Homo sapiens
  light chain complementarity determining region 3 for antibody 48417
QQSYTTPPT

SEQ ID NO: 96834 - protein, 21 aa, Homo sapiens
  heavy chain complementarity determining region 3 for antibody 48417
ARDLKLTSYYYDSSDDHYFDY

SEQ ID NO: 96835 - protein, 9 aa, Homo sapiens
  light chain complementarity determining region 3 for antibody 48418
QQSYTTPLT

SEQ ID NO: 96836 - protein, 22 aa, Homo sapiens
  heavy chain complementarity determining region 3 for antibody 48418
AVLAGLEVIRGGLPTWRDWFDP

SEQ ID NO: 96837 - protein, 9 aa, Homo sapiens
  light chain complementarity determining region 3 for antibody 48419
QQSYTTPLT

SEQ ID NO: 96838 - protein, 17 aa, Homo sapiens
  heavy chain complementarity determining region 3 for antibody 48419
AKDLSWNGDGYFYGMDV

SEQ ID NO: 96839 - protein, 9 aa, Homo sapiens
  light chain complementarity determining region 3 for antibody 48420
QQSYTTPHT

SEQ ID NO: 96840 - protein, 21 aa, Homo sapiens
  heavy chain complementarity determining region 3 for antibody 48420
ARDLKLTSYYYDSSDDHYFDY

SEQ ID NO: 96841 - protein, 9 aa, Homo sapiens
  light chain complementarity determining region 3 for antibody 48421
QQSYTSPLT

SEQ ID NO: 96842 - protein, 14 aa, Homo sapiens
  heavy chain complementarity determining region 3 for antibody 48421
VRFGGGYSYGYFDF

SEQ ID NO: 96843 - protein, 9 aa, Homo sapiens
  light chain complementarity determining region 3 for antibody 48422
QQSYTPPQT

SEQ ID NO: 96844 - protein, 21 aa, Homo sapiens
  heavy chain complementarity determining region 3 for antibody 48422
ARDLKLTSYYYDSSDDHYFDY

SEQ ID NO: 96845 - protein, 9 aa, Homo sapiens
  light chain complementarity determining region 3 for antibody 48423
QQSYTPPNT

SEQ ID NO: 96846 - protein, 11 aa, Homo sapiens
  heavy chain complementarity determining region 3 for antibody 48423
ARQHSGYLAGH

SEQ ID NO: 96847 - protein, 9 aa, Homo sapiens
  light chain complementarity determining region 3 for antibody 48424
QQSYTKFLT

SEQ ID NO: 96848 - protein, 19 aa, Homo sapiens
  heavy chain complementarity determining region 3 for antibody 48424
AHQNYDKSGSYYEGNGMDV

SEQ ID NO: 96849 - protein, 9 aa, Homo sapiens
  light chain complementarity determining region 3 for antibody 48425
QQSYTIPQT

SEQ ID NO: 96850 - protein, 21 aa, Homo sapiens
  heavy chain complementarity determining region 3 for antibody 48425
ARDLKLTSYYYDSSDDHYFDY

SEQ ID NO: 96851 - protein, 9 aa, Homo sapiens
  light chain complementarity determining region 3 for antibody 48426
QQSYTAPLT

SEQ ID NO: 96852 - protein, 16 aa, Homo sapiens
  heavy chain complementarity determining region 3 for antibody 48426
ARSKSRAVEVEAPFDI

SEQ ID NO: 96853 - protein, 10 aa, Homo sapiens
  light chain complementarity determining region 3 for antibody 48427
QQSYSVPPYP

SEQ ID NO: 96854 - protein, 12 aa, Homo sapiens
  heavy chain complementarity determining region 3 for antibody 48427
ARGDGYNYELEY

SEQ ID NO: 96855 - protein, 9 aa, Homo sapiens
  light chain complementarity determining region 3 for antibody 48428
QQSYSTWYT

SEQ ID NO: 96856 - protein, 14 aa, Homo sapiens
  heavy chain complementarity determining region 3 for antibody 48428
ARQTRYTNSWYFDS

SEQ ID NO: 96857 - protein, 9 aa, Homo sapiens
  light chain complementarity determining region 3 for antibody 48429
QQSYSTWYT

SEQ ID NO: 96858 - protein, 14 aa, Homo sapiens
  heavy chain complementarity determining region 3 for antibody 48429
ARQTRYPNSWYFDY

SEQ ID NO: 96859 - protein, 9 aa, Homo sapiens
  light chain complementarity determining region 3 for antibody 48430
QQSYSTVWP

SEQ ID NO: 96860 - protein, 19 aa, Homo sapiens
  heavy chain complementarity determining region 3 for antibody 48430
ARGGLWNALRPSYYYIVDV

SEQ ID NO: 96861 - protein, 9 aa, Homo sapiens
  light chain complementarity determining region 3 for antibody 48431
QQSYSTVRT

SEQ ID NO: 96862 - protein, 19 aa, Homo sapiens
  heavy chain complementarity determining region 3 for antibody 48431
ARGGLWNALRPSYYYIVDV

SEQ ID NO: 96863 - protein, 10 aa, Homo sapiens
  light chain complementarity determining region 3 for antibody 48432
QQSYSTSTWT

SEQ ID NO: 96864 - protein, 16 aa, Homo sapiens
  heavy chain complementarity determining region 3 for antibody 48432
ATFGPTKALRTVAFDL

SEQ ID NO: 96865 - protein, 10 aa, Homo sapiens
  light chain complementarity determining region 3 for antibody 48433
QQSYSTSSYT

SEQ ID NO: 96866 - protein, 17 aa, Homo sapiens
  heavy chain complementarity determining region 3 for antibody 48433
AREKMQVGITFWRYFDV

SEQ ID NO: 96867 - protein, 9 aa, Homo sapiens
  light chain complementarity determining region 3 for antibody 48434
QQSYSTPYT

SEQ ID NO: 96868 - protein, 12 aa, Homo sapiens
  heavy chain complementarity determining region 3 for antibody 48434
VKPAYNSGWYDF

SEQ ID NO: 96869 - protein, 9 aa, Homo sapiens
  light chain complementarity determining region 3 for antibody 48435
QQSYSTPYT

SEQ ID NO: 96870 - protein, 12 aa, Homo sapiens
  heavy chain complementarity determining region 3 for antibody 48435
VHKGGRGNPFDD

SEQ ID NO: 96871 - protein, 9 aa, Homo sapiens
  light chain complementarity determining region 3 for antibody 48436
QQSYSTPYT

SEQ ID NO: 96872 - protein, 20 aa, Homo sapiens
  heavy chain complementarity determining region 3 for antibody 48436
TADRVVLRFLERPPKSWFDP

SEQ ID NO: 96873 - protein, 9 aa, Homo sapiens
  light chain complementarity determining region 3 for antibody 48437
QQSYSTPYT

SEQ ID NO: 96874 - protein, 7 aa, Homo sapiens
  heavy chain complementarity determining region 3 for antibody 48437
ERDGIDY

SEQ ID NO: 96875 - protein, 9 aa, Homo sapiens
  light chain complementarity determining region 3 for antibody 48438
QQSYSTPYT

SEQ ID NO: 96876 - protein, 17 aa, Homo sapiens
  heavy chain complementarity determining region 3 for antibody 48438
ATLAANDCLNGADGFDV

SEQ ID NO: 96877 - protein, 9 aa, Homo sapiens
  light chain complementarity determining region 3 for antibody 48439
QQSYSTPYT

SEQ ID NO: 96878 - protein, 15 aa, Homo sapiens
  heavy chain complementarity determining region 3 for antibody 48439
ARGRSYYDSSGSNYF

SEQ ID NO: 96879 - protein, 9 aa, Homo sapiens
  light chain complementarity determining region 3 for antibody 48440
QQSYSTPYT

SEQ ID NO: 96880 - protein, 10 aa, Homo sapiens
  heavy chain complementarity determining region 3 for antibody 48440
ARDRRPLASD

SEQ ID NO: 96881 - protein, 9 aa, Homo sapiens
  light chain complementarity determining region 3 for antibody 48441
QQSYSTPYP

SEQ ID NO: 96882 - protein, 12 aa, Homo sapiens
  heavy chain complementarity determining region 3 for antibody 48441
VHKGGRGNPFDV

SEQ ID NO: 96883 - protein, 9 aa, Homo sapiens
  light chain complementarity determining region 3 for antibody 48442
QQSYSTPYP

SEQ ID NO: 96884 - protein, 19 aa, Homo sapiens
  heavy chain complementarity determining region 3 for antibody 48442
ARVAYAYHDSSGYYYVFDI

SEQ ID NO: 96885 - protein, 9 aa, Homo sapiens
  light chain complementarity determining region 3 for antibody 48443
QQSYSTPYP

SEQ ID NO: 96886 - protein, 16 aa, Homo sapiens
  heavy chain complementarity determining region 3 for antibody 48443
ARAKWDRGLAVAGFDY

SEQ ID NO: 96887 - protein, 9 aa, Homo sapiens
  light chain complementarity determining region 3 for antibody 48444
QQSYSTPWT

SEQ ID NO: 96888 - protein, 15 aa, Homo sapiens
  heavy chain complementarity determining region 3 for antibody 48444
ARVESVAGSREYFHP

SEQ ID NO: 96889 - protein, 9 aa, Homo sapiens
  light chain complementarity determining region 3 for antibody 48445
QQSYSTPWT

SEQ ID NO: 96890 - protein, 10 aa, Homo sapiens
  heavy chain complementarity determining region 3 for antibody 48445
ARGPSMMIAE

SEQ ID NO: 96891 - protein, 9 aa, Homo sapiens
  light chain complementarity determining region 3 for antibody 48446
QQSYSTPWT

SEQ ID NO: 96892 - protein, 14 aa, Homo sapiens
  heavy chain complementarity determining region 3 for antibody 48446
ARDGVSGVRNGMDV

SEQ ID NO: 96893 - protein, 9 aa, Homo sapiens
  light chain complementarity determining region 3 for antibody 48447
QQSYSTPWT

SEQ ID NO: 96894 - protein, 17 aa, Homo sapiens
  heavy chain complementarity determining region 3 for antibody 48447
AKGKDVWFGGSPDAFDI

SEQ ID NO: 96895 - protein, 9 aa, Homo sapiens
  light chain complementarity determining region 3 for antibody 48448
QQSYSTPVT

SEQ ID NO: 96896 - protein, 10 aa, Homo sapiens
  heavy chain complementarity determining region 3 for antibody 48448
ASLQSGGYYP

SEQ ID NO: 96897 - protein, 9 aa, Homo sapiens
  light chain complementarity determining region 3 for antibody 48449
QQSYSTPST

SEQ ID NO: 96898 - protein, 12 aa, Homo sapiens
  heavy chain complementarity determining region 3 for antibody 48449
TRDGTVTTDLQL

SEQ ID NO: 96899 - protein, 9 aa, Homo sapiens
  light chain complementarity determining region 3 for antibody 48450
QQSYSTPST

SEQ ID NO: 96900 - protein, 16 aa, Homo sapiens
  heavy chain complementarity determining region 3 for antibody 48450
ARGRGYGGNSLRSFDY

SEQ ID NO: 96901 - protein, 9 aa, Homo sapiens
  light chain complementarity determining region 3 for antibody 48451
QQSYSTPST

SEQ ID NO: 96902 - protein, 7 aa, Homo sapiens
  heavy chain complementarity determining region 3 for antibody 48451
ARDGIDY

SEQ ID NO: 96903 - protein, 9 aa, Homo sapiens
  light chain complementarity determining region 3 for antibody 48452
QQSYSTPST

SEQ ID NO: 96904 - protein, 15 aa, Homo sapiens
  heavy chain complementarity determining region 3 for antibody 48452
AAAGLDPYDSGSYGL

SEQ ID NO: 96905 - protein, 9 aa, Homo sapiens
  light chain complementarity determining region 3 for antibody 48453
QQSYSTPST

SEQ ID NO: 96906 - protein, 15 aa, Homo sapiens
  heavy chain complementarity determining region 3 for antibody 48453
AAAGLDPSDSGSYWL

SEQ ID NO: 96907 - protein, 9 aa, Homo sapiens
  light chain complementarity determining region 3 for antibody 48454
QQSYSTPRT

SEQ ID NO: 96908 - protein, 14 aa, Homo sapiens
  heavy chain complementarity determining region 3 for antibody 48454
ASEVEAAAGRFLDY

SEQ ID NO: 96909 - protein, 9 aa, Homo sapiens
  light chain complementarity determining region 3 for antibody 48455
QQSYSTPRT

SEQ ID NO: 96910 - protein, 11 aa, Homo sapiens
  heavy chain complementarity determining region 3 for antibody 48455
ARMRGGWYVES

SEQ ID NO: 96911 - protein, 9 aa, Homo sapiens
  light chain complementarity determining region 3 for antibody 48456
QQSYSTPRT

SEQ ID NO: 96912 - protein, 7 aa, Homo sapiens
  heavy chain complementarity determining region 3 for antibody 48456
ARLGHPY

SEQ ID NO: 96913 - protein, 9 aa, Homo sapiens
  light chain complementarity determining region 3 for antibody 48457
QQSYSTPRT

SEQ ID NO: 96914 - protein, 22 aa, Homo sapiens
  heavy chain complementarity determining region 3 for antibody 48457
AREYYARSGSGFHSYSYYGMDV

SEQ ID NO: 96915 - protein, 9 aa, Homo sapiens
  light chain complementarity determining region 3 for antibody 48458
QQSYSTPRT

SEQ ID NO: 96916 - protein, 20 aa, Homo sapiens
  heavy chain complementarity determining region 3 for antibody 48458
ARESGDNLEMPASPYGALDV

SEQ ID NO: 96917 - protein, 9 aa, Homo sapiens
  light chain complementarity determining region 3 for antibody 48459
QQSYSTPRI

SEQ ID NO: 96918 - protein, 15 aa, Homo sapiens
  heavy chain complementarity determining region 3 for antibody 48459
ARGEVGAGLKYLFDF

SEQ ID NO: 96919 - protein, 9 aa, Homo sapiens
  light chain complementarity determining region 3 for antibody 48460
QQSYSTPRH

SEQ ID NO: 96920 - protein, 12 aa, Homo sapiens
  heavy chain complementarity determining region 3 for antibody 48460
TGEAPSRAWFDP

SEQ ID NO: 96921 - protein, 10 aa, Homo sapiens
  light chain complementarity determining region 3 for antibody 48461
QQSYSTPRDP

SEQ ID NO: 96922 - protein, 16 aa, Homo sapiens
  heavy chain complementarity determining region 3 for antibody 48461
ARVEYYYDRSGYFWDY

SEQ ID NO: 96923 - protein, 10 aa, Homo sapiens
  light chain complementarity determining region 3 for antibody 48462
QQSYSTPRAT

SEQ ID NO: 96924 - protein, 16 aa, Homo sapiens
  heavy chain complementarity determining region 3 for antibody 48462
ARVEYYYDRSGYFWDY

SEQ ID NO: 96925 - protein, 10 aa, Homo sapiens
  light chain complementarity determining region 3 for antibody 48463
QQSYSTPQWT

SEQ ID NO: 96926 - protein, 13 aa, Homo sapiens
  heavy chain complementarity determining region 3 for antibody 48463
ARPPIYRSGWFEY

SEQ ID NO: 96927 - protein, 10 aa, Homo sapiens
  light chain complementarity determining region 3 for antibody 48464
QQSYSTPPYT

SEQ ID NO: 96928 - protein, 15 aa, Homo sapiens
  heavy chain complementarity determining region 3 for antibody 48464
ARWGNDNGDYGRLDS

SEQ ID NO: 96929 - protein, 10 aa, Homo sapiens
  light chain complementarity determining region 3 for antibody 48465
QQSYSTPPWT

SEQ ID NO: 96930 - protein, 19 aa, Homo sapiens
  heavy chain complementarity determining region 3 for antibody 48465
ARDGNPKQSGRRTPSCFDY

SEQ ID NO: 96931 - protein, 10 aa, Homo sapiens
  light chain complementarity determining region 3 for antibody 48466
QQSYSTPPVP

SEQ ID NO: 96932 - protein, 15 aa, Homo sapiens
  heavy chain complementarity determining region 3 for antibody 48466
AREYRSSRYRRRFDY

SEQ ID NO: 96933 - protein, 9 aa, Homo sapiens
  light chain complementarity determining region 3 for antibody 48467
QQSYSTPPT

SEQ ID NO: 96934 - protein, 10 aa, Homo sapiens
  heavy chain complementarity determining region 3 for antibody 48467
AHSHGMDSDY

SEQ ID NO: 96935 - protein, 9 aa, Homo sapiens
  light chain complementarity determining region 3 for antibody 48468
QQSYSTPPP

SEQ ID NO: 96936 - protein, 18 aa, Homo sapiens
  heavy chain complementarity determining region 3 for antibody 48468
ARRKDEKGWYRGDDAFDV

SEQ ID NO: 96937 - protein, 9 aa, Homo sapiens
  light chain complementarity determining region 3 for antibody 48469
QQSYSTPPN

SEQ ID NO: 96938 - protein, 22 aa, Homo sapiens
  heavy chain complementarity determining region 3 for antibody 48469
ATYGRLEGMVRGIPSLFWFFDL

SEQ ID NO: 96939 - protein, 11 aa, Homo sapiens
  light chain complementarity determining region 3 for antibody 48470
QQSYSTPPMYT

SEQ ID NO: 96940 - protein, 20 aa, Homo sapiens
  heavy chain complementarity determining region 3 for antibody 48470
ARGPDVSGKSAYPYYYGLDV

SEQ ID NO: 96941 - protein, 10 aa, Homo sapiens
  light chain complementarity determining region 3 for antibody 48471
QQSYSTPPLT

SEQ ID NO: 96942 - protein, 15 aa, Homo sapiens
  heavy chain complementarity determining region 3 for antibody 48471
ARESIEEGGNSYFHH

SEQ ID NO: 96943 - protein, 9 aa, Homo sapiens
  light chain complementarity determining region 3 for antibody 48472
QQSYSTPNT

SEQ ID NO: 96944 - protein, 16 aa, Homo sapiens
  heavy chain complementarity determining region 3 for antibody 48472
ARPLTRYSNRAWTSDI

SEQ ID NO: 96945 - protein, 9 aa, Homo sapiens
  light chain complementarity determining region 3 for antibody 48473
QQSYSTPLT

SEQ ID NO: 96946 - protein, 11 aa, Homo sapiens
  heavy chain complementarity determining region 3 for antibody 48473
ARSGSSWYLDF

SEQ ID NO: 96947 - protein, 9 aa, Homo sapiens
  light chain complementarity determining region 3 for antibody 48474
QQSYSTPLS

SEQ ID NO: 96948 - protein, 14 aa, Homo sapiens
  heavy chain complementarity determining region 3 for antibody 48474
ARSADTSGYSRFDY

SEQ ID NO: 96949 - protein, 9 aa, Homo sapiens
  light chain complementarity determining region 3 for antibody 48475
QQSYSTPLP

SEQ ID NO: 96950 - protein, 13 aa, Homo sapiens
  heavy chain complementarity determining region 3 for antibody 48475
ARVGVFGDTDFDS

SEQ ID NO: 96951 - protein, 9 aa, Homo sapiens
  light chain complementarity determining region 3 for antibody 48476
QQSYSTPKT

SEQ ID NO: 96952 - protein, 12 aa, Homo sapiens
  heavy chain complementarity determining region 3 for antibody 48476
AKNLMIGDPMRV

SEQ ID NO: 96953 - protein, 9 aa, Homo sapiens
  light chain complementarity determining region 3 for antibody 48477
QQSYSTPIT

SEQ ID NO: 96954 - protein, 17 aa, Homo sapiens
  heavy chain complementarity determining region 3 for antibody 48477
LGIPDLDNFEISRYSSL

SEQ ID NO: 96955 - protein, 9 aa, Homo sapiens
  light chain complementarity determining region 3 for antibody 48478
QQSYSTPHT

SEQ ID NO: 96956 - protein, 11 aa, Homo sapiens
  heavy chain complementarity determining region 3 for antibody 48478
VRGQWLEPIEY

SEQ ID NO: 96957 - protein, 9 aa, Homo sapiens
  light chain complementarity determining region 3 for antibody 48479
QQSYSTPHT

SEQ ID NO: 96958 - protein, 16 aa, Homo sapiens
  heavy chain complementarity determining region 3 for antibody 48479
ARYYSGSETWAKYFDD

SEQ ID NO: 96959 - protein, 9 aa, Homo sapiens
  light chain complementarity determining region 3 for antibody 48480
QQSYSTPGT

SEQ ID NO: 96960 - protein, 15 aa, Homo sapiens
  heavy chain complementarity determining region 3 for antibody 48480
ARVESVAGSREYFQH

SEQ ID NO: 96961 - protein, 9 aa, Homo sapiens
  light chain complementarity determining region 3 for antibody 48481
QQSYSTPGT

SEQ ID NO: 96962 - protein, 11 aa, Homo sapiens
  heavy chain complementarity determining region 3 for antibody 48481
ARMRGGWYVES

SEQ ID NO: 96963 - protein, 9 aa, Homo sapiens
  light chain complementarity determining region 3 for antibody 48482
QQSYSTPGT

SEQ ID NO: 96964 - protein, 16 aa, Homo sapiens
  heavy chain complementarity determining region 3 for antibody 48482
ARGDGYTYGSTYGLDV

SEQ ID NO: 96965 - protein, 9 aa, Homo sapiens
  light chain complementarity determining region 3 for antibody 48483
QQSYSTPGT

SEQ ID NO: 96966 - protein, 15 aa, Homo sapiens
  heavy chain complementarity determining region 3 for antibody 48483
AKDIRSTDTAMVADY

SEQ ID NO: 96967 - protein, 10 aa, Homo sapiens
  light chain complementarity determining region 3 for antibody 48484
QQSYSTPGFT

SEQ ID NO: 96968 - protein, 13 aa, Homo sapiens
  heavy chain complementarity determining region 3 for antibody 48484
AASGTYGGGWFDP

SEQ ID NO: 96969 - protein, 9 aa, Homo sapiens
  light chain complementarity determining region 3 for antibody 48485
QQSYSTPFT

SEQ ID NO: 96970 - protein, 14 aa, Homo sapiens
  heavy chain complementarity determining region 3 for antibody 48485
ALAGYGSSAMTFDY

SEQ ID NO: 96971 - protein, 9 aa, Homo sapiens
  light chain complementarity determining region 3 for antibody 48486
QQSYSTPFP

SEQ ID NO: 96972 - protein, 18 aa, Homo sapiens
  heavy chain complementarity determining region 3 for antibody 48486
ARDLRPAISSGWYDAFDI

SEQ ID NO: 96973 - protein, 10 aa, Homo sapiens
  light chain complementarity determining region 3 for antibody 48487
QQSYSTPEFT

SEQ ID NO: 96974 - protein, 13 aa, Homo sapiens
  heavy chain complementarity determining region 3 for antibody 48487
ARDPGEAVTAFDF

SEQ ID NO: 96975 - protein, 9 aa, Homo sapiens
  light chain complementarity determining region 3 for antibody 48488
QQSYSTPDT

SEQ ID NO: 96976 - protein, 10 aa, Homo sapiens
  heavy chain complementarity determining region 3 for antibody 48488
ARASGHSLDY

SEQ ID NO: 96977 - protein, 9 aa, Homo sapiens
  light chain complementarity determining region 3 for antibody 48489
QQSYSTPCT

SEQ ID NO: 96978 - protein, 11 aa, Homo sapiens
  heavy chain complementarity determining region 3 for antibody 48489
ARMRGGWYVES

SEQ ID NO: 96979 - protein, 9 aa, Homo sapiens
  light chain complementarity determining region 3 for antibody 48490
QQSYSTLWT

SEQ ID NO: 96980 - protein, 17 aa, Homo sapiens
  heavy chain complementarity determining region 3 for antibody 48490
ARWVSYCSGTSCPVFDP

SEQ ID NO: 96981 - protein, 10 aa, Homo sapiens
  light chain complementarity determining region 3 for antibody 48491
QQSYSTLTGT

SEQ ID NO: 96982 - protein, 14 aa, Homo sapiens
  heavy chain complementarity determining region 3 for antibody 48491
ARDSFGPEVVVDDY

SEQ ID NO: 96983 - protein, 10 aa, Homo sapiens
  light chain complementarity determining region 3 for antibody 48492
QQSYSTLLYT

SEQ ID NO: 96984 - protein, 11 aa, Homo sapiens
  heavy chain complementarity determining region 3 for antibody 48492
AKDTNFWTIDY

SEQ ID NO: 96985 - protein, 10 aa, Homo sapiens
  light chain complementarity determining region 3 for antibody 48493
QQSYSTLLYT

SEQ ID NO: 96986 - protein, 11 aa, Homo sapiens
  heavy chain complementarity determining region 3 for antibody 48493
AKDNNVWTIDY

SEQ ID NO: 96987 - protein, 10 aa, Homo sapiens
  light chain complementarity determining region 3 for antibody 48494
QQSYSTLLYN

SEQ ID NO: 96988 - protein, 11 aa, Homo sapiens
  heavy chain complementarity determining region 3 for antibody 48494
AKDNNFWTIDY

SEQ ID NO: 96989 - protein, 10 aa, Homo sapiens
  light chain complementarity determining region 3 for antibody 48495
QQSYSTLLHT

SEQ ID NO: 96990 - protein, 11 aa, Homo sapiens
  heavy chain complementarity determining region 3 for antibody 48495
AKDNNFWTIDY

SEQ ID NO: 96991 - protein, 10 aa, Homo sapiens
  light chain complementarity determining region 3 for antibody 48496
QQSYSTLLDT

SEQ ID NO: 96992 - protein, 11 aa, Homo sapiens
  heavy chain complementarity determining region 3 for antibody 48496
AKDNNFWTIDY

SEQ ID NO: 96993 - protein, 10 aa, Homo sapiens
  light chain complementarity determining region 3 for antibody 48497
QQSYSTLAWM

SEQ ID NO: 96994 - protein, 17 aa, Homo sapiens
  heavy chain complementarity determining region 3 for antibody 48497
ARENRVGPGGVFIPIDH

SEQ ID NO: 96995 - protein, 10 aa, Homo sapiens
  light chain complementarity determining region 3 for antibody 48498
QQSYSTLART

SEQ ID NO: 96996 - protein, 17 aa, Homo sapiens
  heavy chain complementarity determining region 3 for antibody 48498
ARENRVGPGGVFIPIDH

SEQ ID NO: 96997 - protein, 9 aa, Homo sapiens
  light chain complementarity determining region 3 for antibody 48499
QQSYSSVGT

SEQ ID NO: 96998 - protein, 15 aa, Homo sapiens
  heavy chain complementarity determining region 3 for antibody 48499
ARLRKAFGDPNWFDP

SEQ ID NO: 96999 - protein, 9 aa, Homo sapiens
  light chain complementarity determining region 3 for antibody 48500
QQSYSSPYT

SEQ ID NO: 97000 - protein, 13 aa, Homo sapiens
  heavy chain complementarity determining region 3 for antibody 48500
ARAKDYDDNSYDY

SEQ ID NO: 97001 - protein, 9 aa, Homo sapiens
  light chain complementarity determining region 3 for antibody 48501
QQSYSSPYS

SEQ ID NO: 97002 - protein, 18 aa, Homo sapiens
  heavy chain complementarity determining region 3 for antibody 48501
VRRAIKTSGWTVVHYFDY

SEQ ID NO: 97003 - protein, 11 aa, Homo sapiens
  light chain complementarity determining region 3 for antibody 48502
QQSYSSPPMYT

SEQ ID NO: 97004 - protein, 22 aa, Homo sapiens
  heavy chain complementarity determining region 3 for antibody 48502
ARDPLGPYYYDSSTSREGYFDY

SEQ ID NO: 97005 - protein, 9 aa, Homo sapiens
  light chain complementarity determining region 3 for antibody 48503
QQSYSSPLT

SEQ ID NO: 97006 - protein, 21 aa, Homo sapiens
  heavy chain complementarity determining region 3 for antibody 48503
AHTASYYDSSGYYYGRSPFDI

SEQ ID NO: 97007 - protein, 8 aa, Homo sapiens
  light chain complementarity determining region 3 for antibody 48504
QQSYSSLT

SEQ ID NO: 97008 - protein, 15 aa, Homo sapiens
  heavy chain complementarity determining region 3 for antibody 48504
ARGGTGYYSGHFFDI

SEQ ID NO: 97009 - protein, 10 aa, Homo sapiens
  light chain complementarity determining region 3 for antibody 48505
QQSYSSLLLT

SEQ ID NO: 97010 - protein, 14 aa, Homo sapiens
  heavy chain complementarity determining region 3 for antibody 48505
ARPHYYDSGSCYDS

SEQ ID NO: 97011 - protein, 9 aa, Homo sapiens
  light chain complementarity determining region 3 for antibody 48506
QQSYSRPYT

SEQ ID NO: 97012 - protein, 20 aa, Homo sapiens
  heavy chain complementarity determining region 3 for antibody 48506
GKDLWDGGYCSRTSCHGIDS

SEQ ID NO: 97013 - protein, 9 aa, Homo sapiens
  light chain complementarity determining region 3 for antibody 48507
QQSYSRPIT

SEQ ID NO: 97014 - protein, 12 aa, Homo sapiens
  heavy chain complementarity determining region 3 for antibody 48507
TWGKGSHIWFDP

SEQ ID NO: 97015 - protein, 9 aa, Homo sapiens
  light chain complementarity determining region 3 for antibody 48508
QQSYSRIRT

SEQ ID NO: 97016 - protein, 14 aa, Homo sapiens
  heavy chain complementarity determining region 3 for antibody 48508
ARRYCSGETCPEDY

SEQ ID NO: 97017 - protein, 10 aa, Homo sapiens
  light chain complementarity determining region 3 for antibody 48509
QQSYSPSMST

SEQ ID NO: 97018 - protein, 17 aa, Homo sapiens
  heavy chain complementarity determining region 3 for antibody 48509
ARETAQVGIEYWRYLDL

SEQ ID NO: 97019 - protein, 9 aa, Homo sapiens
  light chain complementarity determining region 3 for antibody 48510
QQSYSPPWT

SEQ ID NO: 97020 - protein, 16 aa, Homo sapiens
  heavy chain complementarity determining region 3 for antibody 48510
ARDHYYGSASHRAFDI

SEQ ID NO: 97021 - protein, 10 aa, Homo sapiens
  light chain complementarity determining region 3 for antibody 48511
QQSYSPPGYT

SEQ ID NO: 97022 - protein, 19 aa, Homo sapiens
  heavy chain complementarity determining region 3 for antibody 48511
VRGRDDFWSGNYFIHAMDV

SEQ ID NO: 97023 - protein, 9 aa, Homo sapiens
  light chain complementarity determining region 3 for antibody 48512
QQSYSNPYT

SEQ ID NO: 97024 - protein, 16 aa, Homo sapiens
  heavy chain complementarity determining region 3 for antibody 48512
TRGPGGRDEYKDAFDI

SEQ ID NO: 97025 - protein, 10 aa, Homo sapiens
  light chain complementarity determining region 3 for antibody 48513
QQSYSNPPYT

SEQ ID NO: 97026 - protein, 15 aa, Homo sapiens
  heavy chain complementarity determining region 3 for antibody 48513
ARHSMVFGSSSPFDY

SEQ ID NO: 97027 - protein, 9 aa, Homo sapiens
  light chain complementarity determining region 3 for antibody 48514
QQSYSLPLS

SEQ ID NO: 97028 - protein, 14 aa, Homo sapiens
  heavy chain complementarity determining region 3 for antibody 48514
ARGTTVLSVEAFDY

SEQ ID NO: 97029 - protein, 8 aa, Homo sapiens
  light chain complementarity determining region 3 for antibody 48515
QQSYSKPA

SEQ ID NO: 97030 - protein, 14 aa, Homo sapiens
  heavy chain complementarity determining region 3 for antibody 48515
ARVLDASYYYGIDV

SEQ ID NO: 97031 - protein, 9 aa, Homo sapiens
  light chain complementarity determining region 3 for antibody 48516
QQSYSIPRP

SEQ ID NO: 97032 - protein, 14 aa, Homo sapiens
  heavy chain complementarity determining region 3 for antibody 48516
AENQYSSGSLSSDI

SEQ ID NO: 97033 - protein, 9 aa, Homo sapiens
  light chain complementarity determining region 3 for antibody 48517
QQSYSIPIT

SEQ ID NO: 97034 - protein, 10 aa, Homo sapiens
  heavy chain complementarity determining region 3 for antibody 48517
ARGVPLGGDF

SEQ ID NO: 97035 - protein, 10 aa, Homo sapiens
  light chain complementarity determining region 3 for antibody 48518
QQSYSGPALT

SEQ ID NO: 97036 - protein, 15 aa, Homo sapiens
  heavy chain complementarity determining region 3 for antibody 48518
ARVWGEINYYYGMDV

SEQ ID NO: 97037 - protein, 9 aa, Homo sapiens
  light chain complementarity determining region 3 for antibody 48519
QQSYSGLYS

SEQ ID NO: 97038 - protein, 12 aa, Homo sapiens
  heavy chain complementarity determining region 3 for antibody 48519
ATYGDYYSPFDY

SEQ ID NO: 97039 - protein, 9 aa, Homo sapiens
  light chain complementarity determining region 3 for antibody 48520
QQSYSGLVS

SEQ ID NO: 97040 - protein, 12 aa, Homo sapiens
  heavy chain complementarity determining region 3 for antibody 48520
ATYGDYYSPFDY

SEQ ID NO: 97041 - protein, 13 aa, Homo sapiens
  light chain complementarity determining region 3 for antibody 48521
QQSYSGAHSGPYR

SEQ ID NO: 97042 - protein, 18 aa, Homo sapiens
  heavy chain complementarity determining region 3 for antibody 48521
VRVRCGGGDCFPGSYFDY

SEQ ID NO: 97043 - protein, 9 aa, Homo sapiens
  light chain complementarity determining region 3 for antibody 48522
QQSYSFLYN

SEQ ID NO: 97044 - protein, 18 aa, Homo sapiens
  heavy chain complementarity determining region 3 for antibody 48522
ARDRGNDHGDLDGFYFDL

SEQ ID NO: 97045 - protein, 9 aa, Homo sapiens
  light chain complementarity determining region 3 for antibody 48523
QQSYSAPRS

SEQ ID NO: 97046 - protein, 14 aa, Homo sapiens
  heavy chain complementarity determining region 3 for antibody 48523
VRAGQYSTNWYGVD

SEQ ID NO: 97047 - protein, 10 aa, Homo sapiens
  light chain complementarity determining region 3 for antibody 48524
QQSYSAPQGT

SEQ ID NO: 97048 - protein, 19 aa, Homo sapiens
  heavy chain complementarity determining region 3 for antibody 48524
ARVRITMIRGIIITYAFDI

SEQ ID NO: 97049 - protein, 10 aa, Homo sapiens
  light chain complementarity determining region 3 for antibody 48525
QQSYSAPQFP

SEQ ID NO: 97050 - protein, 14 aa, Homo sapiens
  heavy chain complementarity determining region 3 for antibody 48525
ARVYGDYDLDHFDY

SEQ ID NO: 97051 - protein, 9 aa, Homo sapiens
  light chain complementarity determining region 3 for antibody 48526
QQSYSAPLP

SEQ ID NO: 97052 - protein, 14 aa, Homo sapiens
  heavy chain complementarity determining region 3 for antibody 48526
AKCRDTSGYSGFDL

SEQ ID NO: 97053 - protein, 9 aa, Homo sapiens
  light chain complementarity determining region 3 for antibody 48527
QQSYSAPFT

SEQ ID NO: 97054 - protein, 21 aa, Homo sapiens
  heavy chain complementarity determining region 3 for antibody 48527
ASAVQSRGVRGIIILPDVFDI

SEQ ID NO: 97055 - protein, 10 aa, Homo sapiens
  light chain complementarity determining region 3 for antibody 48528
QQSYRTPQLP

SEQ ID NO: 97056 - protein, 13 aa, Homo sapiens
  heavy chain complementarity determining region 3 for antibody 48528
ARDPGEAVPAFDF

SEQ ID NO: 97057 - protein, 10 aa, Homo sapiens
  light chain complementarity determining region 3 for antibody 48529
QQSYRTPPST

SEQ ID NO: 97058 - protein, 14 aa, Homo sapiens
  heavy chain complementarity determining region 3 for antibody 48529
AKVEPYGDNHRFDY

SEQ ID NO: 97059 - protein, 10 aa, Homo sapiens
  light chain complementarity determining region 3 for antibody 48530
QQSYRTPPFP

SEQ ID NO: 97060 - protein, 14 aa, Homo sapiens
  heavy chain complementarity determining region 3 for antibody 48530
AKVEPYGDNHRFDY

SEQ ID NO: 97061 - protein, 10 aa, Homo sapiens
  light chain complementarity determining region 3 for antibody 48531
QQSYRTPMYT

SEQ ID NO: 97062 - protein, 13 aa, Homo sapiens
  heavy chain complementarity determining region 3 for antibody 48531
ARHSSNSYLPLDY

SEQ ID NO: 97063 - protein, 9 aa, Homo sapiens
  light chain complementarity determining region 3 for antibody 48532
QQSYRTPHT

SEQ ID NO: 97064 - protein, 20 aa, Homo sapiens
  heavy chain complementarity determining region 3 for antibody 48532
TADRVVLRFLERPPKSWFDP

SEQ ID NO: 97065 - protein, 9 aa, Homo sapiens
  light chain complementarity determining region 3 for antibody 48533
QQSYRTPCT

SEQ ID NO: 97066 - protein, 20 aa, Homo sapiens
  heavy chain complementarity determining region 3 for antibody 48533
TADRVVLRFLERPPKSWFDP

SEQ ID NO: 97067 - protein, 9 aa, Homo sapiens
  light chain complementarity determining region 3 for antibody 48534
QQSYRSLYT

SEQ ID NO: 97068 - protein, 15 aa, Homo sapiens
  heavy chain complementarity determining region 3 for antibody 48534
AKDLVPVGTTWAFDF

SEQ ID NO: 97069 - protein, 8 aa, Homo sapiens
  light chain complementarity determining region 3 for antibody 48535
QQSYRGLS

SEQ ID NO: 97070 - protein, 14 aa, Homo sapiens
  heavy chain complementarity determining region 3 for antibody 48535
ASKKHLVTYYGLAV

SEQ ID NO: 97071 - protein, 9 aa, Homo sapiens
  light chain complementarity determining region 3 for antibody 48536
QQSYRAPVT

SEQ ID NO: 97072 - protein, 10 aa, Homo sapiens
  heavy chain complementarity determining region 3 for antibody 48536
ASALGWESGY

SEQ ID NO: 97073 - protein, 9 aa, Homo sapiens
  light chain complementarity determining region 3 for antibody 48537
QQSYRAPRT

SEQ ID NO: 97074 - protein, 10 aa, Homo sapiens
  heavy chain complementarity determining region 3 for antibody 48537
ARGGGYYMDY

SEQ ID NO: 97075 - protein, 9 aa, Homo sapiens
  light chain complementarity determining region 3 for antibody 48538
QQSYRAPRT

SEQ ID NO: 97076 - protein, 22 aa, Homo sapiens
  heavy chain complementarity determining region 3 for antibody 48538
ARDSYIGAGRFDGPRPSQGFEL

SEQ ID NO: 97077 - protein, 10 aa, Homo sapiens
  light chain complementarity determining region 3 for antibody 48539
QQSYRAPQFT

SEQ ID NO: 97078 - protein, 14 aa, Homo sapiens
  heavy chain complementarity determining region 3 for antibody 48539
ARVYGDYDLDHFDY

SEQ ID NO: 97079 - protein, 10 aa, Homo sapiens
  light chain complementarity determining region 3 for antibody 48540
QQSYNWPPYT

SEQ ID NO: 97080 - protein, 11 aa, Homo sapiens
  heavy chain complementarity determining region 3 for antibody 48540
ARGVGSYVFES

SEQ ID NO: 97081 - protein, 9 aa, Homo sapiens
  light chain complementarity determining region 3 for antibody 48541
QQSYNTPYT

SEQ ID NO: 97082 - protein, 16 aa, Homo sapiens
  heavy chain complementarity determining region 3 for antibody 48541
VRSPPDYGGNPGDFDI

SEQ ID NO: 97083 - protein, 9 aa, Homo sapiens
  light chain complementarity determining region 3 for antibody 48542
QQSYNTPYT

SEQ ID NO: 97084 - protein, 11 aa, Homo sapiens
  heavy chain complementarity determining region 3 for antibody 48542
ANQGEAGGMDV

SEQ ID NO: 97085 - protein, 9 aa, Homo sapiens
  light chain complementarity determining region 3 for antibody 48543
QQSYNTPRT

SEQ ID NO: 97086 - protein, 17 aa, Homo sapiens
  heavy chain complementarity determining region 3 for antibody 48543
AREGNLGGIHHSSWMDV

SEQ ID NO: 97087 - protein, 10 aa, Homo sapiens
  light chain complementarity determining region 3 for antibody 48544
QQSYNTPPYT

SEQ ID NO: 97088 - protein, 13 aa, Homo sapiens
  heavy chain complementarity determining region 3 for antibody 48544
ARVNTILGASVDD

SEQ ID NO: 97089 - protein, 9 aa, Homo sapiens
  light chain complementarity determining region 3 for antibody 48545
QQSYNTPIT

SEQ ID NO: 97090 - protein, 16 aa, Homo sapiens
  heavy chain complementarity determining region 3 for antibody 48545
ARGGDMLTGSQWYFDV

SEQ ID NO: 97091 - protein, 9 aa, Homo sapiens
  light chain complementarity determining region 3 for antibody 48546
QQSYNTPIT

SEQ ID NO: 97092 - protein, 16 aa, Homo sapiens
  heavy chain complementarity determining region 3 for antibody 48546
ARGGDILTGSQWYLDV

SEQ ID NO: 97093 - protein, 9 aa, Homo sapiens
  light chain complementarity determining region 3 for antibody 48547
QQSYNTPGT

SEQ ID NO: 97094 - protein, 12 aa, Homo sapiens
  heavy chain complementarity determining region 3 for antibody 48547
GRERFGVFAIAY

SEQ ID NO: 97095 - protein, 8 aa, Homo sapiens
  light chain complementarity determining region 3 for antibody 48548
QQSYNTLT

SEQ ID NO: 97096 - protein, 16 aa, Homo sapiens
  heavy chain complementarity determining region 3 for antibody 48548
AHITPALPGTYEYFSH

SEQ ID NO: 97097 - protein, 8 aa, Homo sapiens
  light chain complementarity determining region 3 for antibody 48549
QQSYNTLP

SEQ ID NO: 97098 - protein, 18 aa, Homo sapiens
  heavy chain complementarity determining region 3 for antibody 48549
ARERLSVPWFGELPHFDH

SEQ ID NO: 97099 - protein, 9 aa, Homo sapiens
  light chain complementarity determining region 3 for antibody 48550
QQSYNSPWT

SEQ ID NO: 97100 - protein, 18 aa, Homo sapiens
  heavy chain complementarity determining region 3 for antibody 48550
AREASMSSTGPPLTWVDP

SEQ ID NO: 97101 - protein, 9 aa, Homo sapiens
  light chain complementarity determining region 3 for antibody 48551
QQSYNSPLT

SEQ ID NO: 97102 - protein, 22 aa, Homo sapiens
  heavy chain complementarity determining region 3 for antibody 48551
ARARSVHVSVFGVNSGRDAFDI

SEQ ID NO: 97103 - protein, 9 aa, Homo sapiens
  light chain complementarity determining region 3 for antibody 48552
QQSYMTPKT

SEQ ID NO: 97104 - protein, 22 aa, Homo sapiens
  heavy chain complementarity determining region 3 for antibody 48552
ARAGYAGSAFGAPNYYYYGMDV

SEQ ID NO: 97105 - protein, 10 aa, Homo sapiens
  light chain complementarity determining region 3 for antibody 48553
QQSYLTSTCT

SEQ ID NO: 97106 - protein, 18 aa, Homo sapiens
  heavy chain complementarity determining region 3 for antibody 48553
ARDPQYYYGSGTFNWFDP

SEQ ID NO: 97107 - protein, 9 aa, Homo sapiens
  light chain complementarity determining region 3 for antibody 48554
QQSYKTPWT

SEQ ID NO: 97108 - protein, 12 aa, Homo sapiens
  heavy chain complementarity determining region 3 for antibody 48554
VRVGPSTVPLEY

SEQ ID NO: 97109 - protein, 9 aa, Homo sapiens
  light chain complementarity determining region 3 for antibody 48555
QQSYKTPWT

SEQ ID NO: 97110 - protein, 12 aa, Homo sapiens
  heavy chain complementarity determining region 3 for antibody 48555
VRVGLSTVTLEY

SEQ ID NO: 97111 - protein, 9 aa, Homo sapiens
  light chain complementarity determining region 3 for antibody 48556
QQSYIVPLS

SEQ ID NO: 97112 - protein, 14 aa, Homo sapiens
  heavy chain complementarity determining region 3 for antibody 48556
ARHDYGDYLSGIDY

SEQ ID NO: 97113 - protein, 9 aa, Homo sapiens
  light chain complementarity determining region 3 for antibody 48557
QQSYITPPT

SEQ ID NO: 97114 - protein, 18 aa, Homo sapiens
  heavy chain complementarity determining region 3 for antibody 48557
ARDKTGYTSGSYAGGLDS

SEQ ID NO: 97115 - protein, 9 aa, Homo sapiens
  light chain complementarity determining region 3 for antibody 48558
QQSYISPRP

SEQ ID NO: 97116 - protein, 12 aa, Homo sapiens
  heavy chain complementarity determining region 3 for antibody 48558
ARDKAYSSGWDV

SEQ ID NO: 97117 - protein, 9 aa, Homo sapiens
  light chain complementarity determining region 3 for antibody 48559
QQSYIPPYT

SEQ ID NO: 97118 - protein, 13 aa, Homo sapiens
  heavy chain complementarity determining region 3 for antibody 48559
AREARLWVGALAY

SEQ ID NO: 97119 - protein, 9 aa, Homo sapiens
  light chain complementarity determining region 3 for antibody 48560
QQSYIPPRT

SEQ ID NO: 97120 - protein, 9 aa, Homo sapiens
  heavy chain complementarity determining region 3 for antibody 48560
FGHYYGLDV

SEQ ID NO: 97121 - protein, 9 aa, Homo sapiens
  light chain complementarity determining region 3 for antibody 48561
QQSYIPPRT

SEQ ID NO: 97122 - protein, 21 aa, Homo sapiens
  heavy chain complementarity determining region 3 for antibody 48561
AQLAVGVPSTTGFGQYYGLDV

SEQ ID NO: 97123 - protein, 10 aa, Homo sapiens
  light chain complementarity determining region 3 for antibody 48562
QQSYINSSIT

SEQ ID NO: 97124 - protein, 15 aa, Homo sapiens
  heavy chain complementarity determining region 3 for antibody 48562
ARYSFDGSYSGSFDY

SEQ ID NO: 97125 - protein, 9 aa, Homo sapiens
  light chain complementarity determining region 3 for antibody 48563
QQSYIAPWT

SEQ ID NO: 97126 - protein, 15 aa, Homo sapiens
  heavy chain complementarity determining region 3 for antibody 48563
VKDISYGYDGSAMDV

SEQ ID NO: 97127 - protein, 10 aa, Homo sapiens
  light chain complementarity determining region 3 for antibody 48564
QQSYHNPFYT

SEQ ID NO: 97128 - protein, 13 aa, Homo sapiens
  heavy chain complementarity determining region 3 for antibody 48564
ARDFPRIGGALDL

SEQ ID NO: 97129 - protein, 9 aa, Homo sapiens
  light chain complementarity determining region 3 for antibody 48565
QQSYHLPPT

SEQ ID NO: 97130 - protein, 15 aa, Homo sapiens
  heavy chain complementarity determining region 3 for antibody 48565
ARQRIYDRTSFIFDY

SEQ ID NO: 97131 - protein, 9 aa, Homo sapiens
  light chain complementarity determining region 3 for antibody 48566
QQSYGTSFT

SEQ ID NO: 97132 - protein, 17 aa, Homo sapiens
  heavy chain complementarity determining region 3 for antibody 48566
ARDRYYDTYGYYYESIY

SEQ ID NO: 97133 - protein, 9 aa, Homo sapiens
  light chain complementarity determining region 3 for antibody 48567
QQSYGTPRT

SEQ ID NO: 97134 - protein, 18 aa, Homo sapiens
  heavy chain complementarity determining region 3 for antibody 48567
ARGRSTFYGSGSKGWLDP

SEQ ID NO: 97135 - protein, 10 aa, Homo sapiens
  light chain complementarity determining region 3 for antibody 48568
QQSYGTPPPT

SEQ ID NO: 97136 - protein, 11 aa, Homo sapiens
  heavy chain complementarity determining region 3 for antibody 48568
AIENYAGATRL

SEQ ID NO: 97137 - protein, 9 aa, Homo sapiens
  light chain complementarity determining region 3 for antibody 48569
QQSYGTPAS

SEQ ID NO: 97138 - protein, 19 aa, Homo sapiens
  heavy chain complementarity determining region 3 for antibody 48569
VRKFCSDGTCYRYDDYFDY

SEQ ID NO: 97139 - protein, 9 aa, Homo sapiens
  light chain complementarity determining region 3 for antibody 48570
QQSYGTFLT

SEQ ID NO: 97140 - protein, 15 aa, Homo sapiens
  heavy chain complementarity determining region 3 for antibody 48570
ARIAYISGWYTWFDP

SEQ ID NO: 97141 - protein, 9 aa, Homo sapiens
  light chain complementarity determining region 3 for antibody 48571
QQSYGIPRP

SEQ ID NO: 97142 - protein, 15 aa, Homo sapiens
  heavy chain complementarity determining region 3 for antibody 48571
AKAQVIWGQLYYFES

SEQ ID NO: 97143 - protein, 9 aa, Homo sapiens
  light chain complementarity determining region 3 for antibody 48572
QQSYGHPYF

SEQ ID NO: 97144 - protein, 10 aa, Homo sapiens
  heavy chain complementarity determining region 3 for antibody 48572
TRAYTADFDY

SEQ ID NO: 97145 - protein, 9 aa, Homo sapiens
  light chain complementarity determining region 3 for antibody 48573
QQSYFIPRP

SEQ ID NO: 97146 - protein, 13 aa, Homo sapiens
  heavy chain complementarity determining region 3 for antibody 48573
STDLDQWVVPLDY

SEQ ID NO: 97147 - protein, 9 aa, Homo sapiens
  light chain complementarity determining region 3 for antibody 48574
QQSYETPRT

SEQ ID NO: 97148 - protein, 16 aa, Homo sapiens
  heavy chain complementarity determining region 3 for antibody 48574
ARDSLNYCASGGFYYY

SEQ ID NO: 97149 - protein, 9 aa, Homo sapiens
  light chain complementarity determining region 3 for antibody 48575
QQSYENPRT

SEQ ID NO: 97150 - protein, 16 aa, Homo sapiens
  heavy chain complementarity determining region 3 for antibody 48575
ARDSLNYYASGGFYYY

SEQ ID NO: 97151 - protein, 9 aa, Homo sapiens
  light chain complementarity determining region 3 for antibody 48576
QQSYEAPYS

SEQ ID NO: 97152 - protein, 14 aa, Homo sapiens
  heavy chain complementarity determining region 3 for antibody 48576
STGLGPFSNTWYDY

SEQ ID NO: 97153 - protein, 9 aa, Homo sapiens
  light chain complementarity determining region 3 for antibody 48577
QQSYDTPRT

SEQ ID NO: 97154 - protein, 9 aa, Homo sapiens
  heavy chain complementarity determining region 3 for antibody 48577
ARGEYSSTH

SEQ ID NO: 97155 - protein, 9 aa, Homo sapiens
  light chain complementarity determining region 3 for antibody 48578
QQSYDSPRT

SEQ ID NO: 97156 - protein, 12 aa, Homo sapiens
  heavy chain complementarity determining region 3 for antibody 48578
ARSSGRSYGMDV

SEQ ID NO: 97157 - protein, 10 aa, Homo sapiens
  light chain complementarity determining region 3 for antibody 48579
QQSYDSAPST

SEQ ID NO: 97158 - protein, 11 aa, Homo sapiens
  heavy chain complementarity determining region 3 for antibody 48579
VTGGGYDGFDY

SEQ ID NO: 97159 - protein, 10 aa, Homo sapiens
  light chain complementarity determining region 3 for antibody 48580
QQSYCTPPFT

SEQ ID NO: 97160 - protein, 14 aa, Homo sapiens
  heavy chain complementarity determining region 3 for antibody 48580
AKVEPYGDNHRFDY

SEQ ID NO: 97161 - protein, 8 aa, Homo sapiens
  light chain complementarity determining region 3 for antibody 48581
QQSYAIHT

SEQ ID NO: 97162 - protein, 16 aa, Homo sapiens
  heavy chain complementarity determining region 3 for antibody 48581
ARQAENKAGGQEAFDI

SEQ ID NO: 97163 - protein, 9 aa, Homo sapiens
  light chain complementarity determining region 3 for antibody 48582
QQSSTSILT

SEQ ID NO: 97164 - protein, 15 aa, Homo sapiens
  heavy chain complementarity determining region 3 for antibody 48582
ARLFLFRGFLIRLDY

SEQ ID NO: 97165 - protein, 9 aa, Homo sapiens
  light chain complementarity determining region 3 for antibody 48583
QQSSTSFLT

SEQ ID NO: 97166 - protein, 18 aa, Homo sapiens
  heavy chain complementarity determining region 3 for antibody 48583
AKSGRRDSSGFLVNWFDP

SEQ ID NO: 97167 - protein, 9 aa, Homo sapiens
  light chain complementarity determining region 3 for antibody 48584
QQSSTAPLT

SEQ ID NO: 97168 - protein, 16 aa, Homo sapiens
  heavy chain complementarity determining region 3 for antibody 48584
ARSKSRAVEVEATFDL

SEQ ID NO: 97169 - protein, 9 aa, Homo sapiens
  light chain complementarity determining region 3 for antibody 48585
QQSSTAPLT

SEQ ID NO: 97170 - protein, 16 aa, Homo sapiens
  heavy chain complementarity determining region 3 for antibody 48585
ARPKSRAVEVEAPFDI

SEQ ID NO: 97171 - protein, 9 aa, Homo sapiens
  light chain complementarity determining region 3 for antibody 48586
QQSSSTRWT

SEQ ID NO: 97172 - protein, 14 aa, Homo sapiens
  heavy chain complementarity determining region 3 for antibody 48586
AKTSDSSGYSRFHF

SEQ ID NO: 97173 - protein, 9 aa, Homo sapiens
  light chain complementarity determining region 3 for antibody 48587
QQSSSTPWT

SEQ ID NO: 97174 - protein, 18 aa, Homo sapiens
  heavy chain complementarity determining region 3 for antibody 48587
VKVAYCVGDCKWGGPLDY

SEQ ID NO: 97175 - protein, 9 aa, Homo sapiens
  light chain complementarity determining region 3 for antibody 48588
QQSSSTPWT

SEQ ID NO: 97176 - protein, 18 aa, Homo sapiens
  heavy chain complementarity determining region 3 for antibody 48588
ARCKLAGTTDSYYFGMDV

SEQ ID NO: 97177 - protein, 9 aa, Homo sapiens
  light chain complementarity determining region 3 for antibody 48589
QQSSSTPWP

SEQ ID NO: 97178 - protein, 18 aa, Homo sapiens
  heavy chain complementarity determining region 3 for antibody 48589
VKVAYCVGDCKWGGTLDY

SEQ ID NO: 97179 - protein, 9 aa, Homo sapiens
  light chain complementarity determining region 3 for antibody 48590
QQSSSTPIT

SEQ ID NO: 97180 - protein, 19 aa, Homo sapiens
  heavy chain complementarity determining region 3 for antibody 48590
AKVGRNPNFSSGWYHHIDY

SEQ ID NO: 97181 - protein, 9 aa, Homo sapiens
  light chain complementarity determining region 3 for antibody 48591
QQSSSSPPT

SEQ ID NO: 97182 - protein, 18 aa, Homo sapiens
  heavy chain complementarity determining region 3 for antibody 48591
ARRTQKITIGGVIVVLDY

SEQ ID NO: 97183 - protein, 9 aa, Homo sapiens
  light chain complementarity determining region 3 for antibody 48592
QQSSSSPGT

SEQ ID NO: 97184 - protein, 11 aa, Homo sapiens
  heavy chain complementarity determining region 3 for antibody 48592
ARLGTWKDFDS

SEQ ID NO: 97185 - protein, 9 aa, Homo sapiens
  light chain complementarity determining region 3 for antibody 48593
QQSSSAPHT

SEQ ID NO: 97186 - protein, 11 aa, Homo sapiens
  heavy chain complementarity determining region 3 for antibody 48593
SRDRRGSGVDP

SEQ ID NO: 97187 - protein, 8 aa, Homo sapiens
  light chain complementarity determining region 3 for antibody 48594
QQSSNWPG

SEQ ID NO: 97188 - protein, 11 aa, Homo sapiens
  heavy chain complementarity determining region 3 for antibody 48594
VRDGLRWNFDY

SEQ ID NO: 97189 - protein, 9 aa, Homo sapiens
  light chain complementarity determining region 3 for antibody 48595
QQSSNTPWP

SEQ ID NO: 97190 - protein, 18 aa, Homo sapiens
  heavy chain complementarity determining region 3 for antibody 48595
VKVANCVGDCKWGGTLDY

SEQ ID NO: 97191 - protein, 9 aa, Homo sapiens
  light chain complementarity determining region 3 for antibody 48596
QQSSNTPPP

SEQ ID NO: 97192 - protein, 22 aa, Homo sapiens
  heavy chain complementarity determining region 3 for antibody 48596
ARFGRMYYDILTGYSESDAFDI

SEQ ID NO: 97193 - protein, 9 aa, Homo sapiens
  light chain complementarity determining region 3 for antibody 48597
QQSSNPPYT

SEQ ID NO: 97194 - protein, 11 aa, Homo sapiens
  heavy chain complementarity determining region 3 for antibody 48597
ARSFSPSICDY

SEQ ID NO: 97195 - protein, 9 aa, Homo sapiens
  light chain complementarity determining region 3 for antibody 48598
QQSSNPPST

SEQ ID NO: 97196 - protein, 11 aa, Homo sapiens
  heavy chain complementarity determining region 3 for antibody 48598
ARSFSTSICDY

SEQ ID NO: 97197 - protein, 9 aa, Homo sapiens
  light chain complementarity determining region 3 for antibody 48599
QQSSNIVWT

SEQ ID NO: 97198 - protein, 19 aa, Homo sapiens
  heavy chain complementarity determining region 3 for antibody 48599
ARDSHFIMMVDAGHYGLDL

SEQ ID NO: 97199 - protein, 11 aa, Homo sapiens
  light chain complementarity determining region 3 for antibody 48600
QQSSGKPSIYT

SEQ ID NO: 97200 - protein, 12 aa, Homo sapiens
  heavy chain complementarity determining region 3 for antibody 48600
ARNSGIRRAFDI

SEQ ID NO: 97201 - protein, 9 aa, Homo sapiens
  light chain complementarity determining region 3 for antibody 48601
QQSSFLPLT

SEQ ID NO: 97202 - protein, 10 aa, Homo sapiens
  heavy chain complementarity determining region 3 for antibody 48601
ARGTGWLPDH

SEQ ID NO: 97203 - protein, 9 aa, Homo sapiens
  light chain complementarity determining region 3 for antibody 48602
QQSRNLMIT

SEQ ID NO: 97204 - protein, 12 aa, Homo sapiens
  heavy chain complementarity determining region 3 for antibody 48602
ARWAGGVSALDI

SEQ ID NO: 97205 - protein, 9 aa, Homo sapiens
  light chain complementarity determining region 3 for antibody 48603
QQSQYLPLT

SEQ ID NO: 97206 - protein, 14 aa, Homo sapiens
  heavy chain complementarity determining region 3 for antibody 48603
STERILGFGEADQV

SEQ ID NO: 97207 - protein, 9 aa, Homo sapiens
  light chain complementarity determining region 3 for antibody 48604
QQSNSYSGT

SEQ ID NO: 97208 - protein, 15 aa, Homo sapiens
  heavy chain complementarity determining region 3 for antibody 48604
ARRHYYGSGSYYFDY

SEQ ID NO: 97209 - protein, 9 aa, Homo sapiens
  light chain complementarity determining region 3 for antibody 48605
QQSNSTPVT

SEQ ID NO: 97210 - protein, 12 aa, Homo sapiens
  heavy chain complementarity determining region 3 for antibody 48605
ASLWFYDSDRDV

SEQ ID NO: 97211 - protein, 10 aa, Homo sapiens
  light chain complementarity determining region 3 for antibody 48606
QQSNSTPPFP

SEQ ID NO: 97212 - protein, 14 aa, Homo sapiens
  heavy chain complementarity determining region 3 for antibody 48606
ARGGSSDYDHHFDY

SEQ ID NO: 97213 - protein, 9 aa, Homo sapiens
  light chain complementarity determining region 3 for antibody 48607
QQSNSSPLT

SEQ ID NO: 97214 - protein, 9 aa, Homo sapiens
  heavy chain complementarity determining region 3 for antibody 48607
SRWDGSLDY

SEQ ID NO: 97215 - protein, 9 aa, Homo sapiens
  light chain complementarity determining region 3 for antibody 48608
QQSNSRPWT

SEQ ID NO: 97216 - protein, 17 aa, Homo sapiens
  heavy chain complementarity determining region 3 for antibody 48608
AKDKDYYDSSGTGPFDI

SEQ ID NO: 97217 - protein, 9 aa, Homo sapiens
  light chain complementarity determining region 3 for antibody 48609
QQSNSIPYT

SEQ ID NO: 97218 - protein, 13 aa, Homo sapiens
  heavy chain complementarity determining region 3 for antibody 48609
ARSRYTYATLLDY

SEQ ID NO: 97219 - protein, 9 aa, Homo sapiens
  light chain complementarity determining region 3 for antibody 48610
QQSNSFPVT

SEQ ID NO: 97220 - protein, 13 aa, Homo sapiens
  heavy chain complementarity determining region 3 for antibody 48610
ARVALGRPAYFDY

SEQ ID NO: 97221 - protein, 9 aa, Homo sapiens
  light chain complementarity determining region 3 for antibody 48611
QQSNSFPLT

SEQ ID NO: 97222 - protein, 17 aa, Homo sapiens
  heavy chain complementarity determining region 3 for antibody 48611
ARASYYYGSGSYWYFDP

SEQ ID NO: 97223 - protein, 10 aa, Homo sapiens
  light chain complementarity determining region 3 for antibody 48612
QQSNNWPPWT

SEQ ID NO: 97224 - protein, 16 aa, Homo sapiens
  heavy chain complementarity determining region 3 for antibody 48612
AKTRDLLLGLAHPFEY

SEQ ID NO: 97225 - protein, 11 aa, Homo sapiens
  light chain complementarity determining region 3 for antibody 48613
QQSNMTLRMYT

SEQ ID NO: 97226 - protein, 14 aa, Homo sapiens
  heavy chain complementarity determining region 3 for antibody 48613
ARPRGSGWVSAFDI

SEQ ID NO: 97227 - protein, 8 aa, Homo sapiens
  light chain complementarity determining region 3 for antibody 48614
QQSNGYPT

SEQ ID NO: 97228 - protein, 13 aa, Homo sapiens
  heavy chain complementarity determining region 3 for antibody 48614
AREPWELLPYFDY

SEQ ID NO: 97229 - protein, 8 aa, Homo sapiens
  light chain complementarity determining region 3 for antibody 48615
QQSNFYRT

SEQ ID NO: 97230 - protein, 12 aa, Homo sapiens
  heavy chain complementarity determining region 3 for antibody 48615
AGAPGATGAFDL

SEQ ID NO: 97231 - protein, 9 aa, Homo sapiens
  light chain complementarity determining region 3 for antibody 48616
QQSNDTPFP

SEQ ID NO: 97232 - protein, 12 aa, Homo sapiens
  heavy chain complementarity determining region 3 for antibody 48616
ARDGTGTGGFDY

SEQ ID NO: 97233 - protein, 9 aa, Homo sapiens
  light chain complementarity determining region 3 for antibody 48617
QQSLTNPPT

SEQ ID NO: 97234 - protein, 18 aa, Homo sapiens
  heavy chain complementarity determining region 3 for antibody 48617
AREKDVSVGYVSYNWFDP

SEQ ID NO: 97235 - protein, 9 aa, Homo sapiens
  light chain complementarity determining region 3 for antibody 48618
QQSKTFPLT

SEQ ID NO: 97236 - protein, 12 aa, Homo sapiens
  heavy chain complementarity determining region 3 for antibody 48618
VRDQAHTTFFDY

SEQ ID NO: 97237 - protein, 9 aa, Homo sapiens
  light chain complementarity determining region 3 for antibody 48619
QQSISSPLT

SEQ ID NO: 97238 - protein, 18 aa, Homo sapiens
  heavy chain complementarity determining region 3 for antibody 48619
ARGVVRRVGASTTYYFDY

SEQ ID NO: 97239 - protein, 9 aa, Homo sapiens
  light chain complementarity determining region 3 for antibody 48620
QQSHTTPLT

SEQ ID NO: 97240 - protein, 13 aa, Homo sapiens
  heavy chain complementarity determining region 3 for antibody 48620
ARDAYDGDWYFDL

SEQ ID NO: 97241 - protein, 9 aa, Homo sapiens
  light chain complementarity determining region 3 for antibody 48621
QQSHTTPLT

SEQ ID NO: 97242 - protein, 13 aa, Homo sapiens
  heavy chain complementarity determining region 3 for antibody 48621
ARDASDGDWYFDI

SEQ ID NO: 97243 - protein, 9 aa, Homo sapiens
  light chain complementarity determining region 3 for antibody 48622
QQSHTSPPT

SEQ ID NO: 97244 - protein, 15 aa, Homo sapiens
  heavy chain complementarity determining region 3 for antibody 48622
ARGSDREDPPGAFDL

SEQ ID NO: 97245 - protein, 9 aa, Homo sapiens
  light chain complementarity determining region 3 for antibody 48623
QQSHTSPPT

SEQ ID NO: 97246 - protein, 15 aa, Homo sapiens
  heavy chain complementarity determining region 3 for antibody 48623
ARGSDLEDPPGACDL

SEQ ID NO: 97247 - protein, 9 aa, Homo sapiens
  light chain complementarity determining region 3 for antibody 48624
QQSHTSPPT

SEQ ID NO: 97248 - protein, 15 aa, Homo sapiens
  heavy chain complementarity determining region 3 for antibody 48624
ARGSDLEDHPGAFDL

SEQ ID NO: 97249 - protein, 9 aa, Homo sapiens
  light chain complementarity determining region 3 for antibody 48625
QQSHTSPPP

SEQ ID NO: 97250 - protein, 15 aa, Homo sapiens
  heavy chain complementarity determining region 3 for antibody 48625
ARGSDLEDPPGAFDL

SEQ ID NO: 97251 - protein, 9 aa, Homo sapiens
  light chain complementarity determining region 3 for antibody 48626
QQSHTRPPT

SEQ ID NO: 97252 - protein, 15 aa, Homo sapiens
  heavy chain complementarity determining region 3 for antibody 48626
ARGSDLDDPPGAFDI

SEQ ID NO: 97253 - protein, 9 aa, Homo sapiens
  light chain complementarity determining region 3 for antibody 48627
QQSHSVPRT

SEQ ID NO: 97254 - protein, 13 aa, Homo sapiens
  heavy chain complementarity determining region 3 for antibody 48627
ARNGDLVNIGFDY

SEQ ID NO: 97255 - protein, 9 aa, Homo sapiens
  light chain complementarity determining region 3 for antibody 48628
QQSHSVPLT

SEQ ID NO: 97256 - protein, 8 aa, Homo sapiens
  heavy chain complementarity determining region 3 for antibody 48628
ARAFGLDY

SEQ ID NO: 97257 - protein, 9 aa, Homo sapiens
  light chain complementarity determining region 3 for antibody 48629
QQSHSTPWT

SEQ ID NO: 97258 - protein, 26 aa, Homo sapiens
  heavy chain complementarity determining region 3 for antibody 48629
TTQIENVFRNFDWQETPYYYFHALDV

SEQ ID NO: 97259 - protein, 9 aa, Homo sapiens
  light chain complementarity determining region 3 for antibody 48630
QQSHSTPWT

SEQ ID NO: 97260 - protein, 13 aa, Homo sapiens
  heavy chain complementarity determining region 3 for antibody 48630
ARGVAAAGYQFDY

SEQ ID NO: 97261 - protein, 9 aa, Homo sapiens
  light chain complementarity determining region 3 for antibody 48631
QQSHSTPRP

SEQ ID NO: 97262 - protein, 16 aa, Homo sapiens
  heavy chain complementarity determining region 3 for antibody 48631
AKAPGKLLIIGDYFDV

SEQ ID NO: 97263 - protein, 9 aa, Homo sapiens
  light chain complementarity determining region 3 for antibody 48632
QQSHSTPFT

SEQ ID NO: 97264 - protein, 10 aa, Homo sapiens
  heavy chain complementarity determining region 3 for antibody 48632
SRSEGYGMDV

SEQ ID NO: 97265 - protein, 8 aa, Homo sapiens
  light chain complementarity determining region 3 for antibody 48633
QQSHSSRA

SEQ ID NO: 97266 - protein, 13 aa, Homo sapiens
  heavy chain complementarity determining region 3 for antibody 48633
ARSGLGRGVSIDH

SEQ ID NO: 97267 - protein, 8 aa, Homo sapiens
  light chain complementarity determining region 3 for antibody 48634
QQSHSSRA

SEQ ID NO: 97268 - protein, 13 aa, Homo sapiens
  heavy chain complementarity determining region 3 for antibody 48634
ARSGLGGGVFIDH

SEQ ID NO: 97269 - protein, 9 aa, Homo sapiens
  light chain complementarity determining region 3 for antibody 48635
QQSHSAPLT

SEQ ID NO: 97270 - protein, 16 aa, Homo sapiens
  heavy chain complementarity determining region 3 for antibody 48635
ARNYYGSGSYYNRFEN

SEQ ID NO: 97271 - protein, 9 aa, Homo sapiens
  light chain complementarity determining region 3 for antibody 48636
QQSHITPLT

SEQ ID NO: 97272 - protein, 10 aa, Homo sapiens
  heavy chain complementarity determining region 3 for antibody 48636
TRSKGYGMDV

SEQ ID NO: 97273 - protein, 9 aa, Homo sapiens
  light chain complementarity determining region 3 for antibody 48637
QQSHITPIP

SEQ ID NO: 97274 - protein, 10 aa, Homo sapiens
  heavy chain complementarity determining region 3 for antibody 48637
TRSEGYGMDV

SEQ ID NO: 97275 - protein, 9 aa, Homo sapiens
  light chain complementarity determining region 3 for antibody 48638
QQSHITPIN

SEQ ID NO: 97276 - protein, 10 aa, Homo sapiens
  heavy chain complementarity determining region 3 for antibody 48638
TRSKGYGMDV

SEQ ID NO: 97277 - protein, 9 aa, Homo sapiens
  light chain complementarity determining region 3 for antibody 48639
QQSHITPFT

SEQ ID NO: 97278 - protein, 10 aa, Homo sapiens
  heavy chain complementarity determining region 3 for antibody 48639
TRSKGYGMDV

SEQ ID NO: 97279 - protein, 11 aa, Homo sapiens
  light chain complementarity determining region 3 for antibody 48640
QQSHITLRMYT

SEQ ID NO: 97280 - protein, 14 aa, Homo sapiens
  heavy chain complementarity determining region 3 for antibody 48640
ARPRGSGWVSAFDI

SEQ ID NO: 97281 - protein, 9 aa, Homo sapiens
  light chain complementarity determining region 3 for antibody 48641
QQSHIPPWT

SEQ ID NO: 97282 - protein, 13 aa, Homo sapiens
  heavy chain complementarity determining region 3 for antibody 48641
ARGVAAAGYQFDY

SEQ ID NO: 97283 - protein, 9 aa, Homo sapiens
  light chain complementarity determining region 3 for antibody 48642
QQSHINPIT

SEQ ID NO: 97284 - protein, 10 aa, Homo sapiens
  heavy chain complementarity determining region 3 for antibody 48642
TRSKGYGMDV

SEQ ID NO: 97285 - protein, 9 aa, Homo sapiens
  light chain complementarity determining region 3 for antibody 48643
QQSHIIPIT

SEQ ID NO: 97286 - protein, 10 aa, Homo sapiens
  heavy chain complementarity determining region 3 for antibody 48643
TRSKGYGMDV

SEQ ID NO: 97287 - protein, 9 aa, Homo sapiens
  light chain complementarity determining region 3 for antibody 48644
QQSHGFPYP

SEQ ID NO: 97288 - protein, 13 aa, Homo sapiens
  heavy chain complementarity determining region 3 for antibody 48644
ARLKDINGWPFDY

SEQ ID NO: 97289 - protein, 9 aa, Homo sapiens
  light chain complementarity determining region 3 for antibody 48645
QQSHDMPWT

SEQ ID NO: 97290 - protein, 11 aa, Homo sapiens
  heavy chain complementarity determining region 3 for antibody 48645
ARDPGGWYFDL

SEQ ID NO: 97291 - protein, 9 aa, Homo sapiens
  light chain complementarity determining region 3 for antibody 48646
QQSHDMPGT

SEQ ID NO: 97292 - protein, 11 aa, Homo sapiens
  heavy chain complementarity determining region 3 for antibody 48646
ARDPGDWYFDL

SEQ ID NO: 97293 - protein, 9 aa, Homo sapiens
  light chain complementarity determining region 3 for antibody 48647
QQSGTSPLT

SEQ ID NO: 97294 - protein, 15 aa, Homo sapiens
  heavy chain complementarity determining region 3 for antibody 48647
VADYIDHSGFGHPDV

SEQ ID NO: 97295 - protein, 9 aa, Homo sapiens
  light chain complementarity determining region 3 for antibody 48648
QQSGNSPVT

SEQ ID NO: 97296 - protein, 23 aa, Homo sapiens
  heavy chain complementarity determining region 3 for antibody 48648
ARDMGASNIAVRPDKLKPQEFDY

SEQ ID NO: 97297 - protein, 9 aa, Homo sapiens
  light chain complementarity determining region 3 for antibody 48649
QQSGHSQYT

SEQ ID NO: 97298 - protein, 8 aa, Homo sapiens
  heavy chain complementarity determining region 3 for antibody 48649
ARARYFDY

SEQ ID NO: 97299 - protein, 9 aa, Homo sapiens
  light chain complementarity determining region 3 for antibody 48650
QQSFYTPHT

SEQ ID NO: 97300 - protein, 14 aa, Homo sapiens
  heavy chain complementarity determining region 3 for antibody 48650
ARRGSYGYSLAFDI

SEQ ID NO: 97301 - protein, 9 aa, Homo sapiens
  light chain complementarity determining region 3 for antibody 48651
QQSFTTPPP

SEQ ID NO: 97302 - protein, 18 aa, Homo sapiens
  heavy chain complementarity determining region 3 for antibody 48651
AREVDVAVDRIMFNILDS

SEQ ID NO: 97303 - protein, 9 aa, Homo sapiens
  light chain complementarity determining region 3 for antibody 48652
QQSFTSILT

SEQ ID NO: 97304 - protein, 18 aa, Homo sapiens
  heavy chain complementarity determining region 3 for antibody 48652
AKSGRRDSSGFLVNWFDP

SEQ ID NO: 97305 - protein, 9 aa, Homo sapiens
  light chain complementarity determining region 3 for antibody 48653
QQSFTNSPT

SEQ ID NO: 97306 - protein, 18 aa, Homo sapiens
  heavy chain complementarity determining region 3 for antibody 48653
AREKDVFVGYVSYNWFDP

SEQ ID NO: 97307 - protein, 9 aa, Homo sapiens
  light chain complementarity determining region 3 for antibody 48654
QQSFTNPTT

SEQ ID NO: 97308 - protein, 18 aa, Homo sapiens
  heavy chain complementarity determining region 3 for antibody 48654
AREKDVFVGYVSYNWFDP

SEQ ID NO: 97309 - protein, 8 aa, Homo sapiens
  light chain complementarity determining region 3 for antibody 48655
QQSFTIRP

SEQ ID NO: 97310 - protein, 13 aa, Homo sapiens
  heavy chain complementarity determining region 3 for antibody 48655
ARDRYSKMSGIDP

SEQ ID NO: 97311 - protein, 9 aa, Homo sapiens
  light chain complementarity determining region 3 for antibody 48656
QQSFSTVYT

SEQ ID NO: 97312 - protein, 16 aa, Homo sapiens
  heavy chain complementarity determining region 3 for antibody 48656
ARESEVKSGWYGPMNL

SEQ ID NO: 97313 - protein, 9 aa, Homo sapiens
  light chain complementarity determining region 3 for antibody 48657
QQSFSTPYT

SEQ ID NO: 97314 - protein, 14 aa, Homo sapiens
  heavy chain complementarity determining region 3 for antibody 48657
ARGGGRGYYSSVDD

SEQ ID NO: 97315 - protein, 9 aa, Homo sapiens
  light chain complementarity determining region 3 for antibody 48658
QQSFSTPYP

SEQ ID NO: 97316 - protein, 10 aa, Homo sapiens
  heavy chain complementarity determining region 3 for antibody 48658
VKEERQWLDN

SEQ ID NO: 97317 - protein, 9 aa, Homo sapiens
  light chain complementarity determining region 3 for antibody 48659
QQSFSTPRT

SEQ ID NO: 97318 - protein, 13 aa, Homo sapiens
  heavy chain complementarity determining region 3 for antibody 48659
AREFPRDYYGMDV

SEQ ID NO: 97319 - protein, 10 aa, Homo sapiens
  light chain complementarity determining region 3 for antibody 48660
QQSFSTPPYP

SEQ ID NO: 97320 - protein, 20 aa, Homo sapiens
  heavy chain complementarity determining region 3 for antibody 48660
ATLNIRGGYGSGWSAEYFQH

SEQ ID NO: 97321 - protein, 9 aa, Homo sapiens
  light chain complementarity determining region 3 for antibody 48661
QQSFSTPPT

SEQ ID NO: 97322 - protein, 18 aa, Homo sapiens
  heavy chain complementarity determining region 3 for antibody 48661
AREGDYFVSGTSYNIFDY

SEQ ID NO: 97323 - protein, 10 aa, Homo sapiens
  light chain complementarity determining region 3 for antibody 48662
QQSFSTPPNT

SEQ ID NO: 97324 - protein, 20 aa, Homo sapiens
  heavy chain complementarity determining region 3 for antibody 48662
ATLNIRGGYGSGWSAEYFQH

SEQ ID NO: 97325 - protein, 9 aa, Homo sapiens
  light chain complementarity determining region 3 for antibody 48663
QQSFSTPLT

SEQ ID NO: 97326 - protein, 20 aa, Homo sapiens
  heavy chain complementarity determining region 3 for antibody 48663
AREALSWVALGETPPCGFDY

SEQ ID NO: 97327 - protein, 9 aa, Homo sapiens
  light chain complementarity determining region 3 for antibody 48664
QQSFSTLST

SEQ ID NO: 97328 - protein, 22 aa, Homo sapiens
  heavy chain complementarity determining region 3 for antibody 48664
ARDPYYYDDSSEVPKPEYYFDY

SEQ ID NO: 97329 - protein, 9 aa, Homo sapiens
  light chain complementarity determining region 3 for antibody 48665
QQSFSSPFT

SEQ ID NO: 97330 - protein, 18 aa, Homo sapiens
  heavy chain complementarity determining region 3 for antibody 48665
ARDRCSGVNCYSWWYFDL

SEQ ID NO: 97331 - protein, 10 aa, Homo sapiens
  light chain complementarity determining region 3 for antibody 48666
QQSFSNPPYT

SEQ ID NO: 97332 - protein, 20 aa, Homo sapiens
  heavy chain complementarity determining region 3 for antibody 48666
ATLNIRGGYGSGWSAEYFQH

SEQ ID NO: 97333 - protein, 9 aa, Homo sapiens
  light chain complementarity determining region 3 for antibody 48667
QQSFSGPRT

SEQ ID NO: 97334 - protein, 21 aa, Homo sapiens
  heavy chain complementarity determining region 3 for antibody 48667
ARWGDCTGSNCYKNYYYGLDV

SEQ ID NO: 97335 - protein, 9 aa, Homo sapiens
  light chain complementarity determining region 3 for antibody 48668
QQSFSDPFT

SEQ ID NO: 97336 - protein, 17 aa, Homo sapiens
  heavy chain complementarity determining region 3 for antibody 48668
TTQNYDDSNLYYWYFDL

SEQ ID NO: 97337 - protein, 9 aa, Homo sapiens
  light chain complementarity determining region 3 for antibody 48669
QQSFRTPYT

SEQ ID NO: 97338 - protein, 14 aa, Homo sapiens
  heavy chain complementarity determining region 3 for antibody 48669
ARGGGRGYYSSADD

SEQ ID NO: 97339 - protein, 9 aa, Homo sapiens
  light chain complementarity determining region 3 for antibody 48670
QQSFRTLYT

SEQ ID NO: 97340 - protein, 10 aa, Homo sapiens
  heavy chain complementarity determining region 3 for antibody 48670
TRDRYGPFDF

SEQ ID NO: 97341 - protein, 10 aa, Homo sapiens
  light chain complementarity determining region 3 for antibody 48671
QQSFNPLLFP

SEQ ID NO: 97342 - protein, 17 aa, Homo sapiens
  heavy chain complementarity determining region 3 for antibody 48671
ARDTSGGWKIGYYGMDV

SEQ ID NO: 97343 - protein, 9 aa, Homo sapiens
  light chain complementarity determining region 3 for antibody 48672
QQSFDIPST

SEQ ID NO: 97344 - protein, 11 aa, Homo sapiens
  heavy chain complementarity determining region 3 for antibody 48672
AKGSFGSGLDT

SEQ ID NO: 97345 - protein, 9 aa, Homo sapiens
  light chain complementarity determining region 3 for antibody 48673
QQSFCVPLT

SEQ ID NO: 97346 - protein, 16 aa, Homo sapiens
  heavy chain complementarity determining region 3 for antibody 48673
IRDHYYESNGGYIPQH

SEQ ID NO: 97347 - protein, 9 aa, Homo sapiens
  light chain complementarity determining region 3 for antibody 48674
QQSFAIPLT

SEQ ID NO: 97348 - protein, 17 aa, Homo sapiens
  heavy chain complementarity determining region 3 for antibody 48674
TKAGGNSRPDYYYGMDV

SEQ ID NO: 97349 - protein, 9 aa, Homo sapiens
  light chain complementarity determining region 3 for antibody 48675
QQSENVPLT

SEQ ID NO: 97350 - protein, 22 aa, Homo sapiens
  heavy chain complementarity determining region 3 for antibody 48675
AKNLFAHRLLPGLLWFGDSSRS

SEQ ID NO: 97351 - protein, 9 aa, Homo sapiens
  light chain complementarity determining region 3 for antibody 48676
QQSDSTPYT

SEQ ID NO: 97352 - protein, 15 aa, Homo sapiens
  heavy chain complementarity determining region 3 for antibody 48676
ARLFLFRGLLVMLDY

SEQ ID NO: 97353 - protein, 10 aa, Homo sapiens
  light chain complementarity determining region 3 for antibody 48677
QQSDSAKLIT

SEQ ID NO: 97354 - protein, 20 aa, Homo sapiens
  heavy chain complementarity determining region 3 for antibody 48677
ARGPDVSGKSAYPYYYGLDV

SEQ ID NO: 97355 - protein, 9 aa, Homo sapiens
  light chain complementarity determining region 3 for antibody 48678
QQSDRAPLT

SEQ ID NO: 97356 - protein, 10 aa, Homo sapiens
  heavy chain complementarity determining region 3 for antibody 48678
ASGLGWESGY

SEQ ID NO: 97357 - protein, 9 aa, Homo sapiens
  light chain complementarity determining region 3 for antibody 48679
QQSDDLPVT

SEQ ID NO: 97358 - protein, 14 aa, Homo sapiens
  heavy chain complementarity determining region 3 for antibody 48679
ARGKRSGWHFRFDY

SEQ ID NO: 97359 - protein, 9 aa, Homo sapiens
  light chain complementarity determining region 3 for antibody 48680
QQSCTTPLI

SEQ ID NO: 97360 - protein, 14 aa, Homo sapiens
  heavy chain complementarity determining region 3 for antibody 48680
AREVRHRAYYALDV

SEQ ID NO: 97361 - protein, 9 aa, Homo sapiens
  light chain complementarity determining region 3 for antibody 48681
QQSAHSPLP

SEQ ID NO: 97362 - protein, 10 aa, Homo sapiens
  heavy chain complementarity determining region 3 for antibody 48681
AKGDGWLPDS

SEQ ID NO: 97363 - protein, 9 aa, Homo sapiens
  light chain complementarity determining region 3 for antibody 48682
QQRYTTPYT

SEQ ID NO: 97364 - protein, 15 aa, Homo sapiens
  heavy chain complementarity determining region 3 for antibody 48682
ARDAFRGDYGGKAEY

SEQ ID NO: 97365 - protein, 9 aa, Homo sapiens
  light chain complementarity determining region 3 for antibody 48683
QQRYTTPQT

SEQ ID NO: 97366 - protein, 21 aa, Homo sapiens
  heavy chain complementarity determining region 3 for antibody 48683
ARDLKLTSYYYDSSDDHYFDY

SEQ ID NO: 97367 - protein, 9 aa, Homo sapiens
  light chain complementarity determining region 3 for antibody 48684
QQRYTIPWT

SEQ ID NO: 97368 - protein, 15 aa, Homo sapiens
  heavy chain complementarity determining region 3 for antibody 48684
ARWGNDNGDYGRLDY

SEQ ID NO: 97369 - protein, 8 aa, Homo sapiens
  light chain complementarity determining region 3 for antibody 48685
QQRYSWWK

SEQ ID NO: 97370 - protein, 16 aa, Homo sapiens
  heavy chain complementarity determining region 3 for antibody 48685
ATMGSASTVTTGAFQH

SEQ ID NO: 97371 - protein, 9 aa, Homo sapiens
  light chain complementarity determining region 3 for antibody 48686
QQRYSWPPT

SEQ ID NO: 97372 - protein, 13 aa, Homo sapiens
  heavy chain complementarity determining region 3 for antibody 48686
AGGYIYGYDYFDS

SEQ ID NO: 97373 - protein, 10 aa, Homo sapiens
  light chain complementarity determining region 3 for antibody 48687
QQRYSWPPFT

SEQ ID NO: 97374 - protein, 17 aa, Homo sapiens
  heavy chain complementarity determining region 3 for antibody 48687
VKPRETYSSGWVDAFDT

SEQ ID NO: 97375 - protein, 9 aa, Homo sapiens
  light chain complementarity determining region 3 for antibody 48688
QQRYSWPLP

SEQ ID NO: 97376 - protein, 13 aa, Homo sapiens
  heavy chain complementarity determining region 3 for antibody 48688
AGGYIYGYDYFDS

SEQ ID NO: 97377 - protein, 9 aa, Homo sapiens
  light chain complementarity determining region 3 for antibody 48689
QQRYSTSLT

SEQ ID NO: 97378 - protein, 16 aa, Homo sapiens
  heavy chain complementarity determining region 3 for antibody 48689
ARGYSSGWHVGGPFGC

SEQ ID NO: 97379 - protein, 9 aa, Homo sapiens
  light chain complementarity determining region 3 for antibody 48690
QQRYSTPYT

SEQ ID NO: 97380 - protein, 12 aa, Homo sapiens
  heavy chain complementarity determining region 3 for antibody 48690
VHKGGRGNPFDV

SEQ ID NO: 97381 - protein, 9 aa, Homo sapiens
  light chain complementarity determining region 3 for antibody 48691
QQRYSTPYT

SEQ ID NO: 97382 - protein, 7 aa, Homo sapiens
  heavy chain complementarity determining region 3 for antibody 48691
ARDGIDY

SEQ ID NO: 97383 - protein, 9 aa, Homo sapiens
  light chain complementarity determining region 3 for antibody 48692
QQRYSTPYT

SEQ ID NO: 97384 - protein, 10 aa, Homo sapiens
  heavy chain complementarity determining region 3 for antibody 48692
ARASGHSLDY

SEQ ID NO: 97385 - protein, 9 aa, Homo sapiens
  light chain complementarity determining region 3 for antibody 48693
QQRYSTPYT

SEQ ID NO: 97386 - protein, 12 aa, Homo sapiens
  heavy chain complementarity determining region 3 for antibody 48693
AMERSGTYVITD

SEQ ID NO: 97387 - protein, 9 aa, Homo sapiens
  light chain complementarity determining region 3 for antibody 48694
QQRYSTPYT

SEQ ID NO: 97388 - protein, 21 aa, Homo sapiens
  heavy chain complementarity determining region 3 for antibody 48694
AHREIVLPPSFTPQPSDAFDV

SEQ ID NO: 97389 - protein, 9 aa, Homo sapiens
  light chain complementarity determining region 3 for antibody 48695
QQRYSTPWT

SEQ ID NO: 97390 - protein, 15 aa, Homo sapiens
  heavy chain complementarity determining region 3 for antibody 48695
ARVESVAGSREYFHH

SEQ ID NO: 97391 - protein, 9 aa, Homo sapiens
  light chain complementarity determining region 3 for antibody 48696
QQRYSTPPT

SEQ ID NO: 97392 - protein, 17 aa, Homo sapiens
  heavy chain complementarity determining region 3 for antibody 48696
VRGPGGSRYTYANPWVY

SEQ ID NO: 97393 - protein, 10 aa, Homo sapiens
  light chain complementarity determining region 3 for antibody 48697
QQRYSTPPFT

SEQ ID NO: 97394 - protein, 17 aa, Homo sapiens
  heavy chain complementarity determining region 3 for antibody 48697
ARGSPISEVLTGNRFDA

SEQ ID NO: 97395 - protein, 9 aa, Homo sapiens
  light chain complementarity determining region 3 for antibody 48698
QQRYSTPLT

SEQ ID NO: 97396 - protein, 11 aa, Homo sapiens
  heavy chain complementarity determining region 3 for antibody 48698
ARSGSSWYFDF

SEQ ID NO: 97397 - protein, 10 aa, Homo sapiens
  light chain complementarity determining region 3 for antibody 48699
QQRYSTLAWT

SEQ ID NO: 97398 - protein, 17 aa, Homo sapiens
  heavy chain complementarity determining region 3 for antibody 48699
ARENRVGPGGVFIPIDH

SEQ ID NO: 97399 - protein, 8 aa, Homo sapiens
  light chain complementarity determining region 3 for antibody 48700
QQRYSSLT

SEQ ID NO: 97400 - protein, 12 aa, Homo sapiens
  heavy chain complementarity determining region 3 for antibody 48700
ARDADSNYDLDY

SEQ ID NO: 97401 - protein, 9 aa, Homo sapiens
  light chain complementarity determining region 3 for antibody 48701
QQRYSIPYT

SEQ ID NO: 97402 - protein, 13 aa, Homo sapiens
  heavy chain complementarity determining region 3 for antibody 48701
ARDLAMTTGLFDY

SEQ ID NO: 97403 - protein, 9 aa, Homo sapiens
  light chain complementarity determining region 3 for antibody 48702
QQRYSIPLT

SEQ ID NO: 97404 - protein, 12 aa, Homo sapiens
  heavy chain complementarity determining region 3 for antibody 48702
TWSSLVSLWFGD

SEQ ID NO: 97405 - protein, 9 aa, Homo sapiens
  light chain complementarity determining region 3 for antibody 48703
QQRYSIPIT

SEQ ID NO: 97406 - protein, 10 aa, Homo sapiens
  heavy chain complementarity determining region 3 for antibody 48703
ARGVHLGGDF

SEQ ID NO: 97407 - protein, 9 aa, Homo sapiens
  light chain complementarity determining region 3 for antibody 48704
QQRYSIPIT

SEQ ID NO: 97408 - protein, 15 aa, Homo sapiens
  heavy chain complementarity determining region 3 for antibody 48704
AKCAEYQLLANWFDP

SEQ ID NO: 97409 - protein, 9 aa, Homo sapiens
  light chain complementarity determining region 3 for antibody 48705
QQRYSAPFT

SEQ ID NO: 97410 - protein, 21 aa, Homo sapiens
  heavy chain complementarity determining region 3 for antibody 48705
ARAVQSRGVRGIIILPDVFDI

SEQ ID NO: 97411 - protein, 10 aa, Homo sapiens
  light chain complementarity determining region 3 for antibody 48706
QQRYNWPSFT

SEQ ID NO: 97412 - protein, 11 aa, Homo sapiens
  heavy chain complementarity determining region 3 for antibody 48706
ARGVGSYPFDS

SEQ ID NO: 97413 - protein, 10 aa, Homo sapiens
  light chain complementarity determining region 3 for antibody 48707
QQRYNWPPYT

SEQ ID NO: 97414 - protein, 16 aa, Homo sapiens
  heavy chain complementarity determining region 3 for antibody 48707
ATGSLGGGWYFPYLHH

SEQ ID NO: 97415 - protein, 10 aa, Homo sapiens
  light chain complementarity determining region 3 for antibody 48708
QQRYNWPPYP

SEQ ID NO: 97416 - protein, 11 aa, Homo sapiens
  heavy chain complementarity determining region 3 for antibody 48708
ARGVGSYPFDH

SEQ ID NO: 97417 - protein, 10 aa, Homo sapiens
  light chain complementarity determining region 3 for antibody 48709
QQRYNWPPIT

SEQ ID NO: 97418 - protein, 11 aa, Homo sapiens
  heavy chain complementarity determining region 3 for antibody 48709
ARGVGSYPFDS

SEQ ID NO: 97419 - protein, 10 aa, Homo sapiens
  light chain complementarity determining region 3 for antibody 48710
QQRYNWPPFP

SEQ ID NO: 97420 - protein, 14 aa, Homo sapiens
  heavy chain complementarity determining region 3 for antibody 48710
ARLEIVVIPPAKNR

SEQ ID NO: 97421 - protein, 10 aa, Homo sapiens
  light chain complementarity determining region 3 for antibody 48711
QQRYNWPPFI

SEQ ID NO: 97422 - protein, 11 aa, Homo sapiens
  heavy chain complementarity determining region 3 for antibody 48711
ARGVGSYPFDS

SEQ ID NO: 97423 - protein, 10 aa, Homo sapiens
  light chain complementarity determining region 3 for antibody 48712
QQRYNWPPFA

SEQ ID NO: 97424 - protein, 11 aa, Homo sapiens
  heavy chain complementarity determining region 3 for antibody 48712
ARGVGSYPFDS

SEQ ID NO: 97425 - protein, 8 aa, Homo sapiens
  light chain complementarity determining region 3 for antibody 48713
QQRYNWAT

SEQ ID NO: 97426 - protein, 15 aa, Homo sapiens
  heavy chain complementarity determining region 3 for antibody 48713
ARTDPDSTNHNYFDQ

SEQ ID NO: 97427 - protein, 9 aa, Homo sapiens
  light chain complementarity determining region 3 for antibody 48714
QQRYNTPIT

SEQ ID NO: 97428 - protein, 16 aa, Homo sapiens
  heavy chain complementarity determining region 3 for antibody 48714
ARGGDILTGSQWYFDV

SEQ ID NO: 97429 - protein, 10 aa, Homo sapiens
  light chain complementarity determining region 3 for antibody 48715
QQRYNRPPWT

SEQ ID NO: 97430 - protein, 20 aa, Homo sapiens
  heavy chain complementarity determining region 3 for antibody 48715
ARHRQVAVPDSFEVFWYFDL

SEQ ID NO: 97431 - protein, 10 aa, Homo sapiens
  light chain complementarity determining region 3 for antibody 48716
QQRYNLPPYT

SEQ ID NO: 97432 - protein, 11 aa, Homo sapiens
  heavy chain complementarity determining region 3 for antibody 48716
ARGVGSYVFES

SEQ ID NO: 97433 - protein, 10 aa, Homo sapiens
  light chain complementarity determining region 3 for antibody 48717
QQRYNCPPFT

SEQ ID NO: 97434 - protein, 11 aa, Homo sapiens
  heavy chain complementarity determining region 3 for antibody 48717
ARGVGSYPFDS

SEQ ID NO: 97435 - protein, 10 aa, Homo sapiens
  light chain complementarity determining region 3 for antibody 48718
QQRYNCPPFP

SEQ ID NO: 97436 - protein, 11 aa, Homo sapiens
  heavy chain complementarity determining region 3 for antibody 48718
ARGVGSYPFDS

SEQ ID NO: 97437 - protein, 9 aa, Homo sapiens
  light chain complementarity determining region 3 for antibody 48719
QQRYITPLT

SEQ ID NO: 97438 - protein, 14 aa, Homo sapiens
  heavy chain complementarity determining region 3 for antibody 48719
ARRGDSYGDNWLDP

SEQ ID NO: 97439 - protein, 9 aa, Homo sapiens
  light chain complementarity determining region 3 for antibody 48720
QQRYHTPRT

SEQ ID NO: 97440 - protein, 17 aa, Homo sapiens
  heavy chain complementarity determining region 3 for antibody 48720
AREGNLGGIHHSSWMDV

SEQ ID NO: 97441 - protein, 8 aa, Homo sapiens
  light chain complementarity determining region 3 for antibody 48721
QQRVKWPT

SEQ ID NO: 97442 - protein, 14 aa, Homo sapiens
  heavy chain complementarity determining region 3 for antibody 48721
ARVDIAATGAPFDP

SEQ ID NO: 97443 - protein, 9 aa, Homo sapiens
  light chain complementarity determining region 3 for antibody 48722
QQRVIWPLS

SEQ ID NO: 97444 - protein, 19 aa, Homo sapiens
  heavy chain complementarity determining region 3 for antibody 48722
ARDPRHTEVENYYYYGMDV

SEQ ID NO: 97445 - protein, 10 aa, Homo sapiens
  light chain complementarity determining region 3 for antibody 48723
QQRVHWPPIT

SEQ ID NO: 97446 - protein, 16 aa, Homo sapiens
  heavy chain complementarity determining region 3 for antibody 48723
ARDNSILADGSWWFDP

SEQ ID NO: 97447 - protein, 11 aa, Homo sapiens
  light chain complementarity determining region 3 for antibody 48724
QQRTYGPPGFT

SEQ ID NO: 97448 - protein, 17 aa, Homo sapiens
  heavy chain complementarity determining region 3 for antibody 48724
ARGGHHDVLTGYDLGSI

SEQ ID NO: 97449 - protein, 9 aa, Homo sapiens
  light chain complementarity determining region 3 for antibody 48725
QQRTNRPLT

SEQ ID NO: 97450 - protein, 17 aa, Homo sapiens
  heavy chain complementarity determining region 3 for antibody 48725
VKGGIYGEFYYYYGMDV

SEQ ID NO: 97451 - protein, 8 aa, Homo sapiens
  light chain complementarity determining region 3 for antibody 48726
QQRTDGLT

SEQ ID NO: 97452 - protein, 13 aa, Homo sapiens
  heavy chain complementarity determining region 3 for antibody 48726
ARDLGEGAVPDES

SEQ ID NO: 97453 - protein, 11 aa, Homo sapiens
  light chain complementarity determining region 3 for antibody 48727
QQRTAWPPEFT

SEQ ID NO: 97454 - protein, 11 aa, Homo sapiens
  heavy chain complementarity determining region 3 for antibody 48727
VRLESLDAFEV

SEQ ID NO: 97455 - protein, 10 aa, Homo sapiens
  light chain complementarity determining region 3 for antibody 48728
QQRSYWPPYT

SEQ ID NO: 97456 - protein, 13 aa, Homo sapiens
  heavy chain complementarity determining region 3 for antibody 48728
AREGYYGSGEFDL

SEQ ID NO: 97457 - protein, 10 aa, Homo sapiens
  light chain complementarity determining region 3 for antibody 48729
QQRSYWPPWT

SEQ ID NO: 97458 - protein, 11 aa, Homo sapiens
  heavy chain complementarity determining region 3 for antibody 48729
ARARGRQGDDF

SEQ ID NO: 97459 - protein, 9 aa, Homo sapiens
  light chain complementarity determining region 3 for antibody 48730
QQRSYWPPT

SEQ ID NO: 97460 - protein, 15 aa, Homo sapiens
  heavy chain complementarity determining region 3 for antibody 48730
ARLHDANGDYGYLDY

SEQ ID NO: 97461 - protein, 9 aa, Homo sapiens
  light chain complementarity determining region 3 for antibody 48731
QQRSTWPYT

SEQ ID NO: 97462 - protein, 17 aa, Homo sapiens
  heavy chain complementarity determining region 3 for antibody 48731
ARHGCTGGSCQRSYFDA

SEQ ID NO: 97463 - protein, 10 aa, Homo sapiens
  light chain complementarity determining region 3 for antibody 48732
QQRSTWPPYT

SEQ ID NO: 97464 - protein, 15 aa, Homo sapiens
  heavy chain complementarity determining region 3 for antibody 48732
AKDQTPDGAGRYFHV

SEQ ID NO: 97465 - protein, 10 aa, Homo sapiens
  light chain complementarity determining region 3 for antibody 48733
QQRSTWPPSS

SEQ ID NO: 97466 - protein, 15 aa, Homo sapiens
  heavy chain complementarity determining region 3 for antibody 48733
AKEETPDAAGRHFDL

SEQ ID NO: 97467 - protein, 10 aa, Homo sapiens
  light chain complementarity determining region 3 for antibody 48734
QQRSTWPPIT

SEQ ID NO: 97468 - protein, 13 aa, Homo sapiens
  heavy chain complementarity determining region 3 for antibody 48734
ARDYGDSYWHFDL

SEQ ID NO: 97469 - protein, 10 aa, Homo sapiens
  light chain complementarity determining region 3 for antibody 48735
QQRSTWPPFS

SEQ ID NO: 97470 - protein, 15 aa, Homo sapiens
  heavy chain complementarity determining region 3 for antibody 48735
AKEETPDGAGRFFDL

SEQ ID NO: 97471 - protein, 10 aa, Homo sapiens
  light chain complementarity determining region 3 for antibody 48736
QQRSTWPPDS

SEQ ID NO: 97472 - protein, 15 aa, Homo sapiens
  heavy chain complementarity determining region 3 for antibody 48736
AKEETPDAAGRHFDL

SEQ ID NO: 97473 - protein, 9 aa, Homo sapiens
  light chain complementarity determining region 3 for antibody 48737
QQRSTWPIT

SEQ ID NO: 97474 - protein, 16 aa, Homo sapiens
  heavy chain complementarity determining region 3 for antibody 48737
ARGRGRGYSSGGTFDY

SEQ ID NO: 97475 - protein, 8 aa, Homo sapiens
  light chain complementarity determining region 3 for antibody 48738
QQRSTWGT

SEQ ID NO: 97476 - protein, 17 aa, Homo sapiens
  heavy chain complementarity determining region 3 for antibody 48738
AKDVHSRQGYYYYGMDV

SEQ ID NO: 97477 - protein, 9 aa, Homo sapiens
  light chain complementarity determining region 3 for antibody 48739
QQRSTTPWT

SEQ ID NO: 97478 - protein, 18 aa, Homo sapiens
  heavy chain complementarity determining region 3 for antibody 48739
VKVAYCVGDCKWGGTLDY

SEQ ID NO: 97479 - protein, 9 aa, Homo sapiens
  light chain complementarity determining region 3 for antibody 48740
QQRSTCPLT

SEQ ID NO: 97480 - protein, 7 aa, Homo sapiens
  heavy chain complementarity determining region 3 for antibody 48740
VRDEWWP

SEQ ID NO: 97481 - protein, 8 aa, Homo sapiens
  light chain complementarity determining region 3 for antibody 48741
QQRSSWQT

SEQ ID NO: 97482 - protein, 23 aa, Homo sapiens
  heavy chain complementarity determining region 3 for antibody 48741
ARRMLRPGFYSDENGHSYGLFDE

SEQ ID NO: 97483 - protein, 8 aa, Homo sapiens
  light chain complementarity determining region 3 for antibody 48742
QQRSSWPT

SEQ ID NO: 97484 - protein, 23 aa, Homo sapiens
  heavy chain complementarity determining region 3 for antibody 48742
ARRMLHPGFYSDENGHSYGLFDE

SEQ ID NO: 97485 - protein, 10 aa, Homo sapiens
  light chain complementarity determining region 3 for antibody 48743
QQRSSWPSIT

SEQ ID NO: 97486 - protein, 13 aa, Homo sapiens
  heavy chain complementarity determining region 3 for antibody 48743
ARESDFRSPGFDF

SEQ ID NO: 97487 - protein, 10 aa, Homo sapiens
  light chain complementarity determining region 3 for antibody 48744
QQRSSWPPIT

SEQ ID NO: 97488 - protein, 13 aa, Homo sapiens
  heavy chain complementarity determining region 3 for antibody 48744
ARDYGDSYWHFDL

SEQ ID NO: 97489 - protein, 8 aa, Homo sapiens
  light chain complementarity determining region 3 for antibody 48745
QQRSSWLT

SEQ ID NO: 97490 - protein, 11 aa, Homo sapiens
  heavy chain complementarity determining region 3 for antibody 48745
VHRFGRNYFDP

SEQ ID NO: 97491 - protein, 10 aa, Homo sapiens
  light chain complementarity determining region 3 for antibody 48746
QQRSRWPPLT

SEQ ID NO: 97492 - protein, 9 aa, Homo sapiens
  heavy chain complementarity determining region 3 for antibody 48746
ARVDGYFDY

SEQ ID NO: 97493 - protein, 8 aa, Homo sapiens
  light chain complementarity determining region 3 for antibody 48747
QQRSNWYT

SEQ ID NO: 97494 - protein, 14 aa, Homo sapiens
  heavy chain complementarity determining region 3 for antibody 48747
ARSGAVYYYHGMDV

SEQ ID NO: 97495 - protein, 8 aa, Homo sapiens
  light chain complementarity determining region 3 for antibody 48748
QQRSNWVT

SEQ ID NO: 97496 - protein, 21 aa, Homo sapiens
  heavy chain complementarity determining region 3 for antibody 48748
ARNDPDNKEVGETYHYNYFDQ

SEQ ID NO: 97497 - protein, 8 aa, Homo sapiens
  light chain complementarity determining region 3 for antibody 48749
QQRSNWVT

SEQ ID NO: 97498 - protein, 21 aa, Homo sapiens
  heavy chain complementarity determining region 3 for antibody 48749
ARNDPDNKEVGEPYHYNYFEQ

SEQ ID NO: 97499 - protein, 8 aa, Homo sapiens
  light chain complementarity determining region 3 for antibody 48750
QQRSNWVP

SEQ ID NO: 97500 - protein, 21 aa, Homo sapiens
  heavy chain complementarity determining region 3 for antibody 48750
ARNDPDKKEGGQTYGYNYFDQ

SEQ ID NO: 97501 - protein, 9 aa, Homo sapiens
  light chain complementarity determining region 3 for antibody 48751
QQRSNWVFT

SEQ ID NO: 97502 - protein, 21 aa, Homo sapiens
  heavy chain complementarity determining region 3 for antibody 48751
STDNWDYYDILIGHSYPYFDH

SEQ ID NO: 97503 - protein, 9 aa, Homo sapiens
  light chain complementarity determining region 3 for antibody 48752
QQRSNWTWT

SEQ ID NO: 97504 - protein, 10 aa, Homo sapiens
  heavy chain complementarity determining region 3 for antibody 48752
ARMVRGYFNH

SEQ ID NO: 97505 - protein, 9 aa, Homo sapiens
  light chain complementarity determining region 3 for antibody 48753
QQRSNWSWP

SEQ ID NO: 97506 - protein, 17 aa, Homo sapiens
  heavy chain complementarity determining region 3 for antibody 48753
ARDGSGAYGPPFTTFDY

SEQ ID NO: 97507 - protein, 11 aa, Homo sapiens
  light chain complementarity determining region 3 for antibody 48754
QQRSNWSPGAT

SEQ ID NO: 97508 - protein, 11 aa, Homo sapiens
  heavy chain complementarity determining region 3 for antibody 48754
ARGTSVWYFDL

SEQ ID NO: 97509 - protein, 9 aa, Homo sapiens
  light chain complementarity determining region 3 for antibody 48755
QQRSNWRYT

SEQ ID NO: 97510 - protein, 16 aa, Homo sapiens
  heavy chain complementarity determining region 3 for antibody 48755
ARPHDPSSTSWYFFDY

SEQ ID NO: 97511 - protein, 10 aa, Homo sapiens
  light chain complementarity determining region 3 for antibody 48756
QQRSNWQRLT

SEQ ID NO: 97512 - protein, 16 aa, Homo sapiens
  heavy chain complementarity determining region 3 for antibody 48756
TKCHDFWNGYSYYFDY

SEQ ID NO: 97513 - protein, 9 aa, Homo sapiens
  light chain complementarity determining region 3 for antibody 48757
QQRSNWPYT

SEQ ID NO: 97514 - protein, 13 aa, Homo sapiens
  heavy chain complementarity determining region 3 for antibody 48757
ARHERGYSFEADY

SEQ ID NO: 97515 - protein, 9 aa, Homo sapiens
  light chain complementarity determining region 3 for antibody 48758
QQRSNWPVT

SEQ ID NO: 97516 - protein, 18 aa, Homo sapiens
  heavy chain complementarity determining region 3 for antibody 48758
ARENGWFGELIYYYGMDV

SEQ ID NO: 97517 - protein, 10 aa, Homo sapiens
  light chain complementarity determining region 3 for antibody 48759
QQRSNWPTPT

SEQ ID NO: 97518 - protein, 14 aa, Homo sapiens
  heavy chain complementarity determining region 3 for antibody 48759
AKDVEFWSGYYGDY

SEQ ID NO: 97519 - protein, 10 aa, Homo sapiens
  light chain complementarity determining region 3 for antibody 48760
QQRSNWPTLT

SEQ ID NO: 97520 - protein, 14 aa, Homo sapiens
  heavy chain complementarity determining region 3 for antibody 48760
AKDVELWSGYYGDY

SEQ ID NO: 97521 - protein, 10 aa, Homo sapiens
  light chain complementarity determining region 3 for antibody 48761
QQRSNWPTLP

SEQ ID NO: 97522 - protein, 14 aa, Homo sapiens
  heavy chain complementarity determining region 3 for antibody 48761
AKDVEFWSGYYGDY

SEQ ID NO: 97523 - protein, 8 aa, Homo sapiens
  light chain complementarity determining region 3 for antibody 48762
QQRSNWPT

SEQ ID NO: 97524 - protein, 11 aa, Homo sapiens
  heavy chain complementarity determining region 3 for antibody 48762
AYGDPGRFLDY

SEQ ID NO: 97525 - protein, 8 aa, Homo sapiens
  light chain complementarity determining region 3 for antibody 48763
QQRSNWPS

SEQ ID NO: 97526 - protein, 15 aa, Homo sapiens
  heavy chain complementarity determining region 3 for antibody 48763
TSGVGILYPSELFDY

SEQ ID NO: 97527 - protein, 8 aa, Homo sapiens
  light chain complementarity determining region 3 for antibody 48764
QQRSNWPS

SEQ ID NO: 97528 - protein, 12 aa, Homo sapiens
  heavy chain complementarity determining region 3 for antibody 48764
AQSVTAMRPFHA

SEQ ID NO: 97529 - protein, 10 aa, Homo sapiens
  light chain complementarity determining region 3 for antibody 48765
QQRSNWPRYT

SEQ ID NO: 97530 - protein, 15 aa, Homo sapiens
  heavy chain complementarity determining region 3 for antibody 48765
ARHDGSGYSYAPDDI

SEQ ID NO: 97531 - protein, 10 aa, Homo sapiens
  light chain complementarity determining region 3 for antibody 48766
QQRSNWPRST

SEQ ID NO: 97532 - protein, 15 aa, Homo sapiens
  heavy chain complementarity determining region 3 for antibody 48766
ARHDGSGYSYAPDEI

SEQ ID NO: 97533 - protein, 10 aa, Homo sapiens
  light chain complementarity determining region 3 for antibody 48767
QQRSNWPRRT

SEQ ID NO: 97534 - protein, 15 aa, Homo sapiens
  heavy chain complementarity determining region 3 for antibody 48767
ARDVTTFIDPDAFDL

SEQ ID NO: 97535 - protein, 10 aa, Homo sapiens
  light chain complementarity determining region 3 for antibody 48768
QQRSNWPPYT

SEQ ID NO: 97536 - protein, 11 aa, Homo sapiens
  heavy chain complementarity determining region 3 for antibody 48768
ARGVGSYVFES

SEQ ID NO: 97537 - protein, 10 aa, Homo sapiens
  light chain complementarity determining region 3 for antibody 48769
QQRSNWPPYT

SEQ ID NO: 97538 - protein, 17 aa, Homo sapiens
  heavy chain complementarity determining region 3 for antibody 48769
ARDGGCSGSRCNSGLGY

SEQ ID NO: 97539 - protein, 11 aa, Homo sapiens
  light chain complementarity determining region 3 for antibody 48770
QQRSNWPPWAT

SEQ ID NO: 97540 - protein, 11 aa, Homo sapiens
  heavy chain complementarity determining region 3 for antibody 48770
ARGTSVWYFDL

SEQ ID NO: 97541 - protein, 12 aa, Homo sapiens
  light chain complementarity determining region 3 for antibody 48771
QQRSNWPPVSPT

SEQ ID NO: 97542 - protein, 15 aa, Homo sapiens
  heavy chain complementarity determining region 3 for antibody 48771
ARDRLHSSGNFYFDY

SEQ ID NO: 97543 - protein, 12 aa, Homo sapiens
  light chain complementarity determining region 3 for antibody 48772
QQRSNWPPVSPP

SEQ ID NO: 97544 - protein, 15 aa, Homo sapiens
  heavy chain complementarity determining region 3 for antibody 48772
ARDRLHSSGNFYFDY

SEQ ID NO: 97545 - protein, 11 aa, Homo sapiens
  light chain complementarity determining region 3 for antibody 48773
QQRSNWPPVAT

SEQ ID NO: 97546 - protein, 11 aa, Homo sapiens
  heavy chain complementarity determining region 3 for antibody 48773
ARGTSVWYFDL

SEQ ID NO: 97547 - protein, 10 aa, Homo sapiens
  light chain complementarity determining region 3 for antibody 48774
QQRSNWPPTT

SEQ ID NO: 97548 - protein, 17 aa, Homo sapiens
  heavy chain complementarity determining region 3 for antibody 48774
AAGYHSESLSADEVFDI

SEQ ID NO: 97549 - protein, 11 aa, Homo sapiens
  light chain complementarity determining region 3 for antibody 48775
QQRSNWPPTGT

SEQ ID NO: 97550 - protein, 13 aa, Homo sapiens
  heavy chain complementarity determining region 3 for antibody 48775
ARGLLGIPAAADY

SEQ ID NO: 97551 - protein, 9 aa, Homo sapiens
  light chain complementarity determining region 3 for antibody 48776
QQRSNWPPT

SEQ ID NO: 97552 - protein, 23 aa, Homo sapiens
  heavy chain complementarity determining region 3 for antibody 48776
ARGHTFYDYVWGSYRSSLNYFDY

SEQ ID NO: 97553 - protein, 10 aa, Homo sapiens
  light chain complementarity determining region 3 for antibody 48777
QQRSNWPPST

SEQ ID NO: 97554 - protein, 11 aa, Homo sapiens
  heavy chain complementarity determining region 3 for antibody 48777
ARGVGSYPFDS

SEQ ID NO: 97555 - protein, 10 aa, Homo sapiens
  light chain complementarity determining region 3 for antibody 48778
QQRSNWPPST

SEQ ID NO: 97556 - protein, 21 aa, Homo sapiens
  heavy chain complementarity determining region 3 for antibody 48778
ARDAPVSRPYSSGWYSSAFDY

SEQ ID NO: 97557 - protein, 10 aa, Homo sapiens
  light chain complementarity determining region 3 for antibody 48779
QQRSNWPPRT

SEQ ID NO: 97558 - protein, 10 aa, Homo sapiens
  heavy chain complementarity determining region 3 for antibody 48779
ARDYTMTFDY

SEQ ID NO: 97559 - protein, 11 aa, Homo sapiens
  light chain complementarity determining region 3 for antibody 48780
QQRSNWPPPWT

SEQ ID NO: 97560 - protein, 13 aa, Homo sapiens
  heavy chain complementarity determining region 3 for antibody 48780
ARGLLGIPAAADY

SEQ ID NO: 97561 - protein, 10 aa, Homo sapiens
  light chain complementarity determining region 3 for antibody 48781
QQRSNWPPPT

SEQ ID NO: 97562 - protein, 18 aa, Homo sapiens
  heavy chain complementarity determining region 3 for antibody 48781
ATSAGPEYSGSYYSRADY

SEQ ID NO: 97563 - protein, 10 aa, Homo sapiens
  light chain complementarity determining region 3 for antibody 48782
QQRSNWPPPT

SEQ ID NO: 97564 - protein, 10 aa, Homo sapiens
  heavy chain complementarity determining region 3 for antibody 48782
ARDYTMTFDY

SEQ ID NO: 97565 - protein, 10 aa, Homo sapiens
  light chain complementarity determining region 3 for antibody 48783
QQRSNWPPNP

SEQ ID NO: 97566 - protein, 12 aa, Homo sapiens
  heavy chain complementarity determining region 3 for antibody 48783
VKSGYSNGWYGH

SEQ ID NO: 97567 - protein, 9 aa, Homo sapiens
  light chain complementarity determining region 3 for antibody 48784
QQRSNWPPN

SEQ ID NO: 97568 - protein, 19 aa, Homo sapiens
  heavy chain complementarity determining region 3 for antibody 48784
ARDVSSADHYGPGKSWFDP

SEQ ID NO: 97569 - protein, 10 aa, Homo sapiens
  light chain complementarity determining region 3 for antibody 48785
QQRSNWPPLT

SEQ ID NO: 97570 - protein, 13 aa, Homo sapiens
  heavy chain complementarity determining region 3 for antibody 48785
ATGGRSGATYFDY

SEQ ID NO: 97571 - protein, 10 aa, Homo sapiens
  light chain complementarity determining region 3 for antibody 48786
QQRSNWPPLT

SEQ ID NO: 97572 - protein, 10 aa, Homo sapiens
  heavy chain complementarity determining region 3 for antibody 48786
ARDYTMPFDY

SEQ ID NO: 97573 - protein, 10 aa, Homo sapiens
  light chain complementarity determining region 3 for antibody 48787
QQRSNWPPLT

SEQ ID NO: 97574 - protein, 11 aa, Homo sapiens
  heavy chain complementarity determining region 3 for antibody 48787
AGWRPTRHYDY

SEQ ID NO: 97575 - protein, 10 aa, Homo sapiens
  light chain complementarity determining region 3 for antibody 48788
QQRSNWPPLT

SEQ ID NO: 97576 - protein, 17 aa, Homo sapiens
  heavy chain complementarity determining region 3 for antibody 48788
AAGYHSESLSADEVFDI

SEQ ID NO: 97577 - protein, 10 aa, Homo sapiens
  light chain complementarity determining region 3 for antibody 48789
QQRSNWPPLP

SEQ ID NO: 97578 - protein, 10 aa, Homo sapiens
  heavy chain complementarity determining region 3 for antibody 48789
ARDYTMTFDY

SEQ ID NO: 97579 - protein, 10 aa, Homo sapiens
  light chain complementarity determining region 3 for antibody 48790
QQRSNWPPLP

SEQ ID NO: 97580 - protein, 21 aa, Homo sapiens
  heavy chain complementarity determining region 3 for antibody 48790
AHAGVGITMYGVIYYYYGMDV

SEQ ID NO: 97581 - protein, 10 aa, Homo sapiens
  light chain complementarity determining region 3 for antibody 48791
QQRSNWPPIT

SEQ ID NO: 97582 - protein, 22 aa, Homo sapiens
  heavy chain complementarity determining region 3 for antibody 48791
ATDRAFSRGNITSAYYPGVLIE

SEQ ID NO: 97583 - protein, 10 aa, Homo sapiens
  light chain complementarity determining region 3 for antibody 48792
QQRSNWPPIT

SEQ ID NO: 97584 - protein, 15 aa, Homo sapiens
  heavy chain complementarity determining region 3 for antibody 48792
ARMVRGLTGVHYFDY

SEQ ID NO: 97585 - protein, 11 aa, Homo sapiens
  light chain complementarity determining region 3 for antibody 48793
QQRSNWPPILT

SEQ ID NO: 97586 - protein, 21 aa, Homo sapiens
  heavy chain complementarity determining region 3 for antibody 48793
ARHDPDNRQGGDTFAYNYFDH

SEQ ID NO: 97587 - protein, 10 aa, Homo sapiens
  light chain complementarity determining region 3 for antibody 48794
QQRSNWPPGG

SEQ ID NO: 97588 - protein, 13 aa, Homo sapiens
  heavy chain complementarity determining region 3 for antibody 48794
ARDVSHGSSSFDL

SEQ ID NO: 97589 - protein, 11 aa, Homo sapiens
  light chain complementarity determining region 3 for antibody 48795
QQRSNWPPGAT

SEQ ID NO: 97590 - protein, 11 aa, Homo sapiens
  heavy chain complementarity determining region 3 for antibody 48795
ARGPSVWYFDL

SEQ ID NO: 97591 - protein, 11 aa, Homo sapiens
  light chain complementarity determining region 3 for antibody 48796
QQRSNWPPENS

SEQ ID NO: 97592 - protein, 14 aa, Homo sapiens
  heavy chain complementarity determining region 3 for antibody 48796
AKVGYSASWNHFDH

SEQ ID NO: 97593 - protein, 11 aa, Homo sapiens
  light chain complementarity determining region 3 for antibody 48797
QQRSNWPPAWT

SEQ ID NO: 97594 - protein, 16 aa, Homo sapiens
  heavy chain complementarity determining region 3 for antibody 48797
ARWWAVAGNKYWYLDL

SEQ ID NO: 97595 - protein, 11 aa, Homo sapiens
  light chain complementarity determining region 3 for antibody 48798
QQRSNWPPAFT

SEQ ID NO: 97596 - protein, 14 aa, Homo sapiens
  heavy chain complementarity determining region 3 for antibody 48798
TRHPTVGGPVGFDT

SEQ ID NO: 97597 - protein, 9 aa, Homo sapiens
  light chain complementarity determining region 3 for antibody 48799
QQRSNWPMT

SEQ ID NO: 97598 - protein, 14 aa, Homo sapiens
  heavy chain complementarity determining region 3 for antibody 48799
ARHGAAGRIAWFDP

SEQ ID NO: 97599 - protein, 10 aa, Homo sapiens
  light chain complementarity determining region 3 for antibody 48800
QQRSNWPLVT

SEQ ID NO: 97600 - protein, 14 aa, Homo sapiens
  heavy chain complementarity determining region 3 for antibody 48800
ARDLGCGDGVCSDH

SEQ ID NO: 97601 - protein, 9 aa, Homo sapiens
  light chain complementarity determining region 3 for antibody 48801
QQRSNWPLT

SEQ ID NO: 97602 - protein, 22 aa, Homo sapiens
  heavy chain complementarity determining region 3 for antibody 48801
VTGPPNHYYSRGPNRNPYYFDD

SEQ ID NO: 97603 - protein, 9 aa, Homo sapiens
  light chain complementarity determining region 3 for antibody 48802
QQRSNWPLT

SEQ ID NO: 97604 - protein, 16 aa, Homo sapiens
  heavy chain complementarity determining region 3 for antibody 48802
VHTSAKVRGVTRPADY

SEQ ID NO: 97605 - protein, 9 aa, Homo sapiens
  light chain complementarity determining region 3 for antibody 48803
QQRSNWPLT

SEQ ID NO: 97606 - protein, 14 aa, Homo sapiens
  heavy chain complementarity determining region 3 for antibody 48803
ASHGAAGRIAWFDP

SEQ ID NO: 97607 - protein, 9 aa, Homo sapiens
  light chain complementarity determining region 3 for antibody 48804
QQRSNWPLT

SEQ ID NO: 97608 - protein, 18 aa, Homo sapiens
  heavy chain complementarity determining region 3 for antibody 48804
ARTLNRLRGVTQYNWFGP

SEQ ID NO: 97609 - protein, 9 aa, Homo sapiens
  light chain complementarity determining region 3 for antibody 48805
QQRSNWPLT

SEQ ID NO: 97610 - protein, 14 aa, Homo sapiens
  heavy chain complementarity determining region 3 for antibody 48805
ARRGAAGRIAWFDP

SEQ ID NO: 97611 - protein, 9 aa, Homo sapiens
  light chain complementarity determining region 3 for antibody 48806
QQRSNWPLT

SEQ ID NO: 97612 - protein, 13 aa, Homo sapiens
  heavy chain complementarity determining region 3 for antibody 48806
ARISDRRARLPDL

SEQ ID NO: 97613 - protein, 9 aa, Homo sapiens
  light chain complementarity determining region 3 for antibody 48807
QQRSNWPLT

SEQ ID NO: 97614 - protein, 12 aa, Homo sapiens
  heavy chain complementarity determining region 3 for antibody 48807
AKARTGFDWFDP

SEQ ID NO: 97615 - protein, 9 aa, Homo sapiens
  light chain complementarity determining region 3 for antibody 48808
QQRSNWPLT

SEQ ID NO: 97616 - protein, 12 aa, Homo sapiens
  heavy chain complementarity determining region 3 for antibody 48808
AGVMVSGYYLDY

SEQ ID NO: 97617 - protein, 9 aa, Homo sapiens
  light chain complementarity determining region 3 for antibody 48809
QQRSNWPLP

SEQ ID NO: 97618 - protein, 18 aa, Homo sapiens
  heavy chain complementarity determining region 3 for antibody 48809
ARDIGEIRAAAASDAFDI

SEQ ID NO: 97619 - protein, 10 aa, Homo sapiens
  light chain complementarity determining region 3 for antibody 48810
QQRSNWPLLT

SEQ ID NO: 97620 - protein, 11 aa, Homo sapiens
  heavy chain complementarity determining region 3 for antibody 48810
VRDPPGNAFDR

SEQ ID NO: 97621 - protein, 10 aa, Homo sapiens
  light chain complementarity determining region 3 for antibody 48811
QQRSNWPLLT

SEQ ID NO: 97622 - protein, 13 aa, Homo sapiens
  heavy chain complementarity determining region 3 for antibody 48811
ARGDGWHDYALDY

SEQ ID NO: 97623 - protein, 10 aa, Homo sapiens
  light chain complementarity determining region 3 for antibody 48812
QQRSNWPIFP

SEQ ID NO: 97624 - protein, 11 aa, Homo sapiens
  heavy chain complementarity determining region 3 for antibody 48812
ASPQVLGAFDL

SEQ ID NO: 97625 - protein, 9 aa, Homo sapiens
  light chain complementarity determining region 3 for antibody 48813
QQRSNWPGT

SEQ ID NO: 97626 - protein, 10 aa, Homo sapiens
  heavy chain complementarity determining region 3 for antibody 48813
ARDNYHSIDY

SEQ ID NO: 97627 - protein, 9 aa, Homo sapiens
  light chain complementarity determining region 3 for antibody 48814
QQRSNWPGT

SEQ ID NO: 97628 - protein, 17 aa, Homo sapiens
  heavy chain complementarity determining region 3 for antibody 48814
AAGYHSKSFFADDAFDL

SEQ ID NO: 97629 - protein, 9 aa, Homo sapiens
  light chain complementarity determining region 3 for antibody 48815
QQRSNWPFT

SEQ ID NO: 97630 - protein, 14 aa, Homo sapiens
  heavy chain complementarity determining region 3 for antibody 48815
ATAYDTSGYAPFDS

SEQ ID NO: 97631 - protein, 9 aa, Homo sapiens
  light chain complementarity determining region 3 for antibody 48816
QQRSNWPFT

SEQ ID NO: 97632 - protein, 14 aa, Homo sapiens
  heavy chain complementarity determining region 3 for antibody 48816
ARDGIMGGPSWFDS

SEQ ID NO: 97633 - protein, 9 aa, Homo sapiens
  light chain complementarity determining region 3 for antibody 48817
QQRSNWPFT

SEQ ID NO: 97634 - protein, 16 aa, Homo sapiens
  heavy chain complementarity determining region 3 for antibody 48817
AKGTGGGWGEDNYFDP

SEQ ID NO: 97635 - protein, 9 aa, Homo sapiens
  light chain complementarity determining region 3 for antibody 48818
QQRSNWPAT

SEQ ID NO: 97636 - protein, 18 aa, Homo sapiens
  heavy chain complementarity determining region 3 for antibody 48818
ARENVWFGELIYYYGMDV

SEQ ID NO: 97637 - protein, 7 aa, Homo sapiens
  light chain complementarity determining region 3 for antibody 48819
QQRSNWP

SEQ ID NO: 97638 - protein, 18 aa, Homo sapiens
  heavy chain complementarity determining region 3 for antibody 48819
ARDIADEETDYYYYGMDV

SEQ ID NO: 97639 - protein, 10 aa, Homo sapiens
  light chain complementarity determining region 3 for antibody 48820
QQRSNWPALT

SEQ ID NO: 97640 - protein, 12 aa, Homo sapiens
  heavy chain complementarity determining region 3 for antibody 48820
AREASSSWYVDY

SEQ ID NO: 97641 - protein, 9 aa, Homo sapiens
  light chain complementarity determining region 3 for antibody 48821
QQRSNWLFT

SEQ ID NO: 97642 - protein, 12 aa, Homo sapiens
  heavy chain complementarity determining region 3 for antibody 48821
ARHHIYPIYFHH

SEQ ID NO: 97643 - protein, 10 aa, Homo sapiens
  light chain complementarity determining region 3 for antibody 48822
QQRSNWKRIT

SEQ ID NO: 97644 - protein, 16 aa, Homo sapiens
  heavy chain complementarity determining region 3 for antibody 48822
TKCHDFWNGYSYYFDY

SEQ ID NO: 97645 - protein, 10 aa, Homo sapiens
  light chain complementarity determining region 3 for antibody 48823
QQRSNWHPNT

SEQ ID NO: 97646 - protein, 12 aa, Homo sapiens
  heavy chain complementarity determining region 3 for antibody 48823
VKSGYSNGWYGH

SEQ ID NO: 97647 - protein, 8 aa, Homo sapiens
  light chain complementarity determining region 3 for antibody 48824
QQRSNSGT

SEQ ID NO: 97648 - protein, 12 aa, Homo sapiens
  heavy chain complementarity determining region 3 for antibody 48824
ARFPSYTSYFDY

SEQ ID NO: 97649 - protein, 10 aa, Homo sapiens
  light chain complementarity determining region 3 for antibody 48825
QQRSNRPRGP

SEQ ID NO: 97650 - protein, 9 aa, Homo sapiens
  heavy chain complementarity determining region 3 for antibody 48825
ARVDGYFDY

SEQ ID NO: 97651 - protein, 10 aa, Homo sapiens
  light chain complementarity determining region 3 for antibody 48826
QQRSNRPPYT

SEQ ID NO: 97652 - protein, 11 aa, Homo sapiens
  heavy chain complementarity determining region 3 for antibody 48826
ARGVGSYPFDS

SEQ ID NO: 97653 - protein, 10 aa, Homo sapiens
  light chain complementarity determining region 3 for antibody 48827
QQRSNRPPIT

SEQ ID NO: 97654 - protein, 17 aa, Homo sapiens
  heavy chain complementarity determining region 3 for antibody 48827
AAGYHSESLSADEVFDI

SEQ ID NO: 97655 - protein, 9 aa, Homo sapiens
  light chain complementarity determining region 3 for antibody 48828
QQRSNRPLT

SEQ ID NO: 97656 - protein, 18 aa, Homo sapiens
  heavy chain complementarity determining region 3 for antibody 48828
ARGHYDILTGSGPNWFDP

SEQ ID NO: 97657 - protein, 9 aa, Homo sapiens
  light chain complementarity determining region 3 for antibody 48829
QQRSNLPPT

SEQ ID NO: 97658 - protein, 14 aa, Homo sapiens
  heavy chain complementarity determining region 3 for antibody 48829
AKAIVGAILHAFDI

SEQ ID NO: 97659 - protein, 11 aa, Homo sapiens
  light chain complementarity determining region 3 for antibody 48830
QQRSNLPPEYS

SEQ ID NO: 97660 - protein, 14 aa, Homo sapiens
  heavy chain complementarity determining region 3 for antibody 48830
AKVGYSASWNHFDH

SEQ ID NO: 97661 - protein, 9 aa, Homo sapiens
  light chain complementarity determining region 3 for antibody 48831
QQRSNGPFT

SEQ ID NO: 97662 - protein, 16 aa, Homo sapiens
  heavy chain complementarity determining region 3 for antibody 48831
ARELARRNTYYHAFEI

SEQ ID NO: 97663 - protein, 9 aa, Homo sapiens
  light chain complementarity determining region 3 for antibody 48832
QQRSLWPWA

SEQ ID NO: 97664 - protein, 14 aa, Homo sapiens
  heavy chain complementarity determining region 3 for antibody 48832
AKSPGTTYNGFVDV

SEQ ID NO: 97665 - protein, 9 aa, Homo sapiens
  light chain complementarity determining region 3 for antibody 48833
QQRSKWPST

SEQ ID NO: 97666 - protein, 16 aa, Homo sapiens
  heavy chain complementarity determining region 3 for antibody 48833
ARGRGRGYSSGGTFDY

SEQ ID NO: 97667 - protein, 10 aa, Homo sapiens
  light chain complementarity determining region 3 for antibody 48834
QQRSKWPPST

SEQ ID NO: 97668 - protein, 9 aa, Homo sapiens
  heavy chain complementarity determining region 3 for antibody 48834
ARVDGYFDY

SEQ ID NO: 97669 - protein, 10 aa, Homo sapiens
  light chain complementarity determining region 3 for antibody 48835
QQRSKWPPLT

SEQ ID NO: 97670 - protein, 15 aa, Homo sapiens
  heavy chain complementarity determining region 3 for antibody 48835
TTDPGQLVYGAYFDY

SEQ ID NO: 97671 - protein, 9 aa, Homo sapiens
  light chain complementarity determining region 3 for antibody 48836
QQRSKRPIT

SEQ ID NO: 97672 - protein, 16 aa, Homo sapiens
  heavy chain complementarity determining region 3 for antibody 48836
ARGRGRGYSSGGTFDY

SEQ ID NO: 97673 - protein, 10 aa, Homo sapiens
  light chain complementarity determining region 3 for antibody 48837
QQRSKRPGVP

SEQ ID NO: 97674 - protein, 13 aa, Homo sapiens
  heavy chain complementarity determining region 3 for antibody 48837
ARDHWDKIAVAAR

SEQ ID NO: 97675 - protein, 10 aa, Homo sapiens
  light chain complementarity determining region 3 for antibody 48838
QQRSKGPPRT

SEQ ID NO: 97676 - protein, 9 aa, Homo sapiens
  heavy chain complementarity determining region 3 for antibody 48838
ARVDGYFDY

SEQ ID NO: 97677 - protein, 9 aa, Homo sapiens
  light chain complementarity determining region 3 for antibody 48839
QQRSKGPIT

SEQ ID NO: 97678 - protein, 16 aa, Homo sapiens
  heavy chain complementarity determining region 3 for antibody 48839
ARGRGRGYSSGGTFDY

SEQ ID NO: 97679 - protein, 8 aa, Homo sapiens
  light chain complementarity determining region 3 for antibody 48840
QQRSIWCT

SEQ ID NO: 97680 - protein, 9 aa, Homo sapiens
  heavy chain complementarity determining region 3 for antibody 48840
VTAEHGIDF

SEQ ID NO: 97681 - protein, 8 aa, Homo sapiens
  light chain complementarity determining region 3 for antibody 48841
QQRSHWWT

SEQ ID NO: 97682 - protein, 12 aa, Homo sapiens
  heavy chain complementarity determining region 3 for antibody 48841
ARLRLRNKRFDP

SEQ ID NO: 97683 - protein, 8 aa, Homo sapiens
  light chain complementarity determining region 3 for antibody 48842
QQRSHWWK

SEQ ID NO: 97684 - protein, 12 aa, Homo sapiens
  heavy chain complementarity determining region 3 for antibody 48842
ARLRLRNKWFDP

SEQ ID NO: 97685 - protein, 11 aa, Homo sapiens
  light chain complementarity determining region 3 for antibody 48843
QQRSHWPPMYT

SEQ ID NO: 97686 - protein, 18 aa, Homo sapiens
  heavy chain complementarity determining region 3 for antibody 48843
ASTYYYDSSGYYLNGHDY

SEQ ID NO: 97687 - protein, 11 aa, Homo sapiens
  light chain complementarity determining region 3 for antibody 48844
QQRSHRPPMYT

SEQ ID NO: 97688 - protein, 18 aa, Homo sapiens
  heavy chain complementarity determining region 3 for antibody 48844
ASTYYYDSSGYYLNGHDY

SEQ ID NO: 97689 - protein, 9 aa, Homo sapiens
  light chain complementarity determining region 3 for antibody 48845
QQRSGWPFP

SEQ ID NO: 97690 - protein, 15 aa, Homo sapiens
  heavy chain complementarity determining region 3 for antibody 48845
AREGYYGSGRGGSDN

SEQ ID NO: 97691 - protein, 9 aa, Homo sapiens
  light chain complementarity determining region 3 for antibody 48846
QQRSGWLPT

SEQ ID NO: 97692 - protein, 15 aa, Homo sapiens
  heavy chain complementarity determining region 3 for antibody 48846
VTGSPFYYDNSGTDY

SEQ ID NO: 97693 - protein, 8 aa, Homo sapiens
  light chain complementarity determining region 3 for antibody 48847
QQRSDWVP

SEQ ID NO: 97694 - protein, 21 aa, Homo sapiens
  heavy chain complementarity determining region 3 for antibody 48847
ARHDPDNRQDGDTFAYNYFDQ

SEQ ID NO: 97695 - protein, 9 aa, Homo sapiens
  light chain complementarity determining region 3 for antibody 48848
QQRSDWPRT

SEQ ID NO: 97696 - protein, 14 aa, Homo sapiens
  heavy chain complementarity determining region 3 for antibody 48848
ARGQEMAEKVDEDY

SEQ ID NO: 97697 - protein, 10 aa, Homo sapiens
  light chain complementarity determining region 3 for antibody 48849
QQRSDWPPWT

SEQ ID NO: 97698 - protein, 13 aa, Homo sapiens
  heavy chain complementarity determining region 3 for antibody 48849
ARAIAAAGNFPAT

SEQ ID NO: 97699 - protein, 8 aa, Homo sapiens
  light chain complementarity determining region 3 for antibody 48850
QQRSDWPP

SEQ ID NO: 97700 - protein, 14 aa, Homo sapiens
  heavy chain complementarity determining region 3 for antibody 48850
VKDLYGGNSLWFDP

SEQ ID NO: 97701 - protein, 10 aa, Homo sapiens
  light chain complementarity determining region 3 for antibody 48851
QQRSDWPPLP

SEQ ID NO: 97702 - protein, 10 aa, Homo sapiens
  heavy chain complementarity determining region 3 for antibody 48851
ARDYTMTFDY

SEQ ID NO: 97703 - protein, 10 aa, Homo sapiens
  light chain complementarity determining region 3 for antibody 48852
QQRSDWPPIP

SEQ ID NO: 97704 - protein, 15 aa, Homo sapiens
  heavy chain complementarity determining region 3 for antibody 48852
ARSSLQLWSKDYFDY

SEQ ID NO: 97705 - protein, 11 aa, Homo sapiens
  light chain complementarity determining region 3 for antibody 48853
QQRSDWPPEDT

SEQ ID NO: 97706 - protein, 15 aa, Homo sapiens
  heavy chain complementarity determining region 3 for antibody 48853
ARGNSGWYAGGAFQH

SEQ ID NO: 97707 - protein, 9 aa, Homo sapiens
  light chain complementarity determining region 3 for antibody 48854
QQRSDWPLT

SEQ ID NO: 97708 - protein, 22 aa, Homo sapiens
  heavy chain complementarity determining region 3 for antibody 48854
VRQEGRYFHGGNGFYVSETFHH

SEQ ID NO: 97709 - protein, 9 aa, Homo sapiens
  light chain complementarity determining region 3 for antibody 48855
QQRSDWPLT

SEQ ID NO: 97710 - protein, 19 aa, Homo sapiens
  heavy chain complementarity determining region 3 for antibody 48855
AKGLSFPLRLGELSLVFDY

SEQ ID NO: 97711 - protein, 9 aa, Homo sapiens
  light chain complementarity determining region 3 for antibody 48856
QQRSDWPLA

SEQ ID NO: 97712 - protein, 12 aa, Homo sapiens
  heavy chain complementarity determining region 3 for antibody 48856
ARDMDGFYGLDY

SEQ ID NO: 97713 - protein, 9 aa, Homo sapiens
  light chain complementarity determining region 3 for antibody 48857
QQRSDWPFT

SEQ ID NO: 97714 - protein, 16 aa, Homo sapiens
  heavy chain complementarity determining region 3 for antibody 48857
ARDLDSSGLYERGSDP

SEQ ID NO: 97715 - protein, 8 aa, Homo sapiens
  light chain complementarity determining region 3 for antibody 48858
QQRSDWGT

SEQ ID NO: 97716 - protein, 21 aa, Homo sapiens
  heavy chain complementarity determining region 3 for antibody 48858
ARHDPDNRQDGDTFAYNYFDQ

SEQ ID NO: 97717 - protein, 8 aa, Homo sapiens
  light chain complementarity determining region 3 for antibody 48859
QQRSDSYP

SEQ ID NO: 97718 - protein, 14 aa, Homo sapiens
  heavy chain complementarity determining region 3 for antibody 48859
AGIYGDFPDNWFDP

SEQ ID NO: 97719 - protein, 8 aa, Homo sapiens
  light chain complementarity determining region 3 for antibody 48860
QQRSDSST

SEQ ID NO: 97720 - protein, 14 aa, Homo sapiens
  heavy chain complementarity determining region 3 for antibody 48860
AGIYGDFPDNWFDP

SEQ ID NO: 97721 - protein, 10 aa, Homo sapiens
  light chain complementarity determining region 3 for antibody 48861
QQRSDRPPLT

SEQ ID NO: 97722 - protein, 10 aa, Homo sapiens
  heavy chain complementarity determining region 3 for antibody 48861
ARDYTMTFDY

SEQ ID NO: 97723 - protein, 8 aa, Homo sapiens
  light chain complementarity determining region 3 for antibody 48862
QQRSDLTT

SEQ ID NO: 97724 - protein, 18 aa, Homo sapiens
  heavy chain complementarity determining region 3 for antibody 48862
AKATARHCSGYNCYYFDY

SEQ ID NO: 97725 - protein, 10 aa, Homo sapiens
  light chain complementarity determining region 3 for antibody 48863
QQRSAWPLYT

SEQ ID NO: 97726 - protein, 14 aa, Homo sapiens
  heavy chain complementarity determining region 3 for antibody 48863
ARVFRFSSGWFFDY

SEQ ID NO: 97727 - protein, 9 aa, Homo sapiens
  light chain complementarity determining region 3 for antibody 48864
QQRSAAPVT

SEQ ID NO: 97728 - protein, 17 aa, Homo sapiens
  heavy chain complementarity determining region 3 for antibody 48864
ARPVLRGSYGGVDAFDL

SEQ ID NO: 97729 - protein, 8 aa, Homo sapiens
  light chain complementarity determining region 3 for antibody 48865
QQRRNWVT

SEQ ID NO: 97730 - protein, 21 aa, Homo sapiens
  heavy chain complementarity determining region 3 for antibody 48865
ARNDPDNKEVGETYHYNYFEQ

SEQ ID NO: 97731 - protein, 10 aa, Homo sapiens
  light chain complementarity determining region 3 for antibody 48866
QQRRNWPPYT

SEQ ID NO: 97732 - protein, 11 aa, Homo sapiens
  heavy chain complementarity determining region 3 for antibody 48866
ARGVGSYPFDS

SEQ ID NO: 97733 - protein, 10 aa, Homo sapiens
  light chain complementarity determining region 3 for antibody 48867
QQRRNWPPYT

SEQ ID NO: 97734 - protein, 13 aa, Homo sapiens
  heavy chain complementarity determining region 3 for antibody 48867
AREEVIGGSPFDF

SEQ ID NO: 97735 - protein, 10 aa, Homo sapiens
  light chain complementarity determining region 3 for antibody 48868
QQRRNWPPYT

SEQ ID NO: 97736 - protein, 16 aa, Homo sapiens
  heavy chain complementarity determining region 3 for antibody 48868
AAFSHLYDSAHMPFDY

SEQ ID NO: 97737 - protein, 10 aa, Homo sapiens
  light chain complementarity determining region 3 for antibody 48869
QQRRNWPPST

SEQ ID NO: 97738 - protein, 16 aa, Homo sapiens
  heavy chain complementarity determining region 3 for antibody 48869
ARISGGYNPVDDAFDI

SEQ ID NO: 97739 - protein, 9 aa, Homo sapiens
  light chain complementarity determining region 3 for antibody 48870
QQRRNWPLT

SEQ ID NO: 97740 - protein, 18 aa, Homo sapiens
  heavy chain complementarity determining region 3 for antibody 48870
ARTLNLLRGVTQYNWFGP

SEQ ID NO: 97741 - protein, 9 aa, Homo sapiens
  light chain complementarity determining region 3 for antibody 48871
QQRRNWPFT

SEQ ID NO: 97742 - protein, 16 aa, Homo sapiens
  heavy chain complementarity determining region 3 for antibody 48871
ARELARRNTYYHAFEI

SEQ ID NO: 97743 - protein, 8 aa, Homo sapiens
  light chain complementarity determining region 3 for antibody 48872
QQRRNSGT

SEQ ID NO: 97744 - protein, 16 aa, Homo sapiens
  heavy chain complementarity determining region 3 for antibody 48872
ATGVPAVAASRFYFDF

SEQ ID NO: 97745 - protein, 9 aa, Homo sapiens
  light chain complementarity determining region 3 for antibody 48873
QQRRDWPIT

SEQ ID NO: 97746 - protein, 15 aa, Homo sapiens
  heavy chain complementarity determining region 3 for antibody 48873
AREFPAPDVYHYFDC

SEQ ID NO: 97747 - protein, 11 aa, Homo sapiens
  light chain complementarity determining region 3 for antibody 48874
QQRQPRSNWPT

SEQ ID NO: 97748 - protein, 15 aa, Homo sapiens
  heavy chain complementarity determining region 3 for antibody 48874
ARGGYSSSWYYWFDP

SEQ ID NO: 97749 - protein, 11 aa, Homo sapiens
  light chain complementarity determining region 3 for antibody 48875
QQRQPRRNWLT

SEQ ID NO: 97750 - protein, 15 aa, Homo sapiens
  heavy chain complementarity determining region 3 for antibody 48875
ARGGYSSSWYYWFDP

SEQ ID NO: 97751 - protein, 11 aa, Homo sapiens
  light chain complementarity determining region 3 for antibody 48876
QQRQPRGNWLT

SEQ ID NO: 97752 - protein, 15 aa, Homo sapiens
  heavy chain complementarity determining region 3 for antibody 48876
ARGGYSSSWYYWFDP

SEQ ID NO: 97753 - protein, 11 aa, Homo sapiens
  light chain complementarity determining region 3 for antibody 48877
QQRQESTNWFN

SEQ ID NO: 97754 - protein, 15 aa, Homo sapiens
  heavy chain complementarity determining region 3 for antibody 48877
ARGGYSSNWYWWFDP

SEQ ID NO: 97755 - protein, 11 aa, Homo sapiens
  light chain complementarity determining region 3 for antibody 48878
QQRQESTKWLN

SEQ ID NO: 97756 - protein, 15 aa, Homo sapiens
  heavy chain complementarity determining region 3 for antibody 48878
ARGGYSSNWYWWFDP

SEQ ID NO: 97757 - protein, 11 aa, Homo sapiens
  light chain complementarity determining region 3 for antibody 48879
QQRQESPNWLT

SEQ ID NO: 97758 - protein, 15 aa, Homo sapiens
  heavy chain complementarity determining region 3 for antibody 48879
ARGGYSSNWYWWFDP

SEQ ID NO: 97759 - protein, 11 aa, Homo sapiens
  light chain complementarity determining region 3 for antibody 48880
QQRQASTNWLN

SEQ ID NO: 97760 - protein, 15 aa, Homo sapiens
  heavy chain complementarity determining region 3 for antibody 48880
ARGGYSSNWYWWFDP

SEQ ID NO: 97761 - protein, 10 aa, Homo sapiens
  light chain complementarity determining region 3 for antibody 48881
QQRNTWPPFT

SEQ ID NO: 97762 - protein, 21 aa, Homo sapiens
  heavy chain complementarity determining region 3 for antibody 48881
ARDLGLCYGSGSSYSYHGMDV

SEQ ID NO: 97763 - protein, 9 aa, Homo sapiens
  light chain complementarity determining region 3 for antibody 48882
QQRNSYSLT

SEQ ID NO: 97764 - protein, 16 aa, Homo sapiens
  heavy chain complementarity determining region 3 for antibody 48882
ARGHRGFGELSLSLDY

SEQ ID NO: 97765 - protein, 9 aa, Homo sapiens
  light chain complementarity determining region 3 for antibody 48883
QQRNSYPLT

SEQ ID NO: 97766 - protein, 17 aa, Homo sapiens
  heavy chain complementarity determining region 3 for antibody 48883
ARNYFGSGNYRLGAFDF

SEQ ID NO: 97767 - protein, 9 aa, Homo sapiens
  light chain complementarity determining region 3 for antibody 48884
QQRNSWPTT

SEQ ID NO: 97768 - protein, 14 aa, Homo sapiens
  heavy chain complementarity determining region 3 for antibody 48884
ARGPFSGSGVGFDF

SEQ ID NO: 97769 - protein, 9 aa, Homo sapiens
  light chain complementarity determining region 3 for antibody 48885
QQRNSWPTP

SEQ ID NO: 97770 - protein, 14 aa, Homo sapiens
  heavy chain complementarity determining region 3 for antibody 48885
ARDPFSGSGVGFDF

SEQ ID NO: 97771 - protein, 9 aa, Homo sapiens
  light chain complementarity determining region 3 for antibody 48886
QQRNNWRRT

SEQ ID NO: 97772 - protein, 17 aa, Homo sapiens
  heavy chain complementarity determining region 3 for antibody 48886
ARDPGLSTGWGSGAFDI

SEQ ID NO: 97773 - protein, 9 aa, Homo sapiens
  light chain complementarity determining region 3 for antibody 48887
QQRNNWRIT

SEQ ID NO: 97774 - protein, 12 aa, Homo sapiens
  heavy chain complementarity determining region 3 for antibody 48887
ARASESSGWYAH

SEQ ID NO: 97775 - protein, 9 aa, Homo sapiens
  light chain complementarity determining region 3 for antibody 48888
QQRNNWPPP

SEQ ID NO: 97776 - protein, 21 aa, Homo sapiens
  heavy chain complementarity determining region 3 for antibody 48888
AKSVGSGKDYYGSGRSDNYHI

SEQ ID NO: 97777 - protein, 9 aa, Homo sapiens
  light chain complementarity determining region 3 for antibody 48889
QQRNNWPLT

SEQ ID NO: 97778 - protein, 16 aa, Homo sapiens
  heavy chain complementarity determining region 3 for antibody 48889
AGTSISRAGPAQHFHY

SEQ ID NO: 97779 - protein, 9 aa, Homo sapiens
  light chain complementarity determining region 3 for antibody 48890
QQRNNWPLP

SEQ ID NO: 97780 - protein, 10 aa, Homo sapiens
  heavy chain complementarity determining region 3 for antibody 48890
ARDAGEPLDY

SEQ ID NO: 97781 - protein, 9 aa, Homo sapiens
  light chain complementarity determining region 3 for antibody 48891
QQRNNRPHT

SEQ ID NO: 97782 - protein, 12 aa, Homo sapiens
  heavy chain complementarity determining region 3 for antibody 48891
ARDLGVGKYFDH

SEQ ID NO: 97783 - protein, 9 aa, Homo sapiens
  light chain complementarity determining region 3 for antibody 48892
QQRNLWPIT

SEQ ID NO: 97784 - protein, 15 aa, Homo sapiens
  heavy chain complementarity determining region 3 for antibody 48892
AKARVAAAGTGALDL

SEQ ID NO: 97785 - protein, 9 aa, Homo sapiens
  light chain complementarity determining region 3 for antibody 48893
QQRNIWPPT

SEQ ID NO: 97786 - protein, 14 aa, Homo sapiens
  heavy chain complementarity determining region 3 for antibody 48893
ATGATGYQYYGLDA

SEQ ID NO: 97787 - protein, 9 aa, Homo sapiens
  light chain complementarity determining region 3 for antibody 48894
QQRNDWLTT

SEQ ID NO: 97788 - protein, 12 aa, Homo sapiens
  heavy chain complementarity determining region 3 for antibody 48894
ARTSLTGTALDY

SEQ ID NO: 97789 - protein, 9 aa, Homo sapiens
  light chain complementarity determining region 3 for antibody 48895
QQRKNWPWK

SEQ ID NO: 97790 - protein, 12 aa, Homo sapiens
  heavy chain complementarity determining region 3 for antibody 48895
ARVGGPRLPLDY

SEQ ID NO: 97791 - protein, 9 aa, Homo sapiens
  light chain complementarity determining region 3 for antibody 48896
QQRKNWPWA

SEQ ID NO: 97792 - protein, 12 aa, Homo sapiens
  heavy chain complementarity determining region 3 for antibody 48896
ARVGGPRLPLDY

SEQ ID NO: 97793 - protein, 11 aa, Homo sapiens
  light chain complementarity determining region 3 for antibody 48897
QQRKESTNWLN

SEQ ID NO: 97794 - protein, 15 aa, Homo sapiens
  heavy chain complementarity determining region 3 for antibody 48897
ARGGYSSNWYWWFDP

SEQ ID NO: 97795 - protein, 9 aa, Homo sapiens
  light chain complementarity determining region 3 for antibody 48898
QQRISWPLT

SEQ ID NO: 97796 - protein, 15 aa, Homo sapiens
  heavy chain complementarity determining region 3 for antibody 48898
TRAAVGIGSFGAFDI

SEQ ID NO: 97797 - protein, 8 aa, Homo sapiens
  light chain complementarity determining region 3 for antibody 48899
QQRINWLT

SEQ ID NO: 97798 - protein, 14 aa, Homo sapiens
  heavy chain complementarity determining region 3 for antibody 48899
ARVDIAATGAPFDP

SEQ ID NO: 97799 - protein, 9 aa, Homo sapiens
  light chain complementarity determining region 3 for antibody 48900
QQRHTWRYP

SEQ ID NO: 97800 - protein, 11 aa, Homo sapiens
  heavy chain complementarity determining region 3 for antibody 48900
AREAYGTTTDY

SEQ ID NO: 97801 - protein, 9 aa, Homo sapiens
  light chain complementarity determining region 3 for antibody 48901
QQRHTSPPT

SEQ ID NO: 97802 - protein, 15 aa, Homo sapiens
  heavy chain complementarity determining region 3 for antibody 48901
ARGSDLEDPPGAFDL

SEQ ID NO: 97803 - protein, 9 aa, Homo sapiens
  light chain complementarity determining region 3 for antibody 48902
QQRHSTPPA

SEQ ID NO: 97804 - protein, 17 aa, Homo sapiens
  heavy chain complementarity determining region 3 for antibody 48902
AKDTPEQQLVFEYAFDI

SEQ ID NO: 97805 - protein, 9 aa, Homo sapiens
  light chain complementarity determining region 3 for antibody 48903
QQRHSPPWT

SEQ ID NO: 97806 - protein, 13 aa, Homo sapiens
  heavy chain complementarity determining region 3 for antibody 48903
ARGVAAAGYQFDY

SEQ ID NO: 97807 - protein, 9 aa, Homo sapiens
  light chain complementarity determining region 3 for antibody 48904
QQRGTWPPL

SEQ ID NO: 97808 - protein, 18 aa, Homo sapiens
  heavy chain complementarity determining region 3 for antibody 48904
TQARLYGDYGTGGYYFDS

SEQ ID NO: 97809 - protein, 11 aa, Homo sapiens
  light chain complementarity determining region 3 for antibody 48905
QQRGNWPPRWT

SEQ ID NO: 97810 - protein, 10 aa, Homo sapiens
  heavy chain complementarity determining region 3 for antibody 48905
ARVNRFHFDF

SEQ ID NO: 97811 - protein, 10 aa, Homo sapiens
  light chain complementarity determining region 3 for antibody 48906
QQRGNWPPNT

SEQ ID NO: 97812 - protein, 12 aa, Homo sapiens
  heavy chain complementarity determining region 3 for antibody 48906
VKSGYSNGWYGH

SEQ ID NO: 97813 - protein, 11 aa, Homo sapiens
  light chain complementarity determining region 3 for antibody 48907
QQRGNWPPIFP

SEQ ID NO: 97814 - protein, 16 aa, Homo sapiens
  heavy chain complementarity determining region 3 for antibody 48907
ARGRLTSTGTWNFPDY

SEQ ID NO: 97815 - protein, 9 aa, Homo sapiens
  light chain complementarity determining region 3 for antibody 48908
QQRGNWPLT

SEQ ID NO: 97816 - protein, 12 aa, Homo sapiens
  heavy chain complementarity determining region 3 for antibody 48908
VRESGDHQEADY

SEQ ID NO: 97817 - protein, 9 aa, Homo sapiens
  light chain complementarity determining region 3 for antibody 48909
QQRGNWPLP

SEQ ID NO: 97818 - protein, 12 aa, Homo sapiens
  heavy chain complementarity determining region 3 for antibody 48909
ARRGAGGSYFEY

SEQ ID NO: 97819 - protein, 9 aa, Homo sapiens
  light chain complementarity determining region 3 for antibody 48910
QQRGNWPGT

SEQ ID NO: 97820 - protein, 16 aa, Homo sapiens
  heavy chain complementarity determining region 3 for antibody 48910
GRLYHYDSGSYSPSDY

SEQ ID NO: 97821 - protein, 10 aa, Homo sapiens
  light chain complementarity determining region 3 for antibody 48911
QQRGNWPEIT

SEQ ID NO: 97822 - protein, 14 aa, Homo sapiens
  heavy chain complementarity determining region 3 for antibody 48911
AKDHDSYVSGFGDV

SEQ ID NO: 97823 - protein, 10 aa, Homo sapiens
  light chain complementarity determining region 3 for antibody 48912
QQRGNSPPWT

SEQ ID NO: 97824 - protein, 12 aa, Homo sapiens
  heavy chain complementarity determining region 3 for antibody 48912
ARDHYARVAFDI

SEQ ID NO: 97825 - protein, 10 aa, Homo sapiens
  light chain complementarity determining region 3 for antibody 48913
QQRGIWPDMP

SEQ ID NO: 97826 - protein, 14 aa, Homo sapiens
  heavy chain complementarity determining region 3 for antibody 48913
AKDNDPYVSGFGDL

SEQ ID NO: 97827 - protein, 10 aa, Homo sapiens
  light chain complementarity determining region 3 for antibody 48914
QQRGIWPAMT

SEQ ID NO: 97828 - protein, 14 aa, Homo sapiens
  heavy chain complementarity determining region 3 for antibody 48914
AKDNDPYVSGFGDL

SEQ ID NO: 97829 - protein, 9 aa, Homo sapiens
  light chain complementarity determining region 3 for antibody 48915
QQRGDWPRT

SEQ ID NO: 97830 - protein, 17 aa, Homo sapiens
  heavy chain complementarity determining region 3 for antibody 48915
AIIPAAKAYYNSFDMDV

SEQ ID NO: 97831 - protein, 8 aa, Homo sapiens
  light chain complementarity determining region 3 for antibody 48916
QQRGDWPP

SEQ ID NO: 97832 - protein, 17 aa, Homo sapiens
  heavy chain complementarity determining region 3 for antibody 48916
ARDVGPRRRLLHNAFDI

SEQ ID NO: 97833 - protein, 9 aa, Homo sapiens
  light chain complementarity determining region 3 for antibody 48917
QQRFTNPPT

SEQ ID NO: 97834 - protein, 18 aa, Homo sapiens
  heavy chain complementarity determining region 3 for antibody 48917
AREKDVFVGYVSYNWFDP

SEQ ID NO: 97835 - protein, 9 aa, Homo sapiens
  light chain complementarity determining region 3 for antibody 48918
QQRFSTPWT

SEQ ID NO: 97836 - protein, 18 aa, Homo sapiens
  heavy chain complementarity determining region 3 for antibody 48918
ASSRLAGTTDSYYFGMDV

SEQ ID NO: 97837 - protein, 9 aa, Homo sapiens
  light chain complementarity determining region 3 for antibody 48919
QQRFSTPRT

SEQ ID NO: 97838 - protein, 17 aa, Homo sapiens
  heavy chain complementarity determining region 3 for antibody 48919
TTHLETNSGTYYHLLDY

SEQ ID NO: 97839 - protein, 9 aa, Homo sapiens
  light chain complementarity determining region 3 for antibody 48920
QQRFSTLYT

SEQ ID NO: 97840 - protein, 22 aa, Homo sapiens
  heavy chain complementarity determining region 3 for antibody 48920
ARDPYYYDDSSEVPKPEYYFDY

SEQ ID NO: 97841 - protein, 9 aa, Homo sapiens
  light chain complementarity determining region 3 for antibody 48921
QQRFSNPVT

SEQ ID NO: 97842 - protein, 18 aa, Homo sapiens
  heavy chain complementarity determining region 3 for antibody 48921
AREEDHYSSGTYYNIFDL

SEQ ID NO: 97843 - protein, 9 aa, Homo sapiens
  light chain complementarity determining region 3 for antibody 48922
QQRFSGPRT

SEQ ID NO: 97844 - protein, 21 aa, Homo sapiens
  heavy chain complementarity determining region 3 for antibody 48922
ARWGDCTGSNCYKYYYYGLDV

SEQ ID NO: 97845 - protein, 9 aa, Homo sapiens
  light chain complementarity determining region 3 for antibody 48923
QQRFRTPYT

SEQ ID NO: 97846 - protein, 14 aa, Homo sapiens
  heavy chain complementarity determining region 3 for antibody 48923
ARGGGRGYYSSVDD

SEQ ID NO: 97847 - protein, 9 aa, Homo sapiens
  light chain complementarity determining region 3 for antibody 48924
QQRFNTPFT

SEQ ID NO: 97848 - protein, 10 aa, Homo sapiens
  heavy chain complementarity determining region 3 for antibody 48924
ARDTDTAFGV

SEQ ID NO: 97849 - protein, 8 aa, Homo sapiens
  light chain complementarity determining region 3 for antibody 48925
QQRFDMRT

SEQ ID NO: 97850 - protein, 17 aa, Homo sapiens
  heavy chain complementarity determining region 3 for antibody 48925
ARDRDGAVTNHQYGMDV

SEQ ID NO: 97851 - protein, 9 aa, Homo sapiens
  light chain complementarity determining region 3 for antibody 48926
QQRFATPRS

SEQ ID NO: 97852 - protein, 12 aa, Homo sapiens
  heavy chain complementarity determining region 3 for antibody 48926
ARQEDIVAPFDY

SEQ ID NO: 97853 - protein, 9 aa, Homo sapiens
  light chain complementarity determining region 3 for antibody 48927
QQRDSTPYT

SEQ ID NO: 97854 - protein, 10 aa, Homo sapiens
  heavy chain complementarity determining region 3 for antibody 48927
ATEYSGGPDY

SEQ ID NO: 97855 - protein, 9 aa, Homo sapiens
  light chain complementarity determining region 3 for antibody 48928
QQRDSPPLT

SEQ ID NO: 97856 - protein, 14 aa, Homo sapiens
  heavy chain complementarity determining region 3 for antibody 48928
ARDSQWLVQYGMDV

SEQ ID NO: 97857 - protein, 9 aa, Homo sapiens
  light chain complementarity determining region 3 for antibody 48929
QQRDSIPRM

SEQ ID NO: 97858 - protein, 11 aa, Homo sapiens
  heavy chain complementarity determining region 3 for antibody 48929
TSAYLTVALDL

SEQ ID NO: 97859 - protein, 9 aa, Homo sapiens
  light chain complementarity determining region 3 for antibody 48930
QQRDNWPRT

SEQ ID NO: 97860 - protein, 11 aa, Homo sapiens
  heavy chain complementarity determining region 3 for antibody 48930
ARARGSGSYNY

SEQ ID NO: 97861 - protein, 9 aa, Homo sapiens
  light chain complementarity determining region 3 for antibody 48931
QQRDNWPRP

SEQ ID NO: 97862 - protein, 11 aa, Homo sapiens
  heavy chain complementarity determining region 3 for antibody 48931
ARARGSGSYNH

SEQ ID NO: 97863 - protein, 10 aa, Homo sapiens
  light chain complementarity determining region 3 for antibody 48932
QQRDNWPPRT

SEQ ID NO: 97864 - protein, 15 aa, Homo sapiens
  heavy chain complementarity determining region 3 for antibody 48932
ARDAPLGVGGRGFDI

SEQ ID NO: 97865 - protein, 9 aa, Homo sapiens
  light chain complementarity determining region 3 for antibody 48933
QQRDNWPDT

SEQ ID NO: 97866 - protein, 12 aa, Homo sapiens
  heavy chain complementarity determining region 3 for antibody 48933
VKRWGAAADIDS

SEQ ID NO: 97867 - protein, 9 aa, Homo sapiens
  light chain complementarity determining region 3 for antibody 48934
QQRDIVPVT

SEQ ID NO: 97868 - protein, 10 aa, Homo sapiens
  heavy chain complementarity determining region 3 for antibody 48934
ASGLGWESAY

SEQ ID NO: 97869 - protein, 9 aa, Homo sapiens
  light chain complementarity determining region 3 for antibody 48935
QQRATTPRT

SEQ ID NO: 97870 - protein, 15 aa, Homo sapiens
  heavy chain complementarity determining region 3 for antibody 48935
ARGKYFYSSADYFDH

SEQ ID NO: 97871 - protein, 10 aa, Homo sapiens
  light chain complementarity determining region 3 for antibody 48936
QQRASWPPPT

SEQ ID NO: 97872 - protein, 12 aa, Homo sapiens
  heavy chain complementarity determining region 3 for antibody 48936
TRAYPQYTVSIN

SEQ ID NO: 97873 - protein, 9 aa, Homo sapiens
  light chain complementarity determining region 3 for antibody 48937
QQRANWPLP

SEQ ID NO: 97874 - protein, 14 aa, Homo sapiens
  heavy chain complementarity determining region 3 for antibody 48937
ASSLWAAAVHYFDY

SEQ ID NO: 97875 - protein, 8 aa, Homo sapiens
  light chain complementarity determining region 3 for antibody 48938
QQRANWFT

SEQ ID NO: 97876 - protein, 19 aa, Homo sapiens
  heavy chain complementarity determining region 3 for antibody 48938
TRQGGYANIGYYYYYGMDV

SEQ ID NO: 97877 - protein, 9 aa, Homo sapiens
  light chain complementarity determining region 3 for antibody 48939
QQRANRPIT

SEQ ID NO: 97878 - protein, 20 aa, Homo sapiens
  heavy chain complementarity determining region 3 for antibody 48939
ARDRTRYCSSASCPGYAFDI

SEQ ID NO: 97879 - protein, 8 aa, Homo sapiens
  light chain complementarity determining region 3 for antibody 48940
QQRAHWVT

SEQ ID NO: 97880 - protein, 20 aa, Homo sapiens
  heavy chain complementarity determining region 3 for antibody 48940
AKEYVVGPSAVTGNWGIFDS

SEQ ID NO: 97881 - protein, 9 aa, Homo sapiens
  light chain complementarity determining region 3 for antibody 48941
QQPYTSRVT

SEQ ID NO: 97882 - protein, 15 aa, Homo sapiens
  heavy chain complementarity determining region 3 for antibody 48941
ARDSFDGSYSGSFDY

SEQ ID NO: 97883 - protein, 9 aa, Homo sapiens
  light chain complementarity determining region 3 for antibody 48942
QQPYEAPYS

SEQ ID NO: 97884 - protein, 14 aa, Homo sapiens
  heavy chain complementarity determining region 3 for antibody 48942
STGLGPFSNTWYDY

SEQ ID NO: 97885 - protein, 9 aa, Homo sapiens
  light chain complementarity determining region 3 for antibody 48943
QQPNSLPFT

SEQ ID NO: 97886 - protein, 14 aa, Homo sapiens
  heavy chain complementarity determining region 3 for antibody 48943
VTRGESSGHYYFDY

SEQ ID NO: 97887 - protein, 9 aa, Homo sapiens
  light chain complementarity determining region 3 for antibody 48944
QQPNSFSWT

SEQ ID NO: 97888 - protein, 17 aa, Homo sapiens
  heavy chain complementarity determining region 3 for antibody 48944
ARGEWRWAVVGEYGLDV

SEQ ID NO: 97889 - protein, 9 aa, Homo sapiens
  light chain complementarity determining region 3 for antibody 48945
QQNYSTLLT

SEQ ID NO: 97890 - protein, 14 aa, Homo sapiens
  heavy chain complementarity determining region 3 for antibody 48945
ASCSSTSCYRGFDS

SEQ ID NO: 97891 - protein, 9 aa, Homo sapiens
  light chain complementarity determining region 3 for antibody 48946
QQNYSSPYT

SEQ ID NO: 97892 - protein, 23 aa, Homo sapiens
  heavy chain complementarity determining region 3 for antibody 48946
ARGVTDCSGRNCYGGEVINAFDV

SEQ ID NO: 97893 - protein, 9 aa, Homo sapiens
  light chain complementarity determining region 3 for antibody 48947
QQNYSSPLT

SEQ ID NO: 97894 - protein, 16 aa, Homo sapiens
  heavy chain complementarity determining region 3 for antibody 48947
ATDLEARGYYQYFFGH

SEQ ID NO: 97895 - protein, 9 aa, Homo sapiens
  light chain complementarity determining region 3 for antibody 48948
QQNYSPPRT

SEQ ID NO: 97896 - protein, 10 aa, Homo sapiens
  heavy chain complementarity determining region 3 for antibody 48948
ARGQFYSFTD

SEQ ID NO: 97897 - protein, 9 aa, Homo sapiens
  light chain complementarity determining region 3 for antibody 48949
QQNYQTPGT

SEQ ID NO: 97898 - protein, 15 aa, Homo sapiens
  heavy chain complementarity determining region 3 for antibody 48949
VRSRPIFIGYFPFDF

SEQ ID NO: 97899 - protein, 9 aa, Homo sapiens
  light chain complementarity determining region 3 for antibody 48950
QQNYNITPT

SEQ ID NO: 97900 - protein, 14 aa, Homo sapiens
  heavy chain complementarity determining region 3 for antibody 48950
ARDRGDGSYYRFED

SEQ ID NO: 97901 - protein, 9 aa, Homo sapiens
  light chain complementarity determining region 3 for antibody 48951
QQNYNFPYT

SEQ ID NO: 97902 - protein, 11 aa, Homo sapiens
  heavy chain complementarity determining region 3 for antibody 48951
ARGLSPGLFDF

SEQ ID NO: 97903 - protein, 9 aa, Homo sapiens
  light chain complementarity determining region 3 for antibody 48952
QQNYITPLT

SEQ ID NO: 97904 - protein, 17 aa, Homo sapiens
  heavy chain complementarity determining region 3 for antibody 48952
ARDPGIAVAGLVPPIDY

SEQ ID NO: 97905 - protein, 9 aa, Homo sapiens
  light chain complementarity determining region 3 for antibody 48953
QQNYATPPT

SEQ ID NO: 97906 - protein, 16 aa, Homo sapiens
  heavy chain complementarity determining region 3 for antibody 48953
ARGFFDSGGYKNAFDL

SEQ ID NO: 97907 - protein, 9 aa, Homo sapiens
  light chain complementarity determining region 3 for antibody 48954
QQNVSPPYT

SEQ ID NO: 97908 - protein, 20 aa, Homo sapiens
  heavy chain complementarity determining region 3 for antibody 48954
ARDLDISVLPGVTDDDGFDI

SEQ ID NO: 97909 - protein, 9 aa, Homo sapiens
  light chain complementarity determining region 3 for antibody 48955
QQNVISPYT

SEQ ID NO: 97910 - protein, 14 aa, Homo sapiens
  heavy chain complementarity determining region 3 for antibody 48955
ARDPHAGSGSYFDY

SEQ ID NO: 97911 - protein, 9 aa, Homo sapiens
  light chain complementarity determining region 3 for antibody 48956
QQNSSSPRT

SEQ ID NO: 97912 - protein, 14 aa, Homo sapiens
  heavy chain complementarity determining region 3 for antibody 48956
ARDSFGPEVVVDDY

SEQ ID NO: 97913 - protein, 8 aa, Homo sapiens
  light chain complementarity determining region 3 for antibody 48957
QQNRSSFP

SEQ ID NO: 97914 - protein, 13 aa, Homo sapiens
  heavy chain complementarity determining region 3 for antibody 48957
ATESGWYQGAFDI

SEQ ID NO: 97915 - protein, 8 aa, Homo sapiens
  light chain complementarity determining region 3 for antibody 48958
QQNRDSFP

SEQ ID NO: 97916 - protein, 13 aa, Homo sapiens
  heavy chain complementarity determining region 3 for antibody 48958
ATESGSYQGAFDI

SEQ ID NO: 97917 - protein, 9 aa, Homo sapiens
  light chain complementarity determining region 3 for antibody 48959
QQNNTYSWT

SEQ ID NO: 97918 - protein, 14 aa, Homo sapiens
  heavy chain complementarity determining region 3 for antibody 48959
ARHWSDYSVPLISR

SEQ ID NO: 97919 - protein, 8 aa, Homo sapiens
  light chain complementarity determining region 3 for antibody 48960
QQNNSYWT

SEQ ID NO: 97920 - protein, 19 aa, Homo sapiens
  heavy chain complementarity determining region 3 for antibody 48960
AREAGYCSGDSCIQGWFDP

SEQ ID NO: 97921 - protein, 9 aa, Homo sapiens
  light chain complementarity determining region 3 for antibody 48961
QQNNSYVWT

SEQ ID NO: 97922 - protein, 16 aa, Homo sapiens
  heavy chain complementarity determining region 3 for antibody 48961
ARSIVGGTWYYYGMDV

SEQ ID NO: 97923 - protein, 9 aa, Homo sapiens
  light chain complementarity determining region 3 for antibody 48962
QQNNSYSGT

SEQ ID NO: 97924 - protein, 13 aa, Homo sapiens
  heavy chain complementarity determining region 3 for antibody 48962
ARLGGTYSDAFDV

SEQ ID NO: 97925 - protein, 9 aa, Homo sapiens
  light chain complementarity determining region 3 for antibody 48963
QQNNSYPWT

SEQ ID NO: 97926 - protein, 15 aa, Homo sapiens
  heavy chain complementarity determining region 3 for antibody 48963
SRAGSRLLRFHAFDI

SEQ ID NO: 97927 - protein, 9 aa, Homo sapiens
  light chain complementarity determining region 3 for antibody 48964
QQNNSYPPT

SEQ ID NO: 97928 - protein, 17 aa, Homo sapiens
  heavy chain complementarity determining region 3 for antibody 48964
AYGDRIPEGGTMWLHDY

SEQ ID NO: 97929 - protein, 9 aa, Homo sapiens
  light chain complementarity determining region 3 for antibody 48965
QQNNSYPLT

SEQ ID NO: 97930 - protein, 9 aa, Homo sapiens
  heavy chain complementarity determining region 3 for antibody 48965
ARGGNSWRY

SEQ ID NO: 97931 - protein, 9 aa, Homo sapiens
  light chain complementarity determining region 3 for antibody 48966
QQNNSYAYS

SEQ ID NO: 97932 - protein, 12 aa, Homo sapiens
  heavy chain complementarity determining region 3 for antibody 48966
AARYSGFDPFDY

SEQ ID NO: 97933 - protein, 8 aa, Homo sapiens
  light chain complementarity determining region 3 for antibody 48967
QQNNSYAT

SEQ ID NO: 97934 - protein, 13 aa, Homo sapiens
  heavy chain complementarity determining region 3 for antibody 48967
TTNFADSLDAFDL

SEQ ID NO: 97935 - protein, 8 aa, Homo sapiens
  light chain complementarity determining region 3 for antibody 48968
QQNNSQWT

SEQ ID NO: 97936 - protein, 17 aa, Homo sapiens
  heavy chain complementarity determining region 3 for antibody 48968
AKETYCSGTGCYGLFDP

SEQ ID NO: 97937 - protein, 9 aa, Homo sapiens
  light chain complementarity determining region 3 for antibody 48969
QQNNSPPRT

SEQ ID NO: 97938 - protein, 13 aa, Homo sapiens
  heavy chain complementarity determining region 3 for antibody 48969
VREDGGDHYGLDV

SEQ ID NO: 97939 - protein, 8 aa, Homo sapiens
  light chain complementarity determining region 3 for antibody 48970
QQNNSLYT

SEQ ID NO: 97940 - protein, 15 aa, Homo sapiens
  heavy chain complementarity determining region 3 for antibody 48970
ARDPDMDSGDSDFDY

SEQ ID NO: 97941 - protein, 9 aa, Homo sapiens
  light chain complementarity determining region 3 for antibody 48971
QQNNSHSWT

SEQ ID NO: 97942 - protein, 13 aa, Homo sapiens
  heavy chain complementarity determining region 3 for antibody 48971
ARMSFRYGYVLDY

SEQ ID NO: 97943 - protein, 11 aa, Homo sapiens
  light chain complementarity determining region 3 for antibody 48972
QQNNGYSPVFT

SEQ ID NO: 97944 - protein, 15 aa, Homo sapiens
  heavy chain complementarity determining region 3 for antibody 48972
ARERFCTSTNCPFDY

SEQ ID NO: 97945 - protein, 9 aa, Homo sapiens
  light chain complementarity determining region 3 for antibody 48973
QQNLNLPLT

SEQ ID NO: 97946 - protein, 13 aa, Homo sapiens
  heavy chain complementarity determining region 3 for antibody 48973
SRGEERNTGEMDL

SEQ ID NO: 97947 - protein, 9 aa, Homo sapiens
  light chain complementarity determining region 3 for antibody 48974
QQNKSYPPT

SEQ ID NO: 97948 - protein, 13 aa, Homo sapiens
  heavy chain complementarity determining region 3 for antibody 48974
ARSYSGSSVSHDY

SEQ ID NO: 97949 - protein, 8 aa, Homo sapiens
  light chain complementarity determining region 3 for antibody 48975
QQNIHWWT

SEQ ID NO: 97950 - protein, 11 aa, Homo sapiens
  heavy chain complementarity determining region 3 for antibody 48975
ARLSVVNYFDY

SEQ ID NO: 97951 - protein, 9 aa, Homo sapiens
  light chain complementarity determining region 3 for antibody 48976
QQNHSYSYT

SEQ ID NO: 97952 - protein, 12 aa, Homo sapiens
  heavy chain complementarity determining region 3 for antibody 48976
AKDDFERPHGTY

SEQ ID NO: 97953 - protein, 9 aa, Homo sapiens
  light chain complementarity determining region 3 for antibody 48977
QQNHSYPGT

SEQ ID NO: 97954 - protein, 15 aa, Homo sapiens
  heavy chain complementarity determining region 3 for antibody 48977
ARLSIAGAGFRWFDP

SEQ ID NO: 97955 - protein, 8 aa, Homo sapiens
  light chain complementarity determining region 3 for antibody 48978
QQNHRGFT

SEQ ID NO: 97956 - protein, 12 aa, Homo sapiens
  heavy chain complementarity determining region 3 for antibody 48978
ARDRVESIRFDH

SEQ ID NO: 97957 - protein, 8 aa, Homo sapiens
  light chain complementarity determining region 3 for antibody 48979
QQNHNLLS

SEQ ID NO: 97958 - protein, 17 aa, Homo sapiens
  heavy chain complementarity determining region 3 for antibody 48979
TRVGRYYDRSGYEYFQH

SEQ ID NO: 97959 - protein, 9 aa, Homo sapiens
  light chain complementarity determining region 3 for antibody 48980
QQNGTSPWA

SEQ ID NO: 97960 - protein, 22 aa, Homo sapiens
  heavy chain complementarity determining region 3 for antibody 48980
TRVSIGIYDTVNGYYHPGPMDS

SEQ ID NO: 97961 - protein, 8 aa, Homo sapiens
  light chain complementarity determining region 3 for antibody 48981
QQNGSSRN

SEQ ID NO: 97962 - protein, 21 aa, Homo sapiens
  heavy chain complementarity determining region 3 for antibody 48981
ARWKGQVSSDWDRDFYPPVDY

SEQ ID NO: 97963 - protein, 9 aa, Homo sapiens
  light chain complementarity determining region 3 for antibody 48982
QQNGSSQWT

SEQ ID NO: 97964 - protein, 12 aa, Homo sapiens
  heavy chain complementarity determining region 3 for antibody 48982
SRGRGSGFYFGY

SEQ ID NO: 97965 - protein, 8 aa, Homo sapiens
  light chain complementarity determining region 3 for antibody 48983
QQNGSSPT

SEQ ID NO: 97966 - protein, 14 aa, Homo sapiens
  heavy chain complementarity determining region 3 for antibody 48983
ARGAGRSSSLPFDY

SEQ ID NO: 97967 - protein, 9 aa, Homo sapiens
  light chain complementarity determining region 3 for antibody 48984
QQNGSSPRT

SEQ ID NO: 97968 - protein, 17 aa, Homo sapiens
  heavy chain complementarity determining region 3 for antibody 48984
ARDRGGPIAVADDVFDI

SEQ ID NO: 97969 - protein, 9 aa, Homo sapiens
  light chain complementarity determining region 3 for antibody 48985
QQNGSSPLT

SEQ ID NO: 97970 - protein, 16 aa, Homo sapiens
  heavy chain complementarity determining region 3 for antibody 48985
AKPHSSGYYVKDAFDI

SEQ ID NO: 97971 - protein, 9 aa, Homo sapiens
  light chain complementarity determining region 3 for antibody 48986
QQNGSSPHT

SEQ ID NO: 97972 - protein, 13 aa, Homo sapiens
  heavy chain complementarity determining region 3 for antibody 48986
ASHRGYHFGYLDY

SEQ ID NO: 97973 - protein, 9 aa, Homo sapiens
  light chain complementarity determining region 3 for antibody 48987
QQNGSSPET

SEQ ID NO: 97974 - protein, 25 aa, Homo sapiens
  heavy chain complementarity determining region 3 for antibody 48987
AREGGTFYFDTSGRLYDTTFYGMDV

SEQ ID NO: 97975 - protein, 9 aa, Homo sapiens
  light chain complementarity determining region 3 for antibody 48988
QQNGSSLWT

SEQ ID NO: 97976 - protein, 13 aa, Homo sapiens
  heavy chain complementarity determining region 3 for antibody 48988
ARDDLLADNGFDY

SEQ ID NO: 97977 - protein, 9 aa, Homo sapiens
  light chain complementarity determining region 3 for antibody 48989
QQNGSSLFT

SEQ ID NO: 97978 - protein, 19 aa, Homo sapiens
  heavy chain complementarity determining region 3 for antibody 48989
ATGLGESGDYEGRGYTRDY

SEQ ID NO: 97979 - protein, 8 aa, Homo sapiens
  light chain complementarity determining region 3 for antibody 48990
QQNGSSIT

SEQ ID NO: 97980 - protein, 14 aa, Homo sapiens
  heavy chain complementarity determining region 3 for antibody 48990
ARDPFVGIPDYFDY

SEQ ID NO: 97981 - protein, 9 aa, Homo sapiens
  light chain complementarity determining region 3 for antibody 48991
QQNGSPPYT

SEQ ID NO: 97982 - protein, 12 aa, Homo sapiens
  heavy chain complementarity determining region 3 for antibody 48991
ATAPWGYGYSMG

SEQ ID NO: 97983 - protein, 9 aa, Homo sapiens
  light chain complementarity determining region 3 for antibody 48992
QQNGSPLYT

SEQ ID NO: 97984 - protein, 17 aa, Homo sapiens
  heavy chain complementarity determining region 3 for antibody 48992
AKVLWSGDALHIGPFDF

SEQ ID NO: 97985 - protein, 9 aa, Homo sapiens
  light chain complementarity determining region 3 for antibody 48993
QQNGRSPQT

SEQ ID NO: 97986 - protein, 16 aa, Homo sapiens
  heavy chain complementarity determining region 3 for antibody 48993
ARGSPTVEDFSWPSDL

SEQ ID NO: 97987 - protein, 9 aa, Homo sapiens
  light chain complementarity determining region 3 for antibody 48994
QQNGNSRIT

SEQ ID NO: 97988 - protein, 9 aa, Homo sapiens
  heavy chain complementarity determining region 3 for antibody 48994
ARGNWNYGY

SEQ ID NO: 97989 - protein, 6 aa, Homo sapiens
  light chain complementarity determining region 3 for antibody 48995
QQNGMS

SEQ ID NO: 97990 - protein, 12 aa, Homo sapiens
  heavy chain complementarity determining region 3 for antibody 48995
ARLANSWYPYDY

SEQ ID NO: 97991 - protein, 9 aa, Homo sapiens
  light chain complementarity determining region 3 for antibody 48996
QQNGKAPLP

SEQ ID NO: 97992 - protein, 15 aa, Homo sapiens
  heavy chain complementarity determining region 3 for antibody 48996
LRESSLHYDSGILDY

SEQ ID NO: 97993 - protein, 9 aa, Homo sapiens
  light chain complementarity determining region 3 for antibody 48997
QQNGISPYT

SEQ ID NO: 97994 - protein, 13 aa, Homo sapiens
  heavy chain complementarity determining region 3 for antibody 48997
TTYWTTVLRVGGP

SEQ ID NO: 97995 - protein, 9 aa, Homo sapiens
  light chain complementarity determining region 3 for antibody 48998
QQNGDSPLS

SEQ ID NO: 97996 - protein, 20 aa, Homo sapiens
  heavy chain complementarity determining region 3 for antibody 48998
ARTEMFYNHLTGYSTGAFDI

SEQ ID NO: 97997 - protein, 10 aa, Homo sapiens
  light chain complementarity determining region 3 for antibody 48999
QQNDVWPPWT

SEQ ID NO: 97998 - protein, 17 aa, Homo sapiens
  heavy chain complementarity determining region 3 for antibody 48999
ARGQGFPDLGIYWYFDL

SEQ ID NO: 97999 - protein, 10 aa, Homo sapiens
  light chain complementarity determining region 3 for antibody 49000
QQNDVLRGYT

SEQ ID NO: 98000 - protein, 11 aa, Homo sapiens
  heavy chain complementarity determining region 3 for antibody 49000
AAVTMHDAFDL

SEQ ID NO: 98001 - protein, 9 aa, Homo sapiens
  light chain complementarity determining region 3 for antibody 49001
QQNDTYSYT

SEQ ID NO: 98002 - protein, 6 aa, Homo sapiens
  heavy chain complementarity determining region 3 for antibody 49001
GVWDNY

SEQ ID NO: 98003 - protein, 9 aa, Homo sapiens
  light chain complementarity determining region 3 for antibody 49002
QQNDTFPWT

SEQ ID NO: 98004 - protein, 11 aa, Homo sapiens
  heavy chain complementarity determining region 3 for antibody 49002
ARVMRGRTIDH

SEQ ID NO: 98005 - protein, 9 aa, Homo sapiens
  light chain complementarity determining region 3 for antibody 49003
QQNDNYPWT

SEQ ID NO: 98006 - protein, 11 aa, Homo sapiens
  heavy chain complementarity determining region 3 for antibody 49003
AHRTLTHGMDV

SEQ ID NO: 98007 - protein, 10 aa, Homo sapiens
  light chain complementarity determining region 3 for antibody 49004
QQNDNWPPYT

SEQ ID NO: 98008 - protein, 17 aa, Homo sapiens
  heavy chain complementarity determining region 3 for antibody 49004
AVVYYYVSSGSNSAFDI

SEQ ID NO: 98009 - protein, 9 aa, Homo sapiens
  light chain complementarity determining region 3 for antibody 49005
QQNDNVTFT

SEQ ID NO: 98010 - protein, 6 aa, Homo sapiens
  heavy chain complementarity determining region 3 for antibody 49005
VSLMFA

SEQ ID NO: 98011 - protein, 9 aa, Homo sapiens
  light chain complementarity determining region 3 for antibody 49006
QQNDNVPYT

SEQ ID NO: 98012 - protein, 18 aa, Homo sapiens
  heavy chain complementarity determining region 3 for antibody 49006
AKDIVLERTVGVSEKLDS

SEQ ID NO: 98013 - protein, 9 aa, Homo sapiens
  light chain complementarity determining region 3 for antibody 49007
QQNDNLSLT

SEQ ID NO: 98014 - protein, 21 aa, Homo sapiens
  heavy chain complementarity determining region 3 for antibody 49007
AHCRDSPGSGSIWHIVEAFDI

SEQ ID NO: 98015 - protein, 9 aa, Homo sapiens
  light chain complementarity determining region 3 for antibody 49008
QQNDNLPYT

SEQ ID NO: 98016 - protein, 16 aa, Homo sapiens
  heavy chain complementarity determining region 3 for antibody 49008
ARASVDTALERGCFDI

SEQ ID NO: 98017 - protein, 9 aa, Homo sapiens
  light chain complementarity determining region 3 for antibody 49009
QQNDNLPLT

SEQ ID NO: 98018 - protein, 17 aa, Homo sapiens
  heavy chain complementarity determining region 3 for antibody 49009
ARDQRAAARYRRSWFDP

SEQ ID NO: 98019 - protein, 9 aa, Homo sapiens
  light chain complementarity determining region 3 for antibody 49010
QQNDNLPLT

SEQ ID NO: 98020 - protein, 15 aa, Homo sapiens
  heavy chain complementarity determining region 3 for antibody 49010
ARAYSSGWYADYFDC

SEQ ID NO: 98021 - protein, 9 aa, Homo sapiens
  light chain complementarity determining region 3 for antibody 49011
QQNDNLPLT

SEQ ID NO: 98022 - protein, 13 aa, Homo sapiens
  heavy chain complementarity determining region 3 for antibody 49011
AKWIPGGQGYFEH

SEQ ID NO: 98023 - protein, 9 aa, Homo sapiens
  light chain complementarity determining region 3 for antibody 49012
QQNDNLPIT

SEQ ID NO: 98024 - protein, 15 aa, Homo sapiens
  heavy chain complementarity determining region 3 for antibody 49012
ASHVVYGGLLVWFDP

SEQ ID NO: 98025 - protein, 9 aa, Homo sapiens
  light chain complementarity determining region 3 for antibody 49013
QQNDNFLVT

SEQ ID NO: 98026 - protein, 15 aa, Homo sapiens
  heavy chain complementarity determining region 3 for antibody 49013
ARGGVYRSGWYGFDF

SEQ ID NO: 98027 - protein, 8 aa, Homo sapiens
  light chain complementarity determining region 3 for antibody 49014
QQNDGAPT

SEQ ID NO: 98028 - protein, 14 aa, Homo sapiens
  heavy chain complementarity determining region 3 for antibody 49014
ARRDCSGDYCYLDY

SEQ ID NO: 98029 - protein, 9 aa, Homo sapiens
  light chain complementarity determining region 3 for antibody 49015
QQNDDLPYT

SEQ ID NO: 98030 - protein, 12 aa, Homo sapiens
  heavy chain complementarity determining region 3 for antibody 49015
GRDGAGRRRIDA

SEQ ID NO: 98031 - protein, 9 aa, Homo sapiens
  light chain complementarity determining region 3 for antibody 49016
QQNDDLPLT

SEQ ID NO: 98032 - protein, 23 aa, Homo sapiens
  heavy chain complementarity determining region 3 for antibody 49016
AGGQEIYSSGWYAKQWFYHGFDV

SEQ ID NO: 98033 - protein, 10 aa, Homo sapiens
  light chain complementarity determining region 3 for antibody 49017
QQNDDLFPVI

SEQ ID NO: 98034 - protein, 13 aa, Homo sapiens
  heavy chain complementarity determining region 3 for antibody 49017
VRDWAWGSGTGDY

SEQ ID NO: 98035 - protein, 9 aa, Homo sapiens
  light chain complementarity determining region 3 for antibody 49018
QQNDDFSLT

SEQ ID NO: 98036 - protein, 17 aa, Homo sapiens
  heavy chain complementarity determining region 3 for antibody 49018
ARHYNYDSSSYYVGFNY

SEQ ID NO: 98037 - protein, 9 aa, Homo sapiens
  light chain complementarity determining region 3 for antibody 49019
QQNDAYPRT

SEQ ID NO: 98038 - protein, 14 aa, Homo sapiens
  heavy chain complementarity determining region 3 for antibody 49019
ARGLAVASNTPGGY

SEQ ID NO: 98039 - protein, 9 aa, Homo sapiens
  light chain complementarity determining region 3 for antibody 49020
QQNCQTPGT

SEQ ID NO: 98040 - protein, 15 aa, Homo sapiens
  heavy chain complementarity determining region 3 for antibody 49020
VRSRPILIGYFPFDF

SEQ ID NO: 98041 - protein, 8 aa, Homo sapiens
  light chain complementarity determining region 3 for antibody 49021
QQNASSYT

SEQ ID NO: 98042 - protein, 19 aa, Homo sapiens
  heavy chain complementarity determining region 3 for antibody 49021
ARHDRNIPAISGTMGHFDY

SEQ ID NO: 98043 - protein, 9 aa, Homo sapiens
  light chain complementarity determining region 3 for antibody 49022
QQNADLPIT

SEQ ID NO: 98044 - protein, 15 aa, Homo sapiens
  heavy chain complementarity determining region 3 for antibody 49022
ARDPGRGGSGSKFDY

SEQ ID NO: 98045 - protein, 9 aa, Homo sapiens
  light chain complementarity determining region 3 for antibody 49023
QQLYKSPRT

SEQ ID NO: 98046 - protein, 14 aa, Homo sapiens
  heavy chain complementarity determining region 3 for antibody 49023
ARAAPEYEWLVPDY

SEQ ID NO: 98047 - protein, 9 aa, Homo sapiens
  light chain complementarity determining region 3 for antibody 49024
QQLYDYPPT

SEQ ID NO: 98048 - protein, 18 aa, Homo sapiens
  heavy chain complementarity determining region 3 for antibody 49024
ARDRDAAMASYYYYGMDV

SEQ ID NO: 98049 - protein, 9 aa, Homo sapiens
  light chain complementarity determining region 3 for antibody 49025
QQLTNYPFT

SEQ ID NO: 98050 - protein, 15 aa, Homo sapiens
  heavy chain complementarity determining region 3 for antibody 49025
ARDLGSGWRDNWFDL

SEQ ID NO: 98051 - protein, 9 aa, Homo sapiens
  light chain complementarity determining region 3 for antibody 49026
QQLRSYPVT

SEQ ID NO: 98052 - protein, 19 aa, Homo sapiens
  heavy chain complementarity determining region 3 for antibody 49026
AREEAAYISSWQSTSWYDY

SEQ ID NO: 98053 - protein, 9 aa, Homo sapiens
  light chain complementarity determining region 3 for antibody 49027
QQLNTYPRT

SEQ ID NO: 98054 - protein, 18 aa, Homo sapiens
  heavy chain complementarity determining region 3 for antibody 49027
ARGQLVVADWEFLYYFDN

SEQ ID NO: 98055 - protein, 9 aa, Homo sapiens
  light chain complementarity determining region 3 for antibody 49028
QQLNTYPRP

SEQ ID NO: 98056 - protein, 15 aa, Homo sapiens
  heavy chain complementarity determining region 3 for antibody 49028
AREHYDILTGSHIDF

SEQ ID NO: 98057 - protein, 9 aa, Homo sapiens
  light chain complementarity determining region 3 for antibody 49029
QQLNSYPSP

SEQ ID NO: 98058 - protein, 20 aa, Homo sapiens
  heavy chain complementarity determining region 3 for antibody 49029
ARDSGDGSGWYVPAAEYFQY

SEQ ID NO: 98059 - protein, 9 aa, Homo sapiens
  light chain complementarity determining region 3 for antibody 49030
QQLNSYPRT

SEQ ID NO: 98060 - protein, 32 aa, Homo sapiens
  heavy chain complementarity determining region 3 for antibody 49030
ARGRRRGVIDSAPNPYRSGWYRGDYYYYAMDV

SEQ ID NO: 98061 - protein, 9 aa, Homo sapiens
  light chain complementarity determining region 3 for antibody 49031
QQLNSYPRT

SEQ ID NO: 98062 - protein, 32 aa, Homo sapiens
  heavy chain complementarity determining region 3 for antibody 49031
AIGRRRGVIDSDPNPYRSGWYRGDYYYYAMDV

SEQ ID NO: 98063 - protein, 9 aa, Homo sapiens
  light chain complementarity determining region 3 for antibody 49032
QQLNSYPRP

SEQ ID NO: 98064 - protein, 11 aa, Homo sapiens
  heavy chain complementarity determining region 3 for antibody 49032
AKPVRGSSLDS

SEQ ID NO: 98065 - protein, 10 aa, Homo sapiens
  light chain complementarity determining region 3 for antibody 49033
QQLNSYPRIT

SEQ ID NO: 98066 - protein, 20 aa, Homo sapiens
  heavy chain complementarity determining region 3 for antibody 49033
ARLSPGDYDPRGYFYYGLDV

SEQ ID NO: 98067 - protein, 9 aa, Homo sapiens
  light chain complementarity determining region 3 for antibody 49034
QQLNSYPPT

SEQ ID NO: 98068 - protein, 12 aa, Homo sapiens
  heavy chain complementarity determining region 3 for antibody 49034
ASDSGIAGADDC

SEQ ID NO: 98069 - protein, 10 aa, Homo sapiens
  light chain complementarity determining region 3 for antibody 49035
QQLNSYPPFT

SEQ ID NO: 98070 - protein, 14 aa, Homo sapiens
  heavy chain complementarity determining region 3 for antibody 49035
AREAHDLWSGYLAY

SEQ ID NO: 98071 - protein, 9 aa, Homo sapiens
  light chain complementarity determining region 3 for antibody 49036
QQLNSYPLT

SEQ ID NO: 98072 - protein, 13 aa, Homo sapiens
  heavy chain complementarity determining region 3 for antibody 49036
ASDLATVVTRRYY

SEQ ID NO: 98073 - protein, 9 aa, Homo sapiens
  light chain complementarity determining region 3 for antibody 49037
QQLNSYPLT

SEQ ID NO: 98074 - protein, 12 aa, Homo sapiens
  heavy chain complementarity determining region 3 for antibody 49037
ARDVSAPAKTDY

SEQ ID NO: 98075 - protein, 9 aa, Homo sapiens
  light chain complementarity determining region 3 for antibody 49038
QQLNSYPIT

SEQ ID NO: 98076 - protein, 15 aa, Homo sapiens
  heavy chain complementarity determining region 3 for antibody 49038
ARTTGHPLETAYFDS

SEQ ID NO: 98077 - protein, 9 aa, Homo sapiens
  light chain complementarity determining region 3 for antibody 49039
QQLNSYPIT

SEQ ID NO: 98078 - protein, 13 aa, Homo sapiens
  heavy chain complementarity determining region 3 for antibody 49039
ARDLGTRGSFFDH

SEQ ID NO: 98079 - protein, 9 aa, Homo sapiens
  light chain complementarity determining region 3 for antibody 49040
QQLNSNLFT

SEQ ID NO: 98080 - protein, 18 aa, Homo sapiens
  heavy chain complementarity determining region 3 for antibody 49040
ARALSRAYCSSTVCPFDY

SEQ ID NO: 98081 - protein, 9 aa, Homo sapiens
  light chain complementarity determining region 3 for antibody 49041
QQLNSFPWT

SEQ ID NO: 98082 - protein, 15 aa, Homo sapiens
  heavy chain complementarity determining region 3 for antibody 49041
ARDKDSGSGRDAFDI

SEQ ID NO: 98083 - protein, 10 aa, Homo sapiens
  light chain complementarity determining region 3 for antibody 49042
QQLNSFPPRP

SEQ ID NO: 98084 - protein, 18 aa, Homo sapiens
  heavy chain complementarity determining region 3 for antibody 49042
ARRHYFDSGDYADDPFDH

SEQ ID NO: 98085 - protein, 9 aa, Homo sapiens
  light chain complementarity determining region 3 for antibody 49043
QQLNSFPLT

SEQ ID NO: 98086 - protein, 19 aa, Homo sapiens
  heavy chain complementarity determining region 3 for antibody 49043
ARGDFYYDSGSYYGGSFDH

SEQ ID NO: 98087 - protein, 9 aa, Homo sapiens
  light chain complementarity determining region 3 for antibody 49044
QQLNSFPFT

SEQ ID NO: 98088 - protein, 11 aa, Homo sapiens
  heavy chain complementarity determining region 3 for antibody 49044
GRHIVWSGMDV

SEQ ID NO: 98089 - protein, 9 aa, Homo sapiens
  light chain complementarity determining region 3 for antibody 49045
QQLNRYPRT

SEQ ID NO: 98090 - protein, 24 aa, Homo sapiens
  heavy chain complementarity determining region 3 for antibody 49045
ARGRTYYCDTCGYPLGYFYYGMDV

SEQ ID NO: 98091 - protein, 9 aa, Homo sapiens
  light chain complementarity determining region 3 for antibody 49046
QQLNRNPLT

SEQ ID NO: 98092 - protein, 16 aa, Homo sapiens
  heavy chain complementarity determining region 3 for antibody 49046
VRGWQVAIDISGYFDL

SEQ ID NO: 98093 - protein, 9 aa, Homo sapiens
  light chain complementarity determining region 3 for antibody 49047
QQLNNYPPT

SEQ ID NO: 98094 - protein, 16 aa, Homo sapiens
  heavy chain complementarity determining region 3 for antibody 49047
ARGPVGEPGGVWYFDL

SEQ ID NO: 98095 - protein, 9 aa, Homo sapiens
  light chain complementarity determining region 3 for antibody 49048
QQLNNYPGT

SEQ ID NO: 98096 - protein, 15 aa, Homo sapiens
  heavy chain complementarity determining region 3 for antibody 49048
VRLRGSSAFQRALDI

SEQ ID NO: 98097 - protein, 9 aa, Homo sapiens
  light chain complementarity determining region 3 for antibody 49049
QQLNNFPIT

SEQ ID NO: 98098 - protein, 14 aa, Homo sapiens
  heavy chain complementarity determining region 3 for antibody 49049
ARVSLVPGVIAFDY

SEQ ID NO: 98099 - protein, 10 aa, Homo sapiens
  light chain complementarity determining region 3 for antibody 49050
QQLNIYPPRT

SEQ ID NO: 98100 - protein, 19 aa, Homo sapiens
  heavy chain complementarity determining region 3 for antibody 49050
ARDVWPSYYYGSGRNAFDI

SEQ ID NO: 98101 - protein, 10 aa, Homo sapiens
  light chain complementarity determining region 3 for antibody 49051
QQLNGSPLFT

SEQ ID NO: 98102 - protein, 14 aa, Homo sapiens
  heavy chain complementarity determining region 3 for antibody 49051
ARLEIVEIPPGKNN

SEQ ID NO: 98103 - protein, 9 aa, Homo sapiens
  light chain complementarity determining region 3 for antibody 49052
QQLNEYPPP

SEQ ID NO: 98104 - protein, 15 aa, Homo sapiens
  heavy chain complementarity determining region 3 for antibody 49052
ARARVPDRMLYAFDI

SEQ ID NO: 98105 - protein, 9 aa, Homo sapiens
  light chain complementarity determining region 3 for antibody 49053
QQLNEYPLT

SEQ ID NO: 98106 - protein, 12 aa, Homo sapiens
  heavy chain complementarity determining region 3 for antibody 49053
ATEADRYGGNVN

SEQ ID NO: 98107 - protein, 9 aa, Homo sapiens
  light chain complementarity determining region 3 for antibody 49054
QQLKSYPRT

SEQ ID NO: 98108 - protein, 17 aa, Homo sapiens
  heavy chain complementarity determining region 3 for antibody 49054
ARDRDSRGWSPLGWFDP

SEQ ID NO: 98109 - protein, 9 aa, Homo sapiens
  light chain complementarity determining region 3 for antibody 49055
QQLKSYPRP

SEQ ID NO: 98110 - protein, 17 aa, Homo sapiens
  heavy chain complementarity determining region 3 for antibody 49055
ARDRDSTAWSPLGWFDP

SEQ ID NO: 98111 - protein, 9 aa, Homo sapiens
  light chain complementarity determining region 3 for antibody 49056
QQLKSYPPP

SEQ ID NO: 98112 - protein, 15 aa, Homo sapiens
  heavy chain complementarity determining region 3 for antibody 49056
AKGYSSGWYESHYDY

SEQ ID NO: 98113 - protein, 9 aa, Homo sapiens
  light chain complementarity determining region 3 for antibody 49057
QQLHNYPPT

SEQ ID NO: 98114 - protein, 12 aa, Homo sapiens
  heavy chain complementarity determining region 3 for antibody 49057
ARAGETKREFDH

SEQ ID NO: 98115 - protein, 9 aa, Homo sapiens
  light chain complementarity determining region 3 for antibody 49058
QQLHANPLT

SEQ ID NO: 98116 - protein, 14 aa, Homo sapiens
  heavy chain complementarity determining region 3 for antibody 49058
ARRRRFSGVYYFDL

SEQ ID NO: 98117 - protein, 8 aa, Homo sapiens
  light chain complementarity determining region 3 for antibody 49059
QQLESYST

SEQ ID NO: 98118 - protein, 16 aa, Homo sapiens
  heavy chain complementarity determining region 3 for antibody 49059
ARHKPWRQLATPLIDH

SEQ ID NO: 98119 - protein, 9 aa, Homo sapiens
  light chain complementarity determining region 3 for antibody 49060
QQLESYPRT

SEQ ID NO: 98120 - protein, 9 aa, Homo sapiens
  heavy chain complementarity determining region 3 for antibody 49060
AKGRSELDV

SEQ ID NO: 98121 - protein, 9 aa, Homo sapiens
  light chain complementarity determining region 3 for antibody 49061
QQLERSPGT

SEQ ID NO: 98122 - protein, 14 aa, Homo sapiens
  heavy chain complementarity determining region 3 for antibody 49061
ARAAPEYQWLVPED

SEQ ID NO: 98123 - protein, 9 aa, Homo sapiens
  light chain complementarity determining region 3 for antibody 49062
QQLDSYPFT

SEQ ID NO: 98124 - protein, 18 aa, Homo sapiens
  heavy chain complementarity determining region 3 for antibody 49062
ARERMVTAIPDDYYGMDV

SEQ ID NO: 98125 - protein, 10 aa, Homo sapiens
  light chain complementarity determining region 3 for antibody 49063
QQLDSSLPWP

SEQ ID NO: 98126 - protein, 13 aa, Homo sapiens
  heavy chain complementarity determining region 3 for antibody 49063
ARLIYVDYVFLDY

SEQ ID NO: 98127 - protein, 9 aa, Homo sapiens
  light chain complementarity determining region 3 for antibody 49064
QQLDRSPWT

SEQ ID NO: 98128 - protein, 14 aa, Homo sapiens
  heavy chain complementarity determining region 3 for antibody 49064
ARAAPEYQWLVPED

SEQ ID NO: 98129 - protein, 9 aa, Homo sapiens
  light chain complementarity determining region 3 for antibody 49065
QQLARSPWT

SEQ ID NO: 98130 - protein, 14 aa, Homo sapiens
  heavy chain complementarity determining region 3 for antibody 49065
ARAAPEYQWLVPED

SEQ ID NO: 98131 - protein, 9 aa, Homo sapiens
  light chain complementarity determining region 3 for antibody 49066
QQKSAAPGT

SEQ ID NO: 98132 - protein, 17 aa, Homo sapiens
  heavy chain complementarity determining region 3 for antibody 49066
ARPVLRGSYGGTDAFEL

SEQ ID NO: 98133 - protein, 9 aa, Homo sapiens
  light chain complementarity determining region 3 for antibody 49067
QQKSAAPAT

SEQ ID NO: 98134 - protein, 17 aa, Homo sapiens
  heavy chain complementarity determining region 3 for antibody 49067
ARPVLRGSYGGTDAFEL

SEQ ID NO: 98135 - protein, 9 aa, Homo sapiens
  light chain complementarity determining region 3 for antibody 49068
QQIYSAPFT

SEQ ID NO: 98136 - protein, 14 aa, Homo sapiens
  heavy chain complementarity determining region 3 for antibody 49068
ARWTLPRNSDAFDV

SEQ ID NO: 98137 - protein, 9 aa, Homo sapiens
  light chain complementarity determining region 3 for antibody 49069
QQINSYPLT

SEQ ID NO: 98138 - protein, 20 aa, Homo sapiens
  heavy chain complementarity determining region 3 for antibody 49069
AGSGSYGSGSYDFSPAWFDP

SEQ ID NO: 98139 - protein, 9 aa, Homo sapiens
  light chain complementarity determining region 3 for antibody 49070
QQIDTSPVT

SEQ ID NO: 98140 - protein, 14 aa, Homo sapiens
  heavy chain complementarity determining region 3 for antibody 49070
ARIPIKGRGLTTDS

SEQ ID NO: 98141 - protein, 8 aa, Homo sapiens
  light chain complementarity determining region 3 for antibody 49071
QQHYTFWT

SEQ ID NO: 98142 - protein, 11 aa, Homo sapiens
  heavy chain complementarity determining region 3 for antibody 49071
ARGVGSYPFDS

SEQ ID NO: 98143 - protein, 9 aa, Homo sapiens
  light chain complementarity determining region 3 for antibody 49072
QQHYSYPLT

SEQ ID NO: 98144 - protein, 14 aa, Homo sapiens
  heavy chain complementarity determining region 3 for antibody 49072
TRGRIDYGYSSFDY

SEQ ID NO: 98145 - protein, 10 aa, Homo sapiens
  light chain complementarity determining region 3 for antibody 49073
QQHYSSPPNT

SEQ ID NO: 98146 - protein, 12 aa, Homo sapiens
  heavy chain complementarity determining region 3 for antibody 49073
ARVGVTGYYLAY

SEQ ID NO: 98147 - protein, 9 aa, Homo sapiens
  light chain complementarity determining region 3 for antibody 49074
QQHYSPPVT

SEQ ID NO: 98148 - protein, 16 aa, Homo sapiens
  heavy chain complementarity determining region 3 for antibody 49074
ARLTESSGYHDEGSDI

SEQ ID NO: 98149 - protein, 10 aa, Homo sapiens
  light chain complementarity determining region 3 for antibody 49075
QQHYSFPPNT

SEQ ID NO: 98150 - protein, 12 aa, Homo sapiens
  heavy chain complementarity determining region 3 for antibody 49075
ARVGVTGYYLAY

SEQ ID NO: 98151 - protein, 8 aa, Homo sapiens
  light chain complementarity determining region 3 for antibody 49076
QQHVSSAS

SEQ ID NO: 98152 - protein, 13 aa, Homo sapiens
  heavy chain complementarity determining region 3 for antibody 49076
VRTWFGELSHFDF

SEQ ID NO: 98153 - protein, 9 aa, Homo sapiens
  light chain complementarity determining region 3 for antibody 49077
QQHSSYPTT

SEQ ID NO: 98154 - protein, 17 aa, Homo sapiens
  heavy chain complementarity determining region 3 for antibody 49077
ARLNRITTGDPHNWFDP

SEQ ID NO: 98155 - protein, 9 aa, Homo sapiens
  light chain complementarity determining region 3 for antibody 49078
QQHSSYPLT

SEQ ID NO: 98156 - protein, 17 aa, Homo sapiens
  heavy chain complementarity determining region 3 for antibody 49078
ARLNRITTGGPHNWFDP

SEQ ID NO: 98157 - protein, 10 aa, Homo sapiens
  light chain complementarity determining region 3 for antibody 49079
QQHSKWPPLT

SEQ ID NO: 98158 - protein, 9 aa, Homo sapiens
  heavy chain complementarity determining region 3 for antibody 49079
ARVDGYFDY

SEQ ID NO: 98159 - protein, 8 aa, Homo sapiens
  light chain complementarity determining region 3 for antibody 49080
QQHRSSFP

SEQ ID NO: 98160 - protein, 13 aa, Homo sapiens
  heavy chain complementarity determining region 3 for antibody 49080
ATESGWYQGAFDI

SEQ ID NO: 98161 - protein, 9 aa, Homo sapiens
  light chain complementarity determining region 3 for antibody 49081
QQHRASPWT

SEQ ID NO: 98162 - protein, 22 aa, Homo sapiens
  heavy chain complementarity determining region 3 for antibody 49081
ARTMPASRWGRSGGDWGAAFDV

SEQ ID NO: 98163 - protein, 9 aa, Homo sapiens
  light chain complementarity determining region 3 for antibody 49082
QQHNYYPFT

SEQ ID NO: 98164 - protein, 5 aa, Homo sapiens
  heavy chain complementarity determining region 3 for antibody 49082
ASGPD

SEQ ID NO: 98165 - protein, 8 aa, Homo sapiens
  light chain complementarity determining region 3 for antibody 49083
QQHNTYCT

SEQ ID NO: 98166 - protein, 21 aa, Homo sapiens
  heavy chain complementarity determining region 3 for antibody 49083
ARGKTQRILMGRGVIPYYFDY

SEQ ID NO: 98167 - protein, 8 aa, Homo sapiens
  light chain complementarity determining region 3 for antibody 49084
QQHNSYYT

SEQ ID NO: 98168 - protein, 7 aa, Homo sapiens
  heavy chain complementarity determining region 3 for antibody 49084
ATVDFFF

SEQ ID NO: 98169 - protein, 9 aa, Homo sapiens
  light chain complementarity determining region 3 for antibody 49085
QQHNSYSGT

SEQ ID NO: 98170 - protein, 13 aa, Homo sapiens
  heavy chain complementarity determining region 3 for antibody 49085
ARLGGTYSDAFDV

SEQ ID NO: 98171 - protein, 9 aa, Homo sapiens
  light chain complementarity determining region 3 for antibody 49086
QQHNSYLMP

SEQ ID NO: 98172 - protein, 19 aa, Homo sapiens
  heavy chain complementarity determining region 3 for antibody 49086
ARDSPRIAVMVLHNWYFDL

SEQ ID NO: 98173 - protein, 10 aa, Homo sapiens
  light chain complementarity determining region 3 for antibody 49087
QQHNSWPPLT

SEQ ID NO: 98174 - protein, 14 aa, Homo sapiens
  heavy chain complementarity determining region 3 for antibody 49087
ARSKWAAPGTPPEY

SEQ ID NO: 98175 - protein, 8 aa, Homo sapiens
  light chain complementarity determining region 3 for antibody 49088
QQHNNWPT

SEQ ID NO: 98176 - protein, 10 aa, Homo sapiens
  heavy chain complementarity determining region 3 for antibody 49088
AIFGVTGTGY

SEQ ID NO: 98177 - protein, 9 aa, Homo sapiens
  light chain complementarity determining region 3 for antibody 49089
QQHNNWPRT

SEQ ID NO: 98178 - protein, 16 aa, Homo sapiens
  heavy chain complementarity determining region 3 for antibody 49089
ARIETPAAQGPNSFDI

SEQ ID NO: 98179 - protein, 10 aa, Homo sapiens
  light chain complementarity determining region 3 for antibody 49090
QQHNNWPPLT

SEQ ID NO: 98180 - protein, 14 aa, Homo sapiens
  heavy chain complementarity determining region 3 for antibody 49090
ARSQWAAPGTPPAY

SEQ ID NO: 98181 - protein, 8 aa, Homo sapiens
  light chain complementarity determining region 3 for antibody 49091
QQHKSYSA

SEQ ID NO: 98182 - protein, 15 aa, Homo sapiens
  heavy chain complementarity determining region 3 for antibody 49091
ARGQNLVRMHDALDF

SEQ ID NO: 98183 - protein, 9 aa, Homo sapiens
  light chain complementarity determining region 3 for antibody 49092
QQHHSVPLT

SEQ ID NO: 98184 - protein, 15 aa, Homo sapiens
  heavy chain complementarity determining region 3 for antibody 49092
ASRRAHYDSSGYFDS

SEQ ID NO: 98185 - protein, 9 aa, Homo sapiens
  light chain complementarity determining region 3 for antibody 49093
QQHGSSPRT

SEQ ID NO: 98186 - protein, 13 aa, Homo sapiens
  heavy chain complementarity determining region 3 for antibody 49093
ARTGRVAGVEGAH

SEQ ID NO: 98187 - protein, 9 aa, Homo sapiens
  light chain complementarity determining region 3 for antibody 49094
QQHGSSPRT

SEQ ID NO: 98188 - protein, 15 aa, Homo sapiens
  heavy chain complementarity determining region 3 for antibody 49094
ARDNYEGSYYGPFDY

SEQ ID NO: 98189 - protein, 10 aa, Homo sapiens
  light chain complementarity determining region 3 for antibody 49095
QQHGSSPQWT

SEQ ID NO: 98190 - protein, 9 aa, Homo sapiens
  heavy chain complementarity determining region 3 for antibody 49095
ARGEYSATH

SEQ ID NO: 98191 - protein, 10 aa, Homo sapiens
  light chain complementarity determining region 3 for antibody 49096
QQHGSSPKRT

SEQ ID NO: 98192 - protein, 9 aa, Homo sapiens
  heavy chain complementarity determining region 3 for antibody 49096
ARGEYSSTH

SEQ ID NO: 98193 - protein, 10 aa, Homo sapiens
  light chain complementarity determining region 3 for antibody 49097
QQHGSSPKGT

SEQ ID NO: 98194 - protein, 9 aa, Homo sapiens
  heavy chain complementarity determining region 3 for antibody 49097
ARGEYSSAH

SEQ ID NO: 98195 - protein, 10 aa, Homo sapiens
  light chain complementarity determining region 3 for antibody 49098
QQHGSSPKGT

SEQ ID NO: 98196 - protein, 9 aa, Homo sapiens
  heavy chain complementarity determining region 3 for antibody 49098
ARGEYSATH

SEQ ID NO: 98197 - protein, 9 aa, Homo sapiens
  light chain complementarity determining region 3 for antibody 49099
QQHGSSPIT

SEQ ID NO: 98198 - protein, 13 aa, Homo sapiens
  heavy chain complementarity determining region 3 for antibody 49099
ARTQLWLGWYFDF

SEQ ID NO: 98199 - protein, 9 aa, Homo sapiens
  light chain complementarity determining region 3 for antibody 49100
QQHGSSPFT

SEQ ID NO: 98200 - protein, 12 aa, Homo sapiens
  heavy chain complementarity determining region 3 for antibody 49100
ARMLGFGSGLAY

SEQ ID NO: 98201 - protein, 8 aa, Homo sapiens
  light chain complementarity determining region 3 for antibody 49101
QQHGSSIT

SEQ ID NO: 98202 - protein, 14 aa, Homo sapiens
  heavy chain complementarity determining region 3 for antibody 49101
ARDPFVGIPDDFDY

SEQ ID NO: 98203 - protein, 10 aa, Homo sapiens
  light chain complementarity determining region 3 for antibody 49102
QQHGGSPLVT

SEQ ID NO: 98204 - protein, 14 aa, Homo sapiens
  heavy chain complementarity determining region 3 for antibody 49102
ARDPIQGRPDYFDY

SEQ ID NO: 98205 - protein, 10 aa, Homo sapiens
  light chain complementarity determining region 3 for antibody 49103
QQHGGSPLFS

SEQ ID NO: 98206 - protein, 12 aa, Homo sapiens
  heavy chain complementarity determining region 3 for antibody 49103
ARGDRDYDAFDV

SEQ ID NO: 98207 - protein, 9 aa, Homo sapiens
  light chain complementarity determining region 3 for antibody 49104
QQHFTSPWA

SEQ ID NO: 98208 - protein, 15 aa, Homo sapiens
  heavy chain complementarity determining region 3 for antibody 49104
ARLRRDPMIVVGFDS

SEQ ID NO: 98209 - protein, 9 aa, Homo sapiens
  light chain complementarity determining region 3 for antibody 49105
QQHETPPWT

SEQ ID NO: 98210 - protein, 17 aa, Homo sapiens
  heavy chain complementarity determining region 3 for antibody 49105
AREVRYCSRTSCSRYDL

SEQ ID NO: 98211 - protein, 9 aa, Homo sapiens
  light chain complementarity determining region 3 for antibody 49106
QQHENLPIT

SEQ ID NO: 98212 - protein, 12 aa, Homo sapiens
  heavy chain complementarity determining region 3 for antibody 49106
TTFYPGAGYFHH

SEQ ID NO: 98213 - protein, 9 aa, Homo sapiens
  light chain complementarity determining region 3 for antibody 49107
QQHDSYPYT

SEQ ID NO: 98214 - protein, 18 aa, Homo sapiens
  heavy chain complementarity determining region 3 for antibody 49107
AREAKFDSSDFQTDASDI

SEQ ID NO: 98215 - protein, 9 aa, Homo sapiens
  light chain complementarity determining region 3 for antibody 49108
QQHDRSALT

SEQ ID NO: 98216 - protein, 15 aa, Homo sapiens
  heavy chain complementarity determining region 3 for antibody 49108
ARSRGHLVATIFPEY

SEQ ID NO: 98217 - protein, 9 aa, Homo sapiens
  light chain complementarity determining region 3 for antibody 49109
QQHDRSALS

SEQ ID NO: 98218 - protein, 15 aa, Homo sapiens
  heavy chain complementarity determining region 3 for antibody 49109
ARSRGHIVATISPQH

SEQ ID NO: 98219 - protein, 9 aa, Homo sapiens
  light chain complementarity determining region 3 for antibody 49110
QQHDNLQLT

SEQ ID NO: 98220 - protein, 19 aa, Homo sapiens
  heavy chain complementarity determining region 3 for antibody 49110
ARHLLRGIAADGPKGWFDP

SEQ ID NO: 98221 - protein, 9 aa, Homo sapiens
  light chain complementarity determining region 3 for antibody 49111
QQHDNLPLT

SEQ ID NO: 98222 - protein, 14 aa, Homo sapiens
  heavy chain complementarity determining region 3 for antibody 49111
ARDAGTSGWYGADY

SEQ ID NO: 98223 - protein, 9 aa, Homo sapiens
  light chain complementarity determining region 3 for antibody 49112
QQHDIFPLT

SEQ ID NO: 98224 - protein, 12 aa, Homo sapiens
  heavy chain complementarity determining region 3 for antibody 49112
TTDRSYGYYSPH

SEQ ID NO: 98225 - protein, 8 aa, Homo sapiens
  light chain complementarity determining region 3 for antibody 49113
QQHDHLCT

SEQ ID NO: 98226 - protein, 10 aa, Homo sapiens
  heavy chain complementarity determining region 3 for antibody 49113
TWVGVSWFAS

SEQ ID NO: 98227 - protein, 9 aa, Homo sapiens
  light chain complementarity determining region 3 for antibody 49114
QQHDDSPLT

SEQ ID NO: 98228 - protein, 12 aa, Homo sapiens
  heavy chain complementarity determining region 3 for antibody 49114
ASGSKGFGESHY

SEQ ID NO: 98229 - protein, 9 aa, Homo sapiens
  light chain complementarity determining region 3 for antibody 49115
QQHATSPRT

SEQ ID NO: 98230 - protein, 6 aa, Homo sapiens
  heavy chain complementarity determining region 3 for antibody 49115
ASVRWG

SEQ ID NO: 98231 - protein, 9 aa, Homo sapiens
  light chain complementarity determining region 3 for antibody 49116
QQHATPQWT

SEQ ID NO: 98232 - protein, 6 aa, Homo sapiens
  heavy chain complementarity determining region 3 for antibody 49116
ASVRWG

SEQ ID NO: 98233 - protein, 9 aa, Homo sapiens
  light chain complementarity determining region 3 for antibody 49117
QQGYTTQFN

SEQ ID NO: 98234 - protein, 16 aa, Homo sapiens
  heavy chain complementarity determining region 3 for antibody 49117
ARGVRDSDRWLGELDS

SEQ ID NO: 98235 - protein, 9 aa, Homo sapiens
  light chain complementarity determining region 3 for antibody 49118
QQGYTPQFT

SEQ ID NO: 98236 - protein, 16 aa, Homo sapiens
  heavy chain complementarity determining region 3 for antibody 49118
ARGVRDSDRWLGELDS

SEQ ID NO: 98237 - protein, 9 aa, Homo sapiens
  light chain complementarity determining region 3 for antibody 49119
QQGYSTPYT

SEQ ID NO: 98238 - protein, 8 aa, Homo sapiens
  heavy chain complementarity determining region 3 for antibody 49119
ASFTMVRV

SEQ ID NO: 98239 - protein, 9 aa, Homo sapiens
  light chain complementarity determining region 3 for antibody 49120
QQGYSTPRT

SEQ ID NO: 98240 - protein, 9 aa, Homo sapiens
  heavy chain complementarity determining region 3 for antibody 49120
TTGGSRLGY

SEQ ID NO: 98241 - protein, 9 aa, Homo sapiens
  light chain complementarity determining region 3 for antibody 49121
QQGYSTPLT

SEQ ID NO: 98242 - protein, 16 aa, Homo sapiens
  heavy chain complementarity determining region 3 for antibody 49121
VRGLDTAMITAENFAF

SEQ ID NO: 98243 - protein, 9 aa, Homo sapiens
  light chain complementarity determining region 3 for antibody 49122
QQGYSTPLT

SEQ ID NO: 98244 - protein, 15 aa, Homo sapiens
  heavy chain complementarity determining region 3 for antibody 49122
ARAQVICGQLYYFDF

SEQ ID NO: 98245 - protein, 9 aa, Homo sapiens
  light chain complementarity determining region 3 for antibody 49123
QQGYSTPLT

SEQ ID NO: 98246 - protein, 17 aa, Homo sapiens
  heavy chain complementarity determining region 3 for antibody 49123
AKERYWGGPLGYYGMDV

SEQ ID NO: 98247 - protein, 9 aa, Homo sapiens
  light chain complementarity determining region 3 for antibody 49124
QQGYSTPLP

SEQ ID NO: 98248 - protein, 15 aa, Homo sapiens
  heavy chain complementarity determining region 3 for antibody 49124
ARAQVIWGQLYYFDY

SEQ ID NO: 98249 - protein, 9 aa, Homo sapiens
  light chain complementarity determining region 3 for antibody 49125
QQGYSTPHT

SEQ ID NO: 98250 - protein, 12 aa, Homo sapiens
  heavy chain complementarity determining region 3 for antibody 49125
ASRKYNSGLFDY

SEQ ID NO: 98251 - protein, 9 aa, Homo sapiens
  light chain complementarity determining region 3 for antibody 49126
QQGYSTPGT

SEQ ID NO: 98252 - protein, 21 aa, Homo sapiens
  heavy chain complementarity determining region 3 for antibody 49126
ARVNWGGYDRDPRQPYKWFDL

SEQ ID NO: 98253 - protein, 9 aa, Homo sapiens
  light chain complementarity determining region 3 for antibody 49127
QQGYSTPFT

SEQ ID NO: 98254 - protein, 13 aa, Homo sapiens
  heavy chain complementarity determining region 3 for antibody 49127
ARRYSASRWAFDI

SEQ ID NO: 98255 - protein, 9 aa, Homo sapiens
  light chain complementarity determining region 3 for antibody 49128
QQGYSTPFT

SEQ ID NO: 98256 - protein, 15 aa, Homo sapiens
  heavy chain complementarity determining region 3 for antibody 49128
ARDLGDDFFHYGMDV

SEQ ID NO: 98257 - protein, 9 aa, Homo sapiens
  light chain complementarity determining region 3 for antibody 49129
QQGYSTPFT

SEQ ID NO: 98258 - protein, 15 aa, Homo sapiens
  heavy chain complementarity determining region 3 for antibody 49129
ARARVIWGQLYYFDS

SEQ ID NO: 98259 - protein, 9 aa, Homo sapiens
  light chain complementarity determining region 3 for antibody 49130
QQGYSTPFT

SEQ ID NO: 98260 - protein, 15 aa, Homo sapiens
  heavy chain complementarity determining region 3 for antibody 49130
ARAQVIWGQLYSFDS

SEQ ID NO: 98261 - protein, 9 aa, Homo sapiens
  light chain complementarity determining region 3 for antibody 49131
QQGYSTPFT

SEQ ID NO: 98262 - protein, 15 aa, Homo sapiens
  heavy chain complementarity determining region 3 for antibody 49131
ARAQVIWGHLYYFDS

SEQ ID NO: 98263 - protein, 9 aa, Homo sapiens
  light chain complementarity determining region 3 for antibody 49132
QQGYSTPFT

SEQ ID NO: 98264 - protein, 15 aa, Homo sapiens
  heavy chain complementarity determining region 3 for antibody 49132
AKSQIIWGHLYYFDS

SEQ ID NO: 98265 - protein, 9 aa, Homo sapiens
  light chain complementarity determining region 3 for antibody 49133
QQGYSSPFT

SEQ ID NO: 98266 - protein, 15 aa, Homo sapiens
  heavy chain complementarity determining region 3 for antibody 49133
TKAQVIWGQLYYFES

SEQ ID NO: 98267 - protein, 9 aa, Homo sapiens
  light chain complementarity determining region 3 for antibody 49134
QQGYSSPFI

SEQ ID NO: 98268 - protein, 15 aa, Homo sapiens
  heavy chain complementarity determining region 3 for antibody 49134
ARAQVIWGQLYYFDS

SEQ ID NO: 98269 - protein, 9 aa, Homo sapiens
  light chain complementarity determining region 3 for antibody 49135
QQGYSPPFI

SEQ ID NO: 98270 - protein, 15 aa, Homo sapiens
  heavy chain complementarity determining region 3 for antibody 49135
ARAQVIWGQLYSFDS

SEQ ID NO: 98271 - protein, 9 aa, Homo sapiens
  light chain complementarity determining region 3 for antibody 49136
QQGYSPPFF

SEQ ID NO: 98272 - protein, 15 aa, Homo sapiens
  heavy chain complementarity determining region 3 for antibody 49136
ARAQVIWGQLYYFDS

SEQ ID NO: 98273 - protein, 9 aa, Homo sapiens
  light chain complementarity determining region 3 for antibody 49137
QQGYSNPPS

SEQ ID NO: 98274 - protein, 15 aa, Homo sapiens
  heavy chain complementarity determining region 3 for antibody 49137
ARAQVIWGQLYYFDA

SEQ ID NO: 98275 - protein, 9 aa, Homo sapiens
  light chain complementarity determining region 3 for antibody 49138
QQGYSIPLT

SEQ ID NO: 98276 - protein, 18 aa, Homo sapiens
  heavy chain complementarity determining region 3 for antibody 49138
AREPLLWFGDKGAYYFDY

SEQ ID NO: 98277 - protein, 9 aa, Homo sapiens
  light chain complementarity determining region 3 for antibody 49139
QQGYSIPLL

SEQ ID NO: 98278 - protein, 15 aa, Homo sapiens
  heavy chain complementarity determining region 3 for antibody 49139
ARALVIWGQLYYFDC

SEQ ID NO: 98279 - protein, 9 aa, Homo sapiens
  light chain complementarity determining region 3 for antibody 49140
QQGYRTPLT

SEQ ID NO: 98280 - protein, 15 aa, Homo sapiens
  heavy chain complementarity determining region 3 for antibody 49140
ARAQVIWGQLYYFDY

SEQ ID NO: 98281 - protein, 9 aa, Homo sapiens
  light chain complementarity determining region 3 for antibody 49141
QQGYRTPFT

SEQ ID NO: 98282 - protein, 15 aa, Homo sapiens
  heavy chain complementarity determining region 3 for antibody 49141
ARAQVIWGQLYYFDS

SEQ ID NO: 98283 - protein, 9 aa, Homo sapiens
  light chain complementarity determining region 3 for antibody 49142
QQGYRRLPT

SEQ ID NO: 98284 - protein, 18 aa, Homo sapiens
  heavy chain complementarity determining region 3 for antibody 49142
ARGYGSGSYFNYYYGMDV

SEQ ID NO: 98285 - protein, 9 aa, Homo sapiens
  light chain complementarity determining region 3 for antibody 49143
QQGYRPPFI

SEQ ID NO: 98286 - protein, 15 aa, Homo sapiens
  heavy chain complementarity determining region 3 for antibody 49143
TRAQVIWGQLHYFDY

SEQ ID NO: 98287 - protein, 9 aa, Homo sapiens
  light chain complementarity determining region 3 for antibody 49144
QQGYRLPFI

SEQ ID NO: 98288 - protein, 15 aa, Homo sapiens
  heavy chain complementarity determining region 3 for antibody 49144
TRAQVIWGQLYYFDY

SEQ ID NO: 98289 - protein, 9 aa, Homo sapiens
  light chain complementarity determining region 3 for antibody 49145
QQGYNTPLT

SEQ ID NO: 98290 - protein, 15 aa, Homo sapiens
  heavy chain complementarity determining region 3 for antibody 49145
TKAQVIWGQLYYFES

SEQ ID NO: 98291 - protein, 9 aa, Homo sapiens
  light chain complementarity determining region 3 for antibody 49146
QQGYNTPFP

SEQ ID NO: 98292 - protein, 15 aa, Homo sapiens
  heavy chain complementarity determining region 3 for antibody 49146
TKAQVIWGQLYYFES

SEQ ID NO: 98293 - protein, 9 aa, Homo sapiens
  light chain complementarity determining region 3 for antibody 49147
QQGYNTPCT

SEQ ID NO: 98294 - protein, 14 aa, Homo sapiens
  heavy chain complementarity determining region 3 for antibody 49147
AKSASLDYYGAFDP

SEQ ID NO: 98295 - protein, 9 aa, Homo sapiens
  light chain complementarity determining region 3 for antibody 49148
QQGYNPPFT

SEQ ID NO: 98296 - protein, 15 aa, Homo sapiens
  heavy chain complementarity determining region 3 for antibody 49148
TKAQVIWGQLYYFES

SEQ ID NO: 98297 - protein, 9 aa, Homo sapiens
  light chain complementarity determining region 3 for antibody 49149
QQGYITPYP

SEQ ID NO: 98298 - protein, 21 aa, Homo sapiens
  heavy chain complementarity determining region 3 for antibody 49149
AVLAGVEVKTGGPRWYNWFDP

SEQ ID NO: 98299 - protein, 9 aa, Homo sapiens
  light chain complementarity determining region 3 for antibody 49150
QQGYHTPFT

SEQ ID NO: 98300 - protein, 15 aa, Homo sapiens
  heavy chain complementarity determining region 3 for antibody 49150
ARHDGSGYSYAPDEI

SEQ ID NO: 98301 - protein, 9 aa, Homo sapiens
  light chain complementarity determining region 3 for antibody 49151
QQGYGPPFI

SEQ ID NO: 98302 - protein, 15 aa, Homo sapiens
  heavy chain complementarity determining region 3 for antibody 49151
ARAQVIWGQLYYFDS

SEQ ID NO: 98303 - protein, 9 aa, Homo sapiens
  light chain complementarity determining region 3 for antibody 49152
QQGTSFPLT

SEQ ID NO: 98304 - protein, 14 aa, Homo sapiens
  heavy chain complementarity determining region 3 for antibody 49152
ARVRYASGPYYTES

SEQ ID NO: 98305 - protein, 9 aa, Homo sapiens
  light chain complementarity determining region 3 for antibody 49153
QQGSSTPFT

SEQ ID NO: 98306 - protein, 16 aa, Homo sapiens
  heavy chain complementarity determining region 3 for antibody 49153
VRGLDTAMITAENFAF

SEQ ID NO: 98307 - protein, 9 aa, Homo sapiens
  light chain complementarity determining region 3 for antibody 49154
QQGSSTPFT

SEQ ID NO: 98308 - protein, 15 aa, Homo sapiens
  heavy chain complementarity determining region 3 for antibody 49154
AKAQVIWGQLYYFDS

SEQ ID NO: 98309 - protein, 9 aa, Homo sapiens
  light chain complementarity determining region 3 for antibody 49155
QQGSSFPYP

SEQ ID NO: 98310 - protein, 9 aa, Homo sapiens
  heavy chain complementarity determining region 3 for antibody 49155
ARDTAMVDS

SEQ ID NO: 98311 - protein, 9 aa, Homo sapiens
  light chain complementarity determining region 3 for antibody 49156
QQGSSFPFT

SEQ ID NO: 98312 - protein, 17 aa, Homo sapiens
  heavy chain complementarity determining region 3 for antibody 49156
ARDGGCSGSRCNSGLGY

SEQ ID NO: 98313 - protein, 8 aa, Homo sapiens
  light chain complementarity determining region 3 for antibody 49157
QQGSNWVT

SEQ ID NO: 98314 - protein, 21 aa, Homo sapiens
  heavy chain complementarity determining region 3 for antibody 49157
ARNDPDKKEGGQSYGYNYFEQ

SEQ ID NO: 98315 - protein, 11 aa, Homo sapiens
  light chain complementarity determining region 3 for antibody 49158
QQGSNWPRLLT

SEQ ID NO: 98316 - protein, 11 aa, Homo sapiens
  heavy chain complementarity determining region 3 for antibody 49158
ARGVLAAAGDY

SEQ ID NO: 98317 - protein, 9 aa, Homo sapiens
  light chain complementarity determining region 3 for antibody 49159
QQGSNWHRT

SEQ ID NO: 98318 - protein, 21 aa, Homo sapiens
  heavy chain complementarity determining region 3 for antibody 49159
ARELGGGNSPWNYYYYYGMDV

SEQ ID NO: 98319 - protein, 9 aa, Homo sapiens
  light chain complementarity determining region 3 for antibody 49160
QQGSNTPFT

SEQ ID NO: 98320 - protein, 15 aa, Homo sapiens
  heavy chain complementarity determining region 3 for antibody 49160
AKAQVIWGQLYYFES

SEQ ID NO: 98321 - protein, 9 aa, Homo sapiens
  light chain complementarity determining region 3 for antibody 49161
QQGSNRPNA

SEQ ID NO: 98322 - protein, 12 aa, Homo sapiens
  heavy chain complementarity determining region 3 for antibody 49161
ARDLGSGRYSDY

SEQ ID NO: 98323 - protein, 9 aa, Homo sapiens
  light chain complementarity determining region 3 for antibody 49162
QQGSKWPIT

SEQ ID NO: 98324 - protein, 16 aa, Homo sapiens
  heavy chain complementarity determining region 3 for antibody 49162
ARGRGRGYSSGGTFDY

SEQ ID NO: 98325 - protein, 9 aa, Homo sapiens
  light chain complementarity determining region 3 for antibody 49163
QQGSISPLT

SEQ ID NO: 98326 - protein, 13 aa, Homo sapiens
  heavy chain complementarity determining region 3 for antibody 49163
ARGLSTTSWYSFY

SEQ ID NO: 98327 - protein, 9 aa, Homo sapiens
  light chain complementarity determining region 3 for antibody 49164
QQGSGWPPT

SEQ ID NO: 98328 - protein, 15 aa, Homo sapiens
  heavy chain complementarity determining region 3 for antibody 49164
VTGSPFYYDNSGTDY

SEQ ID NO: 98329 - protein, 9 aa, Homo sapiens
  light chain complementarity determining region 3 for antibody 49165
QQGRNFQWT

SEQ ID NO: 98330 - protein, 10 aa, Homo sapiens
  heavy chain complementarity determining region 3 for antibody 49165
ARDHVWAFDS

SEQ ID NO: 98331 - protein, 10 aa, Homo sapiens
  light chain complementarity determining region 3 for antibody 49166
QQGNSFPRIT

SEQ ID NO: 98332 - protein, 18 aa, Homo sapiens
  heavy chain complementarity determining region 3 for antibody 49166
ARGFPTIFGAVIRPPFDN

SEQ ID NO: 98333 - protein, 10 aa, Homo sapiens
  light chain complementarity determining region 3 for antibody 49167
QQGNSFPRIP

SEQ ID NO: 98334 - protein, 18 aa, Homo sapiens
  heavy chain complementarity determining region 3 for antibody 49167
ARGFPTIFGAVIRPHFDN

SEQ ID NO: 98335 - protein, 10 aa, Homo sapiens
  light chain complementarity determining region 3 for antibody 49168
QQGGSSPPIT

SEQ ID NO: 98336 - protein, 19 aa, Homo sapiens
  heavy chain complementarity determining region 3 for antibody 49168
ARDLFSDNSGDFLPDYFDY

SEQ ID NO: 98337 - protein, 9 aa, Homo sapiens
  light chain complementarity determining region 3 for antibody 49169
QQFYVTPRT

SEQ ID NO: 98338 - protein, 14 aa, Homo sapiens
  heavy chain complementarity determining region 3 for antibody 49169
ARSQRQSVVHWFDP

SEQ ID NO: 98339 - protein, 9 aa, Homo sapiens
  light chain complementarity determining region 3 for antibody 49170
QQFYTDFPT

SEQ ID NO: 98340 - protein, 20 aa, Homo sapiens
  heavy chain complementarity determining region 3 for antibody 49170
ARVRDDEYSDYIDRYRWLDP

SEQ ID NO: 98341 - protein, 9 aa, Homo sapiens
  light chain complementarity determining region 3 for antibody 49171
QQFYSWPLT

SEQ ID NO: 98342 - protein, 12 aa, Homo sapiens
  heavy chain complementarity determining region 3 for antibody 49171
ARDMVRGGWCDT

SEQ ID NO: 98343 - protein, 9 aa, Homo sapiens
  light chain complementarity determining region 3 for antibody 49172
QQFVTSPLP

SEQ ID NO: 98344 - protein, 12 aa, Homo sapiens
  heavy chain complementarity determining region 3 for antibody 49172
ARALSWDLPLDY

SEQ ID NO: 98345 - protein, 9 aa, Homo sapiens
  light chain complementarity determining region 3 for antibody 49173
QQFNVYPFP

SEQ ID NO: 98346 - protein, 11 aa, Homo sapiens
  heavy chain complementarity determining region 3 for antibody 49173
AKSYGSGAWDY

SEQ ID NO: 98347 - protein, 9 aa, Homo sapiens
  light chain complementarity determining region 3 for antibody 49174
QQFNSYPLT

SEQ ID NO: 98348 - protein, 13 aa, Homo sapiens
  heavy chain complementarity determining region 3 for antibody 49174
ATDLATGRGKDDY

SEQ ID NO: 98349 - protein, 10 aa, Homo sapiens
  light chain complementarity determining region 3 for antibody 49175
QQFNSWPPVT

SEQ ID NO: 98350 - protein, 17 aa, Homo sapiens
  heavy chain complementarity determining region 3 for antibody 49175
ARDPVVVQVGANTFCDH

SEQ ID NO: 98351 - protein, 8 aa, Homo sapiens
  light chain complementarity determining region 3 for antibody 49176
QQFNSPVT

SEQ ID NO: 98352 - protein, 15 aa, Homo sapiens
  heavy chain complementarity determining region 3 for antibody 49176
ARDILRSGPMVSLDY

SEQ ID NO: 98353 - protein, 9 aa, Homo sapiens
  light chain complementarity determining region 3 for antibody 49177
QQFNNYPRT

SEQ ID NO: 98354 - protein, 16 aa, Homo sapiens
  heavy chain complementarity determining region 3 for antibody 49177
ARNLGYSDTEGRYFDY

SEQ ID NO: 98355 - protein, 9 aa, Homo sapiens
  light chain complementarity determining region 3 for antibody 49178
QQFNDYPVT

SEQ ID NO: 98356 - protein, 18 aa, Homo sapiens
  heavy chain complementarity determining region 3 for antibody 49178
ARGPHCSGATCYSQYFDY

SEQ ID NO: 98357 - protein, 9 aa, Homo sapiens
  light chain complementarity determining region 3 for antibody 49179
QQFKTSPFT

SEQ ID NO: 98358 - protein, 14 aa, Homo sapiens
  heavy chain complementarity determining region 3 for antibody 49179
AKAKDSSGYHVFDY

SEQ ID NO: 98359 - protein, 9 aa, Homo sapiens
  light chain complementarity determining region 3 for antibody 49180
QQFKSYPSA

SEQ ID NO: 98360 - protein, 14 aa, Homo sapiens
  heavy chain complementarity determining region 3 for antibody 49180
AKARDASGYHAFDY

SEQ ID NO: 98361 - protein, 9 aa, Homo sapiens
  light chain complementarity determining region 3 for antibody 49181
QQFKSSPYT

SEQ ID NO: 98362 - protein, 18 aa, Homo sapiens
  heavy chain complementarity determining region 3 for antibody 49181
ALFRQTFDSGTYYPHLDK

SEQ ID NO: 98363 - protein, 9 aa, Homo sapiens
  light chain complementarity determining region 3 for antibody 49182
QQFKSSPYT

SEQ ID NO: 98364 - protein, 18 aa, Homo sapiens
  heavy chain complementarity determining region 3 for antibody 49182
ALFRQTFDSGTHYPHLEK

SEQ ID NO: 98365 - protein, 9 aa, Homo sapiens
  light chain complementarity determining region 3 for antibody 49183
QQFKSSPYT

SEQ ID NO: 98366 - protein, 18 aa, Homo sapiens
  heavy chain complementarity determining region 3 for antibody 49183
ALFRQAFDSGTYYPHLEK

SEQ ID NO: 98367 - protein, 9 aa, Homo sapiens
  light chain complementarity determining region 3 for antibody 49184
QQFKIYPFT

SEQ ID NO: 98368 - protein, 14 aa, Homo sapiens
  heavy chain complementarity determining region 3 for antibody 49184
AKAKDSSGYHSSDY

SEQ ID NO: 98369 - protein, 9 aa, Homo sapiens
  light chain complementarity determining region 3 for antibody 49185
QQFHSYPPT

SEQ ID NO: 98370 - protein, 24 aa, Homo sapiens
  heavy chain complementarity determining region 3 for antibody 49185
ARVRIKKTRRVDLVVNYDHYGMDV

SEQ ID NO: 98371 - protein, 9 aa, Homo sapiens
  light chain complementarity determining region 3 for antibody 49186
QQFHSHPPT

SEQ ID NO: 98372 - protein, 18 aa, Homo sapiens
  heavy chain complementarity determining region 3 for antibody 49186
ARPTPHGFGGNYYYGMAV

SEQ ID NO: 98373 - protein, 11 aa, Homo sapiens
  light chain complementarity determining region 3 for antibody 49187
QQFHDLPRGLP

SEQ ID NO: 98374 - protein, 17 aa, Homo sapiens
  heavy chain complementarity determining region 3 for antibody 49187
VRDAFGGTRASRSKFDY

SEQ ID NO: 98375 - protein, 10 aa, Homo sapiens
  light chain complementarity determining region 3 for antibody 49188
QQFGSTLTSS

SEQ ID NO: 98376 - protein, 11 aa, Homo sapiens
  heavy chain complementarity determining region 3 for antibody 49188
ARISSDDAFDI

SEQ ID NO: 98377 - protein, 10 aa, Homo sapiens
  light chain complementarity determining region 3 for antibody 49189
QQFGSTLTDS

SEQ ID NO: 98378 - protein, 11 aa, Homo sapiens
  heavy chain complementarity determining region 3 for antibody 49189
ARISSDDAFDI

SEQ ID NO: 98379 - protein, 9 aa, Homo sapiens
  light chain complementarity determining region 3 for antibody 49190
QQFGSSPWT

SEQ ID NO: 98380 - protein, 13 aa, Homo sapiens
  heavy chain complementarity determining region 3 for antibody 49190
ARSSCSGGSCSRT

SEQ ID NO: 98381 - protein, 9 aa, Homo sapiens
  light chain complementarity determining region 3 for antibody 49191
QQFGRSPWT

SEQ ID NO: 98382 - protein, 15 aa, Homo sapiens
  heavy chain complementarity determining region 3 for antibody 49191
ARGAFDVLTGYRFDI

SEQ ID NO: 98383 - protein, 9 aa, Homo sapiens
  light chain complementarity determining region 3 for antibody 49192
QQFGRSALT

SEQ ID NO: 98384 - protein, 15 aa, Homo sapiens
  heavy chain complementarity determining region 3 for antibody 49192
AKHGIAALGDNWFDS

SEQ ID NO: 98385 - protein, 9 aa, Homo sapiens
  light chain complementarity determining region 3 for antibody 49193
QQFGNSPYS

SEQ ID NO: 98386 - protein, 11 aa, Homo sapiens
  heavy chain complementarity determining region 3 for antibody 49193
AKVGTMRAFDY

SEQ ID NO: 98387 - protein, 9 aa, Homo sapiens
  light chain complementarity determining region 3 for antibody 49194
QQFGISPYT

SEQ ID NO: 98388 - protein, 11 aa, Homo sapiens
  heavy chain complementarity determining region 3 for antibody 49194
ARVGTVRSFDY

SEQ ID NO: 98389 - protein, 9 aa, Homo sapiens
  light chain complementarity determining region 3 for antibody 49195
QQFGGEPRT

SEQ ID NO: 98390 - protein, 16 aa, Homo sapiens
  heavy chain complementarity determining region 3 for antibody 49195
ARDPRGGVAVPADFNY

SEQ ID NO: 98391 - protein, 8 aa, Homo sapiens
  light chain complementarity determining region 3 for antibody 49196
QQFGESQT

SEQ ID NO: 98392 - protein, 14 aa, Homo sapiens
  heavy chain complementarity determining region 3 for antibody 49196
ARDSEYNGPYLYQH

SEQ ID NO: 98393 - protein, 8 aa, Homo sapiens
  light chain complementarity determining region 3 for antibody 49197
QQFGDSPT

SEQ ID NO: 98394 - protein, 14 aa, Homo sapiens
  heavy chain complementarity determining region 3 for antibody 49197
ARDSEYNGPYLYQH

SEQ ID NO: 98395 - protein, 8 aa, Homo sapiens
  light chain complementarity determining region 3 for antibody 49198
QQFGASQT

SEQ ID NO: 98396 - protein, 14 aa, Homo sapiens
  heavy chain complementarity determining region 3 for antibody 49198
ARDSEYNGPYLYQH

SEQ ID NO: 98397 - protein, 9 aa, Homo sapiens
  light chain complementarity determining region 3 for antibody 49199
QQFEISPYP

SEQ ID NO: 98398 - protein, 11 aa, Homo sapiens
  heavy chain complementarity determining region 3 for antibody 49199
ARVGTVRSFDY

SEQ ID NO: 98399 - protein, 11 aa, Homo sapiens
  light chain complementarity determining region 3 for antibody 49200
QQFDYSPPKWT

SEQ ID NO: 98400 - protein, 16 aa, Homo sapiens
  heavy chain complementarity determining region 3 for antibody 49200
AREGSGEIDGPYYFDL

SEQ ID NO: 98401 - protein, 9 aa, Homo sapiens
  light chain complementarity determining region 3 for antibody 49201
QQFDTYPWT

SEQ ID NO: 98402 - protein, 14 aa, Homo sapiens
  heavy chain complementarity determining region 3 for antibody 49201
ARPRTGYYSFFFDF

SEQ ID NO: 98403 - protein, 9 aa, Homo sapiens
  light chain complementarity determining region 3 for antibody 49202
QQFDRAPYT

SEQ ID NO: 98404 - protein, 22 aa, Homo sapiens
  heavy chain complementarity determining region 3 for antibody 49202
TRGRPSASTTFRQGGRQGPFDI

SEQ ID NO: 98405 - protein, 9 aa, Homo sapiens
  light chain complementarity determining region 3 for antibody 49203
QQFDNWPIT

SEQ ID NO: 98406 - protein, 19 aa, Homo sapiens
  heavy chain complementarity determining region 3 for antibody 49203
AKKIRILEWTDDYYYGLDV

SEQ ID NO: 98407 - protein, 13 aa, Homo sapiens
  light chain complementarity determining region 3 for antibody 49204
QQFDDIPRLGRGT

SEQ ID NO: 98408 - protein, 18 aa, Homo sapiens
  heavy chain complementarity determining region 3 for antibody 49204
TTDWPYRWGYDFGLPFDY

SEQ ID NO: 98409 - protein, 8 aa, Homo sapiens
  light chain complementarity determining region 3 for antibody 49205
QQFCDSQT

SEQ ID NO: 98410 - protein, 14 aa, Homo sapiens
  heavy chain complementarity determining region 3 for antibody 49205
ARDSEYNGPYLYQH

SEQ ID NO: 98411 - protein, 10 aa, Homo sapiens
  light chain complementarity determining region 3 for antibody 49206
QQFANSLIFT

SEQ ID NO: 98412 - protein, 12 aa, Homo sapiens
  heavy chain complementarity determining region 3 for antibody 49206
AKWRYNAGSFDY

SEQ ID NO: 98413 - protein, 10 aa, Homo sapiens
  light chain complementarity determining region 3 for antibody 49207
QQFANPLLFT

SEQ ID NO: 98414 - protein, 12 aa, Homo sapiens
  heavy chain complementarity determining region 3 for antibody 49207
AKWRYNAGSFDY

SEQ ID NO: 98415 - protein, 10 aa, Homo sapiens
  light chain complementarity determining region 3 for antibody 49208
QQFANLLIFT

SEQ ID NO: 98416 - protein, 12 aa, Homo sapiens
  heavy chain complementarity determining region 3 for antibody 49208
AKWRYNAGSFDY

SEQ ID NO: 98417 - protein, 10 aa, Homo sapiens
  light chain complementarity determining region 3 for antibody 49209
QQDYNWPPTT

SEQ ID NO: 98418 - protein, 17 aa, Homo sapiens
  heavy chain complementarity determining region 3 for antibody 49209
AQDLPQPSSVLSGIFKY

SEQ ID NO: 98419 - protein, 9 aa, Homo sapiens
  light chain complementarity determining region 3 for antibody 49210
QQDVSSPRT

SEQ ID NO: 98420 - protein, 15 aa, Homo sapiens
  heavy chain complementarity determining region 3 for antibody 49210
VREPGITTADWYFDL

SEQ ID NO: 98421 - protein, 9 aa, Homo sapiens
  light chain complementarity determining region 3 for antibody 49211
QQDVSPPYT

SEQ ID NO: 98422 - protein, 20 aa, Homo sapiens
  heavy chain complementarity determining region 3 for antibody 49211
ARDLDISVLPGVTDDDGFDI

SEQ ID NO: 98423 - protein, 8 aa, Homo sapiens
  light chain complementarity determining region 3 for antibody 49212
QQDTSPWT

SEQ ID NO: 98424 - protein, 17 aa, Homo sapiens
  heavy chain complementarity determining region 3 for antibody 49212
AASPIAPKPWELLPADD

SEQ ID NO: 98425 - protein, 9 aa, Homo sapiens
  light chain complementarity determining region 3 for antibody 49213
QQDSSSPIT

SEQ ID NO: 98426 - protein, 17 aa, Homo sapiens
  heavy chain complementarity determining region 3 for antibody 49213
ARDYYGSRTSLKGLVDY

SEQ ID NO: 98427 - protein, 9 aa, Homo sapiens
  light chain complementarity determining region 3 for antibody 49214
QQDSSLLRT

SEQ ID NO: 98428 - protein, 18 aa, Homo sapiens
  heavy chain complementarity determining region 3 for antibody 49214
GRDLVTTFGGVIIIPMDV

SEQ ID NO: 98429 - protein, 9 aa, Homo sapiens
  light chain complementarity determining region 3 for antibody 49215
QQDSSDSNT

SEQ ID NO: 98430 - protein, 13 aa, Homo sapiens
  heavy chain complementarity determining region 3 for antibody 49215
VRLRNSTGWCLGY

SEQ ID NO: 98431 - protein, 8 aa, Homo sapiens
  light chain complementarity determining region 3 for antibody 49216
QQDSRSRT

SEQ ID NO: 98432 - protein, 19 aa, Homo sapiens
  heavy chain complementarity determining region 3 for antibody 49216
ARDGVTCSGGSCIETAVDS

SEQ ID NO: 98433 - protein, 9 aa, Homo sapiens
  light chain complementarity determining region 3 for antibody 49217
QQDSRSFVA

SEQ ID NO: 98434 - protein, 9 aa, Homo sapiens
  heavy chain complementarity determining region 3 for antibody 49217
AGPGVMSSV

SEQ ID NO: 98435 - protein, 9 aa, Homo sapiens
  light chain complementarity determining region 3 for antibody 49218
QQDSKSPIT

SEQ ID NO: 98436 - protein, 12 aa, Homo sapiens
  heavy chain complementarity determining region 3 for antibody 49218
ATGGWFGQSFEF

SEQ ID NO: 98437 - protein, 9 aa, Homo sapiens
  light chain complementarity determining region 3 for antibody 49219
QQDRRSPST

SEQ ID NO: 98438 - protein, 17 aa, Homo sapiens
  heavy chain complementarity determining region 3 for antibody 49219
AGLSSRLGDGSPSLFDY

SEQ ID NO: 98439 - protein, 9 aa, Homo sapiens
  light chain complementarity determining region 3 for antibody 49220
QQDNSYSRT

SEQ ID NO: 98440 - protein, 13 aa, Homo sapiens
  heavy chain complementarity determining region 3 for antibody 49220
VTNGGSYFGYFDY

SEQ ID NO: 98441 - protein, 10 aa, Homo sapiens
  light chain complementarity determining region 3 for antibody 49221
QQDNSYSPWT

SEQ ID NO: 98442 - protein, 16 aa, Homo sapiens
  heavy chain complementarity determining region 3 for antibody 49221
ARDLVQQQLFPYYFDY

SEQ ID NO: 98443 - protein, 9 aa, Homo sapiens
  light chain complementarity determining region 3 for antibody 49222
QQDNSYPLT

SEQ ID NO: 98444 - protein, 6 aa, Homo sapiens
  heavy chain complementarity determining region 3 for antibody 49222
EWFPHR

SEQ ID NO: 98445 - protein, 8 aa, Homo sapiens
  light chain complementarity determining region 3 for antibody 49223
QQDNSSYT

SEQ ID NO: 98446 - protein, 13 aa, Homo sapiens
  heavy chain complementarity determining region 3 for antibody 49223
ARGGVLVTALLDS

SEQ ID NO: 98447 - protein, 9 aa, Homo sapiens
  light chain complementarity determining region 3 for antibody 49224
QQDNNYSRA

SEQ ID NO: 98448 - protein, 10 aa, Homo sapiens
  heavy chain complementarity determining region 3 for antibody 49224
ARGPHWLCNY

SEQ ID NO: 98449 - protein, 9 aa, Homo sapiens
  light chain complementarity determining region 3 for antibody 49225
QQDNNYPFT

SEQ ID NO: 98450 - protein, 15 aa, Homo sapiens
  heavy chain complementarity determining region 3 for antibody 49225
ARDGWIAATGSFFDY

SEQ ID NO: 98451 - protein, 9 aa, Homo sapiens
  light chain complementarity determining region 3 for antibody 49226
QQDNNWPRT

SEQ ID NO: 98452 - protein, 18 aa, Homo sapiens
  heavy chain complementarity determining region 3 for antibody 49226
ATNPRRVHDYGSGSPFYN

SEQ ID NO: 98453 - protein, 9 aa, Homo sapiens
  light chain complementarity determining region 3 for antibody 49227
QQDNNWPRT

SEQ ID NO: 98454 - protein, 20 aa, Homo sapiens
  heavy chain complementarity determining region 3 for antibody 49227
ARTGYRYFASGRYNQDAYDV

SEQ ID NO: 98455 - protein, 9 aa, Homo sapiens
  light chain complementarity determining region 3 for antibody 49228
QQDNNWPRT

SEQ ID NO: 98456 - protein, 17 aa, Homo sapiens
  heavy chain complementarity determining region 3 for antibody 49228
ARACGAGGGWHCGVFDD

SEQ ID NO: 98457 - protein, 11 aa, Homo sapiens
  light chain complementarity determining region 3 for antibody 49229
QQDNNWPPAGT

SEQ ID NO: 98458 - protein, 13 aa, Homo sapiens
  heavy chain complementarity determining region 3 for antibody 49229
ARDTSGGYNYFDY

SEQ ID NO: 98459 - protein, 9 aa, Homo sapiens
  light chain complementarity determining region 3 for antibody 49230
QQDNDHGVT

SEQ ID NO: 98460 - protein, 9 aa, Homo sapiens
  heavy chain complementarity determining region 3 for antibody 49230
ARGPIHFDY

SEQ ID NO: 98461 - protein, 9 aa, Homo sapiens
  light chain complementarity determining region 3 for antibody 49231
QQDNASSWT

SEQ ID NO: 98462 - protein, 16 aa, Homo sapiens
  heavy chain complementarity determining region 3 for antibody 49231
ASLGGAHYYGSGSHYF

SEQ ID NO: 98463 - protein, 9 aa, Homo sapiens
  light chain complementarity determining region 3 for antibody 49232
QQDLITPVT

SEQ ID NO: 98464 - protein, 11 aa, Homo sapiens
  heavy chain complementarity determining region 3 for antibody 49232
AKIEGGGFAGY

SEQ ID NO: 98465 - protein, 8 aa, Homo sapiens
  light chain complementarity determining region 3 for antibody 49233
QQDLGNPT

SEQ ID NO: 98466 - protein, 13 aa, Homo sapiens
  heavy chain complementarity determining region 3 for antibody 49233
ARYCGGDCSPLDY

SEQ ID NO: 98467 - protein, 9 aa, Homo sapiens
  light chain complementarity determining region 3 for antibody 49234
QQDKSFPYT

SEQ ID NO: 98468 - protein, 14 aa, Homo sapiens
  heavy chain complementarity determining region 3 for antibody 49234
ARRLVGAPDNWFDP

SEQ ID NO: 98469 - protein, 9 aa, Homo sapiens
  light chain complementarity determining region 3 for antibody 49235
QQDHSFPRT

SEQ ID NO: 98470 - protein, 13 aa, Homo sapiens
  heavy chain complementarity determining region 3 for antibody 49235
ATSHDYGDSALDS

SEQ ID NO: 98471 - protein, 9 aa, Homo sapiens
  light chain complementarity determining region 3 for antibody 49236
QQDGYSPLT

SEQ ID NO: 98472 - protein, 15 aa, Homo sapiens
  heavy chain complementarity determining region 3 for antibody 49236
ARSPYRSPGRNWFDP

SEQ ID NO: 98473 - protein, 8 aa, Homo sapiens
  light chain complementarity determining region 3 for antibody 49237
QQDGTSRN

SEQ ID NO: 98474 - protein, 21 aa, Homo sapiens
  heavy chain complementarity determining region 3 for antibody 49237
ARWKGQIRSDWDRDFYPPNDY

SEQ ID NO: 98475 - protein, 10 aa, Homo sapiens
  light chain complementarity determining region 3 for antibody 49238
QQDGTSRLYT

SEQ ID NO: 98476 - protein, 14 aa, Homo sapiens
  heavy chain complementarity determining region 3 for antibody 49238
AKRRRIVGAYYFES

SEQ ID NO: 98477 - protein, 9 aa, Homo sapiens
  light chain complementarity determining region 3 for antibody 49239
QQDGTSPWT

SEQ ID NO: 98478 - protein, 17 aa, Homo sapiens
  heavy chain complementarity determining region 3 for antibody 49239
ARTGEHNVIVVMQYFNY

SEQ ID NO: 98479 - protein, 9 aa, Homo sapiens
  light chain complementarity determining region 3 for antibody 49240
QQDGTSPRT

SEQ ID NO: 98480 - protein, 16 aa, Homo sapiens
  heavy chain complementarity determining region 3 for antibody 49240
ARLPRLGSENSLAFDI

SEQ ID NO: 98481 - protein, 9 aa, Homo sapiens
  light chain complementarity determining region 3 for antibody 49241
QQDGSTPLT

SEQ ID NO: 98482 - protein, 12 aa, Homo sapiens
  heavy chain complementarity determining region 3 for antibody 49241
ARNGYSSSWYRN

SEQ ID NO: 98483 - protein, 9 aa, Homo sapiens
  light chain complementarity determining region 3 for antibody 49242
QQDGSSTWT

SEQ ID NO: 98484 - protein, 12 aa, Homo sapiens
  heavy chain complementarity determining region 3 for antibody 49242
ARESPFTNYFDF

SEQ ID NO: 98485 - protein, 9 aa, Homo sapiens
  light chain complementarity determining region 3 for antibody 49243
QQDGSSQWT

SEQ ID NO: 98486 - protein, 26 aa, Homo sapiens
  heavy chain complementarity determining region 3 for antibody 49243
ARDRFLGYYDDTDSLYSPGFANGMDV

SEQ ID NO: 98487 - protein, 9 aa, Homo sapiens
  light chain complementarity determining region 3 for antibody 49244
QQDGSSPYT

SEQ ID NO: 98488 - protein, 15 aa, Homo sapiens
  heavy chain complementarity determining region 3 for antibody 49244
ARSRQDGDYVYYFDY

SEQ ID NO: 98489 - protein, 9 aa, Homo sapiens
  light chain complementarity determining region 3 for antibody 49245
QQDGSSPYT

SEQ ID NO: 98490 - protein, 20 aa, Homo sapiens
  heavy chain complementarity determining region 3 for antibody 49245
ARGSHIVVVTSIGAAEYFQH

SEQ ID NO: 98491 - protein, 9 aa, Homo sapiens
  light chain complementarity determining region 3 for antibody 49246
QQDGSSPYT

SEQ ID NO: 98492 - protein, 15 aa, Homo sapiens
  heavy chain complementarity determining region 3 for antibody 49246
AILSRDDFKQYYFDY

SEQ ID NO: 98493 - protein, 9 aa, Homo sapiens
  light chain complementarity determining region 3 for antibody 49247
QQDGSSPYP

SEQ ID NO: 98494 - protein, 18 aa, Homo sapiens
  heavy chain complementarity determining region 3 for antibody 49247
ARGGGLGATGYFVGAFDI

SEQ ID NO: 98495 - protein, 9 aa, Homo sapiens
  light chain complementarity determining region 3 for antibody 49248
QQDGSSPWT

SEQ ID NO: 98496 - protein, 12 aa, Homo sapiens
  heavy chain complementarity determining region 3 for antibody 49248
ARHNGREGHFDY

SEQ ID NO: 98497 - protein, 9 aa, Homo sapiens
  light chain complementarity determining region 3 for antibody 49249
QQDGSSPWT

SEQ ID NO: 98498 - protein, 11 aa, Homo sapiens
  heavy chain complementarity determining region 3 for antibody 49249
ARDRGSGWYAY

SEQ ID NO: 98499 - protein, 9 aa, Homo sapiens
  light chain complementarity determining region 3 for antibody 49250
QQDGSSPWT

SEQ ID NO: 98500 - protein, 14 aa, Homo sapiens
  heavy chain complementarity determining region 3 for antibody 49250
AHGRREGNTRIFDQ

SEQ ID NO: 98501 - protein, 9 aa, Homo sapiens
  light chain complementarity determining region 3 for antibody 49251
QQDGSSPWT

SEQ ID NO: 98502 - protein, 18 aa, Homo sapiens
  heavy chain complementarity determining region 3 for antibody 49251
ACSPAYGNYAGQNYGMDV

SEQ ID NO: 98503 - protein, 9 aa, Homo sapiens
  light chain complementarity determining region 3 for antibody 49252
QQDGSSPTT

SEQ ID NO: 98504 - protein, 10 aa, Homo sapiens
  heavy chain complementarity determining region 3 for antibody 49252
ARYYYGYFDY

SEQ ID NO: 98505 - protein, 8 aa, Homo sapiens
  light chain complementarity determining region 3 for antibody 49253
QQDGSSPT

SEQ ID NO: 98506 - protein, 13 aa, Homo sapiens
  heavy chain complementarity determining region 3 for antibody 49253
AKIGRIGVWYFDL

SEQ ID NO: 98507 - protein, 9 aa, Homo sapiens
  light chain complementarity determining region 3 for antibody 49254
QQDGSSPRT

SEQ ID NO: 98508 - protein, 17 aa, Homo sapiens
  heavy chain complementarity determining region 3 for antibody 49254
VREDGCSGGSCRLYFDL

SEQ ID NO: 98509 - protein, 9 aa, Homo sapiens
  light chain complementarity determining region 3 for antibody 49255
QQDGSSPRT

SEQ ID NO: 98510 - protein, 18 aa, Homo sapiens
  heavy chain complementarity determining region 3 for antibody 49255
ASYHIVVVVDADPDAFHI

SEQ ID NO: 98511 - protein, 9 aa, Homo sapiens
  light chain complementarity determining region 3 for antibody 49256
QQDGSSPRT

SEQ ID NO: 98512 - protein, 16 aa, Homo sapiens
  heavy chain complementarity determining region 3 for antibody 49256
ARWSTGDQKSVYGLDV

SEQ ID NO: 98513 - protein, 9 aa, Homo sapiens
  light chain complementarity determining region 3 for antibody 49257
QQDGSSPRT

SEQ ID NO: 98514 - protein, 18 aa, Homo sapiens
  heavy chain complementarity determining region 3 for antibody 49257
ARVFTEVKGLTTIGGFDY

SEQ ID NO: 98515 - protein, 9 aa, Homo sapiens
  light chain complementarity determining region 3 for antibody 49258
QQDGSSPRT

SEQ ID NO: 98516 - protein, 12 aa, Homo sapiens
  heavy chain complementarity determining region 3 for antibody 49258
ARNPYGSGSMGY

SEQ ID NO: 98517 - protein, 9 aa, Homo sapiens
  light chain complementarity determining region 3 for antibody 49259
QQDGSSPRT

SEQ ID NO: 98518 - protein, 17 aa, Homo sapiens
  heavy chain complementarity determining region 3 for antibody 49259
ARMASSDSSGYFGYFDL

SEQ ID NO: 98519 - protein, 9 aa, Homo sapiens
  light chain complementarity determining region 3 for antibody 49260
QQDGSSPRT

SEQ ID NO: 98520 - protein, 17 aa, Homo sapiens
  heavy chain complementarity determining region 3 for antibody 49260
AREPGRRGWGSFGGFDY

SEQ ID NO: 98521 - protein, 9 aa, Homo sapiens
  light chain complementarity determining region 3 for antibody 49261
QQDGSSPRT

SEQ ID NO: 98522 - protein, 11 aa, Homo sapiens
  heavy chain complementarity determining region 3 for antibody 49261
ARDAINWAFDY

SEQ ID NO: 98523 - protein, 9 aa, Homo sapiens
  light chain complementarity determining region 3 for antibody 49262
QQDGSSPQT

SEQ ID NO: 98524 - protein, 14 aa, Homo sapiens
  heavy chain complementarity determining region 3 for antibody 49262
ARAAPEYEWLVPDY

SEQ ID NO: 98525 - protein, 10 aa, Homo sapiens
  light chain complementarity determining region 3 for antibody 49263
QQDGSSPPYT

SEQ ID NO: 98526 - protein, 9 aa, Homo sapiens
  heavy chain complementarity determining region 3 for antibody 49263
ARGYSFWVY

SEQ ID NO: 98527 - protein, 10 aa, Homo sapiens
  light chain complementarity determining region 3 for antibody 49264
QQDGSSPPWT

SEQ ID NO: 98528 - protein, 18 aa, Homo sapiens
  heavy chain complementarity determining region 3 for antibody 49264
VTGGNRPDWSKLHNYFDY

SEQ ID NO: 98529 - protein, 10 aa, Homo sapiens
  light chain complementarity determining region 3 for antibody 49265
QQDGSSPPGT

SEQ ID NO: 98530 - protein, 13 aa, Homo sapiens
  heavy chain complementarity determining region 3 for antibody 49265
ARKRGYSYGYLDY

SEQ ID NO: 98531 - protein, 10 aa, Homo sapiens
  light chain complementarity determining region 3 for antibody 49266
QQDGSSPPAT

SEQ ID NO: 98532 - protein, 11 aa, Homo sapiens
  heavy chain complementarity determining region 3 for antibody 49266
ARHGSEMELDS

SEQ ID NO: 98533 - protein, 9 aa, Homo sapiens
  light chain complementarity determining region 3 for antibody 49267
QQDGSSPLT

SEQ ID NO: 98534 - protein, 12 aa, Homo sapiens
  heavy chain complementarity determining region 3 for antibody 49267
ETLGLMVFADDY

SEQ ID NO: 98535 - protein, 9 aa, Homo sapiens
  light chain complementarity determining region 3 for antibody 49268
QQDGSSPLT

SEQ ID NO: 98536 - protein, 12 aa, Homo sapiens
  heavy chain complementarity determining region 3 for antibody 49268
ARHPDHHPAFDL

SEQ ID NO: 98537 - protein, 9 aa, Homo sapiens
  light chain complementarity determining region 3 for antibody 49269
QQDGSSPKT

SEQ ID NO: 98538 - protein, 16 aa, Homo sapiens
  heavy chain complementarity determining region 3 for antibody 49269
ARERANQFGVNDAFDI

SEQ ID NO: 98539 - protein, 9 aa, Homo sapiens
  light chain complementarity determining region 3 for antibody 49270
QQDGSSPIT

SEQ ID NO: 98540 - protein, 15 aa, Homo sapiens
  heavy chain complementarity determining region 3 for antibody 49270
AREPRTSSGYMPSGY

SEQ ID NO: 98541 - protein, 9 aa, Homo sapiens
  light chain complementarity determining region 3 for antibody 49271
QQDGSSPIT

SEQ ID NO: 98542 - protein, 13 aa, Homo sapiens
  heavy chain complementarity determining region 3 for antibody 49271
ARDLGDGYNSIDH

SEQ ID NO: 98543 - protein, 9 aa, Homo sapiens
  light chain complementarity determining region 3 for antibody 49272
QQDGSSPHT

SEQ ID NO: 98544 - protein, 14 aa, Homo sapiens
  heavy chain complementarity determining region 3 for antibody 49272
ARDRRLGGYRLLDH

SEQ ID NO: 98545 - protein, 9 aa, Homo sapiens
  light chain complementarity determining region 3 for antibody 49273
QQDGSSPHN

SEQ ID NO: 98546 - protein, 14 aa, Homo sapiens
  heavy chain complementarity determining region 3 for antibody 49273
VRHAAPGRYDASDI

SEQ ID NO: 98547 - protein, 9 aa, Homo sapiens
  light chain complementarity determining region 3 for antibody 49274
QQDGSSPGT

SEQ ID NO: 98548 - protein, 11 aa, Homo sapiens
  heavy chain complementarity determining region 3 for antibody 49274
ARDRGSGWYAY

SEQ ID NO: 98549 - protein, 10 aa, Homo sapiens
  light chain complementarity determining region 3 for antibody 49275
QQDGSSPGLT

SEQ ID NO: 98550 - protein, 17 aa, Homo sapiens
  heavy chain complementarity determining region 3 for antibody 49275
ARGGDYGSFTAYSRIDH

SEQ ID NO: 98551 - protein, 9 aa, Homo sapiens
  light chain complementarity determining region 3 for antibody 49276
QQDGSSPFT

SEQ ID NO: 98552 - protein, 10 aa, Homo sapiens
  heavy chain complementarity determining region 3 for antibody 49276
AKGDGWLPDS

SEQ ID NO: 98553 - protein, 10 aa, Homo sapiens
  light chain complementarity determining region 3 for antibody 49277
QQDGSSPAWT

SEQ ID NO: 98554 - protein, 12 aa, Homo sapiens
  heavy chain complementarity determining region 3 for antibody 49277
ARAQTTVTTADS

SEQ ID NO: 98555 - protein, 9 aa, Homo sapiens
  light chain complementarity determining region 3 for antibody 49278
QQDGSSLWT

SEQ ID NO: 98556 - protein, 16 aa, Homo sapiens
  heavy chain complementarity determining region 3 for antibody 49278
ASGLRGMSHYYYDMNV

SEQ ID NO: 98557 - protein, 9 aa, Homo sapiens
  light chain complementarity determining region 3 for antibody 49279
QQDGSSLWT

SEQ ID NO: 98558 - protein, 22 aa, Homo sapiens
  heavy chain complementarity determining region 3 for antibody 49279
AKDAGPGYSPAAVGRGGSCLDH

SEQ ID NO: 98559 - protein, 8 aa, Homo sapiens
  light chain complementarity determining region 3 for antibody 49280
QQDGSSLT

SEQ ID NO: 98560 - protein, 14 aa, Homo sapiens
  heavy chain complementarity determining region 3 for antibody 49280
ATSRTGEAVGLFDH

SEQ ID NO: 98561 - protein, 8 aa, Homo sapiens
  light chain complementarity determining region 3 for antibody 49281
QQDGSSLT

SEQ ID NO: 98562 - protein, 12 aa, Homo sapiens
  heavy chain complementarity determining region 3 for antibody 49281
AREMSMENAFDI

SEQ ID NO: 98563 - protein, 9 aa, Homo sapiens
  light chain complementarity determining region 3 for antibody 49282
QQDGSSLFT

SEQ ID NO: 98564 - protein, 19 aa, Homo sapiens
  heavy chain complementarity determining region 3 for antibody 49282
ATGLGESGDYEGRGYTRDY

SEQ ID NO: 98565 - protein, 9 aa, Homo sapiens
  light chain complementarity determining region 3 for antibody 49283
QQDGSSHIT

SEQ ID NO: 98566 - protein, 19 aa, Homo sapiens
  heavy chain complementarity determining region 3 for antibody 49283
AKDLRHIVYSSGCCDTFDI

SEQ ID NO: 98567 - protein, 9 aa, Homo sapiens
  light chain complementarity determining region 3 for antibody 49284
QQDGSSGYT

SEQ ID NO: 98568 - protein, 15 aa, Homo sapiens
  heavy chain complementarity determining region 3 for antibody 49284
VRTKWEYYFYYGMDV

SEQ ID NO: 98569 - protein, 9 aa, Homo sapiens
  light chain complementarity determining region 3 for antibody 49285
QQDGSSGCT

SEQ ID NO: 98570 - protein, 14 aa, Homo sapiens
  heavy chain complementarity determining region 3 for antibody 49285
ARDAPSYNYGAFDY

SEQ ID NO: 98571 - protein, 8 aa, Homo sapiens
  light chain complementarity determining region 3 for antibody 49286
QQDGSSFT

SEQ ID NO: 98572 - protein, 15 aa, Homo sapiens
  heavy chain complementarity determining region 3 for antibody 49286
TTGDLYYQEENYFDY

SEQ ID NO: 98573 - protein, 9 aa, Homo sapiens
  light chain complementarity determining region 3 for antibody 49287
QQDGSPPYT

SEQ ID NO: 98574 - protein, 12 aa, Homo sapiens
  heavy chain complementarity determining region 3 for antibody 49287
ATAPWGYGYSMG

SEQ ID NO: 98575 - protein, 9 aa, Homo sapiens
  light chain complementarity determining region 3 for antibody 49288
QQDGSPPYT

SEQ ID NO: 98576 - protein, 15 aa, Homo sapiens
  heavy chain complementarity determining region 3 for antibody 49288
ARASRGGYSGAPGDY

SEQ ID NO: 98577 - protein, 9 aa, Homo sapiens
  light chain complementarity determining region 3 for antibody 49289
QQDGSLPLT

SEQ ID NO: 98578 - protein, 16 aa, Homo sapiens
  heavy chain complementarity determining region 3 for antibody 49289
ARDMWLGDQSAEYFQH

SEQ ID NO: 98579 - protein, 9 aa, Homo sapiens
  light chain complementarity determining region 3 for antibody 49290
QQDGSALPT

SEQ ID NO: 98580 - protein, 15 aa, Homo sapiens
  heavy chain complementarity determining region 3 for antibody 49290
ARGKAAAGLKYLFDL

SEQ ID NO: 98581 - protein, 8 aa, Homo sapiens
  light chain complementarity determining region 3 for antibody 49291
QQDGRSPV

SEQ ID NO: 98582 - protein, 17 aa, Homo sapiens
  heavy chain complementarity determining region 3 for antibody 49291
ASQYYYDSGAYKDAFDI

SEQ ID NO: 98583 - protein, 8 aa, Homo sapiens
  light chain complementarity determining region 3 for antibody 49292
QQDGRSPT

SEQ ID NO: 98584 - protein, 17 aa, Homo sapiens
  heavy chain complementarity determining region 3 for antibody 49292
VTTVVEAAAGDYWFFGL

SEQ ID NO: 98585 - protein, 9 aa, Homo sapiens
  light chain complementarity determining region 3 for antibody 49293
QQDGRSPRT

SEQ ID NO: 98586 - protein, 13 aa, Homo sapiens
  heavy chain complementarity determining region 3 for antibody 49293
ARDVKGRYYDGSD

SEQ ID NO: 98587 - protein, 9 aa, Homo sapiens
  light chain complementarity determining region 3 for antibody 49294
QQDGRSPRP

SEQ ID NO: 98588 - protein, 15 aa, Homo sapiens
  heavy chain complementarity determining region 3 for antibody 49294
AKDGEFCGSNCYFGS

SEQ ID NO: 98589 - protein, 9 aa, Homo sapiens
  light chain complementarity determining region 3 for antibody 49295
QQDGRSPIT

SEQ ID NO: 98590 - protein, 13 aa, Homo sapiens
  heavy chain complementarity determining region 3 for antibody 49295
ASQRGGDYWYFDL

SEQ ID NO: 98591 - protein, 8 aa, Homo sapiens
  light chain complementarity determining region 3 for antibody 49296
QQDGNSYT

SEQ ID NO: 98592 - protein, 16 aa, Homo sapiens
  heavy chain complementarity determining region 3 for antibody 49296
SRHFLDYHGSGSYVQH

SEQ ID NO: 98593 - protein, 9 aa, Homo sapiens
  light chain complementarity determining region 3 for antibody 49297
QQDGNSPYT

SEQ ID NO: 98594 - protein, 25 aa, Homo sapiens
  heavy chain complementarity determining region 3 for antibody 49297
ARDSDLGEYDEDGYYFPFKYYGMDV

SEQ ID NO: 98595 - protein, 9 aa, Homo sapiens
  light chain complementarity determining region 3 for antibody 49298
QQDGNSPRT

SEQ ID NO: 98596 - protein, 16 aa, Homo sapiens
  heavy chain complementarity determining region 3 for antibody 49298
ARIWFGEHDYNDAFDI

SEQ ID NO: 98597 - protein, 10 aa, Homo sapiens
  light chain complementarity determining region 3 for antibody 49299
QQDGNSFPWT

SEQ ID NO: 98598 - protein, 16 aa, Homo sapiens
  heavy chain complementarity determining region 3 for antibody 49299
AARRPTLAVAGPSFDY

SEQ ID NO: 98599 - protein, 9 aa, Homo sapiens
  light chain complementarity determining region 3 for antibody 49300
QQDGISPRT

SEQ ID NO: 98600 - protein, 23 aa, Homo sapiens
  heavy chain complementarity determining region 3 for antibody 49300
ARGKRLTDVVMVRTVTLPSPLEY

SEQ ID NO: 98601 - protein, 9 aa, Homo sapiens
  light chain complementarity determining region 3 for antibody 49301
QQDGGSPST

SEQ ID NO: 98602 - protein, 11 aa, Homo sapiens
  heavy chain complementarity determining region 3 for antibody 49301
ARKPTGMAFDC

SEQ ID NO: 98603 - protein, 10 aa, Homo sapiens
  light chain complementarity determining region 3 for antibody 49302
QQDGGSPRYT

SEQ ID NO: 98604 - protein, 16 aa, Homo sapiens
  heavy chain complementarity determining region 3 for antibody 49302
ARVIWVRGLMTPAFDY

SEQ ID NO: 98605 - protein, 9 aa, Homo sapiens
  light chain complementarity determining region 3 for antibody 49303
QQDGGSPLT

SEQ ID NO: 98606 - protein, 23 aa, Homo sapiens
  heavy chain complementarity determining region 3 for antibody 49303
TTDRVDGSPWYTLWWGLDFYFGN

SEQ ID NO: 98607 - protein, 9 aa, Homo sapiens
  light chain complementarity determining region 3 for antibody 49304
QQDGGSLWT

SEQ ID NO: 98608 - protein, 14 aa, Homo sapiens
  heavy chain complementarity determining region 3 for antibody 49304
ARKKDLVYYYALDV

SEQ ID NO: 98609 - protein, 8 aa, Homo sapiens
  light chain complementarity determining region 3 for antibody 49305
QQDGGSLT

SEQ ID NO: 98610 - protein, 20 aa, Homo sapiens
  heavy chain complementarity determining region 3 for antibody 49305
ARRTGYCRGGTCYSDDAFDF

SEQ ID NO: 98611 - protein, 7 aa, Homo sapiens
  light chain complementarity determining region 3 for antibody 49306
QQDGGLT

SEQ ID NO: 98612 - protein, 16 aa, Homo sapiens
  heavy chain complementarity determining region 3 for antibody 49306
ARLLRGGYDFAYFFDY

SEQ ID NO: 98613 - protein, 9 aa, Homo sapiens
  light chain complementarity determining region 3 for antibody 49307
QQDGGFPRT

SEQ ID NO: 98614 - protein, 16 aa, Homo sapiens
  heavy chain complementarity determining region 3 for antibody 49307
ARGRTRGASLGMATAY

SEQ ID NO: 98615 - protein, 9 aa, Homo sapiens
  light chain complementarity determining region 3 for antibody 49308
QQDGASPLI

SEQ ID NO: 98616 - protein, 12 aa, Homo sapiens
  heavy chain complementarity determining region 3 for antibody 49308
ARMGGSYFAFLY

SEQ ID NO: 98617 - protein, 9 aa, Homo sapiens
  light chain complementarity determining region 3 for antibody 49309
QQDFVYSGT

SEQ ID NO: 98618 - protein, 18 aa, Homo sapiens
  heavy chain complementarity determining region 3 for antibody 49309
AKDPGQYSNYPKRGWFDP

SEQ ID NO: 98619 - protein, 8 aa, Homo sapiens
  light chain complementarity determining region 3 for antibody 49310
QQDDYLPA

SEQ ID NO: 98620 - protein, 12 aa, Homo sapiens
  heavy chain complementarity determining region 3 for antibody 49310
ARSNWNIIAFDL

SEQ ID NO: 98621 - protein, 8 aa, Homo sapiens
  light chain complementarity determining region 3 for antibody 49311
QQDDTNSS

SEQ ID NO: 98622 - protein, 16 aa, Homo sapiens
  heavy chain complementarity determining region 3 for antibody 49311
ARVISKWESILDAFKM

SEQ ID NO: 98623 - protein, 7 aa, Homo sapiens
  light chain complementarity determining region 3 for antibody 49312
QQDDSST

SEQ ID NO: 98624 - protein, 15 aa, Homo sapiens
  heavy chain complementarity determining region 3 for antibody 49312
ARIRMAVVLRDAFDI

SEQ ID NO: 98625 - protein, 9 aa, Homo sapiens
  light chain complementarity determining region 3 for antibody 49313
QQDDSSPWT

SEQ ID NO: 98626 - protein, 12 aa, Homo sapiens
  heavy chain complementarity determining region 3 for antibody 49313
ARGLRLGWGLDY

SEQ ID NO: 98627 - protein, 9 aa, Homo sapiens
  light chain complementarity determining region 3 for antibody 49314
QQDDISPRT

SEQ ID NO: 98628 - protein, 14 aa, Homo sapiens
  heavy chain complementarity determining region 3 for antibody 49314
VTDLLTTTTVTTNY

SEQ ID NO: 98629 - protein, 9 aa, Homo sapiens
  light chain complementarity determining region 3 for antibody 49315
QQDDGLPLT

SEQ ID NO: 98630 - protein, 12 aa, Homo sapiens
  heavy chain complementarity determining region 3 for antibody 49315
ARALWPSNAFDV

SEQ ID NO: 98631 - protein, 8 aa, Homo sapiens
  light chain complementarity determining region 3 for antibody 49316
QQDASSPT

SEQ ID NO: 98632 - protein, 16 aa, Homo sapiens
  heavy chain complementarity determining region 3 for antibody 49316
ARAEMATITGGDALDI

SEQ ID NO: 98633 - protein, 9 aa, Homo sapiens
  light chain complementarity determining region 3 for antibody 49317
QQDANSPGT

SEQ ID NO: 98634 - protein, 22 aa, Homo sapiens
  heavy chain complementarity determining region 3 for antibody 49317
AGGEYSYDGSDYLWLPAEYFQH

SEQ ID NO: 98635 - protein, 9 aa, Homo sapiens
  light chain complementarity determining region 3 for antibody 49318
QQDAAAPIT

SEQ ID NO: 98636 - protein, 13 aa, Homo sapiens
  heavy chain complementarity determining region 3 for antibody 49318
AKGAGSGAYLIDY

SEQ ID NO: 98637 - protein, 9 aa, Homo sapiens
  light chain complementarity determining region 3 for antibody 49319
QQCYTTPQT

SEQ ID NO: 98638 - protein, 21 aa, Homo sapiens
  heavy chain complementarity determining region 3 for antibody 49319
ARDLKLTSYYYDSSDDHYFDY

SEQ ID NO: 98639 - protein, 9 aa, Homo sapiens
  light chain complementarity determining region 3 for antibody 49320
QQCYSTPRT

SEQ ID NO: 98640 - protein, 14 aa, Homo sapiens
  heavy chain complementarity determining region 3 for antibody 49320
ARERPHASAGAFDI

SEQ ID NO: 98641 - protein, 9 aa, Homo sapiens
  light chain complementarity determining region 3 for antibody 49321
QQCYSTPPT

SEQ ID NO: 98642 - protein, 20 aa, Homo sapiens
  heavy chain complementarity determining region 3 for antibody 49321
ARGDYDSSGFYPAGAGYFQH

SEQ ID NO: 98643 - protein, 9 aa, Homo sapiens
  light chain complementarity determining region 3 for antibody 49322
QQCYSPPFI

SEQ ID NO: 98644 - protein, 15 aa, Homo sapiens
  heavy chain complementarity determining region 3 for antibody 49322
ARAQVIWGQLYYFDS

SEQ ID NO: 98645 - protein, 9 aa, Homo sapiens
  light chain complementarity determining region 3 for antibody 49323
QQCYSIPFT

SEQ ID NO: 98646 - protein, 8 aa, Homo sapiens
  heavy chain complementarity determining region 3 for antibody 49323
ARSAYCDS

SEQ ID NO: 98647 - protein, 10 aa, Homo sapiens
  light chain complementarity determining region 3 for antibody 49324
QQCSNWPPYT

SEQ ID NO: 98648 - protein, 11 aa, Homo sapiens
  heavy chain complementarity determining region 3 for antibody 49324
ARGVGSYPFDS

SEQ ID NO: 98649 - protein, 11 aa, Homo sapiens
  light chain complementarity determining region 3 for antibody 49325
QQCSNSPPMYP

SEQ ID NO: 98650 - protein, 14 aa, Homo sapiens
  heavy chain complementarity determining region 3 for antibody 49325
VKFLRQQLVNDIDY

SEQ ID NO: 98651 - protein, 11 aa, Homo sapiens
  light chain complementarity determining region 3 for antibody 49326
QQCSNSPPMST

SEQ ID NO: 98652 - protein, 14 aa, Homo sapiens
  heavy chain complementarity determining region 3 for antibody 49326
VKFLRQQLVNDIDY

SEQ ID NO: 98653 - protein, 9 aa, Homo sapiens
  light chain complementarity determining region 3 for antibody 49327
QQCSISPPT

SEQ ID NO: 98654 - protein, 13 aa, Homo sapiens
  heavy chain complementarity determining region 3 for antibody 49327
ARGLSTTSWYSFY

SEQ ID NO: 98655 - protein, 9 aa, Homo sapiens
  light chain complementarity determining region 3 for antibody 49328
QQCRISPLT

SEQ ID NO: 98656 - protein, 13 aa, Homo sapiens
  heavy chain complementarity determining region 3 for antibody 49328
ARGLSTTSWYSFY

SEQ ID NO: 98657 - protein, 9 aa, Homo sapiens
  light chain complementarity determining region 3 for antibody 49329
QQCNKWPLT

SEQ ID NO: 98658 - protein, 15 aa, Homo sapiens
  heavy chain complementarity determining region 3 for antibody 49329
ARDGGGSSWNNYFDF

SEQ ID NO: 98659 - protein, 8 aa, Homo sapiens
  light chain complementarity determining region 3 for antibody 49330
QQCHDLLT

SEQ ID NO: 98660 - protein, 12 aa, Homo sapiens
  heavy chain complementarity determining region 3 for antibody 49330
ATYYFGAGTFDY

SEQ ID NO: 98661 - protein, 9 aa, Homo sapiens
  light chain complementarity determining region 3 for antibody 49331
QQCHDFPYS

SEQ ID NO: 98662 - protein, 13 aa, Homo sapiens
  heavy chain complementarity determining region 3 for antibody 49331
ATLRNVDGWPFDY

SEQ ID NO: 98663 - protein, 9 aa, Homo sapiens
  light chain complementarity determining region 3 for antibody 49332
QQCGTSPST

SEQ ID NO: 98664 - protein, 18 aa, Homo sapiens
  heavy chain complementarity determining region 3 for antibody 49332
ATNYYDSSGYYGSWYFDL

SEQ ID NO: 98665 - protein, 10 aa, Homo sapiens
  light chain complementarity determining region 3 for antibody 49333
QQCGTSPPGR

SEQ ID NO: 98666 - protein, 12 aa, Homo sapiens
  heavy chain complementarity determining region 3 for antibody 49333
ARGGSSGYQLDY

SEQ ID NO: 98667 - protein, 9 aa, Homo sapiens
  light chain complementarity determining region 3 for antibody 49334
QQCGSSPWT

SEQ ID NO: 98668 - protein, 15 aa, Homo sapiens
  heavy chain complementarity determining region 3 for antibody 49334
AKDQGAGGGWEPFDY

SEQ ID NO: 98669 - protein, 9 aa, Homo sapiens
  light chain complementarity determining region 3 for antibody 49335
QQCGSSPGT

SEQ ID NO: 98670 - protein, 15 aa, Homo sapiens
  heavy chain complementarity determining region 3 for antibody 49335
ARRGRVRGPVEGFDC

SEQ ID NO: 98671 - protein, 8 aa, Homo sapiens
  light chain complementarity determining region 3 for antibody 49336
QQCGDSQT

SEQ ID NO: 98672 - protein, 14 aa, Homo sapiens
  heavy chain complementarity determining region 3 for antibody 49336
ARDSEYNGPYLYQH

SEQ ID NO: 98673 - protein, 9 aa, Homo sapiens
  light chain complementarity determining region 3 for antibody 49337
QQCFRTLYT

SEQ ID NO: 98674 - protein, 10 aa, Homo sapiens
  heavy chain complementarity determining region 3 for antibody 49337
ARDRYGPFDF

SEQ ID NO: 98675 - protein, 9 aa, Homo sapiens
  light chain complementarity determining region 3 for antibody 49338
QQCATSPRT

SEQ ID NO: 98676 - protein, 11 aa, Homo sapiens
  heavy chain complementarity determining region 3 for antibody 49338
VRDRGWLQHDY

SEQ ID NO: 98677 - protein, 9 aa, Homo sapiens
  light chain complementarity determining region 3 for antibody 49339
QQCATSPLT

SEQ ID NO: 98678 - protein, 11 aa, Homo sapiens
  heavy chain complementarity determining region 3 for antibody 49339
VRDRGWLHHDY

SEQ ID NO: 98679 - protein, 9 aa, Homo sapiens
  light chain complementarity determining region 3 for antibody 49340
QQAYSYPWT

SEQ ID NO: 98680 - protein, 10 aa, Homo sapiens
  heavy chain complementarity determining region 3 for antibody 49340
ARDPNSGAYF

SEQ ID NO: 98681 - protein, 9 aa, Homo sapiens
  light chain complementarity determining region 3 for antibody 49341
QQAYSYPGT

SEQ ID NO: 98682 - protein, 13 aa, Homo sapiens
  heavy chain complementarity determining region 3 for antibody 49341
VKGRGYGYGYFDF

SEQ ID NO: 98683 - protein, 9 aa, Homo sapiens
  light chain complementarity determining region 3 for antibody 49342
QQAYSFPRT

SEQ ID NO: 98684 - protein, 13 aa, Homo sapiens
  heavy chain complementarity determining region 3 for antibody 49342
ATSHDYGDSALDS

SEQ ID NO: 98685 - protein, 9 aa, Homo sapiens
  light chain complementarity determining region 3 for antibody 49343
QQAYGHPDT

SEQ ID NO: 98686 - protein, 13 aa, Homo sapiens
  heavy chain complementarity determining region 3 for antibody 49343
ARGRTYDRLPYDV

SEQ ID NO: 98687 - protein, 9 aa, Homo sapiens
  light chain complementarity determining region 3 for antibody 49344
QQATSFPRP

SEQ ID NO: 98688 - protein, 14 aa, Homo sapiens
  heavy chain complementarity determining region 3 for antibody 49344
VHSEIDATANAFDY

SEQ ID NO: 98689 - protein, 9 aa, Homo sapiens
  light chain complementarity determining region 3 for antibody 49345
QQATSFPPT

SEQ ID NO: 98690 - protein, 14 aa, Homo sapiens
  heavy chain complementarity determining region 3 for antibody 49345
ARETTTIGQYYFDY

SEQ ID NO: 98691 - protein, 9 aa, Homo sapiens
  light chain complementarity determining region 3 for antibody 49346
QQASSVPET

SEQ ID NO: 98692 - protein, 18 aa, Homo sapiens
  heavy chain complementarity determining region 3 for antibody 49346
ARRKMSTVVTDYYLGLDV

SEQ ID NO: 98693 - protein, 9 aa, Homo sapiens
  light chain complementarity determining region 3 for antibody 49347
QQASSFPST

SEQ ID NO: 98694 - protein, 12 aa, Homo sapiens
  heavy chain complementarity determining region 3 for antibody 49347
ATGGAGNALGAL

SEQ ID NO: 98695 - protein, 9 aa, Homo sapiens
  light chain complementarity determining region 3 for antibody 49348
QQASSFPLT

SEQ ID NO: 98696 - protein, 14 aa, Homo sapiens
  heavy chain complementarity determining region 3 for antibody 49348
ARARPSVTTSHFGD

SEQ ID NO: 98697 - protein, 9 aa, Homo sapiens
  light chain complementarity determining region 3 for antibody 49349
QQASGFPHP

SEQ ID NO: 98698 - protein, 20 aa, Homo sapiens
  heavy chain complementarity determining region 3 for antibody 49349
ARMAVQFHDSGGFFRYYIDN

SEQ ID NO: 98699 - protein, 9 aa, Homo sapiens
  light chain complementarity determining region 3 for antibody 49350
QQASFSPLT

SEQ ID NO: 98700 - protein, 10 aa, Homo sapiens
  heavy chain complementarity determining region 3 for antibody 49350
ARGTGWLPDH

SEQ ID NO: 98701 - protein, 9 aa, Homo sapiens
  light chain complementarity determining region 3 for antibody 49351
QQARSFPYT

SEQ ID NO: 98702 - protein, 15 aa, Homo sapiens
  heavy chain complementarity determining region 3 for antibody 49351
ARHFAYGDTTGYFDL

SEQ ID NO: 98703 - protein, 10 aa, Homo sapiens
  light chain complementarity determining region 3 for antibody 49352
QQANTFPPWP

SEQ ID NO: 98704 - protein, 12 aa, Homo sapiens
  heavy chain complementarity determining region 3 for antibody 49352
ARNGDSSGYFNS

SEQ ID NO: 98705 - protein, 9 aa, Homo sapiens
  light chain complementarity determining region 3 for antibody 49353
QQANSLPRT

SEQ ID NO: 98706 - protein, 14 aa, Homo sapiens
  heavy chain complementarity determining region 3 for antibody 49353
ARMNFCDTGGHFDI

SEQ ID NO: 98707 - protein, 9 aa, Homo sapiens
  light chain complementarity determining region 3 for antibody 49354
QQANSLPRT

SEQ ID NO: 98708 - protein, 16 aa, Homo sapiens
  heavy chain complementarity determining region 3 for antibody 49354
ARESYSCGGGSCYFDF

SEQ ID NO: 98709 - protein, 9 aa, Homo sapiens
  light chain complementarity determining region 3 for antibody 49355
QQANSLPRT

SEQ ID NO: 98710 - protein, 17 aa, Homo sapiens
  heavy chain complementarity determining region 3 for antibody 49355
ARDSAAVADAGGYFLDY

SEQ ID NO: 98711 - protein, 9 aa, Homo sapiens
  light chain complementarity determining region 3 for antibody 49356
QQANSFPYT

SEQ ID NO: 98712 - protein, 22 aa, Homo sapiens
  heavy chain complementarity determining region 3 for antibody 49356
ARDSPNVSGWEKRLSALGWVDP

SEQ ID NO: 98713 - protein, 9 aa, Homo sapiens
  light chain complementarity determining region 3 for antibody 49357
QQANSFPWT

SEQ ID NO: 98714 - protein, 16 aa, Homo sapiens
  heavy chain complementarity determining region 3 for antibody 49357
ARALRFLEGDFYGMDV

SEQ ID NO: 98715 - protein, 10 aa, Homo sapiens
  light chain complementarity determining region 3 for antibody 49358
QQANSFPWFT

SEQ ID NO: 98716 - protein, 18 aa, Homo sapiens
  heavy chain complementarity determining region 3 for antibody 49358
ARYWRSYYDSSTYHAFNV

SEQ ID NO: 98717 - protein, 9 aa, Homo sapiens
  light chain complementarity determining region 3 for antibody 49359
QQANSFPRT

SEQ ID NO: 98718 - protein, 15 aa, Homo sapiens
  heavy chain complementarity determining region 3 for antibody 49359
ARITDYSSGWGHFDY

SEQ ID NO: 98719 - protein, 9 aa, Homo sapiens
  light chain complementarity determining region 3 for antibody 49360
QQANSFPRT

SEQ ID NO: 98720 - protein, 16 aa, Homo sapiens
  heavy chain complementarity determining region 3 for antibody 49360
ARESYSCGGGSRYFDF

SEQ ID NO: 98721 - protein, 9 aa, Homo sapiens
  light chain complementarity determining region 3 for antibody 49361
QQANSFPPT

SEQ ID NO: 98722 - protein, 10 aa, Homo sapiens
  heavy chain complementarity determining region 3 for antibody 49361
ARDLSGGNSL

SEQ ID NO: 98723 - protein, 9 aa, Homo sapiens
  light chain complementarity determining region 3 for antibody 49362
QQANSFPLT

SEQ ID NO: 98724 - protein, 18 aa, Homo sapiens
  heavy chain complementarity determining region 3 for antibody 49362
ARHLGYDSRGYSHNAFDI

SEQ ID NO: 98725 - protein, 9 aa, Homo sapiens
  light chain complementarity determining region 3 for antibody 49363
QQANSFPLP

SEQ ID NO: 98726 - protein, 14 aa, Homo sapiens
  heavy chain complementarity determining region 3 for antibody 49363
ARLEIVVIPPAKNR

SEQ ID NO: 98727 - protein, 9 aa, Homo sapiens
  light chain complementarity determining region 3 for antibody 49364
QQANSFPHT

SEQ ID NO: 98728 - protein, 9 aa, Homo sapiens
  heavy chain complementarity determining region 3 for antibody 49364
ASGNYFLDH

SEQ ID NO: 98729 - protein, 9 aa, Homo sapiens
  light chain complementarity determining region 3 for antibody 49365
QQANSFPFT

SEQ ID NO: 98730 - protein, 11 aa, Homo sapiens
  heavy chain complementarity determining region 3 for antibody 49365
ATDVYGGYSDY

SEQ ID NO: 98731 - protein, 9 aa, Homo sapiens
  light chain complementarity determining region 3 for antibody 49366
QQANSFPFT

SEQ ID NO: 98732 - protein, 12 aa, Homo sapiens
  heavy chain complementarity determining region 3 for antibody 49366
ASGYGSGSYFDY

SEQ ID NO: 98733 - protein, 9 aa, Homo sapiens
  light chain complementarity determining region 3 for antibody 49367
QQANSFPFT

SEQ ID NO: 98734 - protein, 13 aa, Homo sapiens
  heavy chain complementarity determining region 3 for antibody 49367
ARDHGRFGEFIDY

SEQ ID NO: 98735 - protein, 9 aa, Homo sapiens
  light chain complementarity determining region 3 for antibody 49368
QQANRFPST

SEQ ID NO: 98736 - protein, 13 aa, Homo sapiens
  heavy chain complementarity determining region 3 for antibody 49368
ARGTGGNYKMFDS

SEQ ID NO: 98737 - protein, 9 aa, Homo sapiens
  light chain complementarity determining region 3 for antibody 49369
QQANRFPIT

SEQ ID NO: 98738 - protein, 18 aa, Homo sapiens
  heavy chain complementarity determining region 3 for antibody 49369
ARSVSYIVSRFAGAYFDY

SEQ ID NO: 98739 - protein, 9 aa, Homo sapiens
  light chain complementarity determining region 3 for antibody 49370
QQANRFPFT

SEQ ID NO: 98740 - protein, 17 aa, Homo sapiens
  heavy chain complementarity determining region 3 for antibody 49370
AKDLIWNGDGYFYGMDV

SEQ ID NO: 98741 - protein, 9 aa, Homo sapiens
  light chain complementarity determining region 3 for antibody 49371
QQANRFPFP

SEQ ID NO: 98742 - protein, 13 aa, Homo sapiens
  heavy chain complementarity determining region 3 for antibody 49371
ARGTGGNYKMFDS

SEQ ID NO: 98743 - protein, 9 aa, Homo sapiens
  light chain complementarity determining region 3 for antibody 49372
QQANNFPLT

SEQ ID NO: 98744 - protein, 15 aa, Homo sapiens
  heavy chain complementarity determining region 3 for antibody 49372
ARDKDTAMITDAFDI

SEQ ID NO: 98745 - protein, 9 aa, Homo sapiens
  light chain complementarity determining region 3 for antibody 49373
QQANCFPLT

SEQ ID NO: 98746 - protein, 21 aa, Homo sapiens
  heavy chain complementarity determining region 3 for antibody 49373
ARKEAAELRLWFGESQSPLDS

SEQ ID NO: 98747 - protein, 9 aa, Homo sapiens
  light chain complementarity determining region 3 for antibody 49374
QQANCFPFT

SEQ ID NO: 98748 - protein, 13 aa, Homo sapiens
  heavy chain complementarity determining region 3 for antibody 49374
ARGTGGNYKMFDS

SEQ ID NO: 98749 - protein, 9 aa, Homo sapiens
  light chain complementarity determining region 3 for antibody 49375
QQAKSFPPT

SEQ ID NO: 98750 - protein, 20 aa, Homo sapiens
  heavy chain complementarity determining region 3 for antibody 49375
VRTRVREGVAGHFHHYAMDV

SEQ ID NO: 98751 - protein, 9 aa, Homo sapiens
  light chain complementarity determining region 3 for antibody 49376
QQAKSFPFT

SEQ ID NO: 98752 - protein, 12 aa, Homo sapiens
  heavy chain complementarity determining region 3 for antibody 49376
ARDPNRGTRADY

SEQ ID NO: 98753 - protein, 9 aa, Homo sapiens
  light chain complementarity determining region 3 for antibody 49377
QQAKSFPAT

SEQ ID NO: 98754 - protein, 17 aa, Homo sapiens
  heavy chain complementarity determining region 3 for antibody 49377
ARDGGCSGSRCNSGLGY

SEQ ID NO: 98755 - protein, 9 aa, Homo sapiens
  light chain complementarity determining region 3 for antibody 49378
QQAKSFPAT

SEQ ID NO: 98756 - protein, 15 aa, Homo sapiens
  heavy chain complementarity determining region 3 for antibody 49378
ARAQVIWGQLYYFDS

SEQ ID NO: 98757 - protein, 9 aa, Homo sapiens
  light chain complementarity determining region 3 for antibody 49379
QQAITFPLP

SEQ ID NO: 98758 - protein, 8 aa, Homo sapiens
  heavy chain complementarity determining region 3 for antibody 49379
TGHGSDSS

SEQ ID NO: 98759 - protein, 9 aa, Homo sapiens
  light chain complementarity determining region 3 for antibody 49380
QQAHSYPWT

SEQ ID NO: 98760 - protein, 10 aa, Homo sapiens
  heavy chain complementarity determining region 3 for antibody 49380
ARAPNSGAYF

SEQ ID NO: 98761 - protein, 9 aa, Homo sapiens
  light chain complementarity determining region 3 for antibody 49381
QQAHSFPWT

SEQ ID NO: 98762 - protein, 13 aa, Homo sapiens
  heavy chain complementarity determining region 3 for antibody 49381
ATSHDYGDSALDS

SEQ ID NO: 98763 - protein, 9 aa, Homo sapiens
  light chain complementarity determining region 3 for antibody 49382
QQAHSFPMT

SEQ ID NO: 98764 - protein, 13 aa, Homo sapiens
  heavy chain complementarity determining region 3 for antibody 49382
ATSHDYGDSALDS

SEQ ID NO: 98765 - protein, 9 aa, Homo sapiens
  light chain complementarity determining region 3 for antibody 49383
QQAHRFPFT

SEQ ID NO: 98766 - protein, 13 aa, Homo sapiens
  heavy chain complementarity determining region 3 for antibody 49383
ARGTGGNYKMFDS

SEQ ID NO: 98767 - protein, 9 aa, Homo sapiens
  light chain complementarity determining region 3 for antibody 49384
QQAHATPLT

SEQ ID NO: 98768 - protein, 19 aa, Homo sapiens
  heavy chain complementarity determining region 3 for antibody 49384
ARSRNYEFWRGYAHGYLDL

SEQ ID NO: 98769 - protein, 8 aa, Homo sapiens
  light chain complementarity determining region 3 for antibody 49385
QQAGRSLT

SEQ ID NO: 98770 - protein, 8 aa, Homo sapiens
  heavy chain complementarity determining region 3 for antibody 49385
TGHGSDSS

SEQ ID NO: 98771 - protein, 9 aa, Homo sapiens
  light chain complementarity determining region 3 for antibody 49386
QQADSFPRT

SEQ ID NO: 98772 - protein, 15 aa, Homo sapiens
  heavy chain complementarity determining region 3 for antibody 49386
ARGRPSRLAVAGFHS

SEQ ID NO: 98773 - protein, 9 aa, Homo sapiens
  light chain complementarity determining region 3 for antibody 49387
QQADSFPPT

SEQ ID NO: 98774 - protein, 16 aa, Homo sapiens
  heavy chain complementarity determining region 3 for antibody 49387
AREYCSGGTCYWYFDL

SEQ ID NO: 98775 - protein, 9 aa, Homo sapiens
  light chain complementarity determining region 3 for antibody 49388
QQADSFPGT

SEQ ID NO: 98776 - protein, 16 aa, Homo sapiens
  heavy chain complementarity determining region 3 for antibody 49388
ATWQGSGTHYRPYFDY

SEQ ID NO: 98777 - protein, 9 aa, Homo sapiens
  light chain complementarity determining region 3 for antibody 49389
QPYYSSPYT

SEQ ID NO: 98778 - protein, 23 aa, Homo sapiens
  heavy chain complementarity determining region 3 for antibody 49389
ARGVTDCSGRNCYGGEVINAFDV

SEQ ID NO: 98779 - protein, 9 aa, Homo sapiens
  light chain complementarity determining region 3 for antibody 49390
QPYSSYLYT

SEQ ID NO: 98780 - protein, 14 aa, Homo sapiens
  heavy chain complementarity determining region 3 for antibody 49390
ARCMIEAAFRNFDY

SEQ ID NO: 98781 - protein, 8 aa, Homo sapiens
  light chain complementarity determining region 3 for antibody 49391
QPYRDSFP

SEQ ID NO: 98782 - protein, 13 aa, Homo sapiens
  heavy chain complementarity determining region 3 for antibody 49391
ATESGSYQGAFDI

SEQ ID NO: 98783 - protein, 9 aa, Homo sapiens
  light chain complementarity determining region 3 for antibody 49392
QPYNSWPQK

SEQ ID NO: 98784 - protein, 9 aa, Homo sapiens
  heavy chain complementarity determining region 3 for antibody 49392
ARQGTWFDP

SEQ ID NO: 98785 - protein, 10 aa, Homo sapiens
  light chain complementarity determining region 3 for antibody 49393
QPYNSWPPLT

SEQ ID NO: 98786 - protein, 14 aa, Homo sapiens
  heavy chain complementarity determining region 3 for antibody 49393
ARSKWAAPGTPPEY

SEQ ID NO: 98787 - protein, 9 aa, Homo sapiens
  light chain complementarity determining region 3 for antibody 49394
QPYNNWPRT

SEQ ID NO: 98788 - protein, 13 aa, Homo sapiens
  heavy chain complementarity determining region 3 for antibody 49394
ARGSENSPWDPHY

SEQ ID NO: 98789 - protein, 10 aa, Homo sapiens
  light chain complementarity determining region 3 for antibody 49395
QPYNNWPPWA

SEQ ID NO: 98790 - protein, 13 aa, Homo sapiens
  heavy chain complementarity determining region 3 for antibody 49395
ARTLGGSYAYLDF

SEQ ID NO: 98791 - protein, 9 aa, Homo sapiens
  light chain complementarity determining region 3 for antibody 49396
QPYNKWPLT

SEQ ID NO: 98792 - protein, 16 aa, Homo sapiens
  heavy chain complementarity determining region 3 for antibody 49396
ARLTESSGYHDEGFDI

SEQ ID NO: 98793 - protein, 9 aa, Homo sapiens
  light chain complementarity determining region 3 for antibody 49397
QPYKNAPLT

SEQ ID NO: 98794 - protein, 15 aa, Homo sapiens
  heavy chain complementarity determining region 3 for antibody 49397
AGGRHLGFGESYFDP

SEQ ID NO: 98795 - protein, 9 aa, Homo sapiens
  light chain complementarity determining region 3 for antibody 49398
QPYHSFSYT

SEQ ID NO: 98796 - protein, 10 aa, Homo sapiens
  heavy chain complementarity determining region 3 for antibody 49398
ATGTSVGAKF

SEQ ID NO: 98797 - protein, 8 aa, Homo sapiens
  light chain complementarity determining region 3 for antibody 49399
QPYHNNSA

SEQ ID NO: 98798 - protein, 14 aa, Homo sapiens
  heavy chain complementarity determining region 3 for antibody 49399
ARPRNSNWLYYFDY

SEQ ID NO: 98799 - protein, 10 aa, Homo sapiens
  light chain complementarity determining region 3 for antibody 49400
QPYGTSSMYT

SEQ ID NO: 98800 - protein, 13 aa, Homo sapiens
  heavy chain complementarity determining region 3 for antibody 49400
AKHSGSQSYPLDY

SEQ ID NO: 98801 - protein, 9 aa, Homo sapiens
  light chain complementarity determining region 3 for antibody 49401
QPYGSSRWT

SEQ ID NO: 98802 - protein, 18 aa, Homo sapiens
  heavy chain complementarity determining region 3 for antibody 49401
ARGPDHGSSDTVNYFFDL

SEQ ID NO: 98803 - protein, 9 aa, Homo sapiens
  light chain complementarity determining region 3 for antibody 49402
QPYGSSPWT

SEQ ID NO: 98804 - protein, 17 aa, Homo sapiens
  heavy chain complementarity determining region 3 for antibody 49402
ARGGAYYDSSGYDQFDY

SEQ ID NO: 98805 - protein, 7 aa, Homo sapiens
  light chain complementarity determining region 3 for antibody 49403
QPYGSSP

SEQ ID NO: 98806 - protein, 15 aa, Homo sapiens
  heavy chain complementarity determining region 3 for antibody 49403
VRRLAAPGSGDAFDI

SEQ ID NO: 98807 - protein, 9 aa, Homo sapiens
  light chain complementarity determining region 3 for antibody 49404
QPYGSSPSS

SEQ ID NO: 98808 - protein, 15 aa, Homo sapiens
  heavy chain complementarity determining region 3 for antibody 49404
ARGIVRFLRVDAFDI

SEQ ID NO: 98809 - protein, 9 aa, Homo sapiens
  light chain complementarity determining region 3 for antibody 49405
QPYGSSPQT

SEQ ID NO: 98810 - protein, 12 aa, Homo sapiens
  heavy chain complementarity determining region 3 for antibody 49405
ARNGYSSSWYRN

SEQ ID NO: 98811 - protein, 9 aa, Homo sapiens
  light chain complementarity determining region 3 for antibody 49406
QPYGSSPLT

SEQ ID NO: 98812 - protein, 19 aa, Homo sapiens
  heavy chain complementarity determining region 3 for antibody 49406
ATVSTYPSGSLGILGTFDF

SEQ ID NO: 98813 - protein, 8 aa, Homo sapiens
  light chain complementarity determining region 3 for antibody 49407
QPYGSSIT

SEQ ID NO: 98814 - protein, 14 aa, Homo sapiens
  heavy chain complementarity determining region 3 for antibody 49407
TRSPGGGGGGYSQH

SEQ ID NO: 98815 - protein, 9 aa, Homo sapiens
  light chain complementarity determining region 3 for antibody 49408
QPYGSPPYT

SEQ ID NO: 98816 - protein, 12 aa, Homo sapiens
  heavy chain complementarity determining region 3 for antibody 49408
ATAPWGYGYSMG

SEQ ID NO: 98817 - protein, 9 aa, Homo sapiens
  light chain complementarity determining region 3 for antibody 49409
QPYGSPPIT

SEQ ID NO: 98818 - protein, 15 aa, Homo sapiens
  heavy chain complementarity determining region 3 for antibody 49409
ARAMGLIWFGEKLDP

SEQ ID NO: 98819 - protein, 9 aa, Homo sapiens
  light chain complementarity determining region 3 for antibody 49410
QPYGDSPRT

SEQ ID NO: 98820 - protein, 13 aa, Homo sapiens
  heavy chain complementarity determining region 3 for antibody 49410
ARGLTAYHGAFDI

SEQ ID NO: 98821 - protein, 9 aa, Homo sapiens
  light chain complementarity determining region 3 for antibody 49411
QPYAGSPGT

SEQ ID NO: 98822 - protein, 8 aa, Homo sapiens
  heavy chain complementarity determining region 3 for antibody 49411
ARGLSLDS

SEQ ID NO: 98823 - protein, 9 aa, Homo sapiens
  light chain complementarity determining region 3 for antibody 49412
QPTYSSPHT

SEQ ID NO: 98824 - protein, 19 aa, Homo sapiens
  heavy chain complementarity determining region 3 for antibody 49412
ARQVGCLGTDLPGDCGLDV

SEQ ID NO: 98825 - protein, 9 aa, Homo sapiens
  light chain complementarity determining region 3 for antibody 49413
QPSYSTPRT

SEQ ID NO: 98826 - protein, 14 aa, Homo sapiens
  heavy chain complementarity determining region 3 for antibody 49413
AREVEAAAGRFLDY

SEQ ID NO: 98827 - protein, 10 aa, Homo sapiens
  light chain complementarity determining region 3 for antibody 49414
QPSYSTLLYT

SEQ ID NO: 98828 - protein, 11 aa, Homo sapiens
  heavy chain complementarity determining region 3 for antibody 49414
AKDNNFWTIDY

SEQ ID NO: 98829 - protein, 10 aa, Homo sapiens
  light chain complementarity determining region 3 for antibody 49415
QPSYSTLAWT

SEQ ID NO: 98830 - protein, 17 aa, Homo sapiens
  heavy chain complementarity determining region 3 for antibody 49415
ARENRVGPGGVFIPIDH

SEQ ID NO: 98831 - protein, 9 aa, Homo sapiens
  light chain complementarity determining region 3 for antibody 49416
QPSYSFLYT

SEQ ID NO: 98832 - protein, 18 aa, Homo sapiens
  heavy chain complementarity determining region 3 for antibody 49416
ARDRGNDHGDLDGFYFDL

SEQ ID NO: 98833 - protein, 10 aa, Homo sapiens
  light chain complementarity determining region 3 for antibody 49417
QPSYRTPPFT

SEQ ID NO: 98834 - protein, 14 aa, Homo sapiens
  heavy chain complementarity determining region 3 for antibody 49417
AKVEPYGDNHRFDY

SEQ ID NO: 98835 - protein, 9 aa, Homo sapiens
  light chain complementarity determining region 3 for antibody 49418
QPSHTTPLT

SEQ ID NO: 98836 - protein, 13 aa, Homo sapiens
  heavy chain complementarity determining region 3 for antibody 49418
ARDAYDGDWYFDI

SEQ ID NO: 98837 - protein, 9 aa, Homo sapiens
  light chain complementarity determining region 3 for antibody 49419
QPRDNWPRT

SEQ ID NO: 98838 - protein, 11 aa, Homo sapiens
  heavy chain complementarity determining region 3 for antibody 49419
ARARGSGSYNH

SEQ ID NO: 98839 - protein, 9 aa, Homo sapiens
  light chain complementarity determining region 3 for antibody 49420
QPNYNPPFT

SEQ ID NO: 98840 - protein, 13 aa, Homo sapiens
  heavy chain complementarity determining region 3 for antibody 49420
VRGRNYDRDGFDP

SEQ ID NO: 98841 - protein, 9 aa, Homo sapiens
  light chain complementarity determining region 3 for antibody 49421
QPGRNFPWT

SEQ ID NO: 98842 - protein, 10 aa, Homo sapiens
  heavy chain complementarity determining region 3 for antibody 49421
ARDHVWAFDS

SEQ ID NO: 98843 - protein, 9 aa, Homo sapiens
  light chain complementarity determining region 3 for antibody 49422
QPFGGAPRT

SEQ ID NO: 98844 - protein, 16 aa, Homo sapiens
  heavy chain complementarity determining region 3 for antibody 49422
ARDPRGGVAVPADFNY

SEQ ID NO: 98845 - protein, 10 aa, Homo sapiens
  light chain complementarity determining region 3 for antibody 49423
QPDGGSPRYT

SEQ ID NO: 98846 - protein, 16 aa, Homo sapiens
  heavy chain complementarity determining region 3 for antibody 49423
ARVIWVRGLMTPAFDY

SEQ ID NO: 98847 - protein, 11 aa, Homo sapiens
  light chain complementarity determining region 3 for antibody 49424
QNYNTALRGLP

SEQ ID NO: 98848 - protein, 17 aa, Homo sapiens
  heavy chain complementarity determining region 3 for antibody 49424
AAGYHSESLSADEVFDI

SEQ ID NO: 98849 - protein, 9 aa, Homo sapiens
  light chain complementarity determining region 3 for antibody 49425
QNYNGFPQT

SEQ ID NO: 98850 - protein, 12 aa, Homo sapiens
  heavy chain complementarity determining region 3 for antibody 49425
ASGTITGWYHRY

SEQ ID NO: 98851 - protein, 9 aa, Homo sapiens
  light chain complementarity determining region 3 for antibody 49426
QNYNGAPWT

SEQ ID NO: 98852 - protein, 13 aa, Homo sapiens
  heavy chain complementarity determining region 3 for antibody 49426
AKDRHRVAGYFDY

SEQ ID NO: 98853 - protein, 9 aa, Homo sapiens
  light chain complementarity determining region 3 for antibody 49427
QNYDDAPGT

SEQ ID NO: 98854 - protein, 16 aa, Homo sapiens
  heavy chain complementarity determining region 3 for antibody 49427
AKKGGPVKATGNYFDL

SEQ ID NO: 98855 - protein, 8 aa, Homo sapiens
  light chain complementarity determining region 3 for antibody 49428
QNFGTSWT

SEQ ID NO: 98856 - protein, 15 aa, Homo sapiens
  heavy chain complementarity determining region 3 for antibody 49428
VKAKIALAGEDIVDH

SEQ ID NO: 98857 - protein, 9 aa, Homo sapiens
  light chain complementarity determining region 3 for antibody 49429
QMYNSAPRT

SEQ ID NO: 98858 - protein, 14 aa, Homo sapiens
  heavy chain complementarity determining region 3 for antibody 49429
ARHVEVRISGSYAY

SEQ ID NO: 98859 - protein, 11 aa, Homo sapiens
  light chain complementarity determining region 3 for antibody 49430
QMYDGSPPKNI

SEQ ID NO: 98860 - protein, 14 aa, Homo sapiens
  heavy chain complementarity determining region 3 for antibody 49430
ASHVTLTGTRGFDF

SEQ ID NO: 98861 - protein, 10 aa, Homo sapiens
  light chain complementarity determining region 3 for antibody 49431
QMDGGSPLLT

SEQ ID NO: 98862 - protein, 14 aa, Homo sapiens
  heavy chain complementarity determining region 3 for antibody 49431
ARDPALGAPDYLDH

SEQ ID NO: 98863 - protein, 8 aa, Homo sapiens
  light chain complementarity determining region 3 for antibody 49432
QLYGSSPT

SEQ ID NO: 98864 - protein, 16 aa, Homo sapiens
  heavy chain complementarity determining region 3 for antibody 49432
ARDGHSSGWHVRYFDS

SEQ ID NO: 98865 - protein, 11 aa, Homo sapiens
  light chain complementarity determining region 3 for antibody 49433
QLYGSSPPSYP

SEQ ID NO: 98866 - protein, 15 aa, Homo sapiens
  heavy chain complementarity determining region 3 for antibody 49433
AREAITMIEPGAFDI

SEQ ID NO: 98867 - protein, 11 aa, Homo sapiens
  light chain complementarity determining region 3 for antibody 49434
QLYGSSPPSST

SEQ ID NO: 98868 - protein, 15 aa, Homo sapiens
  heavy chain complementarity determining region 3 for antibody 49434
AREAITMIEPGAFDI

SEQ ID NO: 98869 - protein, 11 aa, Homo sapiens
  light chain complementarity determining region 3 for antibody 49435
QLYGSSPPSSP

SEQ ID NO: 98870 - protein, 15 aa, Homo sapiens
  heavy chain complementarity determining region 3 for antibody 49435
AREAITMIEPGAFDI

SEQ ID NO: 98871 - protein, 10 aa, Homo sapiens
  light chain complementarity determining region 3 for antibody 49436
QLYGSSFRIP

SEQ ID NO: 98872 - protein, 10 aa, Homo sapiens
  heavy chain complementarity determining region 3 for antibody 49436
GKADWNYVSY

SEQ ID NO: 98873 - protein, 8 aa, Homo sapiens
  light chain complementarity determining region 3 for antibody 49437
QLYGGSPT

SEQ ID NO: 98874 - protein, 16 aa, Homo sapiens
  heavy chain complementarity determining region 3 for antibody 49437
ARDGHSSGWHVRYFDS

SEQ ID NO: 98875 - protein, 10 aa, Homo sapiens
  light chain complementarity determining region 3 for antibody 49438
QLRSVWPSIS

SEQ ID NO: 98876 - protein, 20 aa, Homo sapiens
  heavy chain complementarity determining region 3 for antibody 49438
AKDRYYDSSGHYYGVNGFDY

SEQ ID NO: 98877 - protein, 9 aa, Homo sapiens
  light chain complementarity determining region 3 for antibody 49439
QLRSTWPFT

SEQ ID NO: 98878 - protein, 18 aa, Homo sapiens
  heavy chain complementarity determining region 3 for antibody 49439
ARDRDAAMASYYYYGMDV

SEQ ID NO: 98879 - protein, 11 aa, Homo sapiens
  light chain complementarity determining region 3 for antibody 49440
QLRSNWPTGYP

SEQ ID NO: 98880 - protein, 12 aa, Homo sapiens
  heavy chain complementarity determining region 3 for antibody 49440
ARDGVGATHFDY

SEQ ID NO: 98881 - protein, 9 aa, Homo sapiens
  light chain complementarity determining region 3 for antibody 49441
QLRSNWLWK

SEQ ID NO: 98882 - protein, 20 aa, Homo sapiens
  heavy chain complementarity determining region 3 for antibody 49441
ATTDLHFYDNSGFYYGWFDP

SEQ ID NO: 98883 - protein, 9 aa, Homo sapiens
  light chain complementarity determining region 3 for antibody 49442
QLRSKWLWT

SEQ ID NO: 98884 - protein, 20 aa, Homo sapiens
  heavy chain complementarity determining region 3 for antibody 49442
ATTDLHFYDNSGFYYGWFDP

SEQ ID NO: 98885 - protein, 11 aa, Homo sapiens
  light chain complementarity determining region 3 for antibody 49443
QLRQERSNWPP

SEQ ID NO: 98886 - protein, 15 aa, Homo sapiens
  heavy chain complementarity determining region 3 for antibody 49443
ARGGYSSGWYYWFDP

SEQ ID NO: 98887 - protein, 9 aa, Homo sapiens
  light chain complementarity determining region 3 for antibody 49444
QLLNSYPRT

SEQ ID NO: 98888 - protein, 13 aa, Homo sapiens
  heavy chain complementarity determining region 3 for antibody 49444
ARGRSRDRHPFDT

SEQ ID NO: 98889 - protein, 10 aa, Homo sapiens
  light chain complementarity determining region 3 for antibody 49445
QLHGSSPKWR

SEQ ID NO: 98890 - protein, 9 aa, Homo sapiens
  heavy chain complementarity determining region 3 for antibody 49445
ARGEYSATH

SEQ ID NO: 98891 - protein, 10 aa, Homo sapiens
  light chain complementarity determining region 3 for antibody 49446
QLHGSSPKGT

SEQ ID NO: 98892 - protein, 9 aa, Homo sapiens
  heavy chain complementarity determining region 3 for antibody 49446
ARGEYSATH

SEQ ID NO: 98893 - protein, 8 aa, Homo sapiens
  light chain complementarity determining region 3 for antibody 49447
QLFNGLPS

SEQ ID NO: 98894 - protein, 14 aa, Homo sapiens
  heavy chain complementarity determining region 3 for antibody 49447
ARMSSLAAPFGMDV

SEQ ID NO: 98895 - protein, 10 aa, Homo sapiens
  light chain complementarity determining region 3 for antibody 49448
QLFGGSPLYP

SEQ ID NO: 98896 - protein, 18 aa, Homo sapiens
  heavy chain complementarity determining region 3 for antibody 49448
AREKDVFVGYVSYNWFDP

SEQ ID NO: 98897 - protein, 9 aa, Homo sapiens
  light chain complementarity determining region 3 for antibody 49449
QKYYRAPWT

SEQ ID NO: 98898 - protein, 12 aa, Homo sapiens
  heavy chain complementarity determining region 3 for antibody 49449
ATRAGITAIPDY

SEQ ID NO: 98899 - protein, 9 aa, Homo sapiens
  light chain complementarity determining region 3 for antibody 49450
QKYRRAPRA

SEQ ID NO: 98900 - protein, 14 aa, Homo sapiens
  heavy chain complementarity determining region 3 for antibody 49450
ARSGAVYYYHGMDV

SEQ ID NO: 98901 - protein, 9 aa, Homo sapiens
  light chain complementarity determining region 3 for antibody 49451
QKYNTAPRT

SEQ ID NO: 98902 - protein, 22 aa, Homo sapiens
  heavy chain complementarity determining region 3 for antibody 49451
AKDLGEDGSSWYDGHYYYGMDV

SEQ ID NO: 98903 - protein, 9 aa, Homo sapiens
  light chain complementarity determining region 3 for antibody 49452
QKYNSVPGT

SEQ ID NO: 98904 - protein, 15 aa, Homo sapiens
  heavy chain complementarity determining region 3 for antibody 49452
ARMPDTSMTGSQFDS

SEQ ID NO: 98905 - protein, 9 aa, Homo sapiens
  light chain complementarity determining region 3 for antibody 49453
QKYNSVPFI

SEQ ID NO: 98906 - protein, 14 aa, Homo sapiens
  heavy chain complementarity determining region 3 for antibody 49453
AREIAGPGPQPLDY

SEQ ID NO: 98907 - protein, 9 aa, Homo sapiens
  light chain complementarity determining region 3 for antibody 49454
QKYNSVALT

SEQ ID NO: 98908 - protein, 16 aa, Homo sapiens
  heavy chain complementarity determining region 3 for antibody 49454
ARSKYGGRTRMLPFDL

SEQ ID NO: 98909 - protein, 9 aa, Homo sapiens
  light chain complementarity determining region 3 for antibody 49455
QKYNSDQFT

SEQ ID NO: 98910 - protein, 14 aa, Homo sapiens
  heavy chain complementarity determining region 3 for antibody 49455
AKVRGPPPTYAFNY

SEQ ID NO: 98911 - protein, 9 aa, Homo sapiens
  light chain complementarity determining region 3 for antibody 49456
QKYNSDPLT

SEQ ID NO: 98912 - protein, 14 aa, Homo sapiens
  heavy chain complementarity determining region 3 for antibody 49456
AKVRGPPPTYAFNY

SEQ ID NO: 98913 - protein, 9 aa, Homo sapiens
  light chain complementarity determining region 3 for antibody 49457
QKYNSDPFT

SEQ ID NO: 98914 - protein, 35 aa, Homo sapiens
  heavy chain complementarity determining region 3 for antibody 49457
SSSYLFPAMILIPAASTPGAREPWSPSPQYSAMDV

SEQ ID NO: 98915 - protein, 9 aa, Homo sapiens
  light chain complementarity determining region 3 for antibody 49458
QKYNSDPFT

SEQ ID NO: 98916 - protein, 14 aa, Homo sapiens
  heavy chain complementarity determining region 3 for antibody 49458
AKVGGPPPTYAFNY

SEQ ID NO: 98917 - protein, 9 aa, Homo sapiens
  light chain complementarity determining region 3 for antibody 49459
QKYNSAPRT

SEQ ID NO: 98918 - protein, 21 aa, Homo sapiens
  heavy chain complementarity determining region 3 for antibody 49459
ARRVTWRPCISGACHTWYFDL

SEQ ID NO: 98919 - protein, 10 aa, Homo sapiens
  light chain complementarity determining region 3 for antibody 49460
QKYNSAPPWP

SEQ ID NO: 98920 - protein, 15 aa, Homo sapiens
  heavy chain complementarity determining region 3 for antibody 49460
ASAPRITPRRGAFDL

SEQ ID NO: 98921 - protein, 10 aa, Homo sapiens
  light chain complementarity determining region 3 for antibody 49461
QKYNSAPPVT

SEQ ID NO: 98922 - protein, 16 aa, Homo sapiens
  heavy chain complementarity determining region 3 for antibody 49461
ARAWGGSGDHMYTLAS

SEQ ID NO: 98923 - protein, 13 aa, Homo sapiens
  light chain complementarity determining region 3 for antibody 49462
QKYNSAPMPPLYT

SEQ ID NO: 98924 - protein, 14 aa, Homo sapiens
  heavy chain complementarity determining region 3 for antibody 49462
ARRGYCAGGSCYDY

SEQ ID NO: 98925 - protein, 9 aa, Homo sapiens
  light chain complementarity determining region 3 for antibody 49463
QKYNSAPLT

SEQ ID NO: 98926 - protein, 15 aa, Homo sapiens
  heavy chain complementarity determining region 3 for antibody 49463
TTPRGPIEALWYFDL

SEQ ID NO: 98927 - protein, 9 aa, Homo sapiens
  light chain complementarity determining region 3 for antibody 49464
QKYNSAPIT

SEQ ID NO: 98928 - protein, 15 aa, Homo sapiens
  heavy chain complementarity determining region 3 for antibody 49464
ARDLGLGTYLRPPNF

SEQ ID NO: 98929 - protein, 9 aa, Homo sapiens
  light chain complementarity determining region 3 for antibody 49465
QKYNSAPGT

SEQ ID NO: 98930 - protein, 16 aa, Homo sapiens
  heavy chain complementarity determining region 3 for antibody 49465
ARVQWVRGLTRDGMDV

SEQ ID NO: 98931 - protein, 9 aa, Homo sapiens
  light chain complementarity determining region 3 for antibody 49466
QKYNSAPGT

SEQ ID NO: 98932 - protein, 20 aa, Homo sapiens
  heavy chain complementarity determining region 3 for antibody 49466
ARGPHIVVLTSIPWRWSLGL

SEQ ID NO: 98933 - protein, 9 aa, Homo sapiens
  light chain complementarity determining region 3 for antibody 49467
QKYNSAPFT

SEQ ID NO: 98934 - protein, 13 aa, Homo sapiens
  heavy chain complementarity determining region 3 for antibody 49467
ARSLTSTNPCLGV

SEQ ID NO: 98935 - protein, 9 aa, Homo sapiens
  light chain complementarity determining region 3 for antibody 49468
QKYNSAPFT

SEQ ID NO: 98936 - protein, 13 aa, Homo sapiens
  heavy chain complementarity determining region 3 for antibody 49468
ARAYPSWFGAFDI

SEQ ID NO: 98937 - protein, 9 aa, Homo sapiens
  light chain complementarity determining region 3 for antibody 49469
QKYNSALFT

SEQ ID NO: 98938 - protein, 16 aa, Homo sapiens
  heavy chain complementarity determining region 3 for antibody 49469
ARPPVAVVGTLVPLDY

SEQ ID NO: 98939 - protein, 9 aa, Homo sapiens
  light chain complementarity determining region 3 for antibody 49470
QKYNSAFRT

SEQ ID NO: 98940 - protein, 14 aa, Homo sapiens
  heavy chain complementarity determining region 3 for antibody 49470
ARYCVGDCDGALDH

SEQ ID NO: 98941 - protein, 8 aa, Homo sapiens
  light chain complementarity determining region 3 for antibody 49471
QKYNSAFP

SEQ ID NO: 98942 - protein, 18 aa, Homo sapiens
  heavy chain complementarity determining region 3 for antibody 49471
ARDLFSFYYNISYYEADC

SEQ ID NO: 98943 - protein, 9 aa, Homo sapiens
  light chain complementarity determining region 3 for antibody 49472
QKYNRSPWT

SEQ ID NO: 98944 - protein, 12 aa, Homo sapiens
  heavy chain complementarity determining region 3 for antibody 49472
ATRAGITAIPDY

SEQ ID NO: 98945 - protein, 9 aa, Homo sapiens
  light chain complementarity determining region 3 for antibody 49473
QKYNRAPLT

SEQ ID NO: 98946 - protein, 15 aa, Homo sapiens
  heavy chain complementarity determining region 3 for antibody 49473
ARDLGLGTYLRPPNF

SEQ ID NO: 98947 - protein, 9 aa, Homo sapiens
  light chain complementarity determining region 3 for antibody 49474
QKYNRAPFP

SEQ ID NO: 98948 - protein, 17 aa, Homo sapiens
  heavy chain complementarity determining region 3 for antibody 49474
ARGGAYYDSSGYDQFDY

SEQ ID NO: 98949 - protein, 9 aa, Homo sapiens
  light chain complementarity determining region 3 for antibody 49475
QKYNRAPFA

SEQ ID NO: 98950 - protein, 17 aa, Homo sapiens
  heavy chain complementarity determining region 3 for antibody 49475
ARGGAYYDSSGYDQFDY

SEQ ID NO: 98951 - protein, 9 aa, Homo sapiens
  light chain complementarity determining region 3 for antibody 49476
QKYNNAPGT

SEQ ID NO: 98952 - protein, 12 aa, Homo sapiens
  heavy chain complementarity determining region 3 for antibody 49476
AREEVAGTTIGP

SEQ ID NO: 98953 - protein, 9 aa, Homo sapiens
  light chain complementarity determining region 3 for antibody 49477
QKYNKAPLT

SEQ ID NO: 98954 - protein, 20 aa, Homo sapiens
  heavy chain complementarity determining region 3 for antibody 49477
ARGRYSRGWSNQYSYHALDV

SEQ ID NO: 98955 - protein, 9 aa, Homo sapiens
  light chain complementarity determining region 3 for antibody 49478
QKYNGAPWT

SEQ ID NO: 98956 - protein, 12 aa, Homo sapiens
  heavy chain complementarity determining region 3 for antibody 49478
ATRAGITAIPDY

SEQ ID NO: 98957 - protein, 9 aa, Homo sapiens
  light chain complementarity determining region 3 for antibody 49479
QKYNDHGVT

SEQ ID NO: 98958 - protein, 9 aa, Homo sapiens
  heavy chain complementarity determining region 3 for antibody 49479
ARGPIHFDY

SEQ ID NO: 98959 - protein, 9 aa, Homo sapiens
  light chain complementarity determining region 3 for antibody 49480
QKYNASSCT

SEQ ID NO: 98960 - protein, 16 aa, Homo sapiens
  heavy chain complementarity determining region 3 for antibody 49480
ASLGGAHYYGSGSHYF

SEQ ID NO: 98961 - protein, 9 aa, Homo sapiens
  light chain complementarity determining region 3 for antibody 49481
QKYKNAPIS

SEQ ID NO: 98962 - protein, 14 aa, Homo sapiens
  heavy chain complementarity determining region 3 for antibody 49481
ARPMSRNWNYPYEY

SEQ ID NO: 98963 - protein, 11 aa, Homo sapiens
  light chain complementarity determining region 3 for antibody 49482
QKYHSAPPSFT

SEQ ID NO: 98964 - protein, 18 aa, Homo sapiens
  heavy chain complementarity determining region 3 for antibody 49482
AREGYDSSGHYATRAFDI

SEQ ID NO: 98965 - protein, 9 aa, Homo sapiens
  light chain complementarity determining region 3 for antibody 49483
QKYGSSPQT

SEQ ID NO: 98966 - protein, 12 aa, Homo sapiens
  heavy chain complementarity determining region 3 for antibody 49483
ARNGYSSSWYRN

SEQ ID NO: 98967 - protein, 10 aa, Homo sapiens
  light chain complementarity determining region 3 for antibody 49484
QKYGSSPPVT

SEQ ID NO: 98968 - protein, 19 aa, Homo sapiens
  heavy chain complementarity determining region 3 for antibody 49484
VRDNYDYWSGRPSAGYFDY

SEQ ID NO: 98969 - protein, 9 aa, Homo sapiens
  light chain complementarity determining region 3 for antibody 49485
QKYGSSPLT

SEQ ID NO: 98970 - protein, 19 aa, Homo sapiens
  heavy chain complementarity determining region 3 for antibody 49485
ATVSTYPSGSLGILGTFDF

SEQ ID NO: 98971 - protein, 10 aa, Homo sapiens
  light chain complementarity determining region 3 for antibody 49486
QKYGSLPRWT

SEQ ID NO: 98972 - protein, 12 aa, Homo sapiens
  heavy chain complementarity determining region 3 for antibody 49486
TRDRFSDDFRDY

SEQ ID NO: 98973 - protein, 10 aa, Homo sapiens
  light chain complementarity determining region 3 for antibody 49487
QKYGPSPPWT

SEQ ID NO: 98974 - protein, 14 aa, Homo sapiens
  heavy chain complementarity determining region 3 for antibody 49487
ARGGTSGRYHQFDY

SEQ ID NO: 98975 - protein, 10 aa, Homo sapiens
  light chain complementarity determining region 3 for antibody 49488
QKYGPSPPGT

SEQ ID NO: 98976 - protein, 14 aa, Homo sapiens
  heavy chain complementarity determining region 3 for antibody 49488
ARGGTSGQYHQFDY

SEQ ID NO: 98977 - protein, 10 aa, Homo sapiens
  light chain complementarity determining region 3 for antibody 49489
QKYGGSPLYT

SEQ ID NO: 98978 - protein, 18 aa, Homo sapiens
  heavy chain complementarity determining region 3 for antibody 49489
ARDHGTALRTSNLRAFDI

SEQ ID NO: 98979 - protein, 9 aa, Homo sapiens
  light chain complementarity determining region 3 for antibody 49490
QKYDTYPWT

SEQ ID NO: 98980 - protein, 11 aa, Homo sapiens
  heavy chain complementarity determining region 3 for antibody 49490
ASAVVAQGFYY

SEQ ID NO: 98981 - protein, 9 aa, Homo sapiens
  light chain complementarity determining region 3 for antibody 49491
QKYDSPPWT

SEQ ID NO: 98982 - protein, 15 aa, Homo sapiens
  heavy chain complementarity determining region 3 for antibody 49491
AREEGIPYAIRHLDC

SEQ ID NO: 98983 - protein, 9 aa, Homo sapiens
  light chain complementarity determining region 3 for antibody 49492
QKYDSAPLT

SEQ ID NO: 98984 - protein, 8 aa, Homo sapiens
  heavy chain complementarity determining region 3 for antibody 49492
TTYGSSHP

SEQ ID NO: 98985 - protein, 9 aa, Homo sapiens
  light chain complementarity determining region 3 for antibody 49493
QKYDSAPGT

SEQ ID NO: 98986 - protein, 15 aa, Homo sapiens
  heavy chain complementarity determining region 3 for antibody 49493
ARAYCTDTNCYGFDY

SEQ ID NO: 98987 - protein, 9 aa, Homo sapiens
  light chain complementarity determining region 3 for antibody 49494
QKYDGAPWT

SEQ ID NO: 98988 - protein, 10 aa, Homo sapiens
  heavy chain complementarity determining region 3 for antibody 49494
STRGTTTSYY

SEQ ID NO: 98989 - protein, 9 aa, Homo sapiens
  light chain complementarity determining region 3 for antibody 49495
QKYDGAPGT

SEQ ID NO: 98990 - protein, 10 aa, Homo sapiens
  heavy chain complementarity determining region 3 for antibody 49495
STRGTTTSYY

SEQ ID NO: 98991 - protein, 8 aa, Homo sapiens
  light chain complementarity determining region 3 for antibody 49496
QKYASSYT

SEQ ID NO: 98992 - protein, 19 aa, Homo sapiens
  heavy chain complementarity determining region 3 for antibody 49496
ARHDRNIPAISGTMGHFDY

SEQ ID NO: 98993 - protein, 9 aa, Homo sapiens
  light chain complementarity determining region 3 for antibody 49497
QKYASAPQT

SEQ ID NO: 98994 - protein, 13 aa, Homo sapiens
  heavy chain complementarity determining region 3 for antibody 49497
AREGQWLGEAFDL

SEQ ID NO: 98995 - protein, 8 aa, Homo sapiens
  light chain complementarity determining region 3 for antibody 49498
QKYAFSLT

SEQ ID NO: 98996 - protein, 15 aa, Homo sapiens
  heavy chain complementarity determining region 3 for antibody 49498
ARDAYTSSGTGYLDP

SEQ ID NO: 98997 - protein, 9 aa, Homo sapiens
  light chain complementarity determining region 3 for antibody 49499
QKSNNAPLT

SEQ ID NO: 98998 - protein, 12 aa, Homo sapiens
  heavy chain complementarity determining region 3 for antibody 49499
ANGAMATITFDY

SEQ ID NO: 98999 - protein, 9 aa, Homo sapiens
  light chain complementarity determining region 3 for antibody 49500
QKSFSSPLT

SEQ ID NO: 99000 - protein, 20 aa, Homo sapiens
  heavy chain complementarity determining region 3 for antibody 49500
VRGDYVWGSYRYPGRYYFDF

SEQ ID NO: 99001 - protein, 9 aa, Homo sapiens
  light chain complementarity determining region 3 for antibody 49501
QKSDTLPLT

SEQ ID NO: 99002 - protein, 22 aa, Homo sapiens
  heavy chain complementarity determining region 3 for antibody 49501
ARSKGALVGATYVSPRGNCFDS

SEQ ID NO: 99003 - protein, 9 aa, Homo sapiens
  light chain complementarity determining region 3 for antibody 49502
QKRSNWPLT

SEQ ID NO: 99004 - protein, 14 aa, Homo sapiens
  heavy chain complementarity determining region 3 for antibody 49502
ARHGAAGRIAWFDP

SEQ ID NO: 99005 - protein, 9 aa, Homo sapiens
  light chain complementarity determining region 3 for antibody 49503
QKNNTAPFT

SEQ ID NO: 99006 - protein, 19 aa, Homo sapiens
  heavy chain complementarity determining region 3 for antibody 49503
ASAMYYYDSSGRYYGGGDY

SEQ ID NO: 99007 - protein, 9 aa, Homo sapiens
  light chain complementarity determining region 3 for antibody 49504
QKNNSAPVT

SEQ ID NO: 99008 - protein, 15 aa, Homo sapiens
  heavy chain complementarity determining region 3 for antibody 49504
AKNSHDGIGSYFFDY

SEQ ID NO: 99009 - protein, 9 aa, Homo sapiens
  light chain complementarity determining region 3 for antibody 49505
QKNNSAPLT

SEQ ID NO: 99010 - protein, 18 aa, Homo sapiens
  heavy chain complementarity determining region 3 for antibody 49505
ARESLMGYGYSDYYAMDV

SEQ ID NO: 99011 - protein, 9 aa, Homo sapiens
  light chain complementarity determining region 3 for antibody 49506
QKNNSAPIT

SEQ ID NO: 99012 - protein, 21 aa, Homo sapiens
  heavy chain complementarity determining region 3 for antibody 49506
AQHGRNMVRGIPLGMKFYFQY

SEQ ID NO: 99013 - protein, 10 aa, Homo sapiens
  light chain complementarity determining region 3 for antibody 49507
QKNNRAPLWT

SEQ ID NO: 99014 - protein, 13 aa, Homo sapiens
  heavy chain complementarity determining region 3 for antibody 49507
ASEIWDYGGNFDF

SEQ ID NO: 99015 - protein, 9 aa, Homo sapiens
  light chain complementarity determining region 3 for antibody 49508
QKNNNAPLT

SEQ ID NO: 99016 - protein, 12 aa, Homo sapiens
  heavy chain complementarity determining region 3 for antibody 49508
ANGAMATITFDY

SEQ ID NO: 99017 - protein, 9 aa, Homo sapiens
  light chain complementarity determining region 3 for antibody 49509
QKNDSAPLT

SEQ ID NO: 99018 - protein, 16 aa, Homo sapiens
  heavy chain complementarity determining region 3 for antibody 49509
AITYHDILTGSGWFDP

SEQ ID NO: 99019 - protein, 9 aa, Homo sapiens
  light chain complementarity determining region 3 for antibody 49510
QKLNSYPRT

SEQ ID NO: 99020 - protein, 13 aa, Homo sapiens
  heavy chain complementarity determining region 3 for antibody 49510
ARGRSRDRHPFDT

SEQ ID NO: 99021 - protein, 9 aa, Homo sapiens
  light chain complementarity determining region 3 for antibody 49511
QKHNSVPLT

SEQ ID NO: 99022 - protein, 14 aa, Homo sapiens
  heavy chain complementarity determining region 3 for antibody 49511
VRTYYHDTSGPFDY

SEQ ID NO: 99023 - protein, 9 aa, Homo sapiens
  light chain complementarity determining region 3 for antibody 49512
QKHDRAPLT

SEQ ID NO: 99024 - protein, 10 aa, Homo sapiens
  heavy chain complementarity determining region 3 for antibody 49512
ARDEGYFGTS

SEQ ID NO: 99025 - protein, 9 aa, Homo sapiens
  light chain complementarity determining region 3 for antibody 49513
QKGNSLPVT

SEQ ID NO: 99026 - protein, 15 aa, Homo sapiens
  heavy chain complementarity determining region 3 for antibody 49513
AREAFDSGGRYRADY

SEQ ID NO: 99027 - protein, 9 aa, Homo sapiens
  light chain complementarity determining region 3 for antibody 49514
QKFDSFPLT

SEQ ID NO: 99028 - protein, 15 aa, Homo sapiens
  heavy chain complementarity determining region 3 for antibody 49514
ATYGYLNSWFQAFDT

SEQ ID NO: 99029 - protein, 10 aa, Homo sapiens
  light chain complementarity determining region 3 for antibody 49515
QKDNSGPPIT

SEQ ID NO: 99030 - protein, 14 aa, Homo sapiens
  heavy chain complementarity determining region 3 for antibody 49515
ARDQTRVGPTTFDF

SEQ ID NO: 99031 - protein, 9 aa, Homo sapiens
  light chain complementarity determining region 3 for antibody 49516
QKDNSAPPT

SEQ ID NO: 99032 - protein, 20 aa, Homo sapiens
  heavy chain complementarity determining region 3 for antibody 49516
VRDGYSDNWFFLHRPNYFDN

SEQ ID NO: 99033 - protein, 9 aa, Homo sapiens
  light chain complementarity determining region 3 for antibody 49517
QKDNSAPFT

SEQ ID NO: 99034 - protein, 11 aa, Homo sapiens
  heavy chain complementarity determining region 3 for antibody 49517
VRDQNWGAFDP

SEQ ID NO: 99035 - protein, 9 aa, Homo sapiens
  light chain complementarity determining region 3 for antibody 49518
QKDNRAPLT

SEQ ID NO: 99036 - protein, 17 aa, Homo sapiens
  heavy chain complementarity determining region 3 for antibody 49518
ARGGAYYDSSGYDQFDY

SEQ ID NO: 99037 - protein, 11 aa, Homo sapiens
  light chain complementarity determining region 3 for antibody 49519
QKDHSAPPSFT

SEQ ID NO: 99038 - protein, 18 aa, Homo sapiens
  heavy chain complementarity determining region 3 for antibody 49519
AREGYDSSGHYATRAFDI

SEQ ID NO: 99039 - protein, 9 aa, Homo sapiens
  light chain complementarity determining region 3 for antibody 49520
QKDDSARLA

SEQ ID NO: 99040 - protein, 13 aa, Homo sapiens
  heavy chain complementarity determining region 3 for antibody 49520
AIDFVRGWYVFDF

SEQ ID NO: 99041 - protein, 9 aa, Homo sapiens
  light chain complementarity determining region 3 for antibody 49521
QHYYSTPVT

SEQ ID NO: 99042 - protein, 18 aa, Homo sapiens
  heavy chain complementarity determining region 3 for antibody 49521
ARERLSVPWFGELPHFDH

SEQ ID NO: 99043 - protein, 10 aa, Homo sapiens
  light chain complementarity determining region 3 for antibody 49522
QHYYSTLSFT

SEQ ID NO: 99044 - protein, 20 aa, Homo sapiens
  heavy chain complementarity determining region 3 for antibody 49522
ARRAVLPDYNDYSGLYGMDV

SEQ ID NO: 99045 - protein, 9 aa, Homo sapiens
  light chain complementarity determining region 3 for antibody 49523
QHYYSQIRS

SEQ ID NO: 99046 - protein, 13 aa, Homo sapiens
  heavy chain complementarity determining region 3 for antibody 49523
AGEYFYDSSGYEY

SEQ ID NO: 99047 - protein, 9 aa, Homo sapiens
  light chain complementarity determining region 3 for antibody 49524
QHYYRTPYT

SEQ ID NO: 99048 - protein, 11 aa, Homo sapiens
  heavy chain complementarity determining region 3 for antibody 49524
ARNTMTAYIDY

SEQ ID NO: 99049 - protein, 9 aa, Homo sapiens
  light chain complementarity determining region 3 for antibody 49525
QHYYRTPYT

SEQ ID NO: 99050 - protein, 11 aa, Homo sapiens
  heavy chain complementarity determining region 3 for antibody 49525
ARNTLMAYIDY

SEQ ID NO: 99051 - protein, 10 aa, Homo sapiens
  light chain complementarity determining region 3 for antibody 49526
QHYYNLPPYS

SEQ ID NO: 99052 - protein, 19 aa, Homo sapiens
  heavy chain complementarity determining region 3 for antibody 49526
ARIPASVDRGTYYTVPLDY

SEQ ID NO: 99053 - protein, 10 aa, Homo sapiens
  light chain complementarity determining region 3 for antibody 49527
QHYYNLPPYS

SEQ ID NO: 99054 - protein, 19 aa, Homo sapiens
  heavy chain complementarity determining region 3 for antibody 49527
AGITASVDRGTYYTVPLDY

SEQ ID NO: 99055 - protein, 9 aa, Homo sapiens
  light chain complementarity determining region 3 for antibody 49528
QHYYGTPRT

SEQ ID NO: 99056 - protein, 13 aa, Homo sapiens
  heavy chain complementarity determining region 3 for antibody 49528
ARGGRGIGGYPDS

SEQ ID NO: 99057 - protein, 11 aa, Homo sapiens
  light chain complementarity determining region 3 for antibody 49529
QHYTNWPPMWT

SEQ ID NO: 99058 - protein, 19 aa, Homo sapiens
  heavy chain complementarity determining region 3 for antibody 49529
ARTANLPYCTATSCPQADV

SEQ ID NO: 99059 - protein, 9 aa, Homo sapiens
  light chain complementarity determining region 3 for antibody 49530
QHYTGAPLT

SEQ ID NO: 99060 - protein, 11 aa, Homo sapiens
  heavy chain complementarity determining region 3 for antibody 49530
ARRGVTPALDI

SEQ ID NO: 99061 - protein, 11 aa, Homo sapiens
  light chain complementarity determining region 3 for antibody 49531
QHYSSYGSTWT

SEQ ID NO: 99062 - protein, 13 aa, Homo sapiens
  heavy chain complementarity determining region 3 for antibody 49531
ARGGVGGLDAFHV

SEQ ID NO: 99063 - protein, 9 aa, Homo sapiens
  light chain complementarity determining region 3 for antibody 49532
QHYSSSPRT

SEQ ID NO: 99064 - protein, 14 aa, Homo sapiens
  heavy chain complementarity determining region 3 for antibody 49532
ARDSFGPEVVVDDY

SEQ ID NO: 99065 - protein, 9 aa, Homo sapiens
  light chain complementarity determining region 3 for antibody 49533
QHYSSFPFT

SEQ ID NO: 99066 - protein, 11 aa, Homo sapiens
  heavy chain complementarity determining region 3 for antibody 49533
ARGEDYDAQGY

SEQ ID NO: 99067 - protein, 9 aa, Homo sapiens
  light chain complementarity determining region 3 for antibody 49534
QHYSNSPRT

SEQ ID NO: 99068 - protein, 15 aa, Homo sapiens
  heavy chain complementarity determining region 3 for antibody 49534
AGDLAGSRQGGWFDP

SEQ ID NO: 99069 - protein, 9 aa, Homo sapiens
  light chain complementarity determining region 3 for antibody 49535
QHYSGSLWT

SEQ ID NO: 99070 - protein, 21 aa, Homo sapiens
  heavy chain complementarity determining region 3 for antibody 49535
ARADIVVVTGTSAFEADGFDI

SEQ ID NO: 99071 - protein, 11 aa, Homo sapiens
  light chain complementarity determining region 3 for antibody 49536
QHYSDSPPEST

SEQ ID NO: 99072 - protein, 13 aa, Homo sapiens
  heavy chain complementarity determining region 3 for antibody 49536
ARESGPNSRGFDF

SEQ ID NO: 99073 - protein, 11 aa, Homo sapiens
  light chain complementarity determining region 3 for antibody 49537
QHYSDSPPENT

SEQ ID NO: 99074 - protein, 13 aa, Homo sapiens
  heavy chain complementarity determining region 3 for antibody 49537
ARESGPNSRGFDF

SEQ ID NO: 99075 - protein, 9 aa, Homo sapiens
  light chain complementarity determining region 3 for antibody 49538
QHYNVAPWT

SEQ ID NO: 99076 - protein, 12 aa, Homo sapiens
  heavy chain complementarity determining region 3 for antibody 49538
AMLLEGMGGVGA

SEQ ID NO: 99077 - protein, 11 aa, Homo sapiens
  light chain complementarity determining region 3 for antibody 49539
QHYNTYSPAGT

SEQ ID NO: 99078 - protein, 22 aa, Homo sapiens
  heavy chain complementarity determining region 3 for antibody 49539
ARASLQYYYDTSGYYHGDAFDI

SEQ ID NO: 99079 - protein, 9 aa, Homo sapiens
  light chain complementarity determining region 3 for antibody 49540
QHYNTYFPT

SEQ ID NO: 99080 - protein, 15 aa, Homo sapiens
  heavy chain complementarity determining region 3 for antibody 49540
ASGSDTSSWIGPSDY

SEQ ID NO: 99081 - protein, 9 aa, Homo sapiens
  light chain complementarity determining region 3 for antibody 49541
QHYNSYSYT

SEQ ID NO: 99082 - protein, 15 aa, Homo sapiens
  heavy chain complementarity determining region 3 for antibody 49541
AKDFRYYGLVPAFDY

SEQ ID NO: 99083 - protein, 9 aa, Homo sapiens
  light chain complementarity determining region 3 for antibody 49542
QHYNSYSRT

SEQ ID NO: 99084 - protein, 16 aa, Homo sapiens
  heavy chain complementarity determining region 3 for antibody 49542
AAGVGMGRGITTTFDY

SEQ ID NO: 99085 - protein, 9 aa, Homo sapiens
  light chain complementarity determining region 3 for antibody 49543
QHYNSYPPP

SEQ ID NO: 99086 - protein, 10 aa, Homo sapiens
  heavy chain complementarity determining region 3 for antibody 49543
SKDTDYVIDY

SEQ ID NO: 99087 - protein, 10 aa, Homo sapiens
  light chain complementarity determining region 3 for antibody 49544
QHYNSNSIYT

SEQ ID NO: 99088 - protein, 16 aa, Homo sapiens
  heavy chain complementarity determining region 3 for antibody 49544
AREGEGAYGEDEYFQH

SEQ ID NO: 99089 - protein, 9 aa, Homo sapiens
  light chain complementarity determining region 3 for antibody 49545
QHYNNYLRR

SEQ ID NO: 99090 - protein, 10 aa, Homo sapiens
  heavy chain complementarity determining region 3 for antibody 49545
ASGRGGFDSD

SEQ ID NO: 99091 - protein, 9 aa, Homo sapiens
  light chain complementarity determining region 3 for antibody 49546
QHYNHFSLT

SEQ ID NO: 99092 - protein, 16 aa, Homo sapiens
  heavy chain complementarity determining region 3 for antibody 49546
ARDHRTKSWPPRAFDI

SEQ ID NO: 99093 - protein, 9 aa, Homo sapiens
  light chain complementarity determining region 3 for antibody 49547
QHYNGYPYT

SEQ ID NO: 99094 - protein, 18 aa, Homo sapiens
  heavy chain complementarity determining region 3 for antibody 49547
ARRPPSISVTGLDDSFDM

SEQ ID NO: 99095 - protein, 9 aa, Homo sapiens
  light chain complementarity determining region 3 for antibody 49548
QHYKTYPYT

SEQ ID NO: 99096 - protein, 18 aa, Homo sapiens
  heavy chain complementarity determining region 3 for antibody 49548
AKANWEFQVFAGAVWFDL

SEQ ID NO: 99097 - protein, 9 aa, Homo sapiens
  light chain complementarity determining region 3 for antibody 49549
QHYIPPSWP

SEQ ID NO: 99098 - protein, 12 aa, Homo sapiens
  heavy chain complementarity determining region 3 for antibody 49549
AIYLAGMGGVGP

SEQ ID NO: 99099 - protein, 9 aa, Homo sapiens
  light chain complementarity determining region 3 for antibody 49550
QHYIASPLT

SEQ ID NO: 99100 - protein, 11 aa, Homo sapiens
  heavy chain complementarity determining region 3 for antibody 49550
VKDRGAIMGDF

SEQ ID NO: 99101 - protein, 8 aa, Homo sapiens
  light chain complementarity determining region 3 for antibody 49551
QHYHFHWT

SEQ ID NO: 99102 - protein, 11 aa, Homo sapiens
  heavy chain complementarity determining region 3 for antibody 49551
ASRDVVETRPF

SEQ ID NO: 99103 - protein, 9 aa, Homo sapiens
  light chain complementarity determining region 3 for antibody 49552
QHYGTYSPT

SEQ ID NO: 99104 - protein, 14 aa, Homo sapiens
  heavy chain complementarity determining region 3 for antibody 49552
ATSRTGEAVGLFDH

SEQ ID NO: 99105 - protein, 8 aa, Homo sapiens
  light chain complementarity determining region 3 for antibody 49553
QHYGTSWP

SEQ ID NO: 99106 - protein, 17 aa, Homo sapiens
  heavy chain complementarity determining region 3 for antibody 49553
ARDPGGGLGDNYHFFDY

SEQ ID NO: 99107 - protein, 11 aa, Homo sapiens
  light chain complementarity determining region 3 for antibody 49554
QHYGTSPPSSP

SEQ ID NO: 99108 - protein, 15 aa, Homo sapiens
  heavy chain complementarity determining region 3 for antibody 49554
AREVTSMIEPGGLDI

SEQ ID NO: 99109 - protein, 11 aa, Homo sapiens
  light chain complementarity determining region 3 for antibody 49555
QHYGTSPPAHT

SEQ ID NO: 99110 - protein, 15 aa, Homo sapiens
  heavy chain complementarity determining region 3 for antibody 49555
AREVTSMIEPGGLDI

SEQ ID NO: 99111 - protein, 11 aa, Homo sapiens
  light chain complementarity determining region 3 for antibody 49556
QHYGTSPPADT

SEQ ID NO: 99112 - protein, 15 aa, Homo sapiens
  heavy chain complementarity determining region 3 for antibody 49556
AREVTSMIEPGGLDI

SEQ ID NO: 99113 - protein, 9 aa, Homo sapiens
  light chain complementarity determining region 3 for antibody 49557
QHYGTPPRT

SEQ ID NO: 99114 - protein, 14 aa, Homo sapiens
  heavy chain complementarity determining region 3 for antibody 49557
AKDPSDDGGGYFDS

SEQ ID NO: 99115 - protein, 11 aa, Homo sapiens
  light chain complementarity determining region 3 for antibody 49558
QHYGTPPPAYP

SEQ ID NO: 99116 - protein, 15 aa, Homo sapiens
  heavy chain complementarity determining region 3 for antibody 49558
AREVTSMIEPGGLDI

SEQ ID NO: 99117 - protein, 9 aa, Homo sapiens
  light chain complementarity determining region 3 for antibody 49559
QHYGTKPET

SEQ ID NO: 99118 - protein, 14 aa, Homo sapiens
  heavy chain complementarity determining region 3 for antibody 49559
ARDLLGGVKDPFDI

SEQ ID NO: 99119 - protein, 9 aa, Homo sapiens
  light chain complementarity determining region 3 for antibody 49560
QHYGSSTLT

SEQ ID NO: 99120 - protein, 19 aa, Homo sapiens
  heavy chain complementarity determining region 3 for antibody 49560
ARGPSVIAPRVQDHWYFDL

SEQ ID NO: 99121 - protein, 9 aa, Homo sapiens
  light chain complementarity determining region 3 for antibody 49561
QHYGSSQYP

SEQ ID NO: 99122 - protein, 20 aa, Homo sapiens
  heavy chain complementarity determining region 3 for antibody 49561
ARFRTGDSSDSNPYFYAMDV

SEQ ID NO: 99123 - protein, 9 aa, Homo sapiens
  light chain complementarity determining region 3 for antibody 49562
QHYGSSQFN

SEQ ID NO: 99124 - protein, 21 aa, Homo sapiens
  heavy chain complementarity determining region 3 for antibody 49562
ARDMGGRRDSSGYYLVGYFDY

SEQ ID NO: 99125 - protein, 9 aa, Homo sapiens
  light chain complementarity determining region 3 for antibody 49563
QHYGSSPRP

SEQ ID NO: 99126 - protein, 14 aa, Homo sapiens
  heavy chain complementarity determining region 3 for antibody 49563
VRGIAVAGLGYFDY

SEQ ID NO: 99127 - protein, 10 aa, Homo sapiens
  light chain complementarity determining region 3 for antibody 49564
QHYGSSPPLT

SEQ ID NO: 99128 - protein, 12 aa, Homo sapiens
  heavy chain complementarity determining region 3 for antibody 49564
ARHGIEVPGLDS

SEQ ID NO: 99129 - protein, 9 aa, Homo sapiens
  light chain complementarity determining region 3 for antibody 49565
QHYGSSPNN

SEQ ID NO: 99130 - protein, 21 aa, Homo sapiens
  heavy chain complementarity determining region 3 for antibody 49565
AHSADDLSEVVTEARFDPYDV

SEQ ID NO: 99131 - protein, 10 aa, Homo sapiens
  light chain complementarity determining region 3 for antibody 49566
QHYGSSPMNT

SEQ ID NO: 99132 - protein, 11 aa, Homo sapiens
  heavy chain complementarity determining region 3 for antibody 49566
ARLQEGDSEDY

SEQ ID NO: 99133 - protein, 9 aa, Homo sapiens
  light chain complementarity determining region 3 for antibody 49567
QHYGSSPLP

SEQ ID NO: 99134 - protein, 19 aa, Homo sapiens
  heavy chain complementarity determining region 3 for antibody 49567
ARGPSVIAPRVQDHWYFDL

SEQ ID NO: 99135 - protein, 10 aa, Homo sapiens
  light chain complementarity determining region 3 for antibody 49568
QHYGSSPAWR

SEQ ID NO: 99136 - protein, 12 aa, Homo sapiens
  heavy chain complementarity determining region 3 for antibody 49568
ARAQTTVTTADF

SEQ ID NO: 99137 - protein, 10 aa, Homo sapiens
  light chain complementarity determining region 3 for antibody 49569
QHYGSSLMYS

SEQ ID NO: 99138 - protein, 14 aa, Homo sapiens
  heavy chain complementarity determining region 3 for antibody 49569
TTDRPHTGMVTFDY

SEQ ID NO: 99139 - protein, 9 aa, Homo sapiens
  light chain complementarity determining region 3 for antibody 49570
QHYGSSHFT

SEQ ID NO: 99140 - protein, 21 aa, Homo sapiens
  heavy chain complementarity determining region 3 for antibody 49570
ARDMGGRRDSSGYYLVGYFDY

SEQ ID NO: 99141 - protein, 10 aa, Homo sapiens
  light chain complementarity determining region 3 for antibody 49571
QHYGSRSPIT

SEQ ID NO: 99142 - protein, 12 aa, Homo sapiens
  heavy chain complementarity determining region 3 for antibody 49571
ARPQGAGDRIDY

SEQ ID NO: 99143 - protein, 10 aa, Homo sapiens
  light chain complementarity determining region 3 for antibody 49572
QHYGSPPPVT

SEQ ID NO: 99144 - protein, 10 aa, Homo sapiens
  heavy chain complementarity determining region 3 for antibody 49572
GRDSDGQWLL

SEQ ID NO: 99145 - protein, 10 aa, Homo sapiens
  light chain complementarity determining region 3 for antibody 49573
QHYGSPPPLR

SEQ ID NO: 99146 - protein, 14 aa, Homo sapiens
  heavy chain complementarity determining region 3 for antibody 49573
ARGGISSYYHHFDS

SEQ ID NO: 99147 - protein, 9 aa, Homo sapiens
  light chain complementarity determining region 3 for antibody 49574
QHYGSPPIT

SEQ ID NO: 99148 - protein, 16 aa, Homo sapiens
  heavy chain complementarity determining region 3 for antibody 49574
ATGSSKGLLIRATFDY

SEQ ID NO: 99149 - protein, 9 aa, Homo sapiens
  light chain complementarity determining region 3 for antibody 49575
QHYGRSPYT

SEQ ID NO: 99150 - protein, 13 aa, Homo sapiens
  heavy chain complementarity determining region 3 for antibody 49575
ARRRIAAARDFMN

SEQ ID NO: 99151 - protein, 10 aa, Homo sapiens
  light chain complementarity determining region 3 for antibody 49576
QHYGRSPPGT

SEQ ID NO: 99152 - protein, 15 aa, Homo sapiens
  heavy chain complementarity determining region 3 for antibody 49576
ARGGRHRERAAAADL

SEQ ID NO: 99153 - protein, 9 aa, Homo sapiens
  light chain complementarity determining region 3 for antibody 49577
QHYGRSPLT

SEQ ID NO: 99154 - protein, 22 aa, Homo sapiens
  heavy chain complementarity determining region 3 for antibody 49577
ARWGGHCSQINCFPGAILPLDF

SEQ ID NO: 99155 - protein, 9 aa, Homo sapiens
  light chain complementarity determining region 3 for antibody 49578
QHYGPSPLT

SEQ ID NO: 99156 - protein, 16 aa, Homo sapiens
  heavy chain complementarity determining region 3 for antibody 49578
ASPVPTSWAVHDAFDI

SEQ ID NO: 99157 - protein, 10 aa, Homo sapiens
  light chain complementarity determining region 3 for antibody 49579
QHYGNSPQWT

SEQ ID NO: 99158 - protein, 16 aa, Homo sapiens
  heavy chain complementarity determining region 3 for antibody 49579
AKDRGSWGNFFGSGDY

SEQ ID NO: 99159 - protein, 9 aa, Homo sapiens
  light chain complementarity determining region 3 for antibody 49580
QHYGNSLLT

SEQ ID NO: 99160 - protein, 10 aa, Homo sapiens
  heavy chain complementarity determining region 3 for antibody 49580
ARDPFEYFDY

SEQ ID NO: 99161 - protein, 9 aa, Homo sapiens
  light chain complementarity determining region 3 for antibody 49581
QHYGNPLWA

SEQ ID NO: 99162 - protein, 17 aa, Homo sapiens
  heavy chain complementarity determining region 3 for antibody 49581
ARDGYCSSTSCYDPSDH

SEQ ID NO: 99163 - protein, 10 aa, Homo sapiens
  light chain complementarity determining region 3 for antibody 49582
QHYGNLLMFP

SEQ ID NO: 99164 - protein, 21 aa, Homo sapiens
  heavy chain complementarity determining region 3 for antibody 49582
ARWRGPTASTMRGVGYYGMDV

SEQ ID NO: 99165 - protein, 9 aa, Homo sapiens
  light chain complementarity determining region 3 for antibody 49583
QHYGNFLPT

SEQ ID NO: 99166 - protein, 12 aa, Homo sapiens
  heavy chain complementarity determining region 3 for antibody 49583
AIMGPPTPRESH

SEQ ID NO: 99167 - protein, 8 aa, Homo sapiens
  light chain complementarity determining region 3 for antibody 49584
QHYGMSVT

SEQ ID NO: 99168 - protein, 17 aa, Homo sapiens
  heavy chain complementarity determining region 3 for antibody 49584
ARHAHDSDMSGFYPFEH

SEQ ID NO: 99169 - protein, 10 aa, Homo sapiens
  light chain complementarity determining region 3 for antibody 49585
QHYGISLMYT

SEQ ID NO: 99170 - protein, 14 aa, Homo sapiens
  heavy chain complementarity determining region 3 for antibody 49585
TTDRPHTGMVTFDY

SEQ ID NO: 99171 - protein, 9 aa, Homo sapiens
  light chain complementarity determining region 3 for antibody 49586
QHYGGSPYT

SEQ ID NO: 99172 - protein, 17 aa, Homo sapiens
  heavy chain complementarity determining region 3 for antibody 49586
ARVDLSEQWLVRWYFDL

SEQ ID NO: 99173 - protein, 9 aa, Homo sapiens
  light chain complementarity determining region 3 for antibody 49587
QHYGGSPSP

SEQ ID NO: 99174 - protein, 17 aa, Homo sapiens
  heavy chain complementarity determining region 3 for antibody 49587
ARVDLSEQWLVLWYFDL

SEQ ID NO: 99175 - protein, 10 aa, Homo sapiens
  light chain complementarity determining region 3 for antibody 49588
QHYGGSPLVT

SEQ ID NO: 99176 - protein, 14 aa, Homo sapiens
  heavy chain complementarity determining region 3 for antibody 49588
ARDAITGSPDYFDY

SEQ ID NO: 99177 - protein, 9 aa, Homo sapiens
  light chain complementarity determining region 3 for antibody 49589
QHYGGSPHT

SEQ ID NO: 99178 - protein, 17 aa, Homo sapiens
  heavy chain complementarity determining region 3 for antibody 49589
ARVDLSEQWLVLWYFDL

SEQ ID NO: 99179 - protein, 9 aa, Homo sapiens
  light chain complementarity determining region 3 for antibody 49590
QHYGGSPDT

SEQ ID NO: 99180 - protein, 17 aa, Homo sapiens
  heavy chain complementarity determining region 3 for antibody 49590
ARVDLSEQWLVLWYFDL

SEQ ID NO: 99181 - protein, 9 aa, Homo sapiens
  light chain complementarity determining region 3 for antibody 49591
QHYGGSLGT

SEQ ID NO: 99182 - protein, 15 aa, Homo sapiens
  heavy chain complementarity determining region 3 for antibody 49591
ARESGYSYGLSAFDI

SEQ ID NO: 99183 - protein, 9 aa, Homo sapiens
  light chain complementarity determining region 3 for antibody 49592
QHYGDFLLT

SEQ ID NO: 99184 - protein, 12 aa, Homo sapiens
  heavy chain complementarity determining region 3 for antibody 49592
AIMGPPTPRESH

SEQ ID NO: 99185 - protein, 9 aa, Homo sapiens
  light chain complementarity determining region 3 for antibody 49593
QHYGCSPYT

SEQ ID NO: 99186 - protein, 17 aa, Homo sapiens
  heavy chain complementarity determining region 3 for antibody 49593
ARVDLSEQWLVLWYFDL

SEQ ID NO: 99187 - protein, 10 aa, Homo sapiens
  light chain complementarity determining region 3 for antibody 49594
QHYGASSELT

SEQ ID NO: 99188 - protein, 11 aa, Homo sapiens
  heavy chain complementarity determining region 3 for antibody 49594
ARRRGVDVTDS

SEQ ID NO: 99189 - protein, 9 aa, Homo sapiens
  light chain complementarity determining region 3 for antibody 49595
QHYFNSPRT

SEQ ID NO: 99190 - protein, 15 aa, Homo sapiens
  heavy chain complementarity determining region 3 for antibody 49595
TREMNRYYYDSGDGY

SEQ ID NO: 99191 - protein, 9 aa, Homo sapiens
  light chain complementarity determining region 3 for antibody 49596
QHYETSPWT

SEQ ID NO: 99192 - protein, 13 aa, Homo sapiens
  heavy chain complementarity determining region 3 for antibody 49596
ARERRQFAWYIDH

SEQ ID NO: 99193 - protein, 9 aa, Homo sapiens
  light chain complementarity determining region 3 for antibody 49597
QHYESSPLT

SEQ ID NO: 99194 - protein, 13 aa, Homo sapiens
  heavy chain complementarity determining region 3 for antibody 49597
ARERRQFAWYIDH

SEQ ID NO: 99195 - protein, 9 aa, Homo sapiens
  light chain complementarity determining region 3 for antibody 49598
QHYDTSPRT

SEQ ID NO: 99196 - protein, 13 aa, Homo sapiens
  heavy chain complementarity determining region 3 for antibody 49598
ATDLGGSNSNFDA

SEQ ID NO: 99197 - protein, 9 aa, Homo sapiens
  light chain complementarity determining region 3 for antibody 49599
QHYDSYSYT

SEQ ID NO: 99198 - protein, 22 aa, Homo sapiens
  heavy chain complementarity determining region 3 for antibody 49599
ARGYRYYDDVWGSYRPLGFFDL

SEQ ID NO: 99199 - protein, 9 aa, Homo sapiens
  light chain complementarity determining region 3 for antibody 49600
QHYDSYPWT

SEQ ID NO: 99200 - protein, 19 aa, Homo sapiens
  heavy chain complementarity determining region 3 for antibody 49600
ARVRGPYNSGGWGTGYFDN

SEQ ID NO: 99201 - protein, 9 aa, Homo sapiens
  light chain complementarity determining region 3 for antibody 49601
QHYDSYPLT

SEQ ID NO: 99202 - protein, 19 aa, Homo sapiens
  heavy chain complementarity determining region 3 for antibody 49601
ARVRGPYNSGGWGTGYFDN

SEQ ID NO: 99203 - protein, 11 aa, Homo sapiens
  light chain complementarity determining region 3 for antibody 49602
QHYDSFFQRWT

SEQ ID NO: 99204 - protein, 16 aa, Homo sapiens
  heavy chain complementarity determining region 3 for antibody 49602
ARVVDTAGFDYYYFDY

SEQ ID NO: 99205 - protein, 10 aa, Homo sapiens
  light chain complementarity determining region 3 for antibody 49603
QHYDNLPRFT

SEQ ID NO: 99206 - protein, 13 aa, Homo sapiens
  heavy chain complementarity determining region 3 for antibody 49603
TRATGQSGTDLGH

SEQ ID NO: 99207 - protein, 9 aa, Homo sapiens
  light chain complementarity determining region 3 for antibody 49604
QHYDNLPHT

SEQ ID NO: 99208 - protein, 23 aa, Homo sapiens
  heavy chain complementarity determining region 3 for antibody 49604
ARVPGLRRYYGILTVSRTRYFDY

SEQ ID NO: 99209 - protein, 9 aa, Homo sapiens
  light chain complementarity determining region 3 for antibody 49605
QHYDNLPFT

SEQ ID NO: 99210 - protein, 10 aa, Homo sapiens
  heavy chain complementarity determining region 3 for antibody 49605
GKADWNYVSY

SEQ ID NO: 99211 - protein, 11 aa, Homo sapiens
  light chain complementarity determining region 3 for antibody 49606
QHYDNFPPGIP

SEQ ID NO: 99212 - protein, 14 aa, Homo sapiens
  heavy chain complementarity determining region 3 for antibody 49606
ARVPNPGWELRFDY

SEQ ID NO: 99213 - protein, 9 aa, Homo sapiens
  light chain complementarity determining region 3 for antibody 49607
QHYDHYPWT

SEQ ID NO: 99214 - protein, 15 aa, Homo sapiens
  heavy chain complementarity determining region 3 for antibody 49607
ATFSDVDAWYSPFDS

SEQ ID NO: 99215 - protein, 9 aa, Homo sapiens
  light chain complementarity determining region 3 for antibody 49608
QHYDHLPLT

SEQ ID NO: 99216 - protein, 15 aa, Homo sapiens
  heavy chain complementarity determining region 3 for antibody 49608
AKLPSRGFGYWYFDV

SEQ ID NO: 99217 - protein, 10 aa, Homo sapiens
  light chain complementarity determining region 3 for antibody 49609
QHYDDSPPWR

SEQ ID NO: 99218 - protein, 14 aa, Homo sapiens
  heavy chain complementarity determining region 3 for antibody 49609
ARSGAGTAAGKFDY

SEQ ID NO: 99219 - protein, 9 aa, Homo sapiens
  light chain complementarity determining region 3 for antibody 49610
QHYATSPYS

SEQ ID NO: 99220 - protein, 12 aa, Homo sapiens
  heavy chain complementarity determining region 3 for antibody 49610
AREPAEDYYLDF

SEQ ID NO: 99221 - protein, 8 aa, Homo sapiens
  light chain complementarity determining region 3 for antibody 49611
QHYANLWT

SEQ ID NO: 99222 - protein, 15 aa, Homo sapiens
  heavy chain complementarity determining region 3 for antibody 49611
ATTIAVPGLFRAFDL

SEQ ID NO: 99223 - protein, 9 aa, Homo sapiens
  light chain complementarity determining region 3 for antibody 49612
QHYANFPYT

SEQ ID NO: 99224 - protein, 8 aa, Homo sapiens
  heavy chain complementarity determining region 3 for antibody 49612
TKALPTPD

SEQ ID NO: 99225 - protein, 9 aa, Homo sapiens
  light chain complementarity determining region 3 for antibody 49613
QHYAGPPLP

SEQ ID NO: 99226 - protein, 11 aa, Homo sapiens
  heavy chain complementarity determining region 3 for antibody 49613
ARKETSRALDV

SEQ ID NO: 99227 - protein, 8 aa, Homo sapiens
  light chain complementarity determining region 3 for antibody 49614
QHYADFLT

SEQ ID NO: 99228 - protein, 13 aa, Homo sapiens
  heavy chain complementarity determining region 3 for antibody 49614
TRVFPWPTMAFDY

SEQ ID NO: 99229 - protein, 9 aa, Homo sapiens
  light chain complementarity determining region 3 for antibody 49615
QHYAAPVRT

SEQ ID NO: 99230 - protein, 11 aa, Homo sapiens
  heavy chain complementarity determining region 3 for antibody 49615
VRDGTGGWMVY

SEQ ID NO: 99231 - protein, 9 aa, Homo sapiens
  light chain complementarity determining region 3 for antibody 49616
QHTSSFPLT

SEQ ID NO: 99232 - protein, 9 aa, Homo sapiens
  heavy chain complementarity determining region 3 for antibody 49616
AKSSGYLDY

SEQ ID NO: 99233 - protein, 9 aa, Homo sapiens
  light chain complementarity determining region 3 for antibody 49617
QHSYSTPLT

SEQ ID NO: 99234 - protein, 17 aa, Homo sapiens
  heavy chain complementarity determining region 3 for antibody 49617
ARRSGDSSGYPYGELDP

SEQ ID NO: 99235 - protein, 9 aa, Homo sapiens
  light chain complementarity determining region 3 for antibody 49618
QHSYSTPFT

SEQ ID NO: 99236 - protein, 13 aa, Homo sapiens
  heavy chain complementarity determining region 3 for antibody 49618
ARPRRYDYGDFDY

SEQ ID NO: 99237 - protein, 10 aa, Homo sapiens
  light chain complementarity determining region 3 for antibody 49619
QHSYITPPWT

SEQ ID NO: 99238 - protein, 14 aa, Homo sapiens
  heavy chain complementarity determining region 3 for antibody 49619
ARAMVTGTDYSFDH

SEQ ID NO: 99239 - protein, 7 aa, Homo sapiens
  light chain complementarity determining region 3 for antibody 49620
QHSTSRP

SEQ ID NO: 99240 - protein, 19 aa, Homo sapiens
  heavy chain complementarity determining region 3 for antibody 49620
AREADYPDGGGSNVATFDY

SEQ ID NO: 99241 - protein, 9 aa, Homo sapiens
  light chain complementarity determining region 3 for antibody 49621
QHSNSYPLT

SEQ ID NO: 99242 - protein, 11 aa, Homo sapiens
  heavy chain complementarity determining region 3 for antibody 49621
TTDVGSGSPAH

SEQ ID NO: 99243 - protein, 9 aa, Homo sapiens
  light chain complementarity determining region 3 for antibody 49622
QHSLTNPRT

SEQ ID NO: 99244 - protein, 14 aa, Homo sapiens
  heavy chain complementarity determining region 3 for antibody 49622
ARQHGSLPGPPIDH

SEQ ID NO: 99245 - protein, 9 aa, Homo sapiens
  light chain complementarity determining region 3 for antibody 49623
QHSKTHPLT

SEQ ID NO: 99246 - protein, 8 aa, Homo sapiens
  heavy chain complementarity determining region 3 for antibody 49623
ISYNSGWY

SEQ ID NO: 99247 - protein, 9 aa, Homo sapiens
  light chain complementarity determining region 3 for antibody 49624
QHSHSTPIT

SEQ ID NO: 99248 - protein, 14 aa, Homo sapiens
  heavy chain complementarity determining region 3 for antibody 49624
ARGQTNSWNGWFDP

SEQ ID NO: 99249 - protein, 9 aa, Homo sapiens
  light chain complementarity determining region 3 for antibody 49625
QHRYTTLYT

SEQ ID NO: 99250 - protein, 13 aa, Homo sapiens
  heavy chain complementarity determining region 3 for antibody 49625
ARMTPVAADAFDI

SEQ ID NO: 99251 - protein, 9 aa, Homo sapiens
  light chain complementarity determining region 3 for antibody 49626
QHRTRWPPS

SEQ ID NO: 99252 - protein, 12 aa, Homo sapiens
  heavy chain complementarity determining region 3 for antibody 49626
ALTKDGSGRVDN

SEQ ID NO: 99253 - protein, 11 aa, Homo sapiens
  light chain complementarity determining region 3 for antibody 49627
QHRTNWPPSPT

SEQ ID NO: 99254 - protein, 11 aa, Homo sapiens
  heavy chain complementarity determining region 3 for antibody 49627
ASGGPVAGIRI

SEQ ID NO: 99255 - protein, 11 aa, Homo sapiens
  light chain complementarity determining region 3 for antibody 49628
QHRTNWPPSLP

SEQ ID NO: 99256 - protein, 11 aa, Homo sapiens
  heavy chain complementarity determining region 3 for antibody 49628
ASGGPVAGIRI

SEQ ID NO: 99257 - protein, 9 aa, Homo sapiens
  light chain complementarity determining region 3 for antibody 49629
QHRSNWPPT

SEQ ID NO: 99258 - protein, 19 aa, Homo sapiens
  heavy chain complementarity determining region 3 for antibody 49629
ARGFIGAARTGFAHYYFDS

SEQ ID NO: 99259 - protein, 11 aa, Homo sapiens
  light chain complementarity determining region 3 for antibody 49630
QHRSNWPPGFT

SEQ ID NO: 99260 - protein, 21 aa, Homo sapiens
  heavy chain complementarity determining region 3 for antibody 49630
ARRMSRGYGNSWYMAGDPFDL

SEQ ID NO: 99261 - protein, 8 aa, Homo sapiens
  light chain complementarity determining region 3 for antibody 49631
QHRSFWYT

SEQ ID NO: 99262 - protein, 12 aa, Homo sapiens
  heavy chain complementarity determining region 3 for antibody 49631
VQDLGGGLVGPS

SEQ ID NO: 99263 - protein, 8 aa, Homo sapiens
  light chain complementarity determining region 3 for antibody 49632
QHRSDWNT

SEQ ID NO: 99264 - protein, 15 aa, Homo sapiens
  heavy chain complementarity determining region 3 for antibody 49632
ARGEFTYCGGDCYDY

SEQ ID NO: 99265 - protein, 11 aa, Homo sapiens
  light chain complementarity determining region 3 for antibody 49633
QHRQESTNWLN

SEQ ID NO: 99266 - protein, 15 aa, Homo sapiens
  heavy chain complementarity determining region 3 for antibody 49633
ARGGYSSNWYWWFDP

SEQ ID NO: 99267 - protein, 10 aa, Homo sapiens
  light chain complementarity determining region 3 for antibody 49634
QHRNSWPRYI

SEQ ID NO: 99268 - protein, 15 aa, Homo sapiens
  heavy chain complementarity determining region 3 for antibody 49634
AGDPHPLNYGGHFNY

SEQ ID NO: 99269 - protein, 9 aa, Homo sapiens
  light chain complementarity determining region 3 for antibody 49635
QHRNNWLPA

SEQ ID NO: 99270 - protein, 17 aa, Homo sapiens
  heavy chain complementarity determining region 3 for antibody 49635
AREGGYCVGGGYRWFDL

SEQ ID NO: 99271 - protein, 9 aa, Homo sapiens
  light chain complementarity determining region 3 for antibody 49636
QHRNNRPPS

SEQ ID NO: 99272 - protein, 17 aa, Homo sapiens
  heavy chain complementarity determining region 3 for antibody 49636
ASEGGYCYSTSCRYFDY

SEQ ID NO: 99273 - protein, 9 aa, Homo sapiens
  light chain complementarity determining region 3 for antibody 49637
QHRNGWPPP

SEQ ID NO: 99274 - protein, 13 aa, Homo sapiens
  heavy chain complementarity determining region 3 for antibody 49637
ARENYLLSWAFDY

SEQ ID NO: 99275 - protein, 10 aa, Homo sapiens
  light chain complementarity determining region 3 for antibody 49638
QHRGKWPPHT

SEQ ID NO: 99276 - protein, 15 aa, Homo sapiens
  heavy chain complementarity determining region 3 for antibody 49638
VRLGVGFDDSSDDDY

SEQ ID NO: 99277 - protein, 11 aa, Homo sapiens
  light chain complementarity determining region 3 for antibody 49639
QHRGGSPPMYT

SEQ ID NO: 99278 - protein, 12 aa, Homo sapiens
  heavy chain complementarity determining region 3 for antibody 49639
ARSESGIDSGDI

SEQ ID NO: 99279 - protein, 8 aa, Homo sapiens
  light chain complementarity determining region 3 for antibody 49640
QHPNIWLT

SEQ ID NO: 99280 - protein, 15 aa, Homo sapiens
  heavy chain complementarity determining region 3 for antibody 49640
ARDGDWRDGIRGFDF

SEQ ID NO: 99281 - protein, 7 aa, Homo sapiens
  light chain complementarity determining region 3 for antibody 49641
QHLSSFT

SEQ ID NO: 99282 - protein, 19 aa, Homo sapiens
  heavy chain complementarity determining region 3 for antibody 49641
ARRPFGGDGTQPDYYGMDV

SEQ ID NO: 99283 - protein, 7 aa, Homo sapiens
  light chain complementarity determining region 3 for antibody 49642
QHLSSFT

SEQ ID NO: 99284 - protein, 19 aa, Homo sapiens
  heavy chain complementarity determining region 3 for antibody 49642
ARRPFGGDGAQTDYYGMDV

SEQ ID NO: 99285 - protein, 9 aa, Homo sapiens
  light chain complementarity determining region 3 for antibody 49643
QHLNSYPPT

SEQ ID NO: 99286 - protein, 17 aa, Homo sapiens
  heavy chain complementarity determining region 3 for antibody 49643
ARGGGYYSGSGTYPFDY

SEQ ID NO: 99287 - protein, 9 aa, Homo sapiens
  light chain complementarity determining region 3 for antibody 49644
QHLHALPWT

SEQ ID NO: 99288 - protein, 18 aa, Homo sapiens
  heavy chain complementarity determining region 3 for antibody 49644
ANDVGGYCSGGSCPGLDS

SEQ ID NO: 99289 - protein, 10 aa, Homo sapiens
  light chain complementarity determining region 3 for antibody 49645
QHLETYSQLR

SEQ ID NO: 99290 - protein, 18 aa, Homo sapiens
  heavy chain complementarity determining region 3 for antibody 49645
VKFYVWILTGYSTDSVDI

SEQ ID NO: 99291 - protein, 10 aa, Homo sapiens
  light chain complementarity determining region 3 for antibody 49646
QHLETYSKLS

SEQ ID NO: 99292 - protein, 18 aa, Homo sapiens
  heavy chain complementarity determining region 3 for antibody 49646
VKFYVWILTGYSTDSVDI

SEQ ID NO: 99293 - protein, 9 aa, Homo sapiens
  light chain complementarity determining region 3 for antibody 49647
QHLDTYPWP

SEQ ID NO: 99294 - protein, 11 aa, Homo sapiens
  heavy chain complementarity determining region 3 for antibody 49647
ARSVNYNGMDV

SEQ ID NO: 99295 - protein, 8 aa, Homo sapiens
  light chain complementarity determining region 3 for antibody 49648
QHHVSSVS

SEQ ID NO: 99296 - protein, 13 aa, Homo sapiens
  heavy chain complementarity determining region 3 for antibody 49648
VRTWFGELSHFDF

SEQ ID NO: 99297 - protein, 12 aa, Homo sapiens
  light chain complementarity determining region 3 for antibody 49649
QHHSYVNSPEYT

SEQ ID NO: 99298 - protein, 12 aa, Homo sapiens
  heavy chain complementarity determining region 3 for antibody 49649
ARETTRFGELDS

SEQ ID NO: 99299 - protein, 8 aa, Homo sapiens
  light chain complementarity determining region 3 for antibody 49650
QHHNNWLT

SEQ ID NO: 99300 - protein, 15 aa, Homo sapiens
  heavy chain complementarity determining region 3 for antibody 49650
ARDGDWRDGIRGFDF

SEQ ID NO: 99301 - protein, 8 aa, Homo sapiens
  light chain complementarity determining region 3 for antibody 49651
QHHNIWPT

SEQ ID NO: 99302 - protein, 15 aa, Homo sapiens
  heavy chain complementarity determining region 3 for antibody 49651
ARDGDWRDGIRGFDF

SEQ ID NO: 99303 - protein, 9 aa, Homo sapiens
  light chain complementarity determining region 3 for antibody 49652
QHHGTSPWT

SEQ ID NO: 99304 - protein, 15 aa, Homo sapiens
  heavy chain complementarity determining region 3 for antibody 49652
ARDYFEGSYYGYFDH

SEQ ID NO: 99305 - protein, 9 aa, Homo sapiens
  light chain complementarity determining region 3 for antibody 49653
QHHGSTPLP

SEQ ID NO: 99306 - protein, 14 aa, Homo sapiens
  heavy chain complementarity determining region 3 for antibody 49653
ARASGDYYIEAFDV

SEQ ID NO: 99307 - protein, 9 aa, Homo sapiens
  light chain complementarity determining region 3 for antibody 49654
QHHAASVRT

SEQ ID NO: 99308 - protein, 11 aa, Homo sapiens
  heavy chain complementarity determining region 3 for antibody 49654
VRDGTGGWMVY

SEQ ID NO: 99309 - protein, 9 aa, Homo sapiens
  light chain complementarity determining region 3 for antibody 49655
QHGYSTPFT

SEQ ID NO: 99310 - protein, 15 aa, Homo sapiens
  heavy chain complementarity determining region 3 for antibody 49655
AKAQVIWGQLYYFDS

SEQ ID NO: 99311 - protein, 9 aa, Homo sapiens
  light chain complementarity determining region 3 for antibody 49656
QHGYSPPFI

SEQ ID NO: 99312 - protein, 15 aa, Homo sapiens
  heavy chain complementarity determining region 3 for antibody 49656
ARAQVIWGQLYYFDS

SEQ ID NO: 99313 - protein, 9 aa, Homo sapiens
  light chain complementarity determining region 3 for antibody 49657
QHGYNTPYT

SEQ ID NO: 99314 - protein, 14 aa, Homo sapiens
  heavy chain complementarity determining region 3 for antibody 49657
AKSASLDYYGAFDP

SEQ ID NO: 99315 - protein, 9 aa, Homo sapiens
  light chain complementarity determining region 3 for antibody 49658
QHFYNTPNT

SEQ ID NO: 99316 - protein, 14 aa, Homo sapiens
  heavy chain complementarity determining region 3 for antibody 49658
AHRGAPIRSTGFDY

SEQ ID NO: 99317 - protein, 9 aa, Homo sapiens
  light chain complementarity determining region 3 for antibody 49659
QHFYNAPGT

SEQ ID NO: 99318 - protein, 12 aa, Homo sapiens
  heavy chain complementarity determining region 3 for antibody 49659
AREREAMGLFDY

SEQ ID NO: 99319 - protein, 9 aa, Homo sapiens
  light chain complementarity determining region 3 for antibody 49660
QHFGSLRFT

SEQ ID NO: 99320 - protein, 13 aa, Homo sapiens
  heavy chain complementarity determining region 3 for antibody 49660
ATSEFSASYYFDI

SEQ ID NO: 99321 - protein, 10 aa, Homo sapiens
  light chain complementarity determining region 3 for antibody 49661
QHFADPPLFP

SEQ ID NO: 99322 - protein, 13 aa, Homo sapiens
  heavy chain complementarity determining region 3 for antibody 49661
VRQSAYDQSGLDY

SEQ ID NO: 99323 - protein, 9 aa, Homo sapiens
  light chain complementarity determining region 3 for antibody 49662
QHDGGSPYT

SEQ ID NO: 99324 - protein, 17 aa, Homo sapiens
  heavy chain complementarity determining region 3 for antibody 49662
ARVDLSEQWLVLWYFDL

SEQ ID NO: 99325 - protein, 9 aa, Homo sapiens
  light chain complementarity determining region 3 for antibody 49663
QHCDSSRFT

SEQ ID NO: 99326 - protein, 13 aa, Homo sapiens
  heavy chain complementarity determining region 3 for antibody 49663
ATSEFSASYYFDI

SEQ ID NO: 99327 - protein, 9 aa, Homo sapiens
  light chain complementarity determining region 3 for antibody 49664
QHAHSFPRT

SEQ ID NO: 99328 - protein, 13 aa, Homo sapiens
  heavy chain complementarity determining region 3 for antibody 49664
ATSHDYGDSALDS

SEQ ID NO: 99329 - protein, 9 aa, Homo sapiens
  light chain complementarity determining region 3 for antibody 49665
QGYGSSPQT

SEQ ID NO: 99330 - protein, 18 aa, Homo sapiens
  heavy chain complementarity determining region 3 for antibody 49665
ARDGGGYNHGSSGAYLDY

SEQ ID NO: 99331 - protein, 9 aa, Homo sapiens
  light chain complementarity determining region 3 for antibody 49666
QGYANFLWG

SEQ ID NO: 99332 - protein, 17 aa, Homo sapiens
  heavy chain complementarity determining region 3 for antibody 49666
AAERDWHADTAPGGFDP

SEQ ID NO: 99333 - protein, 10 aa, Homo sapiens
  light chain complementarity determining region 3 for antibody 49667
QGRDEWPPVI

SEQ ID NO: 99334 - protein, 17 aa, Homo sapiens
  heavy chain complementarity determining region 3 for antibody 49667
TTDDTFDYGDYDDAFDI

SEQ ID NO: 99335 - protein, 9 aa, Homo sapiens
  light chain complementarity determining region 3 for antibody 49668
QEYTSAPFT

SEQ ID NO: 99336 - protein, 15 aa, Homo sapiens
  heavy chain complementarity determining region 3 for antibody 49668
ARGEGDYRLRAPLGY

SEQ ID NO: 99337 - protein, 10 aa, Homo sapiens
  light chain complementarity determining region 3 for antibody 49669
QEYNTHSPRT

SEQ ID NO: 99338 - protein, 19 aa, Homo sapiens
  heavy chain complementarity determining region 3 for antibody 49669
TRPRAYFYDSNSYLGEFEY

SEQ ID NO: 99339 - protein, 10 aa, Homo sapiens
  light chain complementarity determining region 3 for antibody 49670
QEYNRFSPWP

SEQ ID NO: 99340 - protein, 14 aa, Homo sapiens
  heavy chain complementarity determining region 3 for antibody 49670
ARDEGYLVPGFFDY

SEQ ID NO: 99341 - protein, 9 aa, Homo sapiens
  light chain complementarity determining region 3 for antibody 49671
QEYKSYSYT

SEQ ID NO: 99342 - protein, 16 aa, Homo sapiens
  heavy chain complementarity determining region 3 for antibody 49671
ARRNVGFLLMGGALDF

SEQ ID NO: 99343 - protein, 9 aa, Homo sapiens
  light chain complementarity determining region 3 for antibody 49672
QEYDDDSRT

SEQ ID NO: 99344 - protein, 12 aa, Homo sapiens
  heavy chain complementarity determining region 3 for antibody 49672
ARAGSGWYYFDL

SEQ ID NO: 99345 - protein, 9 aa, Homo sapiens
  light chain complementarity determining region 3 for antibody 49673
QEYDDDPRT

SEQ ID NO: 99346 - protein, 12 aa, Homo sapiens
  heavy chain complementarity determining region 3 for antibody 49673
ARAGSGWYYFDL

SEQ ID NO: 99347 - protein, 9 aa, Homo sapiens
  light chain complementarity determining region 3 for antibody 49674
QEYANFLWA

SEQ ID NO: 99348 - protein, 17 aa, Homo sapiens
  heavy chain complementarity determining region 3 for antibody 49674
AAERDWHADTAPGGFDP

SEQ ID NO: 99349 - protein, 11 aa, Homo sapiens
  light chain complementarity determining region 3 for antibody 49675
QEVKSYPRRPT

SEQ ID NO: 99350 - protein, 15 aa, Homo sapiens
  heavy chain complementarity determining region 3 for antibody 49675
ARGAASFSGYDAFDI

SEQ ID NO: 99351 - protein, 8 aa, Homo sapiens
  light chain complementarity determining region 3 for antibody 49676
QESYTALT

SEQ ID NO: 99352 - protein, 15 aa, Homo sapiens
  heavy chain complementarity determining region 3 for antibody 49676
ARQGGQRARGYYSDY

SEQ ID NO: 99353 - protein, 9 aa, Homo sapiens
  light chain complementarity determining region 3 for antibody 49677
QESYSPPFT

SEQ ID NO: 99354 - protein, 15 aa, Homo sapiens
  heavy chain complementarity determining region 3 for antibody 49677
AKDIGTYSDNSTPDY

SEQ ID NO: 99355 - protein, 9 aa, Homo sapiens
  light chain complementarity determining region 3 for antibody 49678
QESYRSPYT

SEQ ID NO: 99356 - protein, 16 aa, Homo sapiens
  heavy chain complementarity determining region 3 for antibody 49678
AHTQLRFLDWFPDFDY

SEQ ID NO: 99357 - protein, 10 aa, Homo sapiens
  light chain complementarity determining region 3 for antibody 49679
QERSTGPPRE

SEQ ID NO: 99358 - protein, 14 aa, Homo sapiens
  heavy chain complementarity determining region 3 for antibody 49679
AMRGLGSSGYYTDY

SEQ ID NO: 99359 - protein, 10 aa, Homo sapiens
  light chain complementarity determining region 3 for antibody 49680
QERSNWPVVT

SEQ ID NO: 99360 - protein, 23 aa, Homo sapiens
  heavy chain complementarity determining region 3 for antibody 49680
ARCRTYYFDGSGYPDYYFYLMDV

SEQ ID NO: 99361 - protein, 10 aa, Homo sapiens
  light chain complementarity determining region 3 for antibody 49681
QEPYSTPSIT

SEQ ID NO: 99362 - protein, 15 aa, Homo sapiens
  heavy chain complementarity determining region 3 for antibody 49681
ARDPGWTQTSYYFDY

SEQ ID NO: 99363 - protein, 9 aa, Homo sapiens
  light chain complementarity determining region 3 for antibody 49682
QEFNSPPWT

SEQ ID NO: 99364 - protein, 14 aa, Homo sapiens
  heavy chain complementarity determining region 3 for antibody 49682
ARAKDSSGFHAFDI

SEQ ID NO: 99365 - protein, 9 aa, Homo sapiens
  light chain complementarity determining region 3 for antibody 49683
QEDGGSPFT

SEQ ID NO: 99366 - protein, 15 aa, Homo sapiens
  heavy chain complementarity determining region 3 for antibody 49683
ARPDCGAITCYVLLF

SEQ ID NO: 99367 - protein, 9 aa, Homo sapiens
  light chain complementarity determining region 3 for antibody 49684
QDYSGHFRT

SEQ ID NO: 99368 - protein, 10 aa, Homo sapiens
  heavy chain complementarity determining region 3 for antibody 49684
TRDWPRSGMD

SEQ ID NO: 99369 - protein, 9 aa, Homo sapiens
  light chain complementarity determining region 3 for antibody 49685
QAYSTISGT

SEQ ID NO: 99370 - protein, 21 aa, Homo sapiens
  heavy chain complementarity determining region 3 for antibody 49685
ARGAVRGFSSGRYSGYDYFHH

SEQ ID NO: 99371 - protein, 9 aa, Homo sapiens
  light chain complementarity determining region 3 for antibody 49686
QAYGTPPRP

SEQ ID NO: 99372 - protein, 13 aa, Homo sapiens
  heavy chain complementarity determining region 3 for antibody 49686
ARVNSSRSFNVDF

SEQ ID NO: 99373 - protein, 9 aa, Homo sapiens
  light chain complementarity determining region 3 for antibody 49687
QASYSPPFT

SEQ ID NO: 99374 - protein, 15 aa, Homo sapiens
  heavy chain complementarity determining region 3 for antibody 49687
AKDIGTYSDNLTPDY

SEQ ID NO: 99375 - protein, 9 aa, Homo sapiens
  light chain complementarity determining region 3 for antibody 49688
PYSNSAPLT

SEQ ID NO: 99376 - protein, 10 aa, Homo sapiens
  heavy chain complementarity determining region 3 for antibody 49688
ARDEGYFGTS

SEQ ID NO: 99377 - protein, 9 aa, Homo sapiens
  light chain complementarity determining region 3 for antibody 49689
PQYKNYPFT

SEQ ID NO: 99378 - protein, 14 aa, Homo sapiens
  heavy chain complementarity determining region 3 for antibody 49689
VRAKDSSGYDLFDY

SEQ ID NO: 99379 - protein, 10 aa, Homo sapiens
  light chain complementarity determining region 3 for antibody 49690
PQYGSSPPAT

SEQ ID NO: 99380 - protein, 11 aa, Homo sapiens
  heavy chain complementarity determining region 3 for antibody 49690
ARHGSEMELDF

SEQ ID NO: 99381 - protein, 9 aa, Homo sapiens
  light chain complementarity determining region 3 for antibody 49691
PQYGSSGGT

SEQ ID NO: 99382 - protein, 17 aa, Homo sapiens
  heavy chain complementarity determining region 3 for antibody 49691
ARDSAPREGYFDDYFDS

SEQ ID NO: 99383 - protein, 9 aa, Homo sapiens
  light chain complementarity determining region 3 for antibody 49692
PQYGSLSIT

SEQ ID NO: 99384 - protein, 16 aa, Homo sapiens
  heavy chain complementarity determining region 3 for antibody 49692
ARGRGYSAYVSYYFDY

SEQ ID NO: 99385 - protein, 8 aa, Homo sapiens
  light chain complementarity determining region 3 for antibody 49693
PQYGSKTT

SEQ ID NO: 99386 - protein, 11 aa, Homo sapiens
  heavy chain complementarity determining region 3 for antibody 49693
GRKPTGWPFDY

SEQ ID NO: 99387 - protein, 9 aa, Homo sapiens
  light chain complementarity determining region 3 for antibody 49694
PQYGRSPRT

SEQ ID NO: 99388 - protein, 15 aa, Homo sapiens
  heavy chain complementarity determining region 3 for antibody 49694
AKDGEFCGSNCYFGS

SEQ ID NO: 99389 - protein, 9 aa, Homo sapiens
  light chain complementarity determining region 3 for antibody 49695
PQYDNWPRT

SEQ ID NO: 99390 - protein, 20 aa, Homo sapiens
  heavy chain complementarity determining region 3 for antibody 49695
ARLPDFFDGGYHYINSHYDY

SEQ ID NO: 99391 - protein, 9 aa, Homo sapiens
  light chain complementarity determining region 3 for antibody 49696
PQTYSPPFT

SEQ ID NO: 99392 - protein, 19 aa, Homo sapiens
  heavy chain complementarity determining region 3 for antibody 49696
ARDMDGRYPDSSGPGMFDP

SEQ ID NO: 99393 - protein, 9 aa, Homo sapiens
  light chain complementarity determining region 3 for antibody 49697
PQSSSLPLT

SEQ ID NO: 99394 - protein, 16 aa, Homo sapiens
  heavy chain complementarity determining region 3 for antibody 49697
VRGGYRYSGPPDAFDI

SEQ ID NO: 99395 - protein, 9 aa, Homo sapiens
  light chain complementarity determining region 3 for antibody 49698
PQRYNWPLT

SEQ ID NO: 99396 - protein, 14 aa, Homo sapiens
  heavy chain complementarity determining region 3 for antibody 49698
ATGPAGGGGYYFDY

SEQ ID NO: 99397 - protein, 8 aa, Homo sapiens
  light chain complementarity determining region 3 for antibody 49699
PQRSNWWT

SEQ ID NO: 99398 - protein, 11 aa, Homo sapiens
  heavy chain complementarity determining region 3 for antibody 49699
ARGNENYYFDY

SEQ ID NO: 99399 - protein, 9 aa, Homo sapiens
  light chain complementarity determining region 3 for antibody 49700
PQRSNWPRT

SEQ ID NO: 99400 - protein, 8 aa, Homo sapiens
  heavy chain complementarity determining region 3 for antibody 49700
VRDGYKQR

SEQ ID NO: 99401 - protein, 11 aa, Homo sapiens
  light chain complementarity determining region 3 for antibody 49701
PQRSNWPPGAT

SEQ ID NO: 99402 - protein, 11 aa, Homo sapiens
  heavy chain complementarity determining region 3 for antibody 49701
ARGTSVWYFDL

SEQ ID NO: 99403 - protein, 9 aa, Homo sapiens
  light chain complementarity determining region 3 for antibody 49702
PQRSNWPLT

SEQ ID NO: 99404 - protein, 12 aa, Homo sapiens
  heavy chain complementarity determining region 3 for antibody 49702
AKTLSSQDQNDY

SEQ ID NO: 99405 - protein, 9 aa, Homo sapiens
  light chain complementarity determining region 3 for antibody 49703
PQRSNWPFT

SEQ ID NO: 99406 - protein, 16 aa, Homo sapiens
  heavy chain complementarity determining region 3 for antibody 49703
ARELARRNTYYHAFEI

SEQ ID NO: 99407 - protein, 10 aa, Homo sapiens
  light chain complementarity determining region 3 for antibody 49704
PQRSKGPPLT

SEQ ID NO: 99408 - protein, 9 aa, Homo sapiens
  heavy chain complementarity determining region 3 for antibody 49704
ARVDGYFDY

SEQ ID NO: 99409 - protein, 9 aa, Homo sapiens
  light chain complementarity determining region 3 for antibody 49705
PQRRNWPIT

SEQ ID NO: 99410 - protein, 15 aa, Homo sapiens
  heavy chain complementarity determining region 3 for antibody 49705
AREFPAPDVYHYFDC

SEQ ID NO: 99411 - protein, 9 aa, Homo sapiens
  light chain complementarity determining region 3 for antibody 49706
PQLNSYPRT

SEQ ID NO: 99412 - protein, 21 aa, Homo sapiens
  heavy chain complementarity determining region 3 for antibody 49706
ARNGAGCSSTSCHYYYDGMDV

SEQ ID NO: 99413 - protein, 9 aa, Homo sapiens
  light chain complementarity determining region 3 for antibody 49707
PQGHSFPYT

SEQ ID NO: 99414 - protein, 18 aa, Homo sapiens
  heavy chain complementarity determining region 3 for antibody 49707
AREGSDYSDVYYYYGMDV

SEQ ID NO: 99415 - protein, 9 aa, Homo sapiens
  light chain complementarity determining region 3 for antibody 49708
PQFNSWPLT

SEQ ID NO: 99416 - protein, 12 aa, Homo sapiens
  heavy chain complementarity determining region 3 for antibody 49708
ARDMVRGGWCDT

SEQ ID NO: 99417 - protein, 8 aa, Homo sapiens
  light chain complementarity determining region 3 for antibody 49709
PQCYDTPT

SEQ ID NO: 99418 - protein, 15 aa, Homo sapiens
  heavy chain complementarity determining region 3 for antibody 49709
TRGGNHIQLWQRFDY

SEQ ID NO: 99419 - protein, 9 aa, Homo sapiens
  light chain complementarity determining region 3 for antibody 49710
PKYNSAPFT

SEQ ID NO: 99420 - protein, 18 aa, Homo sapiens
  heavy chain complementarity determining region 3 for antibody 49710
ARGGYCRNGNCHPTLYDY

SEQ ID NO: 99421 - protein, 9 aa, Homo sapiens
  light chain complementarity determining region 3 for antibody 49711
PKYNNALWT

SEQ ID NO: 99422 - protein, 14 aa, Homo sapiens
  heavy chain complementarity determining region 3 for antibody 49711
ARSPYYATSGPFDH

SEQ ID NO: 99423 - protein, 9 aa, Homo sapiens
  light chain complementarity determining region 3 for antibody 49712
PEYDTYSPT

SEQ ID NO: 99424 - protein, 13 aa, Homo sapiens
  heavy chain complementarity determining region 3 for antibody 49712
ATYSGTYDRPFDL

SEQ ID NO: 99425 - protein, 9 aa, Homo sapiens
  light chain complementarity determining region 3 for antibody 49713
MYPLQTQLS

SEQ ID NO: 99426 - protein, 24 aa, Homo sapiens
  heavy chain complementarity determining region 3 for antibody 49713
ARAVGCDGTNCHAAWGFYYYALDV

SEQ ID NO: 99427 - protein, 9 aa, Homo sapiens
  light chain complementarity determining region 3 for antibody 49714
MRALQTPYT

SEQ ID NO: 99428 - protein, 16 aa, Homo sapiens
  heavy chain complementarity determining region 3 for antibody 49714
ARENTENTDREHHFDY

SEQ ID NO: 99429 - protein, 9 aa, Homo sapiens
  light chain complementarity determining region 3 for antibody 49715
MQVLQTPST

SEQ ID NO: 99430 - protein, 5 aa, Homo sapiens
  heavy chain complementarity determining region 3 for antibody 49715
TRQGL

SEQ ID NO: 99431 - protein, 9 aa, Homo sapiens
  light chain complementarity determining region 3 for antibody 49716
MQVLQTPQT

SEQ ID NO: 99432 - protein, 20 aa, Homo sapiens
  heavy chain complementarity determining region 3 for antibody 49716
SSGGYFCDSPGSSVLDYFDH

SEQ ID NO: 99433 - protein, 9 aa, Homo sapiens
  light chain complementarity determining region 3 for antibody 49717
MQVLQTPQP

SEQ ID NO: 99434 - protein, 20 aa, Homo sapiens
  heavy chain complementarity determining region 3 for antibody 49717
SSGGYFYDSPGSSVLDYFDH

SEQ ID NO: 99435 - protein, 9 aa, Homo sapiens
  light chain complementarity determining region 3 for antibody 49718
MQVLQTPQN

SEQ ID NO: 99436 - protein, 4 aa, Homo sapiens
  heavy chain complementarity determining region 3 for antibody 49718
GMDV

SEQ ID NO: 99437 - protein, 9 aa, Homo sapiens
  light chain complementarity determining region 3 for antibody 49719
MQVLQTPPV

SEQ ID NO: 99438 - protein, 12 aa, Homo sapiens
  heavy chain complementarity determining region 3 for antibody 49719
TKDRTGFPSLYY

SEQ ID NO: 99439 - protein, 9 aa, Homo sapiens
  light chain complementarity determining region 3 for antibody 49720
MQVLQTPLT

SEQ ID NO: 99440 - protein, 10 aa, Homo sapiens
  heavy chain complementarity determining region 3 for antibody 49720
ARKDLIYFNP

SEQ ID NO: 99441 - protein, 9 aa, Homo sapiens
  light chain complementarity determining region 3 for antibody 49721
MQVLQTPHV

SEQ ID NO: 99442 - protein, 12 aa, Homo sapiens
  heavy chain complementarity determining region 3 for antibody 49721
AKDRTGFPSLYY

SEQ ID NO: 99443 - protein, 9 aa, Homo sapiens
  light chain complementarity determining region 3 for antibody 49722
MQVLKTPQT

SEQ ID NO: 99444 - protein, 20 aa, Homo sapiens
  heavy chain complementarity determining region 3 for antibody 49722
SSGGYFYDSPGSSVLDYFDH

SEQ ID NO: 99445 - protein, 9 aa, Homo sapiens
  light chain complementarity determining region 3 for antibody 49723
MQVLHTPQT

SEQ ID NO: 99446 - protein, 20 aa, Homo sapiens
  heavy chain complementarity determining region 3 for antibody 49723
SSGGYFYDSPGSSVLDYFDH

SEQ ID NO: 99447 - protein, 9 aa, Homo sapiens
  light chain complementarity determining region 3 for antibody 49724
MQVLHIPYT

SEQ ID NO: 99448 - protein, 20 aa, Homo sapiens
  heavy chain complementarity determining region 3 for antibody 49724
ARWASRGITVVRRVPGTFDS

SEQ ID NO: 99449 - protein, 9 aa, Homo sapiens
  light chain complementarity determining region 3 for antibody 49725
MQVLEIPGT

SEQ ID NO: 99450 - protein, 23 aa, Homo sapiens
  heavy chain complementarity determining region 3 for antibody 49725
ARDPSASYGYDSPLKYYYYGADV

SEQ ID NO: 99451 - protein, 9 aa, Homo sapiens
  light chain complementarity determining region 3 for antibody 49726
MQTTHGPHT

SEQ ID NO: 99452 - protein, 20 aa, Homo sapiens
  heavy chain complementarity determining region 3 for antibody 49726
ARDPGYKFGYRAGAPVKIDY

SEQ ID NO: 99453 - protein, 9 aa, Homo sapiens
  light chain complementarity determining region 3 for antibody 49727
MQTLQTPST

SEQ ID NO: 99454 - protein, 11 aa, Homo sapiens
  heavy chain complementarity determining region 3 for antibody 49727
ARTHWQQEVRD

SEQ ID NO: 99455 - protein, 9 aa, Homo sapiens
  light chain complementarity determining region 3 for antibody 49728
MQTLQTPLP

SEQ ID NO: 99456 - protein, 16 aa, Homo sapiens
  heavy chain complementarity determining region 3 for antibody 49728
ARDMASITMIGRAFDI

SEQ ID NO: 99457 - protein, 9 aa, Homo sapiens
  light chain complementarity determining region 3 for antibody 49729
MQTLQTPGT

SEQ ID NO: 99458 - protein, 14 aa, Homo sapiens
  heavy chain complementarity determining region 3 for antibody 49729
TTGVVTRGGRFFDI

SEQ ID NO: 99459 - protein, 9 aa, Homo sapiens
  light chain complementarity determining region 3 for antibody 49730
MQTLQTPFT

SEQ ID NO: 99460 - protein, 14 aa, Homo sapiens
  heavy chain complementarity determining region 3 for antibody 49730
ARGRDTSGYSGLDY

SEQ ID NO: 99461 - protein, 9 aa, Homo sapiens
  light chain complementarity determining region 3 for antibody 49731
MQTLQTPFT

SEQ ID NO: 99462 - protein, 16 aa, Homo sapiens
  heavy chain complementarity determining region 3 for antibody 49731
ARDMASITMIGRAFDI

SEQ ID NO: 99463 - protein, 9 aa, Homo sapiens
  light chain complementarity determining region 3 for antibody 49732
MQTLQTHPA

SEQ ID NO: 99464 - protein, 12 aa, Homo sapiens
  heavy chain complementarity determining region 3 for antibody 49732
ARDLYSSWTFGY

SEQ ID NO: 99465 - protein, 9 aa, Homo sapiens
  light chain complementarity determining region 3 for antibody 49733
MQTLQPPLT

SEQ ID NO: 99466 - protein, 16 aa, Homo sapiens
  heavy chain complementarity determining region 3 for antibody 49733
ARDMASITMIGRAFDI

SEQ ID NO: 99467 - protein, 10 aa, Homo sapiens
  light chain complementarity determining region 3 for antibody 49734
MQTLQGPPFT

SEQ ID NO: 99468 - protein, 20 aa, Homo sapiens
  heavy chain complementarity determining region 3 for antibody 49734
ARDSRENSDYYVPAAEYFHY

SEQ ID NO: 99469 - protein, 9 aa, Homo sapiens
  light chain complementarity determining region 3 for antibody 49735
MQTKHWPHT

SEQ ID NO: 99470 - protein, 20 aa, Homo sapiens
  heavy chain complementarity determining region 3 for antibody 49735
ARDPGYKFGYRAGAPVKIDY

SEQ ID NO: 99471 - protein, 10 aa, Homo sapiens
  light chain complementarity determining region 3 for antibody 49736
MQSTHWPPWT

SEQ ID NO: 99472 - protein, 5 aa, Homo sapiens
  heavy chain complementarity determining region 3 for antibody 49736
STGDY

SEQ ID NO: 99473 - protein, 9 aa, Homo sapiens
  light chain complementarity determining region 3 for antibody 49737
MQSTHWPHT

SEQ ID NO: 99474 - protein, 10 aa, Homo sapiens
  heavy chain complementarity determining region 3 for antibody 49737
VMAYDTRGYD

SEQ ID NO: 99475 - protein, 9 aa, Homo sapiens
  light chain complementarity determining region 3 for antibody 49738
MQSTHGPHT

SEQ ID NO: 99476 - protein, 10 aa, Homo sapiens
  heavy chain complementarity determining region 3 for antibody 49738
VMAYDTRGFD

SEQ ID NO: 99477 - protein, 8 aa, Homo sapiens
  light chain complementarity determining region 3 for antibody 49739
MQSLQTPS

SEQ ID NO: 99478 - protein, 22 aa, Homo sapiens
  heavy chain complementarity determining region 3 for antibody 49739
ARGGPPYYYDSSGVRQGNPFDL

SEQ ID NO: 99479 - protein, 10 aa, Homo sapiens
  light chain complementarity determining region 3 for antibody 49740
MQSLQTPPWT

SEQ ID NO: 99480 - protein, 21 aa, Homo sapiens
  heavy chain complementarity determining region 3 for antibody 49740
ARDEFVVVLAGEMPDKRGLDV

SEQ ID NO: 99481 - protein, 8 aa, Homo sapiens
  light chain complementarity determining region 3 for antibody 49741
MQSLQTHP

SEQ ID NO: 99482 - protein, 10 aa, Homo sapiens
  heavy chain complementarity determining region 3 for antibody 49741
AREDFWRLDL

SEQ ID NO: 99483 - protein, 9 aa, Homo sapiens
  light chain complementarity determining region 3 for antibody 49742
MQSLQSPWT

SEQ ID NO: 99484 - protein, 15 aa, Homo sapiens
  heavy chain complementarity determining region 3 for antibody 49742
AREDSADASAWFPRG

SEQ ID NO: 99485 - protein, 9 aa, Homo sapiens
  light chain complementarity determining region 3 for antibody 49743
MQSLQSPPI

SEQ ID NO: 99486 - protein, 15 aa, Homo sapiens
  heavy chain complementarity determining region 3 for antibody 49743
VADYIDPTGNGHPAV

SEQ ID NO: 99487 - protein, 10 aa, Homo sapiens
  light chain complementarity determining region 3 for antibody 49744
MQSLQILPIT

SEQ ID NO: 99488 - protein, 16 aa, Homo sapiens
  heavy chain complementarity determining region 3 for antibody 49744
VRGSDYYGSGDFLFDY

SEQ ID NO: 99489 - protein, 9 aa, Homo sapiens
  light chain complementarity determining region 3 for antibody 49745
MQRQQFPWT

SEQ ID NO: 99490 - protein, 14 aa, Homo sapiens
  heavy chain complementarity determining region 3 for antibody 49745
VREDSTEGWYGMDV

SEQ ID NO: 99491 - protein, 9 aa, Homo sapiens
  light chain complementarity determining region 3 for antibody 49746
MQPLQTPRT

SEQ ID NO: 99492 - protein, 30 aa, Homo sapiens
  heavy chain complementarity determining region 3 for antibody 49746
ARGVTRRLRFMNAFGSGTNLPQPPVDWFDP

SEQ ID NO: 99493 - protein, 9 aa, Homo sapiens
  light chain complementarity determining region 3 for antibody 49747
MQPLQTPPT

SEQ ID NO: 99494 - protein, 11 aa, Homo sapiens
  heavy chain complementarity determining region 3 for antibody 49747
ARERLWFGESV

SEQ ID NO: 99495 - protein, 9 aa, Homo sapiens
  light chain complementarity determining region 3 for antibody 49748
MQPLQTPFT

SEQ ID NO: 99496 - protein, 12 aa, Homo sapiens
  heavy chain complementarity determining region 3 for antibody 49748
ARRTANSASLDF

SEQ ID NO: 99497 - protein, 9 aa, Homo sapiens
  light chain complementarity determining region 3 for antibody 49749
MQPLQAPLP

SEQ ID NO: 99498 - protein, 22 aa, Homo sapiens
  heavy chain complementarity determining region 3 for antibody 49749
ARTETGYYGSGSYYRRSYYFDY

SEQ ID NO: 99499 - protein, 9 aa, Homo sapiens
  light chain complementarity determining region 3 for antibody 49750
MQPLQAPGT

SEQ ID NO: 99500 - protein, 21 aa, Homo sapiens
  heavy chain complementarity determining region 3 for antibody 49750
AREGQKPPPIISSGSRGGLDY

SEQ ID NO: 99501 - protein, 9 aa, Homo sapiens
  light chain complementarity determining region 3 for antibody 49751
MQNTQGPLT

SEQ ID NO: 99502 - protein, 8 aa, Homo sapiens
  heavy chain complementarity determining region 3 for antibody 49751
VLGQDMGH

SEQ ID NO: 99503 - protein, 9 aa, Homo sapiens
  light chain complementarity determining region 3 for antibody 49752
MQNLQTPGT

SEQ ID NO: 99504 - protein, 18 aa, Homo sapiens
  heavy chain complementarity determining region 3 for antibody 49752
AASGRYFFQDSGPLGFAY

SEQ ID NO: 99505 - protein, 9 aa, Homo sapiens
  light chain complementarity determining region 3 for antibody 49753
MQNLHLPYT

SEQ ID NO: 99506 - protein, 17 aa, Homo sapiens
  heavy chain complementarity determining region 3 for antibody 49753
AKDIFFAIAVAGTAFDI

SEQ ID NO: 99507 - protein, 9 aa, Homo sapiens
  light chain complementarity determining region 3 for antibody 49754
MQHTRWPHP

SEQ ID NO: 99508 - protein, 15 aa, Homo sapiens
  heavy chain complementarity determining region 3 for antibody 49754
ARDGSTSTEAHGMDV

SEQ ID NO: 99509 - protein, 9 aa, Homo sapiens
  light chain complementarity determining region 3 for antibody 49755
MQHTRGPHT

SEQ ID NO: 99510 - protein, 15 aa, Homo sapiens
  heavy chain complementarity determining region 3 for antibody 49755
ARDGSTSTEAHGMDV

SEQ ID NO: 99511 - protein, 8 aa, Homo sapiens
  light chain complementarity determining region 3 for antibody 49756
MQGVKRYP

SEQ ID NO: 99512 - protein, 7 aa, Homo sapiens
  heavy chain complementarity determining region 3 for antibody 49756
ATKMGDY

SEQ ID NO: 99513 - protein, 8 aa, Homo sapiens
  light chain complementarity determining region 3 for antibody 49757
MQGVKPYP

SEQ ID NO: 99514 - protein, 7 aa, Homo sapiens
  heavy chain complementarity determining region 3 for antibody 49757
ATKMGDY

SEQ ID NO: 99515 - protein, 9 aa, Homo sapiens
  light chain complementarity determining region 3 for antibody 49758
MQGVHWPGR

SEQ ID NO: 99516 - protein, 12 aa, Homo sapiens
  heavy chain complementarity determining region 3 for antibody 49758
AKGPHIAAGGTL

SEQ ID NO: 99517 - protein, 8 aa, Homo sapiens
  light chain complementarity determining region 3 for antibody 49759
MQGTYWPP

SEQ ID NO: 99518 - protein, 11 aa, Homo sapiens
  heavy chain complementarity determining region 3 for antibody 49759
ARDAMPNNADY

SEQ ID NO: 99519 - protein, 8 aa, Homo sapiens
  light chain complementarity determining region 3 for antibody 49760
MQGTYRGT

SEQ ID NO: 99520 - protein, 11 aa, Homo sapiens
  heavy chain complementarity determining region 3 for antibody 49760
ARDLHSTVPTL

SEQ ID NO: 99521 - protein, 8 aa, Homo sapiens
  light chain complementarity determining region 3 for antibody 49761
MQGTYRGR

SEQ ID NO: 99522 - protein, 11 aa, Homo sapiens
  heavy chain complementarity determining region 3 for antibody 49761
ARDLHSTVTTL

SEQ ID NO: 99523 - protein, 8 aa, Homo sapiens
  light chain complementarity determining region 3 for antibody 49762
MQGTYRGA

SEQ ID NO: 99524 - protein, 11 aa, Homo sapiens
  heavy chain complementarity determining region 3 for antibody 49762
ARDLHSTVTTL

SEQ ID NO: 99525 - protein, 9 aa, Homo sapiens
  light chain complementarity determining region 3 for antibody 49763
MQGTQWPPG

SEQ ID NO: 99526 - protein, 18 aa, Homo sapiens
  heavy chain complementarity determining region 3 for antibody 49763
ARNGYVESHFDLRQYLQH

SEQ ID NO: 99527 - protein, 9 aa, Homo sapiens
  light chain complementarity determining region 3 for antibody 49764
MQGTQWPPA

SEQ ID NO: 99528 - protein, 18 aa, Homo sapiens
  heavy chain complementarity determining region 3 for antibody 49764
ARNGYVESHFDLRQYLHH

SEQ ID NO: 99529 - protein, 9 aa, Homo sapiens
  light chain complementarity determining region 3 for antibody 49765
MQGTQGPWT

SEQ ID NO: 99530 - protein, 15 aa, Homo sapiens
  heavy chain complementarity determining region 3 for antibody 49765
VRFPPDLDIVGMIDS

SEQ ID NO: 99531 - protein, 9 aa, Homo sapiens
  light chain complementarity determining region 3 for antibody 49766
MQGTQGPHT

SEQ ID NO: 99532 - protein, 9 aa, Homo sapiens
  heavy chain complementarity determining region 3 for antibody 49766
VGWGNGLNP

SEQ ID NO: 99533 - protein, 9 aa, Homo sapiens
  light chain complementarity determining region 3 for antibody 49767
MQGTPWPYT

SEQ ID NO: 99534 - protein, 19 aa, Homo sapiens
  heavy chain complementarity determining region 3 for antibody 49767
ARSPAVMWSGDHMYNYFDP

SEQ ID NO: 99535 - protein, 9 aa, Homo sapiens
  light chain complementarity determining region 3 for antibody 49768
MQGTPWPQT

SEQ ID NO: 99536 - protein, 13 aa, Homo sapiens
  heavy chain complementarity determining region 3 for antibody 49768
ARTGQWLGGQYDY

SEQ ID NO: 99537 - protein, 9 aa, Homo sapiens
  light chain complementarity determining region 3 for antibody 49769
MQGTNWPYT

SEQ ID NO: 99538 - protein, 15 aa, Homo sapiens
  heavy chain complementarity determining region 3 for antibody 49769
AVVVAGPSGRKAIDY

SEQ ID NO: 99539 - protein, 10 aa, Homo sapiens
  light chain complementarity determining region 3 for antibody 49770
MQGTNWPPYT

SEQ ID NO: 99540 - protein, 13 aa, Homo sapiens
  heavy chain complementarity determining region 3 for antibody 49770
ARGGAAAGKAFDF

SEQ ID NO: 99541 - protein, 10 aa, Homo sapiens
  light chain complementarity determining region 3 for antibody 49771
MQGTNWPPGT

SEQ ID NO: 99542 - protein, 10 aa, Homo sapiens
  heavy chain complementarity determining region 3 for antibody 49771
VKGVPADWGI

SEQ ID NO: 99543 - protein, 9 aa, Homo sapiens
  light chain complementarity determining region 3 for antibody 49772
MQGTHWPYT

SEQ ID NO: 99544 - protein, 14 aa, Homo sapiens
  heavy chain complementarity determining region 3 for antibody 49772
ARSKWTAPGTPPEY

SEQ ID NO: 99545 - protein, 9 aa, Homo sapiens
  light chain complementarity determining region 3 for antibody 49773
MQGTHWPWT

SEQ ID NO: 99546 - protein, 22 aa, Homo sapiens
  heavy chain complementarity determining region 3 for antibody 49773
ASRHCHSTGCISSYYYYYGIHV

SEQ ID NO: 99547 - protein, 9 aa, Homo sapiens
  light chain complementarity determining region 3 for antibody 49774
MQGTHWPWP

SEQ ID NO: 99548 - protein, 10 aa, Homo sapiens
  heavy chain complementarity determining region 3 for antibody 49774
AKLIQHSSDQ

SEQ ID NO: 99549 - protein, 9 aa, Homo sapiens
  light chain complementarity determining region 3 for antibody 49775
MQGTHWPST

SEQ ID NO: 99550 - protein, 11 aa, Homo sapiens
  heavy chain complementarity determining region 3 for antibody 49775
ARAGDPGAVDI

SEQ ID NO: 99551 - protein, 9 aa, Homo sapiens
  light chain complementarity determining region 3 for antibody 49776
MQGTHWPRT

SEQ ID NO: 99552 - protein, 10 aa, Homo sapiens
  heavy chain complementarity determining region 3 for antibody 49776
IYTGDIWGDH

SEQ ID NO: 99553 - protein, 9 aa, Homo sapiens
  light chain complementarity determining region 3 for antibody 49777
MQGTHWPRR

SEQ ID NO: 99554 - protein, 6 aa, Homo sapiens
  heavy chain complementarity determining region 3 for antibody 49777
ARLTST

SEQ ID NO: 99555 - protein, 10 aa, Homo sapiens
  light chain complementarity determining region 3 for antibody 49778
MQGTHWPPYP

SEQ ID NO: 99556 - protein, 10 aa, Homo sapiens
  heavy chain complementarity determining region 3 for antibody 49778
AKTDGSGPSS

SEQ ID NO: 99557 - protein, 10 aa, Homo sapiens
  light chain complementarity determining region 3 for antibody 49779
MQGTHWPPWT

SEQ ID NO: 99558 - protein, 11 aa, Homo sapiens
  heavy chain complementarity determining region 3 for antibody 49779
ASVHSGYRFDY

SEQ ID NO: 99559 - protein, 10 aa, Homo sapiens
  light chain complementarity determining region 3 for antibody 49780
MQGTHWPPWR

SEQ ID NO: 99560 - protein, 7 aa, Homo sapiens
  heavy chain complementarity determining region 3 for antibody 49780
VRGTFDI

SEQ ID NO: 99561 - protein, 10 aa, Homo sapiens
  light chain complementarity determining region 3 for antibody 49781
MQGTHWPPWR

SEQ ID NO: 99562 - protein, 18 aa, Homo sapiens
  heavy chain complementarity determining region 3 for antibody 49781
VKEGWLMGLAVAGTSEDY

SEQ ID NO: 99563 - protein, 10 aa, Homo sapiens
  light chain complementarity determining region 3 for antibody 49782
MQGTHWPPVT

SEQ ID NO: 99564 - protein, 14 aa, Homo sapiens
  heavy chain complementarity determining region 3 for antibody 49782
VSRPVGGLWYAFDF

SEQ ID NO: 99565 - protein, 10 aa, Homo sapiens
  light chain complementarity determining region 3 for antibody 49783
MQGTHWPPST

SEQ ID NO: 99566 - protein, 14 aa, Homo sapiens
  heavy chain complementarity determining region 3 for antibody 49783
TRGGLYFGEVSPDY

SEQ ID NO: 99567 - protein, 9 aa, Homo sapiens
  light chain complementarity determining region 3 for antibody 49784
MQGTHWPPP

SEQ ID NO: 99568 - protein, 11 aa, Homo sapiens
  heavy chain complementarity determining region 3 for antibody 49784
ATGPQVTMPQD

SEQ ID NO: 99569 - protein, 10 aa, Homo sapiens
  light chain complementarity determining region 3 for antibody 49785
MQGTHWPPNT

SEQ ID NO: 99570 - protein, 15 aa, Homo sapiens
  heavy chain complementarity determining region 3 for antibody 49785
ARTEYIWGSDGAFDI

SEQ ID NO: 99571 - protein, 10 aa, Homo sapiens
  light chain complementarity determining region 3 for antibody 49786
MQGTHWPPGT

SEQ ID NO: 99572 - protein, 11 aa, Homo sapiens
  heavy chain complementarity determining region 3 for antibody 49786
GGFYHGGPCGY

SEQ ID NO: 99573 - protein, 10 aa, Homo sapiens
  light chain complementarity determining region 3 for antibody 49787
MQGTHWPPFT

SEQ ID NO: 99574 - protein, 14 aa, Homo sapiens
  heavy chain complementarity determining region 3 for antibody 49787
TRGGLYFGEVSPDY

SEQ ID NO: 99575 - protein, 10 aa, Homo sapiens
  light chain complementarity determining region 3 for antibody 49788
MQGTHWPPDT

SEQ ID NO: 99576 - protein, 13 aa, Homo sapiens
  heavy chain complementarity determining region 3 for antibody 49788
ARDWAIWQQEFDY

SEQ ID NO: 99577 - protein, 10 aa, Homo sapiens
  light chain complementarity determining region 3 for antibody 49789
MQGTHWPPAT

SEQ ID NO: 99578 - protein, 18 aa, Homo sapiens
  heavy chain complementarity determining region 3 for antibody 49789
ARDQSRQLVRDYYYNMDL

SEQ ID NO: 99579 - protein, 10 aa, Homo sapiens
  light chain complementarity determining region 3 for antibody 49790
MQGTHWPLVT

SEQ ID NO: 99580 - protein, 19 aa, Homo sapiens
  heavy chain complementarity determining region 3 for antibody 49790
ARDGDRYGDYVRGYYGMDV

SEQ ID NO: 99581 - protein, 9 aa, Homo sapiens
  light chain complementarity determining region 3 for antibody 49791
MQGTHWPLT

SEQ ID NO: 99582 - protein, 9 aa, Homo sapiens
  heavy chain complementarity determining region 3 for antibody 49791
AWSNSGGDY

SEQ ID NO: 99583 - protein, 9 aa, Homo sapiens
  light chain complementarity determining region 3 for antibody 49792
MQGTHWPLT

SEQ ID NO: 99584 - protein, 13 aa, Homo sapiens
  heavy chain complementarity determining region 3 for antibody 49792
ARGGDCGGDCFAG

SEQ ID NO: 99585 - protein, 9 aa, Homo sapiens
  light chain complementarity determining region 3 for antibody 49793
MQGTHWPLT

SEQ ID NO: 99586 - protein, 9 aa, Homo sapiens
  heavy chain complementarity determining region 3 for antibody 49793
ARGERGLSH

SEQ ID NO: 99587 - protein, 10 aa, Homo sapiens
  light chain complementarity determining region 3 for antibody 49794
MQGTHWPLPT

SEQ ID NO: 99588 - protein, 19 aa, Homo sapiens
  heavy chain complementarity determining region 3 for antibody 49794
ARDHPPYNNVDHYYYGMDV

SEQ ID NO: 99589 - protein, 9 aa, Homo sapiens
  light chain complementarity determining region 3 for antibody 49795
MQGTHWPKP

SEQ ID NO: 99590 - protein, 11 aa, Homo sapiens
  heavy chain complementarity determining region 3 for antibody 49795
ARDPLGGAFDI

SEQ ID NO: 99591 - protein, 9 aa, Homo sapiens
  light chain complementarity determining region 3 for antibody 49796
MQGTHWPHT

SEQ ID NO: 99592 - protein, 19 aa, Homo sapiens
  heavy chain complementarity determining region 3 for antibody 49796
ARDPYSGDGHNIEYGAFDM

SEQ ID NO: 99593 - protein, 9 aa, Homo sapiens
  light chain complementarity determining region 3 for antibody 49797
MQGTHWPGT

SEQ ID NO: 99594 - protein, 20 aa, Homo sapiens
  heavy chain complementarity determining region 3 for antibody 49797
TRGTRFGVVIVKLWYFGMDV

SEQ ID NO: 99595 - protein, 9 aa, Homo sapiens
  light chain complementarity determining region 3 for antibody 49798
MQGTHWPGT

SEQ ID NO: 99596 - protein, 15 aa, Homo sapiens
  heavy chain complementarity determining region 3 for antibody 49798
ARWGNDNGDYGRLDS

SEQ ID NO: 99597 - protein, 9 aa, Homo sapiens
  light chain complementarity determining region 3 for antibody 49799
MQGTHWPGT

SEQ ID NO: 99598 - protein, 11 aa, Homo sapiens
  heavy chain complementarity determining region 3 for antibody 49799
ARVFYYSPLDP

SEQ ID NO: 99599 - protein, 9 aa, Homo sapiens
  light chain complementarity determining region 3 for antibody 49800
MQGTHWPGT

SEQ ID NO: 99600 - protein, 14 aa, Homo sapiens
  heavy chain complementarity determining region 3 for antibody 49800
ARDRGDGSYYRFED

SEQ ID NO: 99601 - protein, 9 aa, Homo sapiens
  light chain complementarity determining region 3 for antibody 49801
MQGTHWPGT

SEQ ID NO: 99602 - protein, 17 aa, Homo sapiens
  heavy chain complementarity determining region 3 for antibody 49801
ARDGGCSGSRCNSGLGY

SEQ ID NO: 99603 - protein, 9 aa, Homo sapiens
  light chain complementarity determining region 3 for antibody 49802
MQGTHWPGT

SEQ ID NO: 99604 - protein, 10 aa, Homo sapiens
  heavy chain complementarity determining region 3 for antibody 49802
AKLIQHSSDQ

SEQ ID NO: 99605 - protein, 9 aa, Homo sapiens
  light chain complementarity determining region 3 for antibody 49803
MQGTHWPGR

SEQ ID NO: 99606 - protein, 15 aa, Homo sapiens
  heavy chain complementarity determining region 3 for antibody 49803
ARAQVIWGQLYYFDS

SEQ ID NO: 99607 - protein, 10 aa, Homo sapiens
  light chain complementarity determining region 3 for antibody 49804
MQGTHWPGGT

SEQ ID NO: 99608 - protein, 12 aa, Homo sapiens
  heavy chain complementarity determining region 3 for antibody 49804
ARKAIAAGGTDC

SEQ ID NO: 99609 - protein, 9 aa, Homo sapiens
  light chain complementarity determining region 3 for antibody 49805
MQGTHWPFT

SEQ ID NO: 99610 - protein, 16 aa, Homo sapiens
  heavy chain complementarity determining region 3 for antibody 49805
ARDPAIAAAGQVWFDI

SEQ ID NO: 99611 - protein, 9 aa, Homo sapiens
  light chain complementarity determining region 3 for antibody 49806
MQGTHWPDT

SEQ ID NO: 99612 - protein, 11 aa, Homo sapiens
  heavy chain complementarity determining region 3 for antibody 49806
VRDGESGGAHY

SEQ ID NO: 99613 - protein, 9 aa, Homo sapiens
  light chain complementarity determining region 3 for antibody 49807
MQGTHWPDT

SEQ ID NO: 99614 - protein, 15 aa, Homo sapiens
  heavy chain complementarity determining region 3 for antibody 49807
AVVVAGPSGRKAIDY

SEQ ID NO: 99615 - protein, 9 aa, Homo sapiens
  light chain complementarity determining region 3 for antibody 49808
MQGTHWPDT

SEQ ID NO: 99616 - protein, 14 aa, Homo sapiens
  heavy chain complementarity determining region 3 for antibody 49808
ARVDYGGNFAPAIH

SEQ ID NO: 99617 - protein, 9 aa, Homo sapiens
  light chain complementarity determining region 3 for antibody 49809
MQGTHWPDT

SEQ ID NO: 99618 - protein, 25 aa, Homo sapiens
  heavy chain complementarity determining region 3 for antibody 49809
ARSDLVSVRSLWFGDQVDHYYNLDV

SEQ ID NO: 99619 - protein, 9 aa, Homo sapiens
  light chain complementarity determining region 3 for antibody 49810
MQGTHWLDT

SEQ ID NO: 99620 - protein, 8 aa, Homo sapiens
  heavy chain complementarity determining region 3 for antibody 49810
ARYYDRLI

SEQ ID NO: 99621 - protein, 8 aa, Homo sapiens
  light chain complementarity determining region 3 for antibody 49811
MQGTHWLA

SEQ ID NO: 99622 - protein, 10 aa, Homo sapiens
  heavy chain complementarity determining region 3 for antibody 49811
ATEYSGGPDY

SEQ ID NO: 99623 - protein, 9 aa, Homo sapiens
  light chain complementarity determining region 3 for antibody 49812
MQGTHPPST

SEQ ID NO: 99624 - protein, 12 aa, Homo sapiens
  heavy chain complementarity determining region 3 for antibody 49812
PTEAPSTGRLDY

SEQ ID NO: 99625 - protein, 9 aa, Homo sapiens
  light chain complementarity determining region 3 for antibody 49813
MQGTHLPFT

SEQ ID NO: 99626 - protein, 9 aa, Homo sapiens
  heavy chain complementarity determining region 3 for antibody 49813
ARNPRPLPF

SEQ ID NO: 99627 - protein, 9 aa, Homo sapiens
  light chain complementarity determining region 3 for antibody 49814
MQGTHLPFT

SEQ ID NO: 99628 - protein, 9 aa, Homo sapiens
  heavy chain complementarity determining region 3 for antibody 49814
ARNPRHLHF

SEQ ID NO: 99629 - protein, 9 aa, Homo sapiens
  light chain complementarity determining region 3 for antibody 49815
MQGTHLPFP

SEQ ID NO: 99630 - protein, 19 aa, Homo sapiens
  heavy chain complementarity determining region 3 for antibody 49815
AARSKFCSGGSCYYWYFDL

SEQ ID NO: 99631 - protein, 9 aa, Homo sapiens
  light chain complementarity determining region 3 for antibody 49816
MQGTHGPYT

SEQ ID NO: 99632 - protein, 14 aa, Homo sapiens
  heavy chain complementarity determining region 3 for antibody 49816
ARVDYGGNFAPAIH

SEQ ID NO: 99633 - protein, 8 aa, Homo sapiens
  light chain complementarity determining region 3 for antibody 49817
MQGTHGPS

SEQ ID NO: 99634 - protein, 18 aa, Homo sapiens
  heavy chain complementarity determining region 3 for antibody 49817
ARAGYTWNDEPYYYGMDV

SEQ ID NO: 99635 - protein, 9 aa, Homo sapiens
  light chain complementarity determining region 3 for antibody 49818
MQGTHGPRT

SEQ ID NO: 99636 - protein, 14 aa, Homo sapiens
  heavy chain complementarity determining region 3 for antibody 49818
ARDRGDGSYYRFED

SEQ ID NO: 99637 - protein, 9 aa, Homo sapiens
  light chain complementarity determining region 3 for antibody 49819
MQGTHGPQT

SEQ ID NO: 99638 - protein, 13 aa, Homo sapiens
  heavy chain complementarity determining region 3 for antibody 49819
ARTGQWLGGQYDY

SEQ ID NO: 99639 - protein, 9 aa, Homo sapiens
  light chain complementarity determining region 3 for antibody 49820
MQGTHGPPT

SEQ ID NO: 99640 - protein, 14 aa, Homo sapiens
  heavy chain complementarity determining region 3 for antibody 49820
ARLGCFRDHYGMDV

SEQ ID NO: 99641 - protein, 9 aa, Homo sapiens
  light chain complementarity determining region 3 for antibody 49821
MQGTHGPPT

SEQ ID NO: 99642 - protein, 15 aa, Homo sapiens
  heavy chain complementarity determining region 3 for antibody 49821
AREVDKTTDTDGFDV

SEQ ID NO: 99643 - protein, 9 aa, Homo sapiens
  light chain complementarity determining region 3 for antibody 49822
MQGTHGPPT

SEQ ID NO: 99644 - protein, 14 aa, Homo sapiens
  heavy chain complementarity determining region 3 for antibody 49822
ARDLRQWLVSAFDI

SEQ ID NO: 99645 - protein, 9 aa, Homo sapiens
  light chain complementarity determining region 3 for antibody 49823
MQGTHGPPT

SEQ ID NO: 99646 - protein, 14 aa, Homo sapiens
  heavy chain complementarity determining region 3 for antibody 49823
AALGYCNGRICLDL

SEQ ID NO: 99647 - protein, 10 aa, Homo sapiens
  light chain complementarity determining region 3 for antibody 49824
MQGTHGPPGT

SEQ ID NO: 99648 - protein, 17 aa, Homo sapiens
  heavy chain complementarity determining region 3 for antibody 49824
VRDGYTASGRRNAPGAN

SEQ ID NO: 99649 - protein, 10 aa, Homo sapiens
  light chain complementarity determining region 3 for antibody 49825
MQGTHGPPGT

SEQ ID NO: 99650 - protein, 10 aa, Homo sapiens
  heavy chain complementarity determining region 3 for antibody 49825
VKGVPADWGI

SEQ ID NO: 99651 - protein, 9 aa, Homo sapiens
  light chain complementarity determining region 3 for antibody 49826
MQGTHGPLP

SEQ ID NO: 99652 - protein, 9 aa, Homo sapiens
  heavy chain complementarity determining region 3 for antibody 49826
TWSNSGGDY

SEQ ID NO: 99653 - protein, 9 aa, Homo sapiens
  light chain complementarity determining region 3 for antibody 49827
MQGTHGPHT

SEQ ID NO: 99654 - protein, 15 aa, Homo sapiens
  heavy chain complementarity determining region 3 for antibody 49827
AKAQVIWGQLYYFES

SEQ ID NO: 99655 - protein, 9 aa, Homo sapiens
  light chain complementarity determining region 3 for antibody 49828
MQGTHGPGT

SEQ ID NO: 99656 - protein, 20 aa, Homo sapiens
  heavy chain complementarity determining region 3 for antibody 49828
TRGTMFGVVIVKLWYFGMDV

SEQ ID NO: 99657 - protein, 9 aa, Homo sapiens
  light chain complementarity determining region 3 for antibody 49829
MQGTHGPGT

SEQ ID NO: 99658 - protein, 19 aa, Homo sapiens
  heavy chain complementarity determining region 3 for antibody 49829
ARDTARYFDWSEEPNTLDI

SEQ ID NO: 99659 - protein, 9 aa, Homo sapiens
  light chain complementarity determining region 3 for antibody 49830
MQGTHGPGT

SEQ ID NO: 99660 - protein, 15 aa, Homo sapiens
  heavy chain complementarity determining region 3 for antibody 49830
AKDHSPYSSSSDFDY

SEQ ID NO: 99661 - protein, 9 aa, Homo sapiens
  light chain complementarity determining region 3 for antibody 49831
MQGTHCPPT

SEQ ID NO: 99662 - protein, 13 aa, Homo sapiens
  heavy chain complementarity determining region 3 for antibody 49831
ARVHYSSREAVDY

SEQ ID NO: 99663 - protein, 9 aa, Homo sapiens
  light chain complementarity determining region 3 for antibody 49832
MQGTFWWYT

SEQ ID NO: 99664 - protein, 20 aa, Homo sapiens
  heavy chain complementarity determining region 3 for antibody 49832
TTECKSSNCGAKYYYFGMDV

SEQ ID NO: 99665 - protein, 9 aa, Homo sapiens
  light chain complementarity determining region 3 for antibody 49833
MQGSYWWYT

SEQ ID NO: 99666 - protein, 11 aa, Homo sapiens
  heavy chain complementarity determining region 3 for antibody 49833
VATSPEMDSDY

SEQ ID NO: 99667 - protein, 9 aa, Homo sapiens
  light chain complementarity determining region 3 for antibody 49834
MQGSPYSWT

SEQ ID NO: 99668 - protein, 10 aa, Homo sapiens
  heavy chain complementarity determining region 3 for antibody 49834
ARDTFASIDY

SEQ ID NO: 99669 - protein, 9 aa, Homo sapiens
  light chain complementarity determining region 3 for antibody 49835
MQGSHYSWT

SEQ ID NO: 99670 - protein, 10 aa, Homo sapiens
  heavy chain complementarity determining region 3 for antibody 49835
ARDSFASIDY

SEQ ID NO: 99671 - protein, 9 aa, Homo sapiens
  light chain complementarity determining region 3 for antibody 49836
MQGSHWPVT

SEQ ID NO: 99672 - protein, 11 aa, Homo sapiens
  heavy chain complementarity determining region 3 for antibody 49836
ARGSHGHGMDV

SEQ ID NO: 99673 - protein, 24 aa, Homo sapiens
  light chain complementarity determining region 3 for antibody 49837
MQGSHWPTEGWAHFRRRDQGGDQT

SEQ ID NO: 99674 - protein, 15 aa, Homo sapiens
  heavy chain complementarity determining region 3 for antibody 49837
AKGHKQWLEFVASDI

SEQ ID NO: 99675 - protein, 9 aa, Homo sapiens
  light chain complementarity determining region 3 for antibody 49838
MQGSHWPST

SEQ ID NO: 99676 - protein, 21 aa, Homo sapiens
  heavy chain complementarity determining region 3 for antibody 49838
ARLHRHYYDRSGNYVDDGFDV

SEQ ID NO: 99677 - protein, 10 aa, Homo sapiens
  light chain complementarity determining region 3 for antibody 49839
MQGSHWPPYT

SEQ ID NO: 99678 - protein, 11 aa, Homo sapiens
  heavy chain complementarity determining region 3 for antibody 49839
AREAAEGDFDF

SEQ ID NO: 99679 - protein, 10 aa, Homo sapiens
  light chain complementarity determining region 3 for antibody 49840
MQGSHWPPWR

SEQ ID NO: 99680 - protein, 11 aa, Homo sapiens
  heavy chain complementarity determining region 3 for antibody 49840
ARDHPGVGIDY

SEQ ID NO: 99681 - protein, 9 aa, Homo sapiens
  light chain complementarity determining region 3 for antibody 49841
MQGSHWPLT

SEQ ID NO: 99682 - protein, 11 aa, Homo sapiens
  heavy chain complementarity determining region 3 for antibody 49841
ARGSHGHGMDV

SEQ ID NO: 99683 - protein, 9 aa, Homo sapiens
  light chain complementarity determining region 3 for antibody 49842
MQGSHWPLP

SEQ ID NO: 99684 - protein, 15 aa, Homo sapiens
  heavy chain complementarity determining region 3 for antibody 49842
ARDGGVNDDSGHYYV

SEQ ID NO: 99685 - protein, 9 aa, Homo sapiens
  light chain complementarity determining region 3 for antibody 49843
MQGSHWPCT

SEQ ID NO: 99686 - protein, 21 aa, Homo sapiens
  heavy chain complementarity determining region 3 for antibody 49843
ARLHRHYYDRSGNYVDDGFDV

SEQ ID NO: 99687 - protein, 9 aa, Homo sapiens
  light chain complementarity determining region 3 for antibody 49844
MQGSHSSWT

SEQ ID NO: 99688 - protein, 10 aa, Homo sapiens
  heavy chain complementarity determining region 3 for antibody 49844
ARDTFASIDY

SEQ ID NO: 99689 - protein, 9 aa, Homo sapiens
  light chain complementarity determining region 3 for antibody 49845
MQGSHCPLT

SEQ ID NO: 99690 - protein, 21 aa, Homo sapiens
  heavy chain complementarity determining region 3 for antibody 49845
ARLHRHYYDRSGNYVDDGFDV

SEQ ID NO: 99691 - protein, 9 aa, Homo sapiens
  light chain complementarity determining region 3 for antibody 49846
MQGRQTPIT

SEQ ID NO: 99692 - protein, 15 aa, Homo sapiens
  heavy chain complementarity determining region 3 for antibody 49846
ARDVGFGSVPYYFDS

SEQ ID NO: 99693 - protein, 9 aa, Homo sapiens
  light chain complementarity determining region 3 for antibody 49847
MQGRHGPLT

SEQ ID NO: 99694 - protein, 21 aa, Homo sapiens
  heavy chain complementarity determining region 3 for antibody 49847
ARLHRHYYDRSGNYVDDGFDV

SEQ ID NO: 99695 - protein, 9 aa, Homo sapiens
  light chain complementarity determining region 3 for antibody 49848
MQGPHWPPT

SEQ ID NO: 99696 - protein, 16 aa, Homo sapiens
  heavy chain complementarity determining region 3 for antibody 49848
ARVASFYYDRDGMFDS

SEQ ID NO: 99697 - protein, 9 aa, Homo sapiens
  light chain complementarity determining region 3 for antibody 49849
MQGPHWPLT

SEQ ID NO: 99698 - protein, 9 aa, Homo sapiens
  heavy chain complementarity determining region 3 for antibody 49849
TWSNSGGDY

SEQ ID NO: 99699 - protein, 9 aa, Homo sapiens
  light chain complementarity determining region 3 for antibody 49850
MQGPHWPLT

SEQ ID NO: 99700 - protein, 14 aa, Homo sapiens
  heavy chain complementarity determining region 3 for antibody 49850
ARDPFIAVAGSGDY

SEQ ID NO: 99701 - protein, 9 aa, Homo sapiens
  light chain complementarity determining region 3 for antibody 49851
MQGLYGLYT

SEQ ID NO: 99702 - protein, 11 aa, Homo sapiens
  heavy chain complementarity determining region 3 for antibody 49851
VATSPEMDSDY

SEQ ID NO: 99703 - protein, 9 aa, Homo sapiens
  light chain complementarity determining region 3 for antibody 49852
MQGLRIPPT

SEQ ID NO: 99704 - protein, 18 aa, Homo sapiens
  heavy chain complementarity determining region 3 for antibody 49852
ARGGRPWREWLVFNWFVS

SEQ ID NO: 99705 - protein, 9 aa, Homo sapiens
  light chain complementarity determining region 3 for antibody 49853
MQGLQTVLT

SEQ ID NO: 99706 - protein, 15 aa, Homo sapiens
  heavy chain complementarity determining region 3 for antibody 49853
ARGLGTMIRGVIRDQ

SEQ ID NO: 99707 - protein, 9 aa, Homo sapiens
  light chain complementarity determining region 3 for antibody 49854
MQGLQTSWT

SEQ ID NO: 99708 - protein, 17 aa, Homo sapiens
  heavy chain complementarity determining region 3 for antibody 49854
ASEIPPSYSSSQEPFDY

SEQ ID NO: 99709 - protein, 9 aa, Homo sapiens
  light chain complementarity determining region 3 for antibody 49855
MQGLQTSGT

SEQ ID NO: 99710 - protein, 17 aa, Homo sapiens
  heavy chain complementarity determining region 3 for antibody 49855
ASEIPPSYSSSQEPFDY

SEQ ID NO: 99711 - protein, 9 aa, Homo sapiens
  light chain complementarity determining region 3 for antibody 49856
MQGLQTPWP

SEQ ID NO: 99712 - protein, 14 aa, Homo sapiens
  heavy chain complementarity determining region 3 for antibody 49856
ARGRGFTAYAPEGY

SEQ ID NO: 99713 - protein, 8 aa, Homo sapiens
  light chain complementarity determining region 3 for antibody 49857
MQGLQTPT

SEQ ID NO: 99714 - protein, 17 aa, Homo sapiens
  heavy chain complementarity determining region 3 for antibody 49857
ARGAGYCSGESCFKFDL

SEQ ID NO: 99715 - protein, 9 aa, Homo sapiens
  light chain complementarity determining region 3 for antibody 49858
MQGLQTPQT

SEQ ID NO: 99716 - protein, 4 aa, Homo sapiens
  heavy chain complementarity determining region 3 for antibody 49858
GMDV

SEQ ID NO: 99717 - protein, 9 aa, Homo sapiens
  light chain complementarity determining region 3 for antibody 49859
MQGLQTPPT

SEQ ID NO: 99718 - protein, 17 aa, Homo sapiens
  heavy chain complementarity determining region 3 for antibody 49859
ARVDMGRELLNYYGMDV

SEQ ID NO: 99719 - protein, 9 aa, Homo sapiens
  light chain complementarity determining region 3 for antibody 49860
MQGLQTPLT

SEQ ID NO: 99720 - protein, 12 aa, Homo sapiens
  heavy chain complementarity determining region 3 for antibody 49860
VRDRDYFGYFHH

SEQ ID NO: 99721 - protein, 9 aa, Homo sapiens
  light chain complementarity determining region 3 for antibody 49861
MQGLQTPLT

SEQ ID NO: 99722 - protein, 12 aa, Homo sapiens
  heavy chain complementarity determining region 3 for antibody 49861
VRDRDYFGYFHF

SEQ ID NO: 99723 - protein, 8 aa, Homo sapiens
  light chain complementarity determining region 3 for antibody 49862
MQGLQTPG

SEQ ID NO: 99724 - protein, 14 aa, Homo sapiens
  heavy chain complementarity determining region 3 for antibody 49862
VRGHGWGNYYNFDS

SEQ ID NO: 99725 - protein, 9 aa, Homo sapiens
  light chain complementarity determining region 3 for antibody 49863
MQGLQTPGT

SEQ ID NO: 99726 - protein, 18 aa, Homo sapiens
  heavy chain complementarity determining region 3 for antibody 49863
AASGRYFFQNSGPLGFGY

SEQ ID NO: 99727 - protein, 9 aa, Homo sapiens
  light chain complementarity determining region 3 for antibody 49864
MQGLQTPFT

SEQ ID NO: 99728 - protein, 16 aa, Homo sapiens
  heavy chain complementarity determining region 3 for antibody 49864
VTRTIYISDLGGGLDV

SEQ ID NO: 99729 - protein, 9 aa, Homo sapiens
  light chain complementarity determining region 3 for antibody 49865
MQGLQTPFP

SEQ ID NO: 99730 - protein, 14 aa, Homo sapiens
  heavy chain complementarity determining region 3 for antibody 49865
AADPRGYSGYAGGV

SEQ ID NO: 99731 - protein, 9 aa, Homo sapiens
  light chain complementarity determining region 3 for antibody 49866
MQGLQRPPT

SEQ ID NO: 99732 - protein, 22 aa, Homo sapiens
  heavy chain complementarity determining region 3 for antibody 49866
ARGRFKSFDYDSTGYYRKYFDK

SEQ ID NO: 99733 - protein, 9 aa, Homo sapiens
  light chain complementarity determining region 3 for antibody 49867
MQGLQIPPT

SEQ ID NO: 99734 - protein, 12 aa, Homo sapiens
  heavy chain complementarity determining region 3 for antibody 49867
AHNGAARGDLDS

SEQ ID NO: 99735 - protein, 9 aa, Homo sapiens
  light chain complementarity determining region 3 for antibody 49868
MQGLQIPLT

SEQ ID NO: 99736 - protein, 12 aa, Homo sapiens
  heavy chain complementarity determining region 3 for antibody 49868
VRDRDYFGYFQF

SEQ ID NO: 99737 - protein, 9 aa, Homo sapiens
  light chain complementarity determining region 3 for antibody 49869
MQGLQAPGT

SEQ ID NO: 99738 - protein, 23 aa, Homo sapiens
  heavy chain complementarity determining region 3 for antibody 49869
AREREYASGPYYSPLYYYYGVDV

SEQ ID NO: 99739 - protein, 9 aa, Homo sapiens
  light chain complementarity determining region 3 for antibody 49870
MQGLKTPWT

SEQ ID NO: 99740 - protein, 19 aa, Homo sapiens
  heavy chain complementarity determining region 3 for antibody 49870
ARDSFYYETGNYFNDVFDM

SEQ ID NO: 99741 - protein, 9 aa, Homo sapiens
  light chain complementarity determining region 3 for antibody 49871
MQGLHTPLT

SEQ ID NO: 99742 - protein, 12 aa, Homo sapiens
  heavy chain complementarity determining region 3 for antibody 49871
ARWSHSDRIFDS

SEQ ID NO: 99743 - protein, 9 aa, Homo sapiens
  light chain complementarity determining region 3 for antibody 49872
MQGKNWPYL

SEQ ID NO: 99744 - protein, 11 aa, Homo sapiens
  heavy chain complementarity determining region 3 for antibody 49872
ARVGDWNNLEY

SEQ ID NO: 99745 - protein, 9 aa, Homo sapiens
  light chain complementarity determining region 3 for antibody 49873
MQGKHWPLT

SEQ ID NO: 99746 - protein, 9 aa, Homo sapiens
  heavy chain complementarity determining region 3 for antibody 49873
TWSNSGGDY

SEQ ID NO: 99747 - protein, 9 aa, Homo sapiens
  light chain complementarity determining region 3 for antibody 49874
MQGIHGPLR

SEQ ID NO: 99748 - protein, 15 aa, Homo sapiens
  heavy chain complementarity determining region 3 for antibody 49874
TRPYSGYDPRDIFDI

SEQ ID NO: 99749 - protein, 9 aa, Homo sapiens
  light chain complementarity determining region 3 for antibody 49875
MQGAPGPPT

SEQ ID NO: 99750 - protein, 11 aa, Homo sapiens
  heavy chain complementarity determining region 3 for antibody 49875
ARPSHTVTADY

SEQ ID NO: 99751 - protein, 9 aa, Homo sapiens
  light chain complementarity determining region 3 for antibody 49876
MQGANWPPT

SEQ ID NO: 99752 - protein, 11 aa, Homo sapiens
  heavy chain complementarity determining region 3 for antibody 49876
ARPSHTVTADY

SEQ ID NO: 99753 - protein, 9 aa, Homo sapiens
  light chain complementarity determining region 3 for antibody 49877
MQGAHWPIT

SEQ ID NO: 99754 - protein, 12 aa, Homo sapiens
  heavy chain complementarity determining region 3 for antibody 49877
VKEKGGSRVFDY

SEQ ID NO: 99755 - protein, 9 aa, Homo sapiens
  light chain complementarity determining region 3 for antibody 49878
MQGAHWPGT

SEQ ID NO: 99756 - protein, 21 aa, Homo sapiens
  heavy chain complementarity determining region 3 for antibody 49878
ARDAPTRPFFWFGELSPNFDH

SEQ ID NO: 99757 - protein, 10 aa, Homo sapiens
  light chain complementarity determining region 3 for antibody 49879
MQGAHWLPGT

SEQ ID NO: 99758 - protein, 13 aa, Homo sapiens
  heavy chain complementarity determining region 3 for antibody 49879
NVGMVGHTSPVDH

SEQ ID NO: 99759 - protein, 9 aa, Homo sapiens
  light chain complementarity determining region 3 for antibody 49880
MQGAHGPPT

SEQ ID NO: 99760 - protein, 11 aa, Homo sapiens
  heavy chain complementarity determining region 3 for antibody 49880
ARPSHTVTADY

SEQ ID NO: 99761 - protein, 10 aa, Homo sapiens
  light chain complementarity determining region 3 for antibody 49881
MQETHWPPCT

SEQ ID NO: 99762 - protein, 16 aa, Homo sapiens
  heavy chain complementarity determining region 3 for antibody 49881
AKRVWFGELASAVFDG

SEQ ID NO: 99763 - protein, 10 aa, Homo sapiens
  light chain complementarity determining region 3 for antibody 49882
MQDTPWPPCT

SEQ ID NO: 99764 - protein, 16 aa, Homo sapiens
  heavy chain complementarity determining region 3 for antibody 49882
AKRVWFGELSSAVFDV

SEQ ID NO: 99765 - protein, 9 aa, Homo sapiens
  light chain complementarity determining region 3 for antibody 49883
MQDTHWPRP

SEQ ID NO: 99766 - protein, 7 aa, Homo sapiens
  heavy chain complementarity determining region 3 for antibody 49883
ARDSTDF

SEQ ID NO: 99767 - protein, 10 aa, Homo sapiens
  light chain complementarity determining region 3 for antibody 49884
MQDTHWPPGT

SEQ ID NO: 99768 - protein, 16 aa, Homo sapiens
  heavy chain complementarity determining region 3 for antibody 49884
AKRVWFGELASAVFDG

SEQ ID NO: 99769 - protein, 10 aa, Homo sapiens
  light chain complementarity determining region 3 for antibody 49885
MQDTHWPPCT

SEQ ID NO: 99770 - protein, 16 aa, Homo sapiens
  heavy chain complementarity determining region 3 for antibody 49885
AKRVRFGELASAVFDG

SEQ ID NO: 99771 - protein, 10 aa, Homo sapiens
  light chain complementarity determining region 3 for antibody 49886
MQAVQTPGAT

SEQ ID NO: 99772 - protein, 17 aa, Homo sapiens
  heavy chain complementarity determining region 3 for antibody 49886
VKAAYYYDATTYYTHHY

SEQ ID NO: 99773 - protein, 9 aa, Homo sapiens
  light chain complementarity determining region 3 for antibody 49887
MQATYWPFP

SEQ ID NO: 99774 - protein, 14 aa, Homo sapiens
  heavy chain complementarity determining region 3 for antibody 49887
ARHEGKGGGYHFQH

SEQ ID NO: 99775 - protein, 10 aa, Homo sapiens
  light chain complementarity determining region 3 for antibody 49888
MQATPWPPFT

SEQ ID NO: 99776 - protein, 8 aa, Homo sapiens
  heavy chain complementarity determining region 3 for antibody 49888
VRALANSW

SEQ ID NO: 99777 - protein, 10 aa, Homo sapiens
  light chain complementarity determining region 3 for antibody 49889
MQATNWPLYT

SEQ ID NO: 99778 - protein, 11 aa, Homo sapiens
  heavy chain complementarity determining region 3 for antibody 49889
VRGVGRYRPDY

SEQ ID NO: 99779 - protein, 8 aa, Homo sapiens
  light chain complementarity determining region 3 for antibody 49890
MQATNWLS

SEQ ID NO: 99780 - protein, 10 aa, Homo sapiens
  heavy chain complementarity determining region 3 for antibody 49890
AKPGYNSDWS

SEQ ID NO: 99781 - protein, 11 aa, Homo sapiens
  light chain complementarity determining region 3 for antibody 49891
MQATLGPPGVT

SEQ ID NO: 99782 - protein, 16 aa, Homo sapiens
  heavy chain complementarity determining region 3 for antibody 49891
ARDGGVGVDTTMVFDY

SEQ ID NO: 99783 - protein, 9 aa, Homo sapiens
  light chain complementarity determining region 3 for antibody 49892
MQATHWPTT

SEQ ID NO: 99784 - protein, 10 aa, Homo sapiens
  heavy chain complementarity determining region 3 for antibody 49892
ATIGEGSFGN

SEQ ID NO: 99785 - protein, 9 aa, Homo sapiens
  light chain complementarity determining region 3 for antibody 49893
MQATHWPPT

SEQ ID NO: 99786 - protein, 10 aa, Homo sapiens
  heavy chain complementarity determining region 3 for antibody 49893
ATIGEGSFGK

SEQ ID NO: 99787 - protein, 10 aa, Homo sapiens
  light chain complementarity determining region 3 for antibody 49894
MQATHWPPRT

SEQ ID NO: 99788 - protein, 15 aa, Homo sapiens
  heavy chain complementarity determining region 3 for antibody 49894
ARTWIKQWPSEDLDQ

SEQ ID NO: 99789 - protein, 10 aa, Homo sapiens
  light chain complementarity determining region 3 for antibody 49895
MQATHWPPGT

SEQ ID NO: 99790 - protein, 18 aa, Homo sapiens
  heavy chain complementarity determining region 3 for antibody 49895
VRAEISVTMVRGLRAFDT

SEQ ID NO: 99791 - protein, 10 aa, Homo sapiens
  light chain complementarity determining region 3 for antibody 49896
MQATHWPPFP

SEQ ID NO: 99792 - protein, 8 aa, Homo sapiens
  heavy chain complementarity determining region 3 for antibody 49896
VRALANSW

SEQ ID NO: 99793 - protein, 9 aa, Homo sapiens
  light chain complementarity determining region 3 for antibody 49897
MQATHWPLT

SEQ ID NO: 99794 - protein, 15 aa, Homo sapiens
  heavy chain complementarity determining region 3 for antibody 49897
ASELRGAWLKYEFDY

SEQ ID NO: 99795 - protein, 9 aa, Homo sapiens
  light chain complementarity determining region 3 for antibody 49898
MQATHWPGT

SEQ ID NO: 99796 - protein, 15 aa, Homo sapiens
  heavy chain complementarity determining region 3 for antibody 49898
AITSSTSWKGRAFDI

SEQ ID NO: 99797 - protein, 9 aa, Homo sapiens
  light chain complementarity determining region 3 for antibody 49899
MQATHGPYA

SEQ ID NO: 99798 - protein, 10 aa, Homo sapiens
  heavy chain complementarity determining region 3 for antibody 49899
ARDLFRGPAA

SEQ ID NO: 99799 - protein, 9 aa, Homo sapiens
  light chain complementarity determining region 3 for antibody 49900
MQATHGPWT

SEQ ID NO: 99800 - protein, 15 aa, Homo sapiens
  heavy chain complementarity determining region 3 for antibody 49900
AITSSTSWKGRAFDI

SEQ ID NO: 99801 - protein, 10 aa, Homo sapiens
  light chain complementarity determining region 3 for antibody 49901
MQATHGPPWT

SEQ ID NO: 99802 - protein, 18 aa, Homo sapiens
  heavy chain complementarity determining region 3 for antibody 49901
VRAEISVTMVRGLRAFDT

SEQ ID NO: 99803 - protein, 8 aa, Homo sapiens
  light chain complementarity determining region 3 for antibody 49902
MQATHGLS

SEQ ID NO: 99804 - protein, 10 aa, Homo sapiens
  heavy chain complementarity determining region 3 for antibody 49902
AKPGYNSDWS

SEQ ID NO: 99805 - protein, 9 aa, Homo sapiens
  light chain complementarity determining region 3 for antibody 49903
MQASHIPLT

SEQ ID NO: 99806 - protein, 10 aa, Homo sapiens
  heavy chain complementarity determining region 3 for antibody 49903
TTEWAGGPNN

SEQ ID NO: 99807 - protein, 9 aa, Homo sapiens
  light chain complementarity determining region 3 for antibody 49904
MQARQTPCT

SEQ ID NO: 99808 - protein, 11 aa, Homo sapiens
  heavy chain complementarity determining region 3 for antibody 49904
ARVFDYVWFDP

SEQ ID NO: 99809 - protein, 9 aa, Homo sapiens
  light chain complementarity determining region 3 for antibody 49905
MQARQSPGT

SEQ ID NO: 99810 - protein, 11 aa, Homo sapiens
  heavy chain complementarity determining region 3 for antibody 49905
AIDRALIGFDD

SEQ ID NO: 99811 - protein, 9 aa, Homo sapiens
  light chain complementarity determining region 3 for antibody 49906
MQALRTPYT

SEQ ID NO: 99812 - protein, 15 aa, Homo sapiens
  heavy chain complementarity determining region 3 for antibody 49906
ARDNSGVGGKPLFDY

SEQ ID NO: 99813 - protein, 9 aa, Homo sapiens
  light chain complementarity determining region 3 for antibody 49907
MQALRRPGT

SEQ ID NO: 99814 - protein, 12 aa, Homo sapiens
  heavy chain complementarity determining region 3 for antibody 49907
ANNGLEGGTFDH

SEQ ID NO: 99815 - protein, 8 aa, Homo sapiens
  light chain complementarity determining region 3 for antibody 49908
MQALRAPP

SEQ ID NO: 99816 - protein, 16 aa, Homo sapiens
  heavy chain complementarity determining region 3 for antibody 49908
ARHPLFLDNSGYSTDY

SEQ ID NO: 99817 - protein, 9 aa, Homo sapiens
  light chain complementarity determining region 3 for antibody 49909
MQALQVPLP

SEQ ID NO: 99818 - protein, 16 aa, Homo sapiens
  heavy chain complementarity determining region 3 for antibody 49909
ARDPDQDSSMENGMDV

SEQ ID NO: 99819 - protein, 8 aa, Homo sapiens
  light chain complementarity determining region 3 for antibody 49910
MQALQTVT

SEQ ID NO: 99820 - protein, 20 aa, Homo sapiens
  heavy chain complementarity determining region 3 for antibody 49910
ARNSYYGSGNYYKYYYGMDV

SEQ ID NO: 99821 - protein, 9 aa, Homo sapiens
  light chain complementarity determining region 3 for antibody 49911
MQALQTVLT

SEQ ID NO: 99822 - protein, 15 aa, Homo sapiens
  heavy chain complementarity determining region 3 for antibody 49911
ARGLGTMIRGVIRDH

SEQ ID NO: 99823 - protein, 9 aa, Homo sapiens
  light chain complementarity determining region 3 for antibody 49912
MQALQTRYT

SEQ ID NO: 99824 - protein, 16 aa, Homo sapiens
  heavy chain complementarity determining region 3 for antibody 49912
ARVFVVVTWAVHYFDY

SEQ ID NO: 99825 - protein, 9 aa, Homo sapiens
  light chain complementarity determining region 3 for antibody 49913
MQALQTRFT

SEQ ID NO: 99826 - protein, 19 aa, Homo sapiens
  heavy chain complementarity determining region 3 for antibody 49913
GRDRRGLAGGVGGAGGMDV

SEQ ID NO: 99827 - protein, 10 aa, Homo sapiens
  light chain complementarity determining region 3 for antibody 49914
MQALQTRART

SEQ ID NO: 99828 - protein, 13 aa, Homo sapiens
  heavy chain complementarity determining region 3 for antibody 49914
TKLRGGPVTTLEY

SEQ ID NO: 99829 - protein, 9 aa, Homo sapiens
  light chain complementarity determining region 3 for antibody 49915
MQALQTQFT

SEQ ID NO: 99830 - protein, 13 aa, Homo sapiens
  heavy chain complementarity determining region 3 for antibody 49915
ARGIYGGKDGMDV

SEQ ID NO: 99831 - protein, 9 aa, Homo sapiens
  light chain complementarity determining region 3 for antibody 49916
MQALQTPYT

SEQ ID NO: 99832 - protein, 14 aa, Homo sapiens
  heavy chain complementarity determining region 3 for antibody 49916
ASHFSGGTAYYFDH

SEQ ID NO: 99833 - protein, 9 aa, Homo sapiens
  light chain complementarity determining region 3 for antibody 49917
MQALQTPYT

SEQ ID NO: 99834 - protein, 12 aa, Homo sapiens
  heavy chain complementarity determining region 3 for antibody 49917
ARLVRGTNGMDV

SEQ ID NO: 99835 - protein, 9 aa, Homo sapiens
  light chain complementarity determining region 3 for antibody 49918
MQALQTPYT

SEQ ID NO: 99836 - protein, 17 aa, Homo sapiens
  heavy chain complementarity determining region 3 for antibody 49918
ARGVQAYGSQSYYKFVS

SEQ ID NO: 99837 - protein, 9 aa, Homo sapiens
  light chain complementarity determining region 3 for antibody 49919
MQALQTPYT

SEQ ID NO: 99838 - protein, 15 aa, Homo sapiens
  heavy chain complementarity determining region 3 for antibody 49919
ARDNSGVGGEPLFDY

SEQ ID NO: 99839 - protein, 9 aa, Homo sapiens
  light chain complementarity determining region 3 for antibody 49920
MQALQTPWT

SEQ ID NO: 99840 - protein, 15 aa, Homo sapiens
  heavy chain complementarity determining region 3 for antibody 49920
ARSPLTIFYYSGMDV

SEQ ID NO: 99841 - protein, 9 aa, Homo sapiens
  light chain complementarity determining region 3 for antibody 49921
MQALQTPWT

SEQ ID NO: 99842 - protein, 23 aa, Homo sapiens
  heavy chain complementarity determining region 3 for antibody 49921
ARSDYYGSGPYYSPLYYYYGINV

SEQ ID NO: 99843 - protein, 9 aa, Homo sapiens
  light chain complementarity determining region 3 for antibody 49922
MQALQTPWR

SEQ ID NO: 99844 - protein, 16 aa, Homo sapiens
  heavy chain complementarity determining region 3 for antibody 49922
AREFGDYFRRAGTFDY

SEQ ID NO: 99845 - protein, 8 aa, Homo sapiens
  light chain complementarity determining region 3 for antibody 49923
MQALQTPT

SEQ ID NO: 99846 - protein, 10 aa, Homo sapiens
  heavy chain complementarity determining region 3 for antibody 49923
GKADWNYVSY

SEQ ID NO: 99847 - protein, 8 aa, Homo sapiens
  light chain complementarity determining region 3 for antibody 49924
MQALQTPT

SEQ ID NO: 99848 - protein, 12 aa, Homo sapiens
  heavy chain complementarity determining region 3 for antibody 49924
ERLGDSGGDSDF

SEQ ID NO: 99849 - protein, 9 aa, Homo sapiens
  light chain complementarity determining region 3 for antibody 49925
MQALQTPST

SEQ ID NO: 99850 - protein, 17 aa, Homo sapiens
  heavy chain complementarity determining region 3 for antibody 49925
ARGDQAYGSQSYYKFVS

SEQ ID NO: 99851 - protein, 9 aa, Homo sapiens
  light chain complementarity determining region 3 for antibody 49926
MQALQTPST

SEQ ID NO: 99852 - protein, 15 aa, Homo sapiens
  heavy chain complementarity determining region 3 for antibody 49926
ARDNSGVGGNPLFDY

SEQ ID NO: 99853 - protein, 9 aa, Homo sapiens
  light chain complementarity determining region 3 for antibody 49927
MQALQTPST

SEQ ID NO: 99854 - protein, 15 aa, Homo sapiens
  heavy chain complementarity determining region 3 for antibody 49927
ARDNSGVGGKPLFDY

SEQ ID NO: 99855 - protein, 9 aa, Homo sapiens
  light chain complementarity determining region 3 for antibody 49928
MQALQTPST

SEQ ID NO: 99856 - protein, 12 aa, Homo sapiens
  heavy chain complementarity determining region 3 for antibody 49928
ARATWFGVRFDS

SEQ ID NO: 99857 - protein, 9 aa, Homo sapiens
  light chain complementarity determining region 3 for antibody 49929
MQALQTPRT

SEQ ID NO: 99858 - protein, 23 aa, Homo sapiens
  heavy chain complementarity determining region 3 for antibody 49929
ASRYPSSWHDQFRNNYYSYSMDV

SEQ ID NO: 99859 - protein, 9 aa, Homo sapiens
  light chain complementarity determining region 3 for antibody 49930
MQALQTPRR

SEQ ID NO: 99860 - protein, 30 aa, Homo sapiens; identical to SEQ ID NO: 86900
  heavy chain complementarity determining region 3 for antibody 49930

SEQ ID NO: 99861 - protein, 9 aa, Homo sapiens
  light chain complementarity determining region 3 for antibody 49931
MQALQTPRR

SEQ ID NO: 99862 - protein, 10 aa, Homo sapiens
  heavy chain complementarity determining region 3 for antibody 49931
ARDSDIGLDY

SEQ ID NO: 99863 - protein, 9 aa, Homo sapiens
  light chain complementarity determining region 3 for antibody 49932
MQALQTPRP

SEQ ID NO: 99864 - protein, 11 aa, Homo sapiens
  heavy chain complementarity determining region 3 for antibody 49932
GVVVTPDYVDY

SEQ ID NO: 99865 - protein, 9 aa, Homo sapiens
  light chain complementarity determining region 3 for antibody 49933
MQALQTPPT

SEQ ID NO: 99866 - protein, 12 aa, Homo sapiens
  heavy chain complementarity determining region 3 for antibody 49933
ARWDGSGWHWDF

SEQ ID NO: 99867 - protein, 9 aa, Homo sapiens
  light chain complementarity determining region 3 for antibody 49934
MQALQTPPT

SEQ ID NO: 99868 - protein, 16 aa, Homo sapiens
  heavy chain complementarity determining region 3 for antibody 49934
ARVDRAQAGREYFCDY

SEQ ID NO: 99869 - protein, 9 aa, Homo sapiens
  light chain complementarity determining region 3 for antibody 49935
MQALQTPPT

SEQ ID NO: 99870 - protein, 10 aa, Homo sapiens
  heavy chain complementarity determining region 3 for antibody 49935
ARIPRNSGCL

SEQ ID NO: 99871 - protein, 9 aa, Homo sapiens
  light chain complementarity determining region 3 for antibody 49936
MQALQTPPT

SEQ ID NO: 99872 - protein, 14 aa, Homo sapiens
  heavy chain complementarity determining region 3 for antibody 49936
ARGSSSIGIRYFDS

SEQ ID NO: 99873 - protein, 10 aa, Homo sapiens
  light chain complementarity determining region 3 for antibody 49937
MQALQTPPGT

SEQ ID NO: 99874 - protein, 19 aa, Homo sapiens
  heavy chain complementarity determining region 3 for antibody 49937
ARDKRPFDYGDFRGEAFDS

SEQ ID NO: 99875 - protein, 8 aa, Homo sapiens
  light chain complementarity determining region 3 for antibody 49938
MQALQTPP

SEQ ID NO: 99876 - protein, 12 aa, Homo sapiens
  heavy chain complementarity determining region 3 for antibody 49938
ELLGDSGGDSDF

SEQ ID NO: 99877 - protein, 10 aa, Homo sapiens
  light chain complementarity determining region 3 for antibody 49939
MQALQTPMYT

SEQ ID NO: 99878 - protein, 12 aa, Homo sapiens
  heavy chain complementarity determining region 3 for antibody 49939
ARYNWGVGSFDY

SEQ ID NO: 99879 - protein, 10 aa, Homo sapiens
  light chain complementarity determining region 3 for antibody 49940
MQALQTPLYT

SEQ ID NO: 99880 - protein, 12 aa, Homo sapiens
  heavy chain complementarity determining region 3 for antibody 49940
ARGSAYADYVDY

SEQ ID NO: 99881 - protein, 9 aa, Homo sapiens
  light chain complementarity determining region 3 for antibody 49941
MQALQTPLT

SEQ ID NO: 99882 - protein, 12 aa, Homo sapiens
  heavy chain complementarity determining region 3 for antibody 49941
VKDSDQKWELVD

SEQ ID NO: 99883 - protein, 9 aa, Homo sapiens
  light chain complementarity determining region 3 for antibody 49942
MQALQTPLT

SEQ ID NO: 99884 - protein, 12 aa, Homo sapiens
  heavy chain complementarity determining region 3 for antibody 49942
VKDSDQKWDLLD

SEQ ID NO: 99885 - protein, 9 aa, Homo sapiens
  light chain complementarity determining region 3 for antibody 49943
MQALQTPLT

SEQ ID NO: 99886 - protein, 21 aa, Homo sapiens
  heavy chain complementarity determining region 3 for antibody 49943
ARTQYTGYDWDHLFPLLGFDY

SEQ ID NO: 99887 - protein, 9 aa, Homo sapiens
  light chain complementarity determining region 3 for antibody 49944
MQALQTPLT

SEQ ID NO: 99888 - protein, 15 aa, Homo sapiens
  heavy chain complementarity determining region 3 for antibody 49944
ARLGLYGSSWYTFDP

SEQ ID NO: 99889 - protein, 9 aa, Homo sapiens
  light chain complementarity determining region 3 for antibody 49945
MQALQTPLT

SEQ ID NO: 99890 - protein, 18 aa, Homo sapiens
  heavy chain complementarity determining region 3 for antibody 49945
ARGVLVWFGDPKSGGVDY

SEQ ID NO: 99891 - protein, 9 aa, Homo sapiens
  light chain complementarity determining region 3 for antibody 49946
MQALQTPLT

SEQ ID NO: 99892 - protein, 17 aa, Homo sapiens
  heavy chain complementarity determining region 3 for antibody 49946
ARDANPSKRWPDNYFDP

SEQ ID NO: 99893 - protein, 9 aa, Homo sapiens
  light chain complementarity determining region 3 for antibody 49947
MQALQTPLS

SEQ ID NO: 99894 - protein, 16 aa, Homo sapiens
  heavy chain complementarity determining region 3 for antibody 49947
ARAPGIEAAEGYYFDL

SEQ ID NO: 99895 - protein, 11 aa, Homo sapiens
  light chain complementarity determining region 3 for antibody 49948
MQALQTPLGYP

SEQ ID NO: 99896 - protein, 13 aa, Homo sapiens
  heavy chain complementarity determining region 3 for antibody 49948
AKSSRGREHQFMP

SEQ ID NO: 99897 - protein, 9 aa, Homo sapiens
  light chain complementarity determining region 3 for antibody 49949
MQALQTPIT

SEQ ID NO: 99898 - protein, 10 aa, Homo sapiens
  heavy chain complementarity determining region 3 for antibody 49949
GMSIAVAASK

SEQ ID NO: 99899 - protein, 9 aa, Homo sapiens
  light chain complementarity determining region 3 for antibody 49950
MQALQTPGT

SEQ ID NO: 99900 - protein, 15 aa, Homo sapiens
  heavy chain complementarity determining region 3 for antibody 49950
ARSPLTVFYYSGMDV

SEQ ID NO: 99901 - protein, 9 aa, Homo sapiens
  light chain complementarity determining region 3 for antibody 49951
MQALQTPGT

SEQ ID NO: 99902 - protein, 23 aa, Homo sapiens
  heavy chain complementarity determining region 3 for antibody 49951
ARSDYYGSGPYYSPLYYYYGINV

SEQ ID NO: 99903 - protein, 9 aa, Homo sapiens
  light chain complementarity determining region 3 for antibody 49952
MQALQTPGT

SEQ ID NO: 99904 - protein, 30 aa, Homo sapiens; identical to SEQ ID NO: 86900
  heavy chain complementarity determining region 3 for antibody 49952

SEQ ID NO: 99905 - protein, 9 aa, Homo sapiens
  light chain complementarity determining region 3 for antibody 49953
MQALQTPGT

SEQ ID NO: 99906 - protein, 16 aa, Homo sapiens
  heavy chain complementarity determining region 3 for antibody 49953
ARDLRYGYGGISQGDY

SEQ ID NO: 99907 - protein, 9 aa, Homo sapiens
  light chain complementarity determining region 3 for antibody 49954
MQALQTPGT

SEQ ID NO: 99908 - protein, 14 aa, Homo sapiens
  heavy chain complementarity determining region 3 for antibody 49954
ARDLGHDYGSGMDV

SEQ ID NO: 99909 - protein, 9 aa, Homo sapiens
  light chain complementarity determining region 3 for antibody 49955
MQALQTPGT

SEQ ID NO: 99910 - protein, 17 aa, Homo sapiens
  heavy chain complementarity determining region 3 for antibody 49955
ARDAWFRGLIMFYGMDV

SEQ ID NO: 99911 - protein, 9 aa, Homo sapiens
  light chain complementarity determining region 3 for antibody 49956
MQALQTPGR

SEQ ID NO: 99912 - protein, 18 aa, Homo sapiens
  heavy chain complementarity determining region 3 for antibody 49956
AASGRYFFQNSGPLGFGY

SEQ ID NO: 99913 - protein, 9 aa, Homo sapiens
  light chain complementarity determining region 3 for antibody 49957
MQALQTPGP

SEQ ID NO: 99914 - protein, 18 aa, Homo sapiens
  heavy chain complementarity determining region 3 for antibody 49957
AASGRYFFQNSGPLGFGY

SEQ ID NO: 99915 - protein, 10 aa, Homo sapiens
  light chain complementarity determining region 3 for antibody 49958
MQALQTPGNT

SEQ ID NO: 99916 - protein, 15 aa, Homo sapiens
  heavy chain complementarity determining region 3 for antibody 49958
VRAQVIWGQLYYFDY

SEQ ID NO: 99917 - protein, 10 aa, Homo sapiens
  light chain complementarity determining region 3 for antibody 49959
MQALQTPGNT

SEQ ID NO: 99918 - protein, 14 aa, Homo sapiens
  heavy chain complementarity determining region 3 for antibody 49959
ARLEIVEIPPGKNN

SEQ ID NO: 99919 - protein, 10 aa, Homo sapiens
  light chain complementarity determining region 3 for antibody 49960
MQALQTPGGT

SEQ ID NO: 99920 - protein, 17 aa, Homo sapiens
  heavy chain complementarity determining region 3 for antibody 49960
VKAAYLHDGTTYYTHHY

SEQ ID NO: 99921 - protein, 10 aa, Homo sapiens
  light chain complementarity determining region 3 for antibody 49961
MQALQTPGGT

SEQ ID NO: 99922 - protein, 22 aa, Homo sapiens
  heavy chain complementarity determining region 3 for antibody 49961
ARDSRRLLTVTRGEYYYFGMDV

SEQ ID NO: 99923 - protein, 10 aa, Homo sapiens
  light chain complementarity determining region 3 for antibody 49962
MQALQTPGAT

SEQ ID NO: 99924 - protein, 17 aa, Homo sapiens
  heavy chain complementarity determining region 3 for antibody 49962
VKAAYLHDGTTYYTHHY

SEQ ID NO: 99925 - protein, 10 aa, Homo sapiens
  light chain complementarity determining region 3 for antibody 49963
MQALQTPGAT

SEQ ID NO: 99926 - protein, 22 aa, Homo sapiens
  heavy chain complementarity determining region 3 for antibody 49963
ARDSRRLLTVTRGEYYYFGMDV

SEQ ID NO: 99927 - protein, 8 aa, Homo sapiens
  light chain complementarity determining region 3 for antibody 49964
MQALQTPG

SEQ ID NO: 99928 - protein, 19 aa, Homo sapiens
  heavy chain complementarity determining region 3 for antibody 49964
ANFGSGNFYNVRYYSGMDV

SEQ ID NO: 99929 - protein, 9 aa, Homo sapiens
  light chain complementarity determining region 3 for antibody 49965
MQALQTPFT

SEQ ID NO: 99930 - protein, 15 aa, Homo sapiens
  heavy chain complementarity determining region 3 for antibody 49965
ARLGLYGSSWYTFDP

SEQ ID NO: 99931 - protein, 9 aa, Homo sapiens
  light chain complementarity determining region 3 for antibody 49966
MQALQTPFT

SEQ ID NO: 99932 - protein, 16 aa, Homo sapiens
  heavy chain complementarity determining region 3 for antibody 49966
ARHRGGGLQWLVGIDD

SEQ ID NO: 99933 - protein, 8 aa, Homo sapiens
  light chain complementarity determining region 3 for antibody 49967
MQALQTPF

SEQ ID NO: 99934 - protein, 15 aa, Homo sapiens
  heavy chain complementarity determining region 3 for antibody 49967
AKNGDTGSYRGWFEP

SEQ ID NO: 99935 - protein, 9 aa, Homo sapiens
  light chain complementarity determining region 3 for antibody 49968
MQALQTPDT

SEQ ID NO: 99936 - protein, 16 aa, Homo sapiens
  heavy chain complementarity determining region 3 for antibody 49968
ATPRYGAGRQYGGVDY

SEQ ID NO: 99937 - protein, 9 aa, Homo sapiens
  light chain complementarity determining region 3 for antibody 49969
MQALQTPDT

SEQ ID NO: 99938 - protein, 16 aa, Homo sapiens
  heavy chain complementarity determining region 3 for antibody 49969
ARVFVVVTWAVHYFDY

SEQ ID NO: 99939 - protein, 8 aa, Homo sapiens
  light chain complementarity determining region 3 for antibody 49970
MQALQTNP

SEQ ID NO: 99940 - protein, 14 aa, Homo sapiens
  heavy chain complementarity determining region 3 for antibody 49970
ARVRSEVYSSSPDY

SEQ ID NO: 99941 - protein, 8 aa, Homo sapiens
  light chain complementarity determining region 3 for antibody 49971
MQALQTNN

SEQ ID NO: 99942 - protein, 14 aa, Homo sapiens
  heavy chain complementarity determining region 3 for antibody 49971
ARVRSEVYSSSPDY

SEQ ID NO: 99943 - protein, 8 aa, Homo sapiens
  light chain complementarity determining region 3 for antibody 49972
MQALQTNI

SEQ ID NO: 99944 - protein, 14 aa, Homo sapiens
  heavy chain complementarity determining region 3 for antibody 49972
ARVRSEVYSSSPDY

SEQ ID NO: 99945 - protein, 9 aa, Homo sapiens
  light chain complementarity determining region 3 for antibody 49973
MQALQTALT

SEQ ID NO: 99946 - protein, 14 aa, Homo sapiens
  heavy chain complementarity determining region 3 for antibody 49973
ASIGRDWPTVSLDY

SEQ ID NO: 99947 - protein, 9 aa, Homo sapiens
  light chain complementarity determining region 3 for antibody 49974
MQALQTAIT

SEQ ID NO: 99948 - protein, 19 aa, Homo sapiens
  heavy chain complementarity determining region 3 for antibody 49974
ARRTDWHSRGWYGKFYFDY

SEQ ID NO: 99949 - protein, 9 aa, Homo sapiens
  light chain complementarity determining region 3 for antibody 49975
MQALQSQVT

SEQ ID NO: 99950 - protein, 13 aa, Homo sapiens
  heavy chain complementarity determining region 3 for antibody 49975
ARDAGQHYDQFDC

SEQ ID NO: 99951 - protein, 9 aa, Homo sapiens
  light chain complementarity determining region 3 for antibody 49976
MQALQSPRR

SEQ ID NO: 99952 - protein, 7 aa, Homo sapiens
  heavy chain complementarity determining region 3 for antibody 49976
MDGDYGF

SEQ ID NO: 99953 - protein, 9 aa, Homo sapiens
  light chain complementarity determining region 3 for antibody 49977
MQALQSPRP

SEQ ID NO: 99954 - protein, 7 aa, Homo sapiens
  heavy chain complementarity determining region 3 for antibody 49977
MDGDYGF

SEQ ID NO: 99955 - protein, 9 aa, Homo sapiens
  light chain complementarity determining region 3 for antibody 49978
MQALQSPLT

SEQ ID NO: 99956 - protein, 17 aa, Homo sapiens
  heavy chain complementarity determining region 3 for antibody 49978
AKDIFFAIAVAGTAFDI

SEQ ID NO: 99957 - protein, 9 aa, Homo sapiens
  light chain complementarity determining region 3 for antibody 49979
MQALQSPGT

SEQ ID NO: 99958 - protein, 7 aa, Homo sapiens
  heavy chain complementarity determining region 3 for antibody 49979
MDGDYGF

SEQ ID NO: 99959 - protein, 9 aa, Homo sapiens
  light chain complementarity determining region 3 for antibody 49980
MQALQSPFA

SEQ ID NO: 99960 - protein, 9 aa, Homo sapiens
  heavy chain complementarity determining region 3 for antibody 49980
TWSNSGGDY

SEQ ID NO: 99961 - protein, 9 aa, Homo sapiens
  light chain complementarity determining region 3 for antibody 49981
MQALQPPQT

SEQ ID NO: 99962 - protein, 20 aa, Homo sapiens
  heavy chain complementarity determining region 3 for antibody 49981
ARDPSNIAAPDGYYYYGLDI

SEQ ID NO: 99963 - protein, 9 aa, Homo sapiens
  light chain complementarity determining region 3 for antibody 49982
MQALQPPPT

SEQ ID NO: 99964 - protein, 16 aa, Homo sapiens
  heavy chain complementarity determining region 3 for antibody 49982
GVSPGVYCRGASCLSS

SEQ ID NO: 99965 - protein, 9 aa, Homo sapiens
  light chain complementarity determining region 3 for antibody 49983
MQALQPPLT

SEQ ID NO: 99966 - protein, 16 aa, Homo sapiens
  heavy chain complementarity determining region 3 for antibody 49983
ARVRNGNSGGWYGIVY

SEQ ID NO: 99967 - protein, 9 aa, Homo sapiens
  light chain complementarity determining region 3 for antibody 49984
MQALQNPRT

SEQ ID NO: 99968 - protein, 15 aa, Homo sapiens
  heavy chain complementarity determining region 3 for antibody 49984
AKRPGGSYLLDGFDI

SEQ ID NO: 99969 - protein, 9 aa, Homo sapiens
  light chain complementarity determining region 3 for antibody 49985
MQALQIPYT

SEQ ID NO: 99970 - protein, 15 aa, Homo sapiens
  heavy chain complementarity determining region 3 for antibody 49985
ARDNSGVGGKPLFDY

SEQ ID NO: 99971 - protein, 8 aa, Homo sapiens
  light chain complementarity determining region 3 for antibody 49986
MQALQIPT

SEQ ID NO: 99972 - protein, 15 aa, Homo sapiens
  heavy chain complementarity determining region 3 for antibody 49986
TRDSGDSSRWYGMAV

SEQ ID NO: 99973 - protein, 9 aa, Homo sapiens
  light chain complementarity determining region 3 for antibody 49987
MQALQIPST

SEQ ID NO: 99974 - protein, 12 aa, Homo sapiens
  heavy chain complementarity determining region 3 for antibody 49987
ARGRVGGNSFDQ

SEQ ID NO: 99975 - protein, 9 aa, Homo sapiens
  light chain complementarity determining region 3 for antibody 49988
MQALQIPRT

SEQ ID NO: 99976 - protein, 18 aa, Homo sapiens
  heavy chain complementarity determining region 3 for antibody 49988
LKGGGHCTTTACPGAFDI

SEQ ID NO: 99977 - protein, 9 aa, Homo sapiens
  light chain complementarity determining region 3 for antibody 49989
MQALQIPPT

SEQ ID NO: 99978 - protein, 12 aa, Homo sapiens
  heavy chain complementarity determining region 3 for antibody 49989
VRDNGWLGTFDA

SEQ ID NO: 99979 - protein, 9 aa, Homo sapiens
  light chain complementarity determining region 3 for antibody 49990
MQALQIPGT

SEQ ID NO: 99980 - protein, 16 aa, Homo sapiens
  heavy chain complementarity determining region 3 for antibody 49990
ARVGVNWDLGSNGFDI

SEQ ID NO: 99981 - protein, 9 aa, Homo sapiens
  light chain complementarity determining region 3 for antibody 49991
MQALQIPFT

SEQ ID NO: 99982 - protein, 12 aa, Homo sapiens
  heavy chain complementarity determining region 3 for antibody 49991
ARVAHLGRGFHY

SEQ ID NO: 99983 - protein, 9 aa, Homo sapiens
  light chain complementarity determining region 3 for antibody 49992
MQALQIPFT

SEQ ID NO: 99984 - protein, 12 aa, Homo sapiens
  heavy chain complementarity determining region 3 for antibody 49992
ARGRVGGNSFAQ

SEQ ID NO: 99985 - protein, 9 aa, Homo sapiens
  light chain complementarity determining region 3 for antibody 49993
MQALQILST

SEQ ID NO: 99986 - protein, 19 aa, Homo sapiens
  heavy chain complementarity determining region 3 for antibody 49993
ARVRCSSTSCLKYYYGMDV

SEQ ID NO: 99987 - protein, 9 aa, Homo sapiens
  light chain complementarity determining region 3 for antibody 49994
MQALQFPRT

SEQ ID NO: 99988 - protein, 7 aa, Homo sapiens
  heavy chain complementarity determining region 3 for antibody 49994
MDGDYGF

SEQ ID NO: 99989 - protein, 9 aa, Homo sapiens
  light chain complementarity determining region 3 for antibody 49995
MQALQAPGT

SEQ ID NO: 99990 - protein, 15 aa, Homo sapiens
  heavy chain complementarity determining region 3 for antibody 49995
ARSPLTIFYYSGMDV

SEQ ID NO: 99991 - protein, 9 aa, Homo sapiens
  light chain complementarity determining region 3 for antibody 49996
MQALPTPWT

SEQ ID NO: 99992 - protein, 15 aa, Homo sapiens
  heavy chain complementarity determining region 3 for antibody 49996
ARSPLTIFYYSGMDV

SEQ ID NO: 99993 - protein, 9 aa, Homo sapiens
  light chain complementarity determining region 3 for antibody 49997
MQALPTPPT

SEQ ID NO: 99994 - protein, 16 aa, Homo sapiens
  heavy chain complementarity determining region 3 for antibody 49997
ARGTTTNTGLVWGIAH

SEQ ID NO: 99995 - protein, 9 aa, Homo sapiens
  light chain complementarity determining region 3 for antibody 49998
MQALPTPLT

SEQ ID NO: 99996 - protein, 16 aa, Homo sapiens
  heavy chain complementarity determining region 3 for antibody 49998
ARVRNGNSGGWYGIVY

SEQ ID NO: 99997 - protein, 9 aa, Homo sapiens
  light chain complementarity determining region 3 for antibody 49999
MQALLSPRT

SEQ ID NO: 99998 - protein, 13 aa, Homo sapiens
  heavy chain complementarity determining region 3 for antibody 49999
ARDRLGFGNVFDV

SEQ ID NO: 99999 - protein, 9 aa, Homo sapiens
  light chain complementarity determining region 3 for antibody 50000
MQALLSPGT

SEQ ID NO: 100000 - protein, 13 aa, Homo sapiens
  heavy chain complementarity determining region 3 for antibody 50000
ARDRLGFGNFFDV

SEQ ID NO: 100001 - protein, 9 aa, Homo sapiens
  light chain complementarity determining region 3 for antibody 50001
MQALKTPWT

SEQ ID NO: 100002 - protein, 16 aa, Homo sapiens
  heavy chain complementarity determining region 3 for antibody 50001
AREGYCDGVSCNLIDP

SEQ ID NO: 100003 - protein, 9 aa, Homo sapiens
  light chain complementarity determining region 3 for antibody 50002
MQALKTPWT

SEQ ID NO: 100004 - protein, 14 aa, Homo sapiens
  heavy chain complementarity determining region 3 for antibody 50002
ARDMSEISGWWLDP

SEQ ID NO: 100005 - protein, 8 aa, Homo sapiens
  light chain complementarity determining region 3 for antibody 50003
MQALKTPS

SEQ ID NO: 100006 - protein, 15 aa, Homo sapiens
  heavy chain complementarity determining region 3 for antibody 50003
AKNGDTGSYRGWFEP

SEQ ID NO: 100007 - protein, 9 aa, Homo sapiens
  light chain complementarity determining region 3 for antibody 50004
MQALKTPRT

SEQ ID NO: 100008 - protein, 10 aa, Homo sapiens
  heavy chain complementarity determining region 3 for antibody 50004
ARDSDIGLDY

SEQ ID NO: 100009 - protein, 9 aa, Homo sapiens
  light chain complementarity determining region 3 for antibody 50005
MQALKTPLT

SEQ ID NO: 100010 - protein, 14 aa, Homo sapiens
  heavy chain complementarity determining region 3 for antibody 50005
ARGSSSIGIRYFDS

SEQ ID NO: 100011 - protein, 8 aa, Homo sapiens
  light chain complementarity determining region 3 for antibody 50006
MQALKSGV

SEQ ID NO: 100012 - protein, 20 aa, Homo sapiens
  heavy chain complementarity determining region 3 for antibody 50006
ARERVRHSSGPLHYYLGIDV

SEQ ID NO: 100013 - protein, 9 aa, Homo sapiens
  light chain complementarity determining region 3 for antibody 50007
MQALKPPPT

SEQ ID NO: 100014 - protein, 14 aa, Homo sapiens
  heavy chain complementarity determining region 3 for antibody 50007
VRALSRGGRHDFDS

SEQ ID NO: 100015 - protein, 9 aa, Homo sapiens
  light chain complementarity determining region 3 for antibody 50008
MQALKIPFT

SEQ ID NO: 100016 - protein, 12 aa, Homo sapiens
  heavy chain complementarity determining region 3 for antibody 50008
ARGRVGGNSFDQ

SEQ ID NO: 100017 - protein, 8 aa, Homo sapiens
  light chain complementarity determining region 3 for antibody 50009
MQALHTPS

SEQ ID NO: 100018 - protein, 15 aa, Homo sapiens
  heavy chain complementarity determining region 3 for antibody 50009
AKNGDTGSYRGWFEP

SEQ ID NO: 100019 - protein, 10 aa, Homo sapiens
  light chain complementarity determining region 3 for antibody 50010
MQALHTPPYT

SEQ ID NO: 100020 - protein, 15 aa, Homo sapiens
  heavy chain complementarity determining region 3 for antibody 50010
VRDSYQDPYYYGMDV

SEQ ID NO: 100021 - protein, 9 aa, Homo sapiens
  light chain complementarity determining region 3 for antibody 50011
MQALHTPPT

SEQ ID NO: 100022 - protein, 20 aa, Homo sapiens
  heavy chain complementarity determining region 3 for antibody 50011
ARARSISLVRGAMPNWGLDY

SEQ ID NO: 100023 - protein, 9 aa, Homo sapiens
  light chain complementarity determining region 3 for antibody 50012
MQALHTPFT

SEQ ID NO: 100024 - protein, 13 aa, Homo sapiens
  heavy chain complementarity determining region 3 for antibody 50012
ARGIYGGKDGMDV

SEQ ID NO: 100025 - protein, 9 aa, Homo sapiens
  light chain complementarity determining region 3 for antibody 50013
MQALHSPRT

SEQ ID NO: 100026 - protein, 15 aa, Homo sapiens
  heavy chain complementarity determining region 3 for antibody 50013
AKDIHGDDGMRQFES

SEQ ID NO: 100027 - protein, 9 aa, Homo sapiens
  light chain complementarity determining region 3 for antibody 50014
MQALHIPDT

SEQ ID NO: 100028 - protein, 20 aa, Homo sapiens
  heavy chain complementarity determining region 3 for antibody 50014
ARWASRGITVVRRVPGTFDS

SEQ ID NO: 100029 - protein, 9 aa, Homo sapiens
  light chain complementarity determining region 3 for antibody 50015
MQALETTIT

SEQ ID NO: 100030 - protein, 16 aa, Homo sapiens
  heavy chain complementarity determining region 3 for antibody 50015
ARIPLGSSSQGPIFDS

SEQ ID NO: 100031 - protein, 9 aa, Homo sapiens
  light chain complementarity determining region 3 for antibody 50016
MQALETPRP

SEQ ID NO: 100032 - protein, 14 aa, Homo sapiens
  heavy chain complementarity determining region 3 for antibody 50016
ARFSGYDESRYFDS

SEQ ID NO: 100033 - protein, 9 aa, Homo sapiens
  light chain complementarity determining region 3 for antibody 50017
MQALETPGT

SEQ ID NO: 100034 - protein, 17 aa, Homo sapiens
  heavy chain complementarity determining region 3 for antibody 50017
TRHGDHLGGYYNHGMDV

SEQ ID NO: 100035 - protein, 9 aa, Homo sapiens
  light chain complementarity determining region 3 for antibody 50018
MQAKQWPGT

SEQ ID NO: 100036 - protein, 11 aa, Homo sapiens
  heavy chain complementarity determining region 3 for antibody 50018
MVTGWAASFDY

SEQ ID NO: 100037 - protein, 9 aa, Homo sapiens
  light chain complementarity determining region 3 for antibody 50019
MQAHQTPLT

SEQ ID NO: 100038 - protein, 15 aa, Homo sapiens
  heavy chain complementarity determining region 3 for antibody 50019
ARTGSSTWYGYGMDV

SEQ ID NO: 100039 - protein, 10 aa, Homo sapiens
  light chain complementarity determining region 3 for antibody 50020
MQAGQTPGVT

SEQ ID NO: 100040 - protein, 17 aa, Homo sapiens
  heavy chain complementarity determining region 3 for antibody 50020
VKAAYYYDATTYYTHHY

SEQ ID NO: 100041 - protein, 10 aa, Homo sapiens
  light chain complementarity determining region 3 for antibody 50021
MPGTHWPPYT

SEQ ID NO: 100042 - protein, 13 aa, Homo sapiens
  heavy chain complementarity determining region 3 for antibody 50021
ARDWAIWQQEFDY

SEQ ID NO: 100043 - protein, 9 aa, Homo sapiens
  light chain complementarity determining region 3 for antibody 50022
MPGTHWPFT

SEQ ID NO: 100044 - protein, 11 aa, Homo sapiens
  heavy chain complementarity determining region 3 for antibody 50022
TRIMRGDDRVY

SEQ ID NO: 100045 - protein, 9 aa, Homo sapiens
  light chain complementarity determining region 3 for antibody 50023
MPALQAPFT

SEQ ID NO: 100046 - protein, 11 aa, Homo sapiens
  heavy chain complementarity determining region 3 for antibody 50023
ARESLGHSFDI

SEQ ID NO: 100047 - protein, 9 aa, Homo sapiens
  light chain complementarity determining region 3 for antibody 50024
MKALQIPFT

SEQ ID NO: 100048 - protein, 12 aa, Homo sapiens
  heavy chain complementarity determining region 3 for antibody 50024
ARGRVGGNSFDQ

SEQ ID NO: 100049 - protein, 10 aa, Homo sapiens
  light chain complementarity determining region 3 for antibody 50025
MHSLQTLTWT

SEQ ID NO: 100050 - protein, 14 aa, Homo sapiens
  heavy chain complementarity determining region 3 for antibody 50025
ARAKWAAPGTPPAV

SEQ ID NO: 100051 - protein, 8 aa, Homo sapiens
  light chain complementarity determining region 3 for antibody 50026
MHGVQPYP

SEQ ID NO: 100052 - protein, 7 aa, Homo sapiens
  heavy chain complementarity determining region 3 for antibody 50026
ATKMGDY

SEQ ID NO: 100053 - protein, 9 aa, Homo sapiens
  light chain complementarity determining region 3 for antibody 50027
MHGTHWRRT

SEQ ID NO: 100054 - protein, 9 aa, Homo sapiens
  heavy chain complementarity determining region 3 for antibody 50027
ARGGAWFDY

SEQ ID NO: 100055 - protein, 9 aa, Homo sapiens
  light chain complementarity determining region 3 for antibody 50028
MHGKNWPYI

SEQ ID NO: 100056 - protein, 11 aa, Homo sapiens
  heavy chain complementarity determining region 3 for antibody 50028
ARVGDWNNLEY

SEQ ID NO: 100057 - protein, 9 aa, Homo sapiens
  light chain complementarity determining region 3 for antibody 50029
MHALQIPIT

SEQ ID NO: 100058 - protein, 16 aa, Homo sapiens
  heavy chain complementarity determining region 3 for antibody 50029
ARYYYESSGYSHRFDP

SEQ ID NO: 100059 - protein, 8 aa, Homo sapiens
  light chain complementarity determining region 3 for antibody 50030
METTHVWA

SEQ ID NO: 100060 - protein, 7 aa, Homo sapiens
  heavy chain complementarity determining region 3 for antibody 50030
AHNFLRW

SEQ ID NO: 100061 - protein, 9 aa, Homo sapiens
  light chain complementarity determining region 3 for antibody 50031
MEAVQPLPT

SEQ ID NO: 100062 - protein, 16 aa, Homo sapiens
  heavy chain complementarity determining region 3 for antibody 50031
ARGNYCSGGPCFSPDF

SEQ ID NO: 100063 - protein, 9 aa, Homo sapiens
  light chain complementarity determining region 3 for antibody 50032
MEAVQPLPT

SEQ ID NO: 100064 - protein, 16 aa, Homo sapiens
  heavy chain complementarity determining region 3 for antibody 50032
ARGNYCSGGACFSPDF

SEQ ID NO: 100065 - protein, 9 aa, Homo sapiens
  light chain complementarity determining region 3 for antibody 50033
MDGSYWPKT

SEQ ID NO: 100066 - protein, 11 aa, Homo sapiens
  heavy chain complementarity determining region 3 for antibody 50033
ARDPGWGAVDI

SEQ ID NO: 100067 - protein, 9 aa, Homo sapiens
  light chain complementarity determining region 3 for antibody 50034
LYYGSSLCS

SEQ ID NO: 100068 - protein, 19 aa, Homo sapiens
  heavy chain complementarity determining region 3 for antibody 50034
ARVRGFSLLVAVIPDAFDI

SEQ ID NO: 100069 - protein, 9 aa, Homo sapiens
  light chain complementarity determining region 3 for antibody 50035
LRYTINMGT

SEQ ID NO: 100070 - protein, 12 aa, Homo sapiens
  heavy chain complementarity determining region 3 for antibody 50035
GRAVAVSGHFDI

SEQ ID NO: 100071 - protein, 9 aa, Homo sapiens
  light chain complementarity determining region 3 for antibody 50036
LRNTINPGT

SEQ ID NO: 100072 - protein, 12 aa, Homo sapiens
  heavy chain complementarity determining region 3 for antibody 50036
GRAVAVSGHFDI

SEQ ID NO: 100073 - protein, 9 aa, Homo sapiens
  light chain complementarity determining region 3 for antibody 50037
LRDYSYPRT

SEQ ID NO: 100074 - protein, 18 aa, Homo sapiens
  heavy chain complementarity determining region 3 for antibody 50037
ARDTNPNSGDLYFDAFDI

SEQ ID NO: 100075 - protein, 9 aa, Homo sapiens
  light chain complementarity determining region 3 for antibody 50038
LQYSTSPRT

SEQ ID NO: 100076 - protein, 17 aa, Homo sapiens
  heavy chain complementarity determining region 3 for antibody 50038
VKPRETYSSGWVDAFEM

SEQ ID NO: 100077 - protein, 9 aa, Homo sapiens
  light chain complementarity determining region 3 for antibody 50039
LQYRSFPLT

SEQ ID NO: 100078 - protein, 16 aa, Homo sapiens
  heavy chain complementarity determining region 3 for antibody 50039
ARGWIGDVLWFGDLLY

SEQ ID NO: 100079 - protein, 9 aa, Homo sapiens
  light chain complementarity determining region 3 for antibody 50040
LQYNTAPYT

SEQ ID NO: 100080 - protein, 13 aa, Homo sapiens
  heavy chain complementarity determining region 3 for antibody 50040
ARLPYWELYYLDY

SEQ ID NO: 100081 - protein, 9 aa, Homo sapiens
  light chain complementarity determining region 3 for antibody 50041
LQYNSYLWP

SEQ ID NO: 100082 - protein, 11 aa, Homo sapiens
  heavy chain complementarity determining region 3 for antibody 50041
ARDRGYSGHDI

SEQ ID NO: 100083 - protein, 9 aa, Homo sapiens
  light chain complementarity determining region 3 for antibody 50042
LQYNSFPYT

SEQ ID NO: 100084 - protein, 13 aa, Homo sapiens
  heavy chain complementarity determining region 3 for antibody 50042
AREAGFGGSHFDY

SEQ ID NO: 100085 - protein, 9 aa, Homo sapiens
  light chain complementarity determining region 3 for antibody 50043
LQYNSFALT

SEQ ID NO: 100086 - protein, 14 aa, Homo sapiens
  heavy chain complementarity determining region 3 for antibody 50043
AKGGSETAMITFAS

SEQ ID NO: 100087 - protein, 9 aa, Homo sapiens
  light chain complementarity determining region 3 for antibody 50044
LQYNNYPRT

SEQ ID NO: 100088 - protein, 18 aa, Homo sapiens
  heavy chain complementarity determining region 3 for antibody 50044
ARDAGNYYYDTSGPYLDY

SEQ ID NO: 100089 - protein, 9 aa, Homo sapiens
  light chain complementarity determining region 3 for antibody 50045
LQYNNYPRA

SEQ ID NO: 100090 - protein, 15 aa, Homo sapiens
  heavy chain complementarity determining region 3 for antibody 50045
ARPTPESATYRGMDV

SEQ ID NO: 100091 - protein, 9 aa, Homo sapiens
  light chain complementarity determining region 3 for antibody 50046
LQYNIHPCS

SEQ ID NO: 100092 - protein, 8 aa, Homo sapiens
  heavy chain complementarity determining region 3 for antibody 50046
ACMSAPGT

SEQ ID NO: 100093 - protein, 9 aa, Homo sapiens
  light chain complementarity determining region 3 for antibody 50047
LQYKTYPRT

SEQ ID NO: 100094 - protein, 15 aa, Homo sapiens
  heavy chain complementarity determining region 3 for antibody 50047
AKGEKTGGYYYGLDV

SEQ ID NO: 100095 - protein, 9 aa, Homo sapiens
  light chain complementarity determining region 3 for antibody 50048
LQYHSYPGT

SEQ ID NO: 100096 - protein, 15 aa, Homo sapiens
  heavy chain complementarity determining region 3 for antibody 50048
ARPTPESATYRGMDV

SEQ ID NO: 100097 - protein, 9 aa, Homo sapiens
  light chain complementarity determining region 3 for antibody 50049
LQYHDYPLT

SEQ ID NO: 100098 - protein, 13 aa, Homo sapiens
  heavy chain complementarity determining region 3 for antibody 50049
AKTRARGNFNFDI

SEQ ID NO: 100099 - protein, 9 aa, Homo sapiens
  light chain complementarity determining region 3 for antibody 50050
LQYGTSPVT

SEQ ID NO: 100100 - protein, 19 aa, Homo sapiens
  heavy chain complementarity determining region 3 for antibody 50050
ARDQNADYDVLTGYNPADY

SEQ ID NO: 100101 - protein, 9 aa, Homo sapiens
  light chain complementarity determining region 3 for antibody 50051
LQYGNSPDT

SEQ ID NO: 100102 - protein, 13 aa, Homo sapiens
  heavy chain complementarity determining region 3 for antibody 50051
AREGWELLEGLDY

SEQ ID NO: 100103 - protein, 9 aa, Homo sapiens
  light chain complementarity determining region 3 for antibody 50052
LQYGISPYT

SEQ ID NO: 100104 - protein, 13 aa, Homo sapiens
  heavy chain complementarity determining region 3 for antibody 50052
TTYWTTVLRVGGP

SEQ ID NO: 100105 - protein, 9 aa, Homo sapiens
  light chain complementarity determining region 3 for antibody 50053
LQYGGSLLT

SEQ ID NO: 100106 - protein, 17 aa, Homo sapiens
  heavy chain complementarity determining region 3 for antibody 50053
ARIGYYYDGNGYAYDDY

SEQ ID NO: 100107 - protein, 9 aa, Homo sapiens
  light chain complementarity determining region 3 for antibody 50054
LQYGGSATT

SEQ ID NO: 100108 - protein, 11 aa, Homo sapiens
  heavy chain complementarity determining region 3 for antibody 50054
AKIMTRGAILN

SEQ ID NO: 100109 - protein, 9 aa, Homo sapiens
  light chain complementarity determining region 3 for antibody 50055
LQYDSFPLT

SEQ ID NO: 100110 - protein, 14 aa, Homo sapiens
  heavy chain complementarity determining region 3 for antibody 50055
ATLGYAPNTPLWDY

SEQ ID NO: 100111 - protein, 9 aa, Homo sapiens
  light chain complementarity determining region 3 for antibody 50056
LQYDSFPLS

SEQ ID NO: 100112 - protein, 14 aa, Homo sapiens
  heavy chain complementarity determining region 3 for antibody 50056
ATLGYAPNTPLWDY

SEQ ID NO: 100113 - protein, 9 aa, Homo sapiens
  light chain complementarity determining region 3 for antibody 50057
LQTYTSAFT

SEQ ID NO: 100114 - protein, 14 aa, Homo sapiens
  heavy chain complementarity determining region 3 for antibody 50057
VNLGHLDAADAVDY

SEQ ID NO: 100115 - protein, 9 aa, Homo sapiens
  light chain complementarity determining region 3 for antibody 50058
LQTNTYLRT

SEQ ID NO: 100116 - protein, 5 aa, Homo sapiens
  heavy chain complementarity determining region 3 for antibody 50058
AREDV

SEQ ID NO: 100117 - protein, 9 aa, Homo sapiens
  light chain complementarity determining region 3 for antibody 50059
LQTLQTPYT

SEQ ID NO: 100118 - protein, 20 aa, Homo sapiens
  heavy chain complementarity determining region 3 for antibody 50059
AKFVVENKFAKRSSYSGMDV

SEQ ID NO: 100119 - protein, 9 aa, Homo sapiens
  light chain complementarity determining region 3 for antibody 50060
LQSYNSPPT

SEQ ID NO: 100120 - protein, 16 aa, Homo sapiens
  heavy chain complementarity determining region 3 for antibody 50060
ARVAWVRGLMTPAFDY

SEQ ID NO: 100121 - protein, 9 aa, Homo sapiens
  light chain complementarity determining region 3 for antibody 50061
LQSTPWPYT

SEQ ID NO: 100122 - protein, 10 aa, Homo sapiens
  heavy chain complementarity determining region 3 for antibody 50061
GIYSSDGETY

SEQ ID NO: 100123 - protein, 8 aa, Homo sapiens
  light chain complementarity determining region 3 for antibody 50062
LQSNYYLP

SEQ ID NO: 100124 - protein, 15 aa, Homo sapiens
  heavy chain complementarity determining region 3 for antibody 50062
AKSTVTTASGGYIDS

SEQ ID NO: 100125 - protein, 8 aa, Homo sapiens
  light chain complementarity determining region 3 for antibody 50063
LQSNYSLT

SEQ ID NO: 100126 - protein, 15 aa, Homo sapiens
  heavy chain complementarity determining region 3 for antibody 50063
AKSTVTTASGGYIDS

SEQ ID NO: 100127 - protein, 9 aa, Homo sapiens
  light chain complementarity determining region 3 for antibody 50064
LQSNTYPLT

SEQ ID NO: 100128 - protein, 8 aa, Homo sapiens
  heavy chain complementarity determining region 3 for antibody 50064
FRYNSGWE

SEQ ID NO: 100129 - protein, 9 aa, Homo sapiens
  light chain complementarity determining region 3 for antibody 50065
LQSKTYPLT

SEQ ID NO: 100130 - protein, 8 aa, Homo sapiens
  heavy chain complementarity determining region 3 for antibody 50065
FRYNSGCE

SEQ ID NO: 100131 - protein, 10 aa, Homo sapiens
  light chain complementarity determining region 3 for antibody 50066
LQSHSSSFFT

SEQ ID NO: 100132 - protein, 15 aa, Homo sapiens
  heavy chain complementarity determining region 3 for antibody 50066
ARDRDSRYSSGDLDY

SEQ ID NO: 100133 - protein, 10 aa, Homo sapiens
  light chain complementarity determining region 3 for antibody 50067
LQRYSWPPLT

SEQ ID NO: 100134 - protein, 17 aa, Homo sapiens
  heavy chain complementarity determining region 3 for antibody 50067
VKPRETYSSGWVDAFDT

SEQ ID NO: 100135 - protein, 11 aa, Homo sapiens
  light chain complementarity determining region 3 for antibody 50068
LQRSNWPPLFP

SEQ ID NO: 100136 - protein, 13 aa, Homo sapiens
  heavy chain complementarity determining region 3 for antibody 50068
ARVVSYRDYLFDF

SEQ ID NO: 100137 - protein, 11 aa, Homo sapiens
  light chain complementarity determining region 3 for antibody 50069
LQRQESTNWLN

SEQ ID NO: 100138 - protein, 15 aa, Homo sapiens
  heavy chain complementarity determining region 3 for antibody 50069
ARGGYSSNWYWWFDP

SEQ ID NO: 100139 - protein, 9 aa, Homo sapiens
  light chain complementarity determining region 3 for antibody 50070
LQPNYYPRT

SEQ ID NO: 100140 - protein, 19 aa, Homo sapiens
  heavy chain complementarity determining region 3 for antibody 50070
ATGDYYDSSGYHPEAIFGI

SEQ ID NO: 100141 - protein, 9 aa, Homo sapiens
  light chain complementarity determining region 3 for antibody 50071
LQNDNYSFS

SEQ ID NO: 100142 - protein, 22 aa, Homo sapiens
  heavy chain complementarity determining region 3 for antibody 50071
AHSAVHWFGSRACYPSPYYFDF

SEQ ID NO: 100143 - protein, 10 aa, Homo sapiens
  light chain complementarity determining region 3 for antibody 50072
LQLLQLPPVT

SEQ ID NO: 100144 - protein, 16 aa, Homo sapiens
  heavy chain complementarity determining region 3 for antibody 50072
SRPRLGYGDYGHSLQH

SEQ ID NO: 100145 - protein, 9 aa, Homo sapiens
  light chain complementarity determining region 3 for antibody 50073
LQHYSFPRT

SEQ ID NO: 100146 - protein, 8 aa, Homo sapiens
  heavy chain complementarity determining region 3 for antibody 50073
ADIGSGIS

SEQ ID NO: 100147 - protein, 9 aa, Homo sapiens
  light chain complementarity determining region 3 for antibody 50074
LQHYPLPGA

SEQ ID NO: 100148 - protein, 13 aa, Homo sapiens
  heavy chain complementarity determining region 3 for antibody 50074
ARAIHDDKVPFQN

SEQ ID NO: 100149 - protein, 9 aa, Homo sapiens
  light chain complementarity determining region 3 for antibody 50075
LQHYHFPRT

SEQ ID NO: 100150 - protein, 15 aa, Homo sapiens
  heavy chain complementarity determining region 3 for antibody 50075
ARERRAGRFYYGMDV

SEQ ID NO: 100151 - protein, 10 aa, Homo sapiens
  light chain complementarity determining region 3 for antibody 50076
LQHSSYPRLT

SEQ ID NO: 100152 - protein, 17 aa, Homo sapiens
  heavy chain complementarity determining region 3 for antibody 50076
AKVDGSSGLYNVDAFDI

SEQ ID NO: 100153 - protein, 9 aa, Homo sapiens
  light chain complementarity determining region 3 for antibody 50077
LQHSSFHFT

SEQ ID NO: 100154 - protein, 17 aa, Homo sapiens
  heavy chain complementarity determining region 3 for antibody 50077
VRDRGGYFYQHDDAFHI

SEQ ID NO: 100155 - protein, 10 aa, Homo sapiens
  light chain complementarity determining region 3 for antibody 50078
LQHRSYPRLP

SEQ ID NO: 100156 - protein, 17 aa, Homo sapiens
  heavy chain complementarity determining region 3 for antibody 50078
AKVDGSSGLYNVDAFDI

SEQ ID NO: 100157 - protein, 9 aa, Homo sapiens
  light chain complementarity determining region 3 for antibody 50079
LQHRGYPNT

SEQ ID NO: 100158 - protein, 15 aa, Homo sapiens
  heavy chain complementarity determining region 3 for antibody 50079
GRSKFYYESASQFDS

SEQ ID NO: 100159 - protein, 9 aa, Homo sapiens
  light chain complementarity determining region 3 for antibody 50080
LQHNYYPRT

SEQ ID NO: 100160 - protein, 19 aa, Homo sapiens
  heavy chain complementarity determining region 3 for antibody 50080
ATGDYYDGSGYHPEEIFGI

SEQ ID NO: 100161 - protein, 9 aa, Homo sapiens
  light chain complementarity determining region 3 for antibody 50081
LQHNTYPYT

SEQ ID NO: 100162 - protein, 15 aa, Homo sapiens
  heavy chain complementarity determining region 3 for antibody 50081
AAPLGYASAWYRFDF

SEQ ID NO: 100163 - protein, 9 aa, Homo sapiens
  light chain complementarity determining region 3 for antibody 50082
LQHNTYPRT

SEQ ID NO: 100164 - protein, 12 aa, Homo sapiens
  heavy chain complementarity determining region 3 for antibody 50082
ANGRSTLTAFAY

SEQ ID NO: 100165 - protein, 9 aa, Homo sapiens
  light chain complementarity determining region 3 for antibody 50083
LQHNTSPRT

SEQ ID NO: 100166 - protein, 12 aa, Homo sapiens
  heavy chain complementarity determining region 3 for antibody 50083
ANGRSTLTAFTY

SEQ ID NO: 100167 - protein, 9 aa, Homo sapiens
  light chain complementarity determining region 3 for antibody 50084
LQHNSYSYT

SEQ ID NO: 100168 - protein, 11 aa, Homo sapiens
  heavy chain complementarity determining region 3 for antibody 50084
ARHEGRELLGP

SEQ ID NO: 100169 - protein, 9 aa, Homo sapiens
  light chain complementarity determining region 3 for antibody 50085
LQHNSYPYT

SEQ ID NO: 100170 - protein, 17 aa, Homo sapiens
  heavy chain complementarity determining region 3 for antibody 50085
ARDFTYYYDSRGYDADY

SEQ ID NO: 100171 - protein, 9 aa, Homo sapiens
  light chain complementarity determining region 3 for antibody 50086
LQHNSYPRP

SEQ ID NO: 100172 - protein, 17 aa, Homo sapiens
  heavy chain complementarity determining region 3 for antibody 50086
ARPGIAAAAMSGYWFDP

SEQ ID NO: 100173 - protein, 9 aa, Homo sapiens
  light chain complementarity determining region 3 for antibody 50087
LQHNSYPLT

SEQ ID NO: 100174 - protein, 21 aa, Homo sapiens
  heavy chain complementarity determining region 3 for antibody 50087
TVVGCSGGSCLIPPERYGMDV

SEQ ID NO: 100175 - protein, 9 aa, Homo sapiens
  light chain complementarity determining region 3 for antibody 50088
LQHNSYPLT

SEQ ID NO: 100176 - protein, 21 aa, Homo sapiens
  heavy chain complementarity determining region 3 for antibody 50088
TLVVCSGGSCLIPPERYGMDV

SEQ ID NO: 100177 - protein, 9 aa, Homo sapiens
  light chain complementarity determining region 3 for antibody 50089
LQHNSYPLT

SEQ ID NO: 100178 - protein, 21 aa, Homo sapiens
  heavy chain complementarity determining region 3 for antibody 50089
PLVGCSGGSCLIPPERYGMDV

SEQ ID NO: 100179 - protein, 9 aa, Homo sapiens
  light chain complementarity determining region 3 for antibody 50090
LQHNSYPLT

SEQ ID NO: 100180 - protein, 14 aa, Homo sapiens
  heavy chain complementarity determining region 3 for antibody 50090
ARSGDNAYLYSFDY

SEQ ID NO: 100181 - protein, 9 aa, Homo sapiens
  light chain complementarity determining region 3 for antibody 50091
LQHNSYPLT

SEQ ID NO: 100182 - protein, 22 aa, Homo sapiens
  heavy chain complementarity determining region 3 for antibody 50091
AKDQASTVVVVSRPWEVSDLAF

SEQ ID NO: 100183 - protein, 9 aa, Homo sapiens
  light chain complementarity determining region 3 for antibody 50092
LQHNSHPFT

SEQ ID NO: 100184 - protein, 7 aa, Homo sapiens
  heavy chain complementarity determining region 3 for antibody 50092
ADVGWGV

SEQ ID NO: 100185 - protein, 9 aa, Homo sapiens
  light chain complementarity determining region 3 for antibody 50093
LQHNSFPST

SEQ ID NO: 100186 - protein, 16 aa, Homo sapiens
  heavy chain complementarity determining region 3 for antibody 50093
ATFGPTKALRTVAFDL

SEQ ID NO: 100187 - protein, 9 aa, Homo sapiens
  light chain complementarity determining region 3 for antibody 50094
LQHNSFPRT

SEQ ID NO: 100188 - protein, 20 aa, Homo sapiens
  heavy chain complementarity determining region 3 for antibody 50094
AREAHPHYYGSASYYPVFDA

SEQ ID NO: 100189 - protein, 9 aa, Homo sapiens
  light chain complementarity determining region 3 for antibody 50095
LQHNSFPPT

SEQ ID NO: 100190 - protein, 19 aa, Homo sapiens
  heavy chain complementarity determining region 3 for antibody 50095
LRWTNYFDNSGSPSTSFDT

SEQ ID NO: 100191 - protein, 9 aa, Homo sapiens
  light chain complementarity determining region 3 for antibody 50096
LQHNSFPPP

SEQ ID NO: 100192 - protein, 19 aa, Homo sapiens
  heavy chain complementarity determining region 3 for antibody 50096
LRWTNYFDNSGSHSTSFDT

SEQ ID NO: 100193 - protein, 9 aa, Homo sapiens
  light chain complementarity determining region 3 for antibody 50097
LQHNSFPDT

SEQ ID NO: 100194 - protein, 16 aa, Homo sapiens
  heavy chain complementarity determining region 3 for antibody 50097
ATFGPTKALRTVAFDL

SEQ ID NO: 100195 - protein, 9 aa, Homo sapiens
  light chain complementarity determining region 3 for antibody 50098
LQHNRYPHT

SEQ ID NO: 100196 - protein, 15 aa, Homo sapiens
  heavy chain complementarity determining region 3 for antibody 50098
ARSRFYYDTSDYLDY

SEQ ID NO: 100197 - protein, 9 aa, Homo sapiens
  light chain complementarity determining region 3 for antibody 50099
LQHNNYPWA

SEQ ID NO: 100198 - protein, 15 aa, Homo sapiens
  heavy chain complementarity determining region 3 for antibody 50099
ARPTPESATYRGMDV

SEQ ID NO: 100199 - protein, 9 aa, Homo sapiens
  light chain complementarity determining region 3 for antibody 50100
LQHNNYPRT

SEQ ID NO: 100200 - protein, 19 aa, Homo sapiens
  heavy chain complementarity determining region 3 for antibody 50100
ATGDYYDSSGYHPEEIFGI

SEQ ID NO: 100201 - protein, 9 aa, Homo sapiens
  light chain complementarity determining region 3 for antibody 50101
LQHNAFPYP

SEQ ID NO: 100202 - protein, 16 aa, Homo sapiens
  heavy chain complementarity determining region 3 for antibody 50101
TFFYYCSHTGICERNY

SEQ ID NO: 100203 - protein, 9 aa, Homo sapiens
  light chain complementarity determining region 3 for antibody 50102
LQHLTYPYT

SEQ ID NO: 100204 - protein, 11 aa, Homo sapiens
  heavy chain complementarity determining region 3 for antibody 50102
ARNPNWGEFDS

SEQ ID NO: 100205 - protein, 9 aa, Homo sapiens
  light chain complementarity determining region 3 for antibody 50103
LQHDNFPWT

SEQ ID NO: 100206 - protein, 14 aa, Homo sapiens
  heavy chain complementarity determining region 3 for antibody 50103
ARDRRQWQHDGFDI

SEQ ID NO: 100207 - protein, 9 aa, Homo sapiens
  light chain complementarity determining region 3 for antibody 50104
LQHARLPPT

SEQ ID NO: 100208 - protein, 19 aa, Homo sapiens
  heavy chain complementarity determining region 3 for antibody 50104
AKAPLPGYCGGGACYGVDY

SEQ ID NO: 100209 - protein, 9 aa, Homo sapiens
  light chain complementarity determining region 3 for antibody 50105
LQHARLPLT

SEQ ID NO: 100210 - protein, 19 aa, Homo sapiens
  heavy chain complementarity determining region 3 for antibody 50105
AKAPLPGYCSGGACYGVDY

SEQ ID NO: 100211 - protein, 9 aa, Homo sapiens
  light chain complementarity determining region 3 for antibody 50106
LQHARLPLT

SEQ ID NO: 100212 - protein, 19 aa, Homo sapiens
  heavy chain complementarity determining region 3 for antibody 50106
AKAPFPGYCGGGACYGVDY

SEQ ID NO: 100213 - protein, 9 aa, Homo sapiens
  light chain complementarity determining region 3 for antibody 50107
LQHAEFPFT

SEQ ID NO: 100214 - protein, 18 aa, Homo sapiens
  heavy chain complementarity determining region 3 for antibody 50107
ARDSDKRLGEWGLYGLDV

SEQ ID NO: 100215 - protein, 9 aa, Homo sapiens
  light chain complementarity determining region 3 for antibody 50108
LQGTQWPPT

SEQ ID NO: 100216 - protein, 18 aa, Homo sapiens
  heavy chain complementarity determining region 3 for antibody 50108
AKDVGPRFYNAYDPVFDC

SEQ ID NO: 100217 - protein, 10 aa, Homo sapiens
  light chain complementarity determining region 3 for antibody 50109
LQGTQWPPGT

SEQ ID NO: 100218 - protein, 11 aa, Homo sapiens
  heavy chain complementarity determining region 3 for antibody 50109
VRDHPGIGIDY

SEQ ID NO: 100219 - protein, 9 aa, Homo sapiens
  light chain complementarity determining region 3 for antibody 50110
LQGTNWPYT

SEQ ID NO: 100220 - protein, 14 aa, Homo sapiens
  heavy chain complementarity determining region 3 for antibody 50110
ALVGSGRTHNSLDY

SEQ ID NO: 100221 - protein, 9 aa, Homo sapiens
  light chain complementarity determining region 3 for antibody 50111
LQGTHWPPT

SEQ ID NO: 100222 - protein, 11 aa, Homo sapiens
  heavy chain complementarity determining region 3 for antibody 50111
ATGPQVTMPHD

SEQ ID NO: 100223 - protein, 10 aa, Homo sapiens
  light chain complementarity determining region 3 for antibody 50112
LQGTHWPPLP

SEQ ID NO: 100224 - protein, 11 aa, Homo sapiens
  heavy chain complementarity determining region 3 for antibody 50112
ARGGYLQNLDA

SEQ ID NO: 100225 - protein, 10 aa, Homo sapiens
  light chain complementarity determining region 3 for antibody 50113
LQGTHWPPIT

SEQ ID NO: 100226 - protein, 8 aa, Homo sapiens
  heavy chain complementarity determining region 3 for antibody 50113
ARGETTDN

SEQ ID NO: 100227 - protein, 9 aa, Homo sapiens
  light chain complementarity determining region 3 for antibody 50114
LQGTHGPYT

SEQ ID NO: 100228 - protein, 14 aa, Homo sapiens
  heavy chain complementarity determining region 3 for antibody 50114
ALVGSGRTHNSLDY

SEQ ID NO: 100229 - protein, 9 aa, Homo sapiens
  light chain complementarity determining region 3 for antibody 50115
LQGTHGPPT

SEQ ID NO: 100230 - protein, 11 aa, Homo sapiens
  heavy chain complementarity determining region 3 for antibody 50115
ATGPQVTMPQD

SEQ ID NO: 100231 - protein, 9 aa, Homo sapiens
  light chain complementarity determining region 3 for antibody 50116
LQGLQTPWT

SEQ ID NO: 100232 - protein, 14 aa, Homo sapiens
  heavy chain complementarity determining region 3 for antibody 50116
AREDSAVGYYGMDV

SEQ ID NO: 100233 - protein, 9 aa, Homo sapiens
  light chain complementarity determining region 3 for antibody 50117
LQFQNVPLT

SEQ ID NO: 100234 - protein, 18 aa, Homo sapiens
  heavy chain complementarity determining region 3 for antibody 50117
IRGGRDSRGPPGYYNLGV

SEQ ID NO: 100235 - protein, 9 aa, Homo sapiens
  light chain complementarity determining region 3 for antibody 50118
LQDYVYPRT

SEQ ID NO: 100236 - protein, 12 aa, Homo sapiens
  heavy chain complementarity determining region 3 for antibody 50118
ARDPSGYDAFDI

SEQ ID NO: 100237 - protein, 9 aa, Homo sapiens
  light chain complementarity determining region 3 for antibody 50119
LQDYVYPLT

SEQ ID NO: 100238 - protein, 16 aa, Homo sapiens
  heavy chain complementarity determining region 3 for antibody 50119
AKTYSSSAGSHYGMDL

SEQ ID NO: 100239 - protein, 9 aa, Homo sapiens
  light chain complementarity determining region 3 for antibody 50120
LQDYSYPRT

SEQ ID NO: 100240 - protein, 15 aa, Homo sapiens
  heavy chain complementarity determining region 3 for antibody 50120
VREFRHDGDYEQFDQ

SEQ ID NO: 100241 - protein, 9 aa, Homo sapiens
  light chain complementarity determining region 3 for antibody 50121
LQDYNYPRT

SEQ ID NO: 100242 - protein, 18 aa, Homo sapiens
  heavy chain complementarity determining region 3 for antibody 50121
ARDESPKFGSNIYDAFDI

SEQ ID NO: 100243 - protein, 9 aa, Homo sapiens
  light chain complementarity determining region 3 for antibody 50122
LQDYNYPRP

SEQ ID NO: 100244 - protein, 18 aa, Homo sapiens
  heavy chain complementarity determining region 3 for antibody 50122
ARDASPMYNNYWADAFDI

SEQ ID NO: 100245 - protein, 9 aa, Homo sapiens
  light chain complementarity determining region 3 for antibody 50123
LQDYNYPQP

SEQ ID NO: 100246 - protein, 11 aa, Homo sapiens
  heavy chain complementarity determining region 3 for antibody 50123
ARDSRTSGMDV

SEQ ID NO: 100247 - protein, 9 aa, Homo sapiens
  light chain complementarity determining region 3 for antibody 50124
LQDYNSPQT

SEQ ID NO: 100248 - protein, 11 aa, Homo sapiens
  heavy chain complementarity determining region 3 for antibody 50124
ARDSRTSGMDV

SEQ ID NO: 100249 - protein, 9 aa, Homo sapiens
  light chain complementarity determining region 3 for antibody 50125
LQDYDYPRT

SEQ ID NO: 100250 - protein, 19 aa, Homo sapiens
  heavy chain complementarity determining region 3 for antibody 50125
ASLSLLYANSPDYSYGMDV

SEQ ID NO: 100251 - protein, 9 aa, Homo sapiens
  light chain complementarity determining region 3 for antibody 50126
LQDHSYSGT

SEQ ID NO: 100252 - protein, 9 aa, Homo sapiens
  heavy chain complementarity determining region 3 for antibody 50126
AKRTGFGYY

SEQ ID NO: 100253 - protein, 9 aa, Homo sapiens
  light chain complementarity determining region 3 for antibody 50127
LQAYNYPRT

SEQ ID NO: 100254 - protein, 19 aa, Homo sapiens
  heavy chain complementarity determining region 3 for antibody 50127
ARDVDYFYDETRAWDAYDV

SEQ ID NO: 100255 - protein, 9 aa, Homo sapiens
  light chain complementarity determining region 3 for antibody 50128
LQAYDYPHT

SEQ ID NO: 100256 - protein, 11 aa, Homo sapiens
  heavy chain complementarity determining region 3 for antibody 50128
VRFFVVAGPVV

SEQ ID NO: 100257 - protein, 9 aa, Homo sapiens
  light chain complementarity determining region 3 for antibody 50129
LQASGPPLT

SEQ ID NO: 100258 - protein, 11 aa, Homo sapiens
  heavy chain complementarity determining region 3 for antibody 50129
VRFFVVAGTVV

SEQ ID NO: 100259 - protein, 9 aa, Homo sapiens
  light chain complementarity determining region 3 for antibody 50130
LQAQRFPIT

SEQ ID NO: 100260 - protein, 17 aa, Homo sapiens
  heavy chain complementarity determining region 3 for antibody 50130
AKVLWSGEFLFIGPFDY

SEQ ID NO: 100261 - protein, 8 aa, Homo sapiens
  light chain complementarity determining region 3 for antibody 50131
LQALQTPT

SEQ ID NO: 100262 - protein, 16 aa, Homo sapiens
  heavy chain complementarity determining region 3 for antibody 50131
ARAEKGRKYYYYGMDV

SEQ ID NO: 100263 - protein, 9 aa, Homo sapiens
  light chain complementarity determining region 3 for antibody 50132
LQALQTPQT

SEQ ID NO: 100264 - protein, 18 aa, Homo sapiens
  heavy chain complementarity determining region 3 for antibody 50132
ASGYSYGFFGQKLVALDY

SEQ ID NO: 100265 - protein, 9 aa, Homo sapiens
  light chain complementarity determining region 3 for antibody 50133
LQALETPWT

SEQ ID NO: 100266 - protein, 12 aa, Homo sapiens
  heavy chain complementarity determining region 3 for antibody 50133
ARESTRVTTLDY

SEQ ID NO: 100267 - protein, 9 aa, Homo sapiens
  light chain complementarity determining region 3 for antibody 50134
LHYGTSPRS

SEQ ID NO: 100268 - protein, 18 aa, Homo sapiens
  heavy chain complementarity determining region 3 for antibody 50134
AREVPDKRPSNSNPYADV

SEQ ID NO: 100269 - protein, 9 aa, Homo sapiens
  light chain complementarity determining region 3 for antibody 50135
LHHNFYPRT

SEQ ID NO: 100270 - protein, 16 aa, Homo sapiens
  heavy chain complementarity determining region 3 for antibody 50135
AKDRGSWGNFFGSGDY

SEQ ID NO: 100271 - protein, 9 aa, Homo sapiens
  light chain complementarity determining region 3 for antibody 50136
LHHDNFPWT

SEQ ID NO: 100272 - protein, 12 aa, Homo sapiens
  heavy chain complementarity determining region 3 for antibody 50136
AKDLSDYYGPDY

SEQ ID NO: 100273 - protein, 9 aa, Homo sapiens
  light chain complementarity determining region 3 for antibody 50137
LHDYNYPFH

SEQ ID NO: 100274 - protein, 15 aa, Homo sapiens
  heavy chain complementarity determining region 3 for antibody 50137
ARVTRPAGTWETLDY

SEQ ID NO: 100275 - protein, 9 aa, Homo sapiens
  light chain complementarity determining region 3 for antibody 50138
LHDYGSPFT

SEQ ID NO: 100276 - protein, 15 aa, Homo sapiens
  heavy chain complementarity determining region 3 for antibody 50138
AHRLDHVDSAMNFDY

SEQ ID NO: 100277 - protein, 10 aa, Homo sapiens
  light chain complementarity determining region 3 for antibody 50139
LEYNDWPMWT

SEQ ID NO: 100278 - protein, 15 aa, Homo sapiens
  heavy chain complementarity determining region 3 for antibody 50139
ASELRGAWLKYEFDY

SEQ ID NO: 100279 - protein, 8 aa, Homo sapiens
  light chain complementarity determining region 3 for antibody 50140
LEGTHSHP

SEQ ID NO: 100280 - protein, 11 aa, Homo sapiens
  heavy chain complementarity determining region 3 for antibody 50140
ARDPGWGAFDV

SEQ ID NO: 100281 - protein, 9 aa, Homo sapiens
  light chain complementarity determining region 3 for antibody 50141
KQYGSSPQT

SEQ ID NO: 100282 - protein, 12 aa, Homo sapiens
  heavy chain complementarity determining region 3 for antibody 50141
ARNGYSSSWYRN

SEQ ID NO: 100283 - protein, 10 aa, Homo sapiens
  light chain complementarity determining region 3 for antibody 50142
KQYGGSPRYR

SEQ ID NO: 100284 - protein, 10 aa, Homo sapiens
  heavy chain complementarity determining region 3 for antibody 50142
AASDTAQFRY

SEQ ID NO: 100285 - protein, 8 aa, Homo sapiens
  light chain complementarity determining region 3 for antibody 50143
KQYDNLLT

SEQ ID NO: 100286 - protein, 17 aa, Homo sapiens
  heavy chain complementarity determining region 3 for antibody 50143
AKDIFFGIAVAGTAFDI

SEQ ID NO: 100287 - protein, 9 aa, Homo sapiens
  light chain complementarity determining region 3 for antibody 50144
KQSYSIPWT

SEQ ID NO: 100288 - protein, 14 aa, Homo sapiens
  heavy chain complementarity determining region 3 for antibody 50144
ARVRNYYASGDWDY

SEQ ID NO: 100289 - protein, 9 aa, Homo sapiens
  light chain complementarity determining region 3 for antibody 50145
KQSYNTPYT

SEQ ID NO: 100290 - protein, 11 aa, Homo sapiens
  heavy chain complementarity determining region 3 for antibody 50145
AKQGEAGGMDV

SEQ ID NO: 100291 - protein, 10 aa, Homo sapiens
  light chain complementarity determining region 3 for antibody 50146
KQRSKWPPLT

SEQ ID NO: 100292 - protein, 9 aa, Homo sapiens
  heavy chain complementarity determining region 3 for antibody 50146
ARVDGYFDY

SEQ ID NO: 100293 - protein, 9 aa, Homo sapiens
  light chain complementarity determining region 3 for antibody 50147
IQGSYWPST

SEQ ID NO: 100294 - protein, 11 aa, Homo sapiens
  heavy chain complementarity determining region 3 for antibody 50147
ARDPAGGSYDM

SEQ ID NO: 100295 - protein, 9 aa, Homo sapiens
  light chain complementarity determining region 3 for antibody 50148
IQALQTPGT

SEQ ID NO: 100296 - protein, 18 aa, Homo sapiens
  heavy chain complementarity determining region 3 for antibody 50148
AASGRYFFQNSGPLGFGY

SEQ ID NO: 100297 - protein, 9 aa, Homo sapiens
  light chain complementarity determining region 3 for antibody 50149
HYYNSAPLT

SEQ ID NO: 100298 - protein, 10 aa, Homo sapiens
  heavy chain complementarity determining region 3 for antibody 50149
ARDEGYFGPS

SEQ ID NO: 100299 - protein, 7 aa, Homo sapiens
  light chain complementarity determining region 3 for antibody 50150
HTNRPPT

SEQ ID NO: 100300 - protein, 13 aa, Homo sapiens
  heavy chain complementarity determining region 3 for antibody 50150
ARNSGSYPNWFDP

SEQ ID NO: 100301 - protein, 10 aa, Homo sapiens
  light chain complementarity determining region 3 for antibody 50151
HRYGRSPPST

SEQ ID NO: 100302 - protein, 19 aa, Homo sapiens
  heavy chain complementarity determining region 3 for antibody 50151
VKGSGYSASWISSNDGFDV

SEQ ID NO: 100303 - protein, 9 aa, Homo sapiens
  light chain complementarity determining region 3 for antibody 50152
HQYYTPPYS

SEQ ID NO: 100304 - protein, 17 aa, Homo sapiens
  heavy chain complementarity determining region 3 for antibody 50152
ARGFRLCSTCYGAAFDS

SEQ ID NO: 100305 - protein, 9 aa, Homo sapiens
  light chain complementarity determining region 3 for antibody 50153
HQYYSYPNT

SEQ ID NO: 100306 - protein, 14 aa, Homo sapiens
  heavy chain complementarity determining region 3 for antibody 50153
ARSKWTAPGTPPEY

SEQ ID NO: 100307 - protein, 9 aa, Homo sapiens
  light chain complementarity determining region 3 for antibody 50154
HQYYSDPPT

SEQ ID NO: 100308 - protein, 15 aa, Homo sapiens
  heavy chain complementarity determining region 3 for antibody 50154
ARPTPESATYRGMDV

SEQ ID NO: 100309 - protein, 10 aa, Homo sapiens
  light chain complementarity determining region 3 for antibody 50155
HQYVTSPPWT

SEQ ID NO: 100310 - protein, 16 aa, Homo sapiens
  heavy chain complementarity determining region 3 for antibody 50155
ARRQWVRGLFRGGLDY

SEQ ID NO: 100311 - protein, 8 aa, Homo sapiens
  light chain complementarity determining region 3 for antibody 50156
HQYVTSHP

SEQ ID NO: 100312 - protein, 17 aa, Homo sapiens
  heavy chain complementarity determining region 3 for antibody 50156
ARVTSDYGLGSQGRFDY

SEQ ID NO: 100313 - protein, 10 aa, Homo sapiens
  light chain complementarity determining region 3 for antibody 50157
HQYTALTGLP

SEQ ID NO: 100314 - protein, 11 aa, Homo sapiens
  heavy chain complementarity determining region 3 for antibody 50157
ARNAGWIHLKH

SEQ ID NO: 100315 - protein, 10 aa, Homo sapiens
  light chain complementarity determining region 3 for antibody 50158
HQYTAFTGLT

SEQ ID NO: 100316 - protein, 11 aa, Homo sapiens
  heavy chain complementarity determining region 3 for antibody 50158
ARNAGWIHLKH

SEQ ID NO: 100317 - protein, 9 aa, Homo sapiens
  light chain complementarity determining region 3 for antibody 50159
HQYSTSPRT

SEQ ID NO: 100318 - protein, 17 aa, Homo sapiens
  heavy chain complementarity determining region 3 for antibody 50159
VKPRETYSSGWVDTFEM

SEQ ID NO: 100319 - protein, 10 aa, Homo sapiens
  light chain complementarity determining region 3 for antibody 50160
HQYSTSPPGT

SEQ ID NO: 100320 - protein, 16 aa, Homo sapiens
  heavy chain complementarity determining region 3 for antibody 50160
ARRQWVRGLFRGGLDS

SEQ ID NO: 100321 - protein, 9 aa, Homo sapiens
  light chain complementarity determining region 3 for antibody 50161
HQYSTSPCT

SEQ ID NO: 100322 - protein, 17 aa, Homo sapiens
  heavy chain complementarity determining region 3 for antibody 50161
VKPRETYSSGWVDAFEM

SEQ ID NO: 100323 - protein, 8 aa, Homo sapiens
  light chain complementarity determining region 3 for antibody 50162
HQYSRYST

SEQ ID NO: 100324 - protein, 15 aa, Homo sapiens
  heavy chain complementarity determining region 3 for antibody 50162
ASPSYCGGDCYAQDY

SEQ ID NO: 100325 - protein, 10 aa, Homo sapiens
  light chain complementarity determining region 3 for antibody 50163
HQYSRSPPWR

SEQ ID NO: 100326 - protein, 11 aa, Homo sapiens
  heavy chain complementarity determining region 3 for antibody 50163
VKDRGAIMGDF

SEQ ID NO: 100327 - protein, 8 aa, Homo sapiens
  light chain complementarity determining region 3 for antibody 50164
HQYNSYST

SEQ ID NO: 100328 - protein, 11 aa, Homo sapiens
  heavy chain complementarity determining region 3 for antibody 50164
ASTGRRRWVDY

SEQ ID NO: 100329 - protein, 10 aa, Homo sapiens
  light chain complementarity determining region 3 for antibody 50165
HQYNNYPPIT

SEQ ID NO: 100330 - protein, 18 aa, Homo sapiens
  heavy chain complementarity determining region 3 for antibody 50165
AGQYYFDRSGYFLAPLDY

SEQ ID NO: 100331 - protein, 11 aa, Homo sapiens
  light chain complementarity determining region 3 for antibody 50166
HQYNNWPPRFT

SEQ ID NO: 100332 - protein, 17 aa, Homo sapiens
  heavy chain complementarity determining region 3 for antibody 50166
ARIRGDYFPSGFGAFDI

SEQ ID NO: 100333 - protein, 11 aa, Homo sapiens
  light chain complementarity determining region 3 for antibody 50167
HQYNNWPPRFP

SEQ ID NO: 100334 - protein, 17 aa, Homo sapiens
  heavy chain complementarity determining region 3 for antibody 50167
ARIRGDYFPSGFGAFDI

SEQ ID NO: 100335 - protein, 10 aa, Homo sapiens [sequence omitted]

SEQ ID NO: 100336 - protein, 8 aa, Homo sapiens
  heavy chain complementarity determining region 3 for antibody 50168
VRRFALDL

SEQ ID NO: 100337 - protein, 10 aa, Homo sapiens [sequence omitted]

SEQ ID NO: 100338 - protein, 14 aa, Homo sapiens
  heavy chain complementarity determining region 3 for antibody 50169
ARSQWAAPGTPPAY

SEQ ID NO: 100339 - protein, 9 aa, Homo sapiens
  light chain complementarity determining region 3 for antibody 50170
HQYNDWPRT

SEQ ID NO: 100340 - protein, 24 aa, Homo sapiens
  heavy chain complementarity determining region 3 for antibody 50170
AKDLGPPHLPRVTPGYYYYNGLDV

SEQ ID NO: 100341 - protein, 8 aa, Homo sapiens
  light chain complementarity determining region 3 for antibody 50171
HQYKSYST

SEQ ID NO: 100342 - protein, 16 aa, Homo sapiens
  heavy chain complementarity determining region 3 for antibody 50171
AVSLRGGSGWYGPIHH

SEQ ID NO: 100343 - protein, 9 aa, Homo sapiens
  light chain complementarity determining region 3 for antibody 50172
HQYKSYPLP

SEQ ID NO: 100344 - protein, 15 aa, Homo sapiens
  heavy chain complementarity determining region 3 for antibody 50172
ATTVFVLGAPDRIDF

SEQ ID NO: 100345 - protein, 10 aa, Homo sapiens
  light chain complementarity determining region 3 for antibody 50173
HQYHTYPPGT

SEQ ID NO: 100346 - protein, 19 aa, Homo sapiens
  heavy chain complementarity determining region 3 for antibody 50173
VRDSSWGSIVGVTRGKFDY

SEQ ID NO: 100347 - protein, 9 aa, Homo sapiens
  light chain complementarity determining region 3 for antibody 50174
HQYGTSRQP

SEQ ID NO: 100348 - protein, 15 aa, Homo sapiens
  heavy chain complementarity determining region 3 for antibody 50174
AREMIRGVSEDALDV

SEQ ID NO: 100349 - protein, 9 aa, Homo sapiens
  light chain complementarity determining region 3 for antibody 50175
HQYGTSRPT

SEQ ID NO: 100350 - protein, 15 aa, Homo sapiens
  heavy chain complementarity determining region 3 for antibody 50175
AREMIRGVSEDALDV

SEQ ID NO: 100351 - protein, 9 aa, Homo sapiens
  light chain complementarity determining region 3 for antibody 50176
HQYGTSRLT

SEQ ID NO: 100352 - protein, 15 aa, Homo sapiens
  heavy chain complementarity determining region 3 for antibody 50176
AREMIRGVSEDALDV

SEQ ID NO: 100353 - protein, 9 aa, Homo sapiens
  light chain complementarity determining region 3 for antibody 50177
HQYGTSPWT

SEQ ID NO: 100354 - protein, 14 aa, Homo sapiens
  heavy chain complementarity determining region 3 for antibody 50177
ASDPPGGYYGAFDV

SEQ ID NO: 100355 - protein, 9 aa, Homo sapiens
  light chain complementarity determining region 3 for antibody 50178
HQYGTSPRP

SEQ ID NO: 100356 - protein, 13 aa, Homo sapiens
  heavy chain complementarity determining region 3 for antibody 50178
ATSEFSASYYFDI

SEQ ID NO: 100357 - protein, 9 aa, Homo sapiens
  light chain complementarity determining region 3 for antibody 50179
HQYGTSPGT

SEQ ID NO: 100358 - protein, 14 aa, Homo sapiens
  heavy chain complementarity determining region 3 for antibody 50179
ASDPPGRYYGAFDV

SEQ ID NO: 100359 - protein, 9 aa, Homo sapiens
  light chain complementarity determining region 3 for antibody 50180
HQYGSWAWT

SEQ ID NO: 100360 - protein, 16 aa, Homo sapiens
  heavy chain complementarity determining region 3 for antibody 50180
VKDQRVIVGASNYFDY

SEQ ID NO: 100361 - protein, 10 aa, Homo sapiens
  light chain complementarity determining region 3 for antibody 50181
HQYGSSRSIT

SEQ ID NO: 100362 - protein, 13 aa, Homo sapiens
  heavy chain complementarity determining region 3 for antibody 50181
AREGDYGGLYFDY

SEQ ID NO: 100363 - protein, 9 aa, Homo sapiens
  light chain complementarity determining region 3 for antibody 50182
HQYGSSPYT

SEQ ID NO: 100364 - protein, 9 aa, Homo sapiens
  heavy chain complementarity determining region 3 for antibody 50182
AREVEGCDI

SEQ ID NO: 100365 - protein, 9 aa, Homo sapiens
  light chain complementarity determining region 3 for antibody 50183
HQYGSSPRT

SEQ ID NO: 100366 - protein, 13 aa, Homo sapiens
  heavy chain complementarity determining region 3 for antibody 50183
ATESGGYYGGLDY

SEQ ID NO: 100367 - protein, 9 aa, Homo sapiens
  light chain complementarity determining region 3 for antibody 50184
HQYGSSPRP

SEQ ID NO: 100368 - protein, 12 aa, Homo sapiens
  heavy chain complementarity determining region 3 for antibody 50184
ARESGVAGAFDH

SEQ ID NO: 100369 - protein, 9 aa, Homo sapiens
  light chain complementarity determining region 3 for antibody 50185
HQYGSSPRP

SEQ ID NO: 100370 - protein, 12 aa, Homo sapiens
  heavy chain complementarity determining region 3 for antibody 50185
AHFNWDRGTFDY

SEQ ID NO: 100371 - protein, 9 aa, Homo sapiens
  light chain complementarity determining region 3 for antibody 50186
HQYGSSPRN

SEQ ID NO: 100372 - protein, 13 aa, Homo sapiens
  heavy chain complementarity determining region 3 for antibody 50186
ATESGSYYGGLDY

SEQ ID NO: 100373 - protein, 9 aa, Homo sapiens
  light chain complementarity determining region 3 for antibody 50187
HQYGSSPLT

SEQ ID NO: 100374 - protein, 14 aa, Homo sapiens
  heavy chain complementarity determining region 3 for antibody 50187
SSPGHVDISTAGGN

SEQ ID NO: 100375 - protein, 10 aa, Homo sapiens
  light chain complementarity determining region 3 for antibody 50188
HQYGSSLSVT

SEQ ID NO: 100376 - protein, 13 aa, Homo sapiens
  heavy chain complementarity determining region 3 for antibody 50188
AREGDYGGLYFDY

SEQ ID NO: 100377 - protein, 9 aa, Homo sapiens
  light chain complementarity determining region 3 for antibody 50189
HQYGSSHRT

SEQ ID NO: 100378 - protein, 13 aa, Homo sapiens
  heavy chain complementarity determining region 3 for antibody 50189
ATESGSYYGGLDY

SEQ ID NO: 100379 - protein, 9 aa, Homo sapiens
  light chain complementarity determining region 3 for antibody 50190
HQYGSPPRT

SEQ ID NO: 100380 - protein, 13 aa, Homo sapiens
  heavy chain complementarity determining region 3 for antibody 50190
ATESGSYYGGLDY

SEQ ID NO: 100381 - protein, 8 aa, Homo sapiens
  light chain complementarity determining region 3 for antibody 50191
HQYGSNTT

SEQ ID NO: 100382 - protein, 11 aa, Homo sapiens
  heavy chain complementarity determining region 3 for antibody 50191
GRKPTGWPFDY

SEQ ID NO: 100383 - protein, 9 aa, Homo sapiens
  light chain complementarity determining region 3 for antibody 50192
HQYGSLPRT

SEQ ID NO: 100384 - protein, 13 aa, Homo sapiens
  heavy chain complementarity determining region 3 for antibody 50192
ATESGSYYGGLDY

SEQ ID NO: 100385 - protein, 9 aa, Homo sapiens
  light chain complementarity determining region 3 for antibody 50193
HQYGSFPRT

SEQ ID NO: 100386 - protein, 9 aa, Homo sapiens
  heavy chain complementarity determining region 3 for antibody 50193
AREYSSFEY

SEQ ID NO: 100387 - protein, 9 aa, Homo sapiens
  light chain complementarity determining region 3 for antibody 50194
HQYGRSPRT

SEQ ID NO: 100388 - protein, 15 aa, Homo sapiens
  heavy chain complementarity determining region 3 for antibody 50194
AKDGEFCGSNCYFGS

SEQ ID NO: 100389 - protein, 9 aa, Homo sapiens
  light chain complementarity determining region 3 for antibody 50195
HQYGPAPQP

SEQ ID NO: 100390 - protein, 15 aa, Homo sapiens
  heavy chain complementarity determining region 3 for antibody 50195
ARGRNYFDSSGSEYF

SEQ ID NO: 100391 - protein, 9 aa, Homo sapiens
  light chain complementarity determining region 3 for antibody 50196
HQYGPAPPT

SEQ ID NO: 100392 - protein, 15 aa, Homo sapiens
  heavy chain complementarity determining region 3 for antibody 50196
ARGRNYFDSSGSEYF

SEQ ID NO: 100393 - protein, 9 aa, Homo sapiens
  light chain complementarity determining region 3 for antibody 50197
HQYGGSPRT

SEQ ID NO: 100394 - protein, 11 aa, Homo sapiens
  heavy chain complementarity determining region 3 for antibody 50197
ARDANYGLFDY

SEQ ID NO: 100395 - protein, 10 aa, Homo sapiens
  light chain complementarity determining region 3 for antibody 50198
HQYGGSPPWP

SEQ ID NO: 100396 - protein, 16 aa, Homo sapiens
  heavy chain complementarity determining region 3 for antibody 50198
ARRQWVRGLFRGGLDY

SEQ ID NO: 100397 - protein, 9 aa, Homo sapiens
  light chain complementarity determining region 3 for antibody 50199
HQYGGSPHT

SEQ ID NO: 100398 - protein, 17 aa, Homo sapiens
  heavy chain complementarity determining region 3 for antibody 50199
TRDQWGVAVGARSPSRH

SEQ ID NO: 100399 - protein, 8 aa, Homo sapiens
  light chain complementarity determining region 3 for antibody 50200
HQYGDPPP

SEQ ID NO: 100400 - protein, 16 aa, Homo sapiens
  heavy chain complementarity determining region 3 for antibody 50200
AKGSIGWNPEENWFDS

SEQ ID NO: 100401 - protein, 9 aa, Homo sapiens
  light chain complementarity determining region 3 for antibody 50201
HQYGASPYT

SEQ ID NO: 100402 - protein, 15 aa, Homo sapiens
  heavy chain complementarity determining region 3 for antibody 50201
ARDHVWSLSSPYFQH

SEQ ID NO: 100403 - protein, 9 aa, Homo sapiens
  light chain complementarity determining region 3 for antibody 50202
HQYFSSPAT

SEQ ID NO: 100404 - protein, 12 aa, Homo sapiens
  heavy chain complementarity determining region 3 for antibody 50202
TTYAFYGLGRSS

SEQ ID NO: 100405 - protein, 9 aa, Homo sapiens
  light chain complementarity determining region 3 for antibody 50203
HQYFSPPYT

SEQ ID NO: 100406 - protein, 17 aa, Homo sapiens
  heavy chain complementarity determining region 3 for antibody 50203
ARQGHHCDGGSCFPPRY

SEQ ID NO: 100407 - protein, 9 aa, Homo sapiens
  light chain complementarity determining region 3 for antibody 50204
HQYFSLPET

SEQ ID NO: 100408 - protein, 12 aa, Homo sapiens
  heavy chain complementarity determining region 3 for antibody 50204
TTYAFYGLGRSS

SEQ ID NO: 100409 - protein, 9 aa, Homo sapiens
  light chain complementarity determining region 3 for antibody 50205
HQYFCSPET

SEQ ID NO: 100410 - protein, 12 aa, Homo sapiens
  heavy chain complementarity determining region 3 for antibody 50205
TTYAFYGLGRSS

SEQ ID NO: 100411 - protein, 9 aa, Homo sapiens
  light chain complementarity determining region 3 for antibody 50206
HQYDSYSWK

SEQ ID NO: 100412 - protein, 16 aa, Homo sapiens
  heavy chain complementarity determining region 3 for antibody 50206
ATGRGYELKTGWYFDL

SEQ ID NO: 100413 - protein, 9 aa, Homo sapiens
  light chain complementarity determining region 3 for antibody 50207
HQYDSSPRT

SEQ ID NO: 100414 - protein, 13 aa, Homo sapiens
  heavy chain complementarity determining region 3 for antibody 50207
ARAGRVGGVEGAT

SEQ ID NO: 100415 - protein, 9 aa, Homo sapiens
  light chain complementarity determining region 3 for antibody 50208
HQYDSLPRT

SEQ ID NO: 100416 - protein, 13 aa, Homo sapiens
  heavy chain complementarity determining region 3 for antibody 50208
ARTGRVGGVEGAT

SEQ ID NO: 100417 - protein, 9 aa, Homo sapiens
  light chain complementarity determining region 3 for antibody 50209
HQYDRSPLP

SEQ ID NO: 100418 - protein, 13 aa, Homo sapiens
  heavy chain complementarity determining region 3 for antibody 50209
ARRQTYTNYAFDI

SEQ ID NO: 100419 - protein, 9 aa, Homo sapiens
  light chain complementarity determining region 3 for antibody 50210
HQYATFPWP

SEQ ID NO: 100420 - protein, 14 aa, Homo sapiens
  heavy chain complementarity determining region 3 for antibody 50210
ARLGYGAYRAAFDV

SEQ ID NO: 100421 - protein, 8 aa, Homo sapiens
  light chain complementarity determining region 3 for antibody 50211
HQYASSWT

SEQ ID NO: 100422 - protein, 12 aa, Homo sapiens
  heavy chain complementarity determining region 3 for antibody 50211
ANARGVYYHFDC

SEQ ID NO: 100423 - protein, 9 aa, Homo sapiens
  light chain complementarity determining region 3 for antibody 50212
HQYASSVVT

SEQ ID NO: 100424 - protein, 17 aa, Homo sapiens
  heavy chain complementarity determining region 3 for antibody 50212
ATPQQQLIQAITDRLDS

SEQ ID NO: 100425 - protein, 9 aa, Homo sapiens
  light chain complementarity determining region 3 for antibody 50213
HQYASSVGT

SEQ ID NO: 100426 - protein, 17 aa, Homo sapiens
  heavy chain complementarity determining region 3 for antibody 50213
ATPQQQLIQAITDRLDF

SEQ ID NO: 100427 - protein, 9 aa, Homo sapiens
  light chain complementarity determining region 3 for antibody 50214
HQTYSTPST

SEQ ID NO: 100428 - protein, 11 aa, Homo sapiens
  heavy chain complementarity determining region 3 for antibody 50214
EGVEMATIVDY

SEQ ID NO: 100429 - protein, 9 aa, Homo sapiens
  light chain complementarity determining region 3 for antibody 50215
HQTSSFPPA

SEQ ID NO: 100430 - protein, 14 aa, Homo sapiens
  heavy chain complementarity determining region 3 for antibody 50215
ARPSSGVYYSALDV

SEQ ID NO: 100431 - protein, 9 aa, Homo sapiens
  light chain complementarity determining region 3 for antibody 50216
HQTRALPLT

SEQ ID NO: 100432 - protein, 17 aa, Homo sapiens
  heavy chain complementarity determining region 3 for antibody 50216
ASMGIATVRGRYDAFDM

SEQ ID NO: 100433 - protein, 9 aa, Homo sapiens
  light chain complementarity determining region 3 for antibody 50217
HQTRAFPLT

SEQ ID NO: 100434 - protein, 17 aa, Homo sapiens
  heavy chain complementarity determining region 3 for antibody 50217
ASMGIAMVRGRYDAFDM

SEQ ID NO: 100435 - protein, 9 aa, Homo sapiens
  light chain complementarity determining region 3 for antibody 50218
HQTGSFPYT

SEQ ID NO: 100436 - protein, 15 aa, Homo sapiens
  heavy chain complementarity determining region 3 for antibody 50218
AKGDSGYESLGDFDY

SEQ ID NO: 100437 - protein, 9 aa, Homo sapiens
  light chain complementarity determining region 3 for antibody 50219
HQSYTTPRT

SEQ ID NO: 100438 - protein, 16 aa, Homo sapiens
  heavy chain complementarity determining region 3 for antibody 50219
ARESRIGHNPVLGFDL

SEQ ID NO: 100439 - protein, 8 aa, Homo sapiens
  light chain complementarity determining region 3 for antibody 50220
HQSYSTPT

SEQ ID NO: 100440 - protein, 18 aa, Homo sapiens
  heavy chain complementarity determining region 3 for antibody 50220
AREGDYFVSGTSYNIFDY

SEQ ID NO: 100441 - protein, 10 aa, Homo sapiens
  light chain complementarity determining region 3 for antibody 50221
HQSYSTLLYT

SEQ ID NO: 100442 - protein, 11 aa, Homo sapiens
  heavy chain complementarity determining region 3 for antibody 50221
AKDNNFWTIDY

SEQ ID NO: 100443 - protein, 9 aa, Homo sapiens
  light chain complementarity determining region 3 for antibody 50222
HQSYSRPPT

SEQ ID NO: 100444 - protein, 16 aa, Homo sapiens
  heavy chain complementarity determining region 3 for antibody 50222
ARDSRQSGFVGSSFDI

SEQ ID NO: 100445 - protein, 10 aa, Homo sapiens
  light chain complementarity determining region 3 for antibody 50223
HQSYRTPPFT

SEQ ID NO: 100446 - protein, 14 aa, Homo sapiens
  heavy chain complementarity determining region 3 for antibody 50223
AKVEPYGDNHRFDY

SEQ ID NO: 100447 - protein, 9 aa, Homo sapiens
  light chain complementarity determining region 3 for antibody 50224
HQSYNSPYS

SEQ ID NO: 100448 - protein, 13 aa, Homo sapiens
  heavy chain complementarity determining region 3 for antibody 50224
ARSDYYPPDAFDV

SEQ ID NO: 100449 - protein, 9 aa, Homo sapiens
  light chain complementarity determining region 3 for antibody 50225
HQSYIAPPT

SEQ ID NO: 100450 - protein, 14 aa, Homo sapiens
  heavy chain complementarity determining region 3 for antibody 50225
TTCVPAASQNTEDY

SEQ ID NO: 100451 - protein, 9 aa, Homo sapiens
  light chain complementarity determining region 3 for antibody 50226
HQSSYVPRT

SEQ ID NO: 100452 - protein, 19 aa, Homo sapiens
  heavy chain complementarity determining region 3 for antibody 50226
ARDRPSSRRFLEWLLPLDY

SEQ ID NO: 100453 - protein, 9 aa, Homo sapiens
  light chain complementarity determining region 3 for antibody 50227
HQSSTFPRT

SEQ ID NO: 100454 - protein, 14 aa, Homo sapiens
  heavy chain complementarity determining region 3 for antibody 50227
ARDLRETMAGEFAF

SEQ ID NO: 100455 - protein, 9 aa, Homo sapiens
  light chain complementarity determining region 3 for antibody 50228
HQSSTFPQT

SEQ ID NO: 100456 - protein, 15 aa, Homo sapiens
  heavy chain complementarity determining region 3 for antibody 50228
GIVSGNRGWSDAFHI

SEQ ID NO: 100457 - protein, 9 aa, Homo sapiens
  light chain complementarity determining region 3 for antibody 50229
HQSSSLQLT

SEQ ID NO: 100458 - protein, 16 aa, Homo sapiens
  heavy chain complementarity determining region 3 for antibody 50229
VRGGYRYSGPPDAFDI

SEQ ID NO: 100459 - protein, 9 aa, Homo sapiens
  light chain complementarity determining region 3 for antibody 50230
HQSSSLPPT

SEQ ID NO: 100460 - protein, 16 aa, Homo sapiens
  heavy chain complementarity determining region 3 for antibody 50230
VRGGYRYSGPPDAFDI

SEQ ID NO: 100461 - protein, 11 aa, Homo sapiens
  light chain complementarity determining region 3 for antibody 50231
HQSSSLPHTIP

SEQ ID NO: 100462 - protein, 14 aa, Homo sapiens
  heavy chain complementarity determining region 3 for antibody 50231
ARHWGSSLLDPPSD

SEQ ID NO: 100463 - protein, 9 aa, Homo sapiens
  light chain complementarity determining region 3 for antibody 50232
HQSSSLNGT

SEQ ID NO: 100464 - protein, 18 aa, Homo sapiens
  heavy chain complementarity determining region 3 for antibody 50232
ARGSPREYSVYDSEAFDI

SEQ ID NO: 100465 - protein, 9 aa, Homo sapiens
  light chain complementarity determining region 3 for antibody 50233
HQSSSFPWT

SEQ ID NO: 100466 - protein, 12 aa, Homo sapiens
  heavy chain complementarity determining region 3 for antibody 50233
ARALIRGGNLNY

SEQ ID NO: 100467 - protein, 9 aa, Homo sapiens
  light chain complementarity determining region 3 for antibody 50234
HQSSSFPWA

SEQ ID NO: 100468 - protein, 15 aa, Homo sapiens
  heavy chain complementarity determining region 3 for antibody 50234
ARELNSGSYFGSFQY

SEQ ID NO: 100469 - protein, 11 aa, Homo sapiens
  light chain complementarity determining region 3 for antibody 50235
HQSSSFPHTIT

SEQ ID NO: 100470 - protein, 14 aa, Homo sapiens
  heavy chain complementarity determining region 3 for antibody 50235
ARHWGSSLLDPPSD

SEQ ID NO: 100471 - protein, 9 aa, Homo sapiens
  light chain complementarity determining region 3 for antibody 50236
HQSSRLPRT

SEQ ID NO: 100472 - protein, 6 aa, Homo sapiens
  heavy chain complementarity determining region 3 for antibody 50236
TRDGVY

SEQ ID NO: 100473 - protein, 9 aa, Homo sapiens
  light chain complementarity determining region 3 for antibody 50237
HQSSGLQGT

SEQ ID NO: 100474 - protein, 18 aa, Homo sapiens
  heavy chain complementarity determining region 3 for antibody 50237
ARGSPRGYGGYDSEAFDI

SEQ ID NO: 100475 - protein, 9 aa, Homo sapiens
  light chain complementarity determining region 3 for antibody 50238
HQSSGFEGT

SEQ ID NO: 100476 - protein, 18 aa, Homo sapiens
  heavy chain complementarity determining region 3 for antibody 50238
ARGSPREYSGYDAEALDL

SEQ ID NO: 100477 - protein, 9 aa, Homo sapiens
  light chain complementarity determining region 3 for antibody 50239
HQSSDLPCT

SEQ ID NO: 100478 - protein, 13 aa, Homo sapiens
  heavy chain complementarity determining region 3 for antibody 50239
ARLVAQTRVPFDS

SEQ ID NO: 100479 - protein, 9 aa, Homo sapiens
  light chain complementarity determining region 3 for antibody 50240
HQSHTTPWT

SEQ ID NO: 100480 - protein, 15 aa, Homo sapiens
  heavy chain complementarity determining region 3 for antibody 50240
ARNNGGIIWYRAFDI

SEQ ID NO: 100481 - protein, 9 aa, Homo sapiens
  light chain complementarity determining region 3 for antibody 50241
HQSGTFPWT

SEQ ID NO: 100482 - protein, 14 aa, Homo sapiens
  heavy chain complementarity determining region 3 for antibody 50241
IMDASGTGGWYADS

SEQ ID NO: 100483 - protein, 9 aa, Homo sapiens
  light chain complementarity determining region 3 for antibody 50242
HQSGSLPRP

SEQ ID NO: 100484 - protein, 14 aa, Homo sapiens
  heavy chain complementarity determining region 3 for antibody 50242
TTMGWDSGYDDRDY

SEQ ID NO: 100485 - protein, 9 aa, Homo sapiens
  light chain complementarity determining region 3 for antibody 50243
HQSGSFPRT

SEQ ID NO: 100486 - protein, 14 aa, Homo sapiens
  heavy chain complementarity determining region 3 for antibody 50243
TTMGWDSGYDDRDY

SEQ ID NO: 100487 - protein, 9 aa, Homo sapiens
  light chain complementarity determining region 3 for antibody 50244
HQSGSFPIT

SEQ ID NO: 100488 - protein, 16 aa, Homo sapiens
  heavy chain complementarity determining region 3 for antibody 50244
ARVFGSGTYHSDYFDN

SEQ ID NO: 100489 - protein, 8 aa, Homo sapiens
  light chain complementarity determining region 3 for antibody 50245
HQSGRSLT

SEQ ID NO: 100490 - protein, 8 aa, Homo sapiens
  heavy chain complementarity determining region 3 for antibody 50245
TGHGSDSS

SEQ ID NO: 100491 - protein, 9 aa, Homo sapiens
  light chain complementarity determining region 3 for antibody 50246
HQRYNWPLP

SEQ ID NO: 100492 - protein, 13 aa, Homo sapiens
  heavy chain complementarity determining region 3 for antibody 50246
ARVNRMAARYFDL

SEQ ID NO: 100493 - protein, 8 aa, Homo sapiens
  light chain complementarity determining region 3 for antibody 50247
HQRSTLPT

SEQ ID NO: 100494 - protein, 8 aa, Homo sapiens
  heavy chain complementarity determining region 3 for antibody 50247
ARSRPAGY

SEQ ID NO: 100495 - protein, 9 aa, Homo sapiens
  light chain complementarity determining region 3 for antibody 50248
HQRSTLPRT

SEQ ID NO: 100496 - protein, 14 aa, Homo sapiens
  heavy chain complementarity determining region 3 for antibody 50248
ARDLRETMAGEFAF

SEQ ID NO: 100497 - protein, 9 aa, Homo sapiens
  light chain complementarity determining region 3 for antibody 50249
HQRSTLPQT

SEQ ID NO: 100498 - protein, 15 aa, Homo sapiens
  heavy chain complementarity determining region 3 for antibody 50249
GIVSGNRGWSDAFHI

SEQ ID NO: 100499 - protein, 9 aa, Homo sapiens
  light chain complementarity determining region 3 for antibody 50250
HQRSSWPIT

SEQ ID NO: 100500 - protein, 15 aa, Homo sapiens
  heavy chain complementarity determining region 3 for antibody 50250
ARELPVTNVYHYYDY

SEQ ID NO: 100501 - protein, 9 aa, Homo sapiens
  light chain complementarity determining region 3 for antibody 50251
HQRSSFPLT

SEQ ID NO: 100502 - protein, 12 aa, Homo sapiens
  heavy chain complementarity determining region 3 for antibody 50251
AKDAAVATYFEY

SEQ ID NO: 100503 - protein, 9 aa, Homo sapiens
  light chain complementarity determining region 3 for antibody 50252
HQRSNWPRT

SEQ ID NO: 100504 - protein, 8 aa, Homo sapiens
  heavy chain complementarity determining region 3 for antibody 50252
VGDGYKQR

SEQ ID NO: 100505 - protein, 10 aa, Homo sapiens
  light chain complementarity determining region 3 for antibody 50253
HQRSNWPLYT

SEQ ID NO: 100506 - protein, 17 aa, Homo sapiens
  heavy chain complementarity determining region 3 for antibody 50253
ARVGRLTDDYYSNGMDV

SEQ ID NO: 100507 - protein, 9 aa, Homo sapiens
  light chain complementarity determining region 3 for antibody 50254
HQRSNWPFT

SEQ ID NO: 100508 - protein, 15 aa, Homo sapiens
  heavy chain complementarity determining region 3 for antibody 50254
ARAFRTSGIYYNSDY

SEQ ID NO: 100509 - protein, 9 aa, Homo sapiens
  light chain complementarity determining region 3 for antibody 50255
HQRSKWLYT

SEQ ID NO: 100510 - protein, 15 aa, Homo sapiens
  heavy chain complementarity determining region 3 for antibody 50255
SRGLTYYYGSGNPWD

SEQ ID NO: 100511 - protein, 9 aa, Homo sapiens
  light chain complementarity determining region 3 for antibody 50256
HQRSGLKGT

SEQ ID NO: 100512 - protein, 18 aa, Homo sapiens
  heavy chain complementarity determining region 3 for antibody 50256
ARGSPRGYGGYDSEAFDI

SEQ ID NO: 100513 - protein, 9 aa, Homo sapiens
  light chain complementarity determining region 3 for antibody 50257
HQRGTLPWT

SEQ ID NO: 100514 - protein, 14 aa, Homo sapiens
  heavy chain complementarity determining region 3 for antibody 50257
IMDASGTGGWYADS

SEQ ID NO: 100515 - protein, 9 aa, Homo sapiens
  light chain complementarity determining region 3 for antibody 50258
HQRGNWPWT

SEQ ID NO: 100516 - protein, 15 aa, Homo sapiens
  heavy chain complementarity determining region 3 for antibody 50258
VRHSVFSDTSAYYGH

SEQ ID NO: 100517 - protein, 10 aa, Homo sapiens
  light chain complementarity determining region 3 for antibody 50259
HQRFNWPPIT

SEQ ID NO: 100518 - protein, 17 aa, Homo sapiens
  heavy chain complementarity determining region 3 for antibody 50259
ARDLTAPGGTVSMLLDY

SEQ ID NO: 100519 - protein, 9 aa, Homo sapiens
  light chain complementarity determining region 3 for antibody 50260
HQRCNWPRT

SEQ ID NO: 100520 - protein, 8 aa, Homo sapiens
  heavy chain complementarity determining region 3 for antibody 50260
VRDGYKQR

SEQ ID NO: 100521 - protein, 8 aa, Homo sapiens
  light chain complementarity determining region 3 for antibody 50261
HQRANWVT

SEQ ID NO: 100522 - protein, 19 aa, Homo sapiens
  heavy chain complementarity determining region 3 for antibody 50261
TRQGGYANIGYYYYYGMDV

SEQ ID NO: 100523 - protein, 8 aa, Homo sapiens
  light chain complementarity determining region 3 for antibody 50262
HQPTSAPT

SEQ ID NO: 100524 - protein, 14 aa, Homo sapiens
  heavy chain complementarity determining region 3 for antibody 50262
ARARGYRGGWYFDL

SEQ ID NO: 100525 - protein, 8 aa, Homo sapiens
  light chain complementarity determining region 3 for antibody 50263
HQPTSAHP

SEQ ID NO: 100526 - protein, 14 aa, Homo sapiens
  heavy chain complementarity determining region 3 for antibody 50263
ARARGYRGGWYFDL

SEQ ID NO: 100527 - protein, 8 aa, Homo sapiens
  light chain complementarity determining region 3 for antibody 50264
HQPTSAHN

SEQ ID NO: 100528 - protein, 14 aa, Homo sapiens
  heavy chain complementarity determining region 3 for antibody 50264
ARARGYRGGWYFDL

SEQ ID NO: 100529 - protein, 9 aa, Homo sapiens
  light chain complementarity determining region 3 for antibody 50265
HQNSTSPRT

SEQ ID NO: 100530 - protein, 17 aa, Homo sapiens
  heavy chain complementarity determining region 3 for antibody 50265
VKPRETYSSGWVDAFEM

SEQ ID NO: 100531 - protein, 9 aa, Homo sapiens
  light chain complementarity determining region 3 for antibody 50266
HQNGSSPTT

SEQ ID NO: 100532 - protein, 14 aa, Homo sapiens
  heavy chain complementarity determining region 3 for antibody 50266
ARASGSGPGGWFDP

SEQ ID NO: 100533 - protein, 9 aa, Homo sapiens
  light chain complementarity determining region 3 for antibody 50267
HQNGSSPRT

SEQ ID NO: 100534 - protein, 12 aa, Homo sapiens
  heavy chain complementarity determining region 3 for antibody 50267
AHFNWDRGTFDY

SEQ ID NO: 100535 - protein, 9 aa, Homo sapiens
  light chain complementarity determining region 3 for antibody 50268
HQNGGSPYT

SEQ ID NO: 100536 - protein, 17 aa, Homo sapiens
  heavy chain complementarity determining region 3 for antibody 50268
TRDQWGVAVGARSPSRH

SEQ ID NO: 100537 - protein, 9 aa, Homo sapiens
  light chain complementarity determining region 3 for antibody 50269
HQISSLPHT

SEQ ID NO: 100538 - protein, 14 aa, Homo sapiens
  heavy chain complementarity determining region 3 for antibody 50269
ATGGGSGFFWYFDL

SEQ ID NO: 100539 - protein, 9 aa, Homo sapiens
  light chain complementarity determining region 3 for antibody 50270
HQHDRSPLT

SEQ ID NO: 100540 - protein, 13 aa, Homo sapiens
  heavy chain complementarity determining region 3 for antibody 50270
ARRQTYTNYAFDI

SEQ ID NO: 100541 - protein, 9 aa, Homo sapiens
  light chain complementarity determining region 3 for antibody 50271
HQHAYSPLT

SEQ ID NO: 100542 - protein, 10 aa, Homo sapiens
  heavy chain complementarity determining region 3 for antibody 50271
ARTSGWLGDY

SEQ ID NO: 100543 - protein, 9 aa, Homo sapiens
  light chain complementarity determining region 3 for antibody 50272
HQHASAPLT

SEQ ID NO: 100544 - protein, 10 aa, Homo sapiens
  heavy chain complementarity determining region 3 for antibody 50272
ARTSGWLGDY

SEQ ID NO: 100545 - protein, 9 aa, Homo sapiens
  light chain complementarity determining region 3 for antibody 50273
HQGYSTPFT

SEQ ID NO: 100546 - protein, 15 aa, Homo sapiens
  heavy chain complementarity determining region 3 for antibody 50273
AKAQVIWGQLYYFDS

SEQ ID NO: 100547 - protein, 9 aa, Homo sapiens
  light chain complementarity determining region 3 for antibody 50274
HQGYSTPFT

SEQ ID NO: 100548 - protein, 15 aa, Homo sapiens
  heavy chain complementarity determining region 3 for antibody 50274
AKAQLIWGQLYYFGS

SEQ ID NO: 100549 - protein, 9 aa, Homo sapiens
  light chain complementarity determining region 3 for antibody 50275
HQGGSFPQT

SEQ ID NO: 100550 - protein, 18 aa, Homo sapiens
  heavy chain complementarity determining region 3 for antibody 50275
AAATYSSSWKVGEDAFAI

SEQ ID NO: 100551 - protein, 9 aa, Homo sapiens
  light chain complementarity determining region 3 for antibody 50276
HQFDDVRPT

SEQ ID NO: 100552 - protein, 13 aa, Homo sapiens
  heavy chain complementarity determining region 3 for antibody 50276
VRSAYGAQGVFDY

SEQ ID NO: 100553 - protein, 10 aa, Homo sapiens
  light chain complementarity determining region 3 for antibody 50277
HQFATSPPWT

SEQ ID NO: 100554 - protein, 16 aa, Homo sapiens
  heavy chain complementarity determining region 3 for antibody 50277
ARRQWVRGLFKGGLDY

SEQ ID NO: 100555 - protein, 9 aa, Homo sapiens
  light chain complementarity determining region 3 for antibody 50278
HQDGSSPRT

SEQ ID NO: 100556 - protein, 12 aa, Homo sapiens
  heavy chain complementarity determining region 3 for antibody 50278
AHFNWDRGTFDY

SEQ ID NO: 100557 - protein, 9 aa, Homo sapiens
  light chain complementarity determining region 3 for antibody 50279
HQDGDSQYT

SEQ ID NO: 100558 - protein, 13 aa, Homo sapiens
  heavy chain complementarity determining region 3 for antibody 50279
ATRGVGQTAGFNF

SEQ ID NO: 100559 - protein, 9 aa, Homo sapiens
  light chain complementarity determining region 3 for antibody 50280
HQDFSSPGT

SEQ ID NO: 100560 - protein, 12 aa, Homo sapiens
  heavy chain complementarity determining region 3 for antibody 50280
TTYAFYGLGRSS

SEQ ID NO: 100561 - protein, 9 aa, Homo sapiens
  light chain complementarity determining region 3 for antibody 50281
HQDFSSPET

SEQ ID NO: 100562 - protein, 12 aa, Homo sapiens
  heavy chain complementarity determining region 3 for antibody 50281
TTYAFYGLGRSS

SEQ ID NO: 100563 - protein, 9 aa, Homo sapiens
  light chain complementarity determining region 3 for antibody 50282
HQDASSVVT

SEQ ID NO: 100564 - protein, 17 aa, Homo sapiens
  heavy chain complementarity determining region 3 for antibody 50282
ATPQQQLIQAITDRLDF

SEQ ID NO: 100565 - protein, 8 aa, Homo sapiens
  light chain complementarity determining region 3 for antibody 50283
HQCSDWPS

SEQ ID NO: 100566 - protein, 12 aa, Homo sapiens
  heavy chain complementarity determining region 3 for antibody 50283
VRSNWNLMTPDY

SEQ ID NO: 100567 - protein, 8 aa, Homo sapiens
  light chain complementarity determining region 3 for antibody 50284
HQCSDWLS

SEQ ID NO: 100568 - protein, 12 aa, Homo sapiens
  heavy chain complementarity determining region 3 for antibody 50284
VRTNWNLMTPDY

SEQ ID NO: 100569 - protein, 9 aa, Homo sapiens
  light chain complementarity determining region 3 for antibody 50285
HQCATFPWT

SEQ ID NO: 100570 - protein, 14 aa, Homo sapiens
  heavy chain complementarity determining region 3 for antibody 50285
ARLGYGAYRAAFDV

SEQ ID NO: 100571 - protein, 9 aa, Homo sapiens
  light chain complementarity determining region 3 for antibody 50286
HQAYSPPQP

SEQ ID NO: 100572 - protein, 24 aa, Homo sapiens
  heavy chain complementarity determining region 3 for antibody 50286
ARGSLEWFYDSSGYYYAPGDALDV

SEQ ID NO: 100573 - protein, 9 aa, Homo sapiens
  light chain complementarity determining region 3 for antibody 50287
HQAYIFPLT

SEQ ID NO: 100574 - protein, 24 aa, Homo sapiens
  heavy chain complementarity determining region 3 for antibody 50287
ARDRDGSGGASLPRTRYYYYGMHV

SEQ ID NO: 100575 - protein, 9 aa, Homo sapiens
  light chain complementarity determining region 3 for antibody 50288
HQAHSYPFT

SEQ ID NO: 100576 - protein, 14 aa, Homo sapiens
  heavy chain complementarity determining region 3 for antibody 50288
ARRRRLRGSYYFDV

SEQ ID NO: 100577 - protein, 9 aa, Homo sapiens
  light chain complementarity determining region 3 for antibody 50289
HNYNSAPLT

SEQ ID NO: 100578 - protein, 10 aa, Homo sapiens
  heavy chain complementarity determining region 3 for antibody 50289
ARDEGYFGAS

SEQ ID NO: 100579 - protein, 9 aa, Homo sapiens
  light chain complementarity determining region 3 for antibody 50290
HNYGSSSGT

SEQ ID NO: 100580 - protein, 12 aa, Homo sapiens
  heavy chain complementarity determining region 3 for antibody 50290
ARGYDFWSGMDI

SEQ ID NO: 100581 - protein, 9 aa, Homo sapiens
  light chain complementarity determining region 3 for antibody 50291
HNYGNSPRT

SEQ ID NO: 100582 - protein, 13 aa, Homo sapiens
  heavy chain complementarity determining region 3 for antibody 50291
ATESGSYYGGLDY

SEQ ID NO: 100583 - protein, 9 aa, Homo sapiens
  light chain complementarity determining region 3 for antibody 50292
HLRSHWLHT

SEQ ID NO: 100584 - protein, 13 aa, Homo sapiens
  heavy chain complementarity determining region 3 for antibody 50292
AKDLSSGSFVPDS

SEQ ID NO: 100585 - protein, 8 aa, Homo sapiens
  light chain complementarity determining region 3 for antibody 50293
HLFDGVPP

SEQ ID NO: 100586 - protein, 19 aa, Homo sapiens
  heavy chain complementarity determining region 3 for antibody 50293
SRDQSRPEANGWGIKSFDV

SEQ ID NO: 100587 - protein, 9 aa, Homo sapiens
  light chain complementarity determining region 3 for antibody 50294
HKYNGDHFT

SEQ ID NO: 100588 - protein, 16 aa, Homo sapiens
  heavy chain complementarity determining region 3 for antibody 50294
VRFDDILTGVPHPFEY

SEQ ID NO: 100589 - protein, 9 aa, Homo sapiens
  light chain complementarity determining region 3 for antibody 50295
HHYSSSPYT

SEQ ID NO: 100590 - protein, 13 aa, Homo sapiens
  heavy chain complementarity determining region 3 for antibody 50295
ARGTYSAFAIFGV

SEQ ID NO: 100591 - protein, 10 aa, Homo sapiens
  light chain complementarity determining region 3 for antibody 50296
HHYNNWPSAS

SEQ ID NO: 100592 - protein, 18 aa, Homo sapiens
  heavy chain complementarity determining region 3 for antibody 50296
ARGGYDYGWGSYGVYFDY

SEQ ID NO: 100593 - protein, 9 aa, Homo sapiens
  light chain complementarity determining region 3 for antibody 50297
HHYGTSPRT

SEQ ID NO: 100594 - protein, 13 aa, Homo sapiens
  heavy chain complementarity determining region 3 for antibody 50297
ATESGKYQGGLDY

SEQ ID NO: 100595 - protein, 9 aa, Homo sapiens
  light chain complementarity determining region 3 for antibody 50298
HHYGSPPQT

SEQ ID NO: 100596 - protein, 15 aa, Homo sapiens
  heavy chain complementarity determining region 3 for antibody 50298
ARGRSYYDSSGSNYF

SEQ ID NO: 100597 - protein, 9 aa, Homo sapiens
  light chain complementarity determining region 3 for antibody 50299
HHYGNSPRP

SEQ ID NO: 100598 - protein, 13 aa, Homo sapiens
  heavy chain complementarity determining region 3 for antibody 50299
ATESGSYYGGLDY

SEQ ID NO: 100599 - protein, 10 aa, Homo sapiens
  light chain complementarity determining region 3 for antibody 50300
HHYGGSPFFT

SEQ ID NO: 100600 - protein, 18 aa, Homo sapiens
  heavy chain complementarity determining region 3 for antibody 50300
AIQRPYNDFLTGPKYIDN

SEQ ID NO: 100601 - protein, 9 aa, Homo sapiens
  light chain complementarity determining region 3 for antibody 50301
HHSSSATPI

SEQ ID NO: 100602 - protein, 13 aa, Homo sapiens
  heavy chain complementarity determining region 3 for antibody 50301
ARHLPYSNGYFDY

SEQ ID NO: 100603 - protein, 9 aa, Homo sapiens
  light chain complementarity determining region 3 for antibody 50302
HHRSSATLI

SEQ ID NO: 100604 - protein, 13 aa, Homo sapiens
  heavy chain complementarity determining region 3 for antibody 50302
ARHLPYSNGYFDY

SEQ ID NO: 100605 - protein, 9 aa, Homo sapiens
  light chain complementarity determining region 3 for antibody 50303
HHRSDWPLT

SEQ ID NO: 100606 - protein, 17 aa, Homo sapiens
  heavy chain complementarity determining region 3 for antibody 50303
VKSHCINDVCHGGNFQN

SEQ ID NO: 100607 - protein, 9 aa, Homo sapiens
  light chain complementarity determining region 3 for antibody 50304
HHCDSSRYP

SEQ ID NO: 100608 - protein, 14 aa, Homo sapiens
  heavy chain complementarity determining region 3 for antibody 50304
AREYVDVSGYGLDY

SEQ ID NO: 100609 - protein, 10 aa, Homo sapiens
  light chain complementarity determining region 3 for antibody 50305
HCRDEWPPVI

SEQ ID NO: 100610 - protein, 17 aa, Homo sapiens
  heavy chain complementarity determining region 3 for antibody 50305
TTDDTFDYGDYDDAFDI

SEQ ID NO: 100611 - protein, 9 aa, Homo sapiens
  light chain complementarity determining region 3 for antibody 50306
HAFKSAPWT

SEQ ID NO: 100612 - protein, 14 aa, Homo sapiens
  heavy chain complementarity determining region 3 for antibody 50306
ARARDASGFHAFDI

SEQ ID NO: 100613 - protein, 8 aa, Homo sapiens
  light chain complementarity determining region 3 for antibody 50307
GQGTHWPP

SEQ ID NO: 100614 - protein, 12 aa, Homo sapiens
  heavy chain complementarity determining region 3 for antibody 50307
ARDYSTGDIPGY

SEQ ID NO: 100615 - protein, 9 aa, Homo sapiens
  light chain complementarity determining region 3 for antibody 50308
EQYYAFPFT

SEQ ID NO: 100616 - protein, 14 aa, Homo sapiens
  heavy chain complementarity determining region 3 for antibody 50308
ARAPYSHLMTTQEW

SEQ ID NO: 100617 - protein, 9 aa, Homo sapiens
  light chain complementarity determining region 3 for antibody 50309
EQYGNSPTP

SEQ ID NO: 100618 - protein, 19 aa, Homo sapiens
  heavy chain complementarity determining region 3 for antibody 50309
ARRVPYVRGSYRRDYGLDV

SEQ ID NO: 100619 - protein, 9 aa, Homo sapiens
  light chain complementarity determining region 3 for antibody 50310
EQSYRAPPT

SEQ ID NO: 100620 - protein, 18 aa, Homo sapiens
  heavy chain complementarity determining region 3 for antibody 50310
AREEYSYVSGTAYTVMDV

SEQ ID NO: 100621 - protein, 9 aa, Homo sapiens
  light chain complementarity determining region 3 for antibody 50311
EQRYRAPPT

SEQ ID NO: 100622 - protein, 18 aa, Homo sapiens
  heavy chain complementarity determining region 3 for antibody 50311
AREEYNYVSGTAYTVMDV

SEQ ID NO: 100623 - protein, 9 aa, Homo sapiens
  light chain complementarity determining region 3 for antibody 50312
EQDGNSPNT

SEQ ID NO: 100624 - protein, 19 aa, Homo sapiens
  heavy chain complementarity determining region 3 for antibody 50312
ARRVPYVRGSYRRDYGLDV

SEQ ID NO: 100625 - protein, 9 aa, Homo sapiens
  light chain complementarity determining region 3 for antibody 50313
EPSYNTPIT

SEQ ID NO: 100626 - protein, 20 aa, Homo sapiens
  heavy chain complementarity determining region 3 for antibody 50313
ARDPTSYHSGTYYNREGFDS

SEQ ID NO: 100627 - protein, 9 aa, Homo sapiens
  light chain complementarity determining region 3 for antibody 50314
QQYDNLPRT

SEQ ID NO: 100628 - protein, 15 aa, Homo sapiens
  heavy chain complementarity determining region 3 for antibody 50314
ASLPTTWGGFETQNL

SEQ ID NO: 100629 - protein, 9 aa, Homo sapiens
  light chain complementarity determining region 3 for antibody 50315
QQSYSTPLT

SEQ ID NO: 100630 - protein, 10 aa, Homo sapiens
  heavy chain complementarity determining region 3 for antibody 50315
ARERGSAFDL

SEQ ID NO: 100631 - protein, 10 aa, Homo sapiens
  light chain complementarity determining region 3 for antibody 50316
QQYGSSPAWT

SEQ ID NO: 100632 - protein, 17 aa, Homo sapiens
  heavy chain complementarity determining region 3 for antibody 50316
TRVKYCSDGTCYTGTDY

SEQ ID NO: 100633 - protein, 9 aa, Homo sapiens
  light chain complementarity determining region 3 for antibody 50317
QHFGSSGYT

SEQ ID NO: 100634 - protein, 22 aa, Homo sapiens
  heavy chain complementarity determining region 3 for antibody 50317
ARDIGRSGWYAESRYYYKAMDV

SEQ ID NO: 100635 - protein, 9 aa, Homo sapiens
  light chain complementarity determining region 3 for antibody 50318
LQHKIHPNT

SEQ ID NO: 100636 - protein, 7 aa, Homo sapiens
  heavy chain complementarity determining region 3 for antibody 50318
GSRWADF

SEQ ID NO: 100637 - protein, 9 aa, Homo sapiens
  light chain complementarity determining region 3 for antibody 50319
QQCYNTPLT

SEQ ID NO: 100638 - protein, 9 aa, Homo sapiens
  heavy chain complementarity determining region 3 for antibody 50319
ARDQGAMNS

SEQ ID NO: 100639 - protein, 9 aa, Homo sapiens
  light chain complementarity determining region 3 for antibody 50320
QQYYSYSWT

SEQ ID NO: 100640 - protein, 11 aa, Homo sapiens
  heavy chain complementarity determining region 3 for antibody 50320
ASKVGANPYGY

SEQ ID NO: 100641 - protein, 9 aa, Homo sapiens
  light chain complementarity determining region 3 for antibody 50321
QKHDRAPLT

SEQ ID NO: 100642 - protein, 14 aa, Homo sapiens
  heavy chain complementarity determining region 3 for antibody 50321
VHRAEYAYGNYFAY

SEQ ID NO: 100643 - protein, 9 aa, Homo sapiens
  light chain complementarity determining region 3 for antibody 50322
QQSYIIPFT

SEQ ID NO: 100644 - protein, 11 aa, Homo sapiens
  heavy chain complementarity determining region 3 for antibody 50322
ARGLGYGRFDY

SEQ ID NO: 100645 - protein, 9 aa, Homo sapiens
  light chain complementarity determining region 3 for antibody 50323
QQYDNLPRT

SEQ ID NO: 100646 - protein, 15 aa, Homo sapiens
  heavy chain complementarity determining region 3 for antibody 50323
ASLPTTWGGSETQNL

SEQ ID NO: 100647 - protein, 10 aa, Homo sapiens
  light chain complementarity determining region 3 for antibody 50324
QQYDNLLALT

SEQ ID NO: 100648 - protein, 14 aa, Homo sapiens
  heavy chain complementarity determining region 3 for antibody 50324
AGRWGDITPTILDY

SEQ ID NO: 100649 - protein, 9 aa, Homo sapiens
  light chain complementarity determining region 3 for antibody 50325
QQYFNYPWT

SEQ ID NO: 100650 - protein, 16 aa, Homo sapiens
  heavy chain complementarity determining region 3 for antibody 50325
STGECSGATCFRRLDY

SEQ ID NO: 100651 - protein, 9 aa, Homo sapiens
  light chain complementarity determining region 3 for antibody 50326
QHYSRYPYT

SEQ ID NO: 100652 - protein, 15 aa, Homo sapiens
  heavy chain complementarity determining region 3 for antibody 50326
ASGKGDGTGWPFFDF

SEQ ID NO: 100653 - protein, 10 aa, Homo sapiens
  light chain complementarity determining region 3 for antibody 50327
QQYDNLPMYT

SEQ ID NO: 100654 - protein, 6 aa, Homo sapiens
  heavy chain complementarity determining region 3 for antibody 50327
AREGRT

SEQ ID NO: 100655 - protein, 9 aa, Homo sapiens
  light chain complementarity determining region 3 for antibody 50328
QQSYTIPLT

SEQ ID NO: 100656 - protein, 9 aa, Homo sapiens
  heavy chain complementarity determining region 3 for antibody 50328
TTGDDGHAI

SEQ ID NO: 100657 - protein, 8 aa, Homo sapiens
  light chain complementarity determining region 3 for antibody 50329
QQYNSYST

SEQ ID NO: 100658 - protein, 15 aa, Homo sapiens
  heavy chain complementarity determining region 3 for antibody 50329
ASLPTTWGGFETQNL

SEQ ID NO: 100659 - protein, 10 aa, Homo sapiens
  light chain complementarity determining region 3 for antibody 50330
QQYGSSPPIT

SEQ ID NO: 100660 - protein, 9 aa, Homo sapiens
  heavy chain complementarity determining region 3 for antibody 50330
TTGDDGHAI

SEQ ID NO: 100661 - protein, 9 aa, Homo sapiens
  light chain complementarity determining region 3 for antibody 50331
QQYHSYPYS

SEQ ID NO: 100662 - protein, 11 aa, Homo sapiens
  heavy chain complementarity determining region 3 for antibody 50331
ARVVPNYYEYY

SEQ ID NO: 100663 - protein, 8 aa, Homo sapiens
  light chain complementarity determining region 3 for antibody 50332
QQYNSYYT

SEQ ID NO: 100664 - protein, 15 aa, Homo sapiens
  heavy chain complementarity determining region 3 for antibody 50332
AHPRLGYTYGFAFDY

SEQ ID NO: 100665 - protein, 10 aa, Homo sapiens
  light chain complementarity determining region 3 for antibody 50333
QQSYSPPPFT

SEQ ID NO: 100666 - protein, 14 aa, Homo sapiens
  heavy chain complementarity determining region 3 for antibody 50333
ARVHDSSWPPVFDF

SEQ ID NO: 100667 - protein, 10 aa, Homo sapiens
  light chain complementarity determining region 3 for antibody 50334
QQYGSSLLIT

SEQ ID NO: 100668 - protein, 15 aa, Homo sapiens
  heavy chain complementarity determining region 3 for antibody 50334
AHSALYSSGWYRLAY

SEQ ID NO: 100669 - protein, 11 aa, Homo sapiens
  light chain complementarity determining region 3 for antibody 50335
QQRSNWPPTYT

SEQ ID NO: 100670 - protein, 12 aa, Homo sapiens
  heavy chain complementarity determining region 3 for antibody 50335
AREIKAAAGILA

SEQ ID NO: 100671 - protein, 9 aa, Homo sapiens
  light chain complementarity determining region 3 for antibody 50336
QEYASASHS

SEQ ID NO: 100672 - protein, 17 aa, Homo sapiens
  heavy chain complementarity determining region 3 for antibody 50336
ARMGYYESSGFYGYFNL

SEQ ID NO: 100673 - protein, 9 aa, Homo sapiens
  light chain complementarity determining region 3 for antibody 50337
QKCNSAPWT

SEQ ID NO: 100674 - protein, 23 aa, Homo sapiens
  heavy chain complementarity determining region 3 for antibody 50337
ARDCGDDCRNCGDDCRNHWYFDL

SEQ ID NO: 100675 - protein, 9 aa, Homo sapiens
  light chain complementarity determining region 3 for antibody 50338
QQLYSYPLT

SEQ ID NO: 100676 - protein, 15 aa, Homo sapiens
  heavy chain complementarity determining region 3 for antibody 50338
ATLDMTLRHAWQFDL

SEQ ID NO: 100677 - protein, 9 aa, Homo sapiens
  light chain complementarity determining region 3 for antibody 50339
LQDYGYPRT

SEQ ID NO: 100678 - protein, 19 aa, Homo sapiens
  heavy chain complementarity determining region 3 for antibody 50339
ARDVSPQCSGSGWCDALTS

SEQ ID NO: 100679 - protein, 9 aa, Homo sapiens
  light chain complementarity determining region 3 for antibody 50340
QQYGSSSYT

SEQ ID NO: 100680 - protein, 19 aa, Homo sapiens
  heavy chain complementarity determining region 3 for antibody 50340
ARVNRELRGFVVYATYFDY

SEQ ID NO: 100681 - protein, 9 aa, Homo sapiens
  light chain complementarity determining region 3 for antibody 50341
QQYDSDFPT

SEQ ID NO: 100682 - protein, 9 aa, Homo sapiens
  heavy chain complementarity determining region 3 for antibody 50341
ARGAAAADY

SEQ ID NO: 100683 - protein, 8 aa, Homo sapiens
  light chain complementarity determining region 3 for antibody 50342
QQYDNWPR

SEQ ID NO: 100684 - protein, 17 aa, Homo sapiens
  heavy chain complementarity determining region 3 for antibody 50342
ARTIFYYDSSDMSCLGY

SEQ ID NO: 100685 - protein, 9 aa, Homo sapiens
  light chain complementarity determining region 3 for antibody 50343
QHYSRYPYT

SEQ ID NO: 100686 - protein, 15 aa, Homo sapiens
  heavy chain complementarity determining region 3 for antibody 50343
ASGEGDGTGWPFFDF

SEQ ID NO: 100687 - protein, 8 aa, Homo sapiens
  light chain complementarity determining region 3 for antibody 50344
QQYSTTPS

SEQ ID NO: 100688 - protein, 13 aa, Homo sapiens
  heavy chain complementarity determining region 3 for antibody 50344
GRLGTRESLVLDS

SEQ ID NO: 100689 - protein, 8 aa, Homo sapiens
  light chain complementarity determining region 3 for antibody 50345
QQYNRFWT

SEQ ID NO: 100690 - protein, 19 aa, Homo sapiens
  heavy chain complementarity determining region 3 for antibody 50345
ARGGRASHHRSGYYSTCDF

SEQ ID NO: 100691 - protein, 10 aa, Homo sapiens
  light chain complementarity determining region 3 for antibody 50346
QQYHDLPPVT

SEQ ID NO: 100692 - protein, 13 aa, Homo sapiens
  heavy chain complementarity determining region 3 for antibody 50346
AREGLATAATLDY

SEQ ID NO: 100693 - protein, 9 aa, Homo sapiens
  light chain complementarity determining region 3 for antibody 50347
HQYGPLPET

SEQ ID NO: 100694 - protein, 11 aa, Homo sapiens
  heavy chain complementarity determining region 3 for antibody 50347
ARPEGAGAFDF

SEQ ID NO: 100695 - protein, 9 aa, Homo sapiens
  light chain complementarity determining region 3 for antibody 50348
QQSFTTPVT

SEQ ID NO: 100696 - protein, 19 aa, Homo sapiens
  heavy chain complementarity determining region 3 for antibody 50348
SRGAHVSALVILTPHGFDF

SEQ ID NO: 100697 - protein, 9 aa, Homo sapiens
  light chain complementarity determining region 3 for antibody 50349
QQYGSSPQT

SEQ ID NO: 100698 - protein, 15 aa, Homo sapiens
  heavy chain complementarity determining region 3 for antibody 50349
ASGKGDGTGWPFFDF

SEQ ID NO: 100699 - protein, 10 aa, Homo sapiens
  light chain complementarity determining region 3 for antibody 50350
QHYNDYSPHS

SEQ ID NO: 100700 - protein, 15 aa, Homo sapiens
  heavy chain complementarity determining region 3 for antibody 50350
ARGPPGILRLGELWV

SEQ ID NO: 100701 - protein, 9 aa, Homo sapiens
  light chain complementarity determining region 3 for antibody 50351
QQYATSPWT

SEQ ID NO: 100702 - protein, 13 aa, Homo sapiens
  heavy chain complementarity determining region 3 for antibody 50351
ARERNQFDSSLGY

SEQ ID NO: 100703 - protein, 9 aa, Homo sapiens
  light chain complementarity determining region 3 for antibody 50352
QQLNSYPLT

SEQ ID NO: 100704 - protein, 15 aa, Homo sapiens
  heavy chain complementarity determining region 3 for antibody 50352
AKNGASGLTAAGFDF

SEQ ID NO: 100705 - protein, 9 aa, Homo sapiens
  light chain complementarity determining region 3 for antibody 50353
QQSYSTPYT

SEQ ID NO: 100706 - protein, 15 aa, Homo sapiens
  heavy chain complementarity determining region 3 for antibody 50353
ARDQDSSSKSYNFDY

SEQ ID NO: 100707 - protein, 9 aa, Homo sapiens
  light chain complementarity determining region 3 for antibody 50354
LQDYTYPRT

SEQ ID NO: 100708 - protein, 21 aa, Homo sapiens
  heavy chain complementarity determining region 3 for antibody 50354
ARDSTPTQYDKTVFYYDAFDI

SEQ ID NO: 100709 - protein, 9 aa, Homo sapiens
  light chain complementarity determining region 3 for antibody 50355
QQSYSPPLT

SEQ ID NO: 100710 - protein, 14 aa, Homo sapiens
  heavy chain complementarity determining region 3 for antibody 50355
CYGSGTYDSADFDH

SEQ ID NO: 100711 - protein, 9 aa, Homo sapiens
  light chain complementarity determining region 3 for antibody 50356
QQYNSYPLT

SEQ ID NO: 100712 - protein, 13 aa, Homo sapiens
  heavy chain complementarity determining region 3 for antibody 50356
ARHYSSSWGPFDY

SEQ ID NO: 100713 - protein, 9 aa, Homo sapiens
  light chain complementarity determining region 3 for antibody 50357
QQSYSTPFT

SEQ ID NO: 100714 - protein, 11 aa, Homo sapiens
  heavy chain complementarity determining region 3 for antibody 50357
ARQDTAMVTRY

SEQ ID NO: 100715 - protein, 9 aa, Homo sapiens
  light chain complementarity determining region 3 for antibody 50358
QQSYSTPYT

SEQ ID NO: 100716 - protein, 20 aa, Homo sapiens
  heavy chain complementarity determining region 3 for antibody 50358
ARLYCSAGSCYGIGYNGLDV

SEQ ID NO: 100717 - protein, 8 aa, Homo sapiens
  light chain complementarity determining region 3 for antibody 50359
QQYHIYSS

SEQ ID NO: 100718 - protein, 16 aa, Homo sapiens
  heavy chain complementarity determining region 3 for antibody 50359
ARLRSTGWPWGDAFDV

SEQ ID NO: 100719 - protein, 10 aa, Homo sapiens
  light chain complementarity determining region 3 for antibody 50360
QQYNNWPPLT

SEQ ID NO: 100720 - protein, 14 aa, Homo sapiens
  heavy chain complementarity determining region 3 for antibody 50360
ARDIWGGAQVVLNY

SEQ ID NO: 100721 - protein, 9 aa, Homo sapiens
  light chain complementarity determining region 3 for antibody 50361
QQFDNLPIT

SEQ ID NO: 100722 - protein, 16 aa, Homo sapiens
  heavy chain complementarity determining region 3 for antibody 50361
ARGSRYSFLYDSQMDH

SEQ ID NO: 100723 - protein, 9 aa, Homo sapiens
  light chain complementarity determining region 3 for antibody 50362
QQYYSTPRT

SEQ ID NO: 100724 - protein, 12 aa, Homo sapiens
  heavy chain complementarity determining region 3 for antibody 50362
GRVAPVEYYLDF

SEQ ID NO: 100725 - protein, 9 aa, Homo sapiens
  light chain complementarity determining region 3 for antibody 50363
QQLNSYPRA

SEQ ID NO: 100726 - protein, 16 aa, Homo sapiens
  heavy chain complementarity determining region 3 for antibody 50363
AKSDPAYGGYGGYYDD

SEQ ID NO: 100727 - protein, 8 aa, Homo sapiens
  light chain complementarity determining region 3 for antibody 50364
QQYSGWPS

SEQ ID NO: 100728 - protein, 20 aa, Homo sapiens
  heavy chain complementarity determining region 3 for antibody 50364
ARVPASLTGLKFGTLNYFDF

SEQ ID NO: 100729 - protein, 9 aa, Homo sapiens
  light chain complementarity determining region 3 for antibody 50365
QQSYSTPLT

SEQ ID NO: 100730 - protein, 13 aa, Homo sapiens
  heavy chain complementarity determining region 3 for antibody 50365
AHRESLLNDGFDM

SEQ ID NO: 100731 - protein, 9 aa, Homo sapiens
  light chain complementarity determining region 3 for antibody 50366
QQYISYPYT

SEQ ID NO: 100732 - protein, 12 aa, Homo sapiens
  heavy chain complementarity determining region 3 for antibody 50366
ARRHSSGWFYAS

SEQ ID NO: 100733 - protein, 9 aa, Homo sapiens
  light chain complementarity determining region 3 for antibody 50367
LQDYNYPWT

SEQ ID NO: 100734 - protein, 15 aa, Homo sapiens
  heavy chain complementarity determining region 3 for antibody 50367
ARIRGAAVGSEFFDC

SEQ ID NO: 100735 - protein, 9 aa, Homo sapiens
  light chain complementarity determining region 3 for antibody 50368
QKYNSAPWT

SEQ ID NO: 100736 - protein, 13 aa, Homo sapiens
  heavy chain complementarity determining region 3 for antibody 50368
ARDSGSYNAYFQH

SEQ ID NO: 100737 - protein, 10 aa, Homo sapiens
  light chain complementarity determining region 3 for antibody 50369
QQYETFSRVT

SEQ ID NO: 100738 - protein, 10 aa, Homo sapiens
  heavy chain complementarity determining region 3 for antibody 50369
ARFRGGYFDD

SEQ ID NO: 100739 - protein, 9 aa, Homo sapiens
  light chain complementarity determining region 3 for antibody 50370
QQSHDAPRT

SEQ ID NO: 100740 - protein, 31 aa, Homo sapiens
  heavy chain complementarity determining region 3 for antibody 50370
ARDGPGSVVVGPPYLRPRPPTLTTNYYHLDV

SEQ ID NO: 100741 - protein, 9 aa, Homo sapiens
  light chain complementarity determining region 3 for antibody 50371
QQYGSSPIT

SEQ ID NO: 100742 - protein, 15 aa, Homo sapiens
  heavy chain complementarity determining region 3 for antibody 50371
AKERLQWLVPYYFEY

SEQ ID NO: 100743 - protein, 10 aa, Homo sapiens
  light chain complementarity determining region 3 for antibody 50372
QQYGSSLSIT

SEQ ID NO: 100744 - protein, 20 aa, Homo sapiens
  heavy chain complementarity determining region 3 for antibody 50372
ARLYCSAGSCYGIGYNGLDV

SEQ ID NO: 100745 - protein, 9 aa, Homo sapiens
  light chain complementarity determining region 3 for antibody 50373
QQRTNWPPN

SEQ ID NO: 100746 - protein, 15 aa, Homo sapiens
  heavy chain complementarity determining region 3 for antibody 50373
ARHGAGYEQLPAFDY

SEQ ID NO: 100747 - protein, 10 aa, Homo sapiens
  light chain complementarity determining region 3 for antibody 50374
QQSYSTPVYT

SEQ ID NO: 100748 - protein, 13 aa, Homo sapiens
  heavy chain complementarity determining region 3 for antibody 50374
ARDLYESSGYLGF

SEQ ID NO: 100749 - protein, 9 aa, Homo sapiens
  light chain complementarity determining region 3 for antibody 50375
QQHYVYPYT

SEQ ID NO: 100750 - protein, 14 aa, Homo sapiens
  heavy chain complementarity determining region 3 for antibody 50375
ARDGDGDCSHCLDF

SEQ ID NO: 100751 - protein, 10 aa, Homo sapiens
  light chain complementarity determining region 3 for antibody 50376
QQHDDLPPIT

SEQ ID NO: 100752 - protein, 20 aa, Homo sapiens
  heavy chain complementarity determining region 3 for antibody 50376
ARDGGMIYNTGWYGSSYFDT

SEQ ID NO: 100753 - protein, 9 aa, Homo sapiens
  light chain complementarity determining region 3 for antibody 50377
QRYNSYLYT

SEQ ID NO: 100754 - protein, 15 aa, Homo sapiens
  heavy chain complementarity determining region 3 for antibody 50377
ATSGAPSGDYKGLDY

SEQ ID NO: 100755 - protein, 9 aa, Homo sapiens
  light chain complementarity determining region 3 for antibody 50378
QQYNTNSNT

SEQ ID NO: 100756 - protein, 17 aa, Homo sapiens
  heavy chain complementarity determining region 3 for antibody 50378
VKDQGTGWNNAHWFFDL

SEQ ID NO: 100757 - protein, 9 aa, Homo sapiens
  light chain complementarity determining region 3 for antibody 50379
QQSYSTLWT

SEQ ID NO: 100758 - protein, 12 aa, Homo sapiens
  heavy chain complementarity determining region 3 for antibody 50379
ARDGPVAGSFAY

SEQ ID NO: 100759 - protein, 8 aa, Homo sapiens
  light chain complementarity determining region 3 for antibody 50380
MHGAHWWT

SEQ ID NO: 100760 - protein, 7 aa, Homo sapiens
  heavy chain complementarity determining region 3 for antibody 50380
ARGGGGY

SEQ ID NO: 100761 - protein, 9 aa, Homo sapiens
  light chain complementarity determining region 3 for antibody 50381
QHYNSYSET

SEQ ID NO: 100762 - protein, 8 aa, Homo sapiens
  heavy chain complementarity determining region 3 for antibody 50381
ATSPQRGY

SEQ ID NO: 100763 - protein, 9 aa, Homo sapiens
  light chain complementarity determining region 3 for antibody 50382
QQYHNFPRT

SEQ ID NO: 100764 - protein, 24 aa, Homo sapiens
  heavy chain complementarity determining region 3 for antibody 50382
ARERLPEVPRYYYDSSGYPGGFDY

SEQ ID NO: 100765 - protein, 9 aa, Homo sapiens
  light chain complementarity determining region 3 for antibody 50383
QQYGSSPFT

SEQ ID NO: 100766 - protein, 17 aa, Homo sapiens
  heavy chain complementarity determining region 3 for antibody 50383
ARDMALWSFGFSNAFDI

SEQ ID NO: 100767 - protein, 9 aa, Homo sapiens
  light chain complementarity determining region 3 for antibody 50384
LQHDSYPRT

SEQ ID NO: 100768 - protein, 11 aa, Homo sapiens
  heavy chain complementarity determining region 3 for antibody 50384
ARAPYGDSFDH

SEQ ID NO: 100769 - protein, 10 aa, Homo sapiens
  light chain complementarity determining region 3 for antibody 50385
QQYDSLPPIT

SEQ ID NO: 100770 - protein, 24 aa, Homo sapiens
  heavy chain complementarity determining region 3 for antibody 50385
ARKRRVDTAVAEGDARYYYYNMDV

SEQ ID NO: 100771 - protein, 10 aa, Homo sapiens
  light chain complementarity determining region 3 for antibody 50386
QQSYTTPQVT

SEQ ID NO: 100772 - protein, 19 aa, Homo sapiens
  heavy chain complementarity determining region 3 for antibody 50386
ATNTLGYSTGWYSGNYFDY

SEQ ID NO: 100773 - protein, 9 aa, Homo sapiens
  light chain complementarity determining region 3 for antibody 50387
QHYSRYPYT

SEQ ID NO: 100774 - protein, 15 aa, Homo sapiens
  heavy chain complementarity determining region 3 for antibody 50387
ASGEGNGTGWPFFDF

SEQ ID NO: 100775 - protein, 8 aa, Homo sapiens
  light chain complementarity determining region 3 for antibody 50388
QQSYSTLT

SEQ ID NO: 100776 - protein, 14 aa, Homo sapiens
  heavy chain complementarity determining region 3 for antibody 50388
ASFGRISIFGVLDV

SEQ ID NO: 100777 - protein, 9 aa, Homo sapiens
  light chain complementarity determining region 3 for antibody 50389
QQANSFPFT

SEQ ID NO: 100778 - protein, 15 aa, Homo sapiens
  heavy chain complementarity determining region 3 for antibody 50389
ARGVGDGYNSDAFDI

SEQ ID NO: 100779 - protein, 9 aa, Homo sapiens
  light chain complementarity determining region 3 for antibody 50390
LQHNTYPWT

SEQ ID NO: 100780 - protein, 12 aa, Homo sapiens
  heavy chain complementarity determining region 3 for antibody 50390
CSSGFTGRVFQH

SEQ ID NO: 100781 - protein, 9 aa, Homo sapiens
  light chain complementarity determining region 3 for antibody 50391
QRSFRTPWT

SEQ ID NO: 100782 - protein, 15 aa, Homo sapiens
  heavy chain complementarity determining region 3 for antibody 50391
ATQVLGNYYYYGMDV

SEQ ID NO: 100783 - protein, 10 aa, Homo sapiens
  light chain complementarity determining region 3 for antibody 50392
QLYNTYSSFT

SEQ ID NO: 100784 - protein, 14 aa, Homo sapiens
  heavy chain complementarity determining region 3 for antibody 50392
VRSPAGKEGGYLDY

SEQ ID NO: 100785 - protein, 9 aa, Homo sapiens
  light chain complementarity determining region 3 for antibody 50393
QQYSTYSRT

SEQ ID NO: 100786 - protein, 11 aa, Homo sapiens
  heavy chain complementarity determining region 3 for antibody 50393
ARGGYPYGMDV

SEQ ID NO: 100787 - protein, 9 aa, Homo sapiens
  light chain complementarity determining region 3 for antibody 50394
QQYSTFSPT

SEQ ID NO: 100788 - protein, 16 aa, Homo sapiens
  heavy chain complementarity determining region 3 for antibody 50394
ARPSSSGYFSLDAFDI

SEQ ID NO: 100789 - protein, 9 aa, Homo sapiens
  light chain complementarity determining region 3 for antibody 50395
QQYNSYSPT

SEQ ID NO: 100790 - protein, 11 aa, Homo sapiens
  heavy chain complementarity determining region 3 for antibody 50395
ARISGSHDFDY

SEQ ID NO: 100791 - protein, 9 aa, Homo sapiens
  light chain complementarity determining region 3 for antibody 50396
QQSYSTPRT

SEQ ID NO: 100792 - protein, 12 aa, Homo sapiens
  heavy chain complementarity determining region 3 for antibody 50396
ARERVVRDGFDL

SEQ ID NO: 100793 - protein, 9 aa, Homo sapiens
  light chain complementarity determining region 3 for antibody 50397
QQSYNTPRT

SEQ ID NO: 100794 - protein, 15 aa, Homo sapiens
  heavy chain complementarity determining region 3 for antibody 50397
AKDHVPYGDYGSFDY

SEQ ID NO: 100795 - protein, 9 aa, Homo sapiens
  light chain complementarity determining region 3 for antibody 50398
LQYNRYPWT

SEQ ID NO: 100796 - protein, 16 aa, Homo sapiens
  heavy chain complementarity determining region 3 for antibody 50398
ATTPFFGSGNYEPLEF

SEQ ID NO: 100797 - protein, 9 aa, Homo sapiens
  light chain complementarity determining region 3 for antibody 50399
QQTYSTPWT

SEQ ID NO: 100798 - protein, 13 aa, Homo sapiens
  heavy chain complementarity determining region 3 for antibody 50399
ARVVTVDGTPFDF

SEQ ID NO: 100799 - protein, 9 aa, Homo sapiens
  light chain complementarity determining region 3 for antibody 50400
LQHNTFPPT

SEQ ID NO: 100800 - protein, 20 aa, Homo sapiens
  heavy chain complementarity determining region 3 for antibody 50400
ATSLCDTIRCFFWCCQEEDF

SEQ ID NO: 100801 - protein, 9 aa, Homo sapiens
  light chain complementarity determining region 3 for antibody 50401
QQYNNYPFT

SEQ ID NO: 100802 - protein, 15 aa, Homo sapiens
  heavy chain complementarity determining region 3 for antibody 50401
ARGGSRVSSYYYFDY

SEQ ID NO: 100803 - protein, 8 aa, Homo sapiens
  light chain complementarity determining region 3 for antibody 50402
QQYDYILT

SEQ ID NO: 100804 - protein, 8 aa, Homo sapiens
  heavy chain complementarity determining region 3 for antibody 50402
ARDVFRLT

SEQ ID NO: 100805 - protein, 9 aa, Homo sapiens
  light chain complementarity determining region 3 for antibody 50403
QQSYSTPYT

SEQ ID NO: 100806 - protein, 13 aa, Homo sapiens
  heavy chain complementarity determining region 3 for antibody 50403
ARTYSSGWLDFDY

SEQ ID NO: 100807 - protein, 9 aa, Homo sapiens
  light chain complementarity determining region 3 for antibody 50404
QQANSFPIT

SEQ ID NO: 100808 - protein, 17 aa, Homo sapiens
  heavy chain complementarity determining region 3 for antibody 50404
AKGPPPFNWTYGIFFDQ

SEQ ID NO: 100809 - protein, 9 aa, Homo sapiens
  light chain complementarity determining region 3 for antibody 50405
QQSYSTPPT

SEQ ID NO: 100810 - protein, 12 aa, Homo sapiens
  heavy chain complementarity determining region 3 for antibody 50405
ATSEMATMTDDY

SEQ ID NO: 100811 - protein, 10 aa, Homo sapiens
  light chain complementarity determining region 3 for antibody 50406
QQSDSMYPYT

SEQ ID NO: 100812 - protein, 14 aa, Homo sapiens
  heavy chain complementarity determining region 3 for antibody 50406
ARGYSTNGVCAFDP

SEQ ID NO: 100813 - protein, 10 aa, Homo sapiens
  light chain complementarity determining region 3 for antibody 50407
QQYNSYSSFT

SEQ ID NO: 100814 - protein, 14 aa, Homo sapiens
  heavy chain complementarity determining region 3 for antibody 50407
ARCPEGNEGGYLDY

SEQ ID NO: 100815 - protein, 9 aa, Homo sapiens
  light chain complementarity determining region 3 for antibody 50408
QQYDYVPIT

SEQ ID NO: 100816 - protein, 15 aa, Homo sapiens
  heavy chain complementarity determining region 3 for antibody 50408
ARPPHAFTGENYFDL

SEQ ID NO: 100817 - protein, 9 aa, Homo sapiens
  light chain complementarity determining region 3 for antibody 50409
HQYYTTPYT

SEQ ID NO: 100818 - protein, 13 aa, Homo sapiens
  heavy chain complementarity determining region 3 for antibody 50409
TTFHYFGSGTYDY

SEQ ID NO: 100819 - protein, 9 aa, Homo sapiens
  light chain complementarity determining region 3 for antibody 50410
QQYYRYPWT

SEQ ID NO: 100820 - protein, 11 aa, Homo sapiens
  heavy chain complementarity determining region 3 for antibody 50410
ASRTTVTLFDY

SEQ ID NO: 100821 - protein, 9 aa, Homo sapiens
  light chain complementarity determining region 3 for antibody 50411
QQSYSTPRT

SEQ ID NO: 100822 - protein, 13 aa, Homo sapiens
  heavy chain complementarity determining region 3 for antibody 50411
ARAGGYLGEYFDY

SEQ ID NO: 100823 - protein, 7 aa, Homo sapiens
  light chain complementarity determining region 3 for antibody 50412
QQSIVKT

SEQ ID NO: 100824 - protein, 11 aa, Homo sapiens
  heavy chain complementarity determining region 3 for antibody 50412
ARDVVKGGVDY

SEQ ID NO: 100825 - protein, 8 aa, Homo sapiens
  light chain complementarity determining region 3 for antibody 50413
QQTYGALT

SEQ ID NO: 100826 - protein, 12 aa, Homo sapiens
  heavy chain complementarity determining region 3 for antibody 50413
ARAQGYTTYSDF

SEQ ID NO: 100827 - protein, 9 aa, Homo sapiens
  light chain complementarity determining region 3 for antibody 50414
QQSYTTLYT

SEQ ID NO: 100828 - protein, 12 aa, Homo sapiens
  heavy chain complementarity determining region 3 for antibody 50414
ARMKDRYGGYDR

SEQ ID NO: 100829 - protein, 9 aa, Homo sapiens
  light chain complementarity determining region 3 for antibody 50415
QQYGSSSWT

SEQ ID NO: 100830 - protein, 19 aa, Homo sapiens
  heavy chain complementarity determining region 3 for antibody 50415
ARRPATPRFLEWLPDASDI

SEQ ID NO: 100831 - protein, 9 aa, Homo sapiens
  light chain complementarity determining region 3 for antibody 50416
LQHNNYPWT

SEQ ID NO: 100832 - protein, 19 aa, Homo sapiens
  heavy chain complementarity determining region 3 for antibody 50416
ARIGVVSAAPGYFYYDLDV

SEQ ID NO: 100833 - protein, 9 aa, Homo sapiens
  light chain complementarity determining region 3 for antibody 50417
LQDYSYPRT

SEQ ID NO: 100834 - protein, 19 aa, Homo sapiens
  heavy chain complementarity determining region 3 for antibody 50417
ARDTTHVGGRGIYYDAFDL

SEQ ID NO: 100835 - protein, 9 aa, Homo sapiens
  light chain complementarity determining region 3 for antibody 50418
HQYYTTPNT

SEQ ID NO: 100836 - protein, 12 aa, Homo sapiens
  heavy chain complementarity determining region 3 for antibody 50418
ARIDNWNDGLDV

SEQ ID NO: 100837 - protein, 9 aa, Homo sapiens
  light chain complementarity determining region 3 for antibody 50419
QQYNSYFIT

SEQ ID NO: 100838 - protein, 13 aa, Homo sapiens
  heavy chain complementarity determining region 3 for antibody 50419
ASRGYDGDDYKSY

SEQ ID NO: 100839 - protein, 9 aa, Homo sapiens
  light chain complementarity determining region 3 for antibody 50420
QQTYSTLVT

SEQ ID NO: 100840 - protein, 19 aa, Homo sapiens
  heavy chain complementarity determining region 3 for antibody 50420
ARDFLVYDSGTYHTYGMDV

SEQ ID NO: 100841 - protein, 9 aa, Homo sapiens
  light chain complementarity determining region 3 for antibody 50421
QQYHNLSWT

SEQ ID NO: 100842 - protein, 7 aa, Homo sapiens
  heavy chain complementarity determining region 3 for antibody 50421
ATPAGNY

SEQ ID NO: 100843 - protein, 9 aa, Homo sapiens
  light chain complementarity determining region 3 for antibody 50422
QQYGTSPWT

SEQ ID NO: 100844 - protein, 12 aa, Homo sapiens
  heavy chain complementarity determining region 3 for antibody 50422
ARGPRYWYYFDY

SEQ ID NO: 100845 - protein, 9 aa, Homo sapiens
  light chain complementarity determining region 3 for antibody 50423
QQTYSTPRT

SEQ ID NO: 100846 - protein, 8 aa, Homo sapiens
  heavy chain complementarity determining region 3 for antibody 50423
ARDFGERA

SEQ ID NO: 100847 - protein, 9 aa, Homo sapiens
  light chain complementarity determining region 3 for antibody 50424
QQSYRSPYT

SEQ ID NO: 100848 - protein, 25 aa, Homo sapiens
  heavy chain complementarity determining region 3 for antibody 50424
ARIYDYGSVSWKLRAGGLNGYWIDP

SEQ ID NO: 100849 - protein, 8 aa, Homo sapiens
  light chain complementarity determining region 3 for antibody 50425
QQYDNVIT

SEQ ID NO: 100850 - protein, 16 aa, Homo sapiens
  heavy chain complementarity determining region 3 for antibody 50425
ARGGYGDYGGLGVFQI

SEQ ID NO: 100851 - protein, 9 aa, Homo sapiens
  light chain complementarity determining region 3 for antibody 50426
QQLNSYPRT

SEQ ID NO: 100852 - protein, 16 aa, Homo sapiens
  heavy chain complementarity determining region 3 for antibody 50426
ARDIGYYHDNSGYLDY

SEQ ID NO: 100853 - protein, 9 aa, Homo sapiens
  light chain complementarity determining region 3 for antibody 50427
QQLNSYPLT

SEQ ID NO: 100854 - protein, 13 aa, Homo sapiens
  heavy chain complementarity determining region 3 for antibody 50427
AKDRSKYYYGMDV

SEQ ID NO: 100855 - protein, 6 aa, Homo sapiens
  light chain complementarity determining region 3 for antibody 50428
QQYGES

SEQ ID NO: 100856 - protein, 12 aa, Homo sapiens
  heavy chain complementarity determining region 3 for antibody 50428
ARDHPSGWSLSS

SEQ ID NO: 100857 - protein, 9 aa, Homo sapiens
  light chain complementarity determining region 3 for antibody 50429
QQYDNLPRT

SEQ ID NO: 100858 - protein, 15 aa, Homo sapiens
  heavy chain complementarity determining region 3 for antibody 50429
ASLPTTWGGFEPQNL

SEQ ID NO: 100859 - protein, 9 aa, Homo sapiens
  light chain complementarity determining region 3 for antibody 50430
QKHDRAPLT

SEQ ID NO: 100860 - protein, 14 aa, Homo sapiens
  heavy chain complementarity determining region 3 for antibody 50430
AHRAEYAYGNYFAY

SEQ ID NO: 100861 - protein, 9 aa, Homo sapiens
  light chain complementarity determining region 3 for antibody 50431
QQYDNLPRT

SEQ ID NO: 100862 - protein, 15 aa, Homo sapiens
  heavy chain complementarity determining region 3 for antibody 50431
AGLPTTWGGFETQNL

SEQ ID NO: 100863 - protein, 9 aa, Homo sapiens
  light chain complementarity determining region 3 for antibody 50432
HQSYGTPQT

SEQ ID NO: 100864 - protein, 16 aa, Homo sapiens
  heavy chain complementarity determining region 3 for antibody 50432
AHITTDFNWKRNWFDP

SEQ ID NO: 100865 - protein, 8 aa, Homo sapiens
  light chain complementarity determining region 3 for antibody 50433
QQYYSTPR

SEQ ID NO: 100866 - protein, 17 aa, Homo sapiens
  heavy chain complementarity determining region 3 for antibody 50433
ARMVNYDSSGYHGWFDY

SEQ ID NO: 100867 - protein, 13 aa, Homo sapiens
  light chain complementarity determining region 3 for antibody 50434
QQYTPIPLTFPLT

SEQ ID NO: 100868 - protein, 13 aa, Homo sapiens
  heavy chain complementarity determining region 3 for antibody 50434
ARDPETAYDAFDI

SEQ ID NO: 100869 - protein, 9 aa, Homo sapiens
  light chain complementarity determining region 3 for antibody 50435
QQYDNLPIT

SEQ ID NO: 100870 - protein, 15 aa, Homo sapiens
  heavy chain complementarity determining region 3 for antibody 50435
ARDPRGSRGAVYLDY

SEQ ID NO: 100871 - protein, 9 aa, Homo sapiens
  light chain complementarity determining region 3 for antibody 50436
QQYDDLPLT

SEQ ID NO: 100872 - protein, 15 aa, Homo sapiens
  heavy chain complementarity determining region 3 for antibody 50436
ARANPIVATIIRFDS

SEQ ID NO: 100873 - protein, 9 aa, Homo sapiens
  light chain complementarity determining region 3 for antibody 50437
QQHDNLPPT

SEQ ID NO: 100874 - protein, 17 aa, Homo sapiens
  heavy chain complementarity determining region 3 for antibody 50437
ARGDPINYGLGSLSIDY

SEQ ID NO: 100875 - protein, 8 aa, Homo sapiens
  light chain complementarity determining region 3 for antibody 50438
QQYNSCYT

SEQ ID NO: 100876 - protein, 15 aa, Homo sapiens
  heavy chain complementarity determining region 3 for antibody 50438
AHPRLGYTYGFAFDY

SEQ ID NO: 100877 - protein, 9 aa, Homo sapiens
  light chain complementarity determining region 3 for antibody 50439
QQYGSSPFT

SEQ ID NO: 100878 - protein, 15 aa, Homo sapiens
  heavy chain complementarity determining region 3 for antibody 50439
ARGGPVASSGPPYGY

SEQ ID NO: 100879 - protein, 9 aa, Homo sapiens
  light chain complementarity determining region 3 for antibody 50440
QQYDTPPWT

SEQ ID NO: 100880 - protein, 13 aa, Homo sapiens
  heavy chain complementarity determining region 3 for antibody 50440
ARETLIHLPAFEH

SEQ ID NO: 100881 - protein, 9 aa, Homo sapiens
  light chain complementarity determining region 3 for antibody 50441
QQYDNFPES

SEQ ID NO: 100882 - protein, 18 aa, Homo sapiens
  heavy chain complementarity determining region 3 for antibody 50441
AKDRELDFWNGYHDYFDS

SEQ ID NO: 100883 - protein, 9 aa, Homo sapiens
  light chain complementarity determining region 3 for antibody 50442
QQSYSTLFT

SEQ ID NO: 100884 - protein, 16 aa, Homo sapiens
  heavy chain complementarity determining region 3 for antibody 50442
ARGESSGNYYVGAFDI

SEQ ID NO: 100885 - protein, 10 aa, Homo sapiens
  light chain complementarity determining region 3 for antibody 50443
QQRYSTPMYT

SEQ ID NO: 100886 - protein, 16 aa, Homo sapiens
  heavy chain complementarity determining region 3 for antibody 50443
ARERGCSGDSCYYYDY

SEQ ID NO: 100887 - protein, 8 aa, Homo sapiens
  light chain complementarity determining region 3 for antibody 50444
QQRSDWYT

SEQ ID NO: 100888 - protein, 18 aa, Homo sapiens
  heavy chain complementarity determining region 3 for antibody 50444
AQICTGGRCPKNTYWFDP

SEQ ID NO: 100889 - protein, 9 aa, Homo sapiens
  light chain complementarity determining region 3 for antibody 50445
QQDDHLPLT

SEQ ID NO: 100890 - protein, 16 aa, Homo sapiens
  heavy chain complementarity determining region 3 for antibody 50445
ARESDEVIAAAGSLVD

SEQ ID NO: 100891 - protein, 9 aa, Homo sapiens
  light chain complementarity determining region 3 for antibody 50446
QKYNSALET

SEQ ID NO: 100892 - protein, 11 aa, Homo sapiens
  heavy chain complementarity determining region 3 for antibody 50446
AKRSSDHAFDY

SEQ ID NO: 100893 - protein, 9 aa, Homo sapiens
  light chain complementarity determining region 3 for antibody 50447
QQLNSYPYT

SEQ ID NO: 100894 - protein, 18 aa, Homo sapiens
  heavy chain complementarity determining region 3 for antibody 50447
ARGGQYCSSTNCYAVLDY

SEQ ID NO: 100895 - protein, 9 aa, Homo sapiens
  light chain complementarity determining region 3 for antibody 50448
QQYKSYPWT

SEQ ID NO: 100896 - protein, 10 aa, Homo sapiens
  heavy chain complementarity determining region 3 for antibody 50448
ARDSGYGIEY

SEQ ID NO: 100897 - protein, 9 aa, Homo sapiens
  light chain complementarity determining region 3 for antibody 50449
QQYHDRTLT

SEQ ID NO: 100898 - protein, 19 aa, Homo sapiens
  heavy chain complementarity determining region 3 for antibody 50449
ARDAVRCNRGTCYLSGLGS

SEQ ID NO: 100899 - protein, 9 aa, Homo sapiens
  light chain complementarity determining region 3 for antibody 50450
QQSYSTPRT

SEQ ID NO: 100900 - protein, 9 aa, Homo sapiens
  heavy chain complementarity determining region 3 for antibody 50450
ARDEDDFRI

SEQ ID NO: 100901 - protein, 9 aa, Homo sapiens
  light chain complementarity determining region 3 for antibody 50451
QQSYSTPLT

SEQ ID NO: 100902 - protein, 10 aa, Homo sapiens
  heavy chain complementarity determining region 3 for antibody 50451
ARERGGAFDL

SEQ ID NO: 100903 - protein, 9 aa, Homo sapiens
  light chain complementarity determining region 3 for antibody 50452
QQFNNWPLT

SEQ ID NO: 100904 - protein, 13 aa, Homo sapiens
  heavy chain complementarity determining region 3 for antibody 50452
ATYGDSDGEAFDI

SEQ ID NO: 100905 - protein, 9 aa, Homo sapiens
  light chain complementarity determining region 3 for antibody 50453
LQDYNYPYT

SEQ ID NO: 100906 - protein, 13 aa, Homo sapiens
  heavy chain complementarity determining region 3 for antibody 50453
ARPDDYGSGSLQH

SEQ ID NO: 100907 - protein, 9 aa, Homo sapiens
  light chain complementarity determining region 3 for antibody 50454
LQDYNYPRT

SEQ ID NO: 100908 - protein, 18 aa, Homo sapiens
  heavy chain complementarity determining region 3 for antibody 50454
ARDANPSYSGTYYDAFDI

SEQ ID NO: 100909 - protein, 9 aa, Homo sapiens
  light chain complementarity determining region 3 for antibody 50455
QQYNSYPYT

SEQ ID NO: 100910 - protein, 11 aa, Homo sapiens
  heavy chain complementarity determining region 3 for antibody 50455
ATNDYGDYGRY

SEQ ID NO: 100911 - protein, 9 aa, Homo sapiens
  light chain complementarity determining region 3 for antibody 50456
QQYDNLPRT

SEQ ID NO: 100912 - protein, 15 aa, Homo sapiens
  heavy chain complementarity determining region 3 for antibody 50456
ASLPTAWGGFETQNL

SEQ ID NO: 100913 - protein, 9 aa, Homo sapiens
  light chain complementarity determining region 3 for antibody 50457
QQYDNLPLT

SEQ ID NO: 100914 - protein, 14 aa, Homo sapiens
  heavy chain complementarity determining region 3 for antibody 50457
AKDRGITVAGMFDY

SEQ ID NO: 100915 - protein, 10 aa, Homo sapiens
  light chain complementarity determining region 3 for antibody 50458
QQYYNTPLYT

SEQ ID NO: 100916 - protein, 14 aa, Homo sapiens
  heavy chain complementarity determining region 3 for antibody 50458
TTDAAIKPWELLRY

SEQ ID NO: 100917 - protein, 8 aa, Homo sapiens
  light chain complementarity determining region 3 for antibody 50459
QQYNSYRT

SEQ ID NO: 100918 - protein, 14 aa, Homo sapiens
  heavy chain complementarity determining region 3 for antibody 50459
ARDRSSSSPGAFDI

SEQ ID NO: 100919 - protein, 9 aa, Homo sapiens
  light chain complementarity determining region 3 for antibody 50460
QQYGSSPFT

SEQ ID NO: 100920 - protein, 17 aa, Homo sapiens
  heavy chain complementarity determining region 3 for antibody 50460
VRGGSVLQGAIKIPFEY

SEQ ID NO: 100921 - protein, 10 aa, Homo sapiens
  light chain complementarity determining region 3 for antibody 50461
QQGYVNPPLT

SEQ ID NO: 100922 - protein, 13 aa, Homo sapiens
  heavy chain complementarity determining region 3 for antibody 50461
AREQLTAVTAFDS

SEQ ID NO: 100923 - protein, 9 aa, Homo sapiens
  light chain complementarity determining region 3 for antibody 50462
QQSYSNPLT

SEQ ID NO: 100924 - protein, 16 aa, Homo sapiens
  heavy chain complementarity determining region 3 for antibody 50462
ARDGGTYYYDSAAYDY

SEQ ID NO: 100925 - protein, 9 aa, Homo sapiens
  light chain complementarity determining region 3 for antibody 50463
LQHNSYPQT

SEQ ID NO: 100926 - protein, 9 aa, Homo sapiens
  heavy chain complementarity determining region 3 for antibody 50463
ARGRDLPDN

SEQ ID NO: 100927 - protein, 9 aa, Homo sapiens
  light chain complementarity determining region 3 for antibody 50464
QQYYSTPQT

SEQ ID NO: 100928 - protein, 13 aa, Homo sapiens
  heavy chain complementarity determining region 3 for antibody 50464
ARGNDYNDYFFNY

SEQ ID NO: 100929 - protein, 9 aa, Homo sapiens
  light chain complementarity determining region 3 for antibody 50465
QQYNSYSAT

SEQ ID NO: 100930 - protein, 14 aa, Homo sapiens
  heavy chain complementarity determining region 3 for antibody 50465
ARDGGDFSFWYFDL

SEQ ID NO: 100931 - protein, 9 aa, Homo sapiens
  light chain complementarity determining region 3 for antibody 50466
QQYGSSLGT

SEQ ID NO: 100932 - protein, 14 aa, Homo sapiens
  heavy chain complementarity determining region 3 for antibody 50466
ARDGPPYYGGESLY

SEQ ID NO: 100933 - protein, 9 aa, Homo sapiens
  light chain complementarity determining region 3 for antibody 50467
QQYDNLPRT

SEQ ID NO: 100934 - protein, 15 aa, Homo sapiens
  heavy chain complementarity determining region 3 for antibody 50467
ASLPTTWGGFEAQNL

SEQ ID NO: 100935 - protein, 6 aa, Homo sapiens
  light chain complementarity determining region 3 for antibody 50468
QQVAET

SEQ ID NO: 100936 - protein, 12 aa, Homo sapiens
  heavy chain complementarity determining region 3 for antibody 50468
ARDHPSGWALSH

SEQ ID NO: 100937 - protein, 9 aa, Homo sapiens
  light chain complementarity determining region 3 for antibody 50469
QQSYSTGLT

SEQ ID NO: 100938 - protein, 17 aa, Homo sapiens
  heavy chain complementarity determining region 3 for antibody 50469
AKGPVVTMVRKFGYFDS

SEQ ID NO: 100939 - protein, 8 aa, Homo sapiens
  light chain complementarity determining region 3 for antibody 50470
QQRSNWPT

SEQ ID NO: 100940 - protein, 19 aa, Homo sapiens
  heavy chain complementarity determining region 3 for antibody 50470
ARDRIAAAGTDYYYYGMDV

SEQ ID NO: 100941 - protein, 9 aa, Homo sapiens
  light chain complementarity determining region 3 for antibody 50471
QKYISAPFT

SEQ ID NO: 100942 - protein, 13 aa, Homo sapiens
  heavy chain complementarity determining region 3 for antibody 50471
ARAASRYFDRVDY

SEQ ID NO: 100943 - protein, 10 aa, Homo sapiens
  light chain complementarity determining region 3 for antibody 50472
QQYGSSPPWT

SEQ ID NO: 100944 - protein, 15 aa, Homo sapiens
  heavy chain complementarity determining region 3 for antibody 50472
AIPYGSGNHYGSFDY

SEQ ID NO: 100945 - protein, 9 aa, Homo sapiens
  light chain complementarity determining region 3 for antibody 50473
QQSYGTPYT

SEQ ID NO: 100946 - protein, 13 aa, Homo sapiens
  heavy chain complementarity determining region 3 for antibody 50473
ARIRRGDSWHIDY

SEQ ID NO: 100947 - protein, 8 aa, Homo sapiens
  light chain complementarity determining region 3 for antibody 50474
QQRSDLIT

SEQ ID NO: 100948 - protein, 18 aa, Homo sapiens
  heavy chain complementarity determining region 3 for antibody 50474
ARDLGCSGGSCNWSPFDY

SEQ ID NO: 100949 - protein, 9 aa, Homo sapiens
  light chain complementarity determining region 3 for antibody 50475
QQYNSYSGT

SEQ ID NO: 100950 - protein, 14 aa, Homo sapiens
  heavy chain complementarity determining region 3 for antibody 50475
ARVWVSSGLSPLTY

SEQ ID NO: 100951 - protein, 9 aa, Homo sapiens
  light chain complementarity determining region 3 for antibody 50476
QQFGTSPWT

SEQ ID NO: 100952 - protein, 17 aa, Homo sapiens
  heavy chain complementarity determining region 3 for antibody 50476
AKAYCSGGSCYYYGMDV

SEQ ID NO: 100953 - protein, 9 aa, Homo sapiens
  light chain complementarity determining region 3 for antibody 50477
LQDYNYPRT

SEQ ID NO: 100954 - protein, 9 aa, Homo sapiens
  heavy chain complementarity determining region 3 for antibody 50477
VRGATYLDY

SEQ ID NO: 100955 - protein, 8 aa, Homo sapiens
  light chain complementarity determining region 3 for antibody 50478
QQYYSYWT

SEQ ID NO: 100956 - protein, 16 aa, Homo sapiens
  heavy chain complementarity determining region 3 for antibody 50478
ASRIYYSHSSGYSLDY

SEQ ID NO: 100957 - protein, 9 aa, Homo sapiens
  light chain complementarity determining region 3 for antibody 50479
QQYGSSPLT

SEQ ID NO: 100958 - protein, 10 aa, Homo sapiens
  heavy chain complementarity determining region 3 for antibody 50479
AKGSVTTLDY

SEQ ID NO: 100959 - protein, 10 aa, Homo sapiens
  light chain complementarity determining region 3 for antibody 50480
QQYDGWPPIT

SEQ ID NO: 100960 - protein, 12 aa, Homo sapiens
  heavy chain complementarity determining region 3 for antibody 50480
VRHGVVTAEHDS

SEQ ID NO: 100961 - protein, 9 aa, Homo sapiens
  light chain complementarity determining region 3 for antibody 50481
QQRSNPMYT

SEQ ID NO: 100962 - protein, 18 aa, Homo sapiens
  heavy chain complementarity determining region 3 for antibody 50481
ATKPGIAVGGYYYYGMDV

SEQ ID NO: 100963 - protein, 8 aa, Homo sapiens
  light chain complementarity determining region 3 for antibody 50482
LQHDNFPL

SEQ ID NO: 100964 - protein, 20 aa, Homo sapiens
  heavy chain complementarity determining region 3 for antibody 50482
ARWAPAAGRASWLDAYYFDY

SEQ ID NO: 100965 - protein, 9 aa, Homo sapiens
  light chain complementarity determining region 3 for antibody 50483
HQYNSYPVT

SEQ ID NO: 100966 - protein, 15 aa, Homo sapiens
  heavy chain complementarity determining region 3 for antibody 50483
ARISGARTSNDAFDL

SEQ ID NO: 100967 - protein, 9 aa, Homo sapiens
  light chain complementarity determining region 3 for antibody 50484
QQYGSSLFT

SEQ ID NO: 100968 - protein, 19 aa, Homo sapiens
  heavy chain complementarity determining region 3 for antibody 50484
ARVNRELRGFVVYATYFDY

SEQ ID NO: 100969 - protein, 9 aa, Homo sapiens
  light chain complementarity determining region 3 for antibody 50485
QQSYSTPPT

SEQ ID NO: 100970 - protein, 17 aa, Homo sapiens
  heavy chain complementarity determining region 3 for antibody 50485
ARDGGRYSSSFWFRFDY

SEQ ID NO: 100971 - protein, 9 aa, Homo sapiens
  light chain complementarity determining region 3 for antibody 50486
QQSYRTPYT

SEQ ID NO: 100972 - protein, 10 aa, Homo sapiens
  heavy chain complementarity determining region 3 for antibody 50486
AREAGGWYED

SEQ ID NO: 100973 - protein, 9 aa, Homo sapiens
  light chain complementarity determining region 3 for antibody 50487
QQSYDTPRT

SEQ ID NO: 100974 - protein, 16 aa, Homo sapiens
  heavy chain complementarity determining region 3 for antibody 50487
ARDQDIPVAGPSIFVY

SEQ ID NO: 100975 - protein, 10 aa, Homo sapiens
  light chain complementarity determining region 3 for antibody 50488
QHYTDNLILT

SEQ ID NO: 100976 - protein, 10 aa, Homo sapiens
  heavy chain complementarity determining region 3 for antibody 50488
AKDGGGTLDY

SEQ ID NO: 100977 - protein, 10 aa, Homo sapiens
  light chain complementarity determining region 3 for antibody 50489
QHSYGTPLIT

SEQ ID NO: 100978 - protein, 13 aa, Homo sapiens
  heavy chain complementarity determining region 3 for antibody 50489
ARTMPANNWYFDL

SEQ ID NO: 100979 - protein, 9 aa, Homo sapiens
  light chain complementarity determining region 3 for antibody 50490
LQDYNYPWT

SEQ ID NO: 100980 - protein, 17 aa, Homo sapiens
  heavy chain complementarity determining region 3 for antibody 50490
AHNRLDLTLGINGHFDY

SEQ ID NO: 100981 - protein, 9 aa, Homo sapiens
  light chain complementarity determining region 3 for antibody 50491
QQYGSSPQT

SEQ ID NO: 100982 - protein, 15 aa, Homo sapiens
  heavy chain complementarity determining region 3 for antibody 50491
ASGEGDGTGWPFFDF

SEQ ID NO: 100983 - protein, 9 aa, Homo sapiens
  light chain complementarity determining region 3 for antibody 50492
QQSYSTPRT

SEQ ID NO: 100984 - protein, 16 aa, Homo sapiens
  heavy chain complementarity determining region 3 for antibody 50492
TRDRPDRIDFLNWFDP

SEQ ID NO: 100985 - protein, 9 aa, Homo sapiens
  light chain complementarity determining region 3 for antibody 50493
QQSFSNTNT

SEQ ID NO: 100986 - protein, 19 aa, Homo sapiens
  heavy chain complementarity determining region 3 for antibody 50493
AKADLHCRGNNCYNYYLDY

SEQ ID NO: 100987 - protein, 9 aa, Homo sapiens
  light chain complementarity determining region 3 for antibody 50494
QQLNTYPPT

SEQ ID NO: 100988 - protein, 14 aa, Homo sapiens
  heavy chain complementarity determining region 3 for antibody 50494
ARENSVAGTRAYDY

SEQ ID NO: 100989 - protein, 10 aa, Homo sapiens
  light chain complementarity determining region 3 for antibody 50495
MQALQTPPWT

SEQ ID NO: 100990 - protein, 13 aa, Homo sapiens
  heavy chain complementarity determining region 3 for antibody 50495
TKQSTIIIAGTDL

SEQ ID NO: 100991 - protein, 9 aa, Homo sapiens
  light chain complementarity determining region 3 for antibody 50496
LQYNNFPRT

SEQ ID NO: 100992 - protein, 11 aa, Homo sapiens
  heavy chain complementarity determining region 3 for antibody 50496
ARALSSGWLTD

SEQ ID NO: 100993 - protein, 9 aa, Homo sapiens
  light chain complementarity determining region 3 for antibody 50497
LHDYNYPRT

SEQ ID NO: 100994 - protein, 18 aa, Homo sapiens
  heavy chain complementarity determining region 3 for antibody 50497
ARDLDVYDSGPWYDAFDV

SEQ ID NO: 100995 - protein, 9 aa, Homo sapiens
  light chain complementarity determining region 3 for antibody 50498
QQYNSYPWT

SEQ ID NO: 100996 - protein, 11 aa, Homo sapiens
  heavy chain complementarity determining region 3 for antibody 50498
AVVPWERELRV

SEQ ID NO: 100997 - protein, 9 aa, Homo sapiens
  light chain complementarity determining region 3 for antibody 50499
QQYNSSSRT

SEQ ID NO: 100998 - protein, 19 aa, Homo sapiens
  heavy chain complementarity determining region 3 for antibody 50499
ARESPYNSGWYDEPGPLDY

SEQ ID NO: 100999 - protein, 6 aa, Homo sapiens
  light chain complementarity determining region 3 for antibody 50500
QQYGET

SEQ ID NO: 101000 - protein, 12 aa, Homo sapiens
  heavy chain complementarity determining region 3 for antibody 50500
ARDHPSGWSLSS

SEQ ID NO: 101001 - protein, 9 aa, Homo sapiens
  light chain complementarity determining region 3 for antibody 50501
LQYKTYPLT

SEQ ID NO: 101002 - protein, 15 aa, Homo sapiens
  heavy chain complementarity determining region 3 for antibody 50501
ARDRLGNSGWYDVDY

SEQ ID NO: 101003 - protein, 9 aa, Homo sapiens
  light chain complementarity determining region 3 for antibody 50502
LQVYNYPWT

SEQ ID NO: 101004 - protein, 13 aa, Homo sapiens
  heavy chain complementarity determining region 3 for antibody 50502
ARDLSYASEYPGY

SEQ ID NO: 101005 - protein, 9 aa, Homo sapiens
  light chain complementarity determining region 3 for antibody 50503
QQYSDFPVT

SEQ ID NO: 101006 - protein, 18 aa, Homo sapiens
  heavy chain complementarity determining region 3 for antibody 50503
ARAPYDYVNSRGRWHFDF

SEQ ID NO: 101007 - protein, 9 aa, Homo sapiens
  light chain complementarity determining region 3 for antibody 50504
QQYNSFLFT

SEQ ID NO: 101008 - protein, 23 aa, Homo sapiens
  heavy chain complementarity determining region 3 for antibody 50504
ASHYYDFVWENYRYKPRRHTFDI

SEQ ID NO: 101009 - protein, 10 aa, Homo sapiens
  light chain complementarity determining region 3 for antibody 50505
QQYNNWPPLT

SEQ ID NO: 101010 - protein, 15 aa, Homo sapiens
  heavy chain complementarity determining region 3 for antibody 50505
ATHIEAAISWGVVSF

SEQ ID NO: 101011 - protein, 9 aa, Homo sapiens
  light chain complementarity determining region 3 for antibody 50506
QQYDNLPRT

SEQ ID NO: 101012 - protein, 15 aa, Homo sapiens
  heavy chain complementarity determining region 3 for antibody 50506
ASLPTTWGGFETQSL

SEQ ID NO: 101013 - protein, 9 aa, Homo sapiens
  light chain complementarity determining region 3 for antibody 50507
QQYDIYQYS

SEQ ID NO: 101014 - protein, 15 aa, Homo sapiens
  heavy chain complementarity determining region 3 for antibody 50507
ASRRAHYDSSGYFDY

SEQ ID NO: 101015 - protein, 9 aa, Homo sapiens
  light chain complementarity determining region 3 for antibody 50508
QQSYGTPWT

SEQ ID NO: 101016 - protein, 13 aa, Homo sapiens
  heavy chain complementarity determining region 3 for antibody 50508
ARDDADTGDYFDF

SEQ ID NO: 101017 - protein, 8 aa, Homo sapiens
  light chain complementarity determining region 3 for antibody 50509
QQYNSYYT

SEQ ID NO: 101018 - protein, 15 aa, Homo sapiens
  heavy chain complementarity determining region 3 for antibody 50509
ARPRLGYTYGFAFDY

SEQ ID NO: 101019 - protein, 9 aa, Homo sapiens
  light chain complementarity determining region 3 for antibody 50510
QQYDNLPRT

SEQ ID NO: 101020 - protein, 15 aa, Homo sapiens
  heavy chain complementarity determining region 3 for antibody 50510
ASLPTTWRGFETQNL

SEQ ID NO: 101021 - protein, 9 aa, Homo sapiens
  light chain complementarity determining region 3 for antibody 50511
QQVNSYPRT

SEQ ID NO: 101022 - protein, 9 aa, Homo sapiens
  heavy chain complementarity determining region 3 for antibody 50511
ARDVYPEYG

SEQ ID NO: 101023 - protein, 9 aa, Homo sapiens
  light chain complementarity determining region 3 for antibody 50512
QQSYSTPPT

SEQ ID NO: 101024 - protein, 14 aa, Homo sapiens
  heavy chain complementarity determining region 3 for antibody 50512
ARDYAVGDPVLLDY

SEQ ID NO: 101025 - protein, 6 aa, Homo sapiens
  light chain complementarity determining region 3 for antibody 50513
QQSGET

SEQ ID NO: 101026 - protein, 12 aa, Homo sapiens
  heavy chain complementarity determining region 3 for antibody 50513
ARDHISGWSLSN

SEQ ID NO: 101027 - protein, 9 aa, Homo sapiens
  light chain complementarity determining region 3 for antibody 50514
QQLNTYPPT

SEQ ID NO: 101028 - protein, 14 aa, Homo sapiens
  heavy chain complementarity determining region 3 for antibody 50514
ARENSVSGARAYDY

SEQ ID NO: 101029 - protein, 9 aa, Homo sapiens
  light chain complementarity determining region 3 for antibody 50515
MQALQTPWT

SEQ ID NO: 101030 - protein, 19 aa, Homo sapiens
  heavy chain complementarity determining region 3 for antibody 50515
STPASAPYDILTGYYGITY

SEQ ID NO: 101031 - protein, 9 aa, Homo sapiens
  light chain complementarity determining region 3 for antibody 50516
QQYNSYPPT

SEQ ID NO: 101032 - protein, 17 aa, Homo sapiens
  heavy chain complementarity determining region 3 for antibody 50516
AKGELRYFDWLPPTIDF

SEQ ID NO: 101033 - protein, 8 aa, Homo sapiens
  light chain complementarity determining region 3 for antibody 50517
QQYHYLLS

SEQ ID NO: 101034 - protein, 7 aa, Homo sapiens
  heavy chain complementarity determining region 3 for antibody 50517
ASHARAY

SEQ ID NO: 101035 - protein, 9 aa, Homo sapiens
  light chain complementarity determining region 3 for antibody 50518
QQYHNLPLT

SEQ ID NO: 101036 - protein, 18 aa, Homo sapiens
  heavy chain complementarity determining region 3 for antibody 50518
ARDPEATIFGVTPPCLDY

SEQ ID NO: 101037 - protein, 10 aa, Homo sapiens
  light chain complementarity determining region 3 for antibody 50519
QQYGSSPPIT

SEQ ID NO: 101038 - protein, 13 aa, Homo sapiens
  heavy chain complementarity determining region 3 for antibody 50519
ASWGKLTLTTGGY

SEQ ID NO: 101039 - protein, 9 aa, Homo sapiens
  light chain complementarity determining region 3 for antibody 50520
QQSYSTPRT

SEQ ID NO: 101040 - protein, 17 aa, Homo sapiens
  heavy chain complementarity determining region 3 for antibody 50520
AREERSSWSPTEDYFDY

SEQ ID NO: 101041 - protein, 10 aa, Homo sapiens
  light chain complementarity determining region 3 for antibody 50521
QQSYSTPPFT

SEQ ID NO: 101042 - protein, 15 aa, Homo sapiens
  heavy chain complementarity determining region 3 for antibody 50521
TTLNYGDYISDAFDI

SEQ ID NO: 101043 - protein, 9 aa, Homo sapiens
  light chain complementarity determining region 3 for antibody 50522
QQSYNFPRT

SEQ ID NO: 101044 - protein, 18 aa, Homo sapiens
  heavy chain complementarity determining region 3 for antibody 50522
ARDRGTPVDGEWIAAFDI

SEQ ID NO: 101045 - protein, 9 aa, Homo sapiens
  light chain complementarity determining region 3 for antibody 50523
QQGKSFPLT

SEQ ID NO: 101046 - protein, 16 aa, Homo sapiens
  heavy chain complementarity determining region 3 for antibody 50523
AKVLAVTTDPFDYFDC

SEQ ID NO: 101047 - protein, 9 aa, Homo sapiens
  light chain complementarity determining region 3 for antibody 50524
QQANTFPRT

SEQ ID NO: 101048 - protein, 13 aa, Homo sapiens
  heavy chain complementarity determining region 3 for antibody 50524
ARDEALALDAFDI

SEQ ID NO: 101049 - protein, 10 aa, Homo sapiens
  light chain complementarity determining region 3 for antibody 50525
QKCNNAPSIT

SEQ ID NO: 101050 - protein, 13 aa, Homo sapiens
  heavy chain complementarity determining region 3 for antibody 50525
AKVRPNPQHYFDN

SEQ ID NO: 101051 - protein, 9 aa, Homo sapiens
  light chain complementarity determining region 3 for antibody 50526
LQHNSYPLT

SEQ ID NO: 101052 - protein, 11 aa, Homo sapiens
  heavy chain complementarity determining region 3 for antibody 50526
ARMGGSYFLDY

SEQ ID NO: 101053 - protein, 9 aa, Homo sapiens
  light chain complementarity determining region 3 for antibody 50527
LHHFSYPLS

SEQ ID NO: 101054 - protein, 16 aa, Homo sapiens
  heavy chain complementarity determining region 3 for antibody 50527
ARYWNGQTPARDILDF

SEQ ID NO: 101055 - protein, 8 aa, Homo sapiens
  light chain complementarity determining region 3 for antibody 50528
QQYGGFWT

SEQ ID NO: 101056 - protein, 18 aa, Homo sapiens
  heavy chain complementarity determining region 3 for antibody 50528
ASRLSSVDAKSGWKAVDI

SEQ ID NO: 101057 - protein, 9 aa, Homo sapiens
  light chain complementarity determining region 3 for antibody 50529
QQYDGYPWT

SEQ ID NO: 101058 - protein, 20 aa, Homo sapiens
  heavy chain complementarity determining region 3 for antibody 50529
ARARGQWLERAYFHYYGMDV

SEQ ID NO: 101059 - protein, 9 aa, Homo sapiens
  light chain complementarity determining region 3 for antibody 50530
QQNYRTTIT

SEQ ID NO: 101060 - protein, 10 aa, Homo sapiens
  heavy chain complementarity determining region 3 for antibody 50530
SGYRLGRHLP

SEQ ID NO: 101061 - protein, 9 aa, Homo sapiens
  light chain complementarity determining region 3 for antibody 50531
LRYSGYWWT

SEQ ID NO: 101062 - protein, 6 aa, Homo sapiens
  heavy chain complementarity determining region 3 for antibody 50531
ARDLDS

SEQ ID NO: 101063 - protein, 9 aa, Homo sapiens
  light chain complementarity determining region 3 for antibody 50532
LQHNSYPLT

SEQ ID NO: 101064 - protein, 12 aa, Homo sapiens
  heavy chain complementarity determining region 3 for antibody 50532
TKGDTATYYFDY

SEQ ID NO: 101065 - protein, 9 aa, Homo sapiens
  light chain complementarity determining region 3 for antibody 50533
QQYYNYPWT

SEQ ID NO: 101066 - protein, 16 aa, Homo sapiens
  heavy chain complementarity determining region 3 for antibody 50533
AHSPSTPATTAGTFDV

SEQ ID NO: 101067 - protein, 9 aa, Homo sapiens
  light chain complementarity determining region 3 for antibody 50534
QQYNSYSYS

SEQ ID NO: 101068 - protein, 15 aa, Homo sapiens
  heavy chain complementarity determining region 3 for antibody 50534
ARVNGIQLWLGAFAI

SEQ ID NO: 101069 - protein, 9 aa, Homo sapiens
  light chain complementarity determining region 3 for antibody 50535
QQYDNLPRT

SEQ ID NO: 101070 - protein, 15 aa, Homo sapiens
  heavy chain complementarity determining region 3 for antibody 50535
ASLPTTWGGLETQNL

SEQ ID NO: 101071 - protein, 9 aa, Homo sapiens
  light chain complementarity determining region 3 for antibody 50536
QQYDNLPRT

SEQ ID NO: 101072 - protein, 15 aa, Homo sapiens
  heavy chain complementarity determining region 3 for antibody 50536
ASLPATWGGFETQNL

SEQ ID NO: 101073 - protein, 6 aa, Homo sapiens
  light chain complementarity determining region 3 for antibody 50537
QQLGET

SEQ ID NO: 101074 - protein, 12 aa, Homo sapiens
  heavy chain complementarity determining region 3 for antibody 50537
ARDHISGWALSN

SEQ ID NO: 101075 - protein, 10 aa, Homo sapiens
  light chain complementarity determining region 3 for antibody 50538
QQHGSSRPKT

SEQ ID NO: 101076 - protein, 16 aa, Homo sapiens
  heavy chain complementarity determining region 3 for antibody 50538
AREQIVVVVAPGALDI

SEQ ID NO: 101077 - protein, 9 aa, Homo sapiens
  light chain complementarity determining region 3 for antibody 50539
QQADSFPLT

SEQ ID NO: 101078 - protein, 16 aa, Homo sapiens
  heavy chain complementarity determining region 3 for antibody 50539
GRSTMDSFVKYYGVNF

SEQ ID NO: 101079 - protein, 9 aa, Homo sapiens
  light chain complementarity determining region 3 for antibody 50540
QHYNDYSRT

SEQ ID NO: 101080 - protein, 17 aa, Homo sapiens
  heavy chain complementarity determining region 3 for antibody 50540
AREFDSSAWYNLGYFDF

SEQ ID NO: 101081 - protein, 9 aa, Homo sapiens
  light chain complementarity determining region 3 for antibody 50541
HQYADSPLT

SEQ ID NO: 101082 - protein, 10 aa, Homo sapiens
  heavy chain complementarity determining region 3 for antibody 50541
AGGIGWLFDY

SEQ ID NO: 101083 - protein, 9 aa, Homo sapiens
  light chain complementarity determining region 3 for antibody 50542
QQYYTTPLT

SEQ ID NO: 101084 - protein, 11 aa, Homo sapiens
  heavy chain complementarity determining region 3 for antibody 50542
ARPNKHWLLDY

SEQ ID NO: 101085 - protein, 10 aa, Homo sapiens
  light chain complementarity determining region 3 for antibody 50543
QQYYKWPPFT

SEQ ID NO: 101086 - protein, 11 aa, Homo sapiens
  heavy chain complementarity determining region 3 for antibody 50543
AKERLRGVIGY

SEQ ID NO: 101087 - protein, 8 aa, Homo sapiens
  light chain complementarity determining region 3 for antibody 50544
QQYNTYLT

SEQ ID NO: 101088 - protein, 16 aa, Homo sapiens
  heavy chain complementarity determining region 3 for antibody 50544
ASLWGSSSYYYHGVDV

SEQ ID NO: 101089 - protein, 8 aa, Homo sapiens
  light chain complementarity determining region 3 for antibody 50545
QQYITYST

SEQ ID NO: 101090 - protein, 15 aa, Homo sapiens
  heavy chain complementarity determining region 3 for antibody 50545
ARSANKDSSGYLLDD

SEQ ID NO: 101091 - protein, 9 aa, Homo sapiens
  light chain complementarity determining region 3 for antibody 50546
QQYDSLPRT

SEQ ID NO: 101092 - protein, 13 aa, Homo sapiens
  heavy chain complementarity determining region 3 for antibody 50546
ARGGFLAVTDFDY

SEQ ID NO: 101093 - protein, 9 aa, Homo sapiens
  light chain complementarity determining region 3 for antibody 50547
QQTYSRPLT

SEQ ID NO: 101094 - protein, 20 aa, Homo sapiens
  heavy chain complementarity determining region 3 for antibody 50547
ARSDSASCTGGTCYDYWLDP

SEQ ID NO: 101095 - protein, 8 aa, Homo sapiens
  light chain complementarity determining region 3 for antibody 50548
QQSYSTLT

SEQ ID NO: 101096 - protein, 17 aa, Homo sapiens
  heavy chain complementarity determining region 3 for antibody 50548
ARAPQGYPDHYYYGMDV

SEQ ID NO: 101097 - protein, 8 aa, Homo sapiens
  light chain complementarity determining region 3 for antibody 50549
QQSYSTHT

SEQ ID NO: 101098 - protein, 12 aa, Homo sapiens
  heavy chain complementarity determining region 3 for antibody 50549
ARRDSFYYYMDV

SEQ ID NO: 101099 - protein, 10 aa, Homo sapiens
  light chain complementarity determining region 3 for antibody 50550
QQLNSYPSIT

SEQ ID NO: 101100 - protein, 17 aa, Homo sapiens
  heavy chain complementarity determining region 3 for antibody 50550
ARDRAPVTTWFDYGLDV

SEQ ID NO: 101101 - protein, 9 aa, Homo sapiens
  light chain complementarity determining region 3 for antibody 50551
QQCSSYSWT

SEQ ID NO: 101102 - protein, 15 aa, Homo sapiens
  heavy chain complementarity determining region 3 for antibody 50551
ARCGGTKHFYYGMDV

SEQ ID NO: 101103 - protein, 9 aa, Homo sapiens
  light chain complementarity determining region 3 for antibody 50552
QQCNNYPWT

SEQ ID NO: 101104 - protein, 9 aa, Homo sapiens
  heavy chain complementarity determining region 3 for antibody 50552
AREVLRLDS

SEQ ID NO: 101105 - protein, 9 aa, Homo sapiens
  light chain complementarity determining region 3 for antibody 50553
QHLNGYPRS

SEQ ID NO: 101106 - protein, 12 aa, Homo sapiens
  heavy chain complementarity determining region 3 for antibody 50553
AREDIATDALDV

SEQ ID NO: 101107 - protein, 9 aa, Homo sapiens
  light chain complementarity determining region 3 for antibody 50554
QESYSPPRT

SEQ ID NO: 101108 - protein, 12 aa, Homo sapiens
  heavy chain complementarity determining region 3 for antibody 50554
ARSYGVRGYFDY

SEQ ID NO: 101109 - protein, 9 aa, Homo sapiens
  light chain complementarity determining region 3 for antibody 50555
LQHNSYPWT

SEQ ID NO: 101110 - protein, 11 aa, Homo sapiens
  heavy chain complementarity determining region 3 for antibody 50555
ARGLRWRAFDI

SEQ ID NO: 101111 - protein, 9 aa, Homo sapiens
  light chain complementarity determining region 3 for antibody 50556
LQHNGFPPT

SEQ ID NO: 101112 - protein, 12 aa, Homo sapiens
  heavy chain complementarity determining region 3 for antibody 50556
ARAGTGLFFLEY

SEQ ID NO: 101113 - protein, 11 aa, Homo sapiens
  light chain complementarity determining region 3 for antibody 50557
LQHDNFPLRYT

SEQ ID NO: 101114 - protein, 13 aa, Homo sapiens
  heavy chain complementarity determining region 3 for antibody 50557
ARVVAAVSRRLDP

SEQ ID NO: 101115 - protein, 9 aa, Homo sapiens
  light chain complementarity determining region 3 for antibody 50558
QQYSSFSET

SEQ ID NO: 101116 - protein, 18 aa, Homo sapiens
  heavy chain complementarity determining region 3 for antibody 50558
ARPSGRFHRSGYSGYFDL

SEQ ID NO: 101117 - protein, 9 aa, Homo sapiens
  light chain complementarity determining region 3 for antibody 50559
QQYNSNPWT

SEQ ID NO: 101118 - protein, 15 aa, Homo sapiens
  heavy chain complementarity determining region 3 for antibody 50559
AKGRIDYGSGYYFDD

SEQ ID NO: 101119 - protein, 9 aa, Homo sapiens
  light chain complementarity determining region 3 for antibody 50560
QQYGSSPWT

SEQ ID NO: 101120 - protein, 16 aa, Homo sapiens
  heavy chain complementarity determining region 3 for antibody 50560
ARMEWWDLQPLGGFDS

SEQ ID NO: 101121 - protein, 11 aa, Homo sapiens
  light chain complementarity determining region 3 for antibody 50561
QQYDNIPPLLT

SEQ ID NO: 101122 - protein, 14 aa, Homo sapiens
  heavy chain complementarity determining region 3 for antibody 50561
ARSRVDYYYYGMDV

SEQ ID NO: 101123 - protein, 10 aa, Homo sapiens
  light chain complementarity determining region 3 for antibody 50562
QQSYTYPFYT

SEQ ID NO: 101124 - protein, 18 aa, Homo sapiens
  heavy chain complementarity determining region 3 for antibody 50562
AREYDFWNNSHYFRYFDF

SEQ ID NO: 101125 - protein, 9 aa, Homo sapiens
  light chain complementarity determining region 3 for antibody 50563
QQSYSTLLT

SEQ ID NO: 101126 - protein, 15 aa, Homo sapiens
  heavy chain complementarity determining region 3 for antibody 50563
ARDRLGHSSSWYFGY

SEQ ID NO: 101127 - protein, 11 aa, Homo sapiens
  light chain complementarity determining region 3 for antibody 50564
QQLNNYPPQWT

SEQ ID NO: 101128 - protein, 23 aa, Homo sapiens
  heavy chain complementarity determining region 3 for antibody 50564
ARAPAIVGTFSPPYYYHYNGMDV

SEQ ID NO: 101129 - protein, 9 aa, Homo sapiens
  light chain complementarity determining region 3 for antibody 50565
QQGHSPPLT

SEQ ID NO: 101130 - protein, 21 aa, Homo sapiens
  heavy chain complementarity determining region 3 for antibody 50565
ARDKKIHDYGGRFWYYSGLDV

SEQ ID NO: 101131 - protein, 9 aa, Homo sapiens
  light chain complementarity determining region 3 for antibody 50566
QQFGTSTLT

SEQ ID NO: 101132 - protein, 16 aa, Homo sapiens
  heavy chain complementarity determining region 3 for antibody 50566
AKERSEAAPGFNAFDI

SEQ ID NO: 101133 - protein, 8 aa, Homo sapiens
  light chain complementarity determining region 3 for antibody 50567
QKYNSAPT

SEQ ID NO: 101134 - protein, 13 aa, Homo sapiens
  heavy chain complementarity determining region 3 for antibody 50567
ATSLSGTYPYFDY

SEQ ID NO: 101135 - protein, 10 aa, Homo sapiens
  light chain complementarity determining region 3 for antibody 50568
PQCDNLPQLI

SEQ ID NO: 101136 - protein, 13 aa, Homo sapiens
  heavy chain complementarity determining region 3 for antibody 50568
SRGTVGTAYYFDY

SEQ ID NO: 101137 - protein, 9 aa, Homo sapiens
  light chain complementarity determining region 3 for antibody 50569
LQDYSYPAT

SEQ ID NO: 101138 - protein, 13 aa, Homo sapiens
  heavy chain complementarity determining region 3 for antibody 50569
ARDVALSYYTPDY

SEQ ID NO: 101139 - protein, 9 aa, Homo sapiens
  light chain complementarity determining region 3 for antibody 50570
LQDYNYPWT

SEQ ID NO: 101140 - protein, 13 aa, Homo sapiens
  heavy chain complementarity determining region 3 for antibody 50570
ARLGPLSGWLFDY

SEQ ID NO: 101141 - protein, 10 aa, Homo sapiens
  light chain complementarity determining region 3 for antibody 50571
HHSGSSWGYT

SEQ ID NO: 101142 - protein, 14 aa, Homo sapiens
  heavy chain complementarity determining region 3 for antibody 50571
TTEGLLNYFSAFDN

SEQ ID NO: 101143 - protein, 9 aa, Homo sapiens
  light chain complementarity determining region 3 for antibody 50572
QQYYSYPRT

SEQ ID NO: 101144 - protein, 15 aa, Homo sapiens
  heavy chain complementarity determining region 3 for antibody 50572
ARDHYSNYYYYGMDV

SEQ ID NO: 101145 - protein, 8 aa, Homo sapiens
  light chain complementarity determining region 3 for antibody 50573
QQYSSIPL

SEQ ID NO: 101146 - protein, 10 aa, Homo sapiens
  heavy chain complementarity determining region 3 for antibody 50573
VRDHGYHFDY

SEQ ID NO: 101147 - protein, 9 aa, Homo sapiens
  light chain complementarity determining region 3 for antibody 50574
QQYNSFVFT

SEQ ID NO: 101148 - protein, 23 aa, Homo sapiens
  heavy chain complementarity determining region 3 for antibody 50574
ASHYYDYVSGSYHYNLRRHAFDI

SEQ ID NO: 101149 - protein, 9 aa, Homo sapiens
  light chain complementarity determining region 3 for antibody 50575
QQYGSSPLT

SEQ ID NO: 101150 - protein, 17 aa, Homo sapiens
  heavy chain complementarity determining region 3 for antibody 50575
ARYTSGSYYNRPKVFDY

SEQ ID NO: 101151 - protein, 9 aa, Homo sapiens
  light chain complementarity determining region 3 for antibody 50576
QQYGRSPWT

SEQ ID NO: 101152 - protein, 17 aa, Homo sapiens
  heavy chain complementarity determining region 3 for antibody 50576
ARSSMVTSGGVIGIFGY

SEQ ID NO: 101153 - protein, 9 aa, Homo sapiens
  light chain complementarity determining region 3 for antibody 50577
QQSYSSPDT

SEQ ID NO: 101154 - protein, 15 aa, Homo sapiens
  heavy chain complementarity determining region 3 for antibody 50577
ARTYYHSSGHRAFDI

SEQ ID NO: 101155 - protein, 9 aa, Homo sapiens
  light chain complementarity determining region 3 for antibody 50578
QQSFSTLRT

SEQ ID NO: 101156 - protein, 13 aa, Homo sapiens
  heavy chain complementarity determining region 3 for antibody 50578
ARDSGSYSSSFDY

SEQ ID NO: 101157 - protein, 8 aa, Homo sapiens
  light chain complementarity determining region 3 for antibody 50579
QQRFNWVT

SEQ ID NO: 101158 - protein, 13 aa, Homo sapiens
  heavy chain complementarity determining region 3 for antibody 50579
AKLLYGAHSEFDY

SEQ ID NO: 101159 - protein, 9 aa, Homo sapiens
  light chain complementarity determining region 3 for antibody 50580
QQLASYPIT

SEQ ID NO: 101160 - protein, 13 aa, Homo sapiens
  heavy chain complementarity determining region 3 for antibody 50580
TSRSLDAGAPLDF

SEQ ID NO: 101161 - protein, 9 aa, Homo sapiens
  light chain complementarity determining region 3 for antibody 50581
QQHNSFPFT

SEQ ID NO: 101162 - protein, 10 aa, Homo sapiens
  heavy chain complementarity determining region 3 for antibody 50581
GRESSGVLHY

SEQ ID NO: 101163 - protein, 9 aa, Homo sapiens
  light chain complementarity determining region 3 for antibody 50582
QQCDSFPLT

SEQ ID NO: 101164 - protein, 13 aa, Homo sapiens
  heavy chain complementarity determining region 3 for antibody 50582
AGHRGVADDAFDL

SEQ ID NO: 101165 - protein, 10 aa, Homo sapiens
  light chain complementarity determining region 3 for antibody 50583
QQYNSYSHFT

SEQ ID NO: 101166 - protein, 9 aa, Homo sapiens
  heavy chain complementarity determining region 3 for antibody 50583
ARAGDKGDY

SEQ ID NO: 101167 - protein, 10 aa, Homo sapiens
  light chain complementarity determining region 3 for antibody 50584
QQYNDWPPYT

SEQ ID NO: 101168 - protein, 17 aa, Homo sapiens
  heavy chain complementarity determining region 3 for antibody 50584
ARYYYDRSGYFYDFFDY

SEQ ID NO: 101169 - protein, 11 aa, Homo sapiens
  light chain complementarity determining region 3 for antibody 50585
QQYGSSPPGYT

SEQ ID NO: 101170 - protein, 25 aa, Homo sapiens
  heavy chain complementarity determining region 3 for antibody 50585
TKDKAREMATLNWGPKSYYYYGMDV

SEQ ID NO: 101171 - protein, 9 aa, Homo sapiens
  light chain complementarity determining region 3 for antibody 50586
QQYDNLPRT

SEQ ID NO: 101172 - protein, 15 aa, Homo sapiens
  heavy chain complementarity determining region 3 for antibody 50586
TSLPTTWGGFETQNL

SEQ ID NO: 101173 - protein, 9 aa, Homo sapiens
  light chain complementarity determining region 3 for antibody 50587
QQYDNLPRT

SEQ ID NO: 101174 - protein, 15 aa, Homo sapiens
  heavy chain complementarity determining region 3 for antibody 50587
ASLPTTWGGFESQNL

SEQ ID NO: 101175 - protein, 9 aa, Homo sapiens
  light chain complementarity determining region 3 for antibody 50588
QQTYRIPWT

SEQ ID NO: 101176 - protein, 12 aa, Homo sapiens
  heavy chain complementarity determining region 3 for antibody 50588
ARHLELGDSFDI

SEQ ID NO: 101177 - protein, 9 aa, Homo sapiens
  light chain complementarity determining region 3 for antibody 50589
QQSYSTRIT

SEQ ID NO: 101178 - protein, 11 aa, Homo sapiens
  heavy chain complementarity determining region 3 for antibody 50589
VSYSSWNSEDY

SEQ ID NO: 101179 - protein, 9 aa, Homo sapiens
  light chain complementarity determining region 3 for antibody 50590
QQSYSTPWT

SEQ ID NO: 101180 - protein, 13 aa, Homo sapiens
  heavy chain complementarity determining region 3 for antibody 50590
ARGHDPDSSYFDY

SEQ ID NO: 101181 - protein, 9 aa, Homo sapiens
  light chain complementarity determining region 3 for antibody 50591
QQSYSTPRT

SEQ ID NO: 101182 - protein, 6 aa, Homo sapiens
  heavy chain complementarity determining region 3 for antibody 50591
GWLPHY

SEQ ID NO: 101183 - protein, 9 aa, Homo sapiens
  light chain complementarity determining region 3 for antibody 50592
QQSYSTPDT

SEQ ID NO: 101184 - protein, 14 aa, Homo sapiens
  heavy chain complementarity determining region 3 for antibody 50592
AHVAYGPWYNYFDP

SEQ ID NO: 101185 - protein, 9 aa, Homo sapiens
  light chain complementarity determining region 3 for antibody 50593
QQSYSPPPT

SEQ ID NO: 101186 - protein, 17 aa, Homo sapiens
  heavy chain complementarity determining region 3 for antibody 50593
AKDFDGSGSYSLFASDI

SEQ ID NO: 101187 - protein, 8 aa, Homo sapiens
  light chain complementarity determining region 3 for antibody 50594
QQSYSIPT

SEQ ID NO: 101188 - protein, 16 aa, Homo sapiens
  heavy chain complementarity determining region 3 for antibody 50594
ARGIRGLSYGDYTVDY

SEQ ID NO: 101189 - protein, 9 aa, Homo sapiens
  light chain complementarity determining region 3 for antibody 50595
QQSLFTPYT

SEQ ID NO: 101190 - protein, 21 aa, Homo sapiens
  heavy chain complementarity determining region 3 for antibody 50595
AKAGEFDSNGLYSENDDAFYN

SEQ ID NO: 101191 - protein, 10 aa, Homo sapiens
  light chain complementarity determining region 3 for antibody 50596
QQGYSTLPYT

SEQ ID NO: 101192 - protein, 16 aa, Homo sapiens
  heavy chain complementarity determining region 3 for antibody 50596
AKDRQYDILTGYLFDP

SEQ ID NO: 101193 - protein, 10 aa, Homo sapiens
  light chain complementarity determining region 3 for antibody 50597
QNYNSAPTWT

SEQ ID NO: 101194 - protein, 17 aa, Homo sapiens
  heavy chain complementarity determining region 3 for antibody 50597
ASHPMVRESAYNNGMDV

SEQ ID NO: 101195 - protein, 9 aa, Homo sapiens
  light chain complementarity determining region 3 for antibody 50598
QHYGSANRT

SEQ ID NO: 101196 - protein, 13 aa, Homo sapiens
  heavy chain complementarity determining region 3 for antibody 50598
ARGMTRGGSFLGF

SEQ ID NO: 101197 - protein, 9 aa, Homo sapiens
  light chain complementarity determining region 3 for antibody 50599
MQGTHWPIT

SEQ ID NO: 101198 - protein, 19 aa, Homo sapiens
  heavy chain complementarity determining region 3 for antibody 50599
ARDYPSKTVTTVYYYGMDV

SEQ ID NO: 101199 - protein, 9 aa, Homo sapiens
  light chain complementarity determining region 3 for antibody 50600
LQDYNYSLT

SEQ ID NO: 101200 - protein, 13 aa, Homo sapiens
  heavy chain complementarity determining region 3 for antibody 50600
ARLLGGQKGRLDL

SEQ ID NO: 101201 - protein, 9 aa, Homo sapiens
  light chain complementarity determining region 3 for antibody 50601
LQDYNYPRT

SEQ ID NO: 101202 - protein, 22 aa, Homo sapiens
  heavy chain complementarity determining region 3 for antibody 50601
ARDSSPTYYDSSGSHYFDAFDI

SEQ ID NO: 101203 - protein, 9 aa, Homo sapiens
  light chain complementarity determining region 3 for antibody 50602
QQYNSYPYT

SEQ ID NO: 101204 - protein, 13 aa, Homo sapiens
  heavy chain complementarity determining region 3 for antibody 50602
SKPPGRKYYNMDV

SEQ ID NO: 101205 - protein, 9 aa, Homo sapiens
  light chain complementarity determining region 3 for antibody 50603
QQYKTYSWT

SEQ ID NO: 101206 - protein, 19 aa, Homo sapiens
  heavy chain complementarity determining region 3 for antibody 50603
ARGGGYGYLSHYYNYGMDV

SEQ ID NO: 101207 - protein, 9 aa, Homo sapiens
  light chain complementarity determining region 3 for antibody 50604
QQYDNLPRT

SEQ ID NO: 101208 - protein, 15 aa, Homo sapiens
  heavy chain complementarity determining region 3 for antibody 50604
ASRPTTWGGFETQNL

SEQ ID NO: 101209 - protein, 9 aa, Homo sapiens
  light chain complementarity determining region 3 for antibody 50605
QQYDNLPRT

SEQ ID NO: 101210 - protein, 15 aa, Homo sapiens
  heavy chain complementarity determining region 3 for antibody 50605
ASPPTTWGGFETQNL

SEQ ID NO: 101211 - protein, 9 aa, Homo sapiens
  light chain complementarity determining region 3 for antibody 50606
QQYDNLPRT

SEQ ID NO: 101212 - protein, 15 aa, Homo sapiens
  heavy chain complementarity determining region 3 for antibody 50606
ASLPSTWGGFETQNL

SEQ ID NO: 101213 - protein, 9 aa, Homo sapiens
  light chain complementarity determining region 3 for antibody 50607
QQYDKYPWT

SEQ ID NO: 101214 - protein, 14 aa, Homo sapiens
  heavy chain complementarity determining region 3 for antibody 50607
VREAGSGWYRTSDY

SEQ ID NO: 101215 - protein, 11 aa, Homo sapiens
  light chain complementarity determining region 3 for antibody 50608
QQVKDYPRELT

SEQ ID NO: 101216 - protein, 14 aa, Homo sapiens
  heavy chain complementarity determining region 3 for antibody 50608
ARDLLDESPGAFDS

SEQ ID NO: 101217 - protein, 9 aa, Homo sapiens
  light chain complementarity determining region 3 for antibody 50609
QQSYSTRRT

SEQ ID NO: 101218 - protein, 14 aa, Homo sapiens
  heavy chain complementarity determining region 3 for antibody 50609
ARPHRTIFGGGFDP

SEQ ID NO: 101219 - protein, 9 aa, Homo sapiens
  light chain complementarity determining region 3 for antibody 50610
QQSYSTPWT

SEQ ID NO: 101220 - protein, 20 aa, Homo sapiens
  heavy chain complementarity determining region 3 for antibody 50610
ATVGIGGFGSGSYFPIPMDV

SEQ ID NO: 101221 - protein, 9 aa, Homo sapiens
  light chain complementarity determining region 3 for antibody 50611
QQSYSTPPT

SEQ ID NO: 101222 - protein, 16 aa, Homo sapiens
  heavy chain complementarity determining region 3 for antibody 50611
ARKSYYDSSGLGPFDY

SEQ ID NO: 101223 - protein, 10 aa, Homo sapiens
  light chain complementarity determining region 3 for antibody 50612
QQSYSTLTWT

SEQ ID NO: 101224 - protein, 22 aa, Homo sapiens
  heavy chain complementarity determining region 3 for antibody 50612
ARHRFIGYCSSTSCYGVNWFDP

SEQ ID NO: 101225 - protein, 9 aa, Homo sapiens
  light chain complementarity determining region 3 for antibody 50613
QQSYNTPRT

SEQ ID NO: 101226 - protein, 18 aa, Homo sapiens
  heavy chain complementarity determining region 3 for antibody 50613
AREAPHYYDILTGYYVDS

SEQ ID NO: 101227 - protein, 9 aa, Homo sapiens
  light chain complementarity determining region 3 for antibody 50614
QQRSNWPLT

SEQ ID NO: 101228 - protein, 19 aa, Homo sapiens
  heavy chain complementarity determining region 3 for antibody 50614
ARDNPKTDLNNYYYYGMDV

SEQ ID NO: 101229 - protein, 9 aa, Homo sapiens
  light chain complementarity determining region 3 for antibody 50615
QQHYAIPWT

SEQ ID NO: 101230 - protein, 14 aa, Homo sapiens
  heavy chain complementarity determining region 3 for antibody 50615
ARLSDVDGRWDFGY

SEQ ID NO: 101231 - protein, 9 aa, Homo sapiens
  light chain complementarity determining region 3 for antibody 50616
QDLNTYPLT

SEQ ID NO: 101232 - protein, 14 aa, Homo sapiens
  heavy chain complementarity determining region 3 for antibody 50616
SRCSEKYVSWGFDI

SEQ ID NO: 101233 - protein, 9 aa, Homo sapiens
  light chain complementarity determining region 3 for antibody 50617
LQDHNYPWT

SEQ ID NO: 101234 - protein, 16 aa, Homo sapiens
  heavy chain complementarity determining region 3 for antibody 50617
ARTPAYYSRSSYGIDV

SEQ ID NO: 101235 - protein, 9 aa, Homo sapiens
  light chain complementarity determining region 3 for antibody 50618
FQGVYWPLT

SEQ ID NO: 101236 - protein, 8 aa, Homo sapiens
  heavy chain complementarity determining region 3 for antibody 50618
VEEQQLIH

SEQ ID NO: 101237 - protein, 10 aa, Homo sapiens
  light chain complementarity determining region 3 for antibody 50619
QRYDNLPTYT

SEQ ID NO: 101238 - protein, 11 aa, Homo sapiens
  heavy chain complementarity determining region 3 for antibody 50619
ATDPSLGYFQF

SEQ ID NO: 101239 - protein, 9 aa, Homo sapiens
  light chain complementarity determining region 3 for antibody 50620
QQYYTKPWT

SEQ ID NO: 101240 - protein, 14 aa, Homo sapiens
  heavy chain complementarity determining region 3 for antibody 50620
ARTHSSGWADAFDI

SEQ ID NO: 101241 - protein, 9 aa, Homo sapiens
  light chain complementarity determining region 3 for antibody 50621
QQYNSYSRT

SEQ ID NO: 101242 - protein, 11 aa, Homo sapiens
  heavy chain complementarity determining region 3 for antibody 50621
AGRDYYYGLDV

SEQ ID NO: 101243 - protein, 9 aa, Homo sapiens
  light chain complementarity determining region 3 for antibody 50622
QQYNSDSKT

SEQ ID NO: 101244 - protein, 13 aa, Homo sapiens
  heavy chain complementarity determining region 3 for antibody 50622
ARLESSAWTHFDY

SEQ ID NO: 101245 - protein, 9 aa, Homo sapiens
  light chain complementarity determining region 3 for antibody 50623
QQYGSSPPT

SEQ ID NO: 101246 - protein, 11 aa, Homo sapiens
  heavy chain complementarity determining region 3 for antibody 50623
AAKTGSGWYDY

SEQ ID NO: 101247 - protein, 10 aa, Homo sapiens
  light chain complementarity determining region 3 for antibody 50624
QQYGSSLLIT

SEQ ID NO: 101248 - protein, 15 aa, Homo sapiens
  heavy chain complementarity determining region 3 for antibody 50624
AHSALYSSGWYRLDY

SEQ ID NO: 101249 - protein, 9 aa, Homo sapiens
  light chain complementarity determining region 3 for antibody 50625
QQYASYSST

SEQ ID NO: 101250 - protein, 24 aa, Homo sapiens
  heavy chain complementarity determining region 3 for antibody 50625
ARSIATDYYDKGGYYSRDSRQIDH

SEQ ID NO: 101251 - protein, 9 aa, Homo sapiens
  light chain complementarity determining region 3 for antibody 50626
QQTYTPPYI

SEQ ID NO: 101252 - protein, 15 aa, Homo sapiens
  heavy chain complementarity determining region 3 for antibody 50626
GREQGSMVPGDVVDF

SEQ ID NO: 101253 - protein, 9 aa, Homo sapiens
  light chain complementarity determining region 3 for antibody 50627
QQSYSTPWT

SEQ ID NO: 101254 - protein, 18 aa, Homo sapiens
  heavy chain complementarity determining region 3 for antibody 50627
ARLGPYAGSYYGGHAFDI

SEQ ID NO: 101255 - protein, 9 aa, Homo sapiens
  light chain complementarity determining region 3 for antibody 50628
QQSYNFPRT

SEQ ID NO: 101256 - protein, 18 aa, Homo sapiens
  heavy chain complementarity determining region 3 for antibody 50628
ARDRGTSVDGEWIAAFDI

SEQ ID NO: 101257 - protein, 9 aa, Homo sapiens
  light chain complementarity determining region 3 for antibody 50629
QQSNSYSPT

SEQ ID NO: 101258 - protein, 15 aa, Homo sapiens
  heavy chain complementarity determining region 3 for antibody 50629
ARESGGDGYRDAFDI

SEQ ID NO: 101259 - protein, 9 aa, Homo sapiens
  light chain complementarity determining region 3 for antibody 50630
QQLNSYPRT

SEQ ID NO: 101260 - protein, 16 aa, Homo sapiens
  heavy chain complementarity determining region 3 for antibody 50630
ARVAGLTTHGGWHFDL

SEQ ID NO: 101261 - protein, 9 aa, Homo sapiens
  light chain complementarity determining region 3 for antibody 50631
QKYNSALGT

SEQ ID NO: 101262 - protein, 9 aa, Homo sapiens
  heavy chain complementarity determining region 3 for antibody 50631
ARDDSDPGI

SEQ ID NO: 101263 - protein, 9 aa, Homo sapiens
  light chain complementarity determining region 3 for antibody 50632
MQALQTPYT

SEQ ID NO: 101264 - protein, 12 aa, Homo sapiens
  heavy chain complementarity determining region 3 for antibody 50632
ARDHISGWSLSS

SEQ ID NO: 101265 - protein, 8 aa, Homo sapiens
  light chain complementarity determining region 3 for antibody 50633
HYYGSSPT

SEQ ID NO: 101266 - protein, 15 aa, Homo sapiens
  heavy chain complementarity determining region 3 for antibody 50633
ASVRIQLWLHDAFDI

SEQ ID NO: 101267 - protein, 9 aa, Homo sapiens
  light chain complementarity determining region 3 for antibody 50634
QQYNTYPLT

SEQ ID NO: 101268 - protein, 12 aa, Homo sapiens
  heavy chain complementarity determining region 3 for antibody 50634
ARVAQVEYYLDF

SEQ ID NO: 101269 - protein, 9 aa, Homo sapiens
  light chain complementarity determining region 3 for antibody 50635
QQYNSYSTT

SEQ ID NO: 101270 - protein, 18 aa, Homo sapiens
  heavy chain complementarity determining region 3 for antibody 50635
ARDRLSFVTVAGTEAFDI

SEQ ID NO: 101271 - protein, 10 aa, Homo sapiens
  light chain complementarity determining region 3 for antibody 50636
QQYNSYPPGT

SEQ ID NO: 101272 - protein, 15 aa, Homo sapiens
  heavy chain complementarity determining region 3 for antibody 50636
ASQGDRGYSYGYIDY

SEQ ID NO: 101273 - protein, 9 aa, Homo sapiens
  light chain complementarity determining region 3 for antibody 50637
QQYKSHFPT

SEQ ID NO: 101274 - protein, 13 aa, Homo sapiens
  heavy chain complementarity determining region 3 for antibody 50637
VRGDWKQWLVFFY

SEQ ID NO: 101275 - protein, 9 aa, Homo sapiens
  light chain complementarity determining region 3 for antibody 50638
QQYDNLPRT

SEQ ID NO: 101276 - protein, 15 aa, Homo sapiens
  heavy chain complementarity determining region 3 for antibody 50638
ASLPTTWGGFENQNL

SEQ ID NO: 101277 - protein, 10 aa, Homo sapiens
  light chain complementarity determining region 3 for antibody 50639
QQSYRTLPIT

SEQ ID NO: 101278 - protein, 14 aa, Homo sapiens
  heavy chain complementarity determining region 3 for antibody 50639
ARETQTMGGPIIES

SEQ ID NO: 101279 - protein, 9 aa, Homo sapiens
  light chain complementarity determining region 3 for antibody 50640
QQSYRAPYT

SEQ ID NO: 101280 - protein, 16 aa, Homo sapiens
  heavy chain complementarity determining region 3 for antibody 50640
AKVAIPLGRSSAVFDF

SEQ ID NO: 101281 - protein, 9 aa, Homo sapiens
  light chain complementarity determining region 3 for antibody 50641
QQSHSYPPT

SEQ ID NO: 101282 - protein, 16 aa, Homo sapiens
  heavy chain complementarity determining region 3 for antibody 50641
ARDLQLYSTTSGVFGT

SEQ ID NO: 101283 - protein, 9 aa, Homo sapiens
  light chain complementarity determining region 3 for antibody 50642
QLYSRYPYT

SEQ ID NO: 101284 - protein, 15 aa, Homo sapiens
  heavy chain complementarity determining region 3 for antibody 50642
ASGKGDGTGWPFFDF

SEQ ID NO: 101285 - protein, 9 aa, Homo sapiens
  light chain complementarity determining region 3 for antibody 50643
LQHDSYPFT

SEQ ID NO: 101286 - protein, 12 aa, Homo sapiens
  heavy chain complementarity determining region 3 for antibody 50643
TTDFFTLNWLDP

SEQ ID NO: 101287 - protein, 9 aa, Homo sapiens
  light chain complementarity determining region 3 for antibody 50644
HQYNSYPLT

SEQ ID NO: 101288 - protein, 22 aa, Homo sapiens
  heavy chain complementarity determining region 3 for antibody 50644
ASGYRDRDSGSYGDNFPEYFQH

SEQ ID NO: 101289 - protein, 9 aa, Homo sapiens
  light chain complementarity determining region 3 for antibody 50645
QQYSSYSWT

SEQ ID NO: 101290 - protein, 15 aa, Homo sapiens
  heavy chain complementarity determining region 3 for antibody 50645
ARCGGTKHLYYGMDV

SEQ ID NO: 101291 - protein, 10 aa, Homo sapiens
  light chain complementarity determining region 3 for antibody 50646
QQYNTYSQLT

SEQ ID NO: 101292 - protein, 11 aa, Homo sapiens
  heavy chain complementarity determining region 3 for antibody 50646
ARGGQHTRFDF

SEQ ID NO: 101293 - protein, 9 aa, Homo sapiens
  light chain complementarity determining region 3 for antibody 50647
QQYNNLPLT

SEQ ID NO: 101294 - protein, 19 aa, Homo sapiens
  heavy chain complementarity determining region 3 for antibody 50647
ARGGGYGSGRGFYYYGMDV

SEQ ID NO: 101295 - protein, 8 aa, Homo sapiens
  light chain complementarity determining region 3 for antibody 50648
QQYKSPWT

SEQ ID NO: 101296 - protein, 16 aa, Homo sapiens
  heavy chain complementarity determining region 3 for antibody 50648
AREGSSGWYRLAAFDY

SEQ ID NO: 101297 - protein, 9 aa, Homo sapiens
  light chain complementarity determining region 3 for antibody 50649
QQYDNPPRT

SEQ ID NO: 101298 - protein, 15 aa, Homo sapiens
  heavy chain complementarity determining region 3 for antibody 50649
ASLPTTWGGFETQNL

SEQ ID NO: 101299 - protein, 9 aa, Homo sapiens
  light chain complementarity determining region 3 for antibody 50650
QQYDNLPRT

SEQ ID NO: 101300 - protein, 15 aa, Homo sapiens
  heavy chain complementarity determining region 3 for antibody 50650
ASLPTTWGGFKTQNL

SEQ ID NO: 101301 - protein, 10 aa, Homo sapiens
  light chain complementarity determining region 3 for antibody 50651
QQYDGDTMYT

SEQ ID NO: 101302 - protein, 14 aa, Homo sapiens
  heavy chain complementarity determining region 3 for antibody 50651
ARGRRPMTRECFDF

SEQ ID NO: 101303 - protein, 9 aa, Homo sapiens
  light chain complementarity determining region 3 for antibody 50652
QQTYTALIT

SEQ ID NO: 101304 - protein, 21 aa, Homo sapiens
  heavy chain complementarity determining region 3 for antibody 50652
AREGCSGGSCNSDYFYYGMDV

SEQ ID NO: 101305 - protein, 9 aa, Homo sapiens
  light chain complementarity determining region 3 for antibody 50653
QQSYTYPYT

SEQ ID NO: 101306 - protein, 13 aa, Homo sapiens
  heavy chain complementarity determining region 3 for antibody 50653
TTERSAVAGGMDG

SEQ ID NO: 101307 - protein, 10 aa, Homo sapiens
  light chain complementarity determining region 3 for antibody 50654
QQSYSTPPLT

SEQ ID NO: 101308 - protein, 22 aa, Homo sapiens
  heavy chain complementarity determining region 3 for antibody 50654
ARTSLFVSLFGVILPGYWYFDL

SEQ ID NO: 101309 - protein, 9 aa, Homo sapiens
  light chain complementarity determining region 3 for antibody 50655
QQSYSTPFT

SEQ ID NO: 101310 - protein, 21 aa, Homo sapiens
  heavy chain complementarity determining region 3 for antibody 50655
ARDTTVTTRGWVEYYYYGMDV

SEQ ID NO: 101311 - protein, 9 aa, Homo sapiens
  light chain complementarity determining region 3 for antibody 50656
QQSYSTLWT

SEQ ID NO: 101312 - protein, 13 aa, Homo sapiens
  heavy chain complementarity determining region 3 for antibody 50656
ARAPSSGWYYNDY

SEQ ID NO: 101313 - protein, 9 aa, Homo sapiens
  light chain complementarity determining region 3 for antibody 50657
QQSSSTMYT

SEQ ID NO: 101314 - protein, 15 aa, Homo sapiens
  heavy chain complementarity determining region 3 for antibody 50657
TTDPRLLWFGEAMNY

SEQ ID NO: 101315 - protein, 10 aa, Homo sapiens
  light chain complementarity determining region 3 for antibody 50658
QQHDDLPPII

SEQ ID NO: 101316 - protein, 20 aa, Homo sapiens
  heavy chain complementarity determining region 3 for antibody 50658
ARDGGMIYNTGWYGSSYFDT

SEQ ID NO: 101317 - protein, 9 aa, Homo sapiens
  light chain complementarity determining region 3 for antibody 50659
QQAYSSPYT

SEQ ID NO: 101318 - protein, 14 aa, Homo sapiens
  heavy chain complementarity determining region 3 for antibody 50659
ARDPQRGKPDYFDY

SEQ ID NO: 101319 - protein, 11 aa, Homo sapiens
  light chain complementarity determining region 3 for antibody 50660
QLYGDSPPKYT

SEQ ID NO: 101320 - protein, 13 aa, Homo sapiens
  heavy chain complementarity determining region 3 for antibody 50660
ARDRGEYTYAKDY

SEQ ID NO: 101321 - protein, 9 aa, Homo sapiens
  light chain complementarity determining region 3 for antibody 50661
QLLNSFPRT

SEQ ID NO: 101322 - protein, 16 aa, Homo sapiens
  heavy chain complementarity determining region 3 for antibody 50661
VRVEGYDSWGYSRGDY

SEQ ID NO: 101323 - protein, 9 aa, Homo sapiens
  light chain complementarity determining region 3 for antibody 50662
QKYDGAPYT

SEQ ID NO: 101324 - protein, 14 aa, Homo sapiens
  heavy chain complementarity determining region 3 for antibody 50662
AKPQLTGHYGGFDR

SEQ ID NO: 101325 - protein, 9 aa, Homo sapiens
  light chain complementarity determining region 3 for antibody 50663
LQYYNLPLT

SEQ ID NO: 101326 - protein, 19 aa, Homo sapiens
  heavy chain complementarity determining region 3 for antibody 50663
TTSPVFYYDSSDYYAIGDY

SEQ ID NO: 101327 - protein, 9 aa, Homo sapiens
  light chain complementarity determining region 3 for antibody 50664
KQYDNLPLT

SEQ ID NO: 101328 - protein, 11 aa, Homo sapiens
  heavy chain complementarity determining region 3 for antibody 50664
ATFGGWSPSDY

SEQ ID NO: 101329 - protein, 9 aa, Homo sapiens
  light chain complementarity determining region 3 for antibody 50665
QQYYSSPFS

SEQ ID NO: 101330 - protein, 6 aa, Homo sapiens
  heavy chain complementarity determining region 3 for antibody 50665
AYGFDL

SEQ ID NO: 101331 - protein, 11 aa, Homo sapiens
  light chain complementarity determining region 3 for antibody 50666
QQYSNWPPSWT

SEQ ID NO: 101332 - protein, 16 aa, Homo sapiens
  heavy chain complementarity determining region 3 for antibody 50666
ATLLRHYDLMTGPLDY

SEQ ID NO: 101333 - protein, 9 aa, Homo sapiens
  light chain complementarity determining region 3 for antibody 50667
QQYNSYPFT

SEQ ID NO: 101334 - protein, 22 aa, Homo sapiens
  heavy chain complementarity determining region 3 for antibody 50667
ARDAQGITSGGVVVYYYYGMDV

SEQ ID NO: 101335 - protein, 10 aa, Homo sapiens
  light chain complementarity determining region 3 for antibody 50668
QQYGSSPPYT

SEQ ID NO: 101336 - protein, 13 aa, Homo sapiens
  heavy chain complementarity determining region 3 for antibody 50668
ARPQWPITPYFDF

SEQ ID NO: 101337 - protein, 9 aa, Homo sapiens
  light chain complementarity determining region 3 for antibody 50669
QQYGSSPIT

SEQ ID NO: 101338 - protein, 14 aa, Homo sapiens
  heavy chain complementarity determining region 3 for antibody 50669
AAGGTGGSDNWFDP

SEQ ID NO: 101339 - protein, 9 aa, Homo sapiens
  light chain complementarity determining region 3 for antibody 50670
QQYDDVPPT

SEQ ID NO: 101340 - protein, 13 aa, Homo sapiens
  heavy chain complementarity determining region 3 for antibody 50670
AAFYDGTGYKFDY

SEQ ID NO: 101341 - protein, 9 aa, Homo sapiens
  light chain complementarity determining region 3 for antibody 50671
QQSYSSPFT

SEQ ID NO: 101342 - protein, 9 aa, Homo sapiens
  heavy chain complementarity determining region 3 for antibody 50671
ARGDYYFDY

SEQ ID NO: 101343 - protein, 9 aa, Homo sapiens
  light chain complementarity determining region 3 for antibody 50672
QQSYSILRA

SEQ ID NO: 101344 - protein, 14 aa, Homo sapiens
  heavy chain complementarity determining region 3 for antibody 50672
AREVGFGEWETFDY

SEQ ID NO: 101345 - protein, 9 aa, Homo sapiens
  light chain complementarity determining region 3 for antibody 50673
QQSYSAPLT

SEQ ID NO: 101346 - protein, 13 aa, Homo sapiens
  heavy chain complementarity determining region 3 for antibody 50673
ARSLAVAGNWFDP

SEQ ID NO: 101347 - protein, 9 aa, Homo sapiens
  light chain complementarity determining region 3 for antibody 50674
QQSYNNPPT

SEQ ID NO: 101348 - protein, 10 aa, Homo sapiens
  heavy chain complementarity determining region 3 for antibody 50674
AHVTGEDFDY

SEQ ID NO: 101349 - protein, 9 aa, Homo sapiens
  light chain complementarity determining region 3 for antibody 50675
QQSYITPLT

SEQ ID NO: 101350 - protein, 16 aa, Homo sapiens
  heavy chain complementarity determining region 3 for antibody 50675
ARDKLSGSYYGSWFDP

SEQ ID NO: 101351 - protein, 9 aa, Homo sapiens
  light chain complementarity determining region 3 for antibody 50676
QQSNSFPWT

SEQ ID NO: 101352 - protein, 11 aa, Homo sapiens
  heavy chain complementarity determining region 3 for antibody 50676
AKAGHSNSFDS

SEQ ID NO: 101353 - protein, 10 aa, Homo sapiens
  light chain complementarity determining region 3 for antibody 50677
QQRSNWPPLT

SEQ ID NO: 101354 - protein, 17 aa, Homo sapiens
  heavy chain complementarity determining region 3 for antibody 50677
ARAPQQLVHRRGFYFDL

SEQ ID NO: 101355 - protein, 9 aa, Homo sapiens
  light chain complementarity determining region 3 for antibody 50678
QQPYISPYT

SEQ ID NO: 101356 - protein, 12 aa, Homo sapiens
  heavy chain complementarity determining region 3 for antibody 50678
AREGYFDRSLDY

SEQ ID NO: 101357 - protein, 9 aa, Homo sapiens
  light chain complementarity determining region 3 for antibody 50679
QQANSFPLT

SEQ ID NO: 101358 - protein, 14 aa, Homo sapiens
  heavy chain complementarity determining region 3 for antibody 50679
ARGGSRVASNWFDS

SEQ ID NO: 101359 - protein, 9 aa, Homo sapiens
  light chain complementarity determining region 3 for antibody 50680
MEGTHWPYT

SEQ ID NO: 101360 - protein, 12 aa, Homo sapiens
  heavy chain complementarity determining region 3 for antibody 50680
VREGDGYSYGDY

SEQ ID NO: 101361 - protein, 9 aa, Homo sapiens
  light chain complementarity determining region 3 for antibody 50681
LQHNSYPYT

SEQ ID NO: 101362 - protein, 18 aa, Homo sapiens
  heavy chain complementarity determining region 3 for antibody 50681
ARVFGGPYDTSSYYKSDY

SEQ ID NO: 101363 - protein, 9 aa, Homo sapiens
  light chain complementarity determining region 3 for antibody 50682
LQHHSYPLT

SEQ ID NO: 101364 - protein, 11 aa, Homo sapiens
  heavy chain complementarity determining region 3 for antibody 50682
ARMGGSYFTDY

SEQ ID NO: 101365 - protein, 9 aa, Homo sapiens
  light chain complementarity determining region 3 for antibody 50683
HQYQSYSPT

SEQ ID NO: 101366 - protein, 12 aa, Homo sapiens
  heavy chain complementarity determining region 3 for antibody 50683
ARGGGDTGYFDS

SEQ ID NO: 101367 - protein, 9 aa, Homo sapiens
  light chain complementarity determining region 3 for antibody 50684
HQYATAPLT

SEQ ID NO: 101368 - protein, 17 aa, Homo sapiens
  heavy chain complementarity determining region 3 for antibody 50684
ARHQMLTGSGWGRAFDI

SEQ ID NO: 101369 - protein, 9 aa, Homo sapiens
  light chain complementarity determining region 3 for antibody 50685
QQYYSYSWT

SEQ ID NO: 101370 - protein, 11 aa, Homo sapiens
  heavy chain complementarity determining region 3 for antibody 50685
ASKVGANTYGY

SEQ ID NO: 101371 - protein, 9 aa, Homo sapiens
  light chain complementarity determining region 3 for antibody 50686
QQYSGFSWA

SEQ ID NO: 101372 - protein, 19 aa, Homo sapiens
  heavy chain complementarity determining region 3 for antibody 50686
ARYSLRLYCGNVDCYHHDF

SEQ ID NO: 101373 - protein, 9 aa, Homo sapiens
  light chain complementarity determining region 3 for antibody 50687
QQYNSYPWT

SEQ ID NO: 101374 - protein, 11 aa, Homo sapiens
  heavy chain complementarity determining region 3 for antibody 50687
ASDASSKSLAY

SEQ ID NO: 101375 - protein, 9 aa, Homo sapiens
  light chain complementarity determining region 3 for antibody 50688
QQYNSNSET

SEQ ID NO: 101376 - protein, 5 aa, Homo sapiens
  heavy chain complementarity determining region 3 for antibody 50688
AVRWV

SEQ ID NO: 101377 - protein, 9 aa, Homo sapiens
  light chain complementarity determining region 3 for antibody 50689
QQYGTSPVT

SEQ ID NO: 101378 - protein, 11 aa, Homo sapiens
  heavy chain complementarity determining region 3 for antibody 50689
ARGYYFRPVGS

SEQ ID NO: 101379 - protein, 10 aa, Homo sapiens
  light chain complementarity determining region 3 for antibody 50690
QQYGSSPPLT

SEQ ID NO: 101380 - protein, 13 aa, Homo sapiens
  heavy chain complementarity determining region 3 for antibody 50690
ARVGSSWLYYFDY

SEQ ID NO: 101381 - protein, 9 aa, Homo sapiens
  light chain complementarity determining region 3 for antibody 50691
QQYDTFPLT

SEQ ID NO: 101382 - protein, 19 aa, Homo sapiens
  heavy chain complementarity determining region 3 for antibody 50691
ARGKYSSIRAGGYYYGMDV

SEQ ID NO: 101383 - protein, 10 aa, Homo sapiens
  light chain complementarity determining region 3 for antibody 50692
QQTYSTPPYT

SEQ ID NO: 101384 - protein, 10 aa, Homo sapiens
  heavy chain complementarity determining region 3 for antibody 50692
ARQGYSSFDY

SEQ ID NO: 101385 - protein, 9 aa, Homo sapiens
  light chain complementarity determining region 3 for antibody 50693
QQSYTTPRT

SEQ ID NO: 101386 - protein, 10 aa, Homo sapiens
  heavy chain complementarity determining region 3 for antibody 50693
TLGGGWLVDY

SEQ ID NO: 101387 - protein, 9 aa, Homo sapiens
  light chain complementarity determining region 3 for antibody 50694
QQSYSTRLT

SEQ ID NO: 101388 - protein, 15 aa, Homo sapiens
  heavy chain complementarity determining region 3 for antibody 50694
ARDIRFLEWLDAFDI

SEQ ID NO: 101389 - protein, 8 aa, Homo sapiens
  light chain complementarity determining region 3 for antibody 50695
QQSYSTPI

SEQ ID NO: 101390 - protein, 15 aa, Homo sapiens
  heavy chain complementarity determining region 3 for antibody 50695
ARGVEDYGDNEAFDI

SEQ ID NO: 101391 - protein, 11 aa, Homo sapiens
  light chain complementarity determining region 3 for antibody 50696
QQRSNWPPTWT

SEQ ID NO: 101392 - protein, 13 aa, Homo sapiens
  heavy chain complementarity determining region 3 for antibody 50696
ATFSRAPNYYFDN

SEQ ID NO: 101393 - protein, 9 aa, Homo sapiens
  light chain complementarity determining region 3 for antibody 50697
QQLNSYPRT

SEQ ID NO: 101394 - protein, 13 aa, Homo sapiens
  heavy chain complementarity determining region 3 for antibody 50697
ARALVDTDDTFDI

SEQ ID NO: 101395 - protein, 9 aa, Homo sapiens
  light chain complementarity determining region 3 for antibody 50698
QQLNSYPLT

SEQ ID NO: 101396 - protein, 12 aa, Homo sapiens
  heavy chain complementarity determining region 3 for antibody 50698
ARGIAVADYFDY

SEQ ID NO: 101397 - protein, 9 aa, Homo sapiens
  light chain complementarity determining region 3 for antibody 50699
QQLKSYPLT

SEQ ID NO: 101398 - protein, 17 aa, Homo sapiens
  heavy chain complementarity determining region 3 for antibody 50699
ARDQPSEWRSPNHQIDY

SEQ ID NO: 101399 - protein, 8 aa, Homo sapiens
  light chain complementarity determining region 3 for antibody 50700
QQFYSSRT

SEQ ID NO: 101400 - protein, 16 aa, Homo sapiens
  heavy chain complementarity determining region 3 for antibody 50700
ARSSTPGRMEGAPFDY

SEQ ID NO: 101401 - protein, 9 aa, Homo sapiens
  light chain complementarity determining region 3 for antibody 50701
QQCDNLPRT

SEQ ID NO: 101402 - protein, 15 aa, Homo sapiens
  heavy chain complementarity determining region 3 for antibody 50701
ASLPTTWGGFETQNL

SEQ ID NO: 101403 - protein, 9 aa, Homo sapiens
  light chain complementarity determining region 3 for antibody 50702
QQADSLPFT

SEQ ID NO: 101404 - protein, 16 aa, Homo sapiens
  heavy chain complementarity determining region 3 for antibody 50702
AHSPGADGSSWYYFDY

SEQ ID NO: 101405 - protein, 9 aa, Homo sapiens
  light chain complementarity determining region 3 for antibody 50703
LQYNSFPPT

SEQ ID NO: 101406 - protein, 15 aa, Homo sapiens
  heavy chain complementarity determining region 3 for antibody 50703
AKVWRGIQLWYENDY

SEQ ID NO: 101407 - protein, 9 aa, Homo sapiens
  light chain complementarity determining region 3 for antibody 50704
LQHNSYPRT

SEQ ID NO: 101408 - protein, 15 aa, Homo sapiens
  heavy chain complementarity determining region 3 for antibody 50704
ARVLPQWLVPGGFDP

SEQ ID NO: 101409 - protein, 9 aa, Homo sapiens
  light chain complementarity determining region 3 for antibody 50705
QQYYSYSWT

SEQ ID NO: 101410 - protein, 11 aa, Homo sapiens
  heavy chain complementarity determining region 3 for antibody 50705
AGKVGANPYGY

SEQ ID NO: 101411 - protein, 9 aa, Homo sapiens
  light chain complementarity determining region 3 for antibody 50706
QQYSSYSWT

SEQ ID NO: 101412 - protein, 15 aa, Homo sapiens
  heavy chain complementarity determining region 3 for antibody 50706
ARCGGTKHFYYGMDV

SEQ ID NO: 101413 - protein, 9 aa, Homo sapiens
  light chain complementarity determining region 3 for antibody 50707
QQYNAYPYT

SEQ ID NO: 101414 - protein, 19 aa, Homo sapiens
  heavy chain complementarity determining region 3 for antibody 50707
ARRVNYCDTTGCYPEYFNH

SEQ ID NO: 101415 - protein, 9 aa, Homo sapiens
  light chain complementarity determining region 3 for antibody 50708
QQYKSFFPT

SEQ ID NO: 101416 - protein, 13 aa, Homo sapiens
  heavy chain complementarity determining region 3 for antibody 50708
ARGSSSSSWLFDN

SEQ ID NO: 101417 - protein, 9 aa, Homo sapiens
  light chain complementarity determining region 3 for antibody 50709
QQYDTYPYT

SEQ ID NO: 101418 - protein, 9 aa, Homo sapiens
  heavy chain complementarity determining region 3 for antibody 50709
ARGPAARYY

SEQ ID NO: 101419 - protein, 9 aa, Homo sapiens
  light chain complementarity determining region 3 for antibody 50710
QQYDSYPYT

SEQ ID NO: 101420 - protein, 11 aa, Homo sapiens
  heavy chain complementarity determining region 3 for antibody 50710
ATNDYGDYARY

SEQ ID NO: 101421 - protein, 8 aa, Homo sapiens
  light chain complementarity determining region 3 for antibody 50711
QQYDNLPT

SEQ ID NO: 101422 - protein, 16 aa, Homo sapiens
  heavy chain complementarity determining region 3 for antibody 50711
ATTYYYESSGYTSFDY

SEQ ID NO: 101423 - protein, 9 aa, Homo sapiens
  light chain complementarity determining region 3 for antibody 50712
QQYDNLPLT

SEQ ID NO: 101424 - protein, 16 aa, Homo sapiens
  heavy chain complementarity determining region 3 for antibody 50712
ARPLSPAVAGTDEFDY

SEQ ID NO: 101425 - protein, 9 aa, Homo sapiens
  light chain complementarity determining region 3 for antibody 50713
QQYDNLPIT

SEQ ID NO: 101426 - protein, 15 aa, Homo sapiens
  heavy chain complementarity determining region 3 for antibody 50713
ARAHTNDGGKVAFDS

SEQ ID NO: 101427 - protein, 9 aa, Homo sapiens
  light chain complementarity determining region 3 for antibody 50714
QQYATSPLT

SEQ ID NO: 101428 - protein, 10 aa, Homo sapiens
  heavy chain complementarity determining region 3 for antibody 50714
TLGGGWLVDY

SEQ ID NO: 101429 - protein, 8 aa, Homo sapiens
  light chain complementarity determining region 3 for antibody 50715
QQTYSTPT

SEQ ID NO: 101430 - protein, 13 aa, Homo sapiens
  heavy chain complementarity determining region 3 for antibody 50715
ARVHHDSSNGFDI

SEQ ID NO: 101431 - protein, 9 aa, Homo sapiens
  light chain complementarity determining region 3 for antibody 50716
QQSYTTPYT

SEQ ID NO: 101432 - protein, 14 aa, Homo sapiens
  heavy chain complementarity determining region 3 for antibody 50716
ARQLISSWFDAFDI

SEQ ID NO: 101433 - protein, 9 aa, Homo sapiens
  light chain complementarity determining region 3 for antibody 50717
QQSYSTPYT

SEQ ID NO: 101434 - protein, 11 aa, Homo sapiens
  heavy chain complementarity determining region 3 for antibody 50717
ARGGFSYAIDY

SEQ ID NO: 101435 - protein, 9 aa, Homo sapiens
  light chain complementarity determining region 3 for antibody 50718
QQSYSTPWT

SEQ ID NO: 101436 - protein, 15 aa, Homo sapiens
  heavy chain complementarity determining region 3 for antibody 50718
ASGVGASGDHDAFDI

SEQ ID NO: 101437 - protein, 7 aa, Homo sapiens
  light chain complementarity determining region 3 for antibody 50719
QQLNSYS

SEQ ID NO: 101438 - protein, 14 aa, Homo sapiens
  heavy chain complementarity determining region 3 for antibody 50719
ARYSPRSVEAAYDY

SEQ ID NO: 101439 - protein, 11 aa, Homo sapiens
  light chain complementarity determining region 3 for antibody 50720
QQLNSDPPLYS

SEQ ID NO: 101440 - protein, 10 aa, Homo sapiens
  heavy chain complementarity determining region 3 for antibody 50720
ASLRDKGFDF

SEQ ID NO: 101441 - protein, 9 aa, Homo sapiens
  light chain complementarity determining region 3 for antibody 50721
QQHHAYPLT

SEQ ID NO: 101442 - protein, 15 aa, Homo sapiens
  heavy chain complementarity determining region 3 for antibody 50721
AHRREVTRGLWNFDQ

SEQ ID NO: 101443 - protein, 9 aa, Homo sapiens
  light chain complementarity determining region 3 for antibody 50722
QQGNSLPRT

SEQ ID NO: 101444 - protein, 18 aa, Homo sapiens
  heavy chain complementarity determining region 3 for antibody 50722
ARAAISGYSSGWSDAFDI

SEQ ID NO: 101445 - protein, 6 aa, Homo sapiens
  light chain complementarity determining region 3 for antibody 50723
QQFGET

SEQ ID NO: 101446 - protein, 12 aa, Homo sapiens
  heavy chain complementarity determining region 3 for antibody 50723
ARDHDSGWSLSS

SEQ ID NO: 101447 - protein, 10 aa, Homo sapiens
  light chain complementarity determining region 3 for antibody 50724
QQCYSTAPAT

SEQ ID NO: 101448 - protein, 17 aa, Homo sapiens
  heavy chain complementarity determining region 3 for antibody 50724
ARDSWYDHDNSGFHYDY

SEQ ID NO: 101449 - protein, 9 aa, Homo sapiens
  light chain complementarity determining region 3 for antibody 50725
QQANSFPWT

SEQ ID NO: 101450 - protein, 16 aa, Homo sapiens
  heavy chain complementarity determining region 3 for antibody 50725
CRDEAASASAVVDFDS

SEQ ID NO: 101451 - protein, 9 aa, Homo sapiens
  light chain complementarity determining region 3 for antibody 50726
QHYSRYPYT

SEQ ID NO: 101452 - protein, 15 aa, Homo sapiens
  heavy chain complementarity determining region 3 for antibody 50726
ASGEGDGTGRPFFDF

SEQ ID NO: 101453 - protein, 9 aa, Homo sapiens
  light chain complementarity determining region 3 for antibody 50727
QHYASWPLT

SEQ ID NO: 101454 - protein, 13 aa, Homo sapiens
  heavy chain complementarity determining region 3 for antibody 50727
AKEPVVGTSYLDF

SEQ ID NO: 101455 - protein, 8 aa, Homo sapiens
  light chain complementarity determining region 3 for antibody 50728
QHRSNWLT

SEQ ID NO: 101456 - protein, 15 aa, Homo sapiens
  heavy chain complementarity determining region 3 for antibody 50728
AKDITSGWYSGGFDY

SEQ ID NO: 101457 - protein, 9 aa, Homo sapiens
  light chain complementarity determining region 3 for antibody 50729
LQSYSTPWT

SEQ ID NO: 101458 - protein, 13 aa, Homo sapiens
  heavy chain complementarity determining region 3 for antibody 50729
AKIAVPGRGSLDY

SEQ ID NO: 101459 - protein, 8 aa, Homo sapiens
  light chain complementarity determining region 3 for antibody 50730
HHYGRFLS

SEQ ID NO: 101460 - protein, 14 aa, Homo sapiens
  heavy chain complementarity determining region 3 for antibody 50730
ARHGRSSAWSYFDN

SEQ ID NO: 101461 - protein, 9 aa, Homo sapiens
  light chain complementarity determining region 3 for antibody 50731
QQYRTYPPT

SEQ ID NO: 101462 - protein, 14 aa, Homo sapiens
  heavy chain complementarity determining region 3 for antibody 50731
ARLFIGLSADPIDY

SEQ ID NO: 101463 - protein, 8 aa, Homo sapiens
  light chain complementarity determining region 3 for antibody 50732
QQYNSPVT

SEQ ID NO: 101464 - protein, 16 aa, Homo sapiens
  heavy chain complementarity determining region 3 for antibody 50732
AKFCSGGSCYRWFFEL

SEQ ID NO: 101465 - protein, 8 aa, Homo sapiens
  light chain complementarity determining region 3 for antibody 50733
QQYDNLPT

SEQ ID NO: 101466 - protein, 13 aa, Homo sapiens
  heavy chain complementarity determining region 3 for antibody 50733
ARDTGMIRGQFDY

SEQ ID NO: 101467 - protein, 9 aa, Homo sapiens
  light chain complementarity determining region 3 for antibody 50734
QQYDNLPRT

SEQ ID NO: 101468 - protein, 15 aa, Homo sapiens
  heavy chain complementarity determining region 3 for antibody 50734
ASLPTTWGGFGTQNL

SEQ ID NO: 101469 - protein, 9 aa, Homo sapiens
  light chain complementarity determining region 3 for antibody 50735
QQSYSTPLT

SEQ ID NO: 101470 - protein, 13 aa, Homo sapiens
  heavy chain complementarity determining region 3 for antibody 50735
ARDLQQLVERSDY

SEQ ID NO: 101471 - protein, 11 aa, Homo sapiens
  light chain complementarity determining region 3 for antibody 50736
QQFNKWPRMYT

SEQ ID NO: 101472 - protein, 16 aa, Homo sapiens
  heavy chain complementarity determining region 3 for antibody 50736
ARVLTSYYYDSSGFEY

SEQ ID NO: 101473 - protein, 7 aa, Homo sapiens
  light chain complementarity determining region 3 for antibody 50737
LHRSRLT

SEQ ID NO: 101474 - protein, 8 aa, Homo sapiens
  heavy chain complementarity determining region 3 for antibody 50737
ARDDWIDY

SEQ ID NO: 101475 - protein, 9 aa, Homo sapiens
  light chain complementarity determining region 3 for antibody 50738
HQYYNSPLT

SEQ ID NO: 101476 - protein, 14 aa, Homo sapiens
  heavy chain complementarity determining region 3 for antibody 50738
ATGYCGGDCFLLHY

SEQ ID NO: 101477 - protein, 9 aa, Homo sapiens
  light chain complementarity determining region 3 for antibody 50739
QQYNSFSPT

SEQ ID NO: 101478 - protein, 12 aa, Homo sapiens
  heavy chain complementarity determining region 3 for antibody 50739
GRSDGDLSPIDS

SEQ ID NO: 101479 - protein, 8 aa, Homo sapiens
  light chain complementarity determining region 3 for antibody 50740
QQYHTYRT

SEQ ID NO: 101480 - protein, 18 aa, Homo sapiens
  heavy chain complementarity determining region 3 for antibody 50740
ARDSARYSSGSPYNGMDV

SEQ ID NO: 101481 - protein, 9 aa, Homo sapiens
  light chain complementarity determining region 3 for antibody 50741
QQYGSSPLT

SEQ ID NO: 101482 - protein, 19 aa, Homo sapiens
  heavy chain complementarity determining region 3 for antibody 50741
ARHRERVVWFGEPTGRFDP

SEQ ID NO: 101483 - protein, 9 aa, Homo sapiens
  light chain complementarity determining region 3 for antibody 50742
QQYGSAPAT

SEQ ID NO: 101484 - protein, 20 aa, Homo sapiens
  heavy chain complementarity determining region 3 for antibody 50742
ARPLTNWGAITGTPHDFYHI

SEQ ID NO: 101485 - protein, 10 aa, Homo sapiens
  light chain complementarity determining region 3 for antibody 50743
QQYDNLPSLT

SEQ ID NO: 101486 - protein, 11 aa, Homo sapiens
  heavy chain complementarity determining region 3 for antibody 50743
AASRSVVYAKY

SEQ ID NO: 101487 - protein, 9 aa, Homo sapiens
  light chain complementarity determining region 3 for antibody 50744
QQSYTTPRT

SEQ ID NO: 101488 - protein, 18 aa, Homo sapiens
  heavy chain complementarity determining region 3 for antibody 50744
AKDLHIEYYEFWSGSMDV

SEQ ID NO: 101489 - protein, 10 aa, Homo sapiens
  light chain complementarity determining region 3 for antibody 50745
QQSYSTLLWT

SEQ ID NO: 101490 - protein, 11 aa, Homo sapiens
  heavy chain complementarity determining region 3 for antibody 50745
ARQGSGWYFDY

SEQ ID NO: 101491 - protein, 9 aa, Homo sapiens
  light chain complementarity determining region 3 for antibody 50746
QQSHSTPIT

SEQ ID NO: 101492 - protein, 17 aa, Homo sapiens
  heavy chain complementarity determining region 3 for antibody 50746
ARGNYYDSSNGVNWFDP

SEQ ID NO: 101493 - protein, 11 aa, Homo sapiens
  light chain complementarity determining region 3 for antibody 50747
QQRNNWPPAYT

SEQ ID NO: 101494 - protein, 17 aa, Homo sapiens
  heavy chain complementarity determining region 3 for antibody 50747
ARTPSNSGNSYKDAFDI

SEQ ID NO: 101495 - protein, 11 aa, Homo sapiens
  light chain complementarity determining region 3 for antibody 50748
QQQYPSPPMYI

SEQ ID NO: 101496 - protein, 15 aa, Homo sapiens
  heavy chain complementarity determining region 3 for antibody 50748
TTLNYGDYISDAFDI

SEQ ID NO: 101497 - protein, 9 aa, Homo sapiens
  light chain complementarity determining region 3 for antibody 50749
QQNYRTPST

SEQ ID NO: 101498 - protein, 20 aa, Homo sapiens
  heavy chain complementarity determining region 3 for antibody 50749
ARDGELEYCSSTSCSKPFDY

SEQ ID NO: 101499 - protein, 9 aa, Homo sapiens
  light chain complementarity determining region 3 for antibody 50750
QQNDHLPQT

SEQ ID NO: 101500 - protein, 11 aa, Homo sapiens
  heavy chain complementarity determining region 3 for antibody 50750
AREIPLGYLDV

SEQ ID NO: 101501 - protein, 9 aa, Homo sapiens
  light chain complementarity determining region 3 for antibody 50751
QQLNSFPLT

SEQ ID NO: 101502 - protein, 15 aa, Homo sapiens
  heavy chain complementarity determining region 3 for antibody 50751
VRGGRCSGDRCYGDY

SEQ ID NO: 101503 - protein, 9 aa, Homo sapiens
  light chain complementarity determining region 3 for antibody 50752
QNYNTWPWT

SEQ ID NO: 101504 - protein, 12 aa, Homo sapiens
  heavy chain complementarity determining region 3 for antibody 50752
ARSMMIVPACDI

SEQ ID NO: 101505 - protein, 8 aa, Homo sapiens
  light chain complementarity determining region 3 for antibody 50753
QKYNSAPT

SEQ ID NO: 101506 - protein, 13 aa, Homo sapiens
  heavy chain complementarity determining region 3 for antibody 50753
ATALSGTYPYFDY

SEQ ID NO: 101507 - protein, 9 aa, Homo sapiens
  light chain complementarity determining region 3 for antibody 50754
QHYNSYSGT

SEQ ID NO: 101508 - protein, 18 aa, Homo sapiens
  heavy chain complementarity determining region 3 for antibody 50754
ARKGSFGRWLDSRPAFDI

SEQ ID NO: 101509 - protein, 9 aa, Homo sapiens
  light chain complementarity determining region 3 for antibody 50755
QHYNNYRTA

SEQ ID NO: 101510 - protein, 16 aa, Homo sapiens
  heavy chain complementarity determining region 3 for antibody 50755
ARVHPYSLPGYWYFDL

SEQ ID NO: 101511 - protein, 9 aa, Homo sapiens
  light chain complementarity determining region 3 for antibody 50756
QHYHSYPYT

SEQ ID NO: 101512 - protein, 6 aa, Homo sapiens
  heavy chain complementarity determining region 3 for antibody 50756
ASIADY

SEQ ID NO: 101513 - protein, 9 aa, Homo sapiens
  light chain complementarity determining region 3 for antibody 50757
LQHNSYPFT

SEQ ID NO: 101514 - protein, 15 aa, Homo sapiens
  heavy chain complementarity determining region 3 for antibody 50757
ATVYRLGGVSEGMDV

SEQ ID NO: 101515 - protein, 9 aa, Homo sapiens
  light chain complementarity determining region 3 for antibody 50758
QQYYSTPRT

SEQ ID NO: 101516 - protein, 27 aa, Homo sapiens
  heavy chain complementarity determining region 3 for antibody 50758
ARGRHASYYDYVWGSYRNWPQIDSLDY

SEQ ID NO: 101517 - protein, 8 aa, Homo sapiens
  light chain complementarity determining region 3 for antibody 50759
QQYNTYWT

SEQ ID NO: 101518 - protein, 11 aa, Homo sapiens
  heavy chain complementarity determining region 3 for antibody 50759
ARARPGAGSSD

SEQ ID NO: 101519 - protein, 8 aa, Homo sapiens
  light chain complementarity determining region 3 for antibody 50760
QQYNTYST

SEQ ID NO: 101520 - protein, 22 aa, Homo sapiens
  heavy chain complementarity determining region 3 for antibody 50760
ARGRPNIADVVTTIALNEPFDI

SEQ ID NO: 101521 - protein, 9 aa, Homo sapiens
  light chain complementarity determining region 3 for antibody 50761
QQYNSYPLT

SEQ ID NO: 101522 - protein, 11 aa, Homo sapiens
  heavy chain complementarity determining region 3 for antibody 50761
ARSGSYWYFDL

SEQ ID NO: 101523 - protein, 9 aa, Homo sapiens
  light chain complementarity determining region 3 for antibody 50762
QQYNSYPIT

SEQ ID NO: 101524 - protein, 9 aa, Homo sapiens
  heavy chain complementarity determining region 3 for antibody 50762
AKSVPGFDY

SEQ ID NO: 101525 - protein, 10 aa, Homo sapiens
  light chain complementarity determining region 3 for antibody 50763
QQYNNWRPLT

SEQ ID NO: 101526 - protein, 17 aa, Homo sapiens
  heavy chain complementarity determining region 3 for antibody 50763
ARGRPIFTLVRAVIIDS

SEQ ID NO: 101527 - protein, 9 aa, Homo sapiens
  light chain complementarity determining region 3 for antibody 50764
QQYNNLPLT

SEQ ID NO: 101528 - protein, 19 aa, Homo sapiens
  heavy chain complementarity determining region 3 for antibody 50764
ARGKYSSARAGGYYYGMDV

SEQ ID NO: 101529 - protein, 9 aa, Homo sapiens
  light chain complementarity determining region 3 for antibody 50765
QQYGTSRYT

SEQ ID NO: 101530 - protein, 16 aa, Homo sapiens
  heavy chain complementarity determining region 3 for antibody 50765
ARGLGGQLWLQGAFDI

SEQ ID NO: 101531 - protein, 10 aa, Homo sapiens
  light chain complementarity determining region 3 for antibody 50766
QQYGSSSPGT

SEQ ID NO: 101532 - protein, 23 aa, Homo sapiens
  heavy chain complementarity determining region 3 for antibody 50766
VRDSRKRHGIAAAALHYYYYMDV

SEQ ID NO: 101533 - protein, 10 aa, Homo sapiens
  light chain complementarity determining region 3 for antibody 50767
QQYGSSPRIT

SEQ ID NO: 101534 - protein, 16 aa, Homo sapiens
  heavy chain complementarity determining region 3 for antibody 50767
AREGSVLSNYYYGMDV

SEQ ID NO: 101535 - protein, 10 aa, Homo sapiens
  light chain complementarity determining region 3 for antibody 50768
QQYDDYSGGT

SEQ ID NO: 101536 - protein, 15 aa, Homo sapiens
  heavy chain complementarity determining region 3 for antibody 50768
ARDIGTNQYLDYFDY

SEQ ID NO: 101537 - protein, 9 aa, Homo sapiens
  light chain complementarity determining region 3 for antibody 50769
QQSYSTPWT

SEQ ID NO: 101538 - protein, 18 aa, Homo sapiens
  heavy chain complementarity determining region 3 for antibody 50769
ARETTGSSPLVPDDAFDV

SEQ ID NO: 101539 - protein, 9 aa, Homo sapiens
  light chain complementarity determining region 3 for antibody 50770
QQSYSTPRT

SEQ ID NO: 101540 - protein, 9 aa, Homo sapiens
  heavy chain complementarity determining region 3 for antibody 50770
ARDRGPVDY

SEQ ID NO: 101541 - protein, 9 aa, Homo sapiens
  light chain complementarity determining region 3 for antibody 50771
QQSYSTPPT

SEQ ID NO: 101542 - protein, 18 aa, Homo sapiens
  heavy chain complementarity determining region 3 for antibody 50771
ARGTTGYSSSWYLPGLGY

SEQ ID NO: 101543 - protein, 9 aa, Homo sapiens
  light chain complementarity determining region 3 for antibody 50772
QQSYSTALT

SEQ ID NO: 101544 - protein, 14 aa, Homo sapiens
  heavy chain complementarity determining region 3 for antibody 50772
AKDCGDGVAGCIDF

SEQ ID NO: 101545 - protein, 9 aa, Homo sapiens
  light chain complementarity determining region 3 for antibody 50773
QQSYSSPRT

SEQ ID NO: 101546 - protein, 15 aa, Homo sapiens
  heavy chain complementarity determining region 3 for antibody 50773
ARRIVGANFRDYFDY

SEQ ID NO: 101547 - protein, 9 aa, Homo sapiens
  light chain complementarity determining region 3 for antibody 50774
QQSYSNPRT

SEQ ID NO: 101548 - protein, 13 aa, Homo sapiens
  heavy chain complementarity determining region 3 for antibody 50774
AKFGGGNNAPFDY

SEQ ID NO: 101549 - protein, 9 aa, Homo sapiens
  light chain complementarity determining region 3 for antibody 50775
QQSYNSPRS

SEQ ID NO: 101550 - protein, 12 aa, Homo sapiens
  heavy chain complementarity determining region 3 for antibody 50775
VREGEAYDYGDH

SEQ ID NO: 101551 - protein, 9 aa, Homo sapiens
  light chain complementarity determining region 3 for antibody 50776
QQSYNFPRM

SEQ ID NO: 101552 - protein, 18 aa, Homo sapiens
  heavy chain complementarity determining region 3 for antibody 50776
ARDRGTPVDGEWIAAFDI

SEQ ID NO: 101553 - protein, 9 aa, Homo sapiens
  light chain complementarity determining region 3 for antibody 50777
QQSHSTPYT

SEQ ID NO: 101554 - protein, 15 aa, Homo sapiens
  heavy chain complementarity determining region 3 for antibody 50777
ARDGGRWSAEYYFDS

SEQ ID NO: 101555 - protein, 8 aa, Homo sapiens
  light chain complementarity determining region 3 for antibody 50778
QQRSHWLI

SEQ ID NO: 101556 - protein, 13 aa, Homo sapiens
  heavy chain complementarity determining region 3 for antibody 50778
ARGTWFGEFALDY

SEQ ID NO: 101557 - protein, 8 aa, Homo sapiens
  light chain complementarity determining region 3 for antibody 50779
QQHNSYST

SEQ ID NO: 101558 - protein, 11 aa, Homo sapiens
  heavy chain complementarity determining region 3 for antibody 50779
ARSSGWFYFDY

SEQ ID NO: 101559 - protein, 9 aa, Homo sapiens
  light chain complementarity determining region 3 for antibody 50780
QQGYSSPYT

SEQ ID NO: 101560 - protein, 14 aa, Homo sapiens
  heavy chain complementarity determining region 3 for antibody 50780
ARDPQREKPHYFDY

SEQ ID NO: 101561 - protein, 9 aa, Homo sapiens
  light chain complementarity determining region 3 for antibody 50781
QQANSFPWT

SEQ ID NO: 101562 - protein, 13 aa, Homo sapiens
  heavy chain complementarity determining region 3 for antibody 50781
TRVTGTTDDYFDY

SEQ ID NO: 101563 - protein, 9 aa, Homo sapiens
  light chain complementarity determining region 3 for antibody 50782
QQANSFPRT

SEQ ID NO: 101564 - protein, 21 aa, Homo sapiens
  heavy chain complementarity determining region 3 for antibody 50782
ARDLNTMVRGVIITRHHAFDI

SEQ ID NO: 101565 - protein, 9 aa, Homo sapiens
  light chain complementarity determining region 3 for antibody 50783
QHRYSWPLT

SEQ ID NO: 101566 - protein, 17 aa, Homo sapiens
  heavy chain complementarity determining region 3 for antibody 50783
ARGMCGVNCPKLNWFDP

SEQ ID NO: 101567 - protein, 9 aa, Homo sapiens
  light chain complementarity determining region 3 for antibody 50784
QEYNTDSRG

SEQ ID NO: 101568 - protein, 13 aa, Homo sapiens
  heavy chain complementarity determining region 3 for antibody 50784
ARGHHLGRSPFDP

SEQ ID NO: 101569 - protein, 11 aa, Homo sapiens
  light chain complementarity determining region 3 for antibody 50785
MQALQTPGGLT

SEQ ID NO: 101570 - protein, 15 aa, Homo sapiens
  heavy chain complementarity determining region 3 for antibody 50785
ARLIGETYFYYGLDV

SEQ ID NO: 101571 - protein, 9 aa, Homo sapiens
  light chain complementarity determining region 3 for antibody 50786
LQHNTYPLT

SEQ ID NO: 101572 - protein, 18 aa, Homo sapiens
  heavy chain complementarity determining region 3 for antibody 50786
AKDLVRYSGSGNYGVWDI

SEQ ID NO: 101573 - protein, 9 aa, Homo sapiens
  light chain complementarity determining region 3 for antibody 50787
HQYGSSPET

SEQ ID NO: 101574 - protein, 13 aa, Homo sapiens
  heavy chain complementarity determining region 3 for antibody 50787
ASGNYDFWSGYHD

SEQ ID NO: 101575 - protein, 9 aa, Homo sapiens
  light chain complementarity determining region 3 for antibody 50788
HQSYSALWT

SEQ ID NO: 101576 - protein, 15 aa, Homo sapiens
  heavy chain complementarity determining region 3 for antibody 50788
VKSKTYFDFWSGPDY

SEQ ID NO: 101577 - protein, 9 aa, Homo sapiens
  light chain complementarity determining region 3 for antibody 50789
QQYYITPLH

SEQ ID NO: 101578 - protein, 18 aa, Homo sapiens
  heavy chain complementarity determining region 3 for antibody 50789
ARDRRCSSLSCFVDAFDI

SEQ ID NO: 101579 - protein, 9 aa, Homo sapiens
  light chain complementarity determining region 3 for antibody 50790
QQYSNWPPT

SEQ ID NO: 101580 - protein, 15 aa, Homo sapiens
  heavy chain complementarity determining region 3 for antibody 50790
ARVTRPSGIVGAFDI

SEQ ID NO: 101581 - protein, 9 aa, Homo sapiens
  light chain complementarity determining region 3 for antibody 50791
QQYSGSSIT

SEQ ID NO: 101582 - protein, 11 aa, Homo sapiens
  heavy chain complementarity determining region 3 for antibody 50791
ARVYTTGRIDF

SEQ ID NO: 101583 - protein, 9 aa, Homo sapiens
  light chain complementarity determining region 3 for antibody 50792
QQYNSYGWT

SEQ ID NO: 101584 - protein, 17 aa, Homo sapiens
  heavy chain complementarity determining region 3 for antibody 50792
VRPHYYGSGSYRPPFDY

SEQ ID NO: 101585 - protein, 9 aa, Homo sapiens
  light chain complementarity determining region 3 for antibody 50793
QQYDNLPRT

SEQ ID NO: 101586 - protein, 14 aa, Homo sapiens
  heavy chain complementarity determining region 3 for antibody 50793
AKYISSWYLDAFDI

SEQ ID NO: 101587 - protein, 9 aa, Homo sapiens
  light chain complementarity determining region 3 for antibody 50794
QQYDNLPLT

SEQ ID NO: 101588 - protein, 9 aa, Homo sapiens
  heavy chain complementarity determining region 3 for antibody 50794
TTGDDGHAT

SEQ ID NO: 101589 - protein, 9 aa, Homo sapiens
  light chain complementarity determining region 3 for antibody 50795
QQYDKYPLS

SEQ ID NO: 101590 - protein, 16 aa, Homo sapiens
  heavy chain complementarity determining region 3 for antibody 50795
ARERDTVISPVARLRL

SEQ ID NO: 101591 - protein, 9 aa, Homo sapiens
  light chain complementarity determining region 3 for antibody 50796
QQSYSTLAT

SEQ ID NO: 101592 - protein, 13 aa, Homo sapiens
  heavy chain complementarity determining region 3 for antibody 50796
AKPLAGGSWRFDL

SEQ ID NO: 101593 - protein, 9 aa, Homo sapiens
  light chain complementarity determining region 3 for antibody 50797
QQSYSSPYT

SEQ ID NO: 101594 - protein, 18 aa, Homo sapiens
  heavy chain complementarity determining region 3 for antibody 50797
ARDCSGGSCYSDNWYFDL

SEQ ID NO: 101595 - protein, 9 aa, Homo sapiens
  light chain complementarity determining region 3 for antibody 50798
QQADSFPIT

SEQ ID NO: 101596 - protein, 16 aa, Homo sapiens
  heavy chain complementarity determining region 3 for antibody 50798
ARRRDGGGSSGRVFDP

SEQ ID NO: 101597 - protein, 9 aa, Homo sapiens
  light chain complementarity determining region 3 for antibody 50799
LQDYNYPRT

SEQ ID NO: 101598 - protein, 14 aa, Homo sapiens
  heavy chain complementarity determining region 3 for antibody 50799
AKDRRGSGVEVFDI

SEQ ID NO: 101599 - protein, 9 aa, Homo sapiens
  light chain complementarity determining region 3 for antibody 50800
HQLIAYPRT

SEQ ID NO: 101600 - protein, 19 aa, Homo sapiens
  heavy chain complementarity determining region 3 for antibody 50800
SRDGRAHPYSTGYYWYFDL

SEQ ID NO: 101601 - protein, 9 aa, Homo sapiens
  light chain complementarity determining region 3 for antibody 50801
QQYNSYFWT

SEQ ID NO: 101602 - protein, 18 aa, Homo sapiens
  heavy chain complementarity determining region 3 for antibody 50801
AREGRGWSSGWYSSSFDY

SEQ ID NO: 101603 - protein, 9 aa, Homo sapiens
  light chain complementarity determining region 3 for antibody 50802
QQYGNSPYT

SEQ ID NO: 101604 - protein, 16 aa, Homo sapiens
  heavy chain complementarity determining region 3 for antibody 50802
LKGGVYNSGWHDVFPV

SEQ ID NO: 101605 - protein, 8 aa, Homo sapiens
  light chain complementarity determining region 3 for antibody 50803
QQYGDLPT

SEQ ID NO: 101606 - protein, 13 aa, Homo sapiens
  heavy chain complementarity determining region 3 for antibody 50803
TTSFPFAESSFDY

SEQ ID NO: 101607 - protein, 9 aa, Homo sapiens
  light chain complementarity determining region 3 for antibody 50804
QQYDSYLYT

SEQ ID NO: 101608 - protein, 15 aa, Homo sapiens
  heavy chain complementarity determining region 3 for antibody 50804
ARNWVYHDSSGYLDY

SEQ ID NO: 101609 - protein, 9 aa, Homo sapiens
  light chain complementarity determining region 3 for antibody 50805
QQYDNLPRT

SEQ ID NO: 101610 - protein, 15 aa, Homo sapiens
  heavy chain complementarity determining region 3 for antibody 50805
ASLPTTWGGFETRNL

SEQ ID NO: 101611 - protein, 9 aa, Homo sapiens
  light chain complementarity determining region 3 for antibody 50806
QQYDNLPRT

SEQ ID NO: 101612 - protein, 15 aa, Homo sapiens
  heavy chain complementarity determining region 3 for antibody 50806
ASLPTTWGGCETQNL

SEQ ID NO: 101613 - protein, 10 aa, Homo sapiens
  light chain complementarity determining region 3 for antibody 50807
QQYDNLPMYT

SEQ ID NO: 101614 - protein, 6 aa, Homo sapiens
  heavy chain complementarity determining region 3 for antibody 50807
AREGST

SEQ ID NO: 101615 - protein, 10 aa, Homo sapiens
  light chain complementarity determining region 3 for antibody 50808
QQSYSTPRWT

SEQ ID NO: 101616 - protein, 14 aa, Homo sapiens
  heavy chain complementarity determining region 3 for antibody 50808
ARSVPLGDSSAFDI

SEQ ID NO: 101617 - protein, 10 aa, Homo sapiens
  light chain complementarity determining region 3 for antibody 50809
QQSYGTPKWT

SEQ ID NO: 101618 - protein, 11 aa, Homo sapiens
  heavy chain complementarity determining region 3 for antibody 50809
ARRSSGWYLNY

SEQ ID NO: 101619 - protein, 9 aa, Homo sapiens
  light chain complementarity determining region 3 for antibody 50810
QQSYETPLT

SEQ ID NO: 101620 - protein, 16 aa, Homo sapiens
  heavy chain complementarity determining region 3 for antibody 50810
ARDKVAASHTGSLFEY

SEQ ID NO: 101621 - protein, 11 aa, Homo sapiens
  light chain complementarity determining region 3 for antibody 50811
QQRTNWPPEVT

SEQ ID NO: 101622 - protein, 14 aa, Homo sapiens
  heavy chain complementarity determining region 3 for antibody 50811
AGEGHLLGRNAFDI

SEQ ID NO: 101623 - protein, 8 aa, Homo sapiens
  light chain complementarity determining region 3 for antibody 50812
QQFHNLPS

SEQ ID NO: 101624 - protein, 9 aa, Homo sapiens
  heavy chain complementarity determining region 3 for antibody 50812
ARSRYRLDL

SEQ ID NO: 101625 - protein, 9 aa, Homo sapiens
  light chain complementarity determining region 3 for antibody 50813
QQANSFPIT

SEQ ID NO: 101626 - protein, 17 aa, Homo sapiens
  heavy chain complementarity determining region 3 for antibody 50813
AKGATPYNWNYGPYFDH

SEQ ID NO: 101627 - protein, 9 aa, Homo sapiens
  light chain complementarity determining region 3 for antibody 50814
QKYSSAPLT

SEQ ID NO: 101628 - protein, 14 aa, Homo sapiens
  heavy chain complementarity determining region 3 for antibody 50814
ATDDGSGWYGPSRY

SEQ ID NO: 101629 - protein, 9 aa, Homo sapiens
  light chain complementarity determining region 3 for antibody 50815
QKYNSVPLT

SEQ ID NO: 101630 - protein, 20 aa, Homo sapiens
  heavy chain complementarity determining region 3 for antibody 50815
ATVLRGLGSSAWFVGGAFDI

SEQ ID NO: 101631 - protein, 9 aa, Homo sapiens
  light chain complementarity determining region 3 for antibody 50816
QHYSRYPYT

SEQ ID NO: 101632 - protein, 15 aa, Homo sapiens
  heavy chain complementarity determining region 3 for antibody 50816
ASGKGDSTGWPFFDF

SEQ ID NO: 101633 - protein, 6 aa, Homo sapiens
  light chain complementarity determining region 3 for antibody 50817
QGSGTS

SEQ ID NO: 101634 - protein, 12 aa, Homo sapiens
  heavy chain complementarity determining region 3 for antibody 50817
ARDHISGWSLSH

SEQ ID NO: 101635 - protein, 9 aa, Homo sapiens
  light chain complementarity determining region 3 for antibody 50818
QEYASASHS

SEQ ID NO: 101636 - protein, 17 aa, Homo sapiens
  heavy chain complementarity determining region 3 for antibody 50818
ARMDYYESSGFYGYFNL

SEQ ID NO: 101637 - protein, 9 aa, Homo sapiens
  light chain complementarity determining region 3 for antibody 50819
LQSYSSPFT

SEQ ID NO: 101638 - protein, 12 aa, Homo sapiens
  heavy chain complementarity determining region 3 for antibody 50819
ARNVHSGDYVDY

SEQ ID NO: 101639 - protein, 9 aa, Homo sapiens
  light chain complementarity determining region 3 for antibody 50820
LQHNSYPIT

SEQ ID NO: 101640 - protein, 24 aa, Homo sapiens
  heavy chain complementarity determining region 3 for antibody 50820
ARDRQEGTHYDFWGRINYYYGMDV

SEQ ID NO: 101641 - protein, 9 aa, Homo sapiens
  light chain complementarity determining region 3 for antibody 50821
LQDYNYPRT

SEQ ID NO: 101642 - protein, 11 aa, Homo sapiens
  heavy chain complementarity determining region 3 for antibody 50821
AREGYNYGLDY

SEQ ID NO: 101643 - protein, 9 aa, Homo sapiens
  light chain complementarity determining region 3 for antibody 50822
LQDYIYPYT

SEQ ID NO: 101644 - protein, 9 aa, Homo sapiens
  heavy chain complementarity determining region 3 for antibody 50822
ARDRGTFES

SEQ ID NO: 101645 - protein, 8 aa, Homo sapiens
  light chain complementarity determining region 3 for antibody 50823
QQYNSYPT

SEQ ID NO: 101646 - protein, 14 aa, Homo sapiens
  heavy chain complementarity determining region 3 for antibody 50823
AKDRNAVGGDAFDI

SEQ ID NO: 101647 - protein, 9 aa, Homo sapiens
  light chain complementarity determining region 3 for antibody 50824
QQYNSYPFT

SEQ ID NO: 101648 - protein, 9 aa, Homo sapiens
  heavy chain complementarity determining region 3 for antibody 50824
TRGAGFGEN

SEQ ID NO: 101649 - protein, 9 aa, Homo sapiens
  light chain complementarity determining region 3 for antibody 50825
QQYGSSPRT

SEQ ID NO: 101650 - protein, 9 aa, Homo sapiens
  heavy chain complementarity determining region 3 for antibody 50825
ARGHWDHRN

SEQ ID NO: 101651 - protein, 9 aa, Homo sapiens
  light chain complementarity determining region 3 for antibody 50826
QQYGSSPLT

SEQ ID NO: 101652 - protein, 22 aa, Homo sapiens
  heavy chain complementarity determining region 3 for antibody 50826
ARTLFWSGYYVGSLGVVGWFDP

SEQ ID NO: 101653 - protein, 8 aa, Homo sapiens
  light chain complementarity determining region 3 for antibody 50827
QQYGIPPT

SEQ ID NO: 101654 - protein, 11 aa, Homo sapiens
  heavy chain complementarity determining region 3 for antibody 50827
ARHGRQLWFTY

SEQ ID NO: 101655 - protein, 9 aa, Homo sapiens
  light chain complementarity determining region 3 for antibody 50828
QQYDSSPFT

SEQ ID NO: 101656 - protein, 17 aa, Homo sapiens
  heavy chain complementarity determining region 3 for antibody 50828
AKSSVWLNNYYYYGLDL

SEQ ID NO: 101657 - protein, 9 aa, Homo sapiens
  light chain complementarity determining region 3 for antibody 50829
QQYDNLPVS

SEQ ID NO: 101658 - protein, 10 aa, Homo sapiens
  heavy chain complementarity determining region 3 for antibody 50829
ARGGRTWFGP

SEQ ID NO: 101659 - protein, 9 aa, Homo sapiens
  light chain complementarity determining region 3 for antibody 50830
QQYDNLPLT

SEQ ID NO: 101660 - protein, 14 aa, Homo sapiens
  heavy chain complementarity determining region 3 for antibody 50830
ARDNQFLEWSYLDY

SEQ ID NO: 101661 - protein, 9 aa, Homo sapiens
  light chain complementarity determining region 3 for antibody 50831
QQYANIPPT

SEQ ID NO: 101662 - protein, 17 aa, Homo sapiens
  heavy chain complementarity determining region 3 for antibody 50831
ARGPLIRGLVVPVPLDY

SEQ ID NO: 101663 - protein, 9 aa, Homo sapiens
  light chain complementarity determining region 3 for antibody 50832
QQTNSFPLT

SEQ ID NO: 101664 - protein, 23 aa, Homo sapiens
  heavy chain complementarity determining region 3 for antibody 50832
ARAPDTHVTSSPLIVLLSDAFDF

SEQ ID NO: 101665 - protein, 9 aa, Homo sapiens
  light chain complementarity determining region 3 for antibody 50833
QQSYTIPLT

SEQ ID NO: 101666 - protein, 9 aa, Homo sapiens
  heavy chain complementarity determining region 3 for antibody 50833
TTGDDGHDI

SEQ ID NO: 101667 - protein, 10 aa, Homo sapiens
  light chain complementarity determining region 3 for antibody 50834
QQSYSTLLIT

SEQ ID NO: 101668 - protein, 12 aa, Homo sapiens
  heavy chain complementarity determining region 3 for antibody 50834
ARAVSDYYGMDV

SEQ ID NO: 101669 - protein, 9 aa, Homo sapiens
  light chain complementarity determining region 3 for antibody 50835
QQSYITPRT

SEQ ID NO: 101670 - protein, 23 aa, Homo sapiens
  heavy chain complementarity determining region 3 for antibody 50835
ARVVTLGREAPLSSPAVEHGMDV

SEQ ID NO: 101671 - protein, 9 aa, Homo sapiens
  light chain complementarity determining region 3 for antibody 50836
QQSYIIPRT

SEQ ID NO: 101672 - protein, 12 aa, Homo sapiens
  heavy chain complementarity determining region 3 for antibody 50836
ARVAGGIGAFDV

SEQ ID NO: 101673 - protein, 10 aa, Homo sapiens
  light chain complementarity determining region 3 for antibody 50837
QQRSNWPQIT

SEQ ID NO: 101674 - protein, 15 aa, Homo sapiens
  heavy chain complementarity determining region 3 for antibody 50837
ARGGIATPYYYYMDV

SEQ ID NO: 101675 - protein, 6 aa, Homo sapiens
  light chain complementarity determining region 3 for antibody 50838
QQRGES

SEQ ID NO: 101676 - protein, 12 aa, Homo sapiens
  heavy chain complementarity determining region 3 for antibody 50838
ARDHISGWSLSS

SEQ ID NO: 101677 - protein, 9 aa, Homo sapiens
  light chain complementarity determining region 3 for antibody 50839
QQFHSSSLT

SEQ ID NO: 101678 - protein, 20 aa, Homo sapiens
  heavy chain complementarity determining region 3 for antibody 50839
ARGVGYDSSGYYSEGWYFDQ

SEQ ID NO: 101679 - protein, 9 aa, Homo sapiens
  light chain complementarity determining region 3 for antibody 50840
QQANSFPRT

SEQ ID NO: 101680 - protein, 13 aa, Homo sapiens
  heavy chain complementarity determining region 3 for antibody 50840
AKDRISMIVAPLP

SEQ ID NO: 101681 - protein, 9 aa, Homo sapiens
  light chain complementarity determining region 3 for antibody 50841
QKHDRAPLT

SEQ ID NO: 101682 - protein, 14 aa, Homo sapiens
  heavy chain complementarity determining region 3 for antibody 50841
VHRAEYAYGNYFDY

SEQ ID NO: 101683 - protein, 9 aa, Homo sapiens
  light chain complementarity determining region 3 for antibody 50842
QHLRSHPPT

SEQ ID NO: 101684 - protein, 19 aa, Homo sapiens
  heavy chain complementarity determining region 3 for antibody 50842
ARVPPANNHNYYYYYGFDV

SEQ ID NO: 101685 - protein, 9 aa, Homo sapiens
  light chain complementarity determining region 3 for antibody 50843
MQGAHWPIT

SEQ ID NO: 101686 - protein, 11 aa, Homo sapiens
  heavy chain complementarity determining region 3 for antibody 50843
ARGSHGYGMDV

SEQ ID NO: 101687 - protein, 9 aa, Homo sapiens
  light chain complementarity determining region 3 for antibody 50844
LQHNTYPVT

SEQ ID NO: 101688 - protein, 13 aa, Homo sapiens
  heavy chain complementarity determining region 3 for antibody 50844
ARDQVWDPHAFDI

SEQ ID NO: 101689 - protein, 10 aa, Homo sapiens
  light chain complementarity determining region 3 for antibody 50845
LQHNSYPLLT

SEQ ID NO: 101690 - protein, 13 aa, Homo sapiens
  heavy chain complementarity determining region 3 for antibody 50845
TTDLPYNYGALNY

SEQ ID NO: 101691 - protein, 11 aa, Homo sapiens
  light chain complementarity determining region 3 for antibody 50846
LQHNNYPPSWT

SEQ ID NO: 101692 - protein, 10 aa, Homo sapiens
  heavy chain complementarity determining region 3 for antibody 50846
ARDFGRSLDY

SEQ ID NO: 101693 - protein, 9 aa, Homo sapiens
  light chain complementarity determining region 3 for antibody 50847
LQDYNYPLT

SEQ ID NO: 101694 - protein, 18 aa, Homo sapiens
  heavy chain complementarity determining region 3 for antibody 50847
TGDTIGSFGAVIVEHFDY

SEQ ID NO: 101695 - protein, 9 aa, Homo sapiens
  light chain complementarity determining region 3 for antibody 50848
QQYYDIPWT

SEQ ID NO: 101696 - protein, 14 aa, Homo sapiens
  heavy chain complementarity determining region 3 for antibody 50848
AKCAYSYGNDASDK

SEQ ID NO: 101697 - protein, 10 aa, Homo sapiens
  light chain complementarity determining region 3 for antibody 50849
QQYQTFSRVT

SEQ ID NO: 101698 - protein, 10 aa, Homo sapiens
  heavy chain complementarity determining region 3 for antibody 50849
ARFRGGYFDA

SEQ ID NO: 101699 - protein, 9 aa, Homo sapiens
  light chain complementarity determining region 3 for antibody 50850
QQYNSYSHT

SEQ ID NO: 101700 - protein, 19 aa, Homo sapiens
  heavy chain complementarity determining region 3 for antibody 50850
ARDGRAGVWGSYMGYYFDY

SEQ ID NO: 101701 - protein, 9 aa, Homo sapiens
  light chain complementarity determining region 3 for antibody 50851
QQYKSYPVT

SEQ ID NO: 101702 - protein, 16 aa, Homo sapiens
  heavy chain complementarity determining region 3 for antibody 50851
AILYIAIRGNSRFKPH

SEQ ID NO: 101703 - protein, 9 aa, Homo sapiens
  light chain complementarity determining region 3 for antibody 50852
QQYGSSPLT

SEQ ID NO: 101704 - protein, 18 aa, Homo sapiens
  heavy chain complementarity determining region 3 for antibody 50852
AREGHGDYGGSYYYGMDV

SEQ ID NO: 101705 - protein, 9 aa, Homo sapiens
  light chain complementarity determining region 3 for antibody 50853
QQYGSSPKT

SEQ ID NO: 101706 - protein, 15 aa, Homo sapiens
  heavy chain complementarity determining region 3 for antibody 50853
VRDRFSNGLGSYFRY

SEQ ID NO: 101707 - protein, 9 aa, Homo sapiens
  light chain complementarity determining region 3 for antibody 50854
QQYDSYPLT

SEQ ID NO: 101708 - protein, 20 aa, Homo sapiens
  heavy chain complementarity determining region 3 for antibody 50854
ARCAGGGGAQGAQYHNGIDV

SEQ ID NO: 101709 - protein, 9 aa, Homo sapiens
  light chain complementarity determining region 3 for antibody 50855
QQYDNLPRT

SEQ ID NO: 101710 - protein, 15 aa, Homo sapiens
  heavy chain complementarity determining region 3 for antibody 50855
ASLPTTWRGSETQNL

SEQ ID NO: 101711 - protein, 8 aa, Homo sapiens
  light chain complementarity determining region 3 for antibody 50856
QQYDNLAT

SEQ ID NO: 101712 - protein, 20 aa, Homo sapiens
  heavy chain complementarity determining region 3 for antibody 50856
ARGRGRYTNSWYVAKGCMDV

SEQ ID NO: 101713 - protein, 6 aa, Homo sapiens
  light chain complementarity determining region 3 for antibody 50857
QQYATS

SEQ ID NO: 101714 - protein, 12 aa, Homo sapiens
  heavy chain complementarity determining region 3 for antibody 50857
ETLGLMVFADDY

SEQ ID NO: 101715 - protein, 9 aa, Homo sapiens
  light chain complementarity determining region 3 for antibody 50858
QQYANSLYT

SEQ ID NO: 101716 - protein, 16 aa, Homo sapiens
  heavy chain complementarity determining region 3 for antibody 50858
ARDFGVTRTNNWYFDL

SEQ ID NO: 101717 - protein, 9 aa, Homo sapiens
  light chain complementarity determining region 3 for antibody 50859
QQTYSAPWT

SEQ ID NO: 101718 - protein, 16 aa, Homo sapiens
  heavy chain complementarity determining region 3 for antibody 50859
ARQQQLAWRPLYSFDY

SEQ ID NO: 101719 - protein, 11 aa, Homo sapiens
  light chain complementarity determining region 3 for antibody 50860
QQTYNSPPLYT

SEQ ID NO: 101720 - protein, 16 aa, Homo sapiens
  heavy chain complementarity determining region 3 for antibody 50860
ARDHPDEYSSSSYLDA

SEQ ID NO: 101721 - protein, 9 aa, Homo sapiens
  light chain complementarity determining region 3 for antibody 50861
QQSYSTWYT

SEQ ID NO: 101722 - protein, 17 aa, Homo sapiens
  heavy chain complementarity determining region 3 for antibody 50861
AKGLLWFGVLASDAFDI

SEQ ID NO: 101723 - protein, 9 aa, Homo sapiens
  light chain complementarity determining region 3 for antibody 50862
QQSYSTPWT

SEQ ID NO: 101724 - protein, 16 aa, Homo sapiens
  heavy chain complementarity determining region 3 for antibody 50862
TTDSLTMVRGEGVFDY

SEQ ID NO: 101725 - protein, 9 aa, Homo sapiens
  light chain complementarity determining region 3 for antibody 50863
QQSYSTLLT

SEQ ID NO: 101726 - protein, 20 aa, Homo sapiens
  heavy chain complementarity determining region 3 for antibody 50863
ARGYRVRGVIITRRTYYFDY

SEQ ID NO: 101727 - protein, 9 aa, Homo sapiens
  light chain complementarity determining region 3 for antibody 50864
QQSYSNPRT

SEQ ID NO: 101728 - protein, 22 aa, Homo sapiens
  heavy chain complementarity determining region 3 for antibody 50864
ARDIQDYYDSSSYYEKTDAFDI

SEQ ID NO: 101729 - protein, 9 aa, Homo sapiens
  light chain complementarity determining region 3 for antibody 50865
QQSYSNLKS

SEQ ID NO: 101730 - protein, 12 aa, Homo sapiens
  heavy chain complementarity determining region 3 for antibody 50865
VRDLNGYTYDNF

SEQ ID NO: 101731 - protein, 7 aa, Homo sapiens
  light chain complementarity determining region 3 for antibody 50866
QQSYSKT

SEQ ID NO: 101732 - protein, 10 aa, Homo sapiens
  heavy chain complementarity determining region 3 for antibody 50866
AREGSSAFDI

SEQ ID NO: 101733 - protein, 8 aa, Homo sapiens
  light chain complementarity determining region 3 for antibody 50867
QQRSNWIT

SEQ ID NO: 101734 - protein, 9 aa, Homo sapiens
  heavy chain complementarity determining region 3 for antibody 50867
ARENWGPDY

SEQ ID NO: 101735 - protein, 9 aa, Homo sapiens
  light chain complementarity determining region 3 for antibody 50868
QQRIDWPWT

SEQ ID NO: 101736 - protein, 12 aa, Homo sapiens
  heavy chain complementarity determining region 3 for antibody 50868
GREDYRTGYVDS

SEQ ID NO: 101737 - protein, 9 aa, Homo sapiens
  light chain complementarity determining region 3 for antibody 50869
QQLNSYPRT

SEQ ID NO: 101738 - protein, 13 aa, Homo sapiens
  heavy chain complementarity determining region 3 for antibody 50869
ARALVDTDDAFDI

SEQ ID NO: 101739 - protein, 9 aa, Homo sapiens
  light chain complementarity determining region 3 for antibody 50870
QQHNSYLRT

SEQ ID NO: 101740 - protein, 12 aa, Homo sapiens
  heavy chain complementarity determining region 3 for antibody 50870
ARDGRKEWYFDL

SEQ ID NO: 101741 - protein, 9 aa, Homo sapiens
  light chain complementarity determining region 3 for antibody 50871
QQFADSPRT

SEQ ID NO: 101742 - protein, 17 aa, Homo sapiens
  heavy chain complementarity determining region 3 for antibody 50871
TRVKYCSDGTCYTGTDY

SEQ ID NO: 101743 - protein, 9 aa, Homo sapiens
  light chain complementarity determining region 3 for antibody 50872
QQANYFPYT

SEQ ID NO: 101744 - protein, 14 aa, Homo sapiens
  heavy chain complementarity determining region 3 for antibody 50872
AKEPRGEYYGLEGA

SEQ ID NO: 101745 - protein, 9 aa, Homo sapiens
  light chain complementarity determining region 3 for antibody 50873
QKYNSAPGT

SEQ ID NO: 101746 - protein, 23 aa, Homo sapiens
  heavy chain complementarity determining region 3 for antibody 50873
AVGYRYGGSLFSLAVNSEGGMDV

SEQ ID NO: 101747 - protein, 8 aa, Homo sapiens
  light chain complementarity determining region 3 for antibody 50874
QKYGSLWT

SEQ ID NO: 101748 - protein, 14 aa, Homo sapiens
  heavy chain complementarity determining region 3 for antibody 50874
ASHSRDHGYNLGSY

SEQ ID NO: 101749 - protein, 9 aa, Homo sapiens
  light chain complementarity determining region 3 for antibody 50875
MQGTHWPYT

SEQ ID NO: 101750 - protein, 7 aa, Homo sapiens
  heavy chain complementarity determining region 3 for antibody 50875
VVGRGFC

SEQ ID NO: 101751 - protein, 8 aa, Homo sapiens
  light chain complementarity determining region 3 for antibody 50876
MQALQTRT

SEQ ID NO: 101752 - protein, 24 aa, Homo sapiens
  heavy chain complementarity determining region 3 for antibody 50876
AREAGVESCSSPSDYYNNYCGMDV

SEQ ID NO: 101753 - protein, 9 aa, Homo sapiens
  light chain complementarity determining region 3 for antibody 50877
MQALQTPHT

SEQ ID NO: 101754 - protein, 11 aa, Homo sapiens
  heavy chain complementarity determining region 3 for antibody 50877
ATGYTSGWSDS

SEQ ID NO: 101755 - protein, 9 aa, Homo sapiens
  light chain complementarity determining region 3 for antibody 50878
LQHRSYPWT

SEQ ID NO: 101756 - protein, 10 aa, Homo sapiens
  heavy chain complementarity determining region 3 for antibody 50878
GRDPDRPFDH

SEQ ID NO: 101757 - protein, 9 aa, Homo sapiens
  light chain complementarity determining region 3 for antibody 50879
LQDFNYPLT

SEQ ID NO: 101758 - protein, 12 aa, Homo sapiens
  heavy chain complementarity determining region 3 for antibody 50879
AKRLTYADAFDI

SEQ ID NO: 101759 - protein, 9 aa, Homo sapiens
  light chain complementarity determining region 3 for antibody 50880
HQYYTTPPT

SEQ ID NO: 101760 - protein, 16 aa, Homo sapiens
  heavy chain complementarity determining region 3 for antibody 50880
ARDIVVEMTSTGYFDL

SEQ ID NO: 101761 - protein, 9 aa, Homo sapiens
  light chain complementarity determining region 3 for antibody 50881
QQYYSSPIT

SEQ ID NO: 101762 - protein, 17 aa, Homo sapiens
  heavy chain complementarity determining region 3 for antibody 50881
ARERVDSGFDGSYYFDF

SEQ ID NO: 101763 - protein, 9 aa, Homo sapiens
  light chain complementarity determining region 3 for antibody 50882
QQYLHTFYT

SEQ ID NO: 101764 - protein, 17 aa, Homo sapiens
  heavy chain complementarity determining region 3 for antibody 50882
ARDKDFWSGRQRRDFDY

SEQ ID NO: 101765 - protein, 9 aa, Homo sapiens
  light chain complementarity determining region 3 for antibody 50883
QQYGTSPLT

SEQ ID NO: 101766 - protein, 11 aa, Homo sapiens
  heavy chain complementarity determining region 3 for antibody 50883
ARGSLWEWFDP

SEQ ID NO: 101767 - protein, 9 aa, Homo sapiens
  light chain complementarity determining region 3 for antibody 50884
QQYGSSPRT

SEQ ID NO: 101768 - protein, 15 aa, Homo sapiens
  heavy chain complementarity determining region 3 for antibody 50884
ASQGDRGYSYGYIDY

SEQ ID NO: 101769 - protein, 9 aa, Homo sapiens
  light chain complementarity determining region 3 for antibody 50885
QQYGSSPRT

SEQ ID NO: 101770 - protein, 15 aa, Homo sapiens
  heavy chain complementarity determining region 3 for antibody 50885
ARGPRYDFWSGYYGY

SEQ ID NO: 101771 - protein, 10 aa, Homo sapiens
  light chain complementarity determining region 3 for antibody 50886
QQYGSSPPIT

SEQ ID NO: 101772 - protein, 17 aa, Homo sapiens
  heavy chain complementarity determining region 3 for antibody 50886
ARHGAIGDYYSRYYFDY

SEQ ID NO: 101773 - protein, 9 aa, Homo sapiens
  light chain complementarity determining region 3 for antibody 50887
QQYGSSPLT

SEQ ID NO: 101774 - protein, 15 aa, Homo sapiens
  heavy chain complementarity determining region 3 for antibody 50887
TTDGGFYDFWSGFDY

SEQ ID NO: 101775 - protein, 9 aa, Homo sapiens
  light chain complementarity determining region 3 for antibody 50888
QQYDNLPRT

SEQ ID NO: 101776 - protein, 15 aa, Homo sapiens
  heavy chain complementarity determining region 3 for antibody 50888
ASLPTPWGGFETQNL

SEQ ID NO: 101777 - protein, 9 aa, Homo sapiens
  light chain complementarity determining region 3 for antibody 50889
QQYDILPPT

SEQ ID NO: 101778 - protein, 14 aa, Homo sapiens
  heavy chain complementarity determining region 3 for antibody 50889
ASGTFGYSYGSSDY

SEQ ID NO: 101779 - protein, 9 aa, Homo sapiens
  light chain complementarity determining region 3 for antibody 50890
QQTNSFPLT

SEQ ID NO: 101780 - protein, 18 aa, Homo sapiens
  heavy chain complementarity determining region 3 for antibody 50890
AHRPPRGAASGAPPPFDF

SEQ ID NO: 101781 - protein, 9 aa, Homo sapiens
  light chain complementarity determining region 3 for antibody 50891
QQSYSTPWT

SEQ ID NO: 101782 - protein, 20 aa, Homo sapiens
  heavy chain complementarity determining region 3 for antibody 50891
AKTYDYIWGEGGPRGYYFDY

SEQ ID NO: 101783 - protein, 9 aa, Homo sapiens
  light chain complementarity determining region 3 for antibody 50892
QQSYSSPRT

SEQ ID NO: 101784 - protein, 14 aa, Homo sapiens
  heavy chain complementarity determining region 3 for antibody 50892
ARGLTTVTNYYFDY

SEQ ID NO: 101785 - protein, 9 aa, Homo sapiens
  light chain complementarity determining region 3 for antibody 50893
QQSYNTPYT

SEQ ID NO: 101786 - protein, 12 aa, Homo sapiens
  heavy chain complementarity determining region 3 for antibody 50893
ARTGGGYIRIDY

SEQ ID NO: 101787 - protein, 11 aa, Homo sapiens
  light chain complementarity determining region 3 for antibody 50894
QQRSNWPPGLT

SEQ ID NO: 101788 - protein, 17 aa, Homo sapiens
  heavy chain complementarity determining region 3 for antibody 50894
ARERGGSYYWPPLGIDY

SEQ ID NO: 101789 - protein, 10 aa, Homo sapiens
  light chain complementarity determining region 3 for antibody 50895
QQRNNWRALT

SEQ ID NO: 101790 - protein, 17 aa, Homo sapiens
  heavy chain complementarity determining region 3 for antibody 50895
LRGGGQYDILTGNYEDV

SEQ ID NO: 101791 - protein, 9 aa, Homo sapiens
  light chain complementarity determining region 3 for antibody 50896
QQLNSYPRT

SEQ ID NO: 101792 - protein, 16 aa, Homo sapiens
  heavy chain complementarity determining region 3 for antibody 50896
ARDSGVIHPPHYPFDV

SEQ ID NO: 101793 - protein, 9 aa, Homo sapiens
  light chain complementarity determining region 3 for antibody 50897
LQHHTYPLT

SEQ ID NO: 101794 - protein, 14 aa, Homo sapiens
  heavy chain complementarity determining region 3 for antibody 50897
TTGVGRSGSGTPDY

SEQ ID NO: 101795 - protein, 9 aa, Homo sapiens
  light chain complementarity determining region 3 for antibody 50898
HQYNSDSRS

SEQ ID NO: 101796 - protein, 12 aa, Homo sapiens
  heavy chain complementarity determining region 3 for antibody 50898
ARVRDIWGLHDL

SEQ ID NO: 101797 - protein, 10 aa, Homo sapiens
  light chain complementarity determining region 3 for antibody 50899
QQYNSYSPYT

SEQ ID NO: 101798 - protein, 15 aa, Homo sapiens
  heavy chain complementarity determining region 3 for antibody 50899
ARHYGYNYYYDAFDI

SEQ ID NO: 101799 - protein, 9 aa, Homo sapiens
  light chain complementarity determining region 3 for antibody 50900
QQYNSYSLT

SEQ ID NO: 101800 - protein, 18 aa, Homo sapiens
  heavy chain complementarity determining region 3 for antibody 50900
AREVKLNAWFGELPHFDY

SEQ ID NO: 101801 - protein, 10 aa, Homo sapiens [sequence omitted]

SEQ ID NO: 101802 - protein, 11 aa, Homo sapiens
  heavy chain complementarity determining region 3 for antibody 50901
ARDSHYYGMDV

SEQ ID NO: 101803 - protein, 10 aa, Homo sapiens
  light chain complementarity determining region 3 for antibody 50902
QQYNDWPPYT

SEQ ID NO: 101804 - protein, 21 aa, Homo sapiens
  heavy chain complementarity determining region 3 for antibody 50902
ARDPGICPGGGDCYTPLAFDV

SEQ ID NO: 101805 - protein, 9 aa, Homo sapiens
  light chain complementarity determining region 3 for antibody 50903
QQYHSYSDT

SEQ ID NO: 101806 - protein, 19 aa, Homo sapiens
  heavy chain complementarity determining region 3 for antibody 50903
ATGNSDSSGYYFSGCYFDL

SEQ ID NO: 101807 - protein, 9 aa, Homo sapiens
  light chain complementarity determining region 3 for antibody 50904
QQYHSYPYT

SEQ ID NO: 101808 - protein, 7 aa, Homo sapiens
  heavy chain complementarity determining region 3 for antibody 50904
ARLYFDL

SEQ ID NO: 101809 - protein, 9 aa, Homo sapiens
  light chain complementarity determining region 3 for antibody 50905
QQYGTSGIT

SEQ ID NO: 101810 - protein, 17 aa, Homo sapiens
  heavy chain complementarity determining region 3 for antibody 50905
ARIRPPNPAWSGGDFDY

SEQ ID NO: 101811 - protein, 9 aa, Homo sapiens
  light chain complementarity determining region 3 for antibody 50906
QQYGSSPYT

SEQ ID NO: 101812 - protein, 19 aa, Homo sapiens
  heavy chain complementarity determining region 3 for antibody 50906
VKGQDDDILTGAIRGAFDL

SEQ ID NO: 101813 - protein, 9 aa, Homo sapiens
  light chain complementarity determining region 3 for antibody 50907
QQYGRSPWT

SEQ ID NO: 101814 - protein, 17 aa, Homo sapiens
  heavy chain complementarity determining region 3 for antibody 50907
TRSSMVTSGGVIGIFGY

SEQ ID NO: 101815 - protein, 8 aa, Homo sapiens
  light chain complementarity determining region 3 for antibody 50908
QQYGGFWT

SEQ ID NO: 101816 - protein, 18 aa, Homo sapiens
  heavy chain complementarity determining region 3 for antibody 50908
ASRLSSLDAQSGWKASDI

SEQ ID NO: 101817 - protein, 9 aa, Homo sapiens
  light chain complementarity determining region 3 for antibody 50909
QQYDSFPLT

SEQ ID NO: 101818 - protein, 18 aa, Homo sapiens
  heavy chain complementarity determining region 3 for antibody 50909
ARVPPYSSSVRGYYGMDV

SEQ ID NO: 101819 - protein, 9 aa, Homo sapiens
  light chain complementarity determining region 3 for antibody 50910
QQVKSYPLT

SEQ ID NO: 101820 - protein, 12 aa, Homo sapiens
  heavy chain complementarity determining region 3 for antibody 50910
ARAGDYGDYADY

SEQ ID NO: 101821 - protein, 9 aa, Homo sapiens
  light chain complementarity determining region 3 for antibody 50911
QQSYSTPWT

SEQ ID NO: 101822 - protein, 12 aa, Homo sapiens
  heavy chain complementarity determining region 3 for antibody 50911
ARVDSSRWYWVY

SEQ ID NO: 101823 - protein, 9 aa, Homo sapiens
  light chain complementarity determining region 3 for antibody 50912
QQSYSTLGT

SEQ ID NO: 101824 - protein, 13 aa, Homo sapiens
  heavy chain complementarity determining region 3 for antibody 50912
ARSFSGGMGGMDV

SEQ ID NO: 101825 - protein, 9 aa, Homo sapiens
  light chain complementarity determining region 3 for antibody 50913
QQSTSFPLT

SEQ ID NO: 101826 - protein, 19 aa, Homo sapiens
  heavy chain complementarity determining region 3 for antibody 50913
AKALGPYLSGANGGDAFDI

SEQ ID NO: 101827 - protein, 9 aa, Homo sapiens
  light chain complementarity determining region 3 for antibody 50914
QQRNSWPLT

SEQ ID NO: 101828 - protein, 10 aa, Homo sapiens
  heavy chain complementarity determining region 3 for antibody 50914
ARDHNWNYVD

SEQ ID NO: 101829 - protein, 9 aa, Homo sapiens
  light chain complementarity determining region 3 for antibody 50915
QQLNSYSHT

SEQ ID NO: 101830 - protein, 16 aa, Homo sapiens
  heavy chain complementarity determining region 3 for antibody 50915
ARTSYFGSGSFLPFDC

SEQ ID NO: 101831 - protein, 9 aa, Homo sapiens
  light chain complementarity determining region 3 for antibody 50916
QQLNSYPRT

SEQ ID NO: 101832 - protein, 16 aa, Homo sapiens
  heavy chain complementarity determining region 3 for antibody 50916
ARVAGLTTHGGWYFDL

SEQ ID NO: 101833 - protein, 9 aa, Homo sapiens
  light chain complementarity determining region 3 for antibody 50917
QQLNSYPRA

SEQ ID NO: 101834 - protein, 16 aa, Homo sapiens
  heavy chain complementarity determining region 3 for antibody 50917
ARVAGLTSHGGWYFDL

SEQ ID NO: 101835 - protein, 9 aa, Homo sapiens
  light chain complementarity determining region 3 for antibody 50918
QQLNSYLYT

SEQ ID NO: 101836 - protein, 15 aa, Homo sapiens
  heavy chain complementarity determining region 3 for antibody 50918
ARDLASSSWYVGLDY

SEQ ID NO: 101837 - protein, 9 aa, Homo sapiens
  light chain complementarity determining region 3 for antibody 50919
QQFAGSLYT

SEQ ID NO: 101838 - protein, 17 aa, Homo sapiens
  heavy chain complementarity determining region 3 for antibody 50919
ARPPHCSGGDCLGYFDL

SEQ ID NO: 101839 - protein, 9 aa, Homo sapiens
  light chain complementarity determining region 3 for antibody 50920
QLYVNSALT

SEQ ID NO: 101840 - protein, 11 aa, Homo sapiens
  heavy chain complementarity determining region 3 for antibody 50920
ARADYNDAFDV

SEQ ID NO: 101841 - protein, 9 aa, Homo sapiens
  light chain complementarity determining region 3 for antibody 50921
QEYNSAPLT

SEQ ID NO: 101842 - protein, 15 aa, Homo sapiens
  heavy chain complementarity determining region 3 for antibody 50921
ARDRGVVISPDAFDI

SEQ ID NO: 101843 - protein, 8 aa, Homo sapiens
  light chain complementarity determining region 3 for antibody 50922
LQYNSCYT

SEQ ID NO: 101844 - protein, 15 aa, Homo sapiens
  heavy chain complementarity determining region 3 for antibody 50922
AHPRLGYTYGFAFDY

SEQ ID NO: 101845 - protein, 9 aa, Homo sapiens
  light chain complementarity determining region 3 for antibody 50923
LQYNDWPRT

SEQ ID NO: 101846 - protein, 9 aa, Homo sapiens
  heavy chain complementarity determining region 3 for antibody 50923
VKNSGIWSF

SEQ ID NO: 101847 - protein, 9 aa, Homo sapiens
  light chain complementarity determining region 3 for antibody 50924
LQDYNYPLT

SEQ ID NO: 101848 - protein, 12 aa, Homo sapiens
  heavy chain complementarity determining region 3 for antibody 50924
AKRLTYADAFDI

SEQ ID NO: 101849 - protein, 9 aa, Homo sapiens
  light chain complementarity determining region 3 for antibody 50925
LQDHSFPYT

SEQ ID NO: 101850 - protein, 14 aa, Homo sapiens
  heavy chain complementarity determining region 3 for antibody 50925
ARDGYSSGGGVFDY

SEQ ID NO: 101851 - protein, 9 aa, Homo sapiens
  light chain complementarity determining region 3 for antibody 50926
HQYYSTPPT

SEQ ID NO: 101852 - protein, 19 aa, Homo sapiens
  heavy chain complementarity determining region 3 for antibody 50926
ARHLIPSEIPDAGHDAFDF

SEQ ID NO: 101853 - protein, 9 aa, Homo sapiens
  light chain complementarity determining region 3 for antibody 50927
HQYYNSPLT

SEQ ID NO: 101854 - protein, 14 aa, Homo sapiens
  heavy chain complementarity determining region 3 for antibody 50927
ATGSCGGDCFLLHY

SEQ ID NO: 101855 - protein, 9 aa, Homo sapiens
  light chain complementarity determining region 3 for antibody 50928
HQYINAPYT

SEQ ID NO: 101856 - protein, 12 aa, Homo sapiens
  heavy chain complementarity determining region 3 for antibody 50928
AREIAIAGTFDY

SEQ ID NO: 101857 - protein, 10 aa, Homo sapiens
  light chain complementarity determining region 3 for antibody 50929
HLYGNSLRGV

SEQ ID NO: 101858 - protein, 21 aa, Homo sapiens
  heavy chain complementarity determining region 3 for antibody 50929
ARDGPKRGWLGESLYPYYFDY

SEQ ID NO: 101859 - protein, 10 aa, Homo sapiens
  light chain complementarity determining region 3 for antibody 50930
RQYGSSPAWT

SEQ ID NO: 101860 - protein, 17 aa, Homo sapiens
  heavy chain complementarity determining region 3 for antibody 50930
TRVKYCSDGTCYTGTDY

SEQ ID NO: 101861 - protein, 9 aa, Homo sapiens
  light chain complementarity determining region 3 for antibody 50931
QQYYSTPLT

SEQ ID NO: 101862 - protein, 20 aa, Homo sapiens
  heavy chain complementarity determining region 3 for antibody 50931
ARDLTDYDSSGTRKNYYFDY

SEQ ID NO: 101863 - protein, 9 aa, Homo sapiens
  light chain complementarity determining region 3 for antibody 50932
QQYNSEPYT

SEQ ID NO: 101864 - protein, 13 aa, Homo sapiens
  heavy chain complementarity determining region 3 for antibody 50932
ARDSRAYGDDFDY

SEQ ID NO: 101865 - protein, 9 aa, Homo sapiens
  light chain complementarity determining region 3 for antibody 50933
QQYGSSPYT

SEQ ID NO: 101866 - protein, 15 aa, Homo sapiens
  heavy chain complementarity determining region 3 for antibody 50933
ARVQLGSVTYKVFDY

SEQ ID NO: 101867 - protein, 9 aa, Homo sapiens
  light chain complementarity determining region 3 for antibody 50934
QQYGSSPWT

SEQ ID NO: 101868 - protein, 14 aa, Homo sapiens
  heavy chain complementarity determining region 3 for antibody 50934
AIVRGWRGTTKIDP

SEQ ID NO: 101869 - protein, 9 aa, Homo sapiens
  light chain complementarity determining region 3 for antibody 50935
QQYGSSPIT

SEQ ID NO: 101870 - protein, 15 aa, Homo sapiens
  heavy chain complementarity determining region 3 for antibody 50935
AKERLQWLVPCYFEY

SEQ ID NO: 101871 - protein, 10 aa, Homo sapiens
  light chain complementarity determining region 3 for antibody 50936
QQYGSSPAWT

SEQ ID NO: 101872 - protein, 17 aa, Homo sapiens
  heavy chain complementarity determining region 3 for antibody 50936
TRVKYCSDGTCYTGADY

SEQ ID NO: 101873 - protein, 8 aa, Homo sapiens
  light chain complementarity determining region 3 for antibody 50937
QQYGSFFT

SEQ ID NO: 101874 - protein, 14 aa, Homo sapiens
  heavy chain complementarity determining region 3 for antibody 50937
ARHGESSAWSYFDS

SEQ ID NO: 101875 - protein, 10 aa, Homo sapiens
  light chain complementarity determining region 3 for antibody 50938
QQYGGSPPIT

SEQ ID NO: 101876 - protein, 9 aa, Homo sapiens
  heavy chain complementarity determining region 3 for antibody 50938
TTGDDGHAI

SEQ ID NO: 101877 - protein, 9 aa, Homo sapiens
  light chain complementarity determining region 3 for antibody 50939
QQYDNLPRT

SEQ ID NO: 101878 - protein, 15 aa, Homo sapiens
  heavy chain complementarity determining region 3 for antibody 50939
ASLPTTWGSFETQNL

SEQ ID NO: 101879 - protein, 9 aa, Homo sapiens
  light chain complementarity determining region 3 for antibody 50940
QQYDNLPRT

SEQ ID NO: 101880 - protein, 15 aa, Homo sapiens
  heavy chain complementarity determining region 3 for antibody 50940
ASLPTTWGGFETQNP

SEQ ID NO: 101881 - protein, 9 aa, Homo sapiens
  light chain complementarity determining region 3 for antibody 50941
QQSYTTPYT

SEQ ID NO: 101882 - protein, 15 aa, Homo sapiens
  heavy chain complementarity determining region 3 for antibody 50941
ARGWVGAAGYWYFDL

SEQ ID NO: 101883 - protein, 9 aa, Homo sapiens
  light chain complementarity determining region 3 for antibody 50942
QQSYSTPVA

SEQ ID NO: 101884 - protein, 9 aa, Homo sapiens
  heavy chain complementarity determining region 3 for antibody 50942
ARAIRGFDY

SEQ ID NO: 101885 - protein, 9 aa, Homo sapiens
  light chain complementarity determining region 3 for antibody 50943
QQSYSTPRT

SEQ ID NO: 101886 - protein, 13 aa, Homo sapiens
  heavy chain complementarity determining region 3 for antibody 50943
ARTVGGSSGWSDY

SEQ ID NO: 101887 - protein, 9 aa, Homo sapiens
  light chain complementarity determining region 3 for antibody 50944
QQSYSTLWT

SEQ ID NO: 101888 - protein, 13 aa, Homo sapiens
  heavy chain complementarity determining region 3 for antibody 50944
ARRDNVDYLGLDY

SEQ ID NO: 101889 - protein, 9 aa, Homo sapiens
  light chain complementarity determining region 3 for antibody 50945
QQSYISPPT

SEQ ID NO: 101890 - protein, 16 aa, Homo sapiens
  heavy chain complementarity determining region 3 for antibody 50945
SRDHQLHGGSSGVFAY

SEQ ID NO: 101891 - protein, 9 aa, Homo sapiens
  light chain complementarity determining region 3 for antibody 50946
QQSQTMSRT

SEQ ID NO: 101892 - protein, 12 aa, Homo sapiens
  heavy chain complementarity determining region 3 for antibody 50946
ARDRDGDYYFDY

SEQ ID NO: 101893 - protein, 9 aa, Homo sapiens
  light chain complementarity determining region 3 for antibody 50947
QQSQSMPCT

SEQ ID NO: 101894 - protein, 17 aa, Homo sapiens
  heavy chain complementarity determining region 3 for antibody 50947
ARIDDGVVRDDYYAMDV

SEQ ID NO: 101895 - protein, 9 aa, Homo sapiens
  light chain complementarity determining region 3 for antibody 50948
QQSFTVPFT

SEQ ID NO: 101896 - protein, 16 aa, Homo sapiens
  heavy chain complementarity determining region 3 for antibody 50948
ARAPLRYFDWLPPFDY

SEQ ID NO: 101897 - protein, 11 aa, Homo sapiens
  light chain complementarity determining region 3 for antibody 50949
QQRSNWPKVWT

SEQ ID NO: 101898 - protein, 16 aa, Homo sapiens
  heavy chain complementarity determining region 3 for antibody 50949
ARDIPNVWYSSGWYDY

SEQ ID NO: 101899 - protein, 9 aa, Homo sapiens
  light chain complementarity determining region 3 for antibody 50950
QQPNSFPLT

SEQ ID NO: 101900 - protein, 21 aa, Homo sapiens
  heavy chain complementarity determining region 3 for antibody 50950
ARGNCGGDCYSQFYYYYGMDV

SEQ ID NO: 101901 - protein, 9 aa, Homo sapiens
  light chain complementarity determining region 3 for antibody 50951
QQLKSYPVT

SEQ ID NO: 101902 - protein, 14 aa, Homo sapiens
  heavy chain complementarity determining region 3 for antibody 50951
ARENSVAGTRSFDY

SEQ ID NO: 101903 - protein, 9 aa, Homo sapiens
  light chain complementarity determining region 3 for antibody 50952
QQCGSSTGT

SEQ ID NO: 101904 - protein, 14 aa, Homo sapiens
  heavy chain complementarity determining region 3 for antibody 50952
AREKYDINGYGLDY

SEQ ID NO: 101905 - protein, 9 aa, Homo sapiens
  light chain complementarity determining region 3 for antibody 50953
QQANSFPLT

SEQ ID NO: 101906 - protein, 14 aa, Homo sapiens
  heavy chain complementarity determining region 3 for antibody 50953
AKRGSYSSKLYLDY

SEQ ID NO: 101907 - protein, 8 aa, Homo sapiens
  light chain complementarity determining region 3 for antibody 50954
QHYYNWPR

SEQ ID NO: 101908 - protein, 18 aa, Homo sapiens
  heavy chain complementarity determining region 3 for antibody 50954
AITYYDGSGNYGYYGLDV

SEQ ID NO: 101909 - protein, 8 aa, Homo sapiens
  light chain complementarity determining region 3 for antibody 50955
QHYNAYYT

SEQ ID NO: 101910 - protein, 15 aa, Homo sapiens
  heavy chain complementarity determining region 3 for antibody 50955
VKNLDLLASLDVFHV

SEQ ID NO: 101911 - protein, 8 aa, Homo sapiens
  light chain complementarity determining region 3 for antibody 50956
QHYGSSYT

SEQ ID NO: 101912 - protein, 14 aa, Homo sapiens
  heavy chain complementarity determining region 3 for antibody 50956
ARTTYYYDSSPFDP

SEQ ID NO: 101913 - protein, 11 aa, Homo sapiens
  light chain complementarity determining region 3 for antibody 50957
QHRNNWPPGST

SEQ ID NO: 101914 - protein, 12 aa, Homo sapiens
  heavy chain complementarity determining region 3 for antibody 50957
APDRSDYGDPGA

SEQ ID NO: 101915 - protein, 9 aa, Homo sapiens
  light chain complementarity determining region 3 for antibody 50958
MQALQTPWT

SEQ ID NO: 101916 - protein, 13 aa, Homo sapiens
  heavy chain complementarity determining region 3 for antibody 50958
ARVVYSGNQRFDY

SEQ ID NO: 101917 - protein, 10 aa, Homo sapiens
  light chain complementarity determining region 3 for antibody 50959
LQYGGSVLWT

SEQ ID NO: 101918 - protein, 14 aa, Homo sapiens
  heavy chain complementarity determining region 3 for antibody 50959
ASQLLYPYYSEMDV

SEQ ID NO: 101919 - protein, 9 aa, Homo sapiens
  light chain complementarity determining region 3 for antibody 50960
LQHNSYPWT

SEQ ID NO: 101920 - protein, 16 aa, Homo sapiens
  heavy chain complementarity determining region 3 for antibody 50960
ASSRYYYDSSGGLMDY

SEQ ID NO: 101921 - protein, 9 aa, Homo sapiens
  light chain complementarity determining region 3 for antibody 50961
LQHKIHPNT

SEQ ID NO: 101922 - protein, 7 aa, Homo sapiens
  heavy chain complementarity determining region 3 for antibody 50961
GSRWADL

SEQ ID NO: 101923 - protein, 9 aa, Homo sapiens
  light chain complementarity determining region 3 for antibody 50962
LQDYNYPRT

SEQ ID NO: 101924 - protein, 18 aa, Homo sapiens
  heavy chain complementarity determining region 3 for antibody 50962
ARDANPSYSVTYYDAFDI

SEQ ID NO: 101925 - protein, 9 aa, Homo sapiens
  light chain complementarity determining region 3 for antibody 50963
LQALHFPYT

SEQ ID NO: 101926 - protein, 11 aa, Homo sapiens
  heavy chain complementarity determining region 3 for antibody 50963
ARTPGRGGFDY

SEQ ID NO: 101927 - protein, 11 aa, Homo sapiens
  light chain complementarity determining region 3 for antibody 50964
LHRTNWPPDFT

SEQ ID NO: 101928 - protein, 17 aa, Homo sapiens
  heavy chain complementarity determining region 3 for antibody 50964
ATIYCSGGACYSTKFDY

SEQ ID NO: 101929 - protein, 10 aa, Homo sapiens
  light chain complementarity determining region 3 for antibody 50965
QQYYSTPQLT

SEQ ID NO: 101930 - protein, 10 aa, Homo sapiens
  heavy chain complementarity determining region 3 for antibody 50965
ARDLQQGGDY

SEQ ID NO: 101931 - protein, 9 aa, Homo sapiens
  light chain complementarity determining region 3 for antibody 50966
QQYYSSPRT

SEQ ID NO: 101932 - protein, 20 aa, Homo sapiens
  heavy chain complementarity determining region 3 for antibody 50966
ARVSRSRDGYNPRWFRAFDI

SEQ ID NO: 101933 - protein, 9 aa, Homo sapiens
  light chain complementarity determining region 3 for antibody 50967
QQYSSYPYT

SEQ ID NO: 101934 - protein, 15 aa, Homo sapiens
  heavy chain complementarity determining region 3 for antibody 50967
AKGYSSAWYFWYFDL

SEQ ID NO: 101935 - protein, 9 aa, Homo sapiens
  light chain complementarity determining region 3 for antibody 50968
QQYRSYPVT

SEQ ID NO: 101936 - protein, 11 aa, Homo sapiens
  heavy chain complementarity determining region 3 for antibody 50968
GRDLRSRPIDY

SEQ ID NO: 101937 - protein, 9 aa, Homo sapiens
  light chain complementarity determining region 3 for antibody 50969
QQYNSYPRT

SEQ ID NO: 101938 - protein, 13 aa, Homo sapiens
  heavy chain complementarity determining region 3 for antibody 50969
ARGGSGWYPFVDY

SEQ ID NO: 101939 - protein, 8 aa, Homo sapiens
  light chain complementarity determining region 3 for antibody 50970
QQYNNWPT

SEQ ID NO: 101940 - protein, 24 aa, Homo sapiens
  heavy chain complementarity determining region 3 for antibody 50970
ATRAYRSGLYEADPGTSLPYYFEN

SEQ ID NO: 101941 - protein, 9 aa, Homo sapiens
  light chain complementarity determining region 3 for antibody 50971
QQYNDYPFT

SEQ ID NO: 101942 - protein, 24 aa, Homo sapiens
  heavy chain complementarity determining region 3 for antibody 50971
ARGGANVVVPDAVPRVRARWFFNL

SEQ ID NO: 101943 - protein, 9 aa, Homo sapiens
  light chain complementarity determining region 3 for antibody 50972
QQYLRSPPT

SEQ ID NO: 101944 - protein, 17 aa, Homo sapiens
  heavy chain complementarity determining region 3 for antibody 50972
ARGDYCTNVGCIGWFDS

SEQ ID NO: 101945 - protein, 9 aa, Homo sapiens
  light chain complementarity determining region 3 for antibody 50973
QQYHRYPLT

SEQ ID NO: 101946 - protein, 13 aa, Homo sapiens
  heavy chain complementarity determining region 3 for antibody 50973
AHTSSGNFYYLDS

SEQ ID NO: 101947 - protein, 9 aa, Homo sapiens
  light chain complementarity determining region 3 for antibody 50974
QQYGSSTGT

SEQ ID NO: 101948 - protein, 9 aa, Homo sapiens
  heavy chain complementarity determining region 3 for antibody 50974
TTGDDGHAI

SEQ ID NO: 101949 - protein, 9 aa, Homo sapiens
  light chain complementarity determining region 3 for antibody 50975
QQYGSSSWT

SEQ ID NO: 101950 - protein, 19 aa, Homo sapiens
  heavy chain complementarity determining region 3 for antibody 50975
ARGPLDDYVWGSYRSPFDY

SEQ ID NO: 101951 - protein, 9 aa, Homo sapiens
  light chain complementarity determining region 3 for antibody 50976
QQYGSSPYT

SEQ ID NO: 101952 - protein, 14 aa, Homo sapiens
  heavy chain complementarity determining region 3 for antibody 50976
ARLRYNYGDSGLDV

SEQ ID NO: 101953 - protein, 9 aa, Homo sapiens
  light chain complementarity determining region 3 for antibody 50977
QQYGSSPRT

SEQ ID NO: 101954 - protein, 22 aa, Homo sapiens
  heavy chain complementarity determining region 3 for antibody 50977
ARGGDYHDSSGYYYYEYYYMDV

SEQ ID NO: 101955 - protein, 10 aa, Homo sapiens
  light chain complementarity determining region 3 for antibody 50978
QQYGSSPMYT

SEQ ID NO: 101956 - protein, 15 aa, Homo sapiens
  heavy chain complementarity determining region 3 for antibody 50978
ARPGSPGTTRDAFDI

SEQ ID NO: 101957 - protein, 11 aa, Homo sapiens
  light chain complementarity determining region 3 for antibody 50979
QQYDNWPPMYT

SEQ ID NO: 101958 - protein, 16 aa, Homo sapiens
  heavy chain complementarity determining region 3 for antibody 50979
ARPAALAGTGEYYFDY

SEQ ID NO: 101959 - protein, 9 aa, Homo sapiens
  light chain complementarity determining region 3 for antibody 50980
QQYDNLPRT

SEQ ID NO: 101960 - protein, 15 aa, Homo sapiens
  heavy chain complementarity determining region 3 for antibody 50980
ASLPPTWGGFETQNL

SEQ ID NO: 101961 - protein, 9 aa, Homo sapiens
  light chain complementarity determining region 3 for antibody 50981
QQYDNFPFT

SEQ ID NO: 101962 - protein, 13 aa, Homo sapiens
  heavy chain complementarity determining region 3 for antibody 50981
ARSPDYYYYGMDV

SEQ ID NO: 101963 - protein, 10 aa, Homo sapiens
  light chain complementarity determining region 3 for antibody 50982
QQSYTTLPLT

SEQ ID NO: 101964 - protein, 18 aa, Homo sapiens
  heavy chain complementarity determining region 3 for antibody 50982
ARDAEMTTMVVGPWYFDL

SEQ ID NO: 101965 - protein, 9 aa, Homo sapiens
  light chain complementarity determining region 3 for antibody 50983
QQSYSTPPT

SEQ ID NO: 101966 - protein, 17 aa, Homo sapiens
  heavy chain complementarity determining region 3 for antibody 50983
ARDRGVVVVAAGGAFDF

SEQ ID NO: 101967 - protein, 9 aa, Homo sapiens
  light chain complementarity determining region 3 for antibody 50984
QQSYSTPLT

SEQ ID NO: 101968 - protein, 20 aa, Homo sapiens
  heavy chain complementarity determining region 3 for antibody 50984
ARVRGDRGTWGSAYYYYFDS

SEQ ID NO: 101969 - protein, 9 aa, Homo sapiens
  light chain complementarity determining region 3 for antibody 50985
QQSYSTPLT

SEQ ID NO: 101970 - protein, 10 aa, Homo sapiens
  heavy chain complementarity determining region 3 for antibody 50985
ARERGSVFDL

SEQ ID NO: 101971 - protein, 9 aa, Homo sapiens
  light chain complementarity determining region 3 for antibody 50986
QQSYIIPYT

SEQ ID NO: 101972 - protein, 17 aa, Homo sapiens
  heavy chain complementarity determining region 3 for antibody 50986
ARDAGPCVESNCHHFDL

SEQ ID NO: 101973 - protein, 9 aa, Homo sapiens
  light chain complementarity determining region 3 for antibody 50987
QQSGSSPLT

SEQ ID NO: 101974 - protein, 14 aa, Homo sapiens
  heavy chain complementarity determining region 3 for antibody 50987
AKGYLRGVFYWFDS

SEQ ID NO: 101975 - protein, 9 aa, Homo sapiens
  light chain complementarity determining region 3 for antibody 50988
QQSDSTPPT

SEQ ID NO: 101976 - protein, 14 aa, Homo sapiens
  heavy chain complementarity determining region 3 for antibody 50988
AKAPSGDDSFDFDY

SEQ ID NO: 101977 - protein, 8 aa, Homo sapiens
  light chain complementarity determining region 3 for antibody 50989
QQRSNGIT

SEQ ID NO: 101978 - protein, 10 aa, Homo sapiens
  heavy chain complementarity determining region 3 for antibody 50989
ARHWWDYLDL

SEQ ID NO: 101979 - protein, 9 aa, Homo sapiens
  light chain complementarity determining region 3 for antibody 50990
QQNYRTPST

SEQ ID NO: 101980 - protein, 20 aa, Homo sapiens
  heavy chain complementarity determining region 3 for antibody 50990
ARDGGLEYCSSTSCSKPFDY

SEQ ID NO: 101981 - protein, 9 aa, Homo sapiens
  light chain complementarity determining region 3 for antibody 50991
QQHRDYPIT

SEQ ID NO: 101982 - protein, 17 aa, Homo sapiens
  heavy chain complementarity determining region 3 for antibody 50991
VRDGRRWSDFYYYGMDV

SEQ ID NO: 101983 - protein, 8 aa, Homo sapiens
  light chain complementarity determining region 3 for antibody 50992
QQCDISRT

SEQ ID NO: 101984 - protein, 13 aa, Homo sapiens
  heavy chain complementarity determining region 3 for antibody 50992
ARDSYGGNRDFDC

SEQ ID NO: 101985 - protein, 7 aa, Homo sapiens
  light chain complementarity determining region 3 for antibody 50993
QQANSFP

SEQ ID NO: 101986 - protein, 6 aa, Homo sapiens
  heavy chain complementarity determining region 3 for antibody 50993
TTDFNY

SEQ ID NO: 101987 - protein, 12 aa, Homo sapiens
  light chain complementarity determining region 3 for antibody 50994
QQANSFPPEMLT

SEQ ID NO: 101988 - protein, 17 aa, Homo sapiens
  heavy chain complementarity determining region 3 for antibody 50994
ARSLPLYAIRKEYYFDY

SEQ ID NO: 101989 - protein, 10 aa, Homo sapiens
  light chain complementarity determining region 3 for antibody 50995
QHYGSSPPVT

SEQ ID NO: 101990 - protein, 15 aa, Homo sapiens
  heavy chain complementarity determining region 3 for antibody 50995
ARVKYFYTSGSYYRD

SEQ ID NO: 101991 - protein, 10 aa, Homo sapiens
  light chain complementarity determining region 3 for antibody 50996
QHSGSSWGYT

SEQ ID NO: 101992 - protein, 14 aa, Homo sapiens
  heavy chain complementarity determining region 3 for antibody 50996
TTDGFLEWLSGFDY

SEQ ID NO: 101993 - protein, 9 aa, Homo sapiens
  light chain complementarity determining region 3 for antibody 50997
QHLNGYPRS

SEQ ID NO: 101994 - protein, 12 aa, Homo sapiens
  heavy chain complementarity determining region 3 for antibody 50997
ARENIATDALDV

SEQ ID NO: 101995 - protein, 9 aa, Homo sapiens
  light chain complementarity determining region 3 for antibody 50998
QEYAATRRT

SEQ ID NO: 101996 - protein, 13 aa, Homo sapiens
  heavy chain complementarity determining region 3 for antibody 50998
ARGITYSYTCLDY

SEQ ID NO: 101997 - protein, 9 aa, Homo sapiens
  light chain complementarity determining region 3 for antibody 50999
MQATHWPFT

SEQ ID NO: 101998 - protein, 16 aa, Homo sapiens
  heavy chain complementarity determining region 3 for antibody 50999
AHYYWRNSDSSAIFES

SEQ ID NO: 101999 - protein, 9 aa, Homo sapiens
  light chain complementarity determining region 3 for antibody 51000
MQALQTPIT

SEQ ID NO: 102000 - protein, 10 aa, Homo sapiens
  heavy chain complementarity determining region 3 for antibody 51000
SGSIAVATSK

SEQ ID NO: 102001 - protein, 9 aa, Homo sapiens
  light chain complementarity determining region 3 for antibody 51001
LQDYNYPWT

SEQ ID NO: 102002 - protein, 17 aa, Homo sapiens
  heavy chain complementarity determining region 3 for antibody 51001
AHNRLDLTLGIDGHFDY

SEQ ID NO: 102003 - protein, 9 aa, Homo sapiens
  light chain complementarity determining region 3 for antibody 51002
HHYATSPQT

SEQ ID NO: 102004 - protein, 19 aa, Homo sapiens
  heavy chain complementarity determining region 3 for antibody 51002
ARAGGCGGSCYANYYALDV

SEQ ID NO: 102005 - protein, 9 aa, Homo sapiens
  light chain complementarity determining region 3 for antibody 51003
QQYYTTPVT

SEQ ID NO: 102006 - protein, 14 aa, Homo sapiens
  heavy chain complementarity determining region 3 for antibody 51003
AKYISSWYLDAFDI

SEQ ID NO: 102007 - protein, 9 aa, Homo sapiens
  light chain complementarity determining region 3 for antibody 51004
QQYYSYLYT

SEQ ID NO: 102008 - protein, 15 aa, Homo sapiens
  heavy chain complementarity determining region 3 for antibody 51004
ARVAPRAAGTGWFDP

SEQ ID NO: 102009 - protein, 9 aa, Homo sapiens
  light chain complementarity determining region 3 for antibody 51005
QQYYSTPLT

SEQ ID NO: 102010 - protein, 19 aa, Homo sapiens
  heavy chain complementarity determining region 3 for antibody 51005
ARGWSYLDTSGYPSYYFDH

SEQ ID NO: 102011 - protein, 9 aa, Homo sapiens
  light chain complementarity determining region 3 for antibody 51006
QQYYGSSWT

SEQ ID NO: 102012 - protein, 17 aa, Homo sapiens
  heavy chain complementarity determining region 3 for antibody 51006
LSRWAQYNSSPNDVFDI

SEQ ID NO: 102013 - protein, 9 aa, Homo sapiens
  light chain complementarity determining region 3 for antibody 51007
QQYNSFVFT

SEQ ID NO: 102014 - protein, 23 aa, Homo sapiens
  heavy chain complementarity determining region 3 for antibody 51007
ASHYYDYVSGSYHYNLRRHAFGI

SEQ ID NO: 102015 - protein, 9 aa, Homo sapiens
  light chain complementarity determining region 3 for antibody 51008
QQYNNYSWT

SEQ ID NO: 102016 - protein, 19 aa, Homo sapiens
  heavy chain complementarity determining region 3 for antibody 51008
AKSDGGLYTLINKNYQFDS

SEQ ID NO: 102017 - protein, 8 aa, Homo sapiens
  light chain complementarity determining region 3 for antibody 51009
QQYNNLGT

SEQ ID NO: 102018 - protein, 19 aa, Homo sapiens
  heavy chain complementarity determining region 3 for antibody 51009
AHSPFYYGSGSYYTSAFDI

SEQ ID NO: 102019 - protein, 9 aa, Homo sapiens
  light chain complementarity determining region 3 for antibody 51010
QQYGTSPQT

SEQ ID NO: 102020 - protein, 16 aa, Homo sapiens
  heavy chain complementarity determining region 3 for antibody 51010
ASTRQWRWYRGWYFDY

SEQ ID NO: 102021 - protein, 9 aa, Homo sapiens
  light chain complementarity determining region 3 for antibody 51011
QQYGSSPRT

SEQ ID NO: 102022 - protein, 13 aa, Homo sapiens
  heavy chain complementarity determining region 3 for antibody 51011
ARRGSAGVTDIDY

SEQ ID NO: 102023 - protein, 10 aa, Homo sapiens
  light chain complementarity determining region 3 for antibody 51012
QQYGSSPLYT

SEQ ID NO: 102024 - protein, 22 aa, Homo sapiens
  heavy chain complementarity determining region 3 for antibody 51012
ARASKAEGHYYYYRYSSPTFDY

SEQ ID NO: 102025 - protein, 9 aa, Homo sapiens
  light chain complementarity determining region 3 for antibody 51013
QQYGRSPGT

SEQ ID NO: 102026 - protein, 23 aa, Homo sapiens
  heavy chain complementarity determining region 3 for antibody 51013
ARGGIFLLPPSSGQLHSFSPLDV

SEQ ID NO: 102027 - protein, 8 aa, Homo sapiens
  light chain complementarity determining region 3 for antibody 51014
QQYGGFWT

SEQ ID NO: 102028 - protein, 18 aa, Homo sapiens
  heavy chain complementarity determining region 3 for antibody 51014
ASRLSSVDAKSGWQAVDI

SEQ ID NO: 102029 - protein, 9 aa, Homo sapiens
  light chain complementarity determining region 3 for antibody 51015
QQYDSYPWT

SEQ ID NO: 102030 - protein, 7 aa, Homo sapiens
  heavy chain complementarity determining region 3 for antibody 51015
SRGVFSG

SEQ ID NO: 102031 - protein, 9 aa, Homo sapiens
  light chain complementarity determining region 3 for antibody 51016
QQYDNLPRT

SEQ ID NO: 102032 - protein, 15 aa, Homo sapiens
  heavy chain complementarity determining region 3 for antibody 51016
ASLPTTGGGFETQNL

SEQ ID NO: 102033 - protein, 10 aa, Homo sapiens
  light chain complementarity determining region 3 for antibody 51017
QQYDNLPMYT

SEQ ID NO: 102034 - protein, 6 aa, Homo sapiens
  heavy chain complementarity determining region 3 for antibody 51017
AREGPT

SEQ ID NO: 102035 - protein, 9 aa, Homo sapiens
  light chain complementarity determining region 3 for antibody 51018
QQYDNLPLT

SEQ ID NO: 102036 - protein, 18 aa, Homo sapiens
  heavy chain complementarity determining region 3 for antibody 51018
ARGKILLWFGESTYAFDI

SEQ ID NO: 102037 - protein, 8 aa, Homo sapiens
  light chain complementarity determining region 3 for antibody 51019
QQYDKSRT

SEQ ID NO: 102038 - protein, 15 aa, Homo sapiens
  heavy chain complementarity determining region 3 for antibody 51019
ARVLGTTHATKDFQH

SEQ ID NO: 102039 - protein, 9 aa, Homo sapiens
  light chain complementarity determining region 3 for antibody 51020
QQYDDLPIT

SEQ ID NO: 102040 - protein, 15 aa, Homo sapiens
  heavy chain complementarity determining region 3 for antibody 51020
ARRRTSSYYYYGMDV

SEQ ID NO: 102041 - protein, 9 aa, Homo sapiens
  light chain complementarity determining region 3 for antibody 51021
QQSYSTPYT

SEQ ID NO: 102042 - protein, 13 aa, Homo sapiens
  heavy chain complementarity determining region 3 for antibody 51021
AREIVTVTKYLDY

SEQ ID NO: 102043 - protein, 9 aa, Homo sapiens
  light chain complementarity determining region 3 for antibody 51022
QQRSNWWLT

SEQ ID NO: 102044 - protein, 15 aa, Homo sapiens
  heavy chain complementarity determining region 3 for antibody 51022
AADAARGVVGYYFDI

SEQ ID NO: 102045 - protein, 10 aa, Homo sapiens
  light chain complementarity determining region 3 for antibody 51023
QQGSSWPPIT

SEQ ID NO: 102046 - protein, 17 aa, Homo sapiens
  heavy chain complementarity determining region 3 for antibody 51023
ARGNSSGHRLTYWYFDL

SEQ ID NO: 102047 - protein, 9 aa, Homo sapiens
  light chain complementarity determining region 3 for antibody 51024
QKYDSAPPT

SEQ ID NO: 102048 - protein, 22 aa, Homo sapiens
  heavy chain complementarity determining region 3 for antibody 51024
ARDRGRGFSGSGNYYIPYYFDY

SEQ ID NO: 102049 - protein, 11 aa, Homo sapiens
  light chain complementarity determining region 3 for antibody 51025
QHYNNWPPEYT

SEQ ID NO: 102050 - protein, 23 aa, Homo sapiens
  heavy chain complementarity determining region 3 for antibody 51025
ARQDDGEYQRPFARGYYYYAMDV

SEQ ID NO: 102051 - protein, 10 aa, Homo sapiens
  light chain complementarity determining region 3 for antibody 51026
QHRTNWPSWT

SEQ ID NO: 102052 - protein, 18 aa, Homo sapiens
  heavy chain complementarity determining region 3 for antibody 51026
VRGDASTWYRPYSYGMDV

SEQ ID NO: 102053 - protein, 9 aa, Homo sapiens
  light chain complementarity determining region 3 for antibody 51027
QHRSNWKGT

SEQ ID NO: 102054 - protein, 15 aa, Homo sapiens
  heavy chain complementarity determining region 3 for antibody 51027
ARDVGYSSTWEPFDY

SEQ ID NO: 102055 - protein, 9 aa, Homo sapiens
  light chain complementarity determining region 3 for antibody 51028
QEYYTYSRG

SEQ ID NO: 102056 - protein, 13 aa, Homo sapiens
  heavy chain complementarity determining region 3 for antibody 51028
ARAHHLGRSPFDL

SEQ ID NO: 102057 - protein, 9 aa, Homo sapiens
  light chain complementarity determining region 3 for antibody 51029
MQGTHWPYT

SEQ ID NO: 102058 - protein, 10 aa, Homo sapiens
  heavy chain complementarity determining region 3 for antibody 51029
VRDNWGSFDY

SEQ ID NO: 102059 - protein, 9 aa, Homo sapiens
  light chain complementarity determining region 3 for antibody 51030
LQGLQTPRT

SEQ ID NO: 102060 - protein, 17 aa, Homo sapiens
  heavy chain complementarity determining region 3 for antibody 51030
ARDMYYWDSAGYYAFDM

SEQ ID NO: 102061 - protein, 9 aa, Homo sapiens
  light chain complementarity determining region 3 for antibody 51031
HQPIAYPRT

SEQ ID NO: 102062 - protein, 19 aa, Homo sapiens
  heavy chain complementarity determining region 3 for antibody 51031
SRDGRAHPYSTGYYWYFDL

SEQ ID NO: 102063 - protein, 10 aa, Homo sapiens
  light chain complementarity determining region 3 for antibody 51032
QQYNNWPPKT

SEQ ID NO: 102064 - protein, 12 aa, Homo sapiens
  heavy chain complementarity determining region 3 for antibody 51032
AATITAIGTEYK

SEQ ID NO: 102065 - protein, 11 aa, Homo sapiens
  light chain complementarity determining region 3 for antibody 51033
QQYNNWPPALT

SEQ ID NO: 102066 - protein, 14 aa, Homo sapiens
  heavy chain complementarity determining region 3 for antibody 51033
ARDRGYGGYDALDI

SEQ ID NO: 102067 - protein, 10 aa, Homo sapiens
  light chain complementarity determining region 3 for antibody 51034
QQYNNWPMYT

SEQ ID NO: 102068 - protein, 12 aa, Homo sapiens
  heavy chain complementarity determining region 3 for antibody 51034
ARDHISGWALSN

SEQ ID NO: 102069 - protein, 9 aa, Homo sapiens
  light chain complementarity determining region 3 for antibody 51035
QQYGTSPQT

SEQ ID NO: 102070 - protein, 16 aa, Homo sapiens
  heavy chain complementarity determining region 3 for antibody 51035
ASTRQWRWHRGWYFDY

SEQ ID NO: 102071 - protein, 9 aa, Homo sapiens
  light chain complementarity determining region 3 for antibody 51036
QQYGSSSWT

SEQ ID NO: 102072 - protein, 15 aa, Homo sapiens
  heavy chain complementarity determining region 3 for antibody 51036
ARAQRAGVGFGNFDY

SEQ ID NO: 102073 - protein, 10 aa, Homo sapiens
  light chain complementarity determining region 3 for antibody 51037
QQYGSSRTWT

SEQ ID NO: 102074 - protein, 16 aa, Homo sapiens
  heavy chain complementarity determining region 3 for antibody 51037
VRDPRPTYYFDTGAYY

SEQ ID NO: 102075 - protein, 9 aa, Homo sapiens
  light chain complementarity determining region 3 for antibody 51038
QQYGSSPYT

SEQ ID NO: 102076 - protein, 24 aa, Homo sapiens
  heavy chain complementarity determining region 3 for antibody 51038
ARGRGHLWLREGLYYSGMATHFDY

SEQ ID NO: 102077 - protein, 9 aa, Homo sapiens
  light chain complementarity determining region 3 for antibody 51039
QQYGSSPST

SEQ ID NO: 102078 - protein, 20 aa, Homo sapiens
  heavy chain complementarity determining region 3 for antibody 51039
ARDREAVWFGDSLTYSVFDS

SEQ ID NO: 102079 - protein, 9 aa, Homo sapiens
  light chain complementarity determining region 3 for antibody 51040
QQYGSSPLT

SEQ ID NO: 102080 - protein, 21 aa, Homo sapiens
  heavy chain complementarity determining region 3 for antibody 51040
VEDYWTYYDFLSVHQPQPFDS

SEQ ID NO: 102081 - protein, 11 aa, Homo sapiens
  light chain complementarity determining region 3 for antibody 51041
QQYGSSFPTWT

SEQ ID NO: 102082 - protein, 16 aa, Homo sapiens
  heavy chain complementarity determining region 3 for antibody 51041
ARHSERWVLLWGGFDI

SEQ ID NO: 102083 - protein, 6 aa, Homo sapiens
  light chain complementarity determining region 3 for antibody 51042
QQYGET

SEQ ID NO: 102084 - protein, 12 aa, Homo sapiens
  heavy chain complementarity determining region 3 for antibody 51042
ARDHPSGWSLPS

SEQ ID NO: 102085 - protein, 10 aa, Homo sapiens
  light chain complementarity determining region 3 for antibody 51043
QQYDNVPQLT

SEQ ID NO: 102086 - protein, 19 aa, Homo sapiens
  heavy chain complementarity determining region 3 for antibody 51043
ARDRRHDSSSWYPIDALDV

SEQ ID NO: 102087 - protein, 9 aa, Homo sapiens
  light chain complementarity determining region 3 for antibody 51044
QQYDNLPLT

SEQ ID NO: 102088 - protein, 14 aa, Homo sapiens
  heavy chain complementarity determining region 3 for antibody 51044
ARDRDGSTFHYFDY

SEQ ID NO: 102089 - protein, 9 aa, Homo sapiens
  light chain complementarity determining region 3 for antibody 51045
QQYASPPIT

SEQ ID NO: 102090 - protein, 10 aa, Homo sapiens
  heavy chain complementarity determining region 3 for antibody 51045
VAGIGWQPDY

SEQ ID NO: 102091 - protein, 9 aa, Homo sapiens
  light chain complementarity determining region 3 for antibody 51046
QQSYSTLYT

SEQ ID NO: 102092 - protein, 12 aa, Homo sapiens
  heavy chain complementarity determining region 3 for antibody 51046
VREGPRTSHWKN

SEQ ID NO: 102093 - protein, 10 aa, Homo sapiens
  light chain complementarity determining region 3 for antibody 51047
QQSYSTLRFT

SEQ ID NO: 102094 - protein, 18 aa, Homo sapiens
  heavy chain complementarity determining region 3 for antibody 51047
ARAQQGGLVRGPRGALDI

SEQ ID NO: 102095 - protein, 9 aa, Homo sapiens
  light chain complementarity determining region 3 for antibody 51048
QQSYSTLLT

SEQ ID NO: 102096 - protein, 13 aa, Homo sapiens
  heavy chain complementarity determining region 3 for antibody 51048
ARSPSTGWYNFDF

SEQ ID NO: 102097 - protein, 9 aa, Homo sapiens
  light chain complementarity determining region 3 for antibody 51049
QQSYSMPWT

SEQ ID NO: 102098 - protein, 19 aa, Homo sapiens
  heavy chain complementarity determining region 3 for antibody 51049
AREGPIAAPGSFGQNWFDP

SEQ ID NO: 102099 - protein, 9 aa, Homo sapiens
  light chain complementarity determining region 3 for antibody 51050
QQSYSIPWT

SEQ ID NO: 102100 - protein, 21 aa, Homo sapiens
  heavy chain complementarity determining region 3 for antibody 51050
ARDLWSPPDDYGDNGSRLFDP

SEQ ID NO: 102101 - protein, 9 aa, Homo sapiens
  light chain complementarity determining region 3 for antibody 51051
QQSSNTPRT

SEQ ID NO: 102102 - protein, 9 aa, Homo sapiens
  heavy chain complementarity determining region 3 for antibody 51051
TTGDDGHAI

SEQ ID NO: 102103 - protein, 9 aa, Homo sapiens
  light chain complementarity determining region 3 for antibody 51052
QQSFSTPWT

SEQ ID NO: 102104 - protein, 18 aa, Homo sapiens
  heavy chain complementarity determining region 3 for antibody 51052
ARGTPRGQYNILPYYFDY

SEQ ID NO: 102105 - protein, 9 aa, Homo sapiens
  light chain complementarity determining region 3 for antibody 51053
QQRSNWPLT

SEQ ID NO: 102106 - protein, 11 aa, Homo sapiens
  heavy chain complementarity determining region 3 for antibody 51053
VRDDDRYGLDY

SEQ ID NO: 102107 - protein, 10 aa, Homo sapiens
  light chain complementarity determining region 3 for antibody 51054
QQRKYWPPIT

SEQ ID NO: 102108 - protein, 14 aa, Homo sapiens
  heavy chain complementarity determining region 3 for antibody 51054
ARVGTYVYQRWFDP

SEQ ID NO: 102109 - protein, 9 aa, Homo sapiens
  light chain complementarity determining region 3 for antibody 51055
QQLNSYPFT

SEQ ID NO: 102110 - protein, 21 aa, Homo sapiens
  heavy chain complementarity determining region 3 for antibody 51055
ARTVGIAVAGTLLYYYYGMDV

SEQ ID NO: 102111 - protein, 9 aa, Homo sapiens
  light chain complementarity determining region 3 for antibody 51056
QQLNSFPRT

SEQ ID NO: 102112 - protein, 18 aa, Homo sapiens
  heavy chain complementarity determining region 3 for antibody 51056
AREAHYCTNGVCYNLNDY

SEQ ID NO: 102113 - protein, 9 aa, Homo sapiens
  light chain complementarity determining region 3 for antibody 51057
QQIYSTLLT

SEQ ID NO: 102114 - protein, 17 aa, Homo sapiens
  heavy chain complementarity determining region 3 for antibody 51057
ARERGGGYYDSSGTFDP

SEQ ID NO: 102115 - protein, 9 aa, Homo sapiens
  light chain complementarity determining region 3 for antibody 51058
QQFNTSPWT

SEQ ID NO: 102116 - protein, 10 aa, Homo sapiens
  heavy chain complementarity determining region 3 for antibody 51058
ARDYSSGFDH

SEQ ID NO: 102117 - protein, 9 aa, Homo sapiens
  light chain complementarity determining region 3 for antibody 51059
QQAHSFPLT

SEQ ID NO: 102118 - protein, 11 aa, Homo sapiens
  heavy chain complementarity determining region 3 for antibody 51059
ARSPYPYFFDY

SEQ ID NO: 102119 - protein, 9 aa, Homo sapiens
  light chain complementarity determining region 3 for antibody 51060
QQAASFPIT

SEQ ID NO: 102120 - protein, 17 aa, Homo sapiens
  heavy chain complementarity determining region 3 for antibody 51060
AKGPAPDNWTSGHFFDY

SEQ ID NO: 102121 - protein, 9 aa, Homo sapiens
  light chain complementarity determining region 3 for antibody 51061
QHYNGSPYT

SEQ ID NO: 102122 - protein, 14 aa, Homo sapiens
  heavy chain complementarity determining region 3 for antibody 51061
ARKRIGGSYHYLDY

SEQ ID NO: 102123 - protein, 9 aa, Homo sapiens
  light chain complementarity determining region 3 for antibody 51062
MQALQTPYT

SEQ ID NO: 102124 - protein, 16 aa, Homo sapiens
  heavy chain complementarity determining region 3 for antibody 51062
ARQVAVGRGYYYGFDV

SEQ ID NO: 102125 - protein, 9 aa, Homo sapiens
  light chain complementarity determining region 3 for antibody 51063
MQALQTPWT

SEQ ID NO: 102126 - protein, 5 aa, Homo sapiens
  heavy chain complementarity determining region 3 for antibody 51063
TTDGY

SEQ ID NO: 102127 - protein, 9 aa, Homo sapiens
  light chain complementarity determining region 3 for antibody 51064
LQHSTYPWT

SEQ ID NO: 102128 - protein, 15 aa, Homo sapiens
  heavy chain complementarity determining region 3 for antibody 51064
ARGGSGGDWYTLGDY

SEQ ID NO: 102129 - protein, 10 aa, Homo sapiens
  light chain complementarity determining region 3 for antibody 51065
HQYHNWPLFT

SEQ ID NO: 102130 - protein, 13 aa, Homo sapiens
  heavy chain complementarity determining region 3 for antibody 51065
ARARGYSYGWIDY

SEQ ID NO: 102131 - protein, 9 aa, Homo sapiens
  light chain complementarity determining region 3 for antibody 51066
RQYDNLPRT

SEQ ID NO: 102132 - protein, 15 aa, Homo sapiens
  heavy chain complementarity determining region 3 for antibody 51066
ASLPTTWGGFETQNL

SEQ ID NO: 102133 - protein, 9 aa, Homo sapiens
  light chain complementarity determining region 3 for antibody 51067
QQYYSVPLT

SEQ ID NO: 102134 - protein, 12 aa, Homo sapiens
  heavy chain complementarity determining region 3 for antibody 51067
ARSGLDTDYYDS

SEQ ID NO: 102135 - protein, 9 aa, Homo sapiens
  light chain complementarity determining region 3 for antibody 51068
QQYYSTPFT

SEQ ID NO: 102136 - protein, 19 aa, Homo sapiens
  heavy chain complementarity determining region 3 for antibody 51068
ARLGSFGVYGSGSYSAFDF

SEQ ID NO: 102137 - protein, 6 aa, Homo sapiens
  light chain complementarity determining region 3 for antibody 51069
QQYRET

SEQ ID NO: 102138 - protein, 12 aa, Homo sapiens
  heavy chain complementarity determining region 3 for antibody 51069
ARDHPSGWSLSS

SEQ ID NO: 102139 - protein, 9 aa, Homo sapiens
  light chain complementarity determining region 3 for antibody 51070
QQYQNYAWT

SEQ ID NO: 102140 - protein, 16 aa, Homo sapiens
  heavy chain complementarity determining region 3 for antibody 51070
ARRRDYDSGGHDAFDI

SEQ ID NO: 102141 - protein, 9 aa, Homo sapiens
  light chain complementarity determining region 3 for antibody 51071
QQYNTFPTT

SEQ ID NO: 102142 - protein, 14 aa, Homo sapiens
  heavy chain complementarity determining region 3 for antibody 51071
VRELGRLGEFYFTY

SEQ ID NO: 102143 - protein, 10 aa, Homo sapiens
  light chain complementarity determining region 3 for antibody 51072
QQYNNWRPCT

SEQ ID NO: 102144 - protein, 12 aa, Homo sapiens
  heavy chain complementarity determining region 3 for antibody 51072
ARPRNLWRYFDY

SEQ ID NO: 102145 - protein, 13 aa, Homo sapiens
  light chain complementarity determining region 3 for antibody 51073
QQYNNWPPRRMYT

SEQ ID NO: 102146 - protein, 20 aa, Homo sapiens
  heavy chain complementarity determining region 3 for antibody 51073
ARAYCLGGSCYGIGYHGLDV

SEQ ID NO: 102147 - protein, 10 aa, Homo sapiens
  light chain complementarity determining region 3 for antibody 51074
QQYNHWPPIT

SEQ ID NO: 102148 - protein, 15 aa, Homo sapiens
  heavy chain complementarity determining region 3 for antibody 51074
ARPFWSSATNNWFDP

SEQ ID NO: 102149 - protein, 10 aa, Homo sapiens
  light chain complementarity determining region 3 for antibody 51075
QQYGSSSSLT

SEQ ID NO: 102150 - protein, 15 aa, Homo sapiens
  heavy chain complementarity determining region 3 for antibody 51075
AAGDSSGWYSRYFHH

SEQ ID NO: 102151 - protein, 9 aa, Homo sapiens
  light chain complementarity determining region 3 for antibody 51076
QQYGSSPLT

SEQ ID NO: 102152 - protein, 19 aa, Homo sapiens
  heavy chain complementarity determining region 3 for antibody 51076
ARGRYYDSRANPRFPHFDP

SEQ ID NO: 102153 - protein, 9 aa, Homo sapiens
  light chain complementarity determining region 3 for antibody 51077
QQYGSSPFT

SEQ ID NO: 102154 - protein, 17 aa, Homo sapiens
  heavy chain complementarity determining region 3 for antibody 51077
ARSLETWTGYFPGAFDS

SEQ ID NO: 102155 - protein, 8 aa, Homo sapiens
  light chain complementarity determining region 3 for antibody 51078
QQYGSSIT

SEQ ID NO: 102156 - protein, 17 aa, Homo sapiens
  heavy chain complementarity determining region 3 for antibody 51078
AKDSGYRKYYYYQVLDV

SEQ ID NO: 102157 - protein, 9 aa, Homo sapiens
  light chain complementarity determining region 3 for antibody 51079
QQYGNSLFT

SEQ ID NO: 102158 - protein, 19 aa, Homo sapiens
  heavy chain complementarity determining region 3 for antibody 51079
AREGPHIAYRASGRRPFDY

SEQ ID NO: 102159 - protein, 9 aa, Homo sapiens
  light chain complementarity determining region 3 for antibody 51080
QQYGNLPRT

SEQ ID NO: 102160 - protein, 15 aa, Homo sapiens
  heavy chain complementarity determining region 3 for antibody 51080
ASLPTTWGGFETQNL

SEQ ID NO: 102161 - protein, 8 aa, Homo sapiens
  light chain complementarity determining region 3 for antibody 51081
QQYGDSIT

SEQ ID NO: 102162 - protein, 13 aa, Homo sapiens
  heavy chain complementarity determining region 3 for antibody 51081
ARAPFTFDWHFDL

SEQ ID NO: 102163 - protein, 6 aa, Homo sapiens
  light chain complementarity determining region 3 for antibody 51082
QQYDRA

SEQ ID NO: 102164 - protein, 17 aa, Homo sapiens
  heavy chain complementarity determining region 3 for antibody 51082
ARQGYDSRLGYYYAMDV

SEQ ID NO: 102165 - protein, 9 aa, Homo sapiens
  light chain complementarity determining region 3 for antibody 51083
QQYDNLPRT

SEQ ID NO: 102166 - protein, 15 aa, Homo sapiens
  heavy chain complementarity determining region 3 for antibody 51083
ASLPTTWGGFETLNL

SEQ ID NO: 102167 - protein, 11 aa, Homo sapiens
  light chain complementarity determining region 3 for antibody 51084
QQYDNLPPLLT

SEQ ID NO: 102168 - protein, 14 aa, Homo sapiens
  heavy chain complementarity determining region 3 for antibody 51084
ARSRVDYYYYGMDV

SEQ ID NO: 102169 - protein, 8 aa, Homo sapiens
  light chain complementarity determining region 3 for antibody 51085
QQYDMWPT

SEQ ID NO: 102170 - protein, 16 aa, Homo sapiens
  heavy chain complementarity determining region 3 for antibody 51085
ARLLGGQHGVRSLIGH

SEQ ID NO: 102171 - protein, 8 aa, Homo sapiens
  light chain complementarity determining region 3 for antibody 51086
QQTYSTPT

SEQ ID NO: 102172 - protein, 16 aa, Homo sapiens
  heavy chain complementarity determining region 3 for antibody 51086
NTVDLRTRPPTDALDI

SEQ ID NO: 102173 - protein, 10 aa, Homo sapiens
  light chain complementarity determining region 3 for antibody 51087
QQSYSTPPLT

SEQ ID NO: 102174 - protein, 17 aa, Homo sapiens
  heavy chain complementarity determining region 3 for antibody 51087
AKDRGGKQLWLDGTFDY

SEQ ID NO: 102175 - protein, 10 aa, Homo sapiens
  light chain complementarity determining region 3 for antibody 51088
QQSYSTPGCT

SEQ ID NO: 102176 - protein, 18 aa, Homo sapiens
  heavy chain complementarity determining region 3 for antibody 51088
ARGIGIQVWPSLDYGGDS

SEQ ID NO: 102177 - protein, 9 aa, Homo sapiens
  light chain complementarity determining region 3 for antibody 51089
QQSYSSPFN

SEQ ID NO: 102178 - protein, 14 aa, Homo sapiens
  heavy chain complementarity determining region 3 for antibody 51089
ARRIRGDHYYGLDV

SEQ ID NO: 102179 - protein, 9 aa, Homo sapiens
  light chain complementarity determining region 3 for antibody 51090
QQSYSLPGT

SEQ ID NO: 102180 - protein, 18 aa, Homo sapiens
  heavy chain complementarity determining region 3 for antibody 51090
ARTKDDSIWGNYRWGFDS

SEQ ID NO: 102181 - protein, 8 aa, Homo sapiens
  light chain complementarity determining region 3 for antibody 51091
QQRSNWLS

SEQ ID NO: 102182 - protein, 13 aa, Homo sapiens
  heavy chain complementarity determining region 3 for antibody 51091
ARTAAGTMEAFDI

SEQ ID NO: 102183 - protein, 9 aa, Homo sapiens
  light chain complementarity determining region 3 for antibody 51092
QQLHSYMCT

SEQ ID NO: 102184 - protein, 11 aa, Homo sapiens
  heavy chain complementarity determining region 3 for antibody 51092
ARGAWSDALDL

SEQ ID NO: 102185 - protein, 9 aa, Homo sapiens
  light chain complementarity determining region 3 for antibody 51093
QQCYSFPYT

SEQ ID NO: 102186 - protein, 14 aa, Homo sapiens
  heavy chain complementarity determining region 3 for antibody 51093
ARKMGWDGVAWFDP

SEQ ID NO: 102187 - protein, 10 aa, Homo sapiens
  light chain complementarity determining region 3 for antibody 51094
QQAHRFPPYT

SEQ ID NO: 102188 - protein, 11 aa, Homo sapiens
  heavy chain complementarity determining region 3 for antibody 51094
VATPHKYYFDH

SEQ ID NO: 102189 - protein, 11 aa, Homo sapiens
  light chain complementarity determining region 3 for antibody 51095
QLYGTSPPRFT

SEQ ID NO: 102190 - protein, 12 aa, Homo sapiens
  heavy chain complementarity determining region 3 for antibody 51095
ARYMGDYYAFDI

SEQ ID NO: 102191 - protein, 9 aa, Homo sapiens
  light chain complementarity determining region 3 for antibody 51096
QHRSNWQGT

SEQ ID NO: 102192 - protein, 15 aa, Homo sapiens
  heavy chain complementarity determining region 3 for antibody 51096
ARDVGYSSTWEPFDY

SEQ ID NO: 102193 - protein, 9 aa, Homo sapiens
  light chain complementarity determining region 3 for antibody 51097
QHFNGFPVT

SEQ ID NO: 102194 - protein, 17 aa, Homo sapiens
  heavy chain complementarity determining region 3 for antibody 51097
AKETGERGSSFESYLDY

SEQ ID NO: 102195 - protein, 9 aa, Homo sapiens
  light chain complementarity determining region 3 for antibody 51098
MQTTDWPFA

SEQ ID NO: 102196 - protein, 11 aa, Homo sapiens
  heavy chain complementarity determining region 3 for antibody 51098
ATELWGPAVDC

SEQ ID NO: 102197 - protein, 9 aa, Homo sapiens
  light chain complementarity determining region 3 for antibody 51099
MQALRSPLT

SEQ ID NO: 102198 - protein, 13 aa, Homo sapiens
  heavy chain complementarity determining region 3 for antibody 51099
ARGNQQLVNLFDL

SEQ ID NO: 102199 - protein, 9 aa, Homo sapiens
  light chain complementarity determining region 3 for antibody 51100
HHFDTSRWT

SEQ ID NO: 102200 - protein, 13 aa, Homo sapiens
  heavy chain complementarity determining region 3 for antibody 51100
LQWLVLGPSVFDI

SEQ ID NO: 102201 - protein, 9 aa, Homo sapiens
  light chain complementarity determining region 3 for antibody 51101
QQYYSTPAH

SEQ ID NO: 102202 - protein, 12 aa, Homo sapiens
  heavy chain complementarity determining region 3 for antibody 51101
ARGGGGAGYFDY

SEQ ID NO: 102203 - protein, 9 aa, Homo sapiens
  light chain complementarity determining region 3 for antibody 51102
QQYYSTLGT

SEQ ID NO: 102204 - protein, 9 aa, Homo sapiens
  heavy chain complementarity determining region 3 for antibody 51102
ARDPNYFDY

SEQ ID NO: 102205 - protein, 10 aa, Homo sapiens
  light chain complementarity determining region 3 for antibody 51103
QQYTDWLRGT

SEQ ID NO: 102206 - protein, 19 aa, Homo sapiens
  heavy chain complementarity determining region 3 for antibody 51103
ARHAARYSSGWYPNYGMDV

SEQ ID NO: 102207 - protein, 8 aa, Homo sapiens
  light chain complementarity determining region 3 for antibody 51104
QQYNTYTK

SEQ ID NO: 102208 - protein, 20 aa, Homo sapiens
  heavy chain complementarity determining region 3 for antibody 51104
ARDRVVAGSKNHLYYYGLDV

SEQ ID NO: 102209 - protein, 10 aa, Homo sapiens
  light chain complementarity determining region 3 for antibody 51105
QQYNTYSSFT

SEQ ID NO: 102210 - protein, 14 aa, Homo sapiens
  heavy chain complementarity determining region 3 for antibody 51105
ARSPEGKEGGYLDY

SEQ ID NO: 102211 - protein, 9 aa, Homo sapiens
  light chain complementarity determining region 3 for antibody 51106
QQYNSYSYT

SEQ ID NO: 102212 - protein, 8 aa, Homo sapiens
  heavy chain complementarity determining region 3 for antibody 51106
ARDGADGY

SEQ ID NO: 102213 - protein, 10 aa, Homo sapiens
  light chain complementarity determining region 3 for antibody 51107
QQYNSYSPYT

SEQ ID NO: 102214 - protein, 13 aa, Homo sapiens
  heavy chain complementarity determining region 3 for antibody 51107
ARPGSSWYWPFDI

SEQ ID NO: 102215 - protein, 9 aa, Homo sapiens
  light chain complementarity determining region 3 for antibody 51108
QQYNNWPLT

SEQ ID NO: 102216 - protein, 20 aa, Homo sapiens
  heavy chain complementarity determining region 3 for antibody 51108
ARSIAGRSITGRLTTFYFDY

SEQ ID NO: 102217 - protein, 9 aa, Homo sapiens
  light chain complementarity determining region 3 for antibody 51109
QQYLDILYT

SEQ ID NO: 102218 - protein, 17 aa, Homo sapiens
  heavy chain complementarity determining region 3 for antibody 51109
ARDKDFLSGQQRRDFDY

SEQ ID NO: 102219 - protein, 9 aa, Homo sapiens
  light chain complementarity determining region 3 for antibody 51110
QQYKSYEYT

SEQ ID NO: 102220 - protein, 16 aa, Homo sapiens
  heavy chain complementarity determining region 3 for antibody 51110
ARNTHDFGDSYDAFHI

SEQ ID NO: 102221 - protein, 9 aa, Homo sapiens
  light chain complementarity determining region 3 for antibody 51111
QQYGSSPQT

SEQ ID NO: 102222 - protein, 15 aa, Homo sapiens
  heavy chain complementarity determining region 3 for antibody 51111
ASGEGNGTGWPFFDF

SEQ ID NO: 102223 - protein, 10 aa, Homo sapiens
  light chain complementarity determining region 3 for antibody 51112
QQYGSSPPIT

SEQ ID NO: 102224 - protein, 9 aa, Homo sapiens
  heavy chain complementarity determining region 3 for antibody 51112
TTGDDGHDI

SEQ ID NO: 102225 - protein, 10 aa, Homo sapiens
  light chain complementarity determining region 3 for antibody 51113
QQYGSSPLFT

SEQ ID NO: 102226 - protein, 9 aa, Homo sapiens
  heavy chain complementarity determining region 3 for antibody 51113
ARGMEIIVY

SEQ ID NO: 102227 - protein, 9 aa, Homo sapiens
  light chain complementarity determining region 3 for antibody 51114
QQYGSSLWT

SEQ ID NO: 102228 - protein, 12 aa, Homo sapiens
  heavy chain complementarity determining region 3 for antibody 51114
ARVGHHPSNMDV

SEQ ID NO: 102229 - protein, 9 aa, Homo sapiens
  light chain complementarity determining region 3 for antibody 51115
QQYGRSPTT

SEQ ID NO: 102230 - protein, 16 aa, Homo sapiens
  heavy chain complementarity determining region 3 for antibody 51115
AKVQTLYSSSWRVFDY

SEQ ID NO: 102231 - protein, 9 aa, Homo sapiens
  light chain complementarity determining region 3 for antibody 51116
QQYDNLPRT

SEQ ID NO: 102232 - protein, 15 aa, Homo sapiens
  heavy chain complementarity determining region 3 for antibody 51116
ASLPTTWGGFETQTL

SEQ ID NO: 102233 - protein, 9 aa, Homo sapiens
  light chain complementarity determining region 3 for antibody 51117
QQYDNLPRT

SEQ ID NO: 102234 - protein, 15 aa, Homo sapiens
  heavy chain complementarity determining region 3 for antibody 51117
ASLPTTWGGFDTQNL

SEQ ID NO: 102235 - protein, 9 aa, Homo sapiens
  light chain complementarity determining region 3 for antibody 51118
QQYDNLPRT

SEQ ID NO: 102236 - protein, 15 aa, Homo sapiens
  heavy chain complementarity determining region 3 for antibody 51118
ASLPTTCGGFETQNL

SEQ ID NO: 102237 - protein, 9 aa, Homo sapiens
  light chain complementarity determining region 3 for antibody 51119
QQSYSYPYT

SEQ ID NO: 102238 - protein, 11 aa, Homo sapiens
  heavy chain complementarity determining region 3 for antibody 51119
ARIDSLDAFDI

SEQ ID NO: 102239 - protein, 9 aa, Homo sapiens
  light chain complementarity determining region 3 for antibody 51120
QQSYSMPYT

SEQ ID NO: 102240 - protein, 12 aa, Homo sapiens
  heavy chain complementarity determining region 3 for antibody 51120
ARFLSSSGAYDL

SEQ ID NO: 102241 - protein, 9 aa, Homo sapiens
  light chain complementarity determining region 3 for antibody 51121
QQSYSAPLT

SEQ ID NO: 102242 - protein, 15 aa, Homo sapiens
  heavy chain complementarity determining region 3 for antibody 51121
ARDRSSYGPPAYMDV

SEQ ID NO: 102243 - protein, 9 aa, Homo sapiens
  light chain complementarity determining region 3 for antibody 51122
QQSYNTPFT

SEQ ID NO: 102244 - protein, 18 aa, Homo sapiens
  heavy chain complementarity determining region 3 for antibody 51122
ARGDETSGYFSIFDAFDI

SEQ ID NO: 102245 - protein, 10 aa, Homo sapiens
  light chain complementarity determining region 3 for antibody 51123
QQRSNWYMYT

SEQ ID NO: 102246 - protein, 13 aa, Homo sapiens
  heavy chain complementarity determining region 3 for antibody 51123
AHEDSSGYYYDAH

SEQ ID NO: 102247 - protein, 9 aa, Homo sapiens
  light chain complementarity determining region 3 for antibody 51124
QQRSNWPLT

SEQ ID NO: 102248 - protein, 14 aa, Homo sapiens
  heavy chain complementarity determining region 3 for antibody 51124
AILVGSGWYGAFDI

SEQ ID NO: 102249 - protein, 9 aa, Homo sapiens
  light chain complementarity determining region 3 for antibody 51125
QQRSNWPFT

SEQ ID NO: 102250 - protein, 14 aa, Homo sapiens
  heavy chain complementarity determining region 3 for antibody 51125
AKDRHAYGAPYFDY

SEQ ID NO: 102251 - protein, 10 aa, Homo sapiens
  light chain complementarity determining region 3 for antibody 51126
QQLNIYPPRT

SEQ ID NO: 102252 - protein, 15 aa, Homo sapiens
  heavy chain complementarity determining region 3 for antibody 51126
ARAYYYDSSAYYFDY

SEQ ID NO: 102253 - protein, 9 aa, Homo sapiens
  light chain complementarity determining region 3 for antibody 51127
QHYGPSLRT

SEQ ID NO: 102254 - protein, 20 aa, Homo sapiens
  heavy chain complementarity determining region 3 for antibody 51127
ARGNSFRSGWPGTHYYGMDV

SEQ ID NO: 102255 - protein, 11 aa, Homo sapiens
  light chain complementarity determining region 3 for antibody 51128
MQGTHWPLKWT

SEQ ID NO: 102256 - protein, 15 aa, Homo sapiens
  heavy chain complementarity determining region 3 for antibody 51128
ATAPIYYNARDYSDY

SEQ ID NO: 102257 - protein, 9 aa, Homo sapiens
  light chain complementarity determining region 3 for antibody 51129
MQGTHWPGT

SEQ ID NO: 102258 - protein, 11 aa, Homo sapiens
  heavy chain complementarity determining region 3 for antibody 51129
AIWGIWIGLDY

SEQ ID NO: 102259 - protein, 8 aa, Homo sapiens
  light chain complementarity determining region 3 for antibody 51130
MQALQTWT

SEQ ID NO: 102260 - protein, 21 aa, Homo sapiens
  heavy chain complementarity determining region 3 for antibody 51130
AKVARPSVRMIVDMKEDAFDI

SEQ ID NO: 102261 - protein, 9 aa, Homo sapiens
  light chain complementarity determining region 3 for antibody 51131
MQALQTPKT

SEQ ID NO: 102262 - protein, 13 aa, Homo sapiens
  heavy chain complementarity determining region 3 for antibody 51131
ASRGFSSGSYADY

SEQ ID NO: 102263 - protein, 9 aa, Homo sapiens
  light chain complementarity determining region 3 for antibody 51132
MQALQIPFT

SEQ ID NO: 102264 - protein, 13 aa, Homo sapiens
  heavy chain complementarity determining region 3 for antibody 51132
ARASGSNIHHFAY

SEQ ID NO: 102265 - protein, 8 aa, Homo sapiens
  light chain complementarity determining region 3 for antibody 51133
LQYNSGWT

SEQ ID NO: 102266 - protein, 8 aa, Homo sapiens
  heavy chain complementarity determining region 3 for antibody 51133
ASNVDWGY

SEQ ID NO: 102267 - protein, 9 aa, Homo sapiens
  light chain complementarity determining region 3 for antibody 51134
LQHNYYPWT

SEQ ID NO: 102268 - protein, 15 aa, Homo sapiens
  heavy chain complementarity determining region 3 for antibody 51134
ARGWGSGNPSWSFDI

SEQ ID NO: 102269 - protein, 9 aa, Homo sapiens
  light chain complementarity determining region 3 for antibody 51135
LQDYTYPRT

SEQ ID NO: 102270 - protein, 21 aa, Homo sapiens
  heavy chain complementarity determining region 3 for antibody 51135
ARDSTPTQYDKTVYYYDAFDI

SEQ ID NO: 102271 - protein, 9 aa, Homo sapiens
  light chain complementarity determining region 3 for antibody 51136
LQDYNFPYT

SEQ ID NO: 102272 - protein, 11 aa, Homo sapiens
  heavy chain complementarity determining region 3 for antibody 51136
AKPWTAGIIDY

SEQ ID NO: 102273 - protein, 11 aa, Homo sapiens
  light chain complementarity determining region 3 for antibody 51137
LHRTNWPPDFT

SEQ ID NO: 102274 - protein, 17 aa, Homo sapiens
  heavy chain complementarity determining region 3 for antibody 51137
ATIYCSGGACCSTKFDY

SEQ ID NO: 102275 - protein, 10 aa, Homo sapiens
  light chain complementarity determining region 3 for antibody 51138
YQYNSYPSWT

SEQ ID NO: 102276 - protein, 15 aa, Homo sapiens
  heavy chain complementarity determining region 3 for antibody 51138
ARDHRLFPSFYAFDI

SEQ ID NO: 102277 - protein, 9 aa, Homo sapiens
  light chain complementarity determining region 3 for antibody 51139
QRYGSSSWT

SEQ ID NO: 102278 - protein, 19 aa, Homo sapiens
  heavy chain complementarity determining region 3 for antibody 51139
ARRPATPRFLEWLPDASDI

SEQ ID NO: 102279 - protein, 10 aa, Homo sapiens
  light chain complementarity determining region 3 for antibody 51140
QQYYSNSPYT

SEQ ID NO: 102280 - protein, 24 aa, Homo sapiens
  heavy chain complementarity determining region 3 for antibody 51140
ARLGVFYGEVESAASKRFRSYFNC

SEQ ID NO: 102281 - protein, 9 aa, Homo sapiens
  light chain complementarity determining region 3 for antibody 51141
QQYYDFPIT

SEQ ID NO: 102282 - protein, 13 aa, Homo sapiens
  heavy chain complementarity determining region 3 for antibody 51141
ARPSGGAGDSFDI

SEQ ID NO: 102283 - protein, 10 aa, Homo sapiens
  light chain complementarity determining region 3 for antibody 51142
QQYSTWPLLT

SEQ ID NO: 102284 - protein, 14 aa, Homo sapiens
  heavy chain complementarity determining region 3 for antibody 51142
VRDPFGGMIDGGEY

SEQ ID NO: 102285 - protein, 9 aa, Homo sapiens
  light chain complementarity determining region 3 for antibody 51143
QQYNSYPYT

SEQ ID NO: 102286 - protein, 16 aa, Homo sapiens
  heavy chain complementarity determining region 3 for antibody 51143
ARSPPYSSSLTRNFDY

SEQ ID NO: 102287 - protein, 9 aa, Homo sapiens
  light chain complementarity determining region 3 for antibody 51144
QQYNNWPTT

SEQ ID NO: 102288 - protein, 14 aa, Homo sapiens
  heavy chain complementarity determining region 3 for antibody 51144
ARVGTYVYQRWFDP

SEQ ID NO: 102289 - protein, 13 aa, Homo sapiens
  light chain complementarity determining region 3 for antibody 51145
QQYNNWPPRRMYT

SEQ ID NO: 102290 - protein, 20 aa, Homo sapiens
  heavy chain complementarity determining region 3 for antibody 51145
ARLYCSAGSCYGIGYNGLDV

SEQ ID NO: 102291 - protein, 9 aa, Homo sapiens
  light chain complementarity determining region 3 for antibody 51146
QQYHSPPHT

SEQ ID NO: 102292 - protein, 11 aa, Homo sapiens
  heavy chain complementarity determining region 3 for antibody 51146
AAGLGSYPTDY

SEQ ID NO: 102293 - protein, 9 aa, Homo sapiens
  light chain complementarity determining region 3 for antibody 51147
QQYGSSPYT

SEQ ID NO: 102294 - protein, 18 aa, Homo sapiens
  heavy chain complementarity determining region 3 for antibody 51147
ARGSHFTVLNIMGWYFDL

SEQ ID NO: 102295 - protein, 9 aa, Homo sapiens
  light chain complementarity determining region 3 for antibody 51148
QQYGSSPST

SEQ ID NO: 102296 - protein, 14 aa, Homo sapiens
  heavy chain complementarity determining region 3 for antibody 51148
ARGGRLNVWNYLIY

SEQ ID NO: 102297 - protein, 10 aa, Homo sapiens
  light chain complementarity determining region 3 for antibody 51149
QQYGSSPPRT

SEQ ID NO: 102298 - protein, 16 aa, Homo sapiens
  heavy chain complementarity determining region 3 for antibody 51149
ATSTVTTITGSYYFDS

SEQ ID NO: 102299 - protein, 10 aa, Homo sapiens
  light chain complementarity determining region 3 for antibody 51150
QQYGSSPPFT

SEQ ID NO: 102300 - protein, 15 aa, Homo sapiens
  heavy chain complementarity determining region 3 for antibody 51150
AREFGPARYYYGTDV

SEQ ID NO: 102301 - protein, 11 aa, Homo sapiens
  light chain complementarity determining region 3 for antibody 51151
QQYGSSPPDLT

SEQ ID NO: 102302 - protein, 10 aa, Homo sapiens
  heavy chain complementarity determining region 3 for antibody 51151
AKVFTWGFDY

SEQ ID NO: 102303 - protein, 9 aa, Homo sapiens
  light chain complementarity determining region 3 for antibody 51152
QQYGSSLIT

SEQ ID NO: 102304 - protein, 13 aa, Homo sapiens
  heavy chain complementarity determining region 3 for antibody 51152
ARVIATNHDAFDI

SEQ ID NO: 102305 - protein, 10 aa, Homo sapiens
  light chain complementarity determining region 3 for antibody 51153
QQYEDWPPWT

SEQ ID NO: 102306 - protein, 13 aa, Homo sapiens
  heavy chain complementarity determining region 3 for antibody 51153
CRWAGDSYWYFDL

SEQ ID NO: 102307 - protein, 9 aa, Homo sapiens
  light chain complementarity determining region 3 for antibody 51154
QQYDRSPRT

SEQ ID NO: 102308 - protein, 18 aa, Homo sapiens
  heavy chain complementarity determining region 3 for antibody 51154
ARDQCRHRGCVGFDTHDL

SEQ ID NO: 102309 - protein, 9 aa, Homo sapiens
  light chain complementarity determining region 3 for antibody 51155
QQYDNLPYT

SEQ ID NO: 102310 - protein, 12 aa, Homo sapiens
  heavy chain complementarity determining region 3 for antibody 51155
ARVAFGDRSFDY

SEQ ID NO: 102311 - protein, 9 aa, Homo sapiens
  light chain complementarity determining region 3 for antibody 51156
QQYDNLPRT

SEQ ID NO: 102312 - protein, 15 aa, Homo sapiens
  heavy chain complementarity determining region 3 for antibody 51156
ASLPTTWGGFETHNL

SEQ ID NO: 102313 - protein, 9 aa, Homo sapiens
  light chain complementarity determining region 3 for antibody 51157
QQYDNLPRT

SEQ ID NO: 102314 - protein, 15 aa, Homo sapiens
  heavy chain complementarity determining region 3 for antibody 51157
ARLPTTWGGFETQNL

SEQ ID NO: 102315 - protein, 9 aa, Homo sapiens
  light chain complementarity determining region 3 for antibody 51158
QQYDNLPIT

SEQ ID NO: 102316 - protein, 23 aa, Homo sapiens
  heavy chain complementarity determining region 3 for antibody 51158
AREQYYYGSGPRYPLHYYYGMDV

SEQ ID NO: 102317 - protein, 10 aa, Homo sapiens
  light chain complementarity determining region 3 for antibody 51159
QQYDNLLALT

SEQ ID NO: 102318 - protein, 14 aa, Homo sapiens
  heavy chain complementarity determining region 3 for antibody 51159
AGRWGDITPTIFDY

SEQ ID NO: 102319 - protein, 9 aa, Homo sapiens
  light chain complementarity determining region 3 for antibody 51160
QQTDITPYT

SEQ ID NO: 102320 - protein, 20 aa, Homo sapiens
  heavy chain complementarity determining region 3 for antibody 51160
ARGKYNYDSSGSQPSRYFDY

SEQ ID NO: 102321 - protein, 9 aa, Homo sapiens
  light chain complementarity determining region 3 for antibody 51161
QQSYSTPWT

SEQ ID NO: 102322 - protein, 17 aa, Homo sapiens
  heavy chain complementarity determining region 3 for antibody 51161
ARGSEAYCSGGGCSPTY

SEQ ID NO: 102323 - protein, 9 aa, Homo sapiens
  light chain complementarity determining region 3 for antibody 51162
QQSYSTPRT

SEQ ID NO: 102324 - protein, 20 aa, Homo sapiens
  heavy chain complementarity determining region 3 for antibody 51162
ARGGGYDFWSGDYPGRWFDP

SEQ ID NO: 102325 - protein, 9 aa, Homo sapiens
  light chain complementarity determining region 3 for antibody 51163
QQSYNTPLT

SEQ ID NO: 102326 - protein, 16 aa, Homo sapiens
  heavy chain complementarity determining region 3 for antibody 51163
ATAYYSGTYFAENFDY

SEQ ID NO: 102327 - protein, 9 aa, Homo sapiens
  light chain complementarity determining region 3 for antibody 51164
QQSYKTPWT

SEQ ID NO: 102328 - protein, 17 aa, Homo sapiens
  heavy chain complementarity determining region 3 for antibody 51164
ARESSGSSLGGIDAFDI

SEQ ID NO: 102329 - protein, 9 aa, Homo sapiens
  light chain complementarity determining region 3 for antibody 51165
QQSYITPRT

SEQ ID NO: 102330 - protein, 19 aa, Homo sapiens
  heavy chain complementarity determining region 3 for antibody 51165
ARGRPPQTSWYGVGDWFDP

SEQ ID NO: 102331 - protein, 8 aa, Homo sapiens
  light chain complementarity determining region 3 for antibody 51166
QQSFGIPA

SEQ ID NO: 102332 - protein, 13 aa, Homo sapiens
  heavy chain complementarity determining region 3 for antibody 51166
ARHTSIGSYPIDH

SEQ ID NO: 102333 - protein, 9 aa, Homo sapiens
  light chain complementarity determining region 3 for antibody 51167
QQRSNWPVT

SEQ ID NO: 102334 - protein, 11 aa, Homo sapiens
  heavy chain complementarity determining region 3 for antibody 51167
ARDSGEVYFDY

SEQ ID NO: 102335 - protein, 9 aa, Homo sapiens
  light chain complementarity determining region 3 for antibody 51168
QQRSNWPRT

SEQ ID NO: 102336 - protein, 15 aa, Homo sapiens
  heavy chain complementarity determining region 3 for antibody 51168
ARSSGSTGNPEYFQH

SEQ ID NO: 102337 - protein, 9 aa, Homo sapiens
  light chain complementarity determining region 3 for antibody 51169
QQRSNWPLT

SEQ ID NO: 102338 - protein, 13 aa, Homo sapiens
  heavy chain complementarity determining region 3 for antibody 51169
AGHSSQSYSVFDI

SEQ ID NO: 102339 - protein, 9 aa, Homo sapiens
  light chain complementarity determining region 3 for antibody 51170
QQRSNWPFT

SEQ ID NO: 102340 - protein, 14 aa, Homo sapiens
  heavy chain complementarity determining region 3 for antibody 51170
ARDLTTTATYYFDY

SEQ ID NO: 102341 - protein, 9 aa, Homo sapiens
  light chain complementarity determining region 3 for antibody 51171
QQLSSYPFT

SEQ ID NO: 102342 - protein, 18 aa, Homo sapiens
  heavy chain complementarity determining region 3 for antibody 51171
ARADGYCSGGRCYYYYDV

SEQ ID NO: 102343 - protein, 9 aa, Homo sapiens
  light chain complementarity determining region 3 for antibody 51172
QQLKSYPLT

SEQ ID NO: 102344 - protein, 17 aa, Homo sapiens
  heavy chain complementarity determining region 3 for antibody 51172
ARDQPSEWRPPNHQIDY

SEQ ID NO: 102345 - protein, 9 aa, Homo sapiens
  light chain complementarity determining region 3 for antibody 51173
QQFNTYRVT

SEQ ID NO: 102346 - protein, 20 aa, Homo sapiens
  heavy chain complementarity determining region 3 for antibody 51173
ITLVDCYRKTTVTCYGYFDS

SEQ ID NO: 102347 - protein, 9 aa, Homo sapiens
  light chain complementarity determining region 3 for antibody 51174
QQFNSYSWT

SEQ ID NO: 102348 - protein, 14 aa, Homo sapiens
  heavy chain complementarity determining region 3 for antibody 51174
ARGNYVWGSYRFDY

SEQ ID NO: 102349 - protein, 9 aa, Homo sapiens
  light chain complementarity determining region 3 for antibody 51175
QQFGTSPYT

SEQ ID NO: 102350 - protein, 16 aa, Homo sapiens
  heavy chain complementarity determining region 3 for antibody 51175
ARGVRSNLYYYYYIDV

SEQ ID NO: 102351 - protein, 9 aa, Homo sapiens
  light chain complementarity determining region 3 for antibody 51176
QQCNSYSPT

SEQ ID NO: 102352 - protein, 15 aa, Homo sapiens
  heavy chain complementarity determining region 3 for antibody 51176
AREYSSGYLSSWFDP

SEQ ID NO: 102353 - protein, 9 aa, Homo sapiens
  light chain complementarity determining region 3 for antibody 51177
QLYTGSPGT

SEQ ID NO: 102354 - protein, 19 aa, Homo sapiens
  heavy chain complementarity determining region 3 for antibody 51177
ARDLGSSFYADQYDYGMDV

SEQ ID NO: 102355 - protein, 9 aa, Homo sapiens
  light chain complementarity determining region 3 for antibody 51178
QKYNSAPRT

SEQ ID NO: 102356 - protein, 10 aa, Homo sapiens
  heavy chain complementarity determining region 3 for antibody 51178
ARRAVAGNDY

SEQ ID NO: 102357 - protein, 9 aa, Homo sapiens
  light chain complementarity determining region 3 for antibody 51179
QKYNSAPLT

SEQ ID NO: 102358 - protein, 15 aa, Homo sapiens
  heavy chain complementarity determining region 3 for antibody 51179
ARGTGTMTTVTTFAY

SEQ ID NO: 102359 - protein, 10 aa, Homo sapiens
  light chain complementarity determining region 3 for antibody 51180
QHYSNGPSWT

SEQ ID NO: 102360 - protein, 13 aa, Homo sapiens
  heavy chain complementarity determining region 3 for antibody 51180
ARRADGRDWYFDS

SEQ ID NO: 102361 - protein, 12 aa, Homo sapiens
  light chain complementarity determining region 3 for antibody 51181
QHYNSYSPGEYT

SEQ ID NO: 102362 - protein, 15 aa, Homo sapiens
  heavy chain complementarity determining region 3 for antibody 51181
ARRRNGWYGEGTFDI

SEQ ID NO: 102363 - protein, 9 aa, Homo sapiens
  light chain complementarity determining region 3 for antibody 51182
QHYNGYPLT

SEQ ID NO: 102364 - protein, 16 aa, Homo sapiens
  heavy chain complementarity determining region 3 for antibody 51182
AKHSVPGNFYSDYLES

SEQ ID NO: 102365 - protein, 10 aa, Homo sapiens
  light chain complementarity determining region 3 for antibody 51183
QHYDTSPPLT

SEQ ID NO: 102366 - protein, 24 aa, Homo sapiens
  heavy chain complementarity determining region 3 for antibody 51183
ARDLVNYHYDTATKWGGFYYAMDV

SEQ ID NO: 102367 - protein, 9 aa, Homo sapiens
  light chain complementarity determining region 3 for antibody 51184
QEYKSSSHS

SEQ ID NO: 102368 - protein, 17 aa, Homo sapiens
  heavy chain complementarity determining region 3 for antibody 51184
ARMAYYDSSGFYGYFDL

SEQ ID NO: 102369 - protein, 9 aa, Homo sapiens
  light chain complementarity determining region 3 for antibody 51185
MQTLQTPWT

SEQ ID NO: 102370 - protein, 16 aa, Homo sapiens
  heavy chain complementarity determining region 3 for antibody 51185
VYRDPGWVFGTHYFDY

SEQ ID NO: 102371 - protein, 9 aa, Homo sapiens
  light chain complementarity determining region 3 for antibody 51186
MQGTYWPHT

SEQ ID NO: 102372 - protein, 8 aa, Homo sapiens
  heavy chain complementarity determining region 3 for antibody 51186
TRAWGSAH

SEQ ID NO: 102373 - protein, 9 aa, Homo sapiens
  light chain complementarity determining region 3 for antibody 51187
MQALETPYT

SEQ ID NO: 102374 - protein, 13 aa, Homo sapiens
  heavy chain complementarity determining region 3 for antibody 51187
ARDLTVIRGARDY

SEQ ID NO: 102375 - protein, 9 aa, Homo sapiens
  light chain complementarity determining region 3 for antibody 51188
HQYGSSPRT

SEQ ID NO: 102376 - protein, 14 aa, Homo sapiens
  heavy chain complementarity determining region 3 for antibody 51188
ARSGLGGWDRGMDL

SEQ ID NO: 102377 - protein, 9 aa, Homo sapiens
  light chain complementarity determining region 3 for antibody 51189
RQRRDWPWT

SEQ ID NO: 102378 - protein, 14 aa, Homo sapiens
  heavy chain complementarity determining region 3 for antibody 51189
AHTYSSSYYYGVDV

SEQ ID NO: 102379 - protein, 10 aa, Homo sapiens
  light chain complementarity determining region 3 for antibody 51190
QRYDNSPPYT

SEQ ID NO: 102380 - protein, 21 aa, Homo sapiens
  heavy chain complementarity determining region 3 for antibody 51190
TRGCSSSSCYAQGQNYYGMDV

SEQ ID NO: 102381 - protein, 9 aa, Homo sapiens
  light chain complementarity determining region 3 for antibody 51191
QQYYGSPLT

SEQ ID NO: 102382 - protein, 17 aa, Homo sapiens
  heavy chain complementarity determining region 3 for antibody 51191
ARGDYYDSPEGINWFDP

SEQ ID NO: 102383 - protein, 9 aa, Homo sapiens
  light chain complementarity determining region 3 for antibody 51192
QQYYANPLT

SEQ ID NO: 102384 - protein, 17 aa, Homo sapiens
  heavy chain complementarity determining region 3 for antibody 51192
ARVKIDYSGSYYRPMDY

SEQ ID NO: 102385 - protein, 9 aa, Homo sapiens
  light chain complementarity determining region 3 for antibody 51193
QQYREYPYT

SEQ ID NO: 102386 - protein, 15 aa, Homo sapiens
  heavy chain complementarity determining region 3 for antibody 51193
ATDRGINWAYSRFDS

SEQ ID NO: 102387 - protein, 9 aa, Homo sapiens
  light chain complementarity determining region 3 for antibody 51194
QQYNSFPYT

SEQ ID NO: 102388 - protein, 8 aa, Homo sapiens
  heavy chain complementarity determining region 3 for antibody 51194
ARTRAPNC

SEQ ID NO: 102389 - protein, 9 aa, Homo sapiens
  light chain complementarity determining region 3 for antibody 51195
QQYNIYSWT

SEQ ID NO: 102390 - protein, 10 aa, Homo sapiens
  heavy chain complementarity determining region 3 for antibody 51195
AFSDHDALSI

SEQ ID NO: 102391 - protein, 9 aa, Homo sapiens
  light chain complementarity determining region 3 for antibody 51196
QQYINWPPT

SEQ ID NO: 102392 - protein, 16 aa, Homo sapiens
  heavy chain complementarity determining region 3 for antibody 51196
AKDPTVTTVYRAYFDY

SEQ ID NO: 102393 - protein, 9 aa, Homo sapiens
  light chain complementarity determining region 3 for antibody 51197
QQYHSYPYS

SEQ ID NO: 102394 - protein, 11 aa, Homo sapiens
  heavy chain complementarity determining region 3 for antibody 51197
ARVVPNYYEDY

SEQ ID NO: 102395 - protein, 9 aa, Homo sapiens
  light chain complementarity determining region 3 for antibody 51198
QQYGSSPTT

SEQ ID NO: 102396 - protein, 12 aa, Homo sapiens
  heavy chain complementarity determining region 3 for antibody 51198
ARSFYGKDAFDI

SEQ ID NO: 102397 - protein, 10 aa, Homo sapiens
  light chain complementarity determining region 3 for antibody 51199
QQYGSSPPWT

SEQ ID NO: 102398 - protein, 12 aa, Homo sapiens
  heavy chain complementarity determining region 3 for antibody 51199
VRHKWLVYGLDV

SEQ ID NO: 102399 - protein, 10 aa, Homo sapiens
  light chain complementarity determining region 3 for antibody 51200
QQYGSSPAWT

SEQ ID NO: 102400 - protein, 17 aa, Homo sapiens
  heavy chain complementarity determining region 3 for antibody 51200
TRVKYCSDGPCYTGTDY

SEQ ID NO: 102401 - protein, 10 aa, Homo sapiens
  light chain complementarity determining region 3 for antibody 51201
QQYGSSPAWT

SEQ ID NO: 102402 - protein, 17 aa, Homo sapiens
  heavy chain complementarity determining region 3 for antibody 51201
ARVKYCSDGTCYTGTDY

SEQ ID NO: 102403 - protein, 8 aa, Homo sapiens
  light chain complementarity determining region 3 for antibody 51202
QQYGSSAT

SEQ ID NO: 102404 - protein, 14 aa, Homo sapiens
  heavy chain complementarity determining region 3 for antibody 51202
AKRGYGGNSYYFDS

SEQ ID NO: 102405 - protein, 9 aa, Homo sapiens
  light chain complementarity determining region 3 for antibody 51203
QQYFFIPWT

SEQ ID NO: 102406 - protein, 15 aa, Homo sapiens
  heavy chain complementarity determining region 3 for antibody 51203
ARGSGTTGFDSYFAY

SEQ ID NO: 102407 - protein, 10 aa, Homo sapiens
  light chain complementarity determining region 3 for antibody 51204
QQYDSLPPIT

SEQ ID NO: 102408 - protein, 24 aa, Homo sapiens
  heavy chain complementarity determining region 3 for antibody 51204
ARKRHVDTAVAEGDARYYYYNMDV

SEQ ID NO: 102409 - protein, 9 aa, Homo sapiens
  light chain complementarity determining region 3 for antibody 51205
QQYDNLPRT

SEQ ID NO: 102410 - protein, 15 aa, Homo sapiens
  heavy chain complementarity determining region 3 for antibody 51205
SSLPTTWGGFETQNL

SEQ ID NO: 102411 - protein, 9 aa, Homo sapiens
  light chain complementarity determining region 3 for antibody 51206
QQYDKYPLS

SEQ ID NO: 102412 - protein, 16 aa, Homo sapiens
  heavy chain complementarity determining region 3 for antibody 51206
AREGDTVISPVARLRL

SEQ ID NO: 102413 - protein, 8 aa, Homo sapiens
  light chain complementarity determining region 3 for antibody 51207
QQTYSNPT

SEQ ID NO: 102414 - protein, 13 aa, Homo sapiens
  heavy chain complementarity determining region 3 for antibody 51207
ARVHHDSSNGFDI

SEQ ID NO: 102415 - protein, 9 aa, Homo sapiens
  light chain complementarity determining region 3 for antibody 51208
QQSYSVPLI

SEQ ID NO: 102416 - protein, 14 aa, Homo sapiens
  heavy chain complementarity determining region 3 for antibody 51208
SYGSESSDSADFDY

SEQ ID NO: 102417 - protein, 9 aa, Homo sapiens
  light chain complementarity determining region 3 for antibody 51209
QQSYSTPYT

SEQ ID NO: 102418 - protein, 14 aa, Homo sapiens
  heavy chain complementarity determining region 3 for antibody 51209
ARGDSSGYYDWFDP

SEQ ID NO: 102419 - protein, 9 aa, Homo sapiens
  light chain complementarity determining region 3 for antibody 51210
QQSYSTPRT

SEQ ID NO: 102420 - protein, 21 aa, Homo sapiens
  heavy chain complementarity determining region 3 for antibody 51210
TTDLACSAGNCQSGSYWYFDL

SEQ ID NO: 102421 - protein, 10 aa, Homo sapiens
  light chain complementarity determining region 3 for antibody 51211
QQSYSTPGWT

SEQ ID NO: 102422 - protein, 18 aa, Homo sapiens
  heavy chain complementarity determining region 3 for antibody 51211
ARGIGIQVWPSLDYGGDS

SEQ ID NO: 102423 - protein, 9 aa, Homo sapiens
  light chain complementarity determining region 3 for antibody 51212
QQSYSTPDT

SEQ ID NO: 102424 - protein, 17 aa, Homo sapiens
  heavy chain complementarity determining region 3 for antibody 51212
ARGPLLRHLRWLGAFDI

SEQ ID NO: 102425 - protein, 9 aa, Homo sapiens
  light chain complementarity determining region 3 for antibody 51213
QQSYSIPVT

SEQ ID NO: 102426 - protein, 19 aa, Homo sapiens
  heavy chain complementarity determining region 3 for antibody 51213
ARGPEYSSGWYHYYYGMDV

SEQ ID NO: 102427 - protein, 9 aa, Homo sapiens
  light chain complementarity determining region 3 for antibody 51214
QQSHRAPYT

SEQ ID NO: 102428 - protein, 16 aa, Homo sapiens
  heavy chain complementarity determining region 3 for antibody 51214
AKVAIPFGSSSAVFDF

SEQ ID NO: 102429 - protein, 9 aa, Homo sapiens
  light chain complementarity determining region 3 for antibody 51215
QQRSNWPRT

SEQ ID NO: 102430 - protein, 11 aa, Homo sapiens
  heavy chain complementarity determining region 3 for antibody 51215
HSHSSLLGFDY

SEQ ID NO: 102431 - protein, 11 aa, Homo sapiens
  light chain complementarity determining region 3 for antibody 51216
QQRSNWPPTYT

SEQ ID NO: 102432 - protein, 12 aa, Homo sapiens
  heavy chain complementarity determining region 3 for antibody 51216
AREIKAAAGIIA

SEQ ID NO: 102433 - protein, 10 aa, Homo sapiens
  light chain complementarity determining region 3 for antibody 51217
QQRSNWPPNT

SEQ ID NO: 102434 - protein, 17 aa, Homo sapiens
  heavy chain complementarity determining region 3 for antibody 51217
ARDPTGYSSGWYGYFQH

SEQ ID NO: 102435 - protein, 9 aa, Homo sapiens
  light chain complementarity determining region 3 for antibody 51218
QQRSNWPLT

SEQ ID NO: 102436 - protein, 20 aa, Homo sapiens
  heavy chain complementarity determining region 3 for antibody 51218
VRHGQGGLTTQVFDFNGMDV

SEQ ID NO: 102437 - protein, 9 aa, Homo sapiens
  light chain complementarity determining region 3 for antibody 51219
QQRSNWPLT

SEQ ID NO: 102438 - protein, 18 aa, Homo sapiens
  heavy chain complementarity determining region 3 for antibody 51219
AKDLSWGHDILTVYGMDV

SEQ ID NO: 102439 - protein, 9 aa, Homo sapiens
  light chain complementarity determining region 3 for antibody 51220
QQRSNWPIT

SEQ ID NO: 102440 - protein, 15 aa, Homo sapiens
  heavy chain complementarity determining region 3 for antibody 51220
AKAISPFKLLLSFDY

SEQ ID NO: 102441 - protein, 9 aa, Homo sapiens
  light chain complementarity determining region 3 for antibody 51221
QQNYNTQWT

SEQ ID NO: 102442 - protein, 15 aa, Homo sapiens
  heavy chain complementarity determining region 3 for antibody 51221
ARDLFRRGSYHRVDY

SEQ ID NO: 102443 - protein, 9 aa, Homo sapiens
  light chain complementarity determining region 3 for antibody 51222
QQLYSFPLT

SEQ ID NO: 102444 - protein, 15 aa, Homo sapiens
  heavy chain complementarity determining region 3 for antibody 51222
ATLDMTLRHAWQFDL

SEQ ID NO: 102445 - protein, 9 aa, Homo sapiens
  light chain complementarity determining region 3 for antibody 51223
QQFGSSVYT

SEQ ID NO: 102446 - protein, 21 aa, Homo sapiens
  heavy chain complementarity determining region 3 for antibody 51223
ARAYPLYNNGWYSLGTGYLDL

SEQ ID NO: 102447 - protein, 9 aa, Homo sapiens
  light chain complementarity determining region 3 for antibody 51224
QQCDNLPLT

SEQ ID NO: 102448 - protein, 13 aa, Homo sapiens
  heavy chain complementarity determining region 3 for antibody 51224
ARVSFALGRSFDY

SEQ ID NO: 102449 - protein, 9 aa, Homo sapiens
  light chain complementarity determining region 3 for antibody 51225
QQANSFPLT

SEQ ID NO: 102450 - protein, 12 aa, Homo sapiens
  heavy chain complementarity determining region 3 for antibody 51225
ARLGYGESYFDY

SEQ ID NO: 102451 - protein, 9 aa, Homo sapiens
  light chain complementarity determining region 3 for antibody 51226
QKYNSGLLT

SEQ ID NO: 102452 - protein, 13 aa, Homo sapiens
  heavy chain complementarity determining region 3 for antibody 51226
ASGWIQPTMPSDY

SEQ ID NO: 102453 - protein, 9 aa, Homo sapiens
  light chain complementarity determining region 3 for antibody 51227
QKYNSAPWT

SEQ ID NO: 102454 - protein, 18 aa, Homo sapiens
  heavy chain complementarity determining region 3 for antibody 51227
ASVGSPSGSYYGGVDEGY

SEQ ID NO: 102455 - protein, 11 aa, Homo sapiens
  light chain complementarity determining region 3 for antibody 51228
QHRNNWPPGST

SEQ ID NO: 102456 - protein, 12 aa, Homo sapiens
  heavy chain complementarity determining region 3 for antibody 51228
APDRSDYGDHGA

SEQ ID NO: 102457 - protein, 9 aa, Homo sapiens
  light chain complementarity determining region 3 for antibody 51229
QHLNSYPLA

SEQ ID NO: 102458 - protein, 16 aa, Homo sapiens
  heavy chain complementarity determining region 3 for antibody 51229
ARKMTPGNPGKNWFDP

SEQ ID NO: 102459 - protein, 9 aa, Homo sapiens
  light chain complementarity determining region 3 for antibody 51230
MQPLQTPLT

SEQ ID NO: 102460 - protein, 14 aa, Homo sapiens
  heavy chain complementarity determining region 3 for antibody 51230
ARGAVAAATSPFEY

SEQ ID NO: 102461 - protein, 9 aa, Homo sapiens
  light chain complementarity determining region 3 for antibody 51231
MQGTQWPPT

SEQ ID NO: 102462 - protein, 12 aa, Homo sapiens
  heavy chain complementarity determining region 3 for antibody 51231
AKEDGGYSQVDY

SEQ ID NO: 102463 - protein, 9 aa, Homo sapiens
  light chain complementarity determining region 3 for antibody 51232
MQGTHWLYT

SEQ ID NO: 102464 - protein, 20 aa, Homo sapiens
  heavy chain complementarity determining region 3 for antibody 51232
ARLYCSAGSCYGIGYNGLDV

SEQ ID NO: 102465 - protein, 9 aa, Homo sapiens
  light chain complementarity determining region 3 for antibody 51233
MQALQTPPT

SEQ ID NO: 102466 - protein, 14 aa, Homo sapiens
  heavy chain complementarity determining region 3 for antibody 51233
ASFGRISIFGVLDV

SEQ ID NO: 102467 - protein, 9 aa, Homo sapiens
  light chain complementarity determining region 3 for antibody 51234
LQHKIHPNT

SEQ ID NO: 102468 - protein, 7 aa, Homo sapiens
  heavy chain complementarity determining region 3 for antibody 51234
GSRWDDF

SEQ ID NO: 102469 - protein, 9 aa, Homo sapiens
  light chain complementarity determining region 3 for antibody 51235
HQYDSLPLT

SEQ ID NO: 102470 - protein, 15 aa, Homo sapiens
  heavy chain complementarity determining region 3 for antibody 51235
AKPSLPQRLTSAFDI

SEQ ID NO: 102471 - protein, 8 aa, Homo sapiens
  light chain complementarity determining region 3 for antibody 51236
QRRSHWLI

SEQ ID NO: 102472 - protein, 13 aa, Homo sapiens
  heavy chain complementarity determining region 3 for antibody 51236
ARGTWFGEFALDY

SEQ ID NO: 102473 - protein, 9 aa, Homo sapiens
  light chain complementarity determining region 3 for antibody 51237
QQYYSTPYT

SEQ ID NO: 102474 - protein, 22 aa, Homo sapiens
  heavy chain complementarity determining region 3 for antibody 51237
AREHTGYDYDGWYLFRAFAFDI

SEQ ID NO: 102475 - protein, 9 aa, Homo sapiens
  light chain complementarity determining region 3 for antibody 51238
QQYYSTPWT

SEQ ID NO: 102476 - protein, 11 aa, Homo sapiens
  heavy chain complementarity determining region 3 for antibody 51238
ARAGAGRILDY

SEQ ID NO: 102477 - protein, 9 aa, Homo sapiens
  light chain complementarity determining region 3 for antibody 51239
QQYYSTPLT

SEQ ID NO: 102478 - protein, 22 aa, Homo sapiens
  heavy chain complementarity determining region 3 for antibody 51239
ARDSLNYHESGTFSGEYSWFAP

SEQ ID NO: 102479 - protein, 11 aa, Homo sapiens
  light chain complementarity determining region 3 for antibody 51240
QQYSSWPPEYT

SEQ ID NO: 102480 - protein, 13 aa, Homo sapiens
  heavy chain complementarity determining region 3 for antibody 51240
ARGGHSSNWFQDS

SEQ ID NO: 102481 - protein, 8 aa, Homo sapiens
  light chain complementarity determining region 3 for antibody 51241
QQYNTLLT

SEQ ID NO: 102482 - protein, 15 aa, Homo sapiens
  heavy chain complementarity determining region 3 for antibody 51241
ARHAGIASAGYAFDI

SEQ ID NO: 102483 - protein, 8 aa, Homo sapiens
  light chain complementarity determining region 3 for antibody 51242
QQYNRYIT

SEQ ID NO: 102484 - protein, 15 aa, Homo sapiens
  heavy chain complementarity determining region 3 for antibody 51242
ARASRRDFVDTAMNI

SEQ ID NO: 102485 - protein, 10 aa, Homo sapiens
  light chain complementarity determining region 3 for antibody 51243
QQYNNWPPRT

SEQ ID NO: 102486 - protein, 21 aa, Homo sapiens
  heavy chain complementarity determining region 3 for antibody 51243
TRDCPSFNFWRGYYARGWFDP

SEQ ID NO: 102487 - protein, 10 aa, Homo sapiens
  light chain complementarity determining region 3 for antibody 51244
QQYNNWLPLT

SEQ ID NO: 102488 - protein, 12 aa, Homo sapiens
  heavy chain complementarity determining region 3 for antibody 51244
ARDYYDSSGYFV

SEQ ID NO: 102489 - protein, 9 aa, Homo sapiens
  light chain complementarity determining region 3 for antibody 51245
QQYGSSQDT

SEQ ID NO: 102490 - protein, 20 aa, Homo sapiens
  heavy chain complementarity determining region 3 for antibody 51245
ARGDKYYDILTGYYRRPFDY

SEQ ID NO: 102491 - protein, 9 aa, Homo sapiens
  light chain complementarity determining region 3 for antibody 51246
QQYGSSPYT

SEQ ID NO: 102492 - protein, 18 aa, Homo sapiens
  heavy chain complementarity determining region 3 for antibody 51246
ARDRGVTLVRGVLYHFDY

SEQ ID NO: 102493 - protein, 9 aa, Homo sapiens
  light chain complementarity determining region 3 for antibody 51247
QQYGSSPRT

SEQ ID NO: 102494 - protein, 14 aa, Homo sapiens
  heavy chain complementarity determining region 3 for antibody 51247
ARWYYDSSGYYYNF

SEQ ID NO: 102495 - protein, 9 aa, Homo sapiens
  light chain complementarity determining region 3 for antibody 51248
QQYGSSPRT

SEQ ID NO: 102496 - protein, 19 aa, Homo sapiens
  heavy chain complementarity determining region 3 for antibody 51248
ARDGVIQQFHPLKPYFIDY

SEQ ID NO: 102497 - protein, 9 aa, Homo sapiens
  light chain complementarity determining region 3 for antibody 51249
QQYGSSPPT

SEQ ID NO: 102498 - protein, 12 aa, Homo sapiens
  heavy chain complementarity determining region 3 for antibody 51249
ARVLPGSYYFDY

SEQ ID NO: 102499 - protein, 10 aa, Homo sapiens
  light chain complementarity determining region 3 for antibody 51250
QQYGSSPPIT

SEQ ID NO: 102500 - protein, 9 aa, Homo sapiens
  heavy chain complementarity determining region 3 for antibody 51250
TTGDDGHAM

SEQ ID NO: 102501 - protein, 10 aa, Homo sapiens
  light chain complementarity determining region 3 for antibody 51251
QQYGSSPAWT

SEQ ID NO: 102502 - protein, 17 aa, Homo sapiens
  heavy chain complementarity determining region 3 for antibody 51251
TRVKYCSDGTCYTGTDH

SEQ ID NO: 102503 - protein, 10 aa, Homo sapiens
  light chain complementarity determining region 3 for antibody 51252
QQYGSSPAGT

SEQ ID NO: 102504 - protein, 17 aa, Homo sapiens
  heavy chain complementarity determining region 3 for antibody 51252
TRVKYCSDGTCYTGTDY

SEQ ID NO: 102505 - protein, 8 aa, Homo sapiens
  light chain complementarity determining region 3 for antibody 51253
QQYDYILT

SEQ ID NO: 102506 - protein, 8 aa, Homo sapiens
  heavy chain complementarity determining region 3 for antibody 51253
ARDVLRLT

SEQ ID NO: 102507 - protein, 9 aa, Homo sapiens
  light chain complementarity determining region 3 for antibody 51254
QQYDVLPIT

SEQ ID NO: 102508 - protein, 13 aa, Homo sapiens
  heavy chain complementarity determining region 3 for antibody 51254
ARHDGTYSGGFDS

SEQ ID NO: 102509 - protein, 10 aa, Homo sapiens
  light chain complementarity determining region 3 for antibody 51255
QQYDNSPSYT

SEQ ID NO: 102510 - protein, 15 aa, Homo sapiens
  heavy chain complementarity determining region 3 for antibody 51255
ALKPLKDIISLYFDY

SEQ ID NO: 102511 - protein, 9 aa, Homo sapiens
  light chain complementarity determining region 3 for antibody 51256
QQYDNLPRT

SEQ ID NO: 102512 - protein, 15 aa, Homo sapiens
  heavy chain complementarity determining region 3 for antibody 51256
ASLPTMWGGFETQNL

SEQ ID NO: 102513 - protein, 8 aa, Homo sapiens
  light chain complementarity determining region 3 for antibody 51257
QQYDNFPT

SEQ ID NO: 102514 - protein, 14 aa, Homo sapiens
  heavy chain complementarity determining region 3 for antibody 51257
AKGSSGSYYSRFDN

SEQ ID NO: 102515 - protein, 9 aa, Homo sapiens
  light chain complementarity determining region 3 for antibody 51258
QQSYTIPLT

SEQ ID NO: 102516 - protein, 9 aa, Homo sapiens
  heavy chain complementarity determining region 3 for antibody 51258
TTGDDGHAM

SEQ ID NO: 102517 - protein, 9 aa, Homo sapiens
  light chain complementarity determining region 3 for antibody 51259
QQSYSTPPT

SEQ ID NO: 102518 - protein, 14 aa, Homo sapiens
  heavy chain complementarity determining region 3 for antibody 51259
ARGYTAMVSMLFDI

SEQ ID NO: 102519 - protein, 9 aa, Homo sapiens
  light chain complementarity determining region 3 for antibody 51260
QQSYSLPPT

SEQ ID NO: 102520 - protein, 14 aa, Homo sapiens
  heavy chain complementarity determining region 3 for antibody 51260
ASRPPNDYWGAYRV

SEQ ID NO: 102521 - protein, 9 aa, Homo sapiens
  light chain complementarity determining region 3 for antibody 51261
QQSYSIPFT

SEQ ID NO: 102522 - protein, 14 aa, Homo sapiens
  heavy chain complementarity determining region 3 for antibody 51261
ARERVDSSGSRFES

SEQ ID NO: 102523 - protein, 9 aa, Homo sapiens
  light chain complementarity determining region 3 for antibody 51262
QQSFNAPHT

SEQ ID NO: 102524 - protein, 17 aa, Homo sapiens
  heavy chain complementarity determining region 3 for antibody 51262
TRGRYFDWSSNNNYFDY

SEQ ID NO: 102525 - protein, 9 aa, Homo sapiens
  light chain complementarity determining region 3 for antibody 51263
QQRYNFPRT

SEQ ID NO: 102526 - protein, 18 aa, Homo sapiens
  heavy chain complementarity determining region 3 for antibody 51263
ARDRGTPVDGEWIAAFDI

SEQ ID NO: 102527 - protein, 9 aa, Homo sapiens
  light chain complementarity determining region 3 for antibody 51264
QQRSSWPLT

SEQ ID NO: 102528 - protein, 16 aa, Homo sapiens
  heavy chain complementarity determining region 3 for antibody 51264
AKDVEGQLYYYYYMDV

SEQ ID NO: 102529 - protein, 8 aa, Homo sapiens
  light chain complementarity determining region 3 for antibody 51265
QQRSNWPS

SEQ ID NO: 102530 - protein, 13 aa, Homo sapiens
  heavy chain complementarity determining region 3 for antibody 51265
ARGRGWLATRMDV

SEQ ID NO: 102531 - protein, 9 aa, Homo sapiens
  light chain complementarity determining region 3 for antibody 51266
QQRSNWPLT

SEQ ID NO: 102532 - protein, 7 aa, Homo sapiens
  heavy chain complementarity determining region 3 for antibody 51266
VRPGAGY

SEQ ID NO: 102533 - protein, 9 aa, Homo sapiens
  light chain complementarity determining region 3 for antibody 51267
QQLYSYPLP

SEQ ID NO: 102534 - protein, 15 aa, Homo sapiens
  heavy chain complementarity determining region 3 for antibody 51267
ATLDMTLRHAWQFDL

SEQ ID NO: 102535 - protein, 9 aa, Homo sapiens
  light chain complementarity determining region 3 for antibody 51268
QQLNTHPLT

SEQ ID NO: 102536 - protein, 13 aa, Homo sapiens
  heavy chain complementarity determining region 3 for antibody 51268
ARYLFPSSGYGGY

SEQ ID NO: 102537 - protein, 9 aa, Homo sapiens
  light chain complementarity determining region 3 for antibody 51269
QQGMSFPLT

SEQ ID NO: 102538 - protein, 16 aa, Homo sapiens
  heavy chain complementarity determining region 3 for antibody 51269
ARGQSQWNDGYFGLDV

SEQ ID NO: 102539 - protein, 9 aa, Homo sapiens
  light chain complementarity determining region 3 for antibody 51270
QQFNNDFRT

SEQ ID NO: 102540 - protein, 13 aa, Homo sapiens
  heavy chain complementarity determining region 3 for antibody 51270
ARLGIQRRGAFDL

SEQ ID NO: 102541 - protein, 9 aa, Homo sapiens
  light chain complementarity determining region 3 for antibody 51271
QQFHSSSLT

SEQ ID NO: 102542 - protein, 20 aa, Homo sapiens
  heavy chain complementarity determining region 3 for antibody 51271
ARGVGYDSSGYYNEGCYFDY

SEQ ID NO: 102543 - protein, 9 aa, Homo sapiens
  light chain complementarity determining region 3 for antibody 51272
QQFDTLPIT

SEQ ID NO: 102544 - protein, 16 aa, Homo sapiens
  heavy chain complementarity determining region 3 for antibody 51272
ARGSRYSYLYDSQMDH

SEQ ID NO: 102545 - protein, 9 aa, Homo sapiens
  light chain complementarity determining region 3 for antibody 51273
QQCYNTPLT

SEQ ID NO: 102546 - protein, 9 aa, Homo sapiens
  heavy chain complementarity determining region 3 for antibody 51273
ARDQGATNS

SEQ ID NO: 102547 - protein, 9 aa, Homo sapiens
  light chain complementarity determining region 3 for antibody 51274
QQAKSFPLT

SEQ ID NO: 102548 - protein, 14 aa, Homo sapiens
  heavy chain complementarity determining region 3 for antibody 51274
VTVLSKWQITLFDH

SEQ ID NO: 102549 - protein, 8 aa, Homo sapiens
  light chain complementarity determining region 3 for antibody 51275
QNLRSHPL

SEQ ID NO: 102550 - protein, 23 aa, Homo sapiens
  heavy chain complementarity determining region 3 for antibody 51275
ARDCGDDCRNCGDDCRNHWYFDL

SEQ ID NO: 102551 - protein, 9 aa, Homo sapiens
  light chain complementarity determining region 3 for antibody 51276
QKYHSALET

SEQ ID NO: 102552 - protein, 7 aa, Homo sapiens
  heavy chain complementarity determining region 3 for antibody 51276
AISGSDY

SEQ ID NO: 102553 - protein, 9 aa, Homo sapiens
  light chain complementarity determining region 3 for antibody 51277
QHYYTYPWT

SEQ ID NO: 102554 - protein, 14 aa, Homo sapiens
  heavy chain complementarity determining region 3 for antibody 51277
ARADSWYFLGAFDI

SEQ ID NO: 102555 - protein, 10 aa, Homo sapiens
  light chain complementarity determining region 3 for antibody 51278
MQVLQTPPIT

SEQ ID NO: 102556 - protein, 13 aa, Homo sapiens
  heavy chain complementarity determining region 3 for antibody 51278
ARYAAVARWAFDY

SEQ ID NO: 102557 - protein, 9 aa, Homo sapiens
  light chain complementarity determining region 3 for antibody 51279
MQSLQTPNT

SEQ ID NO: 102558 - protein, 17 aa, Homo sapiens
  heavy chain complementarity determining region 3 for antibody 51279
ARVTFMAVRPTKGAFDI

SEQ ID NO: 102559 - protein, 9 aa, Homo sapiens
  light chain complementarity determining region 3 for antibody 51280
MQGAHWPPT

SEQ ID NO: 102560 - protein, 16 aa, Homo sapiens
  heavy chain complementarity determining region 3 for antibody 51280
AKYTSGWFWGGTGMDV

SEQ ID NO: 102561 - protein, 9 aa, Homo sapiens
  light chain complementarity determining region 3 for antibody 51281
MQALQTPLT

SEQ ID NO: 102562 - protein, 14 aa, Homo sapiens
  heavy chain complementarity determining region 3 for antibody 51281
ARALSPLVASGMDV

SEQ ID NO: 102563 - protein, 9 aa, Homo sapiens
  light chain complementarity determining region 3 for antibody 51282
MQALQTPFT

SEQ ID NO: 102564 - protein, 17 aa, Homo sapiens
  heavy chain complementarity determining region 3 for antibody 51282
VRIREKWLRDHYYGMDV

SEQ ID NO: 102565 - protein, 8 aa, Homo sapiens
  light chain complementarity determining region 3 for antibody 51283
MQALQAYT

SEQ ID NO: 102566 - protein, 20 aa, Homo sapiens
  heavy chain complementarity determining region 3 for antibody 51283
ARALTAASSVWSRHYNGVDV

SEQ ID NO: 102567 - protein, 10 aa, Homo sapiens
  light chain complementarity determining region 3 for antibody 51284
MHGTHWPPFT

SEQ ID NO: 102568 - protein, 13 aa, Homo sapiens
  heavy chain complementarity determining region 3 for antibody 51284
VRGGGSENPPFDN

SEQ ID NO: 102569 - protein, 9 aa, Homo sapiens
  light chain complementarity determining region 3 for antibody 51285
LQYGTSSST

SEQ ID NO: 102570 - protein, 10 aa, Homo sapiens
  heavy chain complementarity determining region 3 for antibody 51285
ARDRWGGQWH

SEQ ID NO: 102571 - protein, 9 aa, Homo sapiens
  light chain complementarity determining region 3 for antibody 51286
LQHNTFPPT

SEQ ID NO: 102572 - protein, 20 aa, Homo sapiens
  heavy chain complementarity determining region 3 for antibody 51286
ATSLCDTIRCFFWCCQEEGF

SEQ ID NO: 102573 - protein, 9 aa, Homo sapiens
  light chain complementarity determining region 3 for antibody 51287
LQHDSYPFT

SEQ ID NO: 102574 - protein, 13 aa, Homo sapiens
  heavy chain complementarity determining region 3 for antibody 51287
ARVYRSSYYHFEY

SEQ ID NO: 102575 - protein, 9 aa, Homo sapiens
  light chain complementarity determining region 3 for antibody 51288
LQDYNYPRT

SEQ ID NO: 102576 - protein, 15 aa, Homo sapiens
  heavy chain complementarity determining region 3 for antibody 51288
AKDLSYSTGWPYFDY

SEQ ID NO: 102577 - protein, 9 aa, Homo sapiens
  light chain complementarity determining region 3 for antibody 51289
HQHDISTIT

SEQ ID NO: 102578 - protein, 13 aa, Homo sapiens
  heavy chain complementarity determining region 3 for antibody 51289
ARFGSGTHNAFDI

SEQ ID NO: 102579 - protein, 8 aa, Homo sapiens
  light chain complementarity determining region 3 for antibody 51290
QRTYNALT

SEQ ID NO: 102580 - protein, 21 aa, Homo sapiens
  heavy chain complementarity determining region 3 for antibody 51290
ARAYPLYNNGWYSLGTGYLDL

SEQ ID NO: 102581 - protein, 9 aa, Homo sapiens
  light chain complementarity determining region 3 for antibody 51291
QQYYSSPPT

SEQ ID NO: 102582 - protein, 16 aa, Homo sapiens
  heavy chain complementarity determining region 3 for antibody 51291
AKGATVRAVSHDAFDI

SEQ ID NO: 102583 - protein, 8 aa, Homo sapiens
  light chain complementarity determining region 3 for antibody 51292
QQYSSYWT

SEQ ID NO: 102584 - protein, 16 aa, Homo sapiens
  heavy chain complementarity determining region 3 for antibody 51292
TRESPYVVYGRAFFDY

SEQ ID NO: 102585 - protein, 9 aa, Homo sapiens
  light chain complementarity determining region 3 for antibody 51293
QQYNSYSPT

SEQ ID NO: 102586 - protein, 18 aa, Homo sapiens
  heavy chain complementarity determining region 3 for antibody 51293
ASAHPQRFGYTLPEYFQH

SEQ ID NO: 102587 - protein, 9 aa, Homo sapiens
  light chain complementarity determining region 3 for antibody 51294
QQYNSYPIT

SEQ ID NO: 102588 - protein, 13 aa, Homo sapiens
  heavy chain complementarity determining region 3 for antibody 51294
AKDMRSWFGELDY

SEQ ID NO: 102589 - protein, 8 aa, Homo sapiens
  light chain complementarity determining region 3 for antibody 51295
QQYNSYGT

SEQ ID NO: 102590 - protein, 14 aa, Homo sapiens
  heavy chain complementarity determining region 3 for antibody 51295
ARGGPLILAAYFQH

SEQ ID NO: 102591 - protein, 10 aa, Homo sapiens
  light chain complementarity determining region 3 for antibody 51296
QQYNHWPPYT

SEQ ID NO: 102592 - protein, 15 aa, Homo sapiens
  heavy chain complementarity determining region 3 for antibody 51296
TRTADFWSGYGAFDI

SEQ ID NO: 102593 - protein, 10 aa, Homo sapiens
  light chain complementarity determining region 3 for antibody 51297
QQYGTSPRIT

SEQ ID NO: 102594 - protein, 13 aa, Homo sapiens
  heavy chain complementarity determining region 3 for antibody 51297
ARESSSLNRWFDP

SEQ ID NO: 102595 - protein, 10 aa, Homo sapiens
  light chain complementarity determining region 3 for antibody 51298
QQYGTSPPWT

SEQ ID NO: 102596 - protein, 19 aa, Homo sapiens
  heavy chain complementarity determining region 3 for antibody 51298
ARIRGRYGDSWFGGAYFQH

SEQ ID NO: 102597 - protein, 9 aa, Homo sapiens
  light chain complementarity determining region 3 for antibody 51299
QQYGTSPFT

SEQ ID NO: 102598 - protein, 17 aa, Homo sapiens
  heavy chain complementarity determining region 3 for antibody 51299
AKDLYSSDWYGVNAFDM

SEQ ID NO: 102599 - protein, 9 aa, Homo sapiens
  light chain complementarity determining region 3 for antibody 51300
QQYGSSSYT

SEQ ID NO: 102600 - protein, 19 aa, Homo sapiens
  heavy chain complementarity determining region 3 for antibody 51300
ARVSRELRGFVVYATYFDY

SEQ ID NO: 102601 - protein, 9 aa, Homo sapiens
  light chain complementarity determining region 3 for antibody 51301
QQYGSSPQT

SEQ ID NO: 102602 - protein, 15 aa, Homo sapiens
  heavy chain complementarity determining region 3 for antibody 51301
ARSSSNYPPDWYFDL

SEQ ID NO: 102603 - protein, 9 aa, Homo sapiens
  light chain complementarity determining region 3 for antibody 51302
QQYGSSPPT

SEQ ID NO: 102604 - protein, 13 aa, Homo sapiens
  heavy chain complementarity determining region 3 for antibody 51302
ARGQRWLQLYFDY

SEQ ID NO: 102605 - protein, 11 aa, Homo sapiens
  light chain complementarity determining region 3 for antibody 51303
QQYGSSPPKVT

SEQ ID NO: 102606 - protein, 15 aa, Homo sapiens
  heavy chain complementarity determining region 3 for antibody 51303
AKVYHWPGYYYAMDV

SEQ ID NO: 102607 - protein, 10 aa, Homo sapiens
  light chain complementarity determining region 3 for antibody 51304
QQYGSSPMYS

SEQ ID NO: 102608 - protein, 15 aa, Homo sapiens
  heavy chain complementarity determining region 3 for antibody 51304
ASSSTSWKRMYYFDY

SEQ ID NO: 102609 - protein, 9 aa, Homo sapiens
  light chain complementarity determining region 3 for antibody 51305
QQYGSSPLT

SEQ ID NO: 102610 - protein, 17 aa, Homo sapiens
  heavy chain complementarity determining region 3 for antibody 51305
ARDFRVSSIWYRTTFDS

SEQ ID NO: 102611 - protein, 10 aa, Homo sapiens
  light chain complementarity determining region 3 for antibody 51306
QQYGSSPGYT

SEQ ID NO: 102612 - protein, 13 aa, Homo sapiens
  heavy chain complementarity determining region 3 for antibody 51306
ARDPNSSGYYPRD

SEQ ID NO: 102613 - protein, 7 aa, Homo sapiens
  light chain complementarity determining region 3 for antibody 51307
QQYGSSL

SEQ ID NO: 102614 - protein, 21 aa, Homo sapiens
  heavy chain complementarity determining region 3 for antibody 51307
AREDGLLWFGWGSYGPSPVTI

SEQ ID NO: 102615 - protein, 9 aa, Homo sapiens
  light chain complementarity determining region 3 for antibody 51308
QQYGNSPWT

SEQ ID NO: 102616 - protein, 20 aa, Homo sapiens
  heavy chain complementarity determining region 3 for antibody 51308
ARQNDYFSDGWRFPLGWFDS

SEQ ID NO: 102617 - protein, 9 aa, Homo sapiens
  light chain complementarity determining region 3 for antibody 51309
QQYGISTRT

SEQ ID NO: 102618 - protein, 23 aa, Homo sapiens
  heavy chain complementarity determining region 3 for antibody 51309
TRLHIVPLPTTTGYPFFYHAMDV

SEQ ID NO: 102619 - protein, 11 aa, Homo sapiens
  light chain complementarity determining region 3 for antibody 51310
QQYGGGSPGYT

SEQ ID NO: 102620 - protein, 12 aa, Homo sapiens
  heavy chain complementarity determining region 3 for antibody 51310
AREYPNTCYFDY

SEQ ID NO: 102621 - protein, 10 aa, Homo sapiens
  light chain complementarity determining region 3 for antibody 51311
QQYDSSSPIT

SEQ ID NO: 102622 - protein, 14 aa, Homo sapiens
  heavy chain complementarity determining region 3 for antibody 51311
ARDPMDTAMINFDY

SEQ ID NO: 102623 - protein, 9 aa, Homo sapiens
  light chain complementarity determining region 3 for antibody 51312
QQYDNLPRT

SEQ ID NO: 102624 - protein, 15 aa, Homo sapiens
  heavy chain complementarity determining region 3 for antibody 51312
ASLPTTWGCFETQNL

SEQ ID NO: 102625 - protein, 10 aa, Homo sapiens
  light chain complementarity determining region 3 for antibody 51313
QQSYTTPLFT

SEQ ID NO: 102626 - protein, 19 aa, Homo sapiens
  heavy chain complementarity determining region 3 for antibody 51313
ATDGRNDFWRGYSKGAFDI

SEQ ID NO: 102627 - protein, 9 aa, Homo sapiens
  light chain complementarity determining region 3 for antibody 51314
QQSYSTPRT

SEQ ID NO: 102628 - protein, 15 aa, Homo sapiens
  heavy chain complementarity determining region 3 for antibody 51314
ARAAVVVVSARAFDI

SEQ ID NO: 102629 - protein, 9 aa, Homo sapiens
  light chain complementarity determining region 3 for antibody 51315
QQSYSFLYT

SEQ ID NO: 102630 - protein, 18 aa, Homo sapiens
  heavy chain complementarity determining region 3 for antibody 51315
ARGMRYSNDWRTRTYFDY

SEQ ID NO: 102631 - protein, 9 aa, Homo sapiens
  light chain complementarity determining region 3 for antibody 51316
QQSYFSPRT

SEQ ID NO: 102632 - protein, 16 aa, Homo sapiens
  heavy chain complementarity determining region 3 for antibody 51316
ARVRYLEWRGVDWFDP

SEQ ID NO: 102633 - protein, 9 aa, Homo sapiens
  light chain complementarity determining region 3 for antibody 51317
QQSSSFPLT

SEQ ID NO: 102634 - protein, 13 aa, Homo sapiens
  heavy chain complementarity determining region 3 for antibody 51317
TKAIPVVNDVFDV

SEQ ID NO: 102635 - protein, 11 aa, Homo sapiens
  light chain complementarity determining region 3 for antibody 51318
QQRSNWPQALT

SEQ ID NO: 102636 - protein, 18 aa, Homo sapiens
  heavy chain complementarity determining region 3 for antibody 51318
AREVYSGYDSGWGGNFDY

SEQ ID NO: 102637 - protein, 9 aa, Homo sapiens
  light chain complementarity determining region 3 for antibody 51319
QQRSNWPLT

SEQ ID NO: 102638 - protein, 15 aa, Homo sapiens
  heavy chain complementarity determining region 3 for antibody 51319
ASGLTTVTTTGAFDF

SEQ ID NO: 102639 - protein, 9 aa, Homo sapiens
  light chain complementarity determining region 3 for antibody 51320
QQRSNWPLT

SEQ ID NO: 102640 - protein, 21 aa, Homo sapiens
  heavy chain complementarity determining region 3 for antibody 51320
AKTPTPHSRGWHDRLGRHFDY

SEQ ID NO: 102641 - protein, 11 aa, Homo sapiens
  light chain complementarity determining region 3 for antibody 51321
QQRGNWPPGAT

SEQ ID NO: 102642 - protein, 17 aa, Homo sapiens
  heavy chain complementarity determining region 3 for antibody 51321
AREANYVGQSGYRAFDI

SEQ ID NO: 102643 - protein, 9 aa, Homo sapiens
  light chain complementarity determining region 3 for antibody 51322
QQHYTTPLT

SEQ ID NO: 102644 - protein, 18 aa, Homo sapiens
  heavy chain complementarity determining region 3 for antibody 51322
AREGILRYLERRSTPVDV

SEQ ID NO: 102645 - protein, 9 aa, Homo sapiens
  light chain complementarity determining region 3 for antibody 51323
QQFAGSPRT

SEQ ID NO: 102646 - protein, 17 aa, Homo sapiens
  heavy chain complementarity determining region 3 for antibody 51323
TRVKYCSDGTCYTGTDY

SEQ ID NO: 102647 - protein, 9 aa, Homo sapiens
  light chain complementarity determining region 3 for antibody 51324
QQCYGIPFT

SEQ ID NO: 102648 - protein, 13 aa, Homo sapiens
  heavy chain complementarity determining region 3 for antibody 51324
ARGIHPGGHKFDL

SEQ ID NO: 102649 - protein, 10 aa, Homo sapiens
  light chain complementarity determining region 3 for antibody 51325
QLANSFPPYT

SEQ ID NO: 102650 - protein, 14 aa, Homo sapiens
  heavy chain complementarity determining region 3 for antibody 51325
ARRIAGELFSVFDI

SEQ ID NO: 102651 - protein, 9 aa, Homo sapiens
  light chain complementarity determining region 3 for antibody 51326
QHFGSSGYT

SEQ ID NO: 102652 - protein, 22 aa, Homo sapiens
  heavy chain complementarity determining region 3 for antibody 51326
ERDIGRSGWYAESRYYYKATDV

SEQ ID NO: 102653 - protein, 9 aa, Homo sapiens
  light chain complementarity determining region 3 for antibody 51327
MQGTHWPWT

SEQ ID NO: 102654 - protein, 16 aa, Homo sapiens
  heavy chain complementarity determining region 3 for antibody 51327
TRTYYFGSGSYSHFDY

SEQ ID NO: 102655 - protein, 9 aa, Homo sapiens
  light chain complementarity determining region 3 for antibody 51328
MQGTHWPPT

SEQ ID NO: 102656 - protein, 13 aa, Homo sapiens
  heavy chain complementarity determining region 3 for antibody 51328
ARDGKMRGTYYAN

SEQ ID NO: 102657 - protein, 8 aa, Homo sapiens
  light chain complementarity determining region 3 for antibody 51329
MQALQTRT

SEQ ID NO: 102658 - protein, 24 aa, Homo sapiens
  heavy chain complementarity determining region 3 for antibody 51329
AREAGVESCSSPSDHYNNYCGMDV

SEQ ID NO: 102659 - protein, 9 aa, Homo sapiens
  light chain complementarity determining region 3 for antibody 51330
MQALQTPLT

SEQ ID NO: 102660 - protein, 14 aa, Homo sapiens
  heavy chain complementarity determining region 3 for antibody 51330
ASGYSHDRAGAFDV

SEQ ID NO: 102661 - protein, 9 aa, Homo sapiens
  light chain complementarity determining region 3 for antibody 51331
HQSSSLPIT

SEQ ID NO: 102662 - protein, 10 aa, Homo sapiens
  heavy chain complementarity determining region 3 for antibody 51331
AGLGKESFDY

SEQ ID NO: 102663 - protein, 10 aa, Homo sapiens
  light chain complementarity determining region 3 for antibody 51332
HHRSDWPPIT

SEQ ID NO: 102664 - protein, 7 aa, Homo sapiens
  heavy chain complementarity determining region 3 for antibody 51332
ATGLPNF

SEQ ID NO: 102665 - protein, 9 aa, Homo sapiens
  light chain complementarity determining region 3 for antibody 51333
RQYNTYLYT

SEQ ID NO: 102666 - protein, 11 aa, Homo sapiens
  heavy chain complementarity determining region 3 for antibody 51333
ARGGWNEYFQH

SEQ ID NO: 102667 - protein, 9 aa, Homo sapiens
  light chain complementarity determining region 3 for antibody 51334
QYYRRSPFT

SEQ ID NO: 102668 - protein, 17 aa, Homo sapiens
  heavy chain complementarity determining region 3 for antibody 51334
ARVRAGGVVGTENAFDV

SEQ ID NO: 102669 - protein, 13 aa, Homo sapiens
  light chain complementarity determining region 3 for antibody 51335
QWHQFTTPPTVYI

SEQ ID NO: 102670 - protein, 14 aa, Homo sapiens
  heavy chain complementarity determining region 3 for antibody 51335
ARHTAVATTRGFDY

SEQ ID NO: 102671 - protein, 9 aa, Homo sapiens
  light chain complementarity determining region 3 for antibody 51336
QRYNSYWYT

SEQ ID NO: 102672 - protein, 24 aa, Homo sapiens
  heavy chain complementarity determining region 3 for antibody 51336
ARALKRCSSISCYGWNNYYYGMDV

SEQ ID NO: 102673 - protein, 9 aa, Homo sapiens
  light chain complementarity determining region 3 for antibody 51337
QQYSSYPNT

SEQ ID NO: 102674 - protein, 11 aa, Homo sapiens
  heavy chain complementarity determining region 3 for antibody 51337
ATNDYGDYARY

SEQ ID NO: 102675 - protein, 10 aa, Homo sapiens
  light chain complementarity determining region 3 for antibody 51338
QQYNDWPVFT

SEQ ID NO: 102676 - protein, 15 aa, Homo sapiens
  heavy chain complementarity determining region 3 for antibody 51338
ARTLSINGFYSGSDL

SEQ ID NO: 102677 - protein, 8 aa, Homo sapiens
  light chain complementarity determining region 3 for antibody 51339
QQYHYLLS

SEQ ID NO: 102678 - protein, 7 aa, Homo sapiens
  heavy chain complementarity determining region 3 for antibody 51339
ASHARDY

SEQ ID NO: 102679 - protein, 10 aa, Homo sapiens
  light chain complementarity determining region 3 for antibody 51340
QQYHNWPPLT

SEQ ID NO: 102680 - protein, 13 aa, Homo sapiens
  heavy chain complementarity determining region 3 for antibody 51340
ARGDGYNNNWFDP

SEQ ID NO: 102681 - protein, 9 aa, Homo sapiens
  light chain complementarity determining region 3 for antibody 51341
QQYGSSPVT

SEQ ID NO: 102682 - protein, 16 aa, Homo sapiens
  heavy chain complementarity determining region 3 for antibody 51341
TTDWGSGYSYVRAFDI

SEQ ID NO: 102683 - protein, 10 aa, Homo sapiens
  light chain complementarity determining region 3 for antibody 51342
QQYGSSPPIT

SEQ ID NO: 102684 - protein, 9 aa, Homo sapiens
  heavy chain complementarity determining region 3 for antibody 51342
NTGDDGHAI

SEQ ID NO: 102685 - protein, 8 aa, Homo sapiens
  light chain complementarity determining region 3 for antibody 51343
QQYGSSPL

SEQ ID NO: 102686 - protein, 16 aa, Homo sapiens
  heavy chain complementarity determining region 3 for antibody 51343
ATAQPRYSSGWDPFDF

SEQ ID NO: 102687 - protein, 10 aa, Homo sapiens
  light chain complementarity determining region 3 for antibody 51344
QQYGSSPAWT

SEQ ID NO: 102688 - protein, 17 aa, Homo sapiens
  heavy chain complementarity determining region 3 for antibody 51344
TRVKYCSDGTCYAGTDY

SEQ ID NO: 102689 - protein, 10 aa, Homo sapiens
  light chain complementarity determining region 3 for antibody 51345
QQYGNSPGDT

SEQ ID NO: 102690 - protein, 15 aa, Homo sapiens
  heavy chain complementarity determining region 3 for antibody 51345
ARAFHGSGIINTFDL

SEQ ID NO: 102691 - protein, 9 aa, Homo sapiens
  light chain complementarity determining region 3 for antibody 51346
QQYGMLPFT

SEQ ID NO: 102692 - protein, 19 aa, Homo sapiens
  heavy chain complementarity determining region 3 for antibody 51346
ARVIGVVYYSSGIQGWFDP

SEQ ID NO: 102693 - protein, 9 aa, Homo sapiens
  light chain complementarity determining region 3 for antibody 51347
QQYDNLPRT

SEQ ID NO: 102694 - protein, 15 aa, Homo sapiens
  heavy chain complementarity determining region 3 for antibody 51347
ASLPTTWWGFETQNL

SEQ ID NO: 102695 - protein, 9 aa, Homo sapiens
  light chain complementarity determining region 3 for antibody 51348
QQYDNLPRT

SEQ ID NO: 102696 - protein, 15 aa, Homo sapiens
  heavy chain complementarity determining region 3 for antibody 51348
ASLPTTWGGFETQNI

SEQ ID NO: 102697 - protein, 9 aa, Homo sapiens
  light chain complementarity determining region 3 for antibody 51349
QQYDNLPRT

SEQ ID NO: 102698 - protein, 15 aa, Homo sapiens
  heavy chain complementarity determining region 3 for antibody 51349
ASLPTTWGGFETQNH

SEQ ID NO: 102699 - protein, 9 aa, Homo sapiens
  light chain complementarity determining region 3 for antibody 51350
QQYDNLPRT

SEQ ID NO: 102700 - protein, 15 aa, Homo sapiens
  heavy chain complementarity determining region 3 for antibody 51350
ASLPTSWGGFETQNL

SEQ ID NO: 102701 - protein, 9 aa, Homo sapiens
  light chain complementarity determining region 3 for antibody 51351
QQYDNLPRK

SEQ ID NO: 102702 - protein, 15 aa, Homo sapiens
  heavy chain complementarity determining region 3 for antibody 51351
ASLPTTWGGFETQNL

SEQ ID NO: 102703 - protein, 10 aa, Homo sapiens
  light chain complementarity determining region 3 for antibody 51352
QQSYSTPRLT

SEQ ID NO: 102704 - protein, 17 aa, Homo sapiens
  heavy chain complementarity determining region 3 for antibody 51352
AKDRGGKQLWLDGTFDY

SEQ ID NO: 102705 - protein, 9 aa, Homo sapiens
  light chain complementarity determining region 3 for antibody 51353
QQSYSTPLT

SEQ ID NO: 102706 - protein, 16 aa, Homo sapiens
  heavy chain complementarity determining region 3 for antibody 51353
ARGLGYCGGDCYGFQH

SEQ ID NO: 102707 - protein, 9 aa, Homo sapiens
  light chain complementarity determining region 3 for antibody 51354
QQSYSTPFT

SEQ ID NO: 102708 - protein, 19 aa, Homo sapiens
  heavy chain complementarity determining region 3 for antibody 51354
ASYYYDSSVYYYYHDAFDI

SEQ ID NO: 102709 - protein, 9 aa, Homo sapiens
  light chain complementarity determining region 3 for antibody 51355
QQRTNWPLT

SEQ ID NO: 102710 - protein, 14 aa, Homo sapiens
  heavy chain complementarity determining region 3 for antibody 51355
VHRLMGNSYNGVDV

SEQ ID NO: 102711 - protein, 9 aa, Homo sapiens
  light chain complementarity determining region 3 for antibody 51356
QQRSNWPPT

SEQ ID NO: 102712 - protein, 16 aa, Homo sapiens
  heavy chain complementarity determining region 3 for antibody 51356
ASFSTAGRQEGYYFDY

SEQ ID NO: 102713 - protein, 11 aa, Homo sapiens
  light chain complementarity determining region 3 for antibody 51357
QQRSNWPPKYT

SEQ ID NO: 102714 - protein, 12 aa, Homo sapiens
  heavy chain complementarity determining region 3 for antibody 51357
AREIKAAAGILA

SEQ ID NO: 102715 - protein, 9 aa, Homo sapiens
  light chain complementarity determining region 3 for antibody 51358
QQRGDWPLT

SEQ ID NO: 102716 - protein, 22 aa, Homo sapiens
  heavy chain complementarity determining region 3 for antibody 51358
ARVLFYSDPSGQYSLTSEFFQF

SEQ ID NO: 102717 - protein, 9 aa, Homo sapiens
  light chain complementarity determining region 3 for antibody 51359
QQNDNLPRT

SEQ ID NO: 102718 - protein, 15 aa, Homo sapiens
  heavy chain complementarity determining region 3 for antibody 51359
ASLPTTWGGFETQNL

SEQ ID NO: 102719 - protein, 10 aa, Homo sapiens
  light chain complementarity determining region 3 for antibody 51360
QQCNSASPYT

SEQ ID NO: 102720 - protein, 24 aa, Homo sapiens
  heavy chain complementarity determining region 3 for antibody 51360
ARLAVYFGAVVPRASKRFRSYFDY

SEQ ID NO: 102721 - protein, 7 aa, Homo sapiens
  light chain complementarity determining region 3 for antibody 51361
QLPLPLT

SEQ ID NO: 102722 - protein, 14 aa, Homo sapiens
  heavy chain complementarity determining region 3 for antibody 51361
ASDRGPTRIGVFDY

SEQ ID NO: 102723 - protein, 9 aa, Homo sapiens
  light chain complementarity determining region 3 for antibody 51362
QHRSYWPLT

SEQ ID NO: 102724 - protein, 13 aa, Homo sapiens
  heavy chain complementarity determining region 3 for antibody 51362
AREKGWNDWYFDL

SEQ ID NO: 102725 - protein, 8 aa, Homo sapiens
  light chain complementarity determining region 3 for antibody 51363
QEYGSSPT

SEQ ID NO: 102726 - protein, 20 aa, Homo sapiens
  heavy chain complementarity determining region 3 for antibody 51363
ANRGRLEPLLYYDSSGLFDY

SEQ ID NO: 102727 - protein, 9 aa, Homo sapiens
  light chain complementarity determining region 3 for antibody 51364
MQSLQTPFT

SEQ ID NO: 102728 - protein, 17 aa, Homo sapiens
  heavy chain complementarity determining region 3 for antibody 51364
VKVIQPWLLDYYYGMDV

SEQ ID NO: 102729 - protein, 9 aa, Homo sapiens
  light chain complementarity determining region 3 for antibody 51365
MQPLRTPWT

SEQ ID NO: 102730 - protein, 22 aa, Homo sapiens
  heavy chain complementarity determining region 3 for antibody 51365
ARRSYCRGDCTLYPSDYYAFDV

SEQ ID NO: 102731 - protein, 9 aa, Homo sapiens
  light chain complementarity determining region 3 for antibody 51366
MQGTYWVWT

SEQ ID NO: 102732 - protein, 12 aa, Homo sapiens
  heavy chain complementarity determining region 3 for antibody 51366
VKADRDVYNRDS

SEQ ID NO: 102733 - protein, 9 aa, Homo sapiens
  light chain complementarity determining region 3 for antibody 51367
MQGLQNPLT

SEQ ID NO: 102734 - protein, 12 aa, Homo sapiens
  heavy chain complementarity determining region 3 for antibody 51367
ARFDTGWRYFDF

SEQ ID NO: 102735 - protein, 9 aa, Homo sapiens
  light chain complementarity determining region 3 for antibody 51368
MQALQTPRT

SEQ ID NO: 102736 - protein, 13 aa, Homo sapiens
  heavy chain complementarity determining region 3 for antibody 51368
ARHDNSGCYRFDY

SEQ ID NO: 102737 - protein, 9 aa, Homo sapiens
  light chain complementarity determining region 3 for antibody 51369
MQAIQWPRT

SEQ ID NO: 102738 - protein, 12 aa, Homo sapiens
  heavy chain complementarity determining region 3 for antibody 51369
VTDTERNYYMDV

SEQ ID NO: 102739 - protein, 9 aa, Homo sapiens
  light chain complementarity determining region 3 for antibody 51370
LQYHRYPRT

SEQ ID NO: 102740 - protein, 9 aa, Homo sapiens
  heavy chain complementarity determining region 3 for antibody 51370
VSGGYSYDY

SEQ ID NO: 102741 - protein, 9 aa, Homo sapiens
  light chain complementarity determining region 3 for antibody 51371
HQYNRSPWT

SEQ ID NO: 102742 - protein, 12 aa, Homo sapiens
  heavy chain complementarity determining region 3 for antibody 51371
ATTEWLTDAFEM

SEQ ID NO: 102743 - protein, 9 aa, Homo sapiens
  light chain complementarity determining region 3 for antibody 51372
HQYAAPPLT

SEQ ID NO: 102744 - protein, 10 aa, Homo sapiens
  heavy chain complementarity determining region 3 for antibody 51372
MGGRGWRSES

SEQ ID NO: 102745 - protein, 9 aa, Homo sapiens
  light chain complementarity determining region 3 for antibody 51373
HQSSTLPFT

SEQ ID NO: 102746 - protein, 20 aa, Homo sapiens
  heavy chain complementarity determining region 3 for antibody 51373
ATSDLSFYYHNSGYYPTIDY

SEQ ID NO: 102747 - protein, 9 aa, Homo sapiens
  light chain complementarity determining region 3 for antibody 51374
QYYTTYSST

SEQ ID NO: 102748 - protein, 13 aa, Homo sapiens
  heavy chain complementarity determining region 3 for antibody 51374
ARADLYNYVYFHY

SEQ ID NO: 102749 - protein, 9 aa, Homo sapiens
  light chain complementarity determining region 3 for antibody 51375
QQYYSYSWT

SEQ ID NO: 102750 - protein, 11 aa, Homo sapiens
  heavy chain complementarity determining region 3 for antibody 51375
ASKVGANPFGY

SEQ ID NO: 102751 - protein, 9 aa, Homo sapiens
  light chain complementarity determining region 3 for antibody 51376
QQYNTNLYT

SEQ ID NO: 102752 - protein, 14 aa, Homo sapiens
  heavy chain complementarity determining region 3 for antibody 51376
AKDRVSGGHSPFDS

SEQ ID NO: 102753 - protein, 9 aa, Homo sapiens
  light chain complementarity determining region 3 for antibody 51377
QQYNSYSWT

SEQ ID NO: 102754 - protein, 9 aa, Homo sapiens
  heavy chain complementarity determining region 3 for antibody 51377
AYSGSYFDY

SEQ ID NO: 102755 - protein, 10 aa, Homo sapiens
  light chain complementarity determining region 3 for antibody 51378
QQYNSYSPYT

SEQ ID NO: 102756 - protein, 24 aa, Homo sapiens
  heavy chain complementarity determining region 3 for antibody 51378
ARLSVYFGEVEAAASKRFRSYFNC

SEQ ID NO: 102757 - protein, 9 aa, Homo sapiens
  light chain complementarity determining region 3 for antibody 51379
QQYNSYPYT

SEQ ID NO: 102758 - protein, 11 aa, Homo sapiens
  heavy chain complementarity determining region 3 for antibody 51379
ASSDFGDYARY

SEQ ID NO: 102759 - protein, 9 aa, Homo sapiens
  light chain complementarity determining region 3 for antibody 51380
QQYNSYPYT

SEQ ID NO: 102760 - protein, 15 aa, Homo sapiens
  heavy chain complementarity determining region 3 for antibody 51380
ARVHLRVSGWSPFDY

SEQ ID NO: 102761 - protein, 9 aa, Homo sapiens
  light chain complementarity determining region 3 for antibody 51381
QQYNSYPYT

SEQ ID NO: 102762 - protein, 19 aa, Homo sapiens
  heavy chain complementarity determining region 3 for antibody 51381
ARNPLYLYENIGAEGAFDI

SEQ ID NO: 102763 - protein, 9 aa, Homo sapiens
  light chain complementarity determining region 3 for antibody 51382
QQYNSFSPT

SEQ ID NO: 102764 - protein, 16 aa, Homo sapiens
  heavy chain complementarity determining region 3 for antibody 51382
ARPSSSGYYSLDAFDI

SEQ ID NO: 102765 - protein, 9 aa, Homo sapiens
  light chain complementarity determining region 3 for antibody 51383
QQYNNWPYT

SEQ ID NO: 102766 - protein, 14 aa, Homo sapiens
  heavy chain complementarity determining region 3 for antibody 51383
ARGYNSGWSDHLDF

SEQ ID NO: 102767 - protein, 8 aa, Homo sapiens
  light chain complementarity determining region 3 for antibody 51384
QQYNNWPV

SEQ ID NO: 102768 - protein, 14 aa, Homo sapiens
  heavy chain complementarity determining region 3 for antibody 51384
ARHSEVIAVVVFDY

SEQ ID NO: 102769 - protein, 9 aa, Homo sapiens
  light chain complementarity determining region 3 for antibody 51385
QQYNNWPRT

SEQ ID NO: 102770 - protein, 12 aa, Homo sapiens
  heavy chain complementarity determining region 3 for antibody 51385
ARDHWSGENFDY

SEQ ID NO: 102771 - protein, 10 aa, Homo sapiens [sequence omitted]

SEQ ID NO: 102772 - protein, 10 aa, Homo sapiens
  heavy chain complementarity determining region 3 for antibody 51386
ARENVGAVDH

SEQ ID NO: 102773 - protein, 10 aa, Homo sapiens
  light chain complementarity determining region 3 for antibody 51387
QQYNIWPLFT

SEQ ID NO: 102774 - protein, 15 aa, Homo sapiens
  heavy chain complementarity determining region 3 for antibody 51387
ARASNWLRGDDAFDI

SEQ ID NO: 102775 - protein, 9 aa, Homo sapiens
  light chain complementarity determining region 3 for antibody 51388
QQYHSYPYS

SEQ ID NO: 102776 - protein, 11 aa, Homo sapiens
  heavy chain complementarity determining region 3 for antibody 51388
ARVVPNYYDYY

SEQ ID NO: 102777 - protein, 10 aa, Homo sapiens
  light chain complementarity determining region 3 for antibody 51389
QQYHNRPPDT

SEQ ID NO: 102778 - protein, 14 aa, Homo sapiens
  heavy chain complementarity determining region 3 for antibody 51389
ARDPPGIALAGNSG

SEQ ID NO: 102779 - protein, 9 aa, Homo sapiens
  light chain complementarity determining region 3 for antibody 51390
QQYGTSPFT

SEQ ID NO: 102780 - protein, 14 aa, Homo sapiens
  heavy chain complementarity determining region 3 for antibody 51390
ARVMGHVEARPLDD

SEQ ID NO: 102781 - protein, 10 aa, Homo sapiens
  light chain complementarity determining region 3 for antibody 51391
QQYGSSQAWT

SEQ ID NO: 102782 - protein, 17 aa, Homo sapiens
  heavy chain complementarity determining region 3 for antibody 51391
TRVKYCSDGTCYTGTDY

SEQ ID NO: 102783 - protein, 9 aa, Homo sapiens
  light chain complementarity determining region 3 for antibody 51392
QQYGSSPYT

SEQ ID NO: 102784 - protein, 14 aa, Homo sapiens
  heavy chain complementarity determining region 3 for antibody 51392
ARSENYYDTSGIDY

SEQ ID NO: 102785 - protein, 9 aa, Homo sapiens
  light chain complementarity determining region 3 for antibody 51393
QQYGSSPYT

SEQ ID NO: 102786 - protein, 15 aa, Homo sapiens
  heavy chain complementarity determining region 3 for antibody 51393
ARGWDSDSRGYYYFF

SEQ ID NO: 102787 - protein, 9 aa, Homo sapiens
  light chain complementarity determining region 3 for antibody 51394
QQYGSSPLT

SEQ ID NO: 102788 - protein, 20 aa, Homo sapiens
  heavy chain complementarity determining region 3 for antibody 51394
ARGGYYDILTGYYSGIPIDY

SEQ ID NO: 102789 - protein, 10 aa, Homo sapiens
  light chain complementarity determining region 3 for antibody 51395
QQYGSSPAWT

SEQ ID NO: 102790 - protein, 17 aa, Homo sapiens
  heavy chain complementarity determining region 3 for antibody 51395
TRVKYCSDGTCYTGNDY

SEQ ID NO: 102791 - protein, 10 aa, Homo sapiens
  light chain complementarity determining region 3 for antibody 51396
QQYGSSPAWT

SEQ ID NO: 102792 - protein, 17 aa, Homo sapiens
  heavy chain complementarity determining region 3 for antibody 51396
TRVKYCSDGACYTGTDY

SEQ ID NO: 102793 - protein, 9 aa, Homo sapiens
  light chain complementarity determining region 3 for antibody 51397
QQYDSFPVA

SEQ ID NO: 102794 - protein, 20 aa, Homo sapiens
  heavy chain complementarity determining region 3 for antibody 51397
TRAHISKIVVLIKPNWYFDH

SEQ ID NO: 102795 - protein, 9 aa, Homo sapiens
  light chain complementarity determining region 3 for antibody 51398
QQYDSDFPP

SEQ ID NO: 102796 - protein, 9 aa, Homo sapiens
  heavy chain complementarity determining region 3 for antibody 51398
ARGAAAADY

SEQ ID NO: 102797 - protein, 9 aa, Homo sapiens
  light chain complementarity determining region 3 for antibody 51399
QQYDNLPRT

SEQ ID NO: 102798 - protein, 15 aa, Homo sapiens
  heavy chain complementarity determining region 3 for antibody 51399
ASLPTTWGGVETQNL

SEQ ID NO: 102799 - protein, 9 aa, Homo sapiens
  light chain complementarity determining region 3 for antibody 51400
QQYDNLPRT

SEQ ID NO: 102800 - protein, 15 aa, Homo sapiens
  heavy chain complementarity determining region 3 for antibody 51400
ASLPTTWGGFETQDL

SEQ ID NO: 102801 - protein, 9 aa, Homo sapiens
  light chain complementarity determining region 3 for antibody 51401
QQYDNLPRT

SEQ ID NO: 102802 - protein, 15 aa, Homo sapiens
  heavy chain complementarity determining region 3 for antibody 51401
ASLPNTWGGFETQNL

SEQ ID NO: 102803 - protein, 9 aa, Homo sapiens
  light chain complementarity determining region 3 for antibody 51402
QQYDNLPRT

SEQ ID NO: 102804 - protein, 15 aa, Homo sapiens
  heavy chain complementarity determining region 3 for antibody 51402
ASLATTWGGFETQNL

SEQ ID NO: 102805 - protein, 10 aa, Homo sapiens
  light chain complementarity determining region 3 for antibody 51403
QQYDNLLALT

SEQ ID NO: 102806 - protein, 14 aa, Homo sapiens
  heavy chain complementarity determining region 3 for antibody 51403
AGRWGDITPPILDY

SEQ ID NO: 102807 - protein, 8 aa, Homo sapiens
  light chain complementarity determining region 3 for antibody 51404
QQYDNLGA

SEQ ID NO: 102808 - protein, 17 aa, Homo sapiens
  heavy chain complementarity determining region 3 for antibody 51404
GETQPRKGAFYYYAVDV

SEQ ID NO: 102809 - protein, 9 aa, Homo sapiens
  light chain complementarity determining region 3 for antibody 51405
QQYANIPPT

SEQ ID NO: 102810 - protein, 17 aa, Homo sapiens
  heavy chain complementarity determining region 3 for antibody 51405
ARGPLIRGLGVPVPLDY

SEQ ID NO: 102811 - protein, 9 aa, Homo sapiens
  light chain complementarity determining region 3 for antibody 51406
QQSYSTPWT

SEQ ID NO: 102812 - protein, 16 aa, Homo sapiens
  heavy chain complementarity determining region 3 for antibody 51406
AKVAARLSYYYYGLDV

SEQ ID NO: 102813 - protein, 9 aa, Homo sapiens
  light chain complementarity determining region 3 for antibody 51407
QQSYSTPQT

SEQ ID NO: 102814 - protein, 17 aa, Homo sapiens
  heavy chain complementarity determining region 3 for antibody 51407
ARGAVDFWSGRTGSHDP

SEQ ID NO: 102815 - protein, 9 aa, Homo sapiens
  light chain complementarity determining region 3 for antibody 51408
QQSYSTPIT

SEQ ID NO: 102816 - protein, 16 aa, Homo sapiens
  heavy chain complementarity determining region 3 for antibody 51408
ARSLMVTAFIRPPNDY

SEQ ID NO: 102817 - protein, 9 aa, Homo sapiens
  light chain complementarity determining region 3 for antibody 51409
QQSYSSPWT

SEQ ID NO: 102818 - protein, 20 aa, Homo sapiens
  heavy chain complementarity determining region 3 for antibody 51409
ARGRRELTRGRSHYYYYMDV

SEQ ID NO: 102819 - protein, 10 aa, Homo sapiens
  light chain complementarity determining region 3 for antibody 51410
QQSYSPPPFP

SEQ ID NO: 102820 - protein, 14 aa, Homo sapiens
  heavy chain complementarity determining region 3 for antibody 51410
ARVHDSSWPPVFDF

SEQ ID NO: 102821 - protein, 9 aa, Homo sapiens
  light chain complementarity determining region 3 for antibody 51411
QQRSNWLWT

SEQ ID NO: 102822 - protein, 10 aa, Homo sapiens
  heavy chain complementarity determining region 3 for antibody 51411
ARVGTMIVET

SEQ ID NO: 102823 - protein, 6 aa, Homo sapiens
  light chain complementarity determining region 3 for antibody 51412
QQPGYT

SEQ ID NO: 102824 - protein, 14 aa, Homo sapiens
  heavy chain complementarity determining region 3 for antibody 51412
ATTVDTTLAPYFDY

SEQ ID NO: 102825 - protein, 9 aa, Homo sapiens
  light chain complementarity determining region 3 for antibody 51413
QQLNSYPRT

SEQ ID NO: 102826 - protein, 15 aa, Homo sapiens
  heavy chain complementarity determining region 3 for antibody 51413
AREHYDILTGFHIDF

SEQ ID NO: 102827 - protein, 9 aa, Homo sapiens
  light chain complementarity determining region 3 for antibody 51414
QQLNSYPLT

SEQ ID NO: 102828 - protein, 22 aa, Homo sapiens
  heavy chain complementarity determining region 3 for antibody 51414
AKDLASMVRGVIKLRYYYGMDV

SEQ ID NO: 102829 - protein, 9 aa, Homo sapiens
  light chain complementarity determining region 3 for antibody 51415
QQLFSYPLT

SEQ ID NO: 102830 - protein, 15 aa, Homo sapiens
  heavy chain complementarity determining region 3 for antibody 51415
ATLDMTLRHAWQFDL

SEQ ID NO: 102831 - protein, 9 aa, Homo sapiens
  light chain complementarity determining region 3 for antibody 51416
QQFDNTLWT

SEQ ID NO: 102832 - protein, 15 aa, Homo sapiens
  heavy chain complementarity determining region 3 for antibody 51416
ARDGGLERRGPQFDY

SEQ ID NO: 102833 - protein, 9 aa, Homo sapiens
  light chain complementarity determining region 3 for antibody 51417
QQANSFPLT

SEQ ID NO: 102834 - protein, 12 aa, Homo sapiens
  heavy chain complementarity determining region 3 for antibody 51417
VREGEAYDYGDH

SEQ ID NO: 102835 - protein, 11 aa, Homo sapiens
  light chain complementarity determining region 3 for antibody 51418
QLRSNWPLSLT

SEQ ID NO: 102836 - protein, 16 aa, Homo sapiens
  heavy chain complementarity determining region 3 for antibody 51418
AKEIYGDYFNYYYMDV

SEQ ID NO: 102837 - protein, 9 aa, Homo sapiens
  light chain complementarity determining region 3 for antibody 51419
QKYNSASWT

SEQ ID NO: 102838 - protein, 14 aa, Homo sapiens
  heavy chain complementarity determining region 3 for antibody 51419
ARRVAAATNDAFDI

SEQ ID NO: 102839 - protein, 6 aa, Homo sapiens
  light chain complementarity determining region 3 for antibody 51420
QHYGST

SEQ ID NO: 102840 - protein, 14 aa, Homo sapiens
  heavy chain complementarity determining region 3 for antibody 51420
AREVAVSGTIYFDV

SEQ ID NO: 102841 - protein, 9 aa, Homo sapiens
  light chain complementarity determining region 3 for antibody 51421
QHYGSSAGT

SEQ ID NO: 102842 - protein, 16 aa, Homo sapiens
  heavy chain complementarity determining region 3 for antibody 51421
ARASAAAGTTRVAFDM

SEQ ID NO: 102843 - protein, 9 aa, Homo sapiens
  light chain complementarity determining region 3 for antibody 51422
QHYAYPPRT

SEQ ID NO: 102844 - protein, 13 aa, Homo sapiens
  heavy chain complementarity determining region 3 for antibody 51422
GRGQDSDWPLMAY

SEQ ID NO: 102845 - protein, 9 aa, Homo sapiens
  light chain complementarity determining region 3 for antibody 51423
QHFGSSGYT

SEQ ID NO: 102846 - protein, 22 aa, Homo sapiens
  heavy chain complementarity determining region 3 for antibody 51423
ARDIGRSGWYAESRYYYKAMDF

SEQ ID NO: 102847 - protein, 7 aa, Homo sapiens
  light chain complementarity determining region 3 for antibody 51424
MQGTQWT

SEQ ID NO: 102848 - protein, 15 aa, Homo sapiens
  heavy chain complementarity determining region 3 for antibody 51424
ARAQFPLGVLLAFDI

SEQ ID NO: 102849 - protein, 9 aa, Homo sapiens
  light chain complementarity determining region 3 for antibody 51425
MQGGNWPYT

SEQ ID NO: 102850 - protein, 10 aa, Homo sapiens
  heavy chain complementarity determining region 3 for antibody 51425
VRDVWFSAEH

SEQ ID NO: 102851 - protein, 8 aa, Homo sapiens
  light chain complementarity determining region 3 for antibody 51426
MQALQIPT

SEQ ID NO: 102852 - protein, 21 aa, Homo sapiens
  heavy chain complementarity determining region 3 for antibody 51426
ARGSSLEVSAAEHYYYKGLDV

SEQ ID NO: 102853 - protein, 8 aa, Homo sapiens
  light chain complementarity determining region 3 for antibody 51427
MQALQART

SEQ ID NO: 102854 - protein, 24 aa, Homo sapiens
  heavy chain complementarity determining region 3 for antibody 51427
AREAGVESCSSPSDYYNNYCGMDV

SEQ ID NO: 102855 - protein, 9 aa, Homo sapiens
  light chain complementarity determining region 3 for antibody 51428
LQHNSYPRT

SEQ ID NO: 102856 - protein, 15 aa, Homo sapiens
  heavy chain complementarity determining region 3 for antibody 51428
AKVSVDTGVRSLSDY

SEQ ID NO: 102857 - protein, 9 aa, Homo sapiens
  light chain complementarity determining region 3 for antibody 51429
LQGLQTPRT

SEQ ID NO: 102858 - protein, 17 aa, Homo sapiens
  heavy chain complementarity determining region 3 for antibody 51429
ARDMYYWDSAGYYAFDV

SEQ ID NO: 102859 - protein, 8 aa, Homo sapiens
  light chain complementarity determining region 3 for antibody 51430
RQYGSSYT

SEQ ID NO: 102860 - protein, 13 aa, Homo sapiens
  heavy chain complementarity determining region 3 for antibody 51430
ARVVTMTGLRFDP

SEQ ID NO: 102861 - protein, 9 aa, Homo sapiens
  light chain complementarity determining region 3 for antibody 51431
QQYYGTRWT

SEQ ID NO: 102862 - protein, 14 aa, Homo sapiens
  heavy chain complementarity determining region 3 for antibody 51431
TTMVNYYNTDHFDY

SEQ ID NO: 102863 - protein, 9 aa, Homo sapiens
  light chain complementarity determining region 3 for antibody 51432
QQYSSYPYT

SEQ ID NO: 102864 - protein, 11 aa, Homo sapiens
  heavy chain complementarity determining region 3 for antibody 51432
ASSDFGDYARY

SEQ ID NO: 102865 - protein, 9 aa, Homo sapiens
  light chain complementarity determining region 3 for antibody 51433
QQYNTYSST

SEQ ID NO: 102866 - protein, 14 aa, Homo sapiens
  heavy chain complementarity determining region 3 for antibody 51433
ARGNPNGYSYYFDY

SEQ ID NO: 102867 - protein, 9 aa, Homo sapiens
  light chain complementarity determining region 3 for antibody 51434
QQYNTYPIT

SEQ ID NO: 102868 - protein, 17 aa, Homo sapiens
  heavy chain complementarity determining region 3 for antibody 51434
AREAEPWSSPGGDWFDP

SEQ ID NO: 102869 - protein, 9 aa, Homo sapiens
  light chain complementarity determining region 3 for antibody 51435
QQYNSFSYT

SEQ ID NO: 102870 - protein, 13 aa, Homo sapiens
  heavy chain complementarity determining region 3 for antibody 51435
ASSELRFLEWFNY

SEQ ID NO: 102871 - protein, 9 aa, Homo sapiens
  light chain complementarity determining region 3 for antibody 51436
QQYNNWPQT

SEQ ID NO: 102872 - protein, 19 aa, Homo sapiens
  heavy chain complementarity determining region 3 for antibody 51436
ARTGEEGWFGEVLPTYFDS

SEQ ID NO: 102873 - protein, 11 aa, Homo sapiens
  light chain complementarity determining region 3 for antibody 51437
QQYNKWPPEYT

SEQ ID NO: 102874 - protein, 13 aa, Homo sapiens
  heavy chain complementarity determining region 3 for antibody 51437
AKEGLPRPGYFDY

SEQ ID NO: 102875 - protein, 11 aa, Homo sapiens
  light chain complementarity determining region 3 for antibody 51438
QQYNDWPPERT

SEQ ID NO: 102876 - protein, 16 aa, Homo sapiens
  heavy chain complementarity determining region 3 for antibody 51438
ARVKSSRRDYGDYTDY

SEQ ID NO: 102877 - protein, 9 aa, Homo sapiens
  light chain complementarity determining region 3 for antibody 51439
QQYGSSSWT

SEQ ID NO: 102878 - protein, 22 aa, Homo sapiens
  heavy chain complementarity determining region 3 for antibody 51439
ARSGYYRGSGTYQPPSYYGMDV

SEQ ID NO: 102879 - protein, 8 aa, Homo sapiens
  light chain complementarity determining region 3 for antibody 51440
QQYGSSST

SEQ ID NO: 102880 - protein, 21 aa, Homo sapiens
  heavy chain complementarity determining region 3 for antibody 51440
ARDHGYGGNGRVYYYDYGMDV

SEQ ID NO: 102881 - protein, 9 aa, Homo sapiens
  light chain complementarity determining region 3 for antibody 51441
QQYGSSPYT

SEQ ID NO: 102882 - protein, 17 aa, Homo sapiens
  heavy chain complementarity determining region 3 for antibody 51441
ARGSGSSSWPSRWYFDL

SEQ ID NO: 102883 - protein, 10 aa, Homo sapiens
  light chain complementarity determining region 3 for antibody 51442
QQYGSSPSIT

SEQ ID NO: 102884 - protein, 19 aa, Homo sapiens
  heavy chain complementarity determining region 3 for antibody 51442
AKSAISDYCTNGVCWHFDY

SEQ ID NO: 102885 - protein, 10 aa, Homo sapiens
  light chain complementarity determining region 3 for antibody 51443
QQYGSSPPIT

SEQ ID NO: 102886 - protein, 9 aa, Homo sapiens
  heavy chain complementarity determining region 3 for antibody 51443
TTGDDGLAI

SEQ ID NO: 102887 - protein, 9 aa, Homo sapiens
  light chain complementarity determining region 3 for antibody 51444
QQYGSSPLT

SEQ ID NO: 102888 - protein, 15 aa, Homo sapiens
  heavy chain complementarity determining region 3 for antibody 51444
AAVRSGTIIIDAMDM

SEQ ID NO: 102889 - protein, 9 aa, Homo sapiens
  light chain complementarity determining region 3 for antibody 51445
QQYGSSPGT

SEQ ID NO: 102890 - protein, 18 aa, Homo sapiens
  heavy chain complementarity determining region 3 for antibody 51445
ARESLHYYDSSVSWYFDL

SEQ ID NO: 102891 - protein, 10 aa, Homo sapiens
  light chain complementarity determining region 3 for antibody 51446
QQYGSSPAWT

SEQ ID NO: 102892 - protein, 17 aa, Homo sapiens
  heavy chain complementarity determining region 3 for antibody 51446
TRVKYCSDGTCYTGTEY

SEQ ID NO: 102893 - protein, 10 aa, Homo sapiens
  light chain complementarity determining region 3 for antibody 51447
QQYGSSPAWP

SEQ ID NO: 102894 - protein, 17 aa, Homo sapiens
  heavy chain complementarity determining region 3 for antibody 51447
TRVKYCSDGTCYTGTDY

SEQ ID NO: 102895 - protein, 9 aa, Homo sapiens
  light chain complementarity determining region 3 for antibody 51448
QQYDTPPWT

SEQ ID NO: 102896 - protein, 13 aa, Homo sapiens
  heavy chain complementarity determining region 3 for antibody 51448
ARETLIHLPAFDH

SEQ ID NO: 102897 - protein, 9 aa, Homo sapiens
  light chain complementarity determining region 3 for antibody 51449
QQYDSYPCT

SEQ ID NO: 102898 - protein, 15 aa, Homo sapiens
  heavy chain complementarity determining region 3 for antibody 51449
AHSAFVDVLTPFFAY

SEQ ID NO: 102899 - protein, 10 aa, Homo sapiens
  light chain complementarity determining region 3 for antibody 51450
QQYDNSPPPT

SEQ ID NO: 102900 - protein, 19 aa, Homo sapiens
  heavy chain complementarity determining region 3 for antibody 51450
TREPAAAGTKSRKAEYFQH

SEQ ID NO: 102901 - protein, 9 aa, Homo sapiens
  light chain complementarity determining region 3 for antibody 51451
QQYDNLPRT

SEQ ID NO: 102902 - protein, 15 aa, Homo sapiens
  heavy chain complementarity determining region 3 for antibody 51451
ASLPTTWGGFETPNL

SEQ ID NO: 102903 - protein, 9 aa, Homo sapiens
  light chain complementarity determining region 3 for antibody 51452
QQYDNLLRT

SEQ ID NO: 102904 - protein, 15 aa, Homo sapiens
  heavy chain complementarity determining region 3 for antibody 51452
ASLPTTWGGFETQNL

SEQ ID NO: 102905 - protein, 9 aa, Homo sapiens
  light chain complementarity determining region 3 for antibody 51453
QQYDNIPRT

SEQ ID NO: 102906 - protein, 15 aa, Homo sapiens
  heavy chain complementarity determining region 3 for antibody 51453
ASLPTTWGGFETQNL

SEQ ID NO: 102907 - protein, 9 aa, Homo sapiens
  light chain complementarity determining region 3 for antibody 51454
QQYDNFPRT

SEQ ID NO: 102908 - protein, 15 aa, Homo sapiens
  heavy chain complementarity determining region 3 for antibody 51454
ASLPTTWGGFETQNL

SEQ ID NO: 102909 - protein, 9 aa, Homo sapiens
  light chain complementarity determining region 3 for antibody 51455
QQSYSTPLT

SEQ ID NO: 102910 - protein, 10 aa, Homo sapiens
  heavy chain complementarity determining region 3 for antibody 51455
ARERGRAFDL

SEQ ID NO: 102911 - protein, 9 aa, Homo sapiens
  light chain complementarity determining region 3 for antibody 51456
QQSYNIPLT

SEQ ID NO: 102912 - protein, 15 aa, Homo sapiens
  heavy chain complementarity determining region 3 for antibody 51456
AREPPREWDPNWFDT

SEQ ID NO: 102913 - protein, 9 aa, Homo sapiens
  light chain complementarity determining region 3 for antibody 51457
QQSDSTPFT

SEQ ID NO: 102914 - protein, 13 aa, Homo sapiens
  heavy chain complementarity determining region 3 for antibody 51457
TTSGDGSGWDFDY

SEQ ID NO: 102915 - protein, 9 aa, Homo sapiens
  light chain complementarity determining region 3 for antibody 51458
QQRSSWPPT

SEQ ID NO: 102916 - protein, 19 aa, Homo sapiens
  heavy chain complementarity determining region 3 for antibody 51458
AKTLTLFQGRGATNYYFDY

SEQ ID NO: 102917 - protein, 11 aa, Homo sapiens
  light chain complementarity determining region 3 for antibody 51459
QQRSNWPPTYT

SEQ ID NO: 102918 - protein, 12 aa, Homo sapiens
  heavy chain complementarity determining region 3 for antibody 51459
AREIKAAAGIHA

SEQ ID NO: 102919 - protein, 9 aa, Homo sapiens
  light chain complementarity determining region 3 for antibody 51460
QQRSNWPGT

SEQ ID NO: 102920 - protein, 17 aa, Homo sapiens
  heavy chain complementarity determining region 3 for antibody 51460
ARDHGDYYGSGSFPLHY

SEQ ID NO: 102921 - protein, 10 aa, Homo sapiens
  light chain complementarity determining region 3 for antibody 51461
QQRSGWPPGT

SEQ ID NO: 102922 - protein, 17 aa, Homo sapiens
  heavy chain complementarity determining region 3 for antibody 51461
ARDQVKWQQPGTWYFDL

SEQ ID NO: 102923 - protein, 9 aa, Homo sapiens
  light chain complementarity determining region 3 for antibody 51462
QQFNSFSFS

SEQ ID NO: 102924 - protein, 17 aa, Homo sapiens
  heavy chain complementarity determining region 3 for antibody 51462
AHSRYISAAGLLVGFDY

SEQ ID NO: 102925 - protein, 9 aa, Homo sapiens
  light chain complementarity determining region 3 for antibody 51463
QQCYSTPYS

SEQ ID NO: 102926 - protein, 9 aa, Homo sapiens
  heavy chain complementarity determining region 3 for antibody 51463
ITDQAGGRY

SEQ ID NO: 102927 - protein, 10 aa, Homo sapiens
  light chain complementarity determining region 3 for antibody 51464
QKYNSALPFT

SEQ ID NO: 102928 - protein, 13 aa, Homo sapiens
  heavy chain complementarity determining region 3 for antibody 51464
ARDLPRSGPPFDP

SEQ ID NO: 102929 - protein, 9 aa, Homo sapiens
  light chain complementarity determining region 3 for antibody 51465
QKYDNLPRT

SEQ ID NO: 102930 - protein, 15 aa, Homo sapiens
  heavy chain complementarity determining region 3 for antibody 51465
ASLPTTWGGFETQNL

SEQ ID NO: 102931 - protein, 8 aa, Homo sapiens
  light chain complementarity determining region 3 for antibody 51466
QHYGGSPT

SEQ ID NO: 102932 - protein, 12 aa, Homo sapiens
  heavy chain complementarity determining region 3 for antibody 51466
AGHWGELVIFDS

SEQ ID NO: 102933 - protein, 9 aa, Homo sapiens
  light chain complementarity determining region 3 for antibody 51467
QHFGSSGYT

SEQ ID NO: 102934 - protein, 22 aa, Homo sapiens
  heavy chain complementarity determining region 3 for antibody 51467
ASDIGRSGWYAESRYYYKAMDV

SEQ ID NO: 102935 - protein, 9 aa, Homo sapiens
  light chain complementarity determining region 3 for antibody 51468
QHFGSSGYT

SEQ ID NO: 102936 - protein, 22 aa, Homo sapiens
  heavy chain complementarity determining region 3 for antibody 51468
ARDIGRSGWYAESRYYYKAIDV

SEQ ID NO: 102937 - protein, 9 aa, Homo sapiens
  light chain complementarity determining region 3 for antibody 51469
QHFGSSGYT

SEQ ID NO: 102938 - protein, 22 aa, Homo sapiens
  heavy chain complementarity determining region 3 for antibody 51469
ARDIGRSGWYAEARYYYKAMDV

SEQ ID NO: 102939 - protein, 6 aa, Homo sapiens
  light chain complementarity determining region 3 for antibody 51470
QENGAT

SEQ ID NO: 102940 - protein, 12 aa, Homo sapiens
  heavy chain complementarity determining region 3 for antibody 51470
ARDHITGWSLSD

SEQ ID NO: 102941 - protein, 9 aa, Homo sapiens
  light chain complementarity determining region 3 for antibody 51471
MQYSHWPHT

SEQ ID NO: 102942 - protein, 9 aa, Homo sapiens
  heavy chain complementarity determining region 3 for antibody 51471
AGWGDDYNY

SEQ ID NO: 102943 - protein, 9 aa, Homo sapiens
  light chain complementarity determining region 3 for antibody 51472
MQGTHWPWT

SEQ ID NO: 102944 - protein, 11 aa, Homo sapiens
  heavy chain complementarity determining region 3 for antibody 51472
VRDDDRYGLDY

SEQ ID NO: 102945 - protein, 10 aa, Homo sapiens
  light chain complementarity determining region 3 for antibody 51473
MQGTHWPPVT

SEQ ID NO: 102946 - protein, 13 aa, Homo sapiens
  heavy chain complementarity determining region 3 for antibody 51473
AKDGDTMIFGFDS

SEQ ID NO: 102947 - protein, 9 aa, Homo sapiens
  light chain complementarity determining region 3 for antibody 51474
MQATHWPPL

SEQ ID NO: 102948 - protein, 14 aa, Homo sapiens
  heavy chain complementarity determining region 3 for antibody 51474
ARDREWLLWGSFDI

SEQ ID NO: 102949 - protein, 9 aa, Homo sapiens
  light chain complementarity determining region 3 for antibody 51475
MQALQTPPT

SEQ ID NO: 102950 - protein, 16 aa, Homo sapiens
  heavy chain complementarity determining region 3 for antibody 51475
ARGGFGWLQFFFGMDV

SEQ ID NO: 102951 - protein, 9 aa, Homo sapiens
  light chain complementarity determining region 3 for antibody 51476
MQALQSPST

SEQ ID NO: 102952 - protein, 7 aa, Homo sapiens
  heavy chain complementarity determining region 3 for antibody 51476
DLRSYGY

SEQ ID NO: 102953 - protein, 9 aa, Homo sapiens
  light chain complementarity determining region 3 for antibody 51477
MQALEAPLT

SEQ ID NO: 102954 - protein, 20 aa, Homo sapiens
  heavy chain complementarity determining region 3 for antibody 51477
TTLRFELGWFGSDKKFAFDL

SEQ ID NO: 102955 - protein, 9 aa, Homo sapiens
  light chain complementarity determining region 3 for antibody 51478
MQAIQWPRT

SEQ ID NO: 102956 - protein, 12 aa, Homo sapiens
  heavy chain complementarity determining region 3 for antibody 51478
VTDTDANYYMDV

SEQ ID NO: 102957 - protein, 9 aa, Homo sapiens
  light chain complementarity determining region 3 for antibody 51479
MQAAQAPET

SEQ ID NO: 102958 - protein, 14 aa, Homo sapiens
  heavy chain complementarity determining region 3 for antibody 51479
ARDSVLDHYSGNDH

SEQ ID NO: 102959 - protein, 9 aa, Homo sapiens
  light chain complementarity determining region 3 for antibody 51480
LQHNIHPNT

SEQ ID NO: 102960 - protein, 7 aa, Homo sapiens
  heavy chain complementarity determining region 3 for antibody 51480
GSRWADF

SEQ ID NO: 102961 - protein, 9 aa, Homo sapiens
  light chain complementarity determining region 3 for antibody 51481
LQDYGYPRT

SEQ ID NO: 102962 - protein, 19 aa, Homo sapiens
  heavy chain complementarity determining region 3 for antibody 51481
ARDVSPQCSGSGWCDALNS

SEQ ID NO: 102963 - protein, 8 aa, Homo sapiens
  light chain complementarity determining region 3 for antibody 51482
HYYGSPPT

SEQ ID NO: 102964 - protein, 15 aa, Homo sapiens
  heavy chain complementarity determining region 3 for antibody 51482
ASVRIQLWLHDAFDI

SEQ ID NO: 102965 - protein, 8 aa, Homo sapiens
  light chain complementarity determining region 3 for antibody 51483
HQYNNRGT

SEQ ID NO: 102966 - protein, 13 aa, Homo sapiens
  heavy chain complementarity determining region 3 for antibody 51483
ARDKQWLGGGLDY

SEQ ID NO: 102967 - protein, 9 aa, Homo sapiens
  light chain complementarity determining region 3 for antibody 51484
HQSSSLPET

SEQ ID NO: 102968 - protein, 11 aa, Homo sapiens
  heavy chain complementarity determining region 3 for antibody 51484
ANVGRAVGGDY

SEQ ID NO: 102969 - protein, 9 aa, Homo sapiens
  light chain complementarity determining region 3 for antibody 51485
VQGNSFPLT

SEQ ID NO: 102970 - protein, 17 aa, Homo sapiens
  heavy chain complementarity determining region 3 for antibody 51485
VKDRVAAIFGVISDLDY

SEQ ID NO: 102971 - protein, 9 aa, Homo sapiens
  light chain complementarity determining region 3 for antibody 51486
VQANSFPLT

SEQ ID NO: 102972 - protein, 17 aa, Homo sapiens
  heavy chain complementarity determining region 3 for antibody 51486
VKDRVAAIFGVISDLDY

SEQ ID NO: 102973 - protein, 9 aa, Homo sapiens
  light chain complementarity determining region 3 for antibody 51487
QRCGSSPKT

SEQ ID NO: 102974 - protein, 16 aa, Homo sapiens
  heavy chain complementarity determining region 3 for antibody 51487
ARVPQQWPTFYYGMDV

SEQ ID NO: 102975 - protein, 8 aa, Homo sapiens
  light chain complementarity determining region 3 for antibody 51488
QQYYTTLT

SEQ ID NO: 102976 - protein, 11 aa, Homo sapiens
  heavy chain complementarity determining region 3 for antibody 51488
ARLSLDNYFDH

SEQ ID NO: 102977 - protein, 9 aa, Homo sapiens
  light chain complementarity determining region 3 for antibody 51489
QQYYSTPPT

SEQ ID NO: 102978 - protein, 14 aa, Homo sapiens
  heavy chain complementarity determining region 3 for antibody 51489
ATKFGVSDDYYFDH

SEQ ID NO: 102979 - protein, 10 aa, Homo sapiens
  light chain complementarity determining region 3 for antibody 51490
QQYSSSPIFT

SEQ ID NO: 102980 - protein, 13 aa, Homo sapiens
  heavy chain complementarity determining region 3 for antibody 51490
ARWVSGYYYYFDY

SEQ ID NO: 102981 - protein, 9 aa, Homo sapiens
  light chain complementarity determining region 3 for antibody 51491
QQYRSLPET

SEQ ID NO: 102982 - protein, 11 aa, Homo sapiens
  heavy chain complementarity determining region 3 for antibody 51491
ARPEGGGAFDM

SEQ ID NO: 102983 - protein, 8 aa, Homo sapiens
  light chain complementarity determining region 3 for antibody 51492
QQYNSYYT

SEQ ID NO: 102984 - protein, 21 aa, Homo sapiens
  heavy chain complementarity determining region 3 for antibody 51492
AIQRPPYHYGSGSYYPDAFDI

SEQ ID NO: 102985 - protein, 9 aa, Homo sapiens
  light chain complementarity determining region 3 for antibody 51493
QQYNSYPYG

SEQ ID NO: 102986 - protein, 6 aa, Homo sapiens
  heavy chain complementarity determining region 3 for antibody 51493
ASLADY

SEQ ID NO: 102987 - protein, 9 aa, Homo sapiens
  light chain complementarity determining region 3 for antibody 51494
QQYNSYLWT

SEQ ID NO: 102988 - protein, 20 aa, Homo sapiens
  heavy chain complementarity determining region 3 for antibody 51494
ARDKPTSWMQLWGPGDAFDI

SEQ ID NO: 102989 - protein, 8 aa, Homo sapiens
  light chain complementarity determining region 3 for antibody 51495
QQYNSYCT

SEQ ID NO: 102990 - protein, 17 aa, Homo sapiens
  heavy chain complementarity determining region 3 for antibody 51495
ARGWVRTTVTPTPYFDY

SEQ ID NO: 102991 - protein, 9 aa, Homo sapiens
  light chain complementarity determining region 3 for antibody 51496
QQYNNWPPS

SEQ ID NO: 102992 - protein, 20 aa, Homo sapiens
  heavy chain complementarity determining region 3 for antibody 51496
ARGIGNNKNAAASYRLYFQH

SEQ ID NO: 102993 - protein, 9 aa, Homo sapiens
  light chain complementarity determining region 3 for antibody 51497
QQYNNWPLT

SEQ ID NO: 102994 - protein, 16 aa, Homo sapiens
  heavy chain complementarity determining region 3 for antibody 51497
AKRLGPVGTPGTLFDH

SEQ ID NO: 102995 - protein, 9 aa, Homo sapiens
  light chain complementarity determining region 3 for antibody 51498
QQYGSSSYT

SEQ ID NO: 102996 - protein, 19 aa, Homo sapiens
  heavy chain complementarity determining region 3 for antibody 51498
ARVNRELRGFVVYAAYFDY

SEQ ID NO: 102997 - protein, 9 aa, Homo sapiens
  light chain complementarity determining region 3 for antibody 51499
QQYGSSPYT

SEQ ID NO: 102998 - protein, 18 aa, Homo sapiens
  heavy chain complementarity determining region 3 for antibody 51499
ARVTRDIVLMVYAYYFDY

SEQ ID NO: 102999 - protein, 9 aa, Homo sapiens
  light chain complementarity determining region 3 for antibody 51500
QQYGSSPYT

SEQ ID NO: 103000 - protein, 11 aa, Homo sapiens
  heavy chain complementarity determining region 3 for antibody 51500
ARDGASGAVDY

SEQ ID NO: 103001 - protein, 9 aa, Homo sapiens
  light chain complementarity determining region 3 for antibody 51501
QQYGSSPRT

SEQ ID NO: 103002 - protein, 18 aa, Homo sapiens
  heavy chain complementarity determining region 3 for antibody 51501
ARDQTRTPRRGNSAYHDY

SEQ ID NO: 103003 - protein, 9 aa, Homo sapiens
  light chain complementarity determining region 3 for antibody 51502
QQYGSSPRT

SEQ ID NO: 103004 - protein, 16 aa, Homo sapiens
  heavy chain complementarity determining region 3 for antibody 51502
ARDQRVAASGTWYIDL

SEQ ID NO: 103005 - protein, 10 aa, Homo sapiens
  light chain complementarity determining region 3 for antibody 51503
QQYGSSPACT

SEQ ID NO: 103006 - protein, 17 aa, Homo sapiens
  heavy chain complementarity determining region 3 for antibody 51503
TRVKYCSDGTCYTGTDY

SEQ ID NO: 103007 - protein, 8 aa, Homo sapiens
  light chain complementarity determining region 3 for antibody 51504
QQYGSLIT

SEQ ID NO: 103008 - protein, 18 aa, Homo sapiens
  heavy chain complementarity determining region 3 for antibody 51504
AKGDLASCTGAICYPIDY

SEQ ID NO: 103009 - protein, 9 aa, Homo sapiens
  light chain complementarity determining region 3 for antibody 51505
QQYGDSPRT

SEQ ID NO: 103010 - protein, 23 aa, Homo sapiens
  heavy chain complementarity determining region 3 for antibody 51505
ARDGRRSGSYSLSSYYSYYALDV

SEQ ID NO: 103011 - protein, 9 aa, Homo sapiens
  light chain complementarity determining region 3 for antibody 51506
QQYDTSPVT

SEQ ID NO: 103012 - protein, 15 aa, Homo sapiens
  heavy chain complementarity determining region 3 for antibody 51506
AKSRREVVVIILMDV

SEQ ID NO: 103013 - protein, 10 aa, Homo sapiens
  light chain complementarity determining region 3 for antibody 51507
QQYDNLPTYT

SEQ ID NO: 103014 - protein, 11 aa, Homo sapiens
  heavy chain complementarity determining region 3 for antibody 51507
ATDPSLGYFQF

SEQ ID NO: 103015 - protein, 9 aa, Homo sapiens
  light chain complementarity determining region 3 for antibody 51508
QQYDNLPRT

SEQ ID NO: 103016 - protein, 15 aa, Homo sapiens
  heavy chain complementarity determining region 3 for antibody 51508
ASLPTTWVGFETQNL

SEQ ID NO: 103017 - protein, 9 aa, Homo sapiens
  light chain complementarity determining region 3 for antibody 51509
QQYDNLPRT

SEQ ID NO: 103018 - protein, 15 aa, Homo sapiens
  heavy chain complementarity determining region 3 for antibody 51509
ASLPTTWGGFETENL

SEQ ID NO: 103019 - protein, 9 aa, Homo sapiens
  light chain complementarity determining region 3 for antibody 51510
QQYDNLPRT

SEQ ID NO: 103020 - protein, 15 aa, Homo sapiens
  heavy chain complementarity determining region 3 for antibody 51510
ASLPTTSGGFETQNL

SEQ ID NO: 103021 - protein, 9 aa, Homo sapiens
  light chain complementarity determining region 3 for antibody 51511
QQYDNLPRT

SEQ ID NO: 103022 - protein, 15 aa, Homo sapiens
  heavy chain complementarity determining region 3 for antibody 51511
ASIPTTWGGFETQNL

SEQ ID NO: 103023 - protein, 10 aa, Homo sapiens
  light chain complementarity determining region 3 for antibody 51512
QQYDNLLALT

SEQ ID NO: 103024 - protein, 14 aa, Homo sapiens
  heavy chain complementarity determining region 3 for antibody 51512
AGRWGDITPSILDY

SEQ ID NO: 103025 - protein, 9 aa, Homo sapiens
  light chain complementarity determining region 3 for antibody 51513
QQSYSTPRT

SEQ ID NO: 103026 - protein, 13 aa, Homo sapiens
  heavy chain complementarity determining region 3 for antibody 51513
ARRTNYYYYGMDV

SEQ ID NO: 103027 - protein, 9 aa, Homo sapiens
  light chain complementarity determining region 3 for antibody 51514
QQSYSTPQT

SEQ ID NO: 103028 - protein, 14 aa, Homo sapiens
  heavy chain complementarity determining region 3 for antibody 51514
VRLDLYNYVHGFDI

SEQ ID NO: 103029 - protein, 9 aa, Homo sapiens
  light chain complementarity determining region 3 for antibody 51515
QQSYSTPLT

SEQ ID NO: 103030 - protein, 10 aa, Homo sapiens
  heavy chain complementarity determining region 3 for antibody 51515
ARERGSSFDL

SEQ ID NO: 103031 - protein, 8 aa, Homo sapiens
  light chain complementarity determining region 3 for antibody 51516
QQSYSTPI

SEQ ID NO: 103032 - protein, 15 aa, Homo sapiens
  heavy chain complementarity determining region 3 for antibody 51516
ARGVGDYGDNEAFDI

SEQ ID NO: 103033 - protein, 9 aa, Homo sapiens
  light chain complementarity determining region 3 for antibody 51517
QQSYSTLYT

SEQ ID NO: 103034 - protein, 12 aa, Homo sapiens
  heavy chain complementarity determining region 3 for antibody 51517
VREGPRPSHWKN

SEQ ID NO: 103035 - protein, 9 aa, Homo sapiens
  light chain complementarity determining region 3 for antibody 51518
QQSYKIPWT

SEQ ID NO: 103036 - protein, 16 aa, Homo sapiens
  heavy chain complementarity determining region 3 for antibody 51518
ARTRIVGTSYEWYFDY

SEQ ID NO: 103037 - protein, 9 aa, Homo sapiens
  light chain complementarity determining region 3 for antibody 51519
QQSYATPIT

SEQ ID NO: 103038 - protein, 13 aa, Homo sapiens
  heavy chain complementarity determining region 3 for antibody 51519
AKNIRDGVAAYDF

SEQ ID NO: 103039 - protein, 10 aa, Homo sapiens
  light chain complementarity determining region 3 for antibody 51520
QQRYGWPPLT

SEQ ID NO: 103040 - protein, 16 aa, Homo sapiens
  heavy chain complementarity determining region 3 for antibody 51520
AKPYCGGDCDYNWFDP

SEQ ID NO: 103041 - protein, 9 aa, Homo sapiens
  light chain complementarity determining region 3 for antibody 51521
QQRSSWPLT

SEQ ID NO: 103042 - protein, 19 aa, Homo sapiens
  heavy chain complementarity determining region 3 for antibody 51521
AREGDYDFWSGPVSYYFDY

SEQ ID NO: 103043 - protein, 9 aa, Homo sapiens
  light chain complementarity determining region 3 for antibody 51522
QQRSSWPLT

SEQ ID NO: 103044 - protein, 19 aa, Homo sapiens
  heavy chain complementarity determining region 3 for antibody 51522
AREGDYDFWSGPVSYYFDS

SEQ ID NO: 103045 - protein, 8 aa, Homo sapiens
  light chain complementarity determining region 3 for antibody 51523
QQRSNWPT

SEQ ID NO: 103046 - protein, 11 aa, Homo sapiens
  heavy chain complementarity determining region 3 for antibody 51523
AKERLRGVIGY

SEQ ID NO: 103047 - protein, 9 aa, Homo sapiens
  light chain complementarity determining region 3 for antibody 51524
QQRSDWPVS

SEQ ID NO: 103048 - protein, 14 aa, Homo sapiens
  heavy chain complementarity determining region 3 for antibody 51524
ARVHDSSWPPVFDF

SEQ ID NO: 103049 - protein, 9 aa, Homo sapiens
  light chain complementarity determining region 3 for antibody 51525
QQLYSYPLT

SEQ ID NO: 103050 - protein, 15 aa, Homo sapiens
  heavy chain complementarity determining region 3 for antibody 51525
ATLDMTLRHARQFDL

SEQ ID NO: 103051 - protein, 10 aa, Homo sapiens
  light chain complementarity determining region 3 for antibody 51526
QQLNAYPLYT

SEQ ID NO: 103052 - protein, 14 aa, Homo sapiens
  heavy chain complementarity determining region 3 for antibody 51526
ARLRVTTGRDGLDV

SEQ ID NO: 103053 - protein, 8 aa, Homo sapiens
  light chain complementarity determining region 3 for antibody 51527
QQHNSWPH

SEQ ID NO: 103054 - protein, 16 aa, Homo sapiens
  heavy chain complementarity determining region 3 for antibody 51527
ARLGTGLGSISAAFDI

SEQ ID NO: 103055 - protein, 9 aa, Homo sapiens
  light chain complementarity determining region 3 for antibody 51528
QQALNYPWT

SEQ ID NO: 103056 - protein, 16 aa, Homo sapiens
  heavy chain complementarity determining region 3 for antibody 51528
ARGPVKAHYYYYYMDV

SEQ ID NO: 103057 - protein, 9 aa, Homo sapiens
  light chain complementarity determining region 3 for antibody 51529
QKYNSAPGT

SEQ ID NO: 103058 - protein, 19 aa, Homo sapiens
  heavy chain complementarity determining region 3 for antibody 51529
ARRSTRSGWYSTQGGGMDV

SEQ ID NO: 103059 - protein, 9 aa, Homo sapiens
  light chain complementarity determining region 3 for antibody 51530
QHFGSSGYT

SEQ ID NO: 103060 - protein, 22 aa, Homo sapiens
  heavy chain complementarity determining region 3 for antibody 51530
AGDIGRSGWYAESRYYYKAMDV

SEQ ID NO: 103061 - protein, 9 aa, Homo sapiens
  light chain complementarity determining region 3 for antibody 51531
QHFGGSHFT

SEQ ID NO: 103062 - protein, 17 aa, Homo sapiens
  heavy chain complementarity determining region 3 for antibody 51531
AHHSIVLSPGSFRYFDY

SEQ ID NO: 103063 - protein, 9 aa, Homo sapiens
  light chain complementarity determining region 3 for antibody 51532
QEYYSTPRT

SEQ ID NO: 103064 - protein, 14 aa, Homo sapiens
  heavy chain complementarity determining region 3 for antibody 51532
ARDRGYSGGSAFDI

SEQ ID NO: 103065 - protein, 9 aa, Homo sapiens
  light chain complementarity determining region 3 for antibody 51533
MQTLQTPLT

SEQ ID NO: 103066 - protein, 23 aa, Homo sapiens
  heavy chain complementarity determining region 3 for antibody 51533
AKDRPFETPTVTRHRGGVDAFDM

SEQ ID NO: 103067 - protein, 9 aa, Homo sapiens
  light chain complementarity determining region 3 for antibody 51534
MQAQQTPWT

SEQ ID NO: 103068 - protein, 14 aa, Homo sapiens
  heavy chain complementarity determining region 3 for antibody 51534
VGEENEVVDDAFGI

SEQ ID NO: 103069 - protein, 9 aa, Homo sapiens
  light chain complementarity determining region 3 for antibody 51535
MQALQTPFT

SEQ ID NO: 103070 - protein, 10 aa, Homo sapiens
  heavy chain complementarity determining region 3 for antibody 51535
ARDLGLRGAA

SEQ ID NO: 103071 - protein, 8 aa, Homo sapiens
  light chain complementarity determining region 3 for antibody 51536
MHGAHWGT

SEQ ID NO: 103072 - protein, 7 aa, Homo sapiens
  heavy chain complementarity determining region 3 for antibody 51536
ARGGGGY

SEQ ID NO: 103073 - protein, 9 aa, Homo sapiens
  light chain complementarity determining region 3 for antibody 51537
HQYAVSPWT

SEQ ID NO: 103074 - protein, 10 aa, Homo sapiens
  heavy chain complementarity determining region 3 for antibody 51537
APSLGCYYSS

SEQ ID NO: 103075 - protein, 9 aa, Homo sapiens
  light chain complementarity determining region 3 for antibody 51538
HQSSTLPIT

SEQ ID NO: 103076 - protein, 11 aa, Homo sapiens
  heavy chain complementarity determining region 3 for antibody 51538
ATFYEGDAFDV

SEQ ID NO: 103077 - protein, 9 aa, Homo sapiens
  light chain complementarity determining region 3 for antibody 51539
HQRSDWPVT

SEQ ID NO: 103078 - protein, 14 aa, Homo sapiens
  heavy chain complementarity determining region 3 for antibody 51539
ARVHDSSWPPVFDF

SEQ ID NO: 103079 - protein, 9 aa, Homo sapiens
  light chain complementarity determining region 3 for antibody 51540
QQYYSYSWT

SEQ ID NO: 103080 - protein, 11 aa, Homo sapiens
  heavy chain complementarity determining region 3 for antibody 51540
ASKVGANPYDY

SEQ ID NO: 103081 - protein, 10 aa, Homo sapiens
  light chain complementarity determining region 3 for antibody 51541
QQYYNTPLYT

SEQ ID NO: 103082 - protein, 14 aa, Homo sapiens
  heavy chain complementarity determining region 3 for antibody 51541
TTDAAIKPWELLSY

SEQ ID NO: 103083 - protein, 9 aa, Homo sapiens
  light chain complementarity determining region 3 for antibody 51542
QQYVSSPWT

SEQ ID NO: 103084 - protein, 15 aa, Homo sapiens
  heavy chain complementarity determining region 3 for antibody 51542
ARVADTAMVHDAFDI

SEQ ID NO: 103085 - protein, 10 aa, Homo sapiens
  light chain complementarity determining region 3 for antibody 51543
QQYTTWPPRT

SEQ ID NO: 103086 - protein, 15 aa, Homo sapiens
  heavy chain complementarity determining region 3 for antibody 51543
ARGGLGGSYYRVFDL

SEQ ID NO: 103087 - protein, 11 aa, Homo sapiens
  light chain complementarity determining region 3 for antibody 51544
QQYSTSPPLYT

SEQ ID NO: 103088 - protein, 14 aa, Homo sapiens
  heavy chain complementarity determining region 3 for antibody 51544
ARCSVHNHKRSFDQ

SEQ ID NO: 103089 - protein, 9 aa, Homo sapiens
  light chain complementarity determining region 3 for antibody 51545
QQYNTNSET

SEQ ID NO: 103090 - protein, 8 aa, Homo sapiens
  heavy chain complementarity determining region 3 for antibody 51545
ARHPSSGY

SEQ ID NO: 103091 - protein, 8 aa, Homo sapiens
  light chain complementarity determining region 3 for antibody 51546
QQYNSYYT

SEQ ID NO: 103092 - protein, 16 aa, Homo sapiens
  heavy chain complementarity determining region 3 for antibody 51546
LKGGVYNSGWHDVFPV

SEQ ID NO: 103093 - protein, 8 aa, Homo sapiens
  light chain complementarity determining region 3 for antibody 51547
QQYNSYST

SEQ ID NO: 103094 - protein, 15 aa, Homo sapiens
  heavy chain complementarity determining region 3 for antibody 51547
ASLPTTWGGFEPQNL

SEQ ID NO: 103095 - protein, 8 aa, Homo sapiens
  light chain complementarity determining region 3 for antibody 51548
QQYNSYST

SEQ ID NO: 103096 - protein, 15 aa, Homo sapiens
  heavy chain complementarity determining region 3 for antibody 51548
ASLPTTWGGCETQNL

SEQ ID NO: 103097 - protein, 9 aa, Homo sapiens
  light chain complementarity determining region 3 for antibody 51549
QQYNSYPWT

SEQ ID NO: 103098 - protein, 13 aa, Homo sapiens
  heavy chain complementarity determining region 3 for antibody 51549
ATGVYSGYDIKPY

SEQ ID NO: 103099 - protein, 9 aa, Homo sapiens
  light chain complementarity determining region 3 for antibody 51550
QQYNSYPWT

SEQ ID NO: 103100 - protein, 12 aa, Homo sapiens
  heavy chain complementarity determining region 3 for antibody 51550
ARKEWLPRGLDY

SEQ ID NO: 103101 - protein, 8 aa, Homo sapiens
  light chain complementarity determining region 3 for antibody 51551
QQYNSPVT

SEQ ID NO: 103102 - protein, 16 aa, Homo sapiens
  heavy chain complementarity determining region 3 for antibody 51551
AKFCSGGSCYRWFFDL

SEQ ID NO: 103103 - protein, 9 aa, Homo sapiens
  light chain complementarity determining region 3 for antibody 51552
QQYNSFVFT

SEQ ID NO: 103104 - protein, 23 aa, Homo sapiens
  heavy chain complementarity determining region 3 for antibody 51552
SSHYYDYVSGSYHYNLRRHAFGI

SEQ ID NO: 103105 - protein, 10 aa, Homo sapiens
  light chain complementarity determining region 3 for antibody 51553
QQYNNWPPYT

SEQ ID NO: 103106 - protein, 19 aa, Homo sapiens
  heavy chain complementarity determining region 3 for antibody 51553
AVGLDYYDFSGYYPTYFDY

SEQ ID NO: 103107 - protein, 10 aa, Homo sapiens [sequence omitted]

SEQ ID NO: 103108 - protein, 16 aa, Homo sapiens
  heavy chain complementarity determining region 3 for antibody 51554
ARDTTSGGYYTGIQDY

SEQ ID NO: 103109 - protein, 9 aa, Homo sapiens
  light chain complementarity determining region 3 for antibody 51555
QQYNNLPRT

SEQ ID NO: 103110 - protein, 15 aa, Homo sapiens
  heavy chain complementarity determining region 3 for antibody 51555
ASLPTTWGGFETQNL

SEQ ID NO: 103111 - protein, 11 aa, Homo sapiens
  light chain complementarity determining region 3 for antibody 51556
QQYNHWPPDYT

SEQ ID NO: 103112 - protein, 18 aa, Homo sapiens
  heavy chain complementarity determining region 3 for antibody 51556
AHRRSRHNYGKYNDAFDI

SEQ ID NO: 103113 - protein, 9 aa, Homo sapiens
  light chain complementarity determining region 3 for antibody 51557
QQYNGYFQT

SEQ ID NO: 103114 - protein, 11 aa, Homo sapiens
  heavy chain complementarity determining region 3 for antibody 51557
ARGSHGYGMDV

SEQ ID NO: 103115 - protein, 9 aa, Homo sapiens
  light chain complementarity determining region 3 for antibody 51558
QQYGSSSYT

SEQ ID NO: 103116 - protein, 19 aa, Homo sapiens
  heavy chain complementarity determining region 3 for antibody 51558
ARVNRERRGFVVYATYFDY

SEQ ID NO: 103117 - protein, 9 aa, Homo sapiens
  light chain complementarity determining region 3 for antibody 51559
QQYGSSSYP

SEQ ID NO: 103118 - protein, 19 aa, Homo sapiens
  heavy chain complementarity determining region 3 for antibody 51559
ARVNRELRGFVVYATYFDY

SEQ ID NO: 103119 - protein, 8 aa, Homo sapiens
  light chain complementarity determining region 3 for antibody 51560
QQYGSSRT

SEQ ID NO: 103120 - protein, 18 aa, Homo sapiens
  heavy chain complementarity determining region 3 for antibody 51560
ASSPPFSLAPRRTRYFDY

SEQ ID NO: 103121 - protein, 8 aa, Homo sapiens
  light chain complementarity determining region 3 for antibody 51561
QQYGSSPT

SEQ ID NO: 103122 - protein, 12 aa, Homo sapiens
  heavy chain complementarity determining region 3 for antibody 51561
ARGEQWRKMLNY

SEQ ID NO: 103123 - protein, 8 aa, Homo sapiens
  light chain complementarity determining region 3 for antibody 51562
QQYGSSPT

SEQ ID NO: 103124 - protein, 14 aa, Homo sapiens
  heavy chain complementarity determining region 3 for antibody 51562
ARDNGVVAAEYFDN

SEQ ID NO: 103125 - protein, 9 aa, Homo sapiens
  light chain complementarity determining region 3 for antibody 51563
QQYGSSPRT

SEQ ID NO: 103126 - protein, 17 aa, Homo sapiens
  heavy chain complementarity determining region 3 for antibody 51563
ARESIGHSSSWYLFPPY

SEQ ID NO: 103127 - protein, 9 aa, Homo sapiens
  light chain complementarity determining region 3 for antibody 51564
QQYGSSPQT

SEQ ID NO: 103128 - protein, 15 aa, Homo sapiens
  heavy chain complementarity determining region 3 for antibody 51564
ASGKGDGTGWPFFDC

SEQ ID NO: 103129 - protein, 9 aa, Homo sapiens
  light chain complementarity determining region 3 for antibody 51565
QQYGSSPLA

SEQ ID NO: 103130 - protein, 20 aa, Homo sapiens
  heavy chain complementarity determining region 3 for antibody 51565
ARGPYQVLVGVRHTNSFQDY

SEQ ID NO: 103131 - protein, 9 aa, Homo sapiens
  light chain complementarity determining region 3 for antibody 51566
QQYGSSPFT

SEQ ID NO: 103132 - protein, 17 aa, Homo sapiens
  heavy chain complementarity determining region 3 for antibody 51566
VRGGSVLQGAIKIPFDY

SEQ ID NO: 103133 - protein, 9 aa, Homo sapiens
  light chain complementarity determining region 3 for antibody 51567
QQYGSSPFT

SEQ ID NO: 103134 - protein, 12 aa, Homo sapiens
  heavy chain complementarity determining region 3 for antibody 51567
ARRPGWWGPIDS

SEQ ID NO: 103135 - protein, 10 aa, Homo sapiens
  light chain complementarity determining region 3 for antibody 51568
QQYGSSPAWT

SEQ ID NO: 103136 - protein, 17 aa, Homo sapiens
  heavy chain complementarity determining region 3 for antibody 51568
TRVKYCSDGTCYTGTGY

SEQ ID NO: 103137 - protein, 10 aa, Homo sapiens
  light chain complementarity determining region 3 for antibody 51569
QQYGSSPAWT

SEQ ID NO: 103138 - protein, 17 aa, Homo sapiens
  heavy chain complementarity determining region 3 for antibody 51569
TRVKYCSDGTCYTGPDY

SEQ ID NO: 103139 - protein, 10 aa, Homo sapiens
  light chain complementarity determining region 3 for antibody 51570
QQYGSSPAWT

SEQ ID NO: 103140 - protein, 17 aa, Homo sapiens
  heavy chain complementarity determining region 3 for antibody 51570
TRVKYCSDGSCYTGTDY

SEQ ID NO: 103141 - protein, 10 aa, Homo sapiens
  light chain complementarity determining region 3 for antibody 51571
QQYGSSPAWT

SEQ ID NO: 103142 - protein, 17 aa, Homo sapiens
  heavy chain complementarity determining region 3 for antibody 51571
TRGKYCSDGTCYTGTDY

SEQ ID NO: 103143 - protein, 9 aa, Homo sapiens
  light chain complementarity determining region 3 for antibody 51572
QQYGSSMIT

SEQ ID NO: 103144 - protein, 15 aa, Homo sapiens
  heavy chain complementarity determining region 3 for antibody 51572
ARRYSRARQGWFFDL

SEQ ID NO: 103145 - protein, 9 aa, Homo sapiens
  light chain complementarity determining region 3 for antibody 51573
QQYGSSLYT

SEQ ID NO: 103146 - protein, 21 aa, Homo sapiens
  heavy chain complementarity determining region 3 for antibody 51573
ARAFPLYNSGWYIMGTGYFDL

SEQ ID NO: 103147 - protein, 10 aa, Homo sapiens
  light chain complementarity determining region 3 for antibody 51574
QQYGSSLLIT

SEQ ID NO: 103148 - protein, 15 aa, Homo sapiens
  heavy chain complementarity determining region 3 for antibody 51574
APSALYSSGWYRLAY

SEQ ID NO: 103149 - protein, 9 aa, Homo sapiens
  light chain complementarity determining region 3 for antibody 51575
QQYGLSPRT

SEQ ID NO: 103150 - protein, 18 aa, Homo sapiens
  heavy chain complementarity determining region 3 for antibody 51575
AREVPDRRGSNSNPYADV

SEQ ID NO: 103151 - protein, 9 aa, Homo sapiens
  light chain complementarity determining region 3 for antibody 51576
QQYGGSPRT

SEQ ID NO: 103152 - protein, 18 aa, Homo sapiens
  heavy chain complementarity determining region 3 for antibody 51576
ARDVSPRIGAYYYYYMDV

SEQ ID NO: 103153 - protein, 9 aa, Homo sapiens
  light chain complementarity determining region 3 for antibody 51577
QQYFNYPWT

SEQ ID NO: 103154 - protein, 16 aa, Homo sapiens
  heavy chain complementarity determining region 3 for antibody 51577
STGECSGATCCRRLDY

SEQ ID NO: 103155 - protein, 9 aa, Homo sapiens
  light chain complementarity determining region 3 for antibody 51578
QQYFNYPWT

SEQ ID NO: 103156 - protein, 16 aa, Homo sapiens
  heavy chain complementarity determining region 3 for antibody 51578
STGECSGAPCFRRLDY

SEQ ID NO: 103157 - protein, 10 aa, Homo sapiens
  light chain complementarity determining region 3 for antibody 51579
QQYDSSPPWT

SEQ ID NO: 103158 - protein, 16 aa, Homo sapiens
  heavy chain complementarity determining region 3 for antibody 51579
ARDLTDYGDYRGYLDL

SEQ ID NO: 103159 - protein, 8 aa, Homo sapiens
  light chain complementarity determining region 3 for antibody 51580
QQYDNWPR

SEQ ID NO: 103160 - protein, 17 aa, Homo sapiens
  heavy chain complementarity determining region 3 for antibody 51580
ARTIFYYDSSGMSCLGY

SEQ ID NO: 103161 - protein, 10 aa, Homo sapiens
  light chain complementarity determining region 3 for antibody 51581
QQYDNWPPYT

SEQ ID NO: 103162 - protein, 14 aa, Homo sapiens
  heavy chain complementarity determining region 3 for antibody 51581
TRDPLTIGHQPFDY

SEQ ID NO: 103163 - protein, 9 aa, Homo sapiens
  light chain complementarity determining region 3 for antibody 51582
QQYDNLPRT

SEQ ID NO: 103164 - protein, 15 aa, Homo sapiens
  heavy chain complementarity determining region 3 for antibody 51582
VSLPTTWGGFETQNL

SEQ ID NO: 103165 - protein, 9 aa, Homo sapiens
  light chain complementarity determining region 3 for antibody 51583
QQYDNLPRT

SEQ ID NO: 103166 - protein, 15 aa, Homo sapiens
  heavy chain complementarity determining region 3 for antibody 51583
ASRPTTWGGFESQNL

SEQ ID NO: 103167 - protein, 9 aa, Homo sapiens
  light chain complementarity determining region 3 for antibody 51584
QQYDNLPRT

SEQ ID NO: 103168 - protein, 15 aa, Homo sapiens
  heavy chain complementarity determining region 3 for antibody 51584
ASLQTTWGGFETQNL

SEQ ID NO: 103169 - protein, 9 aa, Homo sapiens
  light chain complementarity determining region 3 for antibody 51585
QQYDNLPRT

SEQ ID NO: 103170 - protein, 15 aa, Homo sapiens
  heavy chain complementarity determining region 3 for antibody 51585
ASLPTTWGGYETQNL

SEQ ID NO: 103171 - protein, 9 aa, Homo sapiens
  light chain complementarity determining region 3 for antibody 51586
QQYDNLPRT

SEQ ID NO: 103172 - protein, 15 aa, Homo sapiens
  heavy chain complementarity determining region 3 for antibody 51586
ASLPTTWGGSEPQNL

SEQ ID NO: 103173 - protein, 9 aa, Homo sapiens
  light chain complementarity determining region 3 for antibody 51587
QQYDNLPRT

SEQ ID NO: 103174 - protein, 15 aa, Homo sapiens
  heavy chain complementarity determining region 3 for antibody 51587
ASLPTTWGGFETQIL

SEQ ID NO: 103175 - protein, 9 aa, Homo sapiens
  light chain complementarity determining region 3 for antibody 51588
QQYDNLPRT

SEQ ID NO: 103176 - protein, 15 aa, Homo sapiens
  heavy chain complementarity determining region 3 for antibody 51588
ASLPTTWGGFETKNL

SEQ ID NO: 103177 - protein, 9 aa, Homo sapiens
  light chain complementarity determining region 3 for antibody 51589
QQYDNLPRT

SEQ ID NO: 103178 - protein, 15 aa, Homo sapiens
  heavy chain complementarity determining region 3 for antibody 51589
ASLPTTWEGFETQNL

SEQ ID NO: 103179 - protein, 9 aa, Homo sapiens
  light chain complementarity determining region 3 for antibody 51590
QQYDNLPRT

SEQ ID NO: 103180 - protein, 15 aa, Homo sapiens
  heavy chain complementarity determining region 3 for antibody 51590
ASLPTTWAGFETQNL

SEQ ID NO: 103181 - protein, 9 aa, Homo sapiens
  light chain complementarity determining region 3 for antibody 51591
QQYDNLPRT

SEQ ID NO: 103182 - protein, 15 aa, Homo sapiens
  heavy chain complementarity determining region 3 for antibody 51591
ASLPTTRGGFETQNL

SEQ ID NO: 103183 - protein, 9 aa, Homo sapiens
  light chain complementarity determining region 3 for antibody 51592
QQYDNLPRT

SEQ ID NO: 103184 - protein, 15 aa, Homo sapiens
  heavy chain complementarity determining region 3 for antibody 51592
ASLPTTLGGFETQNL

SEQ ID NO: 103185 - protein, 9 aa, Homo sapiens
  light chain complementarity determining region 3 for antibody 51593
QQYDNLPRT

SEQ ID NO: 103186 - protein, 15 aa, Homo sapiens
  heavy chain complementarity determining region 3 for antibody 51593
ASLPTAWGGSETQNL

SEQ ID NO: 103187 - protein, 9 aa, Homo sapiens
  light chain complementarity determining region 3 for antibody 51594
QQYDNLPRA

SEQ ID NO: 103188 - protein, 15 aa, Homo sapiens
  heavy chain complementarity determining region 3 for antibody 51594
ASLPTTWGGFETQNL

SEQ ID NO: 103189 - protein, 9 aa, Homo sapiens
  light chain complementarity determining region 3 for antibody 51595
QQYDNLPPT

SEQ ID NO: 103190 - protein, 13 aa, Homo sapiens
  heavy chain complementarity determining region 3 for antibody 51595
TRSRGSYYRVFDY

SEQ ID NO: 103191 - protein, 10 aa, Homo sapiens
  light chain complementarity determining region 3 for antibody 51596
QQYDNLPMYT

SEQ ID NO: 103192 - protein, 6 aa, Homo sapiens
  heavy chain complementarity determining region 3 for antibody 51596
AREGRP

SEQ ID NO: 103193 - protein, 9 aa, Homo sapiens
  light chain complementarity determining region 3 for antibody 51597
QQYDNLPLT

SEQ ID NO: 103194 - protein, 15 aa, Homo sapiens
  heavy chain complementarity determining region 3 for antibody 51597
ASLPTTWGGFETQNL

SEQ ID NO: 103195 - protein, 10 aa, Homo sapiens
  light chain complementarity determining region 3 for antibody 51598
QQYDNLLALT

SEQ ID NO: 103196 - protein, 14 aa, Homo sapiens
  heavy chain complementarity determining region 3 for antibody 51598
AGRWGDITPAILDY

SEQ ID NO: 103197 - protein, 9 aa, Homo sapiens
  light chain complementarity determining region 3 for antibody 51599
QQYDNLHRT

SEQ ID NO: 103198 - protein, 15 aa, Homo sapiens
  heavy chain complementarity determining region 3 for antibody 51599
ASLPTTWGGFETQNL

SEQ ID NO: 103199 - protein, 9 aa, Homo sapiens
  light chain complementarity determining region 3 for antibody 51600
QQYDNFPES

SEQ ID NO: 103200 - protein, 18 aa, Homo sapiens
  heavy chain complementarity determining region 3 for antibody 51600
AKDRELDFWNGYHDYFDT

SEQ ID NO: 103201 - protein, 8 aa, Homo sapiens
  light chain complementarity determining region 3 for antibody 51601
QQYDGSPL

SEQ ID NO: 103202 - protein, 13 aa, Homo sapiens
  heavy chain complementarity determining region 3 for antibody 51601
ATYSGYDRYYFDY

SEQ ID NO: 103203 - protein, 11 aa, Homo sapiens
  light chain complementarity determining region 3 for antibody 51602
QQYDDSPPTYS

SEQ ID NO: 103204 - protein, 15 aa, Homo sapiens
  heavy chain complementarity determining region 3 for antibody 51602
ARDRDRRSYTDCFAH

SEQ ID NO: 103205 - protein, 9 aa, Homo sapiens
  light chain complementarity determining region 3 for antibody 51603
QQYANSLYT

SEQ ID NO: 103206 - protein, 21 aa, Homo sapiens
  heavy chain complementarity determining region 3 for antibody 51603
AKDRRSMDCGSSTCYPYWFDH

SEQ ID NO: 103207 - protein, 9 aa, Homo sapiens
  light chain complementarity determining region 3 for antibody 51604
QQYAGSPWT

SEQ ID NO: 103208 - protein, 12 aa, Homo sapiens
  heavy chain complementarity determining region 3 for antibody 51604
VRSHSTTGRVDY

SEQ ID NO: 103209 - protein, 9 aa, Homo sapiens
  light chain complementarity determining region 3 for antibody 51605
QQSYSTWLT

SEQ ID NO: 103210 - protein, 17 aa, Homo sapiens
  heavy chain complementarity determining region 3 for antibody 51605
AKGPVVTMVRKFGYFDS

SEQ ID NO: 103211 - protein, 9 aa, Homo sapiens
  light chain complementarity determining region 3 for antibody 51606
QQSYSTPYT

SEQ ID NO: 103212 - protein, 17 aa, Homo sapiens
  heavy chain complementarity determining region 3 for antibody 51606
ARAEGGIQLWSYWYFDL

SEQ ID NO: 103213 - protein, 9 aa, Homo sapiens
  light chain complementarity determining region 3 for antibody 51607
QQSYSTPLT

SEQ ID NO: 103214 - protein, 14 aa, Homo sapiens
  heavy chain complementarity determining region 3 for antibody 51607
ARVDTGSYFSAFDI

SEQ ID NO: 103215 - protein, 9 aa, Homo sapiens
  light chain complementarity determining region 3 for antibody 51608
QQSYSTPLT

SEQ ID NO: 103216 - protein, 10 aa, Homo sapiens
  heavy chain complementarity determining region 3 for antibody 51608
AGERGSAFDL

SEQ ID NO: 103217 - protein, 9 aa, Homo sapiens
  light chain complementarity determining region 3 for antibody 51609
QQSYSTLWT

SEQ ID NO: 103218 - protein, 12 aa, Homo sapiens
  heavy chain complementarity determining region 3 for antibody 51609
ARDGPVAGSFDY

SEQ ID NO: 103219 - protein, 8 aa, Homo sapiens
  light chain complementarity determining region 3 for antibody 51610
QQSYSSPT

SEQ ID NO: 103220 - protein, 15 aa, Homo sapiens
  heavy chain complementarity determining region 3 for antibody 51610
AREGVGAAARRNFDF

SEQ ID NO: 103221 - protein, 10 aa, Homo sapiens
  light chain complementarity determining region 3 for antibody 51611
QQSYSSPPFT

SEQ ID NO: 103222 - protein, 14 aa, Homo sapiens
  heavy chain complementarity determining region 3 for antibody 51611
ARVHDSSWPPVFDF

SEQ ID NO: 103223 - protein, 9 aa, Homo sapiens
  light chain complementarity determining region 3 for antibody 51612
QQSYSNPWT

SEQ ID NO: 103224 - protein, 15 aa, Homo sapiens
  heavy chain complementarity determining region 3 for antibody 51612
ARPPHAFTGENYFDL

SEQ ID NO: 103225 - protein, 9 aa, Homo sapiens
  light chain complementarity determining region 3 for antibody 51613
QQSYSIPVT

SEQ ID NO: 103226 - protein, 19 aa, Homo sapiens
  heavy chain complementarity determining region 3 for antibody 51613
ARGAEYSSGWYHYYYGMDV

SEQ ID NO: 103227 - protein, 9 aa, Homo sapiens
  light chain complementarity determining region 3 for antibody 51614
QQSYISPPT

SEQ ID NO: 103228 - protein, 16 aa, Homo sapiens
  heavy chain complementarity determining region 3 for antibody 51614
SRDHQLHGGSSGVFDY

SEQ ID NO: 103229 - protein, 9 aa, Homo sapiens
  light chain complementarity determining region 3 for antibody 51615
QQSFSTPPT

SEQ ID NO: 103230 - protein, 22 aa, Homo sapiens
  heavy chain complementarity determining region 3 for antibody 51615
GHIRCPWGEPDLGRGPGCCFDY

SEQ ID NO: 103231 - protein, 9 aa, Homo sapiens
  light chain complementarity determining region 3 for antibody 51616
QQSCSTPYT

SEQ ID NO: 103232 - protein, 17 aa, Homo sapiens
  heavy chain complementarity determining region 3 for antibody 51616
AKEDTPMVSSSTDAFDI

SEQ ID NO: 103233 - protein, 10 aa, Homo sapiens
  light chain complementarity determining region 3 for antibody 51617
QQRSNWYMYT

SEQ ID NO: 103234 - protein, 13 aa, Homo sapiens
  heavy chain complementarity determining region 3 for antibody 51617
AHEDSSGYYYDDH

SEQ ID NO: 103235 - protein, 9 aa, Homo sapiens
  light chain complementarity determining region 3 for antibody 51618
QQRSNWPWT

SEQ ID NO: 103236 - protein, 8 aa, Homo sapiens
  heavy chain complementarity determining region 3 for antibody 51618
ARQGEGWL

SEQ ID NO: 103237 - protein, 10 aa, Homo sapiens
  light chain complementarity determining region 3 for antibody 51619
QQRSNWPTWT

SEQ ID NO: 103238 - protein, 19 aa, Homo sapiens
  heavy chain complementarity determining region 3 for antibody 51619
ARTLVAAGLGGYYYYGMDV

SEQ ID NO: 103239 - protein, 11 aa, Homo sapiens
  light chain complementarity determining region 3 for antibody 51620
QQRSNWPPTYT

SEQ ID NO: 103240 - protein, 12 aa, Homo sapiens
  heavy chain complementarity determining region 3 for antibody 51620
AREIKAAAGIRA

SEQ ID NO: 103241 - protein, 8 aa, Homo sapiens
  light chain complementarity determining region 3 for antibody 51621
QQRSDLIT

SEQ ID NO: 103242 - protein, 18 aa, Homo sapiens
  heavy chain complementarity determining region 3 for antibody 51621
ARDLGCSGGSCSWSPFDY

SEQ ID NO: 103243 - protein, 9 aa, Homo sapiens
  light chain complementarity determining region 3 for antibody 51622
QQNYTPPYI

SEQ ID NO: 103244 - protein, 15 aa, Homo sapiens
  heavy chain complementarity determining region 3 for antibody 51622
GREQGSMVPGDVVDF

SEQ ID NO: 103245 - protein, 9 aa, Homo sapiens
  light chain complementarity determining region 3 for antibody 51623
QQLYSYPFT

SEQ ID NO: 103246 - protein, 15 aa, Homo sapiens
  heavy chain complementarity determining region 3 for antibody 51623
ATLDMTLRHAWQFDL

SEQ ID NO: 103247 - protein, 9 aa, Homo sapiens
  light chain complementarity determining region 3 for antibody 51624
QQLSSYPPT

SEQ ID NO: 103248 - protein, 14 aa, Homo sapiens
  heavy chain complementarity determining region 3 for antibody 51624
ARENSVAAARAFDY

SEQ ID NO: 103249 - protein, 6 aa, Homo sapiens
  light chain complementarity determining region 3 for antibody 51625
QQLNRA

SEQ ID NO: 103250 - protein, 13 aa, Homo sapiens
  heavy chain complementarity determining region 3 for antibody 51625
VTDLGSGSQPPTL

SEQ ID NO: 103251 - protein, 9 aa, Homo sapiens
  light chain complementarity determining region 3 for antibody 51626
QQIYSAPFT

SEQ ID NO: 103252 - protein, 14 aa, Homo sapiens
  heavy chain complementarity determining region 3 for antibody 51626
ARWTLPRYSNAFDI

SEQ ID NO: 103253 - protein, 9 aa, Homo sapiens
  light chain complementarity determining region 3 for antibody 51627
QQHYVYPYT

SEQ ID NO: 103254 - protein, 14 aa, Homo sapiens
  heavy chain complementarity determining region 3 for antibody 51627
ARDGDGDCSHYLDF

SEQ ID NO: 103255 - protein, 9 aa, Homo sapiens
  light chain complementarity determining region 3 for antibody 51628
QQHDRAPLT

SEQ ID NO: 103256 - protein, 14 aa, Homo sapiens
  heavy chain complementarity determining region 3 for antibody 51628
VHRAEYAYGNYFAY

SEQ ID NO: 103257 - protein, 6 aa, Homo sapiens
  light chain complementarity determining region 3 for antibody 51629
QQFGET

SEQ ID NO: 103258 - protein, 12 aa, Homo sapiens
  heavy chain complementarity determining region 3 for antibody 51629
ARDHDSGWSLAS

SEQ ID NO: 103259 - protein, 9 aa, Homo sapiens
  light chain complementarity determining region 3 for antibody 51630
QQDKSYPWT

SEQ ID NO: 103260 - protein, 10 aa, Homo sapiens
  heavy chain complementarity determining region 3 for antibody 51630
ARDSGYGIEY

SEQ ID NO: 103261 - protein, 9 aa, Homo sapiens
  light chain complementarity determining region 3 for antibody 51631
QQDDSDFPT

SEQ ID NO: 103262 - protein, 9 aa, Homo sapiens
  heavy chain complementarity determining region 3 for antibody 51631
ARGAAAADY

SEQ ID NO: 103263 - protein, 9 aa, Homo sapiens
  light chain complementarity determining region 3 for antibody 51632
QQCYNTPMT

SEQ ID NO: 103264 - protein, 9 aa, Homo sapiens
  heavy chain complementarity determining region 3 for antibody 51632
ARDQGAMNS

SEQ ID NO: 103265 - protein, 9 aa, Homo sapiens
  light chain complementarity determining region 3 for antibody 51633
QQCYNTPLP

SEQ ID NO: 103266 - protein, 9 aa, Homo sapiens
  heavy chain complementarity determining region 3 for antibody 51633
ARDQGAMNS

SEQ ID NO: 103267 - protein, 9 aa, Homo sapiens
  light chain complementarity determining region 3 for antibody 51634
QNYHGAPLT

SEQ ID NO: 103268 - protein, 12 aa, Homo sapiens
  heavy chain complementarity determining region 3 for antibody 51634
AKGLSSGSAYDI

SEQ ID NO: 103269 - protein, 7 aa, Homo sapiens
  light chain complementarity determining region 3 for antibody 51635
QLRSNWP

SEQ ID NO: 103270 - protein, 17 aa, Homo sapiens
  heavy chain complementarity determining region 3 for antibody 51635
ARSLETWTGYFPGAFDS

SEQ ID NO: 103271 - protein, 9 aa, Homo sapiens
  light chain complementarity determining region 3 for antibody 51636
QKYNSAPWT

SEQ ID NO: 103272 - protein, 13 aa, Homo sapiens
  heavy chain complementarity determining region 3 for antibody 51636
ARDSGSYNAYFKH

SEQ ID NO: 103273 - protein, 11 aa, Homo sapiens
  light chain complementarity determining region 3 for antibody 51637
QKYNSAPGTWT

SEQ ID NO: 103274 - protein, 13 aa, Homo sapiens
  heavy chain complementarity determining region 3 for antibody 51637
ARERGSSQLPTDY

SEQ ID NO: 103275 - protein, 9 aa, Homo sapiens
  light chain complementarity determining region 3 for antibody 51638
QKYNSAPFT

SEQ ID NO: 103276 - protein, 20 aa, Homo sapiens
  heavy chain complementarity determining region 3 for antibody 51638
ARDQRVRGLKTILFSGYFDY

SEQ ID NO: 103277 - protein, 9 aa, Homo sapiens
  light chain complementarity determining region 3 for antibody 51639
QKHDRAPLT

SEQ ID NO: 103278 - protein, 14 aa, Homo sapiens
  heavy chain complementarity determining region 3 for antibody 51639
VPRAEYAYGNYFAY

SEQ ID NO: 103279 - protein, 9 aa, Homo sapiens
  light chain complementarity determining region 3 for antibody 51640
QHYSRYPYT

SEQ ID NO: 103280 - protein, 15 aa, Homo sapiens
  heavy chain complementarity determining region 3 for antibody 51640
ASGKGDGPGWPFFDF

SEQ ID NO: 103281 - protein, 9 aa, Homo sapiens
  light chain complementarity determining region 3 for antibody 51641
QHYGSANRT

SEQ ID NO: 103282 - protein, 13 aa, Homo sapiens
  heavy chain complementarity determining region 3 for antibody 51641
ARGMTRGSSFLGF

SEQ ID NO: 103283 - protein, 9 aa, Homo sapiens
  light chain complementarity determining region 3 for antibody 51642
QHFGSSGYT

SEQ ID NO: 103284 - protein, 22 aa, Homo sapiens
  heavy chain complementarity determining region 3 for antibody 51642
ARDIGRSGWYAESRYDYKAMDV

SEQ ID NO: 103285 - protein, 9 aa, Homo sapiens
  light chain complementarity determining region 3 for antibody 51643
QHFGSSGHT

SEQ ID NO: 103286 - protein, 22 aa, Homo sapiens
  heavy chain complementarity determining region 3 for antibody 51643
ARDIGRSGWYAESRYYYKAMDV

SEQ ID NO: 103287 - protein, 9 aa, Homo sapiens
  light chain complementarity determining region 3 for antibody 51644
QAYNNFFRT

SEQ ID NO: 103288 - protein, 11 aa, Homo sapiens
  heavy chain complementarity determining region 3 for antibody 51644
ARDRRAYGMDV

SEQ ID NO: 103289 - protein, 9 aa, Homo sapiens
  light chain complementarity determining region 3 for antibody 51645
MQTLQPPYT

SEQ ID NO: 103290 - protein, 19 aa, Homo sapiens
  heavy chain complementarity determining region 3 for antibody 51645
AICGAITPSPQDDGFAFDI

SEQ ID NO: 103291 - protein, 9 aa, Homo sapiens
  light chain complementarity determining region 3 for antibody 51646
MQGTHWPYT

SEQ ID NO: 103292 - protein, 18 aa, Homo sapiens
  heavy chain complementarity determining region 3 for antibody 51646
ARHSGIGLSPSHYSGVDV

SEQ ID NO: 103293 - protein, 10 aa, Homo sapiens
  light chain complementarity determining region 3 for antibody 51647
MQALQTPPGT

SEQ ID NO: 103294 - protein, 13 aa, Homo sapiens
  heavy chain complementarity determining region 3 for antibody 51647
TKQSTIIIAGTDL

SEQ ID NO: 103295 - protein, 8 aa, Homo sapiens
  light chain complementarity determining region 3 for antibody 51648
MQALQTPI

SEQ ID NO: 103296 - protein, 19 aa, Homo sapiens
  heavy chain complementarity determining region 3 for antibody 51648
AKGYMVRGVIKIYYYGMDF

SEQ ID NO: 103297 - protein, 9 aa, Homo sapiens
  light chain complementarity determining region 3 for antibody 51649
MQALQTLFT

SEQ ID NO: 103298 - protein, 16 aa, Homo sapiens
  heavy chain complementarity determining region 3 for antibody 51649
VRLRMAVFPGHDGLDV

SEQ ID NO: 103299 - protein, 8 aa, Homo sapiens
  light chain complementarity determining region 3 for antibody 51650
MQALHMYT

SEQ ID NO: 103300 - protein, 16 aa, Homo sapiens
  heavy chain complementarity determining region 3 for antibody 51650
ARILIASAGVGYAMDV

SEQ ID NO: 103301 - protein, 9 aa, Homo sapiens
  light chain complementarity determining region 3 for antibody 51651
LQHNTFPPT

SEQ ID NO: 103302 - protein, 20 aa, Homo sapiens
  heavy chain complementarity determining region 3 for antibody 51651
ATSLCDTIRCFFWCCQEDDF

SEQ ID NO: 103303 - protein, 9 aa, Homo sapiens
  light chain complementarity determining region 3 for antibody 51652
LQHKIHPNT

SEQ ID NO: 103304 - protein, 7 aa, Homo sapiens
  heavy chain complementarity determining region 3 for antibody 51652
GSRWVDF

SEQ ID NO: 103305 - protein, 9 aa, Homo sapiens
  light chain complementarity determining region 3 for antibody 51653
LQDYTYPRT

SEQ ID NO: 103306 - protein, 21 aa, Homo sapiens
  heavy chain complementarity determining region 3 for antibody 51653
ARDSSPTQYDKTVFYYDAFDI

SEQ ID NO: 103307 - protein, 9 aa, Homo sapiens
  light chain complementarity determining region 3 for antibody 51654
LQDYNYPWT

SEQ ID NO: 103308 - protein, 15 aa, Homo sapiens
  heavy chain complementarity determining region 3 for antibody 51654
ARIRGAAVGSEFFDF

SEQ ID NO: 103309 - protein, 9 aa, Homo sapiens
  light chain complementarity determining region 3 for antibody 51655
HQYFSYPYT

SEQ ID NO: 103310 - protein, 6 aa, Homo sapiens
  heavy chain complementarity determining region 3 for antibody 51655
AYGFDV

SEQ ID NO: 103311 - protein, 9 aa, Homo sapiens
  light chain complementarity determining region 3 for antibody 51656
HQYDNLPRT

SEQ ID NO: 103312 - protein, 15 aa, Homo sapiens
  heavy chain complementarity determining region 3 for antibody 51656
ASLPTTWGGFETQNL

SEQ ID NO: 103313 - protein, 9 aa, Homo sapiens
  light chain complementarity determining region 3 for antibody 51657
HQFYSIPWT

SEQ ID NO: 103314 - protein, 11 aa, Homo sapiens
  heavy chain complementarity determining region 3 for antibody 51657
AGGEQMFPSSR

SEQ ID NO: 103315 - protein, 14 aa, Homo sapiens
  light chain complementarity determining region 3 for antibody 51658
HCQLFGNSLPRLYT

SEQ ID NO: 103316 - protein, 14 aa, Homo sapiens
  heavy chain complementarity determining region 3 for antibody 51658
ARHISVPSTRGFDS

SEQ ID NO: 103317 - protein, 6 aa, Homo sapiens
  light chain complementarity determining region 3 for antibody 51659
RQVAET

SEQ ID NO: 103318 - protein, 12 aa, Homo sapiens
  heavy chain complementarity determining region 3 for antibody 51659
ARDHPSGWALSH

SEQ ID NO: 103319 - protein, 10 aa, Homo sapiens
  light chain complementarity determining region 3 for antibody 51660
RHRGSWPLIT

SEQ ID NO: 103320 - protein, 23 aa, Homo sapiens
  heavy chain complementarity determining region 3 for antibody 51660
AKLTRFYDYWSGESGPISNWFDP

SEQ ID NO: 103321 - protein, 9 aa, Homo sapiens
  light chain complementarity determining region 3 for antibody 51661
QRYDNLPRT

SEQ ID NO: 103322 - protein, 15 aa, Homo sapiens
  heavy chain complementarity determining region 3 for antibody 51661
ASLPTTWGGFETQNL

SEQ ID NO: 103323 - protein, 10 aa, Homo sapiens
  light chain complementarity determining region 3 for antibody 51662
QRTYIAPPET

SEQ ID NO: 103324 - protein, 15 aa, Homo sapiens
  heavy chain complementarity determining region 3 for antibody 51662
ARGDTSGYYEYYFDY

SEQ ID NO: 103325 - protein, 9 aa, Homo sapiens
  light chain complementarity determining region 3 for antibody 51663
QRSYSTPYT

SEQ ID NO: 103326 - protein, 15 aa, Homo sapiens
  heavy chain complementarity determining region 3 for antibody 51663
ARASGRYVRSNFFDP

SEQ ID NO: 103327 - protein, 9 aa, Homo sapiens
  light chain complementarity determining region 3 for antibody 51664
QQYYTKPGT

SEQ ID NO: 103328 - protein, 14 aa, Homo sapiens
  heavy chain complementarity determining region 3 for antibody 51664
ARTHSSGWADAFDI

SEQ ID NO: 103329 - protein, 9 aa, Homo sapiens
  light chain complementarity determining region 3 for antibody 51665
QQYYSYSWT

SEQ ID NO: 103330 - protein, 11 aa, Homo sapiens
  heavy chain complementarity determining region 3 for antibody 51665
ASKVGSNPYGY

SEQ ID NO: 103331 - protein, 9 aa, Homo sapiens
  light chain complementarity determining region 3 for antibody 51666
QQYYSYSWT

SEQ ID NO: 103332 - protein, 11 aa, Homo sapiens
  heavy chain complementarity determining region 3 for antibody 51666
ASKVGANPSGY

SEQ ID NO: 103333 - protein, 9 aa, Homo sapiens
  light chain complementarity determining region 3 for antibody 51667
QQYYSYSWT

SEQ ID NO: 103334 - protein, 11 aa, Homo sapiens
  heavy chain complementarity determining region 3 for antibody 51667
ASKVGANPFDY

SEQ ID NO: 103335 - protein, 9 aa, Homo sapiens
  light chain complementarity determining region 3 for antibody 51668
QQYYSYSWT

SEQ ID NO: 103336 - protein, 11 aa, Homo sapiens
  heavy chain complementarity determining region 3 for antibody 51668
ASKVGANPCGY

SEQ ID NO: 103337 - protein, 9 aa, Homo sapiens
  light chain complementarity determining region 3 for antibody 51669
QQYYSYSWT

SEQ ID NO: 103338 - protein, 11 aa, Homo sapiens
  heavy chain complementarity determining region 3 for antibody 51669
ASKVGAKPYGY

SEQ ID NO: 103339 - protein, 9 aa, Homo sapiens
  light chain complementarity determining region 3 for antibody 51670
QQYYSYSWT

SEQ ID NO: 103340 - protein, 11 aa, Homo sapiens
  heavy chain complementarity determining region 3 for antibody 51670
ASKVGAHPYGY

SEQ ID NO: 103341 - protein, 9 aa, Homo sapiens
  light chain complementarity determining region 3 for antibody 51671
QQYYSYPYS

SEQ ID NO: 103342 - protein, 11 aa, Homo sapiens
  heavy chain complementarity determining region 3 for antibody 51671
ARVVPNYYEYY

SEQ ID NO: 103343 - protein, 9 aa, Homo sapiens
  light chain complementarity determining region 3 for antibody 51672
QQYYSTPWT

SEQ ID NO: 103344 - protein, 19 aa, Homo sapiens
  heavy chain complementarity determining region 3 for antibody 51672
ARPSHYDSSGSHFDWFFDI

SEQ ID NO: 103345 - protein, 9 aa, Homo sapiens
  light chain complementarity determining region 3 for antibody 51673
QQYYSTPVT

SEQ ID NO: 103346 - protein, 13 aa, Homo sapiens
  heavy chain complementarity determining region 3 for antibody 51673
ARCSSGWGDTFDI

SEQ ID NO: 103347 - protein, 9 aa, Homo sapiens
  light chain complementarity determining region 3 for antibody 51674
QQYYSTPRK

SEQ ID NO: 103348 - protein, 12 aa, Homo sapiens
  heavy chain complementarity determining region 3 for antibody 51674
GRVAPVEYYLDF

SEQ ID NO: 103349 - protein, 9 aa, Homo sapiens
  light chain complementarity determining region 3 for antibody 51675
QQYYSTPQT

SEQ ID NO: 103350 - protein, 13 aa, Homo sapiens
  heavy chain complementarity determining region 3 for antibody 51675
ARGNDYTDYFFNY

SEQ ID NO: 103351 - protein, 9 aa, Homo sapiens
  light chain complementarity determining region 3 for antibody 51676
QQYYSTPLT

SEQ ID NO: 103352 - protein, 14 aa, Homo sapiens
  heavy chain complementarity determining region 3 for antibody 51676
ARDAFDYGDNSHVY

SEQ ID NO: 103353 - protein, 9 aa, Homo sapiens
  light chain complementarity determining region 3 for antibody 51677
QQYYSDFPT

SEQ ID NO: 103354 - protein, 9 aa, Homo sapiens
  heavy chain complementarity determining region 3 for antibody 51677
ARGAAAADY

SEQ ID NO: 103355 - protein, 10 aa, Homo sapiens
  light chain complementarity determining region 3 for antibody 51678
QQYYSAPGVT

SEQ ID NO: 103356 - protein, 13 aa, Homo sapiens
  heavy chain complementarity determining region 3 for antibody 51678
ARGDSSGWLIFDD

SEQ ID NO: 103357 - protein, 10 aa, Homo sapiens
  light chain complementarity determining region 3 for antibody 51679
QQYYNNSPYT

SEQ ID NO: 103358 - protein, 24 aa, Homo sapiens
  heavy chain complementarity determining region 3 for antibody 51679
ARLSVYFGTVASAASKRYRSYFDY

SEQ ID NO: 103359 - protein, 10 aa, Homo sapiens
  light chain complementarity determining region 3 for antibody 51680
QQYSNSVPLT

SEQ ID NO: 103360 - protein, 17 aa, Homo sapiens
  heavy chain complementarity determining region 3 for antibody 51680
ASSGVYYYGSGNYYFDY

SEQ ID NO: 103361 - protein, 9 aa, Homo sapiens
  light chain complementarity determining region 3 for antibody 51681
QQYSDWSPA

SEQ ID NO: 103362 - protein, 19 aa, Homo sapiens
  heavy chain complementarity determining region 3 for antibody 51681
ARATNGIAVVLKRGDSLKH

SEQ ID NO: 103363 - protein, 9 aa, Homo sapiens
  light chain complementarity determining region 3 for antibody 51682
QQYSDFPVT

SEQ ID NO: 103364 - protein, 18 aa, Homo sapiens
  heavy chain complementarity determining region 3 for antibody 51682
ARATYDYVNSRGRWHFDF

SEQ ID NO: 103365 - protein, 8 aa, Homo sapiens
  light chain complementarity determining region 3 for antibody 51683
QQYNTYST

SEQ ID NO: 103366 - protein, 22 aa, Homo sapiens
  heavy chain complementarity determining region 3 for antibody 51683
ARGRANIADVVTTIALNEPFDI

SEQ ID NO: 103367 - protein, 9 aa, Homo sapiens
  light chain complementarity determining region 3 for antibody 51684
QQYNTYSST

SEQ ID NO: 103368 - protein, 18 aa, Homo sapiens
  heavy chain complementarity determining region 3 for antibody 51684
AKNGFDGSSSWFYWYFDL

SEQ ID NO: 103369 - protein, 8 aa, Homo sapiens
  light chain complementarity determining region 3 for antibody 51685
QQYNSYYT

SEQ ID NO: 103370 - protein, 15 aa, Homo sapiens
  heavy chain complementarity determining region 3 for antibody 51685
AHPRLGYTYGLAFDY

SEQ ID NO: 103371 - protein, 8 aa, Homo sapiens
  light chain complementarity determining region 3 for antibody 51686
QQYNSYYT

SEQ ID NO: 103372 - protein, 15 aa, Homo sapiens
  heavy chain complementarity determining region 3 for antibody 51686
AHPRLGYTYGCAFDY

SEQ ID NO: 103373 - protein, 8 aa, Homo sapiens
  light chain complementarity determining region 3 for antibody 51687
QQYNSYST

SEQ ID NO: 103374 - protein, 15 aa, Homo sapiens
  heavy chain complementarity determining region 3 for antibody 51687
ASLPTTWGGSETQNL

SEQ ID NO: 103375 - protein, 8 aa, Homo sapiens
  light chain complementarity determining region 3 for antibody 51688
QQYNSYST

SEQ ID NO: 103376 - protein, 15 aa, Homo sapiens
  heavy chain complementarity determining region 3 for antibody 51688
ASLPPTWGGFETQNL

SEQ ID NO: 103377 - protein, 8 aa, Homo sapiens
  light chain complementarity determining region 3 for antibody 51689
QQYNSYST

SEQ ID NO: 103378 - protein, 15 aa, Homo sapiens
  heavy chain complementarity determining region 3 for antibody 51689
AGLPTTWGGFETQNL

SEQ ID NO: 103379 - protein, 9 aa, Homo sapiens
  light chain complementarity determining region 3 for antibody 51690
QQYNSYPLT

SEQ ID NO: 103380 - protein, 13 aa, Homo sapiens
  heavy chain complementarity determining region 3 for antibody 51690
ARHYSSSRGPFDY

SEQ ID NO: 103381 - protein, 10 aa, Homo sapiens
  light chain complementarity determining region 3 for antibody 51691
QQYNSYLSLT

SEQ ID NO: 103382 - protein, 15 aa, Homo sapiens
  heavy chain complementarity determining region 3 for antibody 51691
ARTSNIAARRGTFDY

SEQ ID NO: 103383 - protein, 9 aa, Homo sapiens
  light chain complementarity determining region 3 for antibody 51692
QQYNSFLFT

SEQ ID NO: 103384 - protein, 23 aa, Homo sapiens
  heavy chain complementarity determining region 3 for antibody 51692
GSHYYDFVWENYRYKPRRHTFDI

SEQ ID NO: 103385 - protein, 9 aa, Homo sapiens
  light chain complementarity determining region 3 for antibody 51693
QQYNNWRGA

SEQ ID NO: 103386 - protein, 19 aa, Homo sapiens
  heavy chain complementarity determining region 3 for antibody 51693
ATDPSSIALAGTLGDAFDI

SEQ ID NO: 103387 - protein, 9 aa, Homo sapiens
  light chain complementarity determining region 3 for antibody 51694
QQYNNAPYT

SEQ ID NO: 103388 - protein, 10 aa, Homo sapiens
  heavy chain complementarity determining region 3 for antibody 51694
AAFRAHYFDY

SEQ ID NO: 103389 - protein, 10 aa, Homo sapiens
  light chain complementarity determining region 3 for antibody 51695
QQYNDWPPYT

SEQ ID NO: 103390 - protein, 17 aa, Homo sapiens
  heavy chain complementarity determining region 3 for antibody 51695
ARYSYDRSGYFYDFFDY

SEQ ID NO: 103391 - protein, 9 aa, Homo sapiens
  light chain complementarity determining region 3 for antibody 51696
QQYKSHFPT

SEQ ID NO: 103392 - protein, 13 aa, Homo sapiens
  heavy chain complementarity determining region 3 for antibody 51696
VRGDWKQWLVFCY

SEQ ID NO: 103393 - protein, 9 aa, Homo sapiens
  light chain complementarity determining region 3 for antibody 51697
QQYKSFPWT

SEQ ID NO: 103394 - protein, 10 aa, Homo sapiens
  heavy chain complementarity determining region 3 for antibody 51697
ARDSGYGIEY

SEQ ID NO: 103395 - protein, 9 aa, Homo sapiens
  light chain complementarity determining region 3 for antibody 51698
QQYISYPST

SEQ ID NO: 103396 - protein, 12 aa, Homo sapiens
  heavy chain complementarity determining region 3 for antibody 51698
ARRHSSGWFYAS

SEQ ID NO: 103397 - protein, 9 aa, Homo sapiens
  light chain complementarity determining region 3 for antibody 51699
QQYHSYPYS

SEQ ID NO: 103398 - protein, 11 aa, Homo sapiens
  heavy chain complementarity determining region 3 for antibody 51699
ARVVPNYYEHY

SEQ ID NO: 103399 - protein, 9 aa, Homo sapiens
  light chain complementarity determining region 3 for antibody 51700
QQYHSYPYS

SEQ ID NO: 103400 - protein, 11 aa, Homo sapiens
  heavy chain complementarity determining region 3 for antibody 51700
ARVVPNDYEYY

SEQ ID NO: 103401 - protein, 10 aa, Homo sapiens
  light chain complementarity determining region 3 for antibody 51701
QQYHDLPPVT

SEQ ID NO: 103402 - protein, 13 aa, Homo sapiens
  heavy chain complementarity determining region 3 for antibody 51701
AREGPATAATLDY

SEQ ID NO: 103403 - protein, 9 aa, Homo sapiens
  light chain complementarity determining region 3 for antibody 51702
QQYGTSPWT

SEQ ID NO: 103404 - protein, 12 aa, Homo sapiens
  heavy chain complementarity determining region 3 for antibody 51702
ARGPRYWYYLDY

SEQ ID NO: 103405 - protein, 9 aa, Homo sapiens
  light chain complementarity determining region 3 for antibody 51703
QQYGSSSYT

SEQ ID NO: 103406 - protein, 19 aa, Homo sapiens
  heavy chain complementarity determining region 3 for antibody 51703
ARVNRDLRGFVVYATYFDY

SEQ ID NO: 103407 - protein, 9 aa, Homo sapiens
  light chain complementarity determining region 3 for antibody 51704
QQYGSSSYT

SEQ ID NO: 103408 - protein, 19 aa, Homo sapiens
  heavy chain complementarity determining region 3 for antibody 51704
ARVNGELRGFVVYATYFDY

SEQ ID NO: 103409 - protein, 9 aa, Homo sapiens
  light chain complementarity determining region 3 for antibody 51705
QQYGSSPWT

SEQ ID NO: 103410 - protein, 16 aa, Homo sapiens
  heavy chain complementarity determining region 3 for antibody 51705
ARMEWWDLHPLGGFDS

SEQ ID NO: 103411 - protein, 9 aa, Homo sapiens
  light chain complementarity determining region 3 for antibody 51706
QQYGSSPQT

SEQ ID NO: 103412 - protein, 15 aa, Homo sapiens
  heavy chain complementarity determining region 3 for antibody 51706
ASGKGDGPGWPFFDF

SEQ ID NO: 103413 - protein, 10 aa, Homo sapiens
  light chain complementarity determining region 3 for antibody 51707
QQYGSSPPLT

SEQ ID NO: 103414 - protein, 9 aa, Homo sapiens
  heavy chain complementarity determining region 3 for antibody 51707
TTGDDGHAI

SEQ ID NO: 103415 - protein, 10 aa, Homo sapiens
  light chain complementarity determining region 3 for antibody 51708
QQYGSSPPIT

SEQ ID NO: 103416 - protein, 9 aa, Homo sapiens
  heavy chain complementarity determining region 3 for antibody 51708
TTGDDGHAL

SEQ ID NO: 103417 - protein, 10 aa, Homo sapiens
  light chain complementarity determining region 3 for antibody 51709
QQYGSSPPIT

SEQ ID NO: 103418 - protein, 9 aa, Homo sapiens
  heavy chain complementarity determining region 3 for antibody 51709
TTGDAGHAI

SEQ ID NO: 103419 - protein, 10 aa, Homo sapiens
  light chain complementarity determining region 3 for antibody 51710
QQYGSSPPIT

SEQ ID NO: 103420 - protein, 9 aa, Homo sapiens
  heavy chain complementarity determining region 3 for antibody 51710
TPGDDGHAI

SEQ ID NO: 103421 - protein, 10 aa, Homo sapiens
  light chain complementarity determining region 3 for antibody 51711
QQYGSSPPGT

SEQ ID NO: 103422 - protein, 15 aa, Homo sapiens
  heavy chain complementarity determining region 3 for antibody 51711
AIPYGSGNHYGSFDY

SEQ ID NO: 103423 - protein, 9 aa, Homo sapiens
  light chain complementarity determining region 3 for antibody 51712
QQYGSSPLT

SEQ ID NO: 103424 - protein, 16 aa, Homo sapiens
  heavy chain complementarity determining region 3 for antibody 51712
ARVSVRGVNRFNWFDS

SEQ ID NO: 103425 - protein, 9 aa, Homo sapiens
  light chain complementarity determining region 3 for antibody 51713
QQYGSSPLT

SEQ ID NO: 103426 - protein, 19 aa, Homo sapiens
  heavy chain complementarity determining region 3 for antibody 51713
ARERTTGLYHPYFHYGFDV

SEQ ID NO: 103427 - protein, 9 aa, Homo sapiens
  light chain complementarity determining region 3 for antibody 51714
QQYGSSPFT

SEQ ID NO: 103428 - protein, 17 aa, Homo sapiens
  heavy chain complementarity determining region 3 for antibody 51714
VRGGSVLEGAIKIPFEY

SEQ ID NO: 103429 - protein, 9 aa, Homo sapiens
  light chain complementarity determining region 3 for antibody 51715
QQYGSSPFT

SEQ ID NO: 103430 - protein, 15 aa, Homo sapiens
  heavy chain complementarity determining region 3 for antibody 51715
ARGGPVASSGPPYDY

SEQ ID NO: 103431 - protein, 9 aa, Homo sapiens
  light chain complementarity determining region 3 for antibody 51716
QQYGSSPFT

SEQ ID NO: 103432 - protein, 17 aa, Homo sapiens
  heavy chain complementarity determining region 3 for antibody 51716
ARDMALWSFGCSNAFDI

SEQ ID NO: 103433 - protein, 10 aa, Homo sapiens
  light chain complementarity determining region 3 for antibody 51717
QQYGSSPAWT

SEQ ID NO: 103434 - protein, 17 aa, Homo sapiens
  heavy chain complementarity determining region 3 for antibody 51717
TRVKYCSDGTCYTGTDD

SEQ ID NO: 103435 - protein, 10 aa, Homo sapiens
  light chain complementarity determining region 3 for antibody 51718
QQYGSSPAWT

SEQ ID NO: 103436 - protein, 17 aa, Homo sapiens
  heavy chain complementarity determining region 3 for antibody 51718
TRVKYCSDGACYAGTDY

SEQ ID NO: 103437 - protein, 10 aa, Homo sapiens
  light chain complementarity determining region 3 for antibody 51719
QQYGSSPAWT

SEQ ID NO: 103438 - protein, 17 aa, Homo sapiens
  heavy chain complementarity determining region 3 for antibody 51719
TRVKYCRDGTCYTGTDY

SEQ ID NO: 103439 - protein, 10 aa, Homo sapiens
  light chain complementarity determining region 3 for antibody 51720
QQYGSSPAWT

SEQ ID NO: 103440 - protein, 17 aa, Homo sapiens
  heavy chain complementarity determining region 3 for antibody 51720
TRVKYCGDGTCYTGTDY

SEQ ID NO: 103441 - protein, 10 aa, Homo sapiens
  light chain complementarity determining region 3 for antibody 51721
QQYGSSPAWT

SEQ ID NO: 103442 - protein, 17 aa, Homo sapiens
  heavy chain complementarity determining region 3 for antibody 51721
TGVKYCSDGTCYTGTDY

SEQ ID NO: 103443 - protein, 10 aa, Homo sapiens
  light chain complementarity determining region 3 for antibody 51722
QQYGSSPAWT

SEQ ID NO: 103444 - protein, 17 aa, Homo sapiens
  heavy chain complementarity determining region 3 for antibody 51722
SRVKYCSDGTCYTGTDY

SEQ ID NO: 103445 - protein, 10 aa, Homo sapiens
  light chain complementarity determining region 3 for antibody 51723
QQYGSSPAWT

SEQ ID NO: 103446 - protein, 15 aa, Homo sapiens
  heavy chain complementarity determining region 3 for antibody 51723
ASLPTTWGGFETQNL

SEQ ID NO: 103447 - protein, 10 aa, Homo sapiens
  light chain complementarity determining region 3 for antibody 51724
QQYGSSPALT

SEQ ID NO: 103448 - protein, 17 aa, Homo sapiens
  heavy chain complementarity determining region 3 for antibody 51724
TRVKYCSDGTCYTGTDY

SEQ ID NO: 103449 - protein, 10 aa, Homo sapiens
  light chain complementarity determining region 3 for antibody 51725
QQYGSSLLIT

SEQ ID NO: 103450 - protein, 15 aa, Homo sapiens
  heavy chain complementarity determining region 3 for antibody 51725
ANSALYSSGWYRLAY

SEQ ID NO: 103451 - protein, 10 aa, Homo sapiens
  light chain complementarity determining region 3 for antibody 51726
QQYGSSLLIT

SEQ ID NO: 103452 - protein, 15 aa, Homo sapiens
  heavy chain complementarity determining region 3 for antibody 51726
AHSALYSSGWYSLAY

SEQ ID NO: 103453 - protein, 11 aa, Homo sapiens
  light chain complementarity determining region 3 for antibody 51727
QQYGSSFPTGT

SEQ ID NO: 103454 - protein, 16 aa, Homo sapiens
  heavy chain complementarity determining region 3 for antibody 51727
ARHSERWVLLWGGFDI

SEQ ID NO: 103455 - protein, 9 aa, Homo sapiens
  light chain complementarity determining region 3 for antibody 51728
QQYGSPPFT

SEQ ID NO: 103456 - protein, 17 aa, Homo sapiens
  heavy chain complementarity determining region 3 for antibody 51728
ARDMALWSFGFSNAFDI

SEQ ID NO: 103457 - protein, 9 aa, Homo sapiens
  light chain complementarity determining region 3 for antibody 51729
QQYGSAPAT

SEQ ID NO: 103458 - protein, 20 aa, Homo sapiens
  heavy chain complementarity determining region 3 for antibody 51729
ARPLTNWGAITGTPHDFYNI

SEQ ID NO: 103459 - protein, 9 aa, Homo sapiens
  light chain complementarity determining region 3 for antibody 51730
QQYGRSPIT

SEQ ID NO: 103460 - protein, 17 aa, Homo sapiens
  heavy chain complementarity determining region 3 for antibody 51730
ARGLPRIATTGTNWFDP

SEQ ID NO: 103461 - protein, 8 aa, Homo sapiens
  light chain complementarity determining region 3 for antibody 51731
QQYGRSLT

SEQ ID NO: 103462 - protein, 16 aa, Homo sapiens
  heavy chain complementarity determining region 3 for antibody 51731
ARAIDLAVTPANAFDI

SEQ ID NO: 103463 - protein, 9 aa, Homo sapiens
  light chain complementarity determining region 3 for antibody 51732
QQYGNSPYT

SEQ ID NO: 103464 - protein, 16 aa, Homo sapiens
  heavy chain complementarity determining region 3 for antibody 51732
LKGGVYNSGWHDVFTV

SEQ ID NO: 103465 - protein, 10 aa, Homo sapiens
  light chain complementarity determining region 3 for antibody 51733
QQYGGSPLVT

SEQ ID NO: 103466 - protein, 14 aa, Homo sapiens
  heavy chain complementarity determining region 3 for antibody 51733
ARDPILSHPDYFDY

SEQ ID NO: 103467 - protein, 6 aa, Homo sapiens
  light chain complementarity determining region 3 for antibody 51734
QQYGET

SEQ ID NO: 103468 - protein, 12 aa, Homo sapiens
  heavy chain complementarity determining region 3 for antibody 51734
ARDHPSGWSLHS

SEQ ID NO: 103469 - protein, 6 aa, Homo sapiens
  light chain complementarity determining region 3 for antibody 51735
QQYGET

SEQ ID NO: 103470 - protein, 12 aa, Homo sapiens
  heavy chain complementarity determining region 3 for antibody 51735
ARDHPSGWSLDS

SEQ ID NO: 103471 - protein, 6 aa, Homo sapiens
  light chain complementarity determining region 3 for antibody 51736
QQYGET

SEQ ID NO: 103472 - protein, 12 aa, Homo sapiens
  heavy chain complementarity determining region 3 for antibody 51736
ARDHPSGWSLAS

SEQ ID NO: 103473 - protein, 6 aa, Homo sapiens
  light chain complementarity determining region 3 for antibody 51737
QQYGES

SEQ ID NO: 103474 - protein, 12 aa, Homo sapiens
  heavy chain complementarity determining region 3 for antibody 51737
ARDHPSGWSLYS

SEQ ID NO: 103475 - protein, 9 aa, Homo sapiens
  light chain complementarity determining region 3 for antibody 51738
QQYFSLPYT

SEQ ID NO: 103476 - protein, 20 aa, Homo sapiens
  heavy chain complementarity determining region 3 for antibody 51738
AKEAKVALLVVVINPLYLDF

SEQ ID NO: 103477 - protein, 9 aa, Homo sapiens
  light chain complementarity determining region 3 for antibody 51739
QQYFNYPWT

SEQ ID NO: 103478 - protein, 16 aa, Homo sapiens
  heavy chain complementarity determining region 3 for antibody 51739
STGECSGAACFRRLDY

SEQ ID NO: 103479 - protein, 9 aa, Homo sapiens
  light chain complementarity determining region 3 for antibody 51740
QQYFNYPWT

SEQ ID NO: 103480 - protein, 16 aa, Homo sapiens
  heavy chain complementarity determining region 3 for antibody 51740
ATGECSGATCFRRLDY

SEQ ID NO: 103481 - protein, 8 aa, Homo sapiens
  light chain complementarity determining region 3 for antibody 51741
QQYDYILT

SEQ ID NO: 103482 - protein, 8 aa, Homo sapiens
  heavy chain complementarity determining region 3 for antibody 51741
ARDVFRHT

SEQ ID NO: 103483 - protein, 9 aa, Homo sapiens
  light chain complementarity determining region 3 for antibody 51742
QQYDSYPYT

SEQ ID NO: 103484 - protein, 11 aa, Homo sapiens
  heavy chain complementarity determining region 3 for antibody 51742
ATNDYGDYASY

SEQ ID NO: 103485 - protein, 9 aa, Homo sapiens
  light chain complementarity determining region 3 for antibody 51743
QQYDSSPLT

SEQ ID NO: 103486 - protein, 15 aa, Homo sapiens
  heavy chain complementarity determining region 3 for antibody 51743
TTDGGFYDFWSGFDY

SEQ ID NO: 103487 - protein, 9 aa, Homo sapiens
  light chain complementarity determining region 3 for antibody 51744
QQYDSFPLT

SEQ ID NO: 103488 - protein, 18 aa, Homo sapiens
  heavy chain complementarity determining region 3 for antibody 51744
ARAPPYSSSVRGYYGMDV

SEQ ID NO: 103489 - protein, 9 aa, Homo sapiens
  light chain complementarity determining region 3 for antibody 51745
QQYDSFPLT

SEQ ID NO: 103490 - protein, 18 aa, Homo sapiens
  heavy chain complementarity determining region 3 for antibody 51745
AGVPPYSSSVRGYYGMDV

SEQ ID NO: 103491 - protein, 9 aa, Homo sapiens
  light chain complementarity determining region 3 for antibody 51746
QQYDRDFPT

SEQ ID NO: 103492 - protein, 9 aa, Homo sapiens
  heavy chain complementarity determining region 3 for antibody 51746
ARGAAAADY

SEQ ID NO: 103493 - protein, 8 aa, Homo sapiens
  light chain complementarity determining region 3 for antibody 51747
QQYDNWPR

SEQ ID NO: 103494 - protein, 17 aa, Homo sapiens
  heavy chain complementarity determining region 3 for antibody 51747
ARTIFCYDSSDMSCLGY

SEQ ID NO: 103495 - protein, 9 aa, Homo sapiens
  light chain complementarity determining region 3 for antibody 51748
QQYDNVPRT

SEQ ID NO: 103496 - protein, 15 aa, Homo sapiens
  heavy chain complementarity determining region 3 for antibody 51748
ASLPTTWGGFETQNL

SEQ ID NO: 103497 - protein, 9 aa, Homo sapiens
  light chain complementarity determining region 3 for antibody 51749
QQYDNLSRT

SEQ ID NO: 103498 - protein, 15 aa, Homo sapiens
  heavy chain complementarity determining region 3 for antibody 51749
ASLPTTWGGSETQNL

SEQ ID NO: 103499 - protein, 9 aa, Homo sapiens
  light chain complementarity determining region 3 for antibody 51750
QQYDNLSRT

SEQ ID NO: 103500 - protein, 15 aa, Homo sapiens
  heavy chain complementarity determining region 3 for antibody 51750
ASLPTTWGGFETQNL

SEQ ID NO: 103501 - protein, 9 aa, Homo sapiens
  light chain complementarity determining region 3 for antibody 51751
QQYDNLPWT

SEQ ID NO: 103502 - protein, 15 aa, Homo sapiens
  heavy chain complementarity determining region 3 for antibody 51751
ASLPTTWGGFETQNL

SEQ ID NO: 103503 - protein, 9 aa, Homo sapiens
  light chain complementarity determining region 3 for antibody 51752
QQYDNLPRT

SEQ ID NO: 103504 - protein, 9 aa, Homo sapiens
  heavy chain complementarity determining region 3 for antibody 51752
TTGDDGHAI

SEQ ID NO: 103505 - protein, 9 aa, Homo sapiens
  light chain complementarity determining region 3 for antibody 51753
QQYDNLPRT

SEQ ID NO: 103506 - protein, 15 aa, Homo sapiens
  heavy chain complementarity determining region 3 for antibody 51753
ASRPTTWGGSETQNL

SEQ ID NO: 103507 - protein, 9 aa, Homo sapiens
  light chain complementarity determining region 3 for antibody 51754
QQYDNLPRT

SEQ ID NO: 103508 - protein, 15 aa, Homo sapiens
  heavy chain complementarity determining region 3 for antibody 51754
ASRPSTWGGFETQNL

SEQ ID NO: 103509 - protein, 9 aa, Homo sapiens
  light chain complementarity determining region 3 for antibody 51755
QQYDNLPRT

SEQ ID NO: 103510 - protein, 15 aa, Homo sapiens
  heavy chain complementarity determining region 3 for antibody 51755
ASLTTTWGGFETQNL

SEQ ID NO: 103511 - protein, 9 aa, Homo sapiens
  light chain complementarity determining region 3 for antibody 51756
QQYDNLPRT

SEQ ID NO: 103512 - protein, 15 aa, Homo sapiens
  heavy chain complementarity determining region 3 for antibody 51756
ASLPTTWWGFETHNL

SEQ ID NO: 103513 - protein, 9 aa, Homo sapiens
  light chain complementarity determining region 3 for antibody 51757
QQYDNLPRT

SEQ ID NO: 103514 - protein, 15 aa, Homo sapiens
  heavy chain complementarity determining region 3 for antibody 51757
ASLPTTWGVFETQNL

SEQ ID NO: 103515 - protein, 9 aa, Homo sapiens
  light chain complementarity determining region 3 for antibody 51758
QQYDNLPRT

SEQ ID NO: 103516 - protein, 15 aa, Homo sapiens
  heavy chain complementarity determining region 3 for antibody 51758
ASLPTTWGGSETQSL

SEQ ID NO: 103517 - protein, 9 aa, Homo sapiens
  light chain complementarity determining region 3 for antibody 51759
QQYDNLPRT

SEQ ID NO: 103518 - protein, 15 aa, Homo sapiens
  heavy chain complementarity determining region 3 for antibody 51759
ASLPTTWGGFETQNF

SEQ ID NO: 103519 - protein, 9 aa, Homo sapiens
  light chain complementarity determining region 3 for antibody 51760
QQYDNLPRT

SEQ ID NO: 103520 - protein, 15 aa, Homo sapiens
  heavy chain complementarity determining region 3 for antibody 51760
ASLPTTWGGFETQKL

SEQ ID NO: 103521 - protein, 9 aa, Homo sapiens
  light chain complementarity determining region 3 for antibody 51761
QQYDNLPRT

SEQ ID NO: 103522 - protein, 15 aa, Homo sapiens
  heavy chain complementarity determining region 3 for antibody 51761
ASLPTTWGGAETQNL

SEQ ID NO: 103523 - protein, 9 aa, Homo sapiens
  light chain complementarity determining region 3 for antibody 51762
QQYDNLPRT

SEQ ID NO: 103524 - protein, 15 aa, Homo sapiens
  heavy chain complementarity determining region 3 for antibody 51762
ASLPTPWGGSETQNL

SEQ ID NO: 103525 - protein, 9 aa, Homo sapiens
  light chain complementarity determining region 3 for antibody 51763
QQYDNLPRT

SEQ ID NO: 103526 - protein, 15 aa, Homo sapiens
  heavy chain complementarity determining region 3 for antibody 51763
ASLPTPWGGFETQDL

SEQ ID NO: 103527 - protein, 9 aa, Homo sapiens
  light chain complementarity determining region 3 for antibody 51764
QQYDNLPRT

SEQ ID NO: 103528 - protein, 15 aa, Homo sapiens
  heavy chain complementarity determining region 3 for antibody 51764
ASLPTAWGGFETHNL

SEQ ID NO: 103529 - protein, 9 aa, Homo sapiens
  light chain complementarity determining region 3 for antibody 51765
QQYDNLPRT

SEQ ID NO: 103530 - protein, 15 aa, Homo sapiens
  heavy chain complementarity determining region 3 for antibody 51765
ASLPTAWGGFEAQNL

SEQ ID NO: 103531 - protein, 9 aa, Homo sapiens
  light chain complementarity determining region 3 for antibody 51766
QQYDNLPRT

SEQ ID NO: 103532 - protein, 15 aa, Homo sapiens
  heavy chain complementarity determining region 3 for antibody 51766
ASHPTTWGGFETQNL

SEQ ID NO: 103533 - protein, 9 aa, Homo sapiens
  light chain complementarity determining region 3 for antibody 51767
QQYDNLPRT

SEQ ID NO: 103534 - protein, 15 aa, Homo sapiens
  heavy chain complementarity determining region 3 for antibody 51767
ARLPTTWGGFETQDL

SEQ ID NO: 103535 - protein, 9 aa, Homo sapiens
  light chain complementarity determining region 3 for antibody 51768
QQYDNLPRT

SEQ ID NO: 103536 - protein, 15 aa, Homo sapiens
  heavy chain complementarity determining region 3 for antibody 51768
ARLPTTWGGFESQNL

SEQ ID NO: 103537 - protein, 9 aa, Homo sapiens
  light chain complementarity determining region 3 for antibody 51769
QQYDNLPRT

SEQ ID NO: 103538 - protein, 13 aa, Homo sapiens
  heavy chain complementarity determining region 3 for antibody 51769
ARGLVSAVGYGDH

SEQ ID NO: 103539 - protein, 9 aa, Homo sapiens
  light chain complementarity determining region 3 for antibody 51770
QQYDNLPRT

SEQ ID NO: 103540 - protein, 15 aa, Homo sapiens
  heavy chain complementarity determining region 3 for antibody 51770
AGLPTTWRGFETQNL

SEQ ID NO: 103541 - protein, 9 aa, Homo sapiens
  light chain complementarity determining region 3 for antibody 51771
QQYDNLPRT

SEQ ID NO: 103542 - protein, 15 aa, Homo sapiens
  heavy chain complementarity determining region 3 for antibody 51771
ACLPTTWGGFESQNL

SEQ ID NO: 103543 - protein, 9 aa, Homo sapiens
  light chain complementarity determining region 3 for antibody 51772
QQYDNLPRP

SEQ ID NO: 103544 - protein, 15 aa, Homo sapiens
  heavy chain complementarity determining region 3 for antibody 51772
ASLPTTWGGFETQNL

SEQ ID NO: 103545 - protein, 9 aa, Homo sapiens
  light chain complementarity determining region 3 for antibody 51773
QQYDNLPQT

SEQ ID NO: 103546 - protein, 15 aa, Homo sapiens
  heavy chain complementarity determining region 3 for antibody 51773
ASLPTTWGGFETQNL

SEQ ID NO: 103547 - protein, 10 aa, Homo sapiens
  light chain complementarity determining region 3 for antibody 51774
QQYDNLPMYT

SEQ ID NO: 103548 - protein, 6 aa, Homo sapiens
  heavy chain complementarity determining region 3 for antibody 51774
AREWRT

SEQ ID NO: 103549 - protein, 10 aa, Homo sapiens
  light chain complementarity determining region 3 for antibody 51775
QQYDNLPMYT

SEQ ID NO: 103550 - protein, 6 aa, Homo sapiens
  heavy chain complementarity determining region 3 for antibody 51775
AREGHT

SEQ ID NO: 103551 - protein, 10 aa, Homo sapiens
  light chain complementarity determining region 3 for antibody 51776
QQYDNLPMYT

SEQ ID NO: 103552 - protein, 6 aa, Homo sapiens
  heavy chain complementarity determining region 3 for antibody 51776
AREGGT

SEQ ID NO: 103553 - protein, 10 aa, Homo sapiens
  light chain complementarity determining region 3 for antibody 51777
QQYDNLLALT

SEQ ID NO: 103554 - protein, 14 aa, Homo sapiens
  heavy chain complementarity determining region 3 for antibody 51777
AGRCGDITPTILDY

SEQ ID NO: 103555 - protein, 9 aa, Homo sapiens
  light chain complementarity determining region 3 for antibody 51778
QQYDNIPPT

SEQ ID NO: 103556 - protein, 17 aa, Homo sapiens
  heavy chain complementarity determining region 3 for antibody 51778
ARGPLIRGLVVPVPLDY

SEQ ID NO: 103557 - protein, 9 aa, Homo sapiens
  light chain complementarity determining region 3 for antibody 51779
QQYDNFQFT

SEQ ID NO: 103558 - protein, 13 aa, Homo sapiens
  heavy chain complementarity determining region 3 for antibody 51779
ARSPDYYYYGMDV

SEQ ID NO: 103559 - protein, 9 aa, Homo sapiens
  light chain complementarity determining region 3 for antibody 51780
QQYDKYPLS

SEQ ID NO: 103560 - protein, 16 aa, Homo sapiens
  heavy chain complementarity determining region 3 for antibody 51780
ARERDTVISPVARFRL

SEQ ID NO: 103561 - protein, 9 aa, Homo sapiens
  light chain complementarity determining region 3 for antibody 51781
QQYDDLPRT

SEQ ID NO: 103562 - protein, 15 aa, Homo sapiens
  heavy chain complementarity determining region 3 for antibody 51781
ASLPTTWGGFETQNL

SEQ ID NO: 103563 - protein, 9 aa, Homo sapiens
  light chain complementarity determining region 3 for antibody 51782
QQYDDLPLT

SEQ ID NO: 103564 - protein, 13 aa, Homo sapiens
  heavy chain complementarity determining region 3 for antibody 51782
VRHRGGSSLMHDW

SEQ ID NO: 103565 - protein, 9 aa, Homo sapiens
  light chain complementarity determining region 3 for antibody 51783
QQYANLPRT

SEQ ID NO: 103566 - protein, 15 aa, Homo sapiens
  heavy chain complementarity determining region 3 for antibody 51783
ASLPTTWGGFETQNL

SEQ ID NO: 103567 - protein, 6 aa, Homo sapiens
  light chain complementarity determining region 3 for antibody 51784
QQVAET

SEQ ID NO: 103568 - protein, 12 aa, Homo sapiens
  heavy chain complementarity determining region 3 for antibody 51784
ARDHPSGWALAH

SEQ ID NO: 103569 - protein, 9 aa, Homo sapiens
  light chain complementarity determining region 3 for antibody 51785
QQTYTPPYN

SEQ ID NO: 103570 - protein, 15 aa, Homo sapiens
  heavy chain complementarity determining region 3 for antibody 51785
GREQGSMVPGDVVDF

SEQ ID NO: 103571 - protein, 9 aa, Homo sapiens
  light chain complementarity determining region 3 for antibody 51786
QQTYTPPSI

SEQ ID NO: 103572 - protein, 15 aa, Homo sapiens
  heavy chain complementarity determining region 3 for antibody 51786
GREQGSMVPGDVVDF

SEQ ID NO: 103573 - protein, 9 aa, Homo sapiens
  light chain complementarity determining region 3 for antibody 51787
QQTYSTPWT

SEQ ID NO: 103574 - protein, 13 aa, Homo sapiens
  heavy chain complementarity determining region 3 for antibody 51787
ARVVTVDGPPFDF

SEQ ID NO: 103575 - protein, 9 aa, Homo sapiens
  light chain complementarity determining region 3 for antibody 51788
QQTYSTPWT

SEQ ID NO: 103576 - protein, 13 aa, Homo sapiens
  heavy chain complementarity determining region 3 for antibody 51788
ARVVTVDGAPFDF

SEQ ID NO: 103577 - protein, 9 aa, Homo sapiens
  light chain complementarity determining region 3 for antibody 51789
QQTYPPPYI

SEQ ID NO: 103578 - protein, 15 aa, Homo sapiens
  heavy chain complementarity determining region 3 for antibody 51789
GREQGSMVPGDVVDF

SEQ ID NO: 103579 - protein, 9 aa, Homo sapiens
  light chain complementarity determining region 3 for antibody 51790
QQTNSFPLT

SEQ ID NO: 103580 - protein, 23 aa, Homo sapiens
  heavy chain complementarity determining region 3 for antibody 51790
ARATDTHVTSSPLIVLLSDAFDF

SEQ ID NO: 103581 - protein, 9 aa, Homo sapiens
  light chain complementarity determining region 3 for antibody 51791
QQSYTTPYT

SEQ ID NO: 103582 - protein, 15 aa, Homo sapiens
  heavy chain complementarity determining region 3 for antibody 51791
ARGCVGAAGYWYFDL

SEQ ID NO: 103583 - protein, 10 aa, Homo sapiens
  light chain complementarity determining region 3 for antibody 51792
QQSYTTPQVT

SEQ ID NO: 103584 - protein, 19 aa, Homo sapiens
  heavy chain complementarity determining region 3 for antibody 51792
ATNTLGYSTGWCSGNYFDY

SEQ ID NO: 103585 - protein, 9 aa, Homo sapiens
  light chain complementarity determining region 3 for antibody 51793
QQSYTIPLT

SEQ ID NO: 103586 - protein, 9 aa, Homo sapiens
  heavy chain complementarity determining region 3 for antibody 51793
TTGDDGPAI

SEQ ID NO: 103587 - protein, 9 aa, Homo sapiens
  light chain complementarity determining region 3 for antibody 51794
QQSYTIPLT

SEQ ID NO: 103588 - protein, 9 aa, Homo sapiens
  heavy chain complementarity determining region 3 for antibody 51794
ATGDDGHAI

SEQ ID NO: 103589 - protein, 9 aa, Homo sapiens
  light chain complementarity determining region 3 for antibody 51795
QQSYSTRRT

SEQ ID NO: 103590 - protein, 14 aa, Homo sapiens
  heavy chain complementarity determining region 3 for antibody 51795
ASPHRTIFGGGFDP

SEQ ID NO: 103591 - protein, 9 aa, Homo sapiens
  light chain complementarity determining region 3 for antibody 51796
QQSYSTPWT

SEQ ID NO: 103592 - protein, 18 aa, Homo sapiens
  heavy chain complementarity determining region 3 for antibody 51796
ARVGPYAGSYYGGHAFDI

SEQ ID NO: 103593 - protein, 10 aa, Homo sapiens
  light chain complementarity determining region 3 for antibody 51797
QQSYSTPVYT

SEQ ID NO: 103594 - protein, 13 aa, Homo sapiens
  heavy chain complementarity determining region 3 for antibody 51797
ARDLYESSGYFGF

SEQ ID NO: 103595 - protein, 9 aa, Homo sapiens
  light chain complementarity determining region 3 for antibody 51798
QQSYSTPRT

SEQ ID NO: 103596 - protein, 16 aa, Homo sapiens
  heavy chain complementarity determining region 3 for antibody 51798
TRDRPDRIEFLNWFDP

SEQ ID NO: 103597 - protein, 9 aa, Homo sapiens
  light chain complementarity determining region 3 for antibody 51799
QQSYSTPRT

SEQ ID NO: 103598 - protein, 10 aa, Homo sapiens
  heavy chain complementarity determining region 3 for antibody 51799
ARERGSAFDL

SEQ ID NO: 103599 - protein, 9 aa, Homo sapiens
  light chain complementarity determining region 3 for antibody 51800
QQSYSTPPT

SEQ ID NO: 103600 - protein, 18 aa, Homo sapiens
  heavy chain complementarity determining region 3 for antibody 51800
ARGTTGYSSSWYLPGLDY

SEQ ID NO: 103601 - protein, 9 aa, Homo sapiens
  light chain complementarity determining region 3 for antibody 51801
QQSYSTPPT

SEQ ID NO: 103602 - protein, 15 aa, Homo sapiens
  heavy chain complementarity determining region 3 for antibody 51801
AREGYSSSWSQPLDY

SEQ ID NO: 103603 - protein, 10 aa, Homo sapiens
  light chain complementarity determining region 3 for antibody 51802
QQSYSTPPFT

SEQ ID NO: 103604 - protein, 15 aa, Homo sapiens
  heavy chain complementarity determining region 3 for antibody 51802
ATLNYGDYISDAFDI

SEQ ID NO: 103605 - protein, 10 aa, Homo sapiens
  light chain complementarity determining region 3 for antibody 51803
QQSYSTPPFT

SEQ ID NO: 103606 - protein, 15 aa, Homo sapiens
  heavy chain complementarity determining region 3 for antibody 51803
ARRGYYGPGKMAYDI

SEQ ID NO: 103607 - protein, 9 aa, Homo sapiens
  light chain complementarity determining region 3 for antibody 51804
QQSYSTPLT

SEQ ID NO: 103608 - protein, 10 aa, Homo sapiens
  heavy chain complementarity determining region 3 for antibody 51804
SRERGSAFDL

SEQ ID NO: 103609 - protein, 9 aa, Homo sapiens
  light chain complementarity determining region 3 for antibody 51805
QQSYSTPLT

SEQ ID NO: 103610 - protein, 10 aa, Homo sapiens
  heavy chain complementarity determining region 3 for antibody 51805
AREGGSAFDL

SEQ ID NO: 103611 - protein, 9 aa, Homo sapiens
  light chain complementarity determining region 3 for antibody 51806
QQSYSTPLT

SEQ ID NO: 103612 - protein, 13 aa, Homo sapiens
  heavy chain complementarity determining region 3 for antibody 51806
AHRESLLNDGFDI

SEQ ID NO: 103613 - protein, 9 aa, Homo sapiens
  light chain complementarity determining region 3 for antibody 51807
QQSYSTPLA

SEQ ID NO: 103614 - protein, 10 aa, Homo sapiens
  heavy chain complementarity determining region 3 for antibody 51807
ARERGSAFDL

SEQ ID NO: 103615 - protein, 9 aa, Homo sapiens
  light chain complementarity determining region 3 for antibody 51808
QQSYSTPFT

SEQ ID NO: 103616 - protein, 11 aa, Homo sapiens
  heavy chain complementarity determining region 3 for antibody 51808
ARQDTAMVTSY

SEQ ID NO: 103617 - protein, 8 aa, Homo sapiens
  light chain complementarity determining region 3 for antibody 51809
QQSYSTLT

SEQ ID NO: 103618 - protein, 14 aa, Homo sapiens
  heavy chain complementarity determining region 3 for antibody 51809
ASFGRISIFGVFDV

SEQ ID NO: 103619 - protein, 10 aa, Homo sapiens
  light chain complementarity determining region 3 for antibody 51810
QQSYSPPPLT

SEQ ID NO: 103620 - protein, 14 aa, Homo sapiens
  heavy chain complementarity determining region 3 for antibody 51810
ARVHDSSWPPVFDF

SEQ ID NO: 103621 - protein, 9 aa, Homo sapiens
  light chain complementarity determining region 3 for antibody 51811
QQSYSPPLT

SEQ ID NO: 103622 - protein, 10 aa, Homo sapiens
  heavy chain complementarity determining region 3 for antibody 51811
ARERGSAFDL

SEQ ID NO: 103623 - protein, 9 aa, Homo sapiens
  light chain complementarity determining region 3 for antibody 51812
QQSYNTPFT

SEQ ID NO: 103624 - protein, 18 aa, Homo sapiens
  heavy chain complementarity determining region 3 for antibody 51812
ARGDETSGYFSSFDAFDI

SEQ ID NO: 103625 - protein, 9 aa, Homo sapiens
  light chain complementarity determining region 3 for antibody 51813
QQSYIIPFT

SEQ ID NO: 103626 - protein, 11 aa, Homo sapiens
  heavy chain complementarity determining region 3 for antibody 51813
ARGLGYGQFDY

SEQ ID NO: 103627 - protein, 9 aa, Homo sapiens
  light chain complementarity determining region 3 for antibody 51814
QQSYDTPRT

SEQ ID NO: 103628 - protein, 16 aa, Homo sapiens
  heavy chain complementarity determining region 3 for antibody 51814
ARDQDIPVAGPSIFDY

SEQ ID NO: 103629 - protein, 7 aa, Homo sapiens
  light chain complementarity determining region 3 for antibody 51815
QQSIVKP

SEQ ID NO: 103630 - protein, 11 aa, Homo sapiens
  heavy chain complementarity determining region 3 for antibody 51815
ARDVVKGGVDY

SEQ ID NO: 103631 - protein, 9 aa, Homo sapiens
  light chain complementarity determining region 3 for antibody 51816
QQSHDAPRT

SEQ ID NO: 103632 - protein, 31 aa, Homo sapiens
  heavy chain complementarity determining region 3 for antibody 51816
ARDGPGSVVVGPTYLRPRPPTLTTNYYHLDV

SEQ ID NO: 103633 - protein, 9 aa, Homo sapiens
  light chain complementarity determining region 3 for antibody 51817
QQSHDAPRT

SEQ ID NO: 103634 - protein, 31 aa, Homo sapiens
  heavy chain complementarity determining region 3 for antibody 51817
ARDGPGSVVVGPPYLRPRPPTLNTNYYHLDV

SEQ ID NO: 103635 - protein, 9 aa, Homo sapiens
  light chain complementarity determining region 3 for antibody 51818
QQSFTTPVT

SEQ ID NO: 103636 - protein, 19 aa, Homo sapiens
  heavy chain complementarity determining region 3 for antibody 51818
SRGANVSALVILTPHGFDF

SEQ ID NO: 103637 - protein, 9 aa, Homo sapiens
  light chain complementarity determining region 3 for antibody 51819
QQSFASPIT

SEQ ID NO: 103638 - protein, 13 aa, Homo sapiens
  heavy chain complementarity determining region 3 for antibody 51819
AKNIRDEVAGYDF

SEQ ID NO: 103639 - protein, 10 aa, Homo sapiens
  light chain complementarity determining region 3 for antibody 51820
QQSDSMYPST

SEQ ID NO: 103640 - protein, 14 aa, Homo sapiens
  heavy chain complementarity determining region 3 for antibody 51820
ARGYSTNGVCAFDP

SEQ ID NO: 103641 - protein, 9 aa, Homo sapiens
  light chain complementarity determining region 3 for antibody 51821
QQSCNFPRT

SEQ ID NO: 103642 - protein, 18 aa, Homo sapiens
  heavy chain complementarity determining region 3 for antibody 51821
ARDRGTPVDGEWIAAFDI

SEQ ID NO: 103643 - protein, 10 aa, Homo sapiens
  light chain complementarity determining region 3 for antibody 51822
QQRYSPPPFT

SEQ ID NO: 103644 - protein, 14 aa, Homo sapiens
  heavy chain complementarity determining region 3 for antibody 51822
ARVHDSSWPPVFDF

SEQ ID NO: 103645 - protein, 10 aa, Homo sapiens
  light chain complementarity determining region 3 for antibody 51823
QQRSTWPPIS

SEQ ID NO: 103646 - protein, 17 aa, Homo sapiens
  heavy chain complementarity determining region 3 for antibody 51823
AHSGGDTNTWYGSHFDS

SEQ ID NO: 103647 - protein, 11 aa, Homo sapiens
  light chain complementarity determining region 3 for antibody 51824
QQRSNWPPTYT

SEQ ID NO: 103648 - protein, 12 aa, Homo sapiens
  heavy chain complementarity determining region 3 for antibody 51824
AREIKAAAGIVA

SEQ ID NO: 103649 - protein, 11 aa, Homo sapiens
  light chain complementarity determining region 3 for antibody 51825
QQRSNWPPMYT

SEQ ID NO: 103650 - protein, 12 aa, Homo sapiens
  heavy chain complementarity determining region 3 for antibody 51825
ASSSRTGWRIDY

SEQ ID NO: 103651 - protein, 10 aa, Homo sapiens
  light chain complementarity determining region 3 for antibody 51826
QQRSNWPPLT

SEQ ID NO: 103652 - protein, 17 aa, Homo sapiens
  heavy chain complementarity determining region 3 for antibody 51826
ARDYRMSSRRPGYGTDV

SEQ ID NO: 103653 - protein, 9 aa, Homo sapiens
  light chain complementarity determining region 3 for antibody 51827
QQRSNWPLT

SEQ ID NO: 103654 - protein, 21 aa, Homo sapiens
  heavy chain complementarity determining region 3 for antibody 51827
ARDLYGSGTYYTINRGDFFNS

SEQ ID NO: 103655 - protein, 9 aa, Homo sapiens
  light chain complementarity determining region 3 for antibody 51828
QQRSNPMYT

SEQ ID NO: 103656 - protein, 18 aa, Homo sapiens
  heavy chain complementarity determining region 3 for antibody 51828
ATKPGIAVGGYYSYGMDV

SEQ ID NO: 103657 - protein, 9 aa, Homo sapiens
  light chain complementarity determining region 3 for antibody 51829
QQRNSWPRT

SEQ ID NO: 103658 - protein, 14 aa, Homo sapiens
  heavy chain complementarity determining region 3 for antibody 51829
ATGLGPQLSPYFQH

SEQ ID NO: 103659 - protein, 11 aa, Homo sapiens
  light chain complementarity determining region 3 for antibody 51830
QQRNNWPPAYT

SEQ ID NO: 103660 - protein, 17 aa, Homo sapiens
  heavy chain complementarity determining region 3 for antibody 51830
AGTPSNSGNSYKDAFDI

SEQ ID NO: 103661 - protein, 8 aa, Homo sapiens
  light chain complementarity determining region 3 for antibody 51831
QQRNNWIT

SEQ ID NO: 103662 - protein, 13 aa, Homo sapiens
  heavy chain complementarity determining region 3 for antibody 51831
ARLLYGAHSEFDY

SEQ ID NO: 103663 - protein, 9 aa, Homo sapiens
  light chain complementarity determining region 3 for antibody 51832
QQNYTPPHI

SEQ ID NO: 103664 - protein, 15 aa, Homo sapiens
  heavy chain complementarity determining region 3 for antibody 51832
GREQGSMVPGDVVDF

SEQ ID NO: 103665 - protein, 9 aa, Homo sapiens
  light chain complementarity determining region 3 for antibody 51833
QQNYRTPIT

SEQ ID NO: 103666 - protein, 10 aa, Homo sapiens
  heavy chain complementarity determining region 3 for antibody 51833
SGYRLGRHLP

SEQ ID NO: 103667 - protein, 6 aa, Homo sapiens
  light chain complementarity determining region 3 for antibody 51834
QQNGES

SEQ ID NO: 103668 - protein, 12 aa, Homo sapiens
  heavy chain complementarity determining region 3 for antibody 51834
ARDHITGWALSS

SEQ ID NO: 103669 - protein, 9 aa, Homo sapiens
  light chain complementarity determining region 3 for antibody 51835
QQLYSYPPT

SEQ ID NO: 103670 - protein, 15 aa, Homo sapiens
  heavy chain complementarity determining region 3 for antibody 51835
ATLDMTLRHAWQFDL

SEQ ID NO: 103671 - protein, 9 aa, Homo sapiens
  light chain complementarity determining region 3 for antibody 51836
QQLYCYPLT

SEQ ID NO: 103672 - protein, 15 aa, Homo sapiens
  heavy chain complementarity determining region 3 for antibody 51836
ATLDMTLRHAWQFDL

SEQ ID NO: 103673 - protein, 9 aa, Homo sapiens
  light chain complementarity determining region 3 for antibody 51837
QQLNTYPYT

SEQ ID NO: 103674 - protein, 17 aa, Homo sapiens
  heavy chain complementarity determining region 3 for antibody 51837
AKVREDVSGWYGDGLDI

SEQ ID NO: 103675 - protein, 9 aa, Homo sapiens
  light chain complementarity determining region 3 for antibody 51838
QQLNTYPLT

SEQ ID NO: 103676 - protein, 20 aa, Homo sapiens
  heavy chain complementarity determining region 3 for antibody 51838
ARDRFSSSWSKDYYYYGLDV

SEQ ID NO: 103677 - protein, 10 aa, Homo sapiens
  light chain complementarity determining region 3 for antibody 51839
QQLNTYLPYT

SEQ ID NO: 103678 - protein, 21 aa, Homo sapiens
  heavy chain complementarity determining region 3 for antibody 51839
ARLRERGDSLWLGEFHNYFDP

SEQ ID NO: 103679 - protein, 10 aa, Homo sapiens
  light chain complementarity determining region 3 for antibody 51840
QQLNSYPRYT

SEQ ID NO: 103680 - protein, 11 aa, Homo sapiens
  heavy chain complementarity determining region 3 for antibody 51840
ARTNSVRWFDP

SEQ ID NO: 103681 - protein, 9 aa, Homo sapiens
  light chain complementarity determining region 3 for antibody 51841
QQLNSYPRT

SEQ ID NO: 103682 - protein, 15 aa, Homo sapiens
  heavy chain complementarity determining region 3 for antibody 51841
AREHYDSLTGFHIDF

SEQ ID NO: 103683 - protein, 9 aa, Homo sapiens
  light chain complementarity determining region 3 for antibody 51842
QQLNSYPRA

SEQ ID NO: 103684 - protein, 16 aa, Homo sapiens
  heavy chain complementarity determining region 3 for antibody 51842
AKSDPAYGGYGGYFDD

SEQ ID NO: 103685 - protein, 9 aa, Homo sapiens
  light chain complementarity determining region 3 for antibody 51843
QQLNSYPLT

SEQ ID NO: 103686 - protein, 14 aa, Homo sapiens
  heavy chain complementarity determining region 3 for antibody 51843
ARVMGKFGDYVTDY

SEQ ID NO: 103687 - protein, 9 aa, Homo sapiens
  light chain complementarity determining region 3 for antibody 51844
QQLNSYPLT

SEQ ID NO: 103688 - protein, 13 aa, Homo sapiens
  heavy chain complementarity determining region 3 for antibody 51844
AKDRAKYYYGMDV

SEQ ID NO: 103689 - protein, 11 aa, Homo sapiens
  light chain complementarity determining region 3 for antibody 51845
QQLNNYPPQWT

SEQ ID NO: 103690 - protein, 23 aa, Homo sapiens
  heavy chain complementarity determining region 3 for antibody 51845
ARATAIVGTFSPPYYYHYNGMDV

SEQ ID NO: 103691 - protein, 9 aa, Homo sapiens
  light chain complementarity determining region 3 for antibody 51846
QQIYSYPLT

SEQ ID NO: 103692 - protein, 15 aa, Homo sapiens
  heavy chain complementarity determining region 3 for antibody 51846
ATLDMTLRHAWQFDL

SEQ ID NO: 103693 - protein, 9 aa, Homo sapiens
  light chain complementarity determining region 3 for antibody 51847
QQHYVYPYT

SEQ ID NO: 103694 - protein, 14 aa, Homo sapiens
  heavy chain complementarity determining region 3 for antibody 51847
ARDGDGACSHCLDF

SEQ ID NO: 103695 - protein, 10 aa, Homo sapiens
  light chain complementarity determining region 3 for antibody 51848
QQHDDLPPIT

SEQ ID NO: 103696 - protein, 20 aa, Homo sapiens
  heavy chain complementarity determining region 3 for antibody 51848
ARDGGMIYTTGWYGSSYFDT

SEQ ID NO: 103697 - protein, 10 aa, Homo sapiens
  light chain complementarity determining region 3 for antibody 51849
QQHDDLPPIT

SEQ ID NO: 103698 - protein, 20 aa, Homo sapiens
  heavy chain complementarity determining region 3 for antibody 51849
ARDGGMIYNTGWYGSSYFDS

SEQ ID NO: 103699 - protein, 9 aa, Homo sapiens
  light chain complementarity determining region 3 for antibody 51850
QQFNSYPRT

SEQ ID NO: 103700 - protein, 15 aa, Homo sapiens
  heavy chain complementarity determining region 3 for antibody 51850
VRAGYSGSRLQAFDI

SEQ ID NO: 103701 - protein, 11 aa, Homo sapiens
  light chain complementarity determining region 3 for antibody 51851
QQFNKWPRMYT

SEQ ID NO: 103702 - protein, 16 aa, Homo sapiens
  heavy chain complementarity determining region 3 for antibody 51851
ARVLTSYYYDTSGFEY

SEQ ID NO: 103703 - protein, 9 aa, Homo sapiens
  light chain complementarity determining region 3 for antibody 51852
QQFDSLPIT

SEQ ID NO: 103704 - protein, 16 aa, Homo sapiens
  heavy chain complementarity determining region 3 for antibody 51852
ARGSRYSFLYDSQMDH

SEQ ID NO: 103705 - protein, 9 aa, Homo sapiens
  light chain complementarity determining region 3 for antibody 51853
QQCYTTPLT

SEQ ID NO: 103706 - protein, 9 aa, Homo sapiens
  heavy chain complementarity determining region 3 for antibody 51853
ARDQGAMNS

SEQ ID NO: 103707 - protein, 9 aa, Homo sapiens
  light chain complementarity determining region 3 for antibody 51854
QQCYNTPLT

SEQ ID NO: 103708 - protein, 9 aa, Homo sapiens
  heavy chain complementarity determining region 3 for antibody 51854
ARDQGAMNP

SEQ ID NO: 103709 - protein, 9 aa, Homo sapiens
  light chain complementarity determining region 3 for antibody 51855
QQCYNTPLT

SEQ ID NO: 103710 - protein, 9 aa, Homo sapiens
  heavy chain complementarity determining region 3 for antibody 51855
ARDQGAMNA

SEQ ID NO: 103711 - protein, 9 aa, Homo sapiens
  light chain complementarity determining region 3 for antibody 51856
QQCYNTPLN

SEQ ID NO: 103712 - protein, 9 aa, Homo sapiens
  heavy chain complementarity determining region 3 for antibody 51856
ARDQGAMNS

SEQ ID NO: 103713 - protein, 9 aa, Homo sapiens
  light chain complementarity determining region 3 for antibody 51857
QQCYITPLT

SEQ ID NO: 103714 - protein, 9 aa, Homo sapiens
  heavy chain complementarity determining region 3 for antibody 51857
ARDQGAMNS

SEQ ID NO: 103715 - protein, 9 aa, Homo sapiens
  light chain complementarity determining region 3 for antibody 51858
QQCDSSPIT

SEQ ID NO: 103716 - protein, 17 aa, Homo sapiens
  heavy chain complementarity determining region 3 for antibody 51858
AKGLTPFGGHYRHAFDI

SEQ ID NO: 103717 - protein, 9 aa, Homo sapiens
  light chain complementarity determining region 3 for antibody 51859
QQADSFPIT

SEQ ID NO: 103718 - protein, 16 aa, Homo sapiens
  heavy chain complementarity determining region 3 for antibody 51859
ARRRDGGGSAGRVFDP

SEQ ID NO: 103719 - protein, 9 aa, Homo sapiens
  light chain complementarity determining region 3 for antibody 51860
QPYDSDFPT

SEQ ID NO: 103720 - protein, 9 aa, Homo sapiens
  heavy chain complementarity determining region 3 for antibody 51860
ARGAAAADY

SEQ ID NO: 103721 - protein, 9 aa, Homo sapiens
  light chain complementarity determining region 3 for antibody 51861
QPTYTPPYI

SEQ ID NO: 103722 - protein, 15 aa, Homo sapiens
  heavy chain complementarity determining region 3 for antibody 51861
GREQGSMVPGDVVDF

SEQ ID NO: 103723 - protein, 9 aa, Homo sapiens
  light chain complementarity determining region 3 for antibody 51862
QPLYSYPLT

SEQ ID NO: 103724 - protein, 15 aa, Homo sapiens
  heavy chain complementarity determining region 3 for antibody 51862
ATLDMTLRHAWQFDL

SEQ ID NO: 103725 - protein, 9 aa, Homo sapiens
  light chain complementarity determining region 3 for antibody 51863
QKYNSAPGT

SEQ ID NO: 103726 - protein, 23 aa, Homo sapiens
  heavy chain complementarity determining region 3 for antibody 51863
AVGYRYGGALFSLAVNSEGGMDV

SEQ ID NO: 103727 - protein, 9 aa, Homo sapiens
  light chain complementarity determining region 3 for antibody 51864
QKTYTPPYI

SEQ ID NO: 103728 - protein, 15 aa, Homo sapiens
  heavy chain complementarity determining region 3 for antibody 51864
GREQGSMVPGDVVDF

SEQ ID NO: 103729 - protein, 9 aa, Homo sapiens
  light chain complementarity determining region 3 for antibody 51865
QKLYSYPLT

SEQ ID NO: 103730 - protein, 15 aa, Homo sapiens
  heavy chain complementarity determining region 3 for antibody 51865
ATLDMTLRHAWQFDL

SEQ ID NO: 103731 - protein, 9 aa, Homo sapiens
  light chain complementarity determining region 3 for antibody 51866
QKHDRAPLT

SEQ ID NO: 103732 - protein, 14 aa, Homo sapiens
  heavy chain complementarity determining region 3 for antibody 51866
VHRAEYAYGSYFAY

SEQ ID NO: 103733 - protein, 9 aa, Homo sapiens
  light chain complementarity determining region 3 for antibody 51867
QKHDRAPLT

SEQ ID NO: 103734 - protein, 14 aa, Homo sapiens
  heavy chain complementarity determining region 3 for antibody 51867
VHRAEYAYGNYFGY

SEQ ID NO: 103735 - protein, 9 aa, Homo sapiens
  light chain complementarity determining region 3 for antibody 51868
QKHDRAPLT

SEQ ID NO: 103736 - protein, 14 aa, Homo sapiens
  heavy chain complementarity determining region 3 for antibody 51868
VHRADYAYGNYFAY

SEQ ID NO: 103737 - protein, 9 aa, Homo sapiens
  light chain complementarity determining region 3 for antibody 51869
QKHDRAPLT

SEQ ID NO: 103738 - protein, 14 aa, Homo sapiens
  heavy chain complementarity determining region 3 for antibody 51869
AHRAEYAYGNYFDY

SEQ ID NO: 103739 - protein, 9 aa, Homo sapiens
  light chain complementarity determining region 3 for antibody 51870
QHYVSSPYT

SEQ ID NO: 103740 - protein, 14 aa, Homo sapiens
  heavy chain complementarity determining region 3 for antibody 51870
ARGYYDSRGLYFEY

SEQ ID NO: 103741 - protein, 9 aa, Homo sapiens
  light chain complementarity determining region 3 for antibody 51871
QHYSSYPYT

SEQ ID NO: 103742 - protein, 15 aa, Homo sapiens
  heavy chain complementarity determining region 3 for antibody 51871
ASGKGDGTGWPFFDF

SEQ ID NO: 103743 - protein, 9 aa, Homo sapiens
  light chain complementarity determining region 3 for antibody 51872
QHYSRYPYT

SEQ ID NO: 103744 - protein, 15 aa, Homo sapiens
  heavy chain complementarity determining region 3 for antibody 51872
SSGEGDGTGWPFFDF

SEQ ID NO: 103745 - protein, 9 aa, Homo sapiens
  light chain complementarity determining region 3 for antibody 51873
QHYNTWPWT

SEQ ID NO: 103746 - protein, 12 aa, Homo sapiens
  heavy chain complementarity determining region 3 for antibody 51873
ARSMMIVPACDI

SEQ ID NO: 103747 - protein, 11 aa, Homo sapiens
  light chain complementarity determining region 3 for antibody 51874
QHYNNWPPEYT

SEQ ID NO: 103748 - protein, 23 aa, Homo sapiens
  heavy chain complementarity determining region 3 for antibody 51874
ARQDDGEYQRPFARGYYYCAMDV

SEQ ID NO: 103749 - protein, 9 aa, Homo sapiens
  light chain complementarity determining region 3 for antibody 51875
QHYNINSET

SEQ ID NO: 103750 - protein, 8 aa, Homo sapiens
  heavy chain complementarity determining region 3 for antibody 51875
ATHPSTGA

SEQ ID NO: 103751 - protein, 10 aa, Homo sapiens
  light chain complementarity determining region 3 for antibody 51876
QHYNDYSPHS

SEQ ID NO: 103752 - protein, 15 aa, Homo sapiens
  heavy chain complementarity determining region 3 for antibody 51876
ARGPPGILRLGELWF

SEQ ID NO: 103753 - protein, 10 aa, Homo sapiens
  light chain complementarity determining region 3 for antibody 51877
QHYHNWPPWT

SEQ ID NO: 103754 - protein, 14 aa, Homo sapiens
  heavy chain complementarity determining region 3 for antibody 51877
AKTLTGTYYRFFDY

SEQ ID NO: 103755 - protein, 8 aa, Homo sapiens
  light chain complementarity determining region 3 for antibody 51878
QHYGSSPT

SEQ ID NO: 103756 - protein, 16 aa, Homo sapiens
  heavy chain complementarity determining region 3 for antibody 51878
AAAYCSGGNCYKALDH

SEQ ID NO: 103757 - protein, 9 aa, Homo sapiens
  light chain complementarity determining region 3 for antibody 51879
QHSHSAPRT

SEQ ID NO: 103758 - protein, 14 aa, Homo sapiens
  heavy chain complementarity determining region 3 for antibody 51879
TRDRLDISGWYSDY

SEQ ID NO: 103759 - protein, 9 aa, Homo sapiens
  light chain complementarity determining region 3 for antibody 51880
QHLGSSGYT

SEQ ID NO: 103760 - protein, 22 aa, Homo sapiens
  heavy chain complementarity determining region 3 for antibody 51880
ARDIGRSGWYAESRYYYKAMDV

SEQ ID NO: 103761 - protein, 9 aa, Homo sapiens
  light chain complementarity determining region 3 for antibody 51881
QHFGSSGYT

SEQ ID NO: 103762 - protein, 22 aa, Homo sapiens
  heavy chain complementarity determining region 3 for antibody 51881
SRDIGRSGWYAESRYYYKAMDV

SEQ ID NO: 103763 - protein, 9 aa, Homo sapiens
  light chain complementarity determining region 3 for antibody 51882
QHFGSSGYT

SEQ ID NO: 103764 - protein, 22 aa, Homo sapiens
  heavy chain complementarity determining region 3 for antibody 51882
ARDIGRSGWYAEYRYYYKAMDV

SEQ ID NO: 103765 - protein, 9 aa, Homo sapiens
  light chain complementarity determining region 3 for antibody 51883
QHFGSSGYT

SEQ ID NO: 103766 - protein, 22 aa, Homo sapiens
  heavy chain complementarity determining region 3 for antibody 51883
ARDIGRSGWYAESRYYYQAMDV

SEQ ID NO: 103767 - protein, 9 aa, Homo sapiens
  light chain complementarity determining region 3 for antibody 51884
QHFGSSGYT

SEQ ID NO: 103768 - protein, 22 aa, Homo sapiens
  heavy chain complementarity determining region 3 for antibody 51884
ARDIGRSGWYAESRYYYNAMDV

SEQ ID NO: 103769 - protein, 9 aa, Homo sapiens
  light chain complementarity determining region 3 for antibody 51885
QHFGSSGYT

SEQ ID NO: 103770 - protein, 22 aa, Homo sapiens
  heavy chain complementarity determining region 3 for antibody 51885
ARDIGRSGWYAESRYYYKPMDV

SEQ ID NO: 103771 - protein, 9 aa, Homo sapiens
  light chain complementarity determining region 3 for antibody 51886
QHFGSSGYT

SEQ ID NO: 103772 - protein, 22 aa, Homo sapiens
  heavy chain complementarity determining region 3 for antibody 51886
ARDIGRSGWYAESRYYYKALDV

SEQ ID NO: 103773 - protein, 9 aa, Homo sapiens
  light chain complementarity determining region 3 for antibody 51887
QHFGSSGYT

SEQ ID NO: 103774 - protein, 22 aa, Homo sapiens
  heavy chain complementarity determining region 3 for antibody 51887
ARDIGRSGWYAESRDYYKAMDV

SEQ ID NO: 103775 - protein, 9 aa, Homo sapiens
  light chain complementarity determining region 3 for antibody 51888
QHFGSSGYT

SEQ ID NO: 103776 - protein, 22 aa, Homo sapiens
  heavy chain complementarity determining region 3 for antibody 51888
ARDIGRSGWYAESGYYYKAMDV

SEQ ID NO: 103777 - protein, 9 aa, Homo sapiens
  light chain complementarity determining region 3 for antibody 51889
QHFGSSGYT

SEQ ID NO: 103778 - protein, 22 aa, Homo sapiens
  heavy chain complementarity determining region 3 for antibody 51889
ARDIGRSGWCAESRYYYKAMDV

SEQ ID NO: 103779 - protein, 9 aa, Homo sapiens
  light chain complementarity determining region 3 for antibody 51890
QHFGSSGYT

SEQ ID NO: 103780 - protein, 22 aa, Homo sapiens
  heavy chain complementarity determining region 3 for antibody 51890
ACDIGRSGWYAESRYYYKAMDV

SEQ ID NO: 103781 - protein, 9 aa, Homo sapiens
  light chain complementarity determining region 3 for antibody 51891
QHFGSSGYP

SEQ ID NO: 103782 - protein, 22 aa, Homo sapiens
  heavy chain complementarity determining region 3 for antibody 51891
ARDIGRSGWYAESRYYYKAMDV

SEQ ID NO: 103783 - protein, 9 aa, Homo sapiens
  light chain complementarity determining region 3 for antibody 51892
QHCYNTPLT

SEQ ID NO: 103784 - protein, 9 aa, Homo sapiens
  heavy chain complementarity determining region 3 for antibody 51892
ARDQGAMNS

SEQ ID NO: 103785 - protein, 9 aa, Homo sapiens
  light chain complementarity determining region 3 for antibody 51893
QEYASASHS

SEQ ID NO: 103786 - protein, 17 aa, Homo sapiens
  heavy chain complementarity determining region 3 for antibody 51893
ARMGYYESSGCYGYFNL

SEQ ID NO: 103787 - protein, 9 aa, Homo sapiens
  light chain complementarity determining region 3 for antibody 51894
PQYYSSPFS

SEQ ID NO: 103788 - protein, 6 aa, Homo sapiens
  heavy chain complementarity determining region 3 for antibody 51894
AYGFDL

SEQ ID NO: 103789 - protein, 9 aa, Homo sapiens
  light chain complementarity determining region 3 for antibody 51895
PQCYNTPLT

SEQ ID NO: 103790 - protein, 9 aa, Homo sapiens
  heavy chain complementarity determining region 3 for antibody 51895
ARDQGAMNS

SEQ ID NO: 103791 - protein, 8 aa, Homo sapiens
  light chain complementarity determining region 3 for antibody 51896
MQGTPPYT

SEQ ID NO: 103792 - protein, 13 aa, Homo sapiens
  heavy chain complementarity determining region 3 for antibody 51896
ARDSREQQFVYDV

SEQ ID NO: 103793 - protein, 9 aa, Homo sapiens
  light chain complementarity determining region 3 for antibody 51897
MQGTHWPYT

SEQ ID NO: 103794 - protein, 10 aa, Homo sapiens
  heavy chain complementarity determining region 3 for antibody 51897
ARDNWGSLDY

SEQ ID NO: 103795 - protein, 9 aa, Homo sapiens
  light chain complementarity determining region 3 for antibody 51898
MQALQTPRT

SEQ ID NO: 103796 - protein, 22 aa, Homo sapiens
  heavy chain complementarity determining region 3 for antibody 51898
ARGGEDDSVWGNSRPPPPWNDS

SEQ ID NO: 103797 - protein, 10 aa, Homo sapiens
  light chain complementarity determining region 3 for antibody 51899
MQALQTPPLT

SEQ ID NO: 103798 - protein, 18 aa, Homo sapiens
  heavy chain complementarity determining region 3 for antibody 51899
ARGQIAVAGIVRMFAFDM

SEQ ID NO: 103799 - protein, 9 aa, Homo sapiens
  light chain complementarity determining region 3 for antibody 51900
MQALQTPLT

SEQ ID NO: 103800 - protein, 25 aa, Homo sapiens
  heavy chain complementarity determining region 3 for antibody 51900
ARLALSLPSGKAVVPAPYYYYGMSV

SEQ ID NO: 103801 - protein, 9 aa, Homo sapiens
  light chain complementarity determining region 3 for antibody 51901
MQALQTPLT

SEQ ID NO: 103802 - protein, 14 aa, Homo sapiens
  heavy chain complementarity determining region 3 for antibody 51901
AGPHIAPTGVNLGD

SEQ ID NO: 103803 - protein, 9 aa, Homo sapiens
  light chain complementarity determining region 3 for antibody 51902
MQALQTPIT

SEQ ID NO: 103804 - protein, 10 aa, Homo sapiens
  heavy chain complementarity determining region 3 for antibody 51902
SGSIAVATEK

SEQ ID NO: 103805 - protein, 9 aa, Homo sapiens
  light chain complementarity determining region 3 for antibody 51903
MQALQTPIT

SEQ ID NO: 103806 - protein, 10 aa, Homo sapiens
  heavy chain complementarity determining region 3 for antibody 51903
ARSIAVAASN

SEQ ID NO: 103807 - protein, 9 aa, Homo sapiens
  light chain complementarity determining region 3 for antibody 51904
MQAIQWPRT

SEQ ID NO: 103808 - protein, 12 aa, Homo sapiens
  heavy chain complementarity determining region 3 for antibody 51904
VTDTDRNYYMDV

SEQ ID NO: 103809 - protein, 9 aa, Homo sapiens
  light chain complementarity determining region 3 for antibody 51905
MEGKNWPWT

SEQ ID NO: 103810 - protein, 11 aa, Homo sapiens
  heavy chain complementarity determining region 3 for antibody 51905
VRTSRSASSDD

SEQ ID NO: 103811 - protein, 9 aa, Homo sapiens
  light chain complementarity determining region 3 for antibody 51906
LQVYNYPWT

SEQ ID NO: 103812 - protein, 13 aa, Homo sapiens
  heavy chain complementarity determining region 3 for antibody 51906
ARDLSYASEDPGY

SEQ ID NO: 103813 - protein, 9 aa, Homo sapiens
  light chain complementarity determining region 3 for antibody 51907
LQTYSTPYT

SEQ ID NO: 103814 - protein, 16 aa, Homo sapiens
  heavy chain complementarity determining region 3 for antibody 51907
ARGVRQDTAMVDYFDN

SEQ ID NO: 103815 - protein, 9 aa, Homo sapiens
  light chain complementarity determining region 3 for antibody 51908
LQHNTYPWT

SEQ ID NO: 103816 - protein, 12 aa, Homo sapiens
  heavy chain complementarity determining region 3 for antibody 51908
CSSWFTGRVFQH

SEQ ID NO: 103817 - protein, 9 aa, Homo sapiens
  light chain complementarity determining region 3 for antibody 51909
LQHNTYPWT

SEQ ID NO: 103818 - protein, 12 aa, Homo sapiens
  heavy chain complementarity determining region 3 for antibody 51909
CSSGFTGRVFKH

SEQ ID NO: 103819 - protein, 9 aa, Homo sapiens
  light chain complementarity determining region 3 for antibody 51910
LQHNTFPPT

SEQ ID NO: 103820 - protein, 20 aa, Homo sapiens
  heavy chain complementarity determining region 3 for antibody 51910
ATALCDTIRCFFWCCQEEDF

SEQ ID NO: 103821 - protein, 9 aa, Homo sapiens
  light chain complementarity determining region 3 for antibody 51911
LQHNSYPRT

SEQ ID NO: 103822 - protein, 18 aa, Homo sapiens
  heavy chain complementarity determining region 3 for antibody 51911
AIWSDGSGSYYYYYNMDV

SEQ ID NO: 103823 - protein, 9 aa, Homo sapiens
  light chain complementarity determining region 3 for antibody 51912
LQHNSYPQT

SEQ ID NO: 103824 - protein, 9 aa, Homo sapiens
  heavy chain complementarity determining region 3 for antibody 51912
ARGRDFPDN

SEQ ID NO: 103825 - protein, 9 aa, Homo sapiens
  light chain complementarity determining region 3 for antibody 51913
LQHNGFPPT

SEQ ID NO: 103826 - protein, 12 aa, Homo sapiens
  heavy chain complementarity determining region 3 for antibody 51913
ARAGTGLFFLDY

SEQ ID NO: 103827 - protein, 9 aa, Homo sapiens
  light chain complementarity determining region 3 for antibody 51914
LQHKINPNT

SEQ ID NO: 103828 - protein, 7 aa, Homo sapiens
  heavy chain complementarity determining region 3 for antibody 51914
GSRWADF

SEQ ID NO: 103829 - protein, 9 aa, Homo sapiens
  light chain complementarity determining region 3 for antibody 51915
LQHKIHPNT

SEQ ID NO: 103830 - protein, 7 aa, Homo sapiens
  heavy chain complementarity determining region 3 for antibody 51915
GIRWADF

SEQ ID NO: 103831 - protein, 9 aa, Homo sapiens
  light chain complementarity determining region 3 for antibody 51916
LQHKIHPNT

SEQ ID NO: 103832 - protein, 15 aa, Homo sapiens
  heavy chain complementarity determining region 3 for antibody 51916
ASLPTTWGGFETQNL

SEQ ID NO: 103833 - protein, 9 aa, Homo sapiens
  light chain complementarity determining region 3 for antibody 51917
LQHKIHPKT

SEQ ID NO: 103834 - protein, 7 aa, Homo sapiens
  heavy chain complementarity determining region 3 for antibody 51917
GSRWADF

SEQ ID NO: 103835 - protein, 9 aa, Homo sapiens
  light chain complementarity determining region 3 for antibody 51918
LQDYSYPRT

SEQ ID NO: 103836 - protein, 19 aa, Homo sapiens
  heavy chain complementarity determining region 3 for antibody 51918
ARDTTHVGGRGIYYDAFDF

SEQ ID NO: 103837 - protein, 9 aa, Homo sapiens
  light chain complementarity determining region 3 for antibody 51919
LQDYNYPWT

SEQ ID NO: 103838 - protein, 13 aa, Homo sapiens
  heavy chain complementarity determining region 3 for antibody 51919
ARDLSYGSGYPGY

SEQ ID NO: 103839 - protein, 9 aa, Homo sapiens
  light chain complementarity determining region 3 for antibody 51920
LQDYGYPRA

SEQ ID NO: 103840 - protein, 19 aa, Homo sapiens
  heavy chain complementarity determining region 3 for antibody 51920
ARDVSPQCSGSGWCDALTS

SEQ ID NO: 103841 - protein, 9 aa, Homo sapiens
  light chain complementarity determining region 3 for antibody 51921
LKYNSFPPT

SEQ ID NO: 103842 - protein, 15 aa, Homo sapiens
  heavy chain complementarity determining region 3 for antibody 51921
AKVWRGIQLWYENDY

SEQ ID NO: 103843 - protein, 9 aa, Homo sapiens
  light chain complementarity determining region 3 for antibody 51922
HQYGTSPRS

SEQ ID NO: 103844 - protein, 18 aa, Homo sapiens
  heavy chain complementarity determining region 3 for antibody 51922
AREVPDRRASNSNPYADV

SEQ ID NO: 103845 - protein, 9 aa, Homo sapiens
  light chain complementarity determining region 3 for antibody 51923
HQYGDSPWT

SEQ ID NO: 103846 - protein, 14 aa, Homo sapiens
  heavy chain complementarity determining region 3 for antibody 51923
ARDGGNTAGYAFEI

SEQ ID NO: 103847 - protein, 10 aa, Homo sapiens
  light chain complementarity determining region 3 for antibody 51924
HQYEHLPPYT

SEQ ID NO: 103848 - protein, 12 aa, Homo sapiens
  heavy chain complementarity determining region 3 for antibody 51924
STHRRGGHQFEY

SEQ ID NO: 103849 - protein, 9 aa, Homo sapiens
  light chain complementarity determining region 3 for antibody 51925
HQYCSSPET

SEQ ID NO: 103850 - protein, 13 aa, Homo sapiens
  heavy chain complementarity determining region 3 for antibody 51925
ASGNYDFWSGYHD

SEQ ID NO: 103851 - protein, 9 aa, Homo sapiens
  light chain complementarity determining region 3 for antibody 51926
HQYATPPLT

SEQ ID NO: 103852 - protein, 17 aa, Homo sapiens
  heavy chain complementarity determining region 3 for antibody 51926
ARHQMLTGSGWGRAFDI

SEQ ID NO: 103853 - protein, 9 aa, Homo sapiens
  light chain complementarity determining region 3 for antibody 51927
HQYATAPLP

SEQ ID NO: 103854 - protein, 17 aa, Homo sapiens
  heavy chain complementarity determining region 3 for antibody 51927
ARHQMLTGSGWGRAFDI

SEQ ID NO: 103855 - protein, 9 aa, Homo sapiens
  light chain complementarity determining region 3 for antibody 51928
HQSYSLPHT

SEQ ID NO: 103856 - protein, 11 aa, Homo sapiens
  heavy chain complementarity determining region 3 for antibody 51928
ARGGVAAAIDY

SEQ ID NO: 103857 - protein, 9 aa, Homo sapiens
  light chain complementarity determining region 3 for antibody 51929
HQSSSLPET

SEQ ID NO: 103858 - protein, 8 aa, Homo sapiens
  heavy chain complementarity determining region 3 for antibody 51929
ASYSSKDS

SEQ ID NO: 103859 - protein, 9 aa, Homo sapiens
  light chain complementarity determining region 3 for antibody 51930
HHYGDSPWT

SEQ ID NO: 103860 - protein, 14 aa, Homo sapiens
  heavy chain complementarity determining region 3 for antibody 51930
ARDGGNTAGYAFEI

SEQ ID NO: 103861 - protein, 9 aa, Homo sapiens
  light chain complementarity determining region 3 for antibody 51931
QQSYSTLYT

SEQ ID NO: 103862 - protein, 12 aa, Homo sapiens
  heavy chain complementarity determining region 3 for antibody 51931
VREGPRTSHWKN

SEQ ID NO: 103863 - protein, 9 aa, Homo sapiens
  light chain complementarity determining region 3 for antibody 51932
QQCYSFPYT

SEQ ID NO: 103864 - protein, 14 aa, Homo sapiens
  heavy chain complementarity determining region 3 for antibody 51932
ARKMGWDGVAWFDP

SEQ ID NO: 103865 - protein, 8 aa, Homo sapiens
  light chain complementarity determining region 3 for antibody 51933
QQYATSWT

SEQ ID NO: 103866 - protein, 16 aa, Homo sapiens
  heavy chain complementarity determining region 3 for antibody 51933
AAGPSVEGVLREYFPH

SEQ ID NO: 103867 - protein, 9 aa, Homo sapiens
  light chain complementarity determining region 3 for antibody 51934
QQYDSYPCT

SEQ ID NO: 103868 - protein, 15 aa, Homo sapiens
  heavy chain complementarity determining region 3 for antibody 51934
AHSAFVDVLTPFFAY

SEQ ID NO: 103869 - protein, 9 aa, Homo sapiens
  light chain complementarity determining region 3 for antibody 51935
QQYNTLQWT

SEQ ID NO: 103870 - protein, 14 aa, Homo sapiens
  heavy chain complementarity determining region 3 for antibody 51935
ARKMGWDGVAWFDP

SEQ ID NO: 103871 - protein, 9 aa, Homo sapiens
  light chain complementarity determining region 3 for antibody 51936
QQLNSYPYT

SEQ ID NO: 103872 - protein, 12 aa, Homo sapiens
  heavy chain complementarity determining region 3 for antibody 51936
ALSITMVVEPDF

SEQ ID NO: 103873 - protein, 9 aa, Homo sapiens
  light chain complementarity determining region 3 for antibody 51937
QQYNSYPWT

SEQ ID NO: 103874 - protein, 7 aa, Homo sapiens
  heavy chain complementarity determining region 3 for antibody 51937
SPVSGRY

SEQ ID NO: 103875 - protein, 11 aa, Homo sapiens
  light chain complementarity determining region 3 for antibody 51938
QQTYSNRPDIT

SEQ ID NO: 103876 - protein, 20 aa, Homo sapiens
  heavy chain complementarity determining region 3 for antibody 51938
AHRPFTFHYDTGGYYNWFDP

SEQ ID NO: 103877 - protein, 10 aa, Homo sapiens
  light chain complementarity determining region 3 for antibody 51939
QQSYSTPPFT

SEQ ID NO: 103878 - protein, 15 aa, Homo sapiens
  heavy chain complementarity determining region 3 for antibody 51939
ARRGYYGPGKMAYDI

SEQ ID NO: 103879 - protein, 9 aa, Homo sapiens
  light chain complementarity determining region 3 for antibody 51940
QQALNYPWT

SEQ ID NO: 103880 - protein, 16 aa, Homo sapiens
  heavy chain complementarity determining region 3 for antibody 51940
ARGPVKAHYYYYYMDV

SEQ ID NO: 103881 - protein, 9 aa, Homo sapiens
  light chain complementarity determining region 3 for antibody 51941
QQSYSTLYT

SEQ ID NO: 103882 - protein, 12 aa, Homo sapiens
  heavy chain complementarity determining region 3 for antibody 51941
VREGPRPSHWKN

SEQ ID NO: 103883 - protein, 9 aa, Homo sapiens
  light chain complementarity determining region 3 for antibody 51942
LQDYNYPWT

SEQ ID NO: 103884 - protein, 13 aa, Homo sapiens
  heavy chain complementarity determining region 3 for antibody 51942
ARDLSYGSGYPGY

SEQ ID NO: 103885 - protein, 8 aa, Homo sapiens
  light chain complementarity determining region 3 for antibody 51943
QQYNSYWT

SEQ ID NO: 103886 - protein, 11 aa, Homo sapiens
  heavy chain complementarity determining region 3 for antibody 51943
ARGAWPYFFDL

SEQ ID NO: 103887 - protein, 10 aa, Homo sapiens
  light chain complementarity determining region 3 for antibody 51944
HQYEHLPPYT

SEQ ID NO: 103888 - protein, 12 aa, Homo sapiens
  heavy chain complementarity determining region 3 for antibody 51944
STHRRGGHQFEY

SEQ ID NO: 103889 - protein, 9 aa, Homo sapiens
  light chain complementarity determining region 3 for antibody 51945
QKYNSAPPT

SEQ ID NO: 103890 - protein, 15 aa, Homo sapiens
  heavy chain complementarity determining region 3 for antibody 51945
ARGGGPYYDSSGYQQ

SEQ ID NO: 103891 - protein, 9 aa, Homo sapiens
  light chain complementarity determining region 3 for antibody 51946
QQYNSYPYT

SEQ ID NO: 103892 - protein, 15 aa, Homo sapiens
  heavy chain complementarity determining region 3 for antibody 51946
AKGPGFAYGKKYFQH

SEQ ID NO: 103893 - protein, 9 aa, Homo sapiens
  light chain complementarity determining region 3 for antibody 51947
QQYNSYSRT

SEQ ID NO: 103894 - protein, 16 aa, Homo sapiens
  heavy chain complementarity determining region 3 for antibody 51947
ARGPVKAHYYYYYMDV

SEQ ID NO: 103895 - protein, 10 aa, Homo sapiens
  light chain complementarity determining region 3 for antibody 51948
QQYYNNSPYT

SEQ ID NO: 103896 - protein, 24 aa, Homo sapiens
  heavy chain complementarity determining region 3 for antibody 51948
ARLSVYFGTVASAASKRYRSYFDY

SEQ ID NO: 103897 - protein, 9 aa, Homo sapiens
  light chain complementarity determining region 3 for antibody 51949
QQYYSSPQT

SEQ ID NO: 103898 - protein, 13 aa, Homo sapiens
  heavy chain complementarity determining region 3 for antibody 51949
ARDAADWRAAFDV

SEQ ID NO: 103899 - protein, 9 aa, Homo sapiens
  light chain complementarity determining region 3 for antibody 51950
QHYNSYSLT

SEQ ID NO: 103900 - protein, 16 aa, Homo sapiens
  heavy chain complementarity determining region 3 for antibody 51950
ARFSGYVNYLQFYMEV

SEQ ID NO: 103901 - protein, 9 aa, Homo sapiens
  light chain complementarity determining region 3 for antibody 51951
QQYFSSTWT

SEQ ID NO: 103902 - protein, 9 aa, Homo sapiens
  heavy chain complementarity determining region 3 for antibody 51951
AHRYEAFGA

SEQ ID NO: 103903 - protein, 9 aa, Homo sapiens
  light chain complementarity determining region 3 for antibody 51952
QQYNSYSKT

SEQ ID NO: 103904 - protein, 19 aa, Homo sapiens
  heavy chain complementarity determining region 3 for antibody 51952
ARLATILRGNMRSIRRLDV

SEQ ID NO: 103905 - protein, 9 aa, Homo sapiens
  light chain complementarity determining region 3 for antibody 51953
QQSYSTPYT

SEQ ID NO: 103906 - protein, 15 aa, Homo sapiens
  heavy chain complementarity determining region 3 for antibody 51953
ATYMSGLYYYYAMDV

SEQ ID NO: 103907 - protein, 9 aa, Homo sapiens
  light chain complementarity determining region 3 for antibody 51954
QQYSNYPFT

SEQ ID NO: 103908 - protein, 14 aa, Homo sapiens
  heavy chain complementarity determining region 3 for antibody 51954
ARWDWDYYYYGMDV

SEQ ID NO: 103909 - protein, 8 aa, Homo sapiens
  light chain complementarity determining region 3 for antibody 51955
QPYGSSRT

SEQ ID NO: 103910 - protein, 7 aa, Homo sapiens
  heavy chain complementarity determining region 3 for antibody 51955
SPVSGRY

SEQ ID NO: 103911 - protein, 9 aa, Homo sapiens
  light chain complementarity determining region 3 for antibody 51956
QQRTNWPLT

SEQ ID NO: 103912 - protein, 16 aa, Homo sapiens
  heavy chain complementarity determining region 3 for antibody 51956
VSYDNSGYDRLDAFDI

SEQ ID NO: 103913 - protein, 8 aa, Homo sapiens
  light chain complementarity determining region 3 for antibody 51957
QQYNSYWT

SEQ ID NO: 103914 - protein, 17 aa, Homo sapiens
  heavy chain complementarity determining region 3 for antibody 51957
ARDSSYCGGDCSTASDY

SEQ ID NO: 103915 - protein, 9 aa, Homo sapiens
  light chain complementarity determining region 3 for antibody 51958
QQANTFPLT

SEQ ID NO: 103916 - protein, 14 aa, Homo sapiens
  heavy chain complementarity determining region 3 for antibody 51958
AKDTLWFGEEAPDY

SEQ ID NO: 103917 - protein, 8 aa, Homo sapiens
  light chain complementarity determining region 3 for antibody 51959
QQYNNWPS

SEQ ID NO: 103918 - protein, 13 aa, Homo sapiens
  heavy chain complementarity determining region 3 for antibody 51959
ARSAPTSNWYFDL

SEQ ID NO: 103919 - protein, 9 aa, Homo sapiens
  light chain complementarity determining region 3 for antibody 51960
LQHDRFPLT

SEQ ID NO: 103920 - protein, 23 aa, Homo sapiens
  heavy chain complementarity determining region 3 for antibody 51960
ARGYCSGDRCHDIPYYSYYGVDV

SEQ ID NO: 103921 - protein, 9 aa, Homo sapiens
  light chain complementarity determining region 3 for antibody 51961
LQHDNLPYT

SEQ ID NO: 103922 - protein, 19 aa, Homo sapiens
  heavy chain complementarity determining region 3 for antibody 51961
ARDHPLGVGGTPGGNPLDF

SEQ ID NO: 103923 - protein, 8 aa, Homo sapiens
  light chain complementarity determining region 3 for antibody 51962
QLYSASRT

SEQ ID NO: 103924 - protein, 14 aa, Homo sapiens
  heavy chain complementarity determining region 3 for antibody 51962
ARGGRWSTVALLDL

SEQ ID NO: 103925 - protein, 9 aa, Homo sapiens
  light chain complementarity determining region 3 for antibody 51963
QQYNSYSST

SEQ ID NO: 103926 - protein, 15 aa, Homo sapiens
  heavy chain complementarity determining region 3 for antibody 51963
ARGGGPYYDSSGYQQ

SEQ ID NO: 103927 - protein, 9 aa, Homo sapiens
  light chain complementarity determining region 3 for antibody 51964
QQANSFPLT

SEQ ID NO: 103928 - protein, 11 aa, Homo sapiens
  heavy chain complementarity determining region 3 for antibody 51964
ARGNSFYYMDV

SEQ ID NO: 103929 - protein, 9 aa, Homo sapiens
  light chain complementarity determining region 3 for antibody 51965
QQSYSTPPT

SEQ ID NO: 103930 - protein, 15 aa, Homo sapiens
  heavy chain complementarity determining region 3 for antibody 51965
AREGYSSSWSQPLDY

SEQ ID NO: 103931 - protein, 9 aa, Homo sapiens
  light chain complementarity determining region 3 for antibody 51966
QNLNSYPLT

SEQ ID NO: 103932 - protein, 14 aa, Homo sapiens
  heavy chain complementarity determining region 3 for antibody 51966
SRYAERYVSWAYDM

SEQ ID NO: 103933 - protein, 9 aa, Homo sapiens
  light chain complementarity determining region 3 for antibody 51967
QQYNSYPPT

SEQ ID NO: 103934 - protein, 13 aa, Homo sapiens
  heavy chain complementarity determining region 3 for antibody 51967
GGRGYHGYAPGDS

SEQ ID NO: 103935 - protein, 10 aa, Homo sapiens
  light chain complementarity determining region 3 for antibody 51968
QQLNSYPRYT

SEQ ID NO: 103936 - protein, 11 aa, Homo sapiens
  heavy chain complementarity determining region 3 for antibody 51968
ARTNSVRWFDP

SEQ ID NO: 103937 - protein, 11 aa, Homo sapiens
  light chain complementarity determining region 3 for antibody 51969
QQYGSSPPELT

SEQ ID NO: 103938 - protein, 11 aa, Homo sapiens
  heavy chain complementarity determining region 3 for antibody 51969
TRGWVPRPFDY

SEQ ID NO: 103939 - protein, 10 aa, Homo sapiens
  light chain complementarity determining region 3 for antibody 51970
QQYGSSPRYT

SEQ ID NO: 103940 - protein, 15 aa, Homo sapiens
  heavy chain complementarity determining region 3 for antibody 51970
AQTYSSSWYAHHFDY

SEQ ID NO: 103941 - protein, 9 aa, Homo sapiens
  light chain complementarity determining region 3 for antibody 51971
LQDYTYPWT

SEQ ID NO: 103942 - protein, 15 aa, Homo sapiens
  heavy chain complementarity determining region 3 for antibody 51971
ARVRGSAYAEEKLES

SEQ ID NO: 103943 - protein, 9 aa, Homo sapiens
  light chain complementarity determining region 3 for antibody 51972
QQYNSYPVT

SEQ ID NO: 103944 - protein, 20 aa, Homo sapiens
  heavy chain complementarity determining region 3 for antibody 51972
AHTPRYDILTGYYPNWYFDL

SEQ ID NO: 103945 - protein, 9 aa, Homo sapiens
  light chain complementarity determining region 3 for antibody 51973
QQCGSSPPT

SEQ ID NO: 103946 - protein, 12 aa, Homo sapiens
  heavy chain complementarity determining region 3 for antibody 51973
ARMYVNKYYFES

SEQ ID NO: 103947 - protein, 9 aa, Homo sapiens
  light chain complementarity determining region 3 for antibody 51974
QQCDDLPLT

SEQ ID NO: 103948 - protein, 16 aa, Homo sapiens
  heavy chain complementarity determining region 3 for antibody 51974
ASPHHLGSGSYGTFQS

SEQ ID NO: 103949 - protein, 10 aa, Homo sapiens
  light chain complementarity determining region 3 for antibody 51975
QQYDNVPPLT

SEQ ID NO: 103950 - protein, 19 aa, Homo sapiens
  heavy chain complementarity determining region 3 for antibody 51975
ARITTDIVIVPGAIDGFDI

SEQ ID NO: 103951 - protein, 9 aa, Homo sapiens
  light chain complementarity determining region 3 for antibody 51976
QQTYNTPFA

SEQ ID NO: 103952 - protein, 13 aa, Homo sapiens
  heavy chain complementarity determining region 3 for antibody 51976
ANSWYVRDLLLEY

SEQ ID NO: 103953 - protein, 8 aa, Homo sapiens
  light chain complementarity determining region 3 for antibody 51977
QQYGSSFT

SEQ ID NO: 103954 - protein, 16 aa, Homo sapiens
  heavy chain complementarity determining region 3 for antibody 51977
ARVAVTLRKQYNWFDP

SEQ ID NO: 103955 - protein, 10 aa, Homo sapiens
  light chain complementarity determining region 3 for antibody 51978
QQYDNFLSYT

SEQ ID NO: 103956 - protein, 13 aa, Homo sapiens
  heavy chain complementarity determining region 3 for antibody 51978
ARESIFGVIRMDV

SEQ ID NO: 103957 - protein, 9 aa, Homo sapiens
  light chain complementarity determining region 3 for antibody 51979
QQYDKVPYT

SEQ ID NO: 103958 - protein, 11 aa, Homo sapiens
  heavy chain complementarity determining region 3 for antibody 51979
ARLFGWHSGDF

SEQ ID NO: 103959 - protein, 9 aa, Homo sapiens
  light chain complementarity determining region 3 for antibody 51980
QQSYHMPYT

SEQ ID NO: 103960 - protein, 13 aa, Homo sapiens
  heavy chain complementarity determining region 3 for antibody 51980
AREIRRGPIWLDT

SEQ ID NO: 103961 - protein, 8 aa, Homo sapiens
  light chain complementarity determining region 3 for antibody 51981
QQYDGSPL

SEQ ID NO: 103962 - protein, 13 aa, Homo sapiens
  heavy chain complementarity determining region 3 for antibody 51981
ATYSGYDRYYFDY

SEQ ID NO: 103963 - protein, 9 aa, Homo sapiens
  light chain complementarity determining region 3 for antibody 51982
QQSYSTSWT

SEQ ID NO: 103964 - protein, 14 aa, Homo sapiens
  heavy chain complementarity determining region 3 for antibody 51982
ANSIRRFFDSSMDF

SEQ ID NO: 103965 - protein, 9 aa, Homo sapiens
  light chain complementarity determining region 3 for antibody 51983
QQFYSPPWT

SEQ ID NO: 103966 - protein, 14 aa, Homo sapiens
  heavy chain complementarity determining region 3 for antibody 51983
TGYSSGWYPFGMDV

SEQ ID NO: 103967 - protein, 8 aa, Homo sapiens
  light chain complementarity determining region 3 for antibody 51984
QQYAKPFT

SEQ ID NO: 103968 - protein, 17 aa, Homo sapiens
  heavy chain complementarity determining region 3 for antibody 51984
AREGVVVSATSGEHFDH

SEQ ID NO: 103969 - protein, 10 aa, Homo sapiens [sequence omitted]

SEQ ID NO: 103970 - protein, 10 aa, Homo sapiens
  heavy chain complementarity determining region 3 for antibody 51985
TTDVIYRFDS

SEQ ID NO: 103971 - protein, 10 aa, Homo sapiens
  light chain complementarity determining region 3 for antibody 51986
LQHNSYPKYT

SEQ ID NO: 103972 - protein, 9 aa, Homo sapiens
  heavy chain complementarity determining region 3 for antibody 51986
AILGGGSDP

SEQ ID NO: 103973 - protein, 8 aa, Homo sapiens
  light chain complementarity determining region 3 for antibody 51987
QQYATSWT

SEQ ID NO: 103974 - protein, 16 aa, Homo sapiens
  heavy chain complementarity determining region 3 for antibody 51987
AAGPSVEGVLREYFTH

SEQ ID NO: 103975 - protein, 8 aa, Homo sapiens
  light chain complementarity determining region 3 for antibody 51988
QQYAASPT

SEQ ID NO: 103976 - protein, 21 aa, Homo sapiens
  heavy chain complementarity determining region 3 for antibody 51988
ARGPQAYDILNGFSTDNYFDH

SEQ ID NO: 103977 - protein, 8 aa, Homo sapiens
  light chain complementarity determining region 3 for antibody 51989
QQTFGALT

SEQ ID NO: 103978 - protein, 16 aa, Homo sapiens
  heavy chain complementarity determining region 3 for antibody 51989
ARGLRQWEIRRDAFHF

SEQ ID NO: 103979 - protein, 9 aa, Homo sapiens
  light chain complementarity determining region 3 for antibody 51990
QQSYSTLYT

SEQ ID NO: 103980 - protein, 12 aa, Homo sapiens
  heavy chain complementarity determining region 3 for antibody 51990
GREGPRTSHWKN

SEQ ID NO: 103981 - protein, 9 aa, Homo sapiens
  light chain complementarity determining region 3 for antibody 51991
QQSYSTALT

SEQ ID NO: 103982 - protein, 21 aa, Homo sapiens
  heavy chain complementarity determining region 3 for antibody 51991
AKDPRTLRFLDWLPEPYYFDY

SEQ ID NO: 103983 - protein, 9 aa, Homo sapiens
  light chain complementarity determining region 3 for antibody 51992
QQSYSTPYT

SEQ ID NO: 103984 - protein, 19 aa, Homo sapiens
  heavy chain complementarity determining region 3 for antibody 51992
ARDLQVTGSQWELPGYFDY

SEQ ID NO: 103985 - protein, 9 aa, Homo sapiens
  light chain complementarity determining region 3 for antibody 51993
QQANSFPFT

SEQ ID NO: 103986 - protein, 15 aa, Homo sapiens
  heavy chain complementarity determining region 3 for antibody 51993
ARVITVATVGFYFDY

SEQ ID NO: 103987 - protein, 9 aa, Homo sapiens
  light chain complementarity determining region 3 for antibody 51994
LQHHDFPRT

SEQ ID NO: 103988 - protein, 15 aa, Homo sapiens
  heavy chain complementarity determining region 3 for antibody 51994
ARDGLGGGYHGGFDH

SEQ ID NO: 103989 - protein, 9 aa, Homo sapiens
  light chain complementarity determining region 3 for antibody 51995
LQDYNNPWT

SEQ ID NO: 103990 - protein, 15 aa, Homo sapiens
  heavy chain complementarity determining region 3 for antibody 51995
ARGGVEMATMRYFDL

SEQ ID NO: 103991 - protein, 9 aa, Homo sapiens
  light chain complementarity determining region 3 for antibody 51996
QQYDNFPYT

SEQ ID NO: 103992 - protein, 21 aa, Homo sapiens
  heavy chain complementarity determining region 3 for antibody 51996
ARDSATRITLFGAVVGNGMDV

SEQ ID NO: 103993 - protein, 9 aa, Homo sapiens
  light chain complementarity determining region 3 for antibody 51997
QQYDDLPLT

SEQ ID NO: 103994 - protein, 13 aa, Homo sapiens
  heavy chain complementarity determining region 3 for antibody 51997
ARHRGGSSLMHDW

SEQ ID NO: 103995 - protein, 9 aa, Homo sapiens
  light chain complementarity determining region 3 for antibody 51998
QQLNSYPRT

SEQ ID NO: 103996 - protein, 13 aa, Homo sapiens
  heavy chain complementarity determining region 3 for antibody 51998
ARDAYSTRKAFDI

SEQ ID NO: 103997 - protein, 11 aa, Homo sapiens
  light chain complementarity determining region 3 for antibody 51999
QQYNYNSPGIT

SEQ ID NO: 103998 - protein, 15 aa, Homo sapiens
  heavy chain complementarity determining region 3 for antibody 51999
ARSGIFGVLITRLDY

SEQ ID NO: 103999 - protein, 9 aa, Homo sapiens
  light chain complementarity determining region 3 for antibody 52000
QQYNSYSWT

SEQ ID NO: 104000 - protein, 15 aa, Homo sapiens
  heavy chain complementarity determining region 3 for antibody 52000
ARGDGILRDSGILEW

SEQ ID NO: 104001 - protein, 9 aa, Homo sapiens
  light chain complementarity determining region 3 for antibody 52001
QQYMTYPWT

SEQ ID NO: 104002 - protein, 16 aa, Homo sapiens
  heavy chain complementarity determining region 3 for antibody 52001
ARGDCSGATCFRRLDH

SEQ ID NO: 104003 - protein, 9 aa, Homo sapiens
  light chain complementarity determining region 3 for antibody 52002
QQTHSSPLT

SEQ ID NO: 104004 - protein, 15 aa, Homo sapiens
  heavy chain complementarity determining region 3 for antibody 52002
ARDFRVSLTGGRTDF

SEQ ID NO: 104005 - protein, 9 aa, Homo sapiens
  light chain complementarity determining region 3 for antibody 52003
QQSYSTPRT

SEQ ID NO: 104006 - protein, 11 aa, Homo sapiens
  heavy chain complementarity determining region 3 for antibody 52003
AKDRAAGASDS

SEQ ID NO: 104007 - protein, 9 aa, Homo sapiens
  light chain complementarity determining region 3 for antibody 52004
QQSYSNPRT

SEQ ID NO: 104008 - protein, 13 aa, Homo sapiens
  heavy chain complementarity determining region 3 for antibody 52004
AKFGSGNYAPFDY

SEQ ID NO: 104009 - protein, 8 aa, Homo sapiens
  light chain complementarity determining region 3 for antibody 52005
QQYYFRPH

SEQ ID NO: 104010 - protein, 17 aa, Homo sapiens
  heavy chain complementarity determining region 3 for antibody 52005
AHSPAFLWTRRGDYFDS

SEQ ID NO: 104011 - protein, 9 aa, Homo sapiens
  light chain complementarity determining region 3 for antibody 52006
QQYDNLPLT

SEQ ID NO: 104012 - protein, 11 aa, Homo sapiens
  heavy chain complementarity determining region 3 for antibody 52006
ARGRRRVLMDV

SEQ ID NO: 104013 - protein, 9 aa, Homo sapiens
  light chain complementarity determining region 3 for antibody 52007
QQLNSFPWT

SEQ ID NO: 104014 - protein, 12 aa, Homo sapiens
  heavy chain complementarity determining region 3 for antibody 52007
ATVNWNYPIFDY

SEQ ID NO: 104015 - protein, 9 aa, Homo sapiens
  light chain complementarity determining region 3 for antibody 52008
QHYDSSPYT

SEQ ID NO: 104016 - protein, 15 aa, Homo sapiens
  heavy chain complementarity determining region 3 for antibody 52008
ARQKMNYYDRGYFDL

SEQ ID NO: 104017 - protein, 11 aa, Homo sapiens
  light chain complementarity determining region 3 for antibody 52009
HQRSNWPSGFT

SEQ ID NO: 104018 - protein, 14 aa, Homo sapiens
  heavy chain complementarity determining region 3 for antibody 52009
ARAPTIYGVRCFDY

SEQ ID NO: 104019 - protein, 9 aa, Homo sapiens
  light chain complementarity determining region 3 for antibody 52010
QQSYSTLYT

SEQ ID NO: 104020 - protein, 14 aa, Homo sapiens
  heavy chain complementarity determining region 3 for antibody 52010
ARKMGWDGVAWFDP

SEQ ID NO: 104021 - protein, 9 aa, Homo sapiens
  light chain complementarity determining region 3 for antibody 52011
QQRSNWPLT

SEQ ID NO: 104022 - protein, 16 aa, Homo sapiens
  heavy chain complementarity determining region 3 for antibody 52011
ARRGDGDNDPIYYFDH

SEQ ID NO: 104023 - protein, 8 aa, Homo sapiens
  light chain complementarity determining region 3 for antibody 52012
QESFSTYS

SEQ ID NO: 104024 - protein, 14 aa, Homo sapiens
  heavy chain complementarity determining region 3 for antibody 52012
ASGDSSGYGYYFDS

SEQ ID NO: 104025 - protein, 9 aa, Homo sapiens
  light chain complementarity determining region 3 for antibody 52013
QQYNSYPYT

SEQ ID NO: 104026 - protein, 17 aa, Homo sapiens
  heavy chain complementarity determining region 3 for antibody 52013
ARDSVAASPYYYFGMDV

SEQ ID NO: 104027 - protein, 10 aa, Homo sapiens
  light chain complementarity determining region 3 for antibody 52014
QQYGSSPPYS

SEQ ID NO: 104028 - protein, 13 aa, Homo sapiens
  heavy chain complementarity determining region 3 for antibody 52014
TRGAGYYTEYFQE

SEQ ID NO: 104029 - protein, 9 aa, Homo sapiens
  light chain complementarity determining region 3 for antibody 52015
QQYDNLPLT

SEQ ID NO: 104030 - protein, 16 aa, Homo sapiens
  heavy chain complementarity determining region 3 for antibody 52015
AHNNIGTYSRAEYFHH

SEQ ID NO: 104031 - protein, 9 aa, Homo sapiens
  light chain complementarity determining region 3 for antibody 52016
QQRNSWPLT

SEQ ID NO: 104032 - protein, 15 aa, Homo sapiens
  heavy chain complementarity determining region 3 for antibody 52016
AREIREYQMSNPFDI

SEQ ID NO: 104033 - protein, 9 aa, Homo sapiens
  light chain complementarity determining region 3 for antibody 52017
QKHDRAPLT

SEQ ID NO: 104034 - protein, 14 aa, Homo sapiens
  heavy chain complementarity determining region 3 for antibody 52017
VHRAEYAYGNYFAY

SEQ ID NO: 104035 - protein, 9 aa, Homo sapiens
  light chain complementarity determining region 3 for antibody 52018
MQARQPPRT

SEQ ID NO: 104036 - protein, 13 aa, Homo sapiens
  heavy chain complementarity determining region 3 for antibody 52018
ARAGGGYYNPFDY

SEQ ID NO: 104037 - protein, 9 aa, Homo sapiens
  light chain complementarity determining region 3 for antibody 52019
LQYNMYPRT

SEQ ID NO: 104038 - protein, 18 aa, Homo sapiens
  heavy chain complementarity determining region 3 for antibody 52019
ARETGGYCTDGSCGAFDV

SEQ ID NO: 104039 - protein, 9 aa, Homo sapiens
  light chain complementarity determining region 3 for antibody 52020
QQYYNLPYT

SEQ ID NO: 104040 - protein, 13 aa, Homo sapiens
  heavy chain complementarity determining region 3 for antibody 52020
AAPTTGKNYGTDV

SEQ ID NO: 104041 - protein, 9 aa, Homo sapiens
  light chain complementarity determining region 3 for antibody 52021
QQLNSYPRT

SEQ ID NO: 104042 - protein, 17 aa, Homo sapiens
  heavy chain complementarity determining region 3 for antibody 52021
ARDAVEIILPPSRSFDC

SEQ ID NO: 104043 - protein, 9 aa, Homo sapiens
  light chain complementarity determining region 3 for antibody 52022
QQSYAVPLT

SEQ ID NO: 104044 - protein, 13 aa, Homo sapiens
  heavy chain complementarity determining region 3 for antibody 52022
ARDIVTDFWYFDL

SEQ ID NO: 104045 - protein, 9 aa, Homo sapiens
  light chain complementarity determining region 3 for antibody 52023
QHYNINSET

SEQ ID NO: 104046 - protein, 8 aa, Homo sapiens
  heavy chain complementarity determining region 3 for antibody 52023
ATHPSTGA

SEQ ID NO: 104047 - protein, 9 aa, Homo sapiens
  light chain complementarity determining region 3 for antibody 52024
QQYKSYPLI

SEQ ID NO: 104048 - protein, 8 aa, Homo sapiens
  heavy chain complementarity determining region 3 for antibody 52024
AKDYYDTP

SEQ ID NO: 104049 - protein, 9 aa, Homo sapiens
  light chain complementarity determining region 3 for antibody 52025
QQTYRTPLT

SEQ ID NO: 104050 - protein, 17 aa, Homo sapiens
  heavy chain complementarity determining region 3 for antibody 52025
ARRKIASYTGRLTHFDN

SEQ ID NO: 104051 - protein, 9 aa, Homo sapiens
  light chain complementarity determining region 3 for antibody 52026
QQSYSTPYT

SEQ ID NO: 104052 - protein, 14 aa, Homo sapiens
  heavy chain complementarity determining region 3 for antibody 52026
ARLVYHGGMFTFDV

SEQ ID NO: 104053 - protein, 9 aa, Homo sapiens
  light chain complementarity determining region 3 for antibody 52027
QQSYSLPPT

SEQ ID NO: 104054 - protein, 14 aa, Homo sapiens
  heavy chain complementarity determining region 3 for antibody 52027
ASRPPNDYWGAYRI

SEQ ID NO: 104055 - protein, 9 aa, Homo sapiens
  light chain complementarity determining region 3 for antibody 52028
QQCYSFPYT

SEQ ID NO: 104056 - protein, 12 aa, Homo sapiens
  heavy chain complementarity determining region 3 for antibody 52028
VREGPRTSHWKN

SEQ ID NO: 104057 - protein, 10 aa, Homo sapiens
  light chain complementarity determining region 3 for antibody 52029
QHYNTYAPIT

SEQ ID NO: 104058 - protein, 18 aa, Homo sapiens
  heavy chain complementarity determining region 3 for antibody 52029
VRSKTDYEQGSWVGVFDP

SEQ ID NO: 104059 - protein, 9 aa, Homo sapiens
  light chain complementarity determining region 3 for antibody 52030
QQTYITPRT

SEQ ID NO: 104060 - protein, 9 aa, Homo sapiens
  heavy chain complementarity determining region 3 for antibody 52030
ARGAGTFDY

SEQ ID NO: 104061 - protein, 9 aa, Homo sapiens
  light chain complementarity determining region 3 for antibody 52031
QQSYDTQYT

SEQ ID NO: 104062 - protein, 12 aa, Homo sapiens
  heavy chain complementarity determining region 3 for antibody 52031
ARYDMVTGGFDY

SEQ ID NO: 104063 - protein, 9 aa, Homo sapiens
  light chain complementarity determining region 3 for antibody 52032
QKYDSGPLA

SEQ ID NO: 104064 - protein, 16 aa, Homo sapiens
  heavy chain complementarity determining region 3 for antibody 52032
VRLDILIGYSEGIFDY

SEQ ID NO: 104065 - protein, 9 aa, Homo sapiens
  light chain complementarity determining region 3 for antibody 52033
QQYSNFPNT

SEQ ID NO: 104066 - protein, 11 aa, Homo sapiens
  heavy chain complementarity determining region 3 for antibody 52033
ATNDYGDYARY

SEQ ID NO: 104067 - protein, 9 aa, Homo sapiens
  light chain complementarity determining region 3 for antibody 52034
QQYRTYSPD

SEQ ID NO: 104068 - protein, 28 aa, Homo sapiens
  heavy chain complementarity determining region 3 for antibody 52034
AREKWAGTSGEIKWGVAPRPRSNDAFDI

SEQ ID NO: 104069 - protein, 9 aa, Homo sapiens
  light chain complementarity determining region 3 for antibody 52035
QQYNDWPYT

SEQ ID NO: 104070 - protein, 14 aa, Homo sapiens
  heavy chain complementarity determining region 3 for antibody 52035
FTDLITLVSDRRSY

SEQ ID NO: 104071 - protein, 8 aa, Homo sapiens
  light chain complementarity determining region 3 for antibody 52036
QQYDTSIT

SEQ ID NO: 104072 - protein, 19 aa, Homo sapiens
  heavy chain complementarity determining region 3 for antibody 52036
ARRDYDSSGYYYSSYYFDY

SEQ ID NO: 104073 - protein, 9 aa, Homo sapiens
  light chain complementarity determining region 3 for antibody 52037
QQSYNTPPT

SEQ ID NO: 104074 - protein, 14 aa, Homo sapiens
  heavy chain complementarity determining region 3 for antibody 52037
ARVSGITMIEVVDH

SEQ ID NO: 104075 - protein, 9 aa, Homo sapiens
  light chain complementarity determining region 3 for antibody 52038
QQHDSPPFT

SEQ ID NO: 104076 - protein, 9 aa, Homo sapiens
  heavy chain complementarity determining region 3 for antibody 52038
AKGYAPFDY

SEQ ID NO: 104077 - protein, 7 aa, Homo sapiens
  light chain complementarity determining region 3 for antibody 52039
QHYNDFT

SEQ ID NO: 104078 - protein, 11 aa, Homo sapiens
  heavy chain complementarity determining region 3 for antibody 52039
AHRSPEGSFDI

SEQ ID NO: 104079 - protein, 9 aa, Homo sapiens
  light chain complementarity determining region 3 for antibody 52040
LQHNSYPWT

SEQ ID NO: 104080 - protein, 11 aa, Homo sapiens
  heavy chain complementarity determining region 3 for antibody 52040
ARGPARGYFDY

SEQ ID NO: 104081 - protein, 8 aa, Homo sapiens
  light chain complementarity determining region 3 for antibody 52041
QQYNSYST

SEQ ID NO: 104082 - protein, 16 aa, Homo sapiens
  heavy chain complementarity determining region 3 for antibody 52041
ARDKSQGWFGELSFDS

SEQ ID NO: 104083 - protein, 10 aa, Homo sapiens
  light chain complementarity determining region 3 for antibody 52042
QQSYSTPPLT

SEQ ID NO: 104084 - protein, 19 aa, Homo sapiens
  heavy chain complementarity determining region 3 for antibody 52042
ARGGYDILTGYYHYYYFDL

SEQ ID NO: 104085 - protein, 9 aa, Homo sapiens
  light chain complementarity determining region 3 for antibody 52043
QQSYITPYT

SEQ ID NO: 104086 - protein, 20 aa, Homo sapiens
  heavy chain complementarity determining region 3 for antibody 52043
AHQSYEILSVALYYYYGFDV

SEQ ID NO: 104087 - protein, 9 aa, Homo sapiens
  light chain complementarity determining region 3 for antibody 52044
QHYNSAPWT

SEQ ID NO: 104088 - protein, 13 aa, Homo sapiens
  heavy chain complementarity determining region 3 for antibody 52044
ARFGHWPKYYLDY

SEQ ID NO: 104089 - protein, 9 aa, Homo sapiens
  light chain complementarity determining region 3 for antibody 52045
QQYNSYPVT

SEQ ID NO: 104090 - protein, 9 aa, Homo sapiens
  heavy chain complementarity determining region 3 for antibody 52045
VRGGNGLDP

SEQ ID NO: 104091 - protein, 9 aa, Homo sapiens
  light chain complementarity determining region 3 for antibody 52046
QQYDNVPPS

SEQ ID NO: 104092 - protein, 19 aa, Homo sapiens
  heavy chain complementarity determining region 3 for antibody 52046
ARTYYYDNGGYYAERDFDL

SEQ ID NO: 104093 - protein, 8 aa, Homo sapiens
  light chain complementarity determining region 3 for antibody 52047
QQYDNLPT

SEQ ID NO: 104094 - protein, 15 aa, Homo sapiens
  heavy chain complementarity determining region 3 for antibody 52047
ARGGAVIAAADTFDY

SEQ ID NO: 104095 - protein, 9 aa, Homo sapiens
  light chain complementarity determining region 3 for antibody 52048
QQTYSTPLT

SEQ ID NO: 104096 - protein, 24 aa, Homo sapiens
  heavy chain complementarity determining region 3 for antibody 52048
AKDRRPYYDFWSGYYNHYYYGMDV

SEQ ID NO: 104097 - protein, 10 aa, Homo sapiens
  light chain complementarity determining region 3 for antibody 52049
QQSYSTPRLT

SEQ ID NO: 104098 - protein, 14 aa, Homo sapiens
  heavy chain complementarity determining region 3 for antibody 52049
ATERPDLAVAALDY

SEQ ID NO: 104099 - protein, 9 aa, Homo sapiens
  light chain complementarity determining region 3 for antibody 52050
QQSYSTPFT

SEQ ID NO: 104100 - protein, 16 aa, Homo sapiens
  heavy chain complementarity determining region 3 for antibody 52050
ATGDYYPDRTGHYFDN

SEQ ID NO: 104101 - protein, 11 aa, Homo sapiens
  light chain complementarity determining region 3 for antibody 52051
QQRSNWPPAIT

SEQ ID NO: 104102 - protein, 14 aa, Homo sapiens
  heavy chain complementarity determining region 3 for antibody 52051
ASLPWGGAIDVFDI

SEQ ID NO: 104103 - protein, 9 aa, Homo sapiens
  light chain complementarity determining region 3 for antibody 52052
QQNYRTTIT

SEQ ID NO: 104104 - protein, 10 aa, Homo sapiens
  heavy chain complementarity determining region 3 for antibody 52052
SGYTLGRHLP

SEQ ID NO: 104105 - protein, 9 aa, Homo sapiens
  light chain complementarity determining region 3 for antibody 52053
QEYYSYSRG

SEQ ID NO: 104106 - protein, 13 aa, Homo sapiens
  heavy chain complementarity determining region 3 for antibody 52053
ARTHHLGRSPFDL

SEQ ID NO: 104107 - protein, 9 aa, Homo sapiens
  light chain complementarity determining region 3 for antibody 52054
FQHNAYPRA

SEQ ID NO: 104108 - protein, 18 aa, Homo sapiens
  heavy chain complementarity determining region 3 for antibody 52054
TNTVHSGWNGVPYGPIAY

SEQ ID NO: 104109 - protein, 9 aa, Homo sapiens
  light chain complementarity determining region 3 for antibody 52055
QQSYSTLYT

SEQ ID NO: 104110 - protein, 12 aa, Homo sapiens
  heavy chain complementarity determining region 3 for antibody 52055
VREGPRASHWKN

SEQ ID NO: 104111 - protein, 9 aa, Homo sapiens
  light chain complementarity determining region 3 for antibody 52056
QQGMSFPHT

SEQ ID NO: 104112 - protein, 18 aa, Homo sapiens
  heavy chain complementarity determining region 3 for antibody 52056
ASQLDSSVGSKAYWYFDI

SEQ ID NO: 104113 - protein, 9 aa, Homo sapiens
  light chain complementarity determining region 3 for antibody 52057
QEYYTYSRG

SEQ ID NO: 104114 - protein, 13 aa, Homo sapiens
  heavy chain complementarity determining region 3 for antibody 52057
ARTHHLGRSPFDL

SEQ ID NO: 104115 - protein, 11 aa, Homo sapiens
  light chain complementarity determining region 3 for antibody 52058
MQGTHWPPVRT

SEQ ID NO: 104116 - protein, 17 aa, Homo sapiens
  heavy chain complementarity determining region 3 for antibody 52058
VRDKDVVATMDYYGMDV

SEQ ID NO: 104117 - protein, 9 aa, Homo sapiens
  light chain complementarity determining region 3 for antibody 52059
QQYYSAPQT

SEQ ID NO: 104118 - protein, 10 aa, Homo sapiens
  heavy chain complementarity determining region 3 for antibody 52059
ARDHNGDFDY

SEQ ID NO: 104119 - protein, 9 aa, Homo sapiens
  light chain complementarity determining region 3 for antibody 52060
QQCVIYPLS

SEQ ID NO: 104120 - protein, 12 aa, Homo sapiens
  heavy chain complementarity determining region 3 for antibody 52060
ARDSTIRARFDY

SEQ ID NO: 104121 - protein, 9 aa, Homo sapiens
  light chain complementarity determining region 3 for antibody 52061
LQHSSYPFT

SEQ ID NO: 104122 - protein, 12 aa, Homo sapiens
  heavy chain complementarity determining region 3 for antibody 52061
ARSFSRLAAFDL

SEQ ID NO: 104123 - protein, 10 aa, Homo sapiens
  light chain complementarity determining region 3 for antibody 52062
LHHGTSPMYT

SEQ ID NO: 104124 - protein, 10 aa, Homo sapiens
  heavy chain complementarity determining region 3 for antibody 52062
AREIPYYFDY

SEQ ID NO: 104125 - protein, 9 aa, Homo sapiens
  light chain complementarity determining region 3 for antibody 52063
QQYYSTPLT

SEQ ID NO: 104126 - protein, 14 aa, Homo sapiens
  heavy chain complementarity determining region 3 for antibody 52063
ARDRWGAISGGLDV

SEQ ID NO: 104127 - protein, 8 aa, Homo sapiens
  light chain complementarity determining region 3 for antibody 52064
QQYNSYLT

SEQ ID NO: 104128 - protein, 15 aa, Homo sapiens
  heavy chain complementarity determining region 3 for antibody 52064
ARGRGQYSSWSENDY

SEQ ID NO: 104129 - protein, 9 aa, Homo sapiens
  light chain complementarity determining region 3 for antibody 52065
QQSYSTPYT

SEQ ID NO: 104130 - protein, 15 aa, Homo sapiens
  heavy chain complementarity determining region 3 for antibody 52065
ARTSGRYVRSNYFDP

SEQ ID NO: 104131 - protein, 9 aa, Homo sapiens
  light chain complementarity determining region 3 for antibody 52066
QQSYNTPLT

SEQ ID NO: 104132 - protein, 18 aa, Homo sapiens
  heavy chain complementarity determining region 3 for antibody 52066
ARQDALPGDYYYYYGLDV

SEQ ID NO: 104133 - protein, 9 aa, Homo sapiens
  light chain complementarity determining region 3 for antibody 52067
QQSYGAPPT

SEQ ID NO: 104134 - protein, 14 aa, Homo sapiens
  heavy chain complementarity determining region 3 for antibody 52067
ARVLGSSWSYGMDV

SEQ ID NO: 104135 - protein, 9 aa, Homo sapiens
  light chain complementarity determining region 3 for antibody 52068
QQCYSFPYT

SEQ ID NO: 104136 - protein, 14 aa, Homo sapiens
  heavy chain complementarity determining region 3 for antibody 52068
ARKTGWDGVAWFDP

SEQ ID NO: 104137 - protein, 10 aa, Homo sapiens
  light chain complementarity determining region 3 for antibody 52069
QQYNSFLLYT

SEQ ID NO: 104138 - protein, 19 aa, Homo sapiens
  heavy chain complementarity determining region 3 for antibody 52069
ARDQAHILSSSPHAEYFQH

SEQ ID NO: 104139 - protein, 9 aa, Homo sapiens
  light chain complementarity determining region 3 for antibody 52070
QQSYSTLYT

SEQ ID NO: 104140 - protein, 12 aa, Homo sapiens
  heavy chain complementarity determining region 3 for antibody 52070
VREGPRTSRWKN

SEQ ID NO: 104141 - protein, 9 aa, Homo sapiens
  light chain complementarity determining region 3 for antibody 52071
QQSYNTWWT

SEQ ID NO: 104142 - protein, 17 aa, Homo sapiens
  heavy chain complementarity determining region 3 for antibody 52071
AVGPNPVEPRGTRAFDI

SEQ ID NO: 104143 - protein, 10 aa, Homo sapiens
  light chain complementarity determining region 3 for antibody 52072
QQSDSTPRIT

SEQ ID NO: 104144 - protein, 14 aa, Homo sapiens
  heavy chain complementarity determining region 3 for antibody 52072
ARERPDIAVAALDY

SEQ ID NO: 104145 - protein, 10 aa, Homo sapiens
  light chain complementarity determining region 3 for antibody 52073
QQRSNWPRIT

SEQ ID NO: 104146 - protein, 10 aa, Homo sapiens
  heavy chain complementarity determining region 3 for antibody 52073
AKDQRSYGDS

SEQ ID NO: 104147 - protein, 9 aa, Homo sapiens
  light chain complementarity determining region 3 for antibody 52074
QEYNSHSRG

SEQ ID NO: 104148 - protein, 13 aa, Homo sapiens
  heavy chain complementarity determining region 3 for antibody 52074
ARGHHLGRSPFDP

SEQ ID NO: 104149 - protein, 9 aa, Homo sapiens
  light chain complementarity determining region 3 for antibody 52075
HNYDTAPLT

SEQ ID NO: 104150 - protein, 20 aa, Homo sapiens
  heavy chain complementarity determining region 3 for antibody 52075
TIVLRGLGSSAYYVGSAFDI

SEQ ID NO: 104151 - protein, 9 aa, Homo sapiens
  light chain complementarity determining region 3 for antibody 52076
QQYNSFSLT

SEQ ID NO: 104152 - protein, 14 aa, Homo sapiens
  heavy chain complementarity determining region 3 for antibody 52076
AKGGVVGPRTYFDY

SEQ ID NO: 104153 - protein, 9 aa, Homo sapiens
  light chain complementarity determining region 3 for antibody 52077
QQYGRSPIT

SEQ ID NO: 104154 - protein, 17 aa, Homo sapiens
  heavy chain complementarity determining region 3 for antibody 52077
ARGLPRIATTGTNWFDP

SEQ ID NO: 104155 - protein, 9 aa, Homo sapiens
  light chain complementarity determining region 3 for antibody 52078
QQTYSSPYT

SEQ ID NO: 104156 - protein, 15 aa, Homo sapiens
  heavy chain complementarity determining region 3 for antibody 52078
ARAMRYYYDIYAFDI

SEQ ID NO: 104157 - protein, 8 aa, Homo sapiens
  light chain complementarity determining region 3 for antibody 52079
QQSYSTPT

SEQ ID NO: 104158 - protein, 13 aa, Homo sapiens
  heavy chain complementarity determining region 3 for antibody 52079
ARVHHDSSNAFDI

SEQ ID NO: 104159 - protein, 9 aa, Homo sapiens
  light chain complementarity determining region 3 for antibody 52080
QQLNTYPFT

SEQ ID NO: 104160 - protein, 11 aa, Homo sapiens
  heavy chain complementarity determining region 3 for antibody 52080
ARQVDLYGSDV

SEQ ID NO: 104161 - protein, 9 aa, Homo sapiens
  light chain complementarity determining region 3 for antibody 52081
QQHSSYPWT

SEQ ID NO: 104162 - protein, 18 aa, Homo sapiens
  heavy chain complementarity determining region 3 for antibody 52081
ATVRVGYCYGGSCYPFDS

SEQ ID NO: 104163 - protein, 9 aa, Homo sapiens
  light chain complementarity determining region 3 for antibody 52082
MQTLQTPKT

SEQ ID NO: 104164 - protein, 12 aa, Homo sapiens
  heavy chain complementarity determining region 3 for antibody 52082
ASGGDYGAGVAP

SEQ ID NO: 104165 - protein, 9 aa, Homo sapiens
  light chain complementarity determining region 3 for antibody 52083
QQYNSYPWT

SEQ ID NO: 104166 - protein, 18 aa, Homo sapiens
  heavy chain complementarity determining region 3 for antibody 52083
ARRSRPENLDSSGGFFDY

SEQ ID NO: 104167 - protein, 6 aa, Homo sapiens
  light chain complementarity determining region 3 for antibody 52084
QQYNSY

SEQ ID NO: 104168 - protein, 16 aa, Homo sapiens
  heavy chain complementarity determining region 3 for antibody 52084
ARGRDWVRAHYYGMDV

SEQ ID NO: 104169 - protein, 9 aa, Homo sapiens
  light chain complementarity determining region 3 for antibody 52085
QQSYSTPRT

SEQ ID NO: 104170 - protein, 20 aa, Homo sapiens
  heavy chain complementarity determining region 3 for antibody 52085
ARGWPVAAVAGRKRLGAMDV

SEQ ID NO: 104171 - protein, 9 aa, Homo sapiens
  light chain complementarity determining region 3 for antibody 52086
QQSYSTLYT

SEQ ID NO: 104172 - protein, 12 aa, Homo sapiens
  heavy chain complementarity determining region 3 for antibody 52086
VRGGPRTSHWKN

SEQ ID NO: 104173 - protein, 9 aa, Homo sapiens
  light chain complementarity determining region 3 for antibody 52087
QHRVNWPLT

SEQ ID NO: 104174 - protein, 13 aa, Homo sapiens
  heavy chain complementarity determining region 3 for antibody 52087
ATMIRGVLGGLDV

SEQ ID NO: 104175 - protein, 8 aa, Homo sapiens
  light chain complementarity determining region 3 for antibody 52088
QQYYSYST

SEQ ID NO: 104176 - protein, 18 aa, Homo sapiens
  heavy chain complementarity determining region 3 for antibody 52088
AHRQVGSGNDWNSGTFDI

SEQ ID NO: 104177 - protein, 9 aa, Homo sapiens
  light chain complementarity determining region 3 for antibody 52089
QQYNSYSRT

SEQ ID NO: 104178 - protein, 20 aa, Homo sapiens
  heavy chain complementarity determining region 3 for antibody 52089
ARDRGPRYCSDSSCRGDFDY

SEQ ID NO: 104179 - protein, 9 aa, Homo sapiens
  light chain complementarity determining region 3 for antibody 52090
QQYNSYSFT

SEQ ID NO: 104180 - protein, 12 aa, Homo sapiens
  heavy chain complementarity determining region 3 for antibody 52090
ATALSLYSSSGV

SEQ ID NO: 104181 - protein, 9 aa, Homo sapiens
  light chain complementarity determining region 3 for antibody 52091
QQYNSYPWT

SEQ ID NO: 104182 - protein, 13 aa, Homo sapiens
  heavy chain complementarity determining region 3 for antibody 52091
ASPSSGDYYGIDV

SEQ ID NO: 104183 - protein, 9 aa, Homo sapiens
  light chain complementarity determining region 3 for antibody 52092
QQYNSYPRT

SEQ ID NO: 104184 - protein, 14 aa, Homo sapiens
  heavy chain complementarity determining region 3 for antibody 52092
ARGLGAKTGRYFDL

SEQ ID NO: 104185 - protein, 9 aa, Homo sapiens
  light chain complementarity determining region 3 for antibody 52093
QQYHNLPIT

SEQ ID NO: 104186 - protein, 15 aa, Homo sapiens
  heavy chain complementarity determining region 3 for antibody 52093
ARTSLDCTNGVCYDY

SEQ ID NO: 104187 - protein, 9 aa, Homo sapiens
  light chain complementarity determining region 3 for antibody 52094
QQSYSTPYT

SEQ ID NO: 104188 - protein, 10 aa, Homo sapiens
  heavy chain complementarity determining region 3 for antibody 52094
ARARNRAFDI

SEQ ID NO: 104189 - protein, 10 aa, Homo sapiens
  light chain complementarity determining region 3 for antibody 52095
QQSNNWPPIT

SEQ ID NO: 104190 - protein, 18 aa, Homo sapiens
  heavy chain complementarity determining region 3 for antibody 52095
ARDMGDSPLFMTSILFDY

SEQ ID NO: 104191 - protein, 9 aa, Homo sapiens
  light chain complementarity determining region 3 for antibody 52096
QQANSFPPT

SEQ ID NO: 104192 - protein, 16 aa, Homo sapiens
  heavy chain complementarity determining region 3 for antibody 52096
ARDASTSVTLDNYFDS

SEQ ID NO: 104193 - protein, 9 aa, Homo sapiens
  light chain complementarity determining region 3 for antibody 52097
QQANSFPFT

SEQ ID NO: 104194 - protein, 14 aa, Homo sapiens
  heavy chain complementarity determining region 3 for antibody 52097
AKGSGRSLTRHFDL

SEQ ID NO: 104195 - protein, 9 aa, Homo sapiens
  light chain complementarity determining region 3 for antibody 52098
QKYNSVPLT

SEQ ID NO: 104196 - protein, 18 aa, Homo sapiens
  heavy chain complementarity determining region 3 for antibody 52098
ARVGYEWVENYYYHDMDV

SEQ ID NO: 104197 - protein, 10 aa, Homo sapiens
  light chain complementarity determining region 3 for antibody 52099
LQTYNTDPVT

SEQ ID NO: 104198 - protein, 14 aa, Homo sapiens
  heavy chain complementarity determining region 3 for antibody 52099
ARDKGSGDYYYFDL

SEQ ID NO: 104199 - protein, 11 aa, Homo sapiens
  light chain complementarity determining region 3 for antibody 52100
QQSYSTPPSLT

SEQ ID NO: 104200 - protein, 12 aa, Homo sapiens
  heavy chain complementarity determining region 3 for antibody 52100
AREGNWDVHLDS

SEQ ID NO: 104201 - protein, 9 aa, Homo sapiens
  light chain complementarity determining region 3 for antibody 52101
HQGYHVPLT

SEQ ID NO: 104202 - protein, 16 aa, Homo sapiens
  heavy chain complementarity determining region 3 for antibody 52101
ARDQCLNGVCHWRWDY

SEQ ID NO: 104203 - protein, 9 aa, Homo sapiens
  light chain complementarity determining region 3 for antibody 52102
QQYYTNRRT

SEQ ID NO: 104204 - protein, 14 aa, Homo sapiens
  heavy chain complementarity determining region 3 for antibody 52102
TKLGMTNGPEYFQH

SEQ ID NO: 104205 - protein, 11 aa, Homo sapiens
  light chain complementarity determining region 3 for antibody 52103
QQYDSSPTTYI

SEQ ID NO: 104206 - protein, 14 aa, Homo sapiens
  heavy chain complementarity determining region 3 for antibody 52103
ARAGLAGWSSQFDL

SEQ ID NO: 104207 - protein, 10 aa, Homo sapiens
  light chain complementarity determining region 3 for antibody 52104
QQYDNLPPYT

SEQ ID NO: 104208 - protein, 19 aa, Homo sapiens
  heavy chain complementarity determining region 3 for antibody 52104
ARRSVYDYLWGSHRDAFDI

SEQ ID NO: 104209 - protein, 9 aa, Homo sapiens
  light chain complementarity determining region 3 for antibody 52105
QQSYSKLWA

SEQ ID NO: 104210 - protein, 25 aa, Homo sapiens
  heavy chain complementarity determining region 3 for antibody 52105
ARDLNWGRDCGGVTCYSDTSYYFDN

SEQ ID NO: 104211 - protein, 9 aa, Homo sapiens
  light chain complementarity determining region 3 for antibody 52106
QQLNSYLWK

SEQ ID NO: 104212 - protein, 14 aa, Homo sapiens
  heavy chain complementarity determining region 3 for antibody 52106
ATYYGDYAGVTLGY

SEQ ID NO: 104213 - protein, 9 aa, Homo sapiens
  light chain complementarity determining region 3 for antibody 52107
QKYNSAPWT

SEQ ID NO: 104214 - protein, 10 aa, Homo sapiens
  heavy chain complementarity determining region 3 for antibody 52107
ATSGGDGFDM

SEQ ID NO: 104215 - protein, 9 aa, Homo sapiens
  light chain complementarity determining region 3 for antibody 52108
LQHNSFPWT

SEQ ID NO: 104216 - protein, 11 aa, Homo sapiens
  heavy chain complementarity determining region 3 for antibody 52108
VRDVPTAHLDY

SEQ ID NO: 104217 - protein, 9 aa, Homo sapiens
  light chain complementarity determining region 3 for antibody 52109
LQDSNYPRT

SEQ ID NO: 104218 - protein, 18 aa, Homo sapiens
  heavy chain complementarity determining region 3 for antibody 52109
ARDRTYASNGNYYDSFDY

SEQ ID NO: 104219 - protein, 9 aa, Homo sapiens
  light chain complementarity determining region 3 for antibody 52110
QQYYSTPLT

SEQ ID NO: 104220 - protein, 20 aa, Homo sapiens
  heavy chain complementarity determining region 3 for antibody 52110
TRDSAHYYDSGSYYHTAFDI

SEQ ID NO: 104221 - protein, 8 aa, Homo sapiens
  light chain complementarity determining region 3 for antibody 52111
QQYSSLYS

SEQ ID NO: 104222 - protein, 14 aa, Homo sapiens
  heavy chain complementarity determining region 3 for antibody 52111
ARVNRFLEGDYLDY

SEQ ID NO: 104223 - protein, 9 aa, Homo sapiens
  light chain complementarity determining region 3 for antibody 52112
QQYDNLPLT

SEQ ID NO: 104224 - protein, 16 aa, Homo sapiens
  heavy chain complementarity determining region 3 for antibody 52112
AKDQDWDSSSWYILDY

SEQ ID NO: 104225 - protein, 9 aa, Homo sapiens
  light chain complementarity determining region 3 for antibody 52113
QQSYSTLYT

SEQ ID NO: 104226 - protein, 12 aa, Homo sapiens
  heavy chain complementarity determining region 3 for antibody 52113
VREGPRTSHWKD

SEQ ID NO: 104227 - protein, 9 aa, Homo sapiens
  light chain complementarity determining region 3 for antibody 52114
QQFNSYPFT

SEQ ID NO: 104228 - protein, 21 aa, Homo sapiens
  heavy chain complementarity determining region 3 for antibody 52114
AKRVVIATASVGLYYYYYIDV

SEQ ID NO: 104229 - protein, 9 aa, Homo sapiens
  light chain complementarity determining region 3 for antibody 52115
QHYGASPET

SEQ ID NO: 104230 - protein, 16 aa, Homo sapiens
  heavy chain complementarity determining region 3 for antibody 52115
AASRHPDAYDRRYFDV

SEQ ID NO: 104231 - protein, 9 aa, Homo sapiens
  light chain complementarity determining region 3 for antibody 52116
QQTYNTPGT

SEQ ID NO: 104232 - protein, 18 aa, Homo sapiens
  heavy chain complementarity determining region 3 for antibody 52116
ARATKGSAYYYMVFYFDF

SEQ ID NO: 104233 - protein, 9 aa, Homo sapiens
  light chain complementarity determining region 3 for antibody 52117
QQLSAHPYT

SEQ ID NO: 104234 - protein, 17 aa, Homo sapiens
  heavy chain complementarity determining region 3 for antibody 52117
ARERGYCSDEHCYGFAH

SEQ ID NO: 104235 - protein, 10 aa, Homo sapiens
  light chain complementarity determining region 3 for antibody 52118
QQLNSYPMYT

SEQ ID NO: 104236 - protein, 15 aa, Homo sapiens
  heavy chain complementarity determining region 3 for antibody 52118
AKDKTYYYDNHGYSD

SEQ ID NO: 104237 - protein, 9 aa, Homo sapiens
  light chain complementarity determining region 3 for antibody 52119
QQGYTHPIV

SEQ ID NO: 104238 - protein, 13 aa, Homo sapiens
  heavy chain complementarity determining region 3 for antibody 52119
ARDVGYCGDGICQ

SEQ ID NO: 104239 - protein, 9 aa, Homo sapiens
  light chain complementarity determining region 3 for antibody 52120
QQFDELPIT

SEQ ID NO: 104240 - protein, 9 aa, Homo sapiens
  heavy chain complementarity determining region 3 for antibody 52120
ARSTHPRGP

SEQ ID NO: 104241 - protein, 9 aa, Homo sapiens
  light chain complementarity determining region 3 for antibody 52121
QQANSFPLT

SEQ ID NO: 104242 - protein, 13 aa, Homo sapiens
  heavy chain complementarity determining region 3 for antibody 52121
ASPSSGNYYGIDI

SEQ ID NO: 104243 - protein, 10 aa, Homo sapiens
  light chain complementarity determining region 3 for antibody 52122
QHSYYNGPYT

SEQ ID NO: 104244 - protein, 11 aa, Homo sapiens
  heavy chain complementarity determining region 3 for antibody 52122
ATITPGFPADF

SEQ ID NO: 104245 - protein, 9 aa, Homo sapiens
  light chain complementarity determining region 3 for antibody 52123
QHSYSPPWT

SEQ ID NO: 104246 - protein, 15 aa, Homo sapiens
  heavy chain complementarity determining region 3 for antibody 52123
ARKQRRIAGPNWFDL

SEQ ID NO: 104247 - protein, 9 aa, Homo sapiens
  light chain complementarity determining region 3 for antibody 52124
QESYSITRT

SEQ ID NO: 104248 - protein, 14 aa, Homo sapiens
  heavy chain complementarity determining region 3 for antibody 52124
ASTAVTTFAEYFQH

SEQ ID NO: 104249 - protein, 9 aa, Homo sapiens
  light chain complementarity determining region 3 for antibody 52125
QQYDNSPIT

SEQ ID NO: 104250 - protein, 17 aa, Homo sapiens
  heavy chain complementarity determining region 3 for antibody 52125
ARHIAVAGLRQKGYVDY

SEQ ID NO: 104251 - protein, 9 aa, Homo sapiens
  light chain complementarity determining region 3 for antibody 52126
QQSYSTLYT

SEQ ID NO: 104252 - protein, 12 aa, Homo sapiens
  heavy chain complementarity determining region 3 for antibody 52126
VREGPGTSHWKN

SEQ ID NO: 104253 - protein, 9 aa, Homo sapiens
  light chain complementarity determining region 3 for antibody 52127
QQCYSFPYT

SEQ ID NO: 104254 - protein, 14 aa, Homo sapiens
  heavy chain complementarity determining region 3 for antibody 52127
ARKMGWDGVAWFDT

SEQ ID NO: 104255 - protein, 9 aa, Homo sapiens
  light chain complementarity determining region 3 for antibody 52128
QKYISAPWT

SEQ ID NO: 104256 - protein, 14 aa, Homo sapiens
  heavy chain complementarity determining region 3 for antibody 52128
ARFRSTSWDAPPDC

SEQ ID NO: 104257 - protein, 9 aa, Homo sapiens
  light chain complementarity determining region 3 for antibody 52129
QQYNSYPYT

SEQ ID NO: 104258 - protein, 17 aa, Homo sapiens
  heavy chain complementarity determining region 3 for antibody 52129
ARDRSAYGSGIYPFCDN

SEQ ID NO: 104259 - protein, 10 aa, Homo sapiens
  light chain complementarity determining region 3 for antibody 52130
QQTLDSPPWT

SEQ ID NO: 104260 - protein, 13 aa, Homo sapiens
  heavy chain complementarity determining region 3 for antibody 52130
ARAAVAGTSKLDY

SEQ ID NO: 104261 - protein, 9 aa, Homo sapiens
  light chain complementarity determining region 3 for antibody 52131
QQSYTTPPT

SEQ ID NO: 104262 - protein, 13 aa, Homo sapiens
  heavy chain complementarity determining region 3 for antibody 52131
TRAIFGVVLGVDY

SEQ ID NO: 104263 - protein, 9 aa, Homo sapiens
  light chain complementarity determining region 3 for antibody 52132
QQSYSTALT

SEQ ID NO: 104264 - protein, 21 aa, Homo sapiens
  heavy chain complementarity determining region 3 for antibody 52132
AKEPRTLRFLDWLPEPYYFDY

SEQ ID NO: 104265 - protein, 9 aa, Homo sapiens
  light chain complementarity determining region 3 for antibody 52133
QQYNSYSET

SEQ ID NO: 104266 - protein, 17 aa, Homo sapiens
  heavy chain complementarity determining region 3 for antibody 52133
TREGGSARVGVNDAFDM

SEQ ID NO: 104267 - protein, 9 aa, Homo sapiens
  light chain complementarity determining region 3 for antibody 52134
QQYNSYPWT

SEQ ID NO: 104268 - protein, 15 aa, Homo sapiens
  heavy chain complementarity determining region 3 for antibody 52134
AKGGTQRHYYYHMDV

SEQ ID NO: 104269 - protein, 9 aa, Homo sapiens
  light chain complementarity determining region 3 for antibody 52135
QQYIRYPKT

SEQ ID NO: 104270 - protein, 16 aa, Homo sapiens
  heavy chain complementarity determining region 3 for antibody 52135
ATGDHDFRTGYFPFDY

SEQ ID NO: 104271 - protein, 9 aa, Homo sapiens
  light chain complementarity determining region 3 for antibody 52136
QQYGSSWWT

SEQ ID NO: 104272 - protein, 12 aa, Homo sapiens
  heavy chain complementarity determining region 3 for antibody 52136
ARGDSYFEAFDI

SEQ ID NO: 104273 - protein, 9 aa, Homo sapiens
  light chain complementarity determining region 3 for antibody 52137
QQYFFIPWT

SEQ ID NO: 104274 - protein, 15 aa, Homo sapiens
  heavy chain complementarity determining region 3 for antibody 52137
ARGSGTTGFDSYFAY

SEQ ID NO: 104275 - protein, 9 aa, Homo sapiens
  light chain complementarity determining region 3 for antibody 52138
QQYDSSPWT

SEQ ID NO: 104276 - protein, 14 aa, Homo sapiens
  heavy chain complementarity determining region 3 for antibody 52138
ARVAYDYVWGTLDY

SEQ ID NO: 104277 - protein, 9 aa, Homo sapiens
  light chain complementarity determining region 3 for antibody 52139
QQYDSDFPT

SEQ ID NO: 104278 - protein, 9 aa, Homo sapiens
  heavy chain complementarity determining region 3 for antibody 52139
ARGAAAADY

SEQ ID NO: 104279 - protein, 9 aa, Homo sapiens
  light chain complementarity determining region 3 for antibody 52140
QQYDNLPPT

SEQ ID NO: 104280 - protein, 17 aa, Homo sapiens
  heavy chain complementarity determining region 3 for antibody 52140
AKVVVPASLGPRGWFDP

SEQ ID NO: 104281 - protein, 9 aa, Homo sapiens
  light chain complementarity determining region 3 for antibody 52141
QQTYSTPHT

SEQ ID NO: 104282 - protein, 13 aa, Homo sapiens
  heavy chain complementarity determining region 3 for antibody 52141
ARVNDGDYVLYDF

SEQ ID NO: 104283 - protein, 9 aa, Homo sapiens
  light chain complementarity determining region 3 for antibody 52142
QQSYSTPYT

SEQ ID NO: 104284 - protein, 18 aa, Homo sapiens
  heavy chain complementarity determining region 3 for antibody 52142
ARQRGVGQYSSSWEGFDI

SEQ ID NO: 104285 - protein, 9 aa, Homo sapiens
  light chain complementarity determining region 3 for antibody 52143
QQSYSTPYT

SEQ ID NO: 104286 - protein, 13 aa, Homo sapiens
  heavy chain complementarity determining region 3 for antibody 52143
ARGASSSWYWVDY

SEQ ID NO: 104287 - protein, 8 aa, Homo sapiens
  light chain complementarity determining region 3 for antibody 52144
QQSYSTPL

SEQ ID NO: 104288 - protein, 17 aa, Homo sapiens
  heavy chain complementarity determining region 3 for antibody 52144
ARAVNYDYIWGSLSLDY

SEQ ID NO: 104289 - protein, 9 aa, Homo sapiens
  light chain complementarity determining region 3 for antibody 52145
QQSSSTPRT

SEQ ID NO: 104290 - protein, 13 aa, Homo sapiens
  heavy chain complementarity determining region 3 for antibody 52145
ARDDDIWKYYFDY

SEQ ID NO: 104291 - protein, 9 aa, Homo sapiens
  light chain complementarity determining region 3 for antibody 52146
QQADSFPYT

SEQ ID NO: 104292 - protein, 13 aa, Homo sapiens
  heavy chain complementarity determining region 3 for antibody 52146
ARVLGAGGYYFDY

SEQ ID NO: 104293 - protein, 8 aa, Homo sapiens
  light chain complementarity determining region 3 for antibody 52147
QQYNTSPT

SEQ ID NO: 104294 - protein, 16 aa, Homo sapiens
  heavy chain complementarity determining region 3 for antibody 52147
ARPHCSDRSCYGFYGH

SEQ ID NO: 104295 - protein, 9 aa, Homo sapiens
  light chain complementarity determining region 3 for antibody 52148
QQYNSYPWP

SEQ ID NO: 104296 - protein, 12 aa, Homo sapiens
  heavy chain complementarity determining region 3 for antibody 52148
AKDSFHNAAGDY

SEQ ID NO: 104297 - protein, 9 aa, Homo sapiens
  light chain complementarity determining region 3 for antibody 52149
QQYGSTPWT

SEQ ID NO: 104298 - protein, 18 aa, Homo sapiens
  heavy chain complementarity determining region 3 for antibody 52149
ARDGGPPNNWNWVGFFDY

SEQ ID NO: 104299 - protein, 10 aa, Homo sapiens
  light chain complementarity determining region 3 for antibody 52150
QQYGSSPSVT

SEQ ID NO: 104300 - protein, 15 aa, Homo sapiens
  heavy chain complementarity determining region 3 for antibody 52150
ARDNRGGWIPDWFDT

SEQ ID NO: 104301 - protein, 11 aa, Homo sapiens
  light chain complementarity determining region 3 for antibody 52151
QQYGGSPPGYT

SEQ ID NO: 104302 - protein, 14 aa, Homo sapiens
  heavy chain complementarity determining region 3 for antibody 52151
TSANTVPSLEYFQH

SEQ ID NO: 104303 - protein, 10 aa, Homo sapiens
  light chain complementarity determining region 3 for antibody 52152
QQVNSFPALT

SEQ ID NO: 104304 - protein, 14 aa, Homo sapiens
  heavy chain complementarity determining region 3 for antibody 52152
ARRGKLWPAGAFDI

SEQ ID NO: 104305 - protein, 9 aa, Homo sapiens
  light chain complementarity determining region 3 for antibody 52153
QQTYSTPPT

SEQ ID NO: 104306 - protein, 11 aa, Homo sapiens
  heavy chain complementarity determining region 3 for antibody 52153
ARTRGPNGLDV

SEQ ID NO: 104307 - protein, 9 aa, Homo sapiens
  light chain complementarity determining region 3 for antibody 52154
QQSYSTAWT

SEQ ID NO: 104308 - protein, 10 aa, Homo sapiens
  heavy chain complementarity determining region 3 for antibody 52154
ARVVGNAFDI

SEQ ID NO: 104309 - protein, 9 aa, Homo sapiens
  light chain complementarity determining region 3 for antibody 52155
QQSFSIPLT

SEQ ID NO: 104310 - protein, 12 aa, Homo sapiens
  heavy chain complementarity determining region 3 for antibody 52155
ARELRGSKPFDY

SEQ ID NO: 104311 - protein, 8 aa, Homo sapiens
  light chain complementarity determining region 3 for antibody 52156
QQRFTWPT

SEQ ID NO: 104312 - protein, 14 aa, Homo sapiens
  heavy chain complementarity determining region 3 for antibody 52156
AKLRSDWENDALDI

SEQ ID NO: 104313 - protein, 9 aa, Homo sapiens
  light chain complementarity determining region 3 for antibody 52157
QQLSDYPRT

SEQ ID NO: 104314 - protein, 16 aa, Homo sapiens
  heavy chain complementarity determining region 3 for antibody 52157
ARTPNEMGTISDGFDL

SEQ ID NO: 104315 - protein, 10 aa, Homo sapiens
  light chain complementarity determining region 3 for antibody 52158
QQAFNRPRLT

SEQ ID NO: 104316 - protein, 16 aa, Homo sapiens
  heavy chain complementarity determining region 3 for antibody 52158
ARSNAPSSGYYNWFDP

SEQ ID NO: 104317 - protein, 9 aa, Homo sapiens
  light chain complementarity determining region 3 for antibody 52159
LQLAIYPRS

SEQ ID NO: 104318 - protein, 19 aa, Homo sapiens
  heavy chain complementarity determining region 3 for antibody 52159
ARVALVRGLIITGYDAFDI

SEQ ID NO: 104319 - protein, 10 aa, Homo sapiens
  light chain complementarity determining region 3 for antibody 52160
QQYSSYSPWA

SEQ ID NO: 104320 - protein, 15 aa, Homo sapiens
  heavy chain complementarity determining region 3 for antibody 52160
AREGGYDSGYWYFDL

SEQ ID NO: 104321 - protein, 9 aa, Homo sapiens
  light chain complementarity determining region 3 for antibody 52161
QQYNSYSVT

SEQ ID NO: 104322 - protein, 15 aa, Homo sapiens
  heavy chain complementarity determining region 3 for antibody 52161
TRGRGNTEGYKPFDL

SEQ ID NO: 104323 - protein, 9 aa, Homo sapiens
  light chain complementarity determining region 3 for antibody 52162
QQYNSNLNT

SEQ ID NO: 104324 - protein, 11 aa, Homo sapiens
  heavy chain complementarity determining region 3 for antibody 52162
ATGYWLSYFDN

SEQ ID NO: 104325 - protein, 9 aa, Homo sapiens
  light chain complementarity determining region 3 for antibody 52163
QQYNNYPYT

SEQ ID NO: 104326 - protein, 12 aa, Homo sapiens
  heavy chain complementarity determining region 3 for antibody 52163
AHAPQSSGWISV

SEQ ID NO: 104327 - protein, 9 aa, Homo sapiens
  light chain complementarity determining region 3 for antibody 52164
QQYDNLPPV

SEQ ID NO: 104328 - protein, 14 aa, Homo sapiens
  heavy chain complementarity determining region 3 for antibody 52164
YYYGSGDTGDAFDI

SEQ ID NO: 104329 - protein, 9 aa, Homo sapiens
  light chain complementarity determining region 3 for antibody 52165
QQYDNLPLT

SEQ ID NO: 104330 - protein, 13 aa, Homo sapiens
  heavy chain complementarity determining region 3 for antibody 52165
TTEVSRESGSPDY

SEQ ID NO: 104331 - protein, 9 aa, Homo sapiens
  light chain complementarity determining region 3 for antibody 52166
QQLNSYPLT

SEQ ID NO: 104332 - protein, 5 aa, Homo sapiens
  heavy chain complementarity determining region 3 for antibody 52166
IPRDF

SEQ ID NO: 104333 - protein, 8 aa, Homo sapiens
  light chain complementarity determining region 3 for antibody 52167
QQLNSWVT

SEQ ID NO: 104334 - protein, 16 aa, Homo sapiens
  heavy chain complementarity determining region 3 for antibody 52167
ARGYYYDSSADYSFDY

SEQ ID NO: 104335 - protein, 9 aa, Homo sapiens
  light chain complementarity determining region 3 for antibody 52168
QQGYNTPIT

SEQ ID NO: 104336 - protein, 12 aa, Homo sapiens
  heavy chain complementarity determining region 3 for antibody 52168
ARDGLLAAAGHG

SEQ ID NO: 104337 - protein, 9 aa, Homo sapiens
  light chain complementarity determining region 3 for antibody 52169
LQDYNYPYT

SEQ ID NO: 104338 - protein, 10 aa, Homo sapiens
  heavy chain complementarity determining region 3 for antibody 52169
ARALGGQFVT

SEQ ID NO: 104339 - protein, 10 aa, Homo sapiens
  light chain complementarity determining region 3 for antibody 52170
QQYHDWPPWT

SEQ ID NO: 104340 - protein, 13 aa, Homo sapiens
  heavy chain complementarity determining region 3 for antibody 52170
ARDSAYRREFFQH

SEQ ID NO: 104341 - protein, 10 aa, Homo sapiens
  light chain complementarity determining region 3 for antibody 52171
QQYDSSRLYT

SEQ ID NO: 104342 - protein, 21 aa, Homo sapiens
  heavy chain complementarity determining region 3 for antibody 52171
ARISSRYYYDTSGYYYATFDD

SEQ ID NO: 104343 - protein, 9 aa, Homo sapiens
  light chain complementarity determining region 3 for antibody 52172
QQYDDLPIT

SEQ ID NO: 104344 - protein, 8 aa, Homo sapiens
  heavy chain complementarity determining region 3 for antibody 52172
RTLTPADV

SEQ ID NO: 104345 - protein, 9 aa, Homo sapiens
  light chain complementarity determining region 3 for antibody 52173
QQLNSYPYT

SEQ ID NO: 104346 - protein, 12 aa, Homo sapiens
  heavy chain complementarity determining region 3 for antibody 52173
ALSITTVVEPDF

SEQ ID NO: 104347 - protein, 9 aa, Homo sapiens
  light chain complementarity determining region 3 for antibody 52174
QQCYSTLYT

SEQ ID NO: 104348 - protein, 12 aa, Homo sapiens
  heavy chain complementarity determining region 3 for antibody 52174
VREGPRTSHWKN

SEQ ID NO: 104349 - protein, 9 aa, Homo sapiens
  light chain complementarity determining region 3 for antibody 52175
QQCYSFPYT

SEQ ID NO: 104350 - protein, 14 aa, Homo sapiens
  heavy chain complementarity determining region 3 for antibody 52175
AGKMGWDGVAWFDP

SEQ ID NO: 104351 - protein, 9 aa, Homo sapiens
  light chain complementarity determining region 3 for antibody 52176
LQHNTYPWT

SEQ ID NO: 104352 - protein, 17 aa, Homo sapiens
  heavy chain complementarity determining region 3 for antibody 52176
ARGTLWFGELSDDAFDI

SEQ ID NO: 104353 - protein, 9 aa, Homo sapiens
  light chain complementarity determining region 3 for antibody 52177
LQHNSYPLT

SEQ ID NO: 104354 - protein, 12 aa, Homo sapiens
  heavy chain complementarity determining region 3 for antibody 52177
ARGYPLGLIFGY

SEQ ID NO: 104355 - protein, 7 aa, Homo sapiens
  light chain complementarity determining region 3 for antibody 52178
LQDYMWT

SEQ ID NO: 104356 - protein, 10 aa, Homo sapiens
  heavy chain complementarity determining region 3 for antibody 52178
ARRDVSGYSH

SEQ ID NO: 104357 - protein, 9 aa, Homo sapiens
  light chain complementarity determining region 3 for antibody 52179
HQSYISPHT

SEQ ID NO: 104358 - protein, 20 aa, Homo sapiens
  heavy chain complementarity determining region 3 for antibody 52179
ASAGKYCTGGSCYSMDAFDF

SEQ ID NO: 104359 - protein, 9 aa, Homo sapiens
  light chain complementarity determining region 3 for antibody 52180
QQYYSTPWT

SEQ ID NO: 104360 - protein, 24 aa, Homo sapiens
  heavy chain complementarity determining region 3 for antibody 52180
AREAPEIPLWSGYSMARRYYGMDV

SEQ ID NO: 104361 - protein, 11 aa, Homo sapiens
  light chain complementarity determining region 3 for antibody 52181
QQYNNWPPGGT

SEQ ID NO: 104362 - protein, 12 aa, Homo sapiens
  heavy chain complementarity determining region 3 for antibody 52181
ARSKIGARTLDY

SEQ ID NO: 104363 - protein, 9 aa, Homo sapiens
  light chain complementarity determining region 3 for antibody 52182
QQYKSSSKT

SEQ ID NO: 104364 - protein, 12 aa, Homo sapiens
  heavy chain complementarity determining region 3 for antibody 52182
ARHVGETSPFGY

SEQ ID NO: 104365 - protein, 9 aa, Homo sapiens
  light chain complementarity determining region 3 for antibody 52183
QQSYNFPRT

SEQ ID NO: 104366 - protein, 18 aa, Homo sapiens
  heavy chain complementarity determining region 3 for antibody 52183
ARDGQVPSSETNYYGLDV

SEQ ID NO: 104367 - protein, 9 aa, Homo sapiens
  light chain complementarity determining region 3 for antibody 52184
QQLHSYPHT

SEQ ID NO: 104368 - protein, 14 aa, Homo sapiens
  heavy chain complementarity determining region 3 for antibody 52184
ARLGEVTYYYGMDV

SEQ ID NO: 104369 - protein, 9 aa, Homo sapiens
  light chain complementarity determining region 3 for antibody 52185
QQASSFPFT

SEQ ID NO: 104370 - protein, 15 aa, Homo sapiens
  heavy chain complementarity determining region 3 for antibody 52185
AKLTQAYGGSGRFDY

SEQ ID NO: 104371 - protein, 9 aa, Homo sapiens
  light chain complementarity determining region 3 for antibody 52186
QQANSFPGT

SEQ ID NO: 104372 - protein, 14 aa, Homo sapiens
  heavy chain complementarity determining region 3 for antibody 52186
ARAGDPIKWYYFDH

SEQ ID NO: 104373 - protein, 10 aa, Homo sapiens
  light chain complementarity determining region 3 for antibody 52187
QKYNSQSPWT

SEQ ID NO: 104374 - protein, 10 aa, Homo sapiens
  heavy chain complementarity determining region 3 for antibody 52187
ARVPVTSGNY

SEQ ID NO: 104375 - protein, 9 aa, Homo sapiens
  light chain complementarity determining region 3 for antibody 52188
QKYKNAPWA

SEQ ID NO: 104376 - protein, 16 aa, Homo sapiens
  heavy chain complementarity determining region 3 for antibody 52188
AKELNSSPTELDVFDI

SEQ ID NO: 104377 - protein, 9 aa, Homo sapiens
  light chain complementarity determining region 3 for antibody 52189
QHYDSSPFT

SEQ ID NO: 104378 - protein, 11 aa, Homo sapiens
  heavy chain complementarity determining region 3 for antibody 52189
ARDWSYDSSAS

SEQ ID NO: 104379 - protein, 9 aa, Homo sapiens
  light chain complementarity determining region 3 for antibody 52190
QEYNSAPET

SEQ ID NO: 104380 - protein, 5 aa, Homo sapiens
  heavy chain complementarity determining region 3 for antibody 52190
ARIYD

SEQ ID NO: 104381 - protein, 9 aa, Homo sapiens
  light chain complementarity determining region 3 for antibody 52191
KQALQAPWT

SEQ ID NO: 104382 - protein, 11 aa, Homo sapiens
  heavy chain complementarity determining region 3 for antibody 52191
ARVRMEWVVDY

SEQ ID NO: 104383 - protein, 10 aa, Homo sapiens
  light chain complementarity determining region 3 for antibody 52192
HQSSSLPHGT

SEQ ID NO: 104384 - protein, 20 aa, Homo sapiens
  heavy chain complementarity determining region 3 for antibody 52192
ARDGGSIVATMGGHYYGMDV

SEQ ID NO: 104385 - protein, 10 aa, Homo sapiens
  light chain complementarity determining region 3 for antibody 52193
QQYYNNSPYT

SEQ ID NO: 104386 - protein, 24 aa, Homo sapiens
  heavy chain complementarity determining region 3 for antibody 52193
ARLSVYFGTVASVASKRYRSYFDY

SEQ ID NO: 104387 - protein, 9 aa, Homo sapiens
  light chain complementarity determining region 3 for antibody 52194
QQYSSLPRT

SEQ ID NO: 104388 - protein, 16 aa, Homo sapiens
  heavy chain complementarity determining region 3 for antibody 52194
ARLQQLVLGRGDAFDI

SEQ ID NO: 104389 - protein, 9 aa, Homo sapiens
  light chain complementarity determining region 3 for antibody 52195
QQYNSYRYT

SEQ ID NO: 104390 - protein, 23 aa, Homo sapiens
  heavy chain complementarity determining region 3 for antibody 52195
ARATQYYEFWSGYFPNYYYGMDV

SEQ ID NO: 104391 - protein, 9 aa, Homo sapiens
  light chain complementarity determining region 3 for antibody 52196
QQYNSYQIT

SEQ ID NO: 104392 - protein, 10 aa, Homo sapiens
  heavy chain complementarity determining region 3 for antibody 52196
ARMALTTMPA

SEQ ID NO: 104393 - protein, 9 aa, Homo sapiens
  light chain complementarity determining region 3 for antibody 52197
QQYDTYSGT

SEQ ID NO: 104394 - protein, 14 aa, Homo sapiens
  heavy chain complementarity determining region 3 for antibody 52197
ATTYIAGAGTYFDY

SEQ ID NO: 104395 - protein, 9 aa, Homo sapiens
  light chain complementarity determining region 3 for antibody 52198
QQYDSYPCT

SEQ ID NO: 104396 - protein, 15 aa, Homo sapiens
  heavy chain complementarity determining region 3 for antibody 52198
AHSAFVDVLTPFFDY

SEQ ID NO: 104397 - protein, 9 aa, Homo sapiens
  light chain complementarity determining region 3 for antibody 52199
QQYDSPPLT

SEQ ID NO: 104398 - protein, 11 aa, Homo sapiens
  heavy chain complementarity determining region 3 for antibody 52199
MRDLAVAGTAV

SEQ ID NO: 104399 - protein, 9 aa, Homo sapiens
  light chain complementarity determining region 3 for antibody 52200
QQTSSTPPT

SEQ ID NO: 104400 - protein, 16 aa, Homo sapiens
  heavy chain complementarity determining region 3 for antibody 52200
GRDHQLHGRSSGVFDY

SEQ ID NO: 104401 - protein, 9 aa, Homo sapiens
  light chain complementarity determining region 3 for antibody 52201
QQSYSTLYT

SEQ ID NO: 104402 - protein, 12 aa, Homo sapiens
  heavy chain complementarity determining region 3 for antibody 52201
VREGPRSSHWKN

SEQ ID NO: 104403 - protein, 8 aa, Homo sapiens
  light chain complementarity determining region 3 for antibody 52202
QQSYSTLT

SEQ ID NO: 104404 - protein, 16 aa, Homo sapiens
  heavy chain complementarity determining region 3 for antibody 52202
ARSDYSRDGYNRYFDF

SEQ ID NO: 104405 - protein, 9 aa, Homo sapiens
  light chain complementarity determining region 3 for antibody 52203
QQSYSIPWT

SEQ ID NO: 104406 - protein, 20 aa, Homo sapiens
  heavy chain complementarity determining region 3 for antibody 52203
ASDSQSTSEYGSGSINWFDP

SEQ ID NO: 104407 - protein, 11 aa, Homo sapiens
  light chain complementarity determining region 3 for antibody 52204
QQRDNWPPAAF

SEQ ID NO: 104408 - protein, 11 aa, Homo sapiens
  heavy chain complementarity determining region 3 for antibody 52204
ARDFVRQWFDY

SEQ ID NO: 104409 - protein, 9 aa, Homo sapiens
  light chain complementarity determining region 3 for antibody 52205
QQLNNYPLT

SEQ ID NO: 104410 - protein, 12 aa, Homo sapiens
  heavy chain complementarity determining region 3 for antibody 52205
AMYTSSWYGTGY

SEQ ID NO: 104411 - protein, 8 aa, Homo sapiens
  light chain complementarity determining region 3 for antibody 52206
QQFTAPDT

SEQ ID NO: 104412 - protein, 14 aa, Homo sapiens
  heavy chain complementarity determining region 3 for antibody 52206
ARESWISESGGYPY

SEQ ID NO: 104413 - protein, 9 aa, Homo sapiens
  light chain complementarity determining region 3 for antibody 52207
QQCYSFPYT

SEQ ID NO: 104414 - protein, 14 aa, Homo sapiens
  heavy chain complementarity determining region 3 for antibody 52207
ARKMGWGGVAWFDP

SEQ ID NO: 104415 - protein, 9 aa, Homo sapiens
  light chain complementarity determining region 3 for antibody 52208
QHYHTSMYT

SEQ ID NO: 104416 - protein, 12 aa, Homo sapiens
  heavy chain complementarity determining region 3 for antibody 52208
VREGPRTSHWKN

SEQ ID NO: 104417 - protein, 9 aa, Homo sapiens
  light chain complementarity determining region 3 for antibody 52209
LQYNSHPPT

SEQ ID NO: 104418 - protein, 15 aa, Homo sapiens
  heavy chain complementarity determining region 3 for antibody 52209
ARVKFGSGSYWFFDL

SEQ ID NO: 104419 - protein, 9 aa, Homo sapiens
  light chain complementarity determining region 3 for antibody 52210
LQDSNFPLT

SEQ ID NO: 104420 - protein, 14 aa, Homo sapiens
  heavy chain complementarity determining region 3 for antibody 52210
AGRPSNSGSPLVDY

SEQ ID NO: 104421 - protein, 9 aa, Homo sapiens
  light chain complementarity determining region 3 for antibody 52211
QQYSSYSGT

SEQ ID NO: 104422 - protein, 8 aa, Homo sapiens
  heavy chain complementarity determining region 3 for antibody 52211
ARGKPMGD

SEQ ID NO: 104423 - protein, 8 aa, Homo sapiens
  light chain complementarity determining region 3 for antibody 52212
QQYNTYST

SEQ ID NO: 104424 - protein, 15 aa, Homo sapiens
  heavy chain complementarity determining region 3 for antibody 52212
ARGPYKYGIAGTYVY

SEQ ID NO: 104425 - protein, 9 aa, Homo sapiens
  light chain complementarity determining region 3 for antibody 52213
QQYNSYPWT

SEQ ID NO: 104426 - protein, 7 aa, Homo sapiens
  heavy chain complementarity determining region 3 for antibody 52213
SPVSGSY

SEQ ID NO: 104427 - protein, 9 aa, Homo sapiens
  light chain complementarity determining region 3 for antibody 52214
QQYGSSPWT

SEQ ID NO: 104428 - protein, 24 aa, Homo sapiens
  heavy chain complementarity determining region 3 for antibody 52214
AHRLRTYDYIWDSNRPAVFDAFDI

SEQ ID NO: 104429 - protein, 9 aa, Homo sapiens
  light chain complementarity determining region 3 for antibody 52215
QQSYSAPIT

SEQ ID NO: 104430 - protein, 16 aa, Homo sapiens
  heavy chain complementarity determining region 3 for antibody 52215
AKEGFGDGDYEKIFQF

SEQ ID NO: 104431 - protein, 8 aa, Homo sapiens
  light chain complementarity determining region 3 for antibody 52216
QQRCNWIT

SEQ ID NO: 104432 - protein, 12 aa, Homo sapiens
  heavy chain complementarity determining region 3 for antibody 52216
ARLGIDPNWFDP

SEQ ID NO: 104433 - protein, 9 aa, Homo sapiens
  light chain complementarity determining region 3 for antibody 52217
QQLNSYPIT

SEQ ID NO: 104434 - protein, 16 aa, Homo sapiens
  heavy chain complementarity determining region 3 for antibody 52217
ARHYGGMGHYYCSADY

SEQ ID NO: 104435 - protein, 10 aa, Homo sapiens
  light chain complementarity determining region 3 for antibody 52218
QHSDNLPQVT

SEQ ID NO: 104436 - protein, 19 aa, Homo sapiens
  heavy chain complementarity determining region 3 for antibody 52218
AKVARVYGSLSGWRSYFDT

SEQ ID NO: 104437 - protein, 9 aa, Homo sapiens
  light chain complementarity determining region 3 for antibody 52219
LQDFNYPRT

SEQ ID NO: 104438 - protein, 18 aa, Homo sapiens
  heavy chain complementarity determining region 3 for antibody 52219
VRDLSPSASVNYHDGFDI

SEQ ID NO: 104439 - protein, 11 aa, Homo sapiens
  light chain complementarity determining region 3 for antibody 52220
RQYNNWPPGGT

SEQ ID NO: 104440 - protein, 12 aa, Homo sapiens
  heavy chain complementarity determining region 3 for antibody 52220
ARSKIGARTLDY

SEQ ID NO: 104441 - protein, 9 aa, Homo sapiens
  light chain complementarity determining region 3 for antibody 52221
QQYNSYPYT

SEQ ID NO: 104442 - protein, 13 aa, Homo sapiens
  heavy chain complementarity determining region 3 for antibody 52221
AREGSGPLINIDL

SEQ ID NO: 104443 - protein, 9 aa, Homo sapiens
  light chain complementarity determining region 3 for antibody 52222
QQYNIYSET

SEQ ID NO: 104444 - protein, 8 aa, Homo sapiens
  heavy chain complementarity determining region 3 for antibody 52222
ATAPTKGY

SEQ ID NO: 104445 - protein, 9 aa, Homo sapiens
  light chain complementarity determining region 3 for antibody 52223
QQYGSSSWT

SEQ ID NO: 104446 - protein, 11 aa, Homo sapiens
  heavy chain complementarity determining region 3 for antibody 52223
ARAPTYSGTYS

SEQ ID NO: 104447 - protein, 8 aa, Homo sapiens
  light chain complementarity determining region 3 for antibody 52224
QQYATSWT

SEQ ID NO: 104448 - protein, 16 aa, Homo sapiens
  heavy chain complementarity determining region 3 for antibody 52224
AAGPSVEGVLREYFQH

SEQ ID NO: 104449 - protein, 9 aa, Homo sapiens
  light chain complementarity determining region 3 for antibody 52225
QQRSNWPIT

SEQ ID NO: 104450 - protein, 16 aa, Homo sapiens
  heavy chain complementarity determining region 3 for antibody 52225
GGVDSRGYYRAEYFQH

SEQ ID NO: 104451 - protein, 9 aa, Homo sapiens
  light chain complementarity determining region 3 for antibody 52226
QHYDSFSYT

SEQ ID NO: 104452 - protein, 16 aa, Homo sapiens
  heavy chain complementarity determining region 3 for antibody 52226
ARHRNNLGGVGDSFAI

SEQ ID NO: 104453 - protein, 11 aa, Homo sapiens
  light chain complementarity determining region 3 for antibody 52227
QHRGHWPPGAT

SEQ ID NO: 104454 - protein, 17 aa, Homo sapiens
  heavy chain complementarity determining region 3 for antibody 52227
AKEANYGGGSGYRSFDI

SEQ ID NO: 104455 - protein, 7 aa, Homo sapiens
  light chain complementarity determining region 3 for antibody 52228
QHPLPLT

SEQ ID NO: 104456 - protein, 14 aa, Homo sapiens
  heavy chain complementarity determining region 3 for antibody 52228
ASDRGPSRIGIFDF

SEQ ID NO: 104457 - protein, 9 aa, Homo sapiens
  light chain complementarity determining region 3 for antibody 52229
MQPLQTPIT

SEQ ID NO: 104458 - protein, 13 aa, Homo sapiens
  heavy chain complementarity determining region 3 for antibody 52229
ARTMYQWVYAMDV

SEQ ID NO: 104459 - protein, 9 aa, Homo sapiens
  light chain complementarity determining region 3 for antibody 52230
HQSYSDLHT

SEQ ID NO: 104460 - protein, 11 aa, Homo sapiens
  heavy chain complementarity determining region 3 for antibody 52230
ARGVLHDALDF

SEQ ID NO: 104461 - protein, 9 aa, Homo sapiens
  light chain complementarity determining region 3 for antibody 52231
QQYYSYPHT

SEQ ID NO: 104462 - protein, 18 aa, Homo sapiens
  heavy chain complementarity determining region 3 for antibody 52231
ARDDNWNHLDYYYYGMDV

SEQ ID NO: 104463 - protein, 9 aa, Homo sapiens
  light chain complementarity determining region 3 for antibody 52232
QQYYSASRT

SEQ ID NO: 104464 - protein, 11 aa, Homo sapiens
  heavy chain complementarity determining region 3 for antibody 52232
ARHRQDYGDHV

SEQ ID NO: 104465 - protein, 9 aa, Homo sapiens
  light chain complementarity determining region 3 for antibody 52233
QQYNSFPWT

SEQ ID NO: 104466 - protein, 19 aa, Homo sapiens
  heavy chain complementarity determining region 3 for antibody 52233
ARDLGPSSQGSGRPYGMDV

SEQ ID NO: 104467 - protein, 9 aa, Homo sapiens
  light chain complementarity determining region 3 for antibody 52234
QQYNSFLLT

SEQ ID NO: 104468 - protein, 23 aa, Homo sapiens
  heavy chain complementarity determining region 3 for antibody 52234
ASHYYDYVWGSYRYNPRRHAFDI

SEQ ID NO: 104469 - protein, 9 aa, Homo sapiens
  light chain complementarity determining region 3 for antibody 52235
QQYNNYPNT

SEQ ID NO: 104470 - protein, 11 aa, Homo sapiens
  heavy chain complementarity determining region 3 for antibody 52235
ATNDYGDYARY

SEQ ID NO: 104471 - protein, 8 aa, Homo sapiens
  light chain complementarity determining region 3 for antibody 52236
QQYENLYT

SEQ ID NO: 104472 - protein, 14 aa, Homo sapiens
  heavy chain complementarity determining region 3 for antibody 52236
ARMGDGDYVFAFDI

SEQ ID NO: 104473 - protein, 8 aa, Homo sapiens
  light chain complementarity determining region 3 for antibody 52237
QQYATSWT

SEQ ID NO: 104474 - protein, 16 aa, Homo sapiens
  heavy chain complementarity determining region 3 for antibody 52237
AAGPSVEGVLRGYFPH

SEQ ID NO: 104475 - protein, 10 aa, Homo sapiens
  light chain complementarity determining region 3 for antibody 52238
QQSYTTPSWT

SEQ ID NO: 104476 - protein, 18 aa, Homo sapiens
  heavy chain complementarity determining region 3 for antibody 52238
ARDGFFMMTFGGISAFDL

SEQ ID NO: 104477 - protein, 9 aa, Homo sapiens
  light chain complementarity determining region 3 for antibody 52239
QQSYSTRKT

SEQ ID NO: 104478 - protein, 13 aa, Homo sapiens
  heavy chain complementarity determining region 3 for antibody 52239
ARVLRNSGASLDI

SEQ ID NO: 104479 - protein, 9 aa, Homo sapiens
  light chain complementarity determining region 3 for antibody 52240
QQSYSTPYT

SEQ ID NO: 104480 - protein, 13 aa, Homo sapiens
  heavy chain complementarity determining region 3 for antibody 52240
ARHSYGDYDAFDI

SEQ ID NO: 104481 - protein, 10 aa, Homo sapiens
  light chain complementarity determining region 3 for antibody 52241
QQSYSTPRLT

SEQ ID NO: 104482 - protein, 14 aa, Homo sapiens
  heavy chain complementarity determining region 3 for antibody 52241
ARERPDLAVAALDS

SEQ ID NO: 104483 - protein, 9 aa, Homo sapiens
  light chain complementarity determining region 3 for antibody 52242
QQSHTTPRT

SEQ ID NO: 104484 - protein, 10 aa, Homo sapiens
  heavy chain complementarity determining region 3 for antibody 52242
AKDQRPAYDY

SEQ ID NO: 104485 - protein, 10 aa, Homo sapiens
  light chain complementarity determining region 3 for antibody 52243
QQRSNWPPYT

SEQ ID NO: 104486 - protein, 13 aa, Homo sapiens
  heavy chain complementarity determining region 3 for antibody 52243
TTPWAHRTWKLEY

SEQ ID NO: 104487 - protein, 9 aa, Homo sapiens
  light chain complementarity determining region 3 for antibody 52244
QQRSNWPLT

SEQ ID NO: 104488 - protein, 18 aa, Homo sapiens
  heavy chain complementarity determining region 3 for antibody 52244
ARGGDFWSGYYVKYFFDY

SEQ ID NO: 104489 - protein, 9 aa, Homo sapiens
  light chain complementarity determining region 3 for antibody 52245
QQCSRSPPT

SEQ ID NO: 104490 - protein, 12 aa, Homo sapiens
  heavy chain complementarity determining region 3 for antibody 52245
ASLQVMNYFFDN

SEQ ID NO: 104491 - protein, 9 aa, Homo sapiens
  light chain complementarity determining region 3 for antibody 52246
QHRSGWPPT

SEQ ID NO: 104492 - protein, 17 aa, Homo sapiens
  heavy chain complementarity determining region 3 for antibody 52246
AREGGYCSGGSCRWFDY

SEQ ID NO: 104493 - protein, 9 aa, Homo sapiens
  light chain complementarity determining region 3 for antibody 52247
QHLNSYPFT

SEQ ID NO: 104494 - protein, 17 aa, Homo sapiens
  heavy chain complementarity determining region 3 for antibody 52247
ARDGYDGYTYASSVFDL

SEQ ID NO: 104495 - protein, 9 aa, Homo sapiens
  light chain complementarity determining region 3 for antibody 52248
LQDYSYPRT

SEQ ID NO: 104496 - protein, 18 aa, Homo sapiens
  heavy chain complementarity determining region 3 for antibody 52248
ARDRNYCDSPVCYDVLDI

SEQ ID NO: 104497 - protein, 9 aa, Homo sapiens
  light chain complementarity determining region 3 for antibody 52249
LQDYNYPWT

SEQ ID NO: 104498 - protein, 6 aa, Homo sapiens
  heavy chain complementarity determining region 3 for antibody 52249
TLRTEY

SEQ ID NO: 104499 - protein, 9 aa, Homo sapiens
  light chain complementarity determining region 3 for antibody 52250
QQYGSSTGT

SEQ ID NO: 104500 - protein, 9 aa, Homo sapiens
  heavy chain complementarity determining region 3 for antibody 52250
ARGGWYFDL

SEQ ID NO: 104501 - protein, 10 aa, Homo sapiens
  light chain complementarity determining region 3 for antibody 52251
QQYGNSPLYT

SEQ ID NO: 104502 - protein, 12 aa, Homo sapiens
  heavy chain complementarity determining region 3 for antibody 52251
ARDKTPRDAFDI

SEQ ID NO: 104503 - protein, 8 aa, Homo sapiens
  light chain complementarity determining region 3 for antibody 52252
QQYDNLLT

SEQ ID NO: 104504 - protein, 17 aa, Homo sapiens
  heavy chain complementarity determining region 3 for antibody 52252
ATGRRVGNNYYQYDMDV

SEQ ID NO: 104505 - protein, 9 aa, Homo sapiens
  light chain complementarity determining region 3 for antibody 52253
QQSYSTSVT

SEQ ID NO: 104506 - protein, 14 aa, Homo sapiens
  heavy chain complementarity determining region 3 for antibody 52253
ARADIYGDYVYFDY

SEQ ID NO: 104507 - protein, 8 aa, Homo sapiens
  light chain complementarity determining region 3 for antibody 52254
QQSYSTGT

SEQ ID NO: 104508 - protein, 16 aa, Homo sapiens
  heavy chain complementarity determining region 3 for antibody 52254
VRGGGGGECCDHYMDV

SEQ ID NO: 104509 - protein, 9 aa, Homo sapiens
  light chain complementarity determining region 3 for antibody 52255
QQANSFPLT

SEQ ID NO: 104510 - protein, 12 aa, Homo sapiens
  heavy chain complementarity determining region 3 for antibody 52255
TKVGSKGEFFDY

SEQ ID NO: 104511 - protein, 9 aa, Homo sapiens
  light chain complementarity determining region 3 for antibody 52256
MQGTHWPAT

SEQ ID NO: 104512 - protein, 14 aa, Homo sapiens
  heavy chain complementarity determining region 3 for antibody 52256
AGGHYYDSSGYLGY

SEQ ID NO: 104513 - protein, 9 aa, Homo sapiens
  light chain complementarity determining region 3 for antibody 52257
RQYNSYSKT

SEQ ID NO: 104514 - protein, 19 aa, Homo sapiens
  heavy chain complementarity determining region 3 for antibody 52257
ARLATILRGNMRSIRRLDV

SEQ ID NO: 104515 - protein, 9 aa, Homo sapiens
  light chain complementarity determining region 3 for antibody 52258
QQYYSTSWT

SEQ ID NO: 104516 - protein, 10 aa, Homo sapiens
  heavy chain complementarity determining region 3 for antibody 52258
TTPGGVPTYY

SEQ ID NO: 104517 - protein, 9 aa, Homo sapiens
  light chain complementarity determining region 3 for antibody 52259
QQYYSTLYT

SEQ ID NO: 104518 - protein, 14 aa, Homo sapiens
  heavy chain complementarity determining region 3 for antibody 52259
AKSFRGYSGSYYDH

SEQ ID NO: 104519 - protein, 9 aa, Homo sapiens
  light chain complementarity determining region 3 for antibody 52260
QQYNSYPIT

SEQ ID NO: 104520 - protein, 20 aa, Homo sapiens
  heavy chain complementarity determining region 3 for antibody 52260
AHSLPESGYSYGKKYNWFDP

SEQ ID NO: 104521 - protein, 9 aa, Homo sapiens
  light chain complementarity determining region 3 for antibody 52261
QQYGSSPWT

SEQ ID NO: 104522 - protein, 10 aa, Homo sapiens
  heavy chain complementarity determining region 3 for antibody 52261
ARDGQWLVPY

SEQ ID NO: 104523 - protein, 9 aa, Homo sapiens
  light chain complementarity determining region 3 for antibody 52262
QQYGSSPRT

SEQ ID NO: 104524 - protein, 14 aa, Homo sapiens
  heavy chain complementarity determining region 3 for antibody 52262
AREILGRGSGFFDY

SEQ ID NO: 104525 - protein, 9 aa, Homo sapiens
  light chain complementarity determining region 3 for antibody 52263
QQYDNLPRT

SEQ ID NO: 104526 - protein, 15 aa, Homo sapiens
  heavy chain complementarity determining region 3 for antibody 52263
ASLPTTWGGFETQNL

SEQ ID NO: 104527 - protein, 9 aa, Homo sapiens
  light chain complementarity determining region 3 for antibody 52264
QQYARLPYT

SEQ ID NO: 104528 - protein, 12 aa, Homo sapiens
  heavy chain complementarity determining region 3 for antibody 52264
ARDLRYNWDGDY

SEQ ID NO: 104529 - protein, 9 aa, Homo sapiens
  light chain complementarity determining region 3 for antibody 52265
QNYYSAPQT

SEQ ID NO: 104530 - protein, 18 aa, Homo sapiens
  heavy chain complementarity determining region 3 for antibody 52265
ARAGRVFAELFKPAPFDY

SEQ ID NO: 104531 - protein, 10 aa, Homo sapiens
  light chain complementarity determining region 3 for antibody 52266
QHYNSSSQCT

SEQ ID NO: 104532 - protein, 22 aa, Homo sapiens
  heavy chain complementarity determining region 3 for antibody 52266
ARWYAYGSGTYYDPSYYYGMDV

SEQ ID NO: 104533 - protein, 9 aa, Homo sapiens
  light chain complementarity determining region 3 for antibody 52267
MQSTHWPHT

SEQ ID NO: 104534 - protein, 8 aa, Homo sapiens
  heavy chain complementarity determining region 3 for antibody 52267
ATWASSNN

SEQ ID NO: 104535 - protein, 9 aa, Homo sapiens
  light chain complementarity determining region 3 for antibody 52268
MQALQTPYT

SEQ ID NO: 104536 - protein, 13 aa, Homo sapiens
  heavy chain complementarity determining region 3 for antibody 52268
AKVRARIFRAPDH

SEQ ID NO: 104537 - protein, 9 aa, Homo sapiens
  light chain complementarity determining region 3 for antibody 52269
LQYNSFSWT

SEQ ID NO: 104538 - protein, 16 aa, Homo sapiens
  heavy chain complementarity determining region 3 for antibody 52269
ARITRKWPRANPVPDY

SEQ ID NO: 104539 - protein, 10 aa, Homo sapiens
  light chain complementarity determining region 3 for antibody 52270
IQRTHWPTWT

SEQ ID NO: 104540 - protein, 19 aa, Homo sapiens
  heavy chain complementarity determining region 3 for antibody 52270
ARVSGYCDMMTCYHPRLDS

SEQ ID NO: 104541 - protein, 9 aa, Homo sapiens
  light chain complementarity determining region 3 for antibody 52271
HQCATSPLT

SEQ ID NO: 104542 - protein, 10 aa, Homo sapiens
  heavy chain complementarity determining region 3 for antibody 52271
AGGYGWTSDY

SEQ ID NO: 104543 - protein, 8 aa, Homo sapiens
  light chain complementarity determining region 3 for antibody 52272
HHCIWPFP

SEQ ID NO: 104544 - protein, 12 aa, Homo sapiens
  heavy chain complementarity determining region 3 for antibody 52272
SAEFWNIGWQNR

SEQ ID NO: 104545 - protein, 9 aa, Homo sapiens
  light chain complementarity determining region 3 for antibody 52273
QQYYSTPLT

SEQ ID NO: 104546 - protein, 16 aa, Homo sapiens
  heavy chain complementarity determining region 3 for antibody 52273
ARDRGVGATPRSLYNY

SEQ ID NO: 104547 - protein, 10 aa, Homo sapiens
  light chain complementarity determining region 3 for antibody 52274
QQYNSYPLFT

SEQ ID NO: 104548 - protein, 22 aa, Homo sapiens
  heavy chain complementarity determining region 3 for antibody 52274
AREGGYCSGGRCDKYYHYGMDV

SEQ ID NO: 104549 - protein, 8 aa, Homo sapiens
  light chain complementarity determining region 3 for antibody 52275
QQYDTYWT

SEQ ID NO: 104550 - protein, 21 aa, Homo sapiens
  heavy chain complementarity determining region 3 for antibody 52275
AGREALCTNDCSDRGLNAFDI

SEQ ID NO: 104551 - protein, 8 aa, Homo sapiens
  light chain complementarity determining region 3 for antibody 52276
QQSYSTST

SEQ ID NO: 104552 - protein, 13 aa, Homo sapiens
  heavy chain complementarity determining region 3 for antibody 52276
ARESIGVASSFDY

SEQ ID NO: 104553 - protein, 9 aa, Homo sapiens
  light chain complementarity determining region 3 for antibody 52277
QQSYSTPLT

SEQ ID NO: 104554 - protein, 14 aa, Homo sapiens
  heavy chain complementarity determining region 3 for antibody 52277
ARGINRGFDYRFDF

SEQ ID NO: 104555 - protein, 9 aa, Homo sapiens
  light chain complementarity determining region 3 for antibody 52278
QQSGSSPYT

SEQ ID NO: 104556 - protein, 14 aa, Homo sapiens
  heavy chain complementarity determining region 3 for antibody 52278
ARKRSETGHWHFDL

SEQ ID NO: 104557 - protein, 9 aa, Homo sapiens
  light chain complementarity determining region 3 for antibody 52279
QNYDGDPLT

SEQ ID NO: 104558 - protein, 21 aa, Homo sapiens
  heavy chain complementarity determining region 3 for antibody 52279
ARHEEGDIVLVPAAMGGGFGY

SEQ ID NO: 104559 - protein, 9 aa, Homo sapiens
  light chain complementarity determining region 3 for antibody 52280
QKYNSYLYT

SEQ ID NO: 104560 - protein, 12 aa, Homo sapiens
  heavy chain complementarity determining region 3 for antibody 52280
ASGRYGDYHIDQ

SEQ ID NO: 104561 - protein, 9 aa, Homo sapiens
  light chain complementarity determining region 3 for antibody 52281
LQDYRYPRT

SEQ ID NO: 104562 - protein, 13 aa, Homo sapiens
  heavy chain complementarity determining region 3 for antibody 52281
ARRTDVDYYGLDV

SEQ ID NO: 104563 - protein, 9 aa, Homo sapiens
  light chain complementarity determining region 3 for antibody 52282
QQYYTYPLT

SEQ ID NO: 104564 - protein, 14 aa, Homo sapiens
  heavy chain complementarity determining region 3 for antibody 52282
ARVYRPYTDGAVGD

SEQ ID NO: 104565 - protein, 9 aa, Homo sapiens
  light chain complementarity determining region 3 for antibody 52283
QQYNTHSGT

SEQ ID NO: 104566 - protein, 14 aa, Homo sapiens
  heavy chain complementarity determining region 3 for antibody 52283
ARHWSDYSVPLISR

SEQ ID NO: 104567 - protein, 10 aa, Homo sapiens
  light chain complementarity determining region 3 for antibody 52284
QQYNSYSGGT

SEQ ID NO: 104568 - protein, 13 aa, Homo sapiens
  heavy chain complementarity determining region 3 for antibody 52284
ARLYYDSGRALDY

SEQ ID NO: 104569 - protein, 9 aa, Homo sapiens
  light chain complementarity determining region 3 for antibody 52285
QQYNSYPWT

SEQ ID NO: 104570 - protein, 13 aa, Homo sapiens
  heavy chain complementarity determining region 3 for antibody 52285
ARSASSVPGTLHY

SEQ ID NO: 104571 - protein, 9 aa, Homo sapiens
  light chain complementarity determining region 3 for antibody 52286
QQYNSFFYT

SEQ ID NO: 104572 - protein, 13 aa, Homo sapiens
  heavy chain complementarity determining region 3 for antibody 52286
ARRVLTGRSFFDY

SEQ ID NO: 104573 - protein, 8 aa, Homo sapiens
  light chain complementarity determining region 3 for antibody 52287
QQYGSVLT

SEQ ID NO: 104574 - protein, 8 aa, Homo sapiens
  heavy chain complementarity determining region 3 for antibody 52287
ARGGIVGP

SEQ ID NO: 104575 - protein, 8 aa, Homo sapiens
  light chain complementarity determining region 3 for antibody 52288
QQYGSSPA

SEQ ID NO: 104576 - protein, 13 aa, Homo sapiens
  heavy chain complementarity determining region 3 for antibody 52288
ATDSTIWGNGIDN

SEQ ID NO: 104577 - protein, 9 aa, Homo sapiens
  light chain complementarity determining region 3 for antibody 52289
QQYGDSPYT

SEQ ID NO: 104578 - protein, 12 aa, Homo sapiens
  heavy chain complementarity determining region 3 for antibody 52289
ARHTYSSGWYNY

SEQ ID NO: 104579 - protein, 9 aa, Homo sapiens
  light chain complementarity determining region 3 for antibody 52290
QQSYSTPRT

SEQ ID NO: 104580 - protein, 19 aa, Homo sapiens
  heavy chain complementarity determining region 3 for antibody 52290
ARAERDYESSGYYLYYFDS

SEQ ID NO: 104581 - protein, 9 aa, Homo sapiens
  light chain complementarity determining region 3 for antibody 52291
QQSYSTPHT

SEQ ID NO: 104582 - protein, 20 aa, Homo sapiens
  heavy chain complementarity determining region 3 for antibody 52291
ATRLEWLVRSGSYYYYGMDA

SEQ ID NO: 104583 - protein, 9 aa, Homo sapiens
  light chain complementarity determining region 3 for antibody 52292
QQSYSILRT

SEQ ID NO: 104584 - protein, 15 aa, Homo sapiens
  heavy chain complementarity determining region 3 for antibody 52292
ATSHLAAAGKRSLDY

SEQ ID NO: 104585 - protein, 8 aa, Homo sapiens
  light chain complementarity determining region 3 for antibody 52293
QQSYSART

SEQ ID NO: 104586 - protein, 13 aa, Homo sapiens
  heavy chain complementarity determining region 3 for antibody 52293
ARSGFGGGVYFDH

SEQ ID NO: 104587 - protein, 9 aa, Homo sapiens
  light chain complementarity determining region 3 for antibody 52294
QQSFSTPHT

SEQ ID NO: 104588 - protein, 13 aa, Homo sapiens
  heavy chain complementarity determining region 3 for antibody 52294
ARDSRMPDDAFDI

SEQ ID NO: 104589 - protein, 8 aa, Homo sapiens
  light chain complementarity determining region 3 for antibody 52295
QQLSPMFT

SEQ ID NO: 104590 - protein, 16 aa, Homo sapiens
  heavy chain complementarity determining region 3 for antibody 52295
ARGAGALWRRYYGLDV

SEQ ID NO: 104591 - protein, 9 aa, Homo sapiens
  light chain complementarity determining region 3 for antibody 52296
QQLNSYPLT

SEQ ID NO: 104592 - protein, 22 aa, Homo sapiens
  heavy chain complementarity determining region 3 for antibody 52296
AREVYSNSSGYYKDPAYDAFDI

SEQ ID NO: 104593 - protein, 10 aa, Homo sapiens
  light chain complementarity determining region 3 for antibody 52297
MQGLQSPPLT

SEQ ID NO: 104594 - protein, 16 aa, Homo sapiens
  heavy chain complementarity determining region 3 for antibody 52297
ARYARVGWTVYHAFDI

SEQ ID NO: 104595 - protein, 9 aa, Homo sapiens
  light chain complementarity determining region 3 for antibody 52298
MQGLETPQN

SEQ ID NO: 104596 - protein, 14 aa, Homo sapiens
  heavy chain complementarity determining region 3 for antibody 52298
ARDSLYRTLRRLDS

SEQ ID NO: 104597 - protein, 9 aa, Homo sapiens
  light chain complementarity determining region 3 for antibody 52299
QQYNSYPRT

SEQ ID NO: 104598 - protein, 9 aa, Homo sapiens
  heavy chain complementarity determining region 3 for antibody 52299
ASGKTRFDV

SEQ ID NO: 104599 - protein, 9 aa, Homo sapiens
  light chain complementarity determining region 3 for antibody 52300
QQYNDYPFT

SEQ ID NO: 104600 - protein, 24 aa, Homo sapiens
  heavy chain complementarity determining region 3 for antibody 52300
ARGGANVVVPDAVPRVRARWFFNL

SEQ ID NO: 104601 - protein, 10 aa, Homo sapiens
  light chain complementarity determining region 3 for antibody 52301
QQYNDWPLWT

SEQ ID NO: 104602 - protein, 10 aa, Homo sapiens
  heavy chain complementarity determining region 3 for antibody 52301
ARAFPSGYDY

SEQ ID NO: 104603 - protein, 10 aa, Homo sapiens
  light chain complementarity determining region 3 for antibody 52302
QQYDGSPPWT

SEQ ID NO: 104604 - protein, 16 aa, Homo sapiens
  heavy chain complementarity determining region 3 for antibody 52302
ATNYYDSSGQDWYFDL

SEQ ID NO: 104605 - protein, 9 aa, Homo sapiens
  light chain complementarity determining region 3 for antibody 52303
QQRRDWPLT

SEQ ID NO: 104606 - protein, 18 aa, Homo sapiens
  heavy chain complementarity determining region 3 for antibody 52303
TNTVHSGWNGVPYGPIAY

SEQ ID NO: 104607 - protein, 9 aa, Homo sapiens
  light chain complementarity determining region 3 for antibody 52304
QQLASYPLT

SEQ ID NO: 104608 - protein, 13 aa, Homo sapiens
  heavy chain complementarity determining region 3 for antibody 52304
ARRGNGGYEYFDL

SEQ ID NO: 104609 - protein, 10 aa, Homo sapiens
  light chain complementarity determining region 3 for antibody 52305
QHRYNWPPIT

SEQ ID NO: 104610 - protein, 9 aa, Homo sapiens
  heavy chain complementarity determining region 3 for antibody 52305
TRGGTYFDY

SEQ ID NO: 104611 - protein, 9 aa, Homo sapiens
  light chain complementarity determining region 3 for antibody 52306
LQHNSYPRT

SEQ ID NO: 104612 - protein, 20 aa, Homo sapiens
  heavy chain complementarity determining region 3 for antibody 52306
ARDGYYYDSSGYFVGLIFDY

SEQ ID NO: 104613 - protein, 10 aa, Homo sapiens
  light chain complementarity determining region 3 for antibody 52307
QRYGYSPPWT

SEQ ID NO: 104614 - protein, 15 aa, Homo sapiens
  heavy chain complementarity determining region 3 for antibody 52307
ATRGERLRPRGAFDI

SEQ ID NO: 104615 - protein, 9 aa, Homo sapiens
  light chain complementarity determining region 3 for antibody 52308
QQYREYPYT

SEQ ID NO: 104616 - protein, 15 aa, Homo sapiens
  heavy chain complementarity determining region 3 for antibody 52308
ATDRGINWAYSRFDS

SEQ ID NO: 104617 - protein, 9 aa, Homo sapiens
  light chain complementarity determining region 3 for antibody 52309
QQYNTLQWT

SEQ ID NO: 104618 - protein, 14 aa, Homo sapiens
  heavy chain complementarity determining region 3 for antibody 52309
ARKMGWYGVAWFDP

SEQ ID NO: 104619 - protein, 9 aa, Homo sapiens
  light chain complementarity determining region 3 for antibody 52310
QQYNSYPYT

SEQ ID NO: 104620 - protein, 15 aa, Homo sapiens
  heavy chain complementarity determining region 3 for antibody 52310
AKGPGFAYGKKYFHH

SEQ ID NO: 104621 - protein, 9 aa, Homo sapiens
  light chain complementarity determining region 3 for antibody 52311
QQYKSYPWT

SEQ ID NO: 104622 - protein, 10 aa, Homo sapiens
  heavy chain complementarity determining region 3 for antibody 52311
ARDSGYGIEC

SEQ ID NO: 104623 - protein, 9 aa, Homo sapiens
  light chain complementarity determining region 3 for antibody 52312
QQSYSLSRT

SEQ ID NO: 104624 - protein, 19 aa, Homo sapiens
  heavy chain complementarity determining region 3 for antibody 52312
ARESNYYESDNNYRRLFDM

SEQ ID NO: 104625 - protein, 10 aa, Homo sapiens
  light chain complementarity determining region 3 for antibody 52313
QQSYITPSVT

SEQ ID NO: 104626 - protein, 19 aa, Homo sapiens
  heavy chain complementarity determining region 3 for antibody 52313
AKDPGFRYTNGWYEGSFDY

SEQ ID NO: 104627 - protein, 10 aa, Homo sapiens
  light chain complementarity determining region 3 for antibody 52314
QQSYGTWTWT

SEQ ID NO: 104628 - protein, 14 aa, Homo sapiens
  heavy chain complementarity determining region 3 for antibody 52314
AGLRHSSGPVGFDY

SEQ ID NO: 104629 - protein, 7 aa, Homo sapiens
  light chain complementarity determining region 3 for antibody 52315
QQRRGFT

SEQ ID NO: 104630 - protein, 13 aa, Homo sapiens
  heavy chain complementarity determining region 3 for antibody 52315
ARETVLRGVIEVY

SEQ ID NO: 104631 - protein, 9 aa, Homo sapiens
  light chain complementarity determining region 3 for antibody 52316
QQCYSFPYT

SEQ ID NO: 104632 - protein, 14 aa, Homo sapiens
  heavy chain complementarity determining region 3 for antibody 52316
ARKMGWDGVARFDP

SEQ ID NO: 104633 - protein, 9 aa, Homo sapiens
  light chain complementarity determining region 3 for antibody 52317
QHYHNLPIT

SEQ ID NO: 104634 - protein, 15 aa, Homo sapiens
  heavy chain complementarity determining region 3 for antibody 52317
ARVRGGTYPRNAFDI

SEQ ID NO: 104635 - protein, 11 aa, Homo sapiens
  light chain complementarity determining region 3 for antibody 52318
MQALQTPPRLT

SEQ ID NO: 104636 - protein, 15 aa, Homo sapiens
  heavy chain complementarity determining region 3 for antibody 52318
ARHSAPRVTTNWFDP

SEQ ID NO: 104637 - protein, 9 aa, Homo sapiens
  light chain complementarity determining region 3 for antibody 52319
LQHNSYPRT

SEQ ID NO: 104638 - protein, 15 aa, Homo sapiens
  heavy chain complementarity determining region 3 for antibody 52319
ARGSSSWTSGPYFDY

SEQ ID NO: 104639 - protein, 9 aa, Homo sapiens
  light chain complementarity determining region 3 for antibody 52320
HQRSNWPYT

SEQ ID NO: 104640 - protein, 13 aa, Homo sapiens
  heavy chain complementarity determining region 3 for antibody 52320
AKDLPDHWMVLDS

SEQ ID NO: 104641 - protein, 9 aa, Homo sapiens
  light chain complementarity determining region 3 for antibody 52321
QQYTNLPPV

SEQ ID NO: 104642 - protein, 9 aa, Homo sapiens
  heavy chain complementarity determining region 3 for antibody 52321
ARGEDWFDP

SEQ ID NO: 104643 - protein, 8 aa, Homo sapiens
  light chain complementarity determining region 3 for antibody 52322
QQYNSYST

SEQ ID NO: 104644 - protein, 19 aa, Homo sapiens
  heavy chain complementarity determining region 3 for antibody 52322
ARERGRTIFGVVIAYYFDY

SEQ ID NO: 104645 - protein, 9 aa, Homo sapiens
  light chain complementarity determining region 3 for antibody 52323
QQYNNYPRT

SEQ ID NO: 104646 - protein, 14 aa, Homo sapiens
  heavy chain complementarity determining region 3 for antibody 52323
ARGLGARTGRYFDL

SEQ ID NO: 104647 - protein, 9 aa, Homo sapiens
  light chain complementarity determining region 3 for antibody 52324
QQYGSSPET

SEQ ID NO: 104648 - protein, 19 aa, Homo sapiens
  heavy chain complementarity determining region 3 for antibody 52324
ARYCTSTSCELGHQYGLDV

SEQ ID NO: 104649 - protein, 8 aa, Homo sapiens
  light chain complementarity determining region 3 for antibody 52325
QQYGSSHT

SEQ ID NO: 104650 - protein, 14 aa, Homo sapiens
  heavy chain complementarity determining region 3 for antibody 52325
TRHSDTFYSSSYFD

SEQ ID NO: 104651 - protein, 10 aa, Homo sapiens
  light chain complementarity determining region 3 for antibody 52326
QQYDNLPMYT

SEQ ID NO: 104652 - protein, 14 aa, Homo sapiens
  heavy chain complementarity determining region 3 for antibody 52326
ARDPFSGAPDYFDY

SEQ ID NO: 104653 - protein, 9 aa, Homo sapiens
  light chain complementarity determining region 3 for antibody 52327
QQSYSTSWT

SEQ ID NO: 104654 - protein, 16 aa, Homo sapiens
  heavy chain complementarity determining region 3 for antibody 52327
ATDGTPGIMGMVYFDY

SEQ ID NO: 104655 - protein, 9 aa, Homo sapiens
  light chain complementarity determining region 3 for antibody 52328
QQSYSTPRT

SEQ ID NO: 104656 - protein, 11 aa, Homo sapiens
  heavy chain complementarity determining region 3 for antibody 52328
ATLGIGNAFDI

SEQ ID NO: 104657 - protein, 9 aa, Homo sapiens
  light chain complementarity determining region 3 for antibody 52329
QQSYSSPWT

SEQ ID NO: 104658 - protein, 10 aa, Homo sapiens
  heavy chain complementarity determining region 3 for antibody 52329
ARVSNQGFDP

SEQ ID NO: 104659 - protein, 6 aa, Homo sapiens
  light chain complementarity determining region 3 for antibody 52330
QQLDSE

SEQ ID NO: 104660 - protein, 15 aa, Homo sapiens
  heavy chain complementarity determining region 3 for antibody 52330
ATTVPFNYDTGGYGN

SEQ ID NO: 104661 - protein, 9 aa, Homo sapiens
  light chain complementarity determining region 3 for antibody 52331
LQYNSYPRT

SEQ ID NO: 104662 - protein, 19 aa, Homo sapiens
  heavy chain complementarity determining region 3 for antibody 52331
ATGWGIYSGYDWEADAFDI

SEQ ID NO: 104663 - protein, 9 aa, Homo sapiens
  light chain complementarity determining region 3 for antibody 52332
LQRHSWPQT

SEQ ID NO: 104664 - protein, 10 aa, Homo sapiens
  heavy chain complementarity determining region 3 for antibody 52332
ARWSGVYYDF

SEQ ID NO: 104665 - protein, 9 aa, Homo sapiens
  light chain complementarity determining region 3 for antibody 52333
HQYDRSPLT

SEQ ID NO: 104666 - protein, 13 aa, Homo sapiens
  heavy chain complementarity determining region 3 for antibody 52333
ARRQTYTNYAFDI

SEQ ID NO: 104667 - protein, 9 aa, Homo sapiens
  light chain complementarity determining region 3 for antibody 52334
QQYNSYSWT

SEQ ID NO: 104668 - protein, 11 aa, Homo sapiens
  heavy chain complementarity determining region 3 for antibody 52334
ARTGYSDCFDY

SEQ ID NO: 104669 - protein, 10 aa, Homo sapiens
  light chain complementarity determining region 3 for antibody 52335
QQYNNWPPYT

SEQ ID NO: 104670 - protein, 17 aa, Homo sapiens
  heavy chain complementarity determining region 3 for antibody 52335
AGGGGSAEQYMYPPNNY

SEQ ID NO: 104671 - protein, 9 aa, Homo sapiens
  light chain complementarity determining region 3 for antibody 52336
QQYGSSPVT

SEQ ID NO: 104672 - protein, 14 aa, Homo sapiens
  heavy chain complementarity determining region 3 for antibody 52336
ARDLTIFGRSTLGY

SEQ ID NO: 104673 - protein, 11 aa, Homo sapiens
  light chain complementarity determining region 3 for antibody 52337
QQYGSSPSLYT

SEQ ID NO: 104674 - protein, 23 aa, Homo sapiens
  heavy chain complementarity determining region 3 for antibody 52337
ARGGYDYLWGSYRYPERGYYFDY

SEQ ID NO: 104675 - protein, 8 aa, Homo sapiens
  light chain complementarity determining region 3 for antibody 52338
QQYAISWT

SEQ ID NO: 104676 - protein, 15 aa, Homo sapiens
  heavy chain complementarity determining region 3 for antibody 52338
ARGCGGDCYGDALDI

SEQ ID NO: 104677 - protein, 9 aa, Homo sapiens
  light chain complementarity determining region 3 for antibody 52339
QQTYITPWT

SEQ ID NO: 104678 - protein, 17 aa, Homo sapiens
  heavy chain complementarity determining region 3 for antibody 52339
ARDRWGTDYYYNYYMDV

SEQ ID NO: 104679 - protein, 9 aa, Homo sapiens
  light chain complementarity determining region 3 for antibody 52340
QQSYTTPYT

SEQ ID NO: 104680 - protein, 14 aa, Homo sapiens
  heavy chain complementarity determining region 3 for antibody 52340
TRERSIAVAKPFDY

SEQ ID NO: 104681 - protein, 9 aa, Homo sapiens
  light chain complementarity determining region 3 for antibody 52341
QQSYSTLYT

SEQ ID NO: 104682 - protein, 15 aa, Homo sapiens
  heavy chain complementarity determining region 3 for antibody 52341
ARRGYYGPGKMAYDI

SEQ ID NO: 104683 - protein, 9 aa, Homo sapiens
  light chain complementarity determining region 3 for antibody 52342
QQSYSTLFT

SEQ ID NO: 104684 - protein, 15 aa, Homo sapiens
  heavy chain complementarity determining region 3 for antibody 52342
ARASGWQFESYSMDV

SEQ ID NO: 104685 - protein, 9 aa, Homo sapiens
  light chain complementarity determining region 3 for antibody 52343
QQSYSIPST

SEQ ID NO: 104686 - protein, 16 aa, Homo sapiens
  heavy chain complementarity determining region 3 for antibody 52343
ARDRSQGQWLVSIFDS

SEQ ID NO: 104687 - protein, 9 aa, Homo sapiens
  light chain complementarity determining region 3 for antibody 52344
QQSYGTPRT

SEQ ID NO: 104688 - protein, 18 aa, Homo sapiens
  heavy chain complementarity determining region 3 for antibody 52344
ARGAAYSSGWTGINWFDP

SEQ ID NO: 104689 - protein, 9 aa, Homo sapiens
  light chain complementarity determining region 3 for antibody 52345
QQSNRFPPI

SEQ ID NO: 104690 - protein, 18 aa, Homo sapiens
  heavy chain complementarity determining region 3 for antibody 52345
ARRRAQDYYDSSANIFDY

SEQ ID NO: 104691 - protein, 9 aa, Homo sapiens
  light chain complementarity determining region 3 for antibody 52346
QQSFSTPRT

SEQ ID NO: 104692 - protein, 13 aa, Homo sapiens
  heavy chain complementarity determining region 3 for antibody 52346
ARGDLHYNYGMDV

SEQ ID NO: 104693 - protein, 9 aa, Homo sapiens
  light chain complementarity determining region 3 for antibody 52347
QQAYIFPLT

SEQ ID NO: 104694 - protein, 24 aa, Homo sapiens
  heavy chain complementarity determining region 3 for antibody 52347
ARDRDGSGGASLPRTRYYYYGLHV

SEQ ID NO: 104695 - protein, 9 aa, Homo sapiens
  light chain complementarity determining region 3 for antibody 52348
QQANSFPYT

SEQ ID NO: 104696 - protein, 20 aa, Homo sapiens
  heavy chain complementarity determining region 3 for antibody 52348
ARDASYYYDIRGNYYYGMDV

SEQ ID NO: 104697 - protein, 9 aa, Homo sapiens
  light chain complementarity determining region 3 for antibody 52349
MQALQTPYT

SEQ ID NO: 104698 - protein, 14 aa, Homo sapiens
  heavy chain complementarity determining region 3 for antibody 52349
ARRRIAAFQDAFDI

SEQ ID NO: 104699 - protein, 10 aa, Homo sapiens
  light chain complementarity determining region 3 for antibody 52350
QQYYDRPPWT

SEQ ID NO: 104700 - protein, 20 aa, Homo sapiens
  heavy chain complementarity determining region 3 for antibody 52350
ARSSYYDSEVVGRLTSAFDI

SEQ ID NO: 104701 - protein, 10 aa, Homo sapiens
  light chain complementarity determining region 3 for antibody 52351
QQYGSSPPFT

SEQ ID NO: 104702 - protein, 13 aa, Homo sapiens
  heavy chain complementarity determining region 3 for antibody 52351
AVIDWGTVSLRHG

SEQ ID NO: 104703 - protein, 9 aa, Homo sapiens
  light chain complementarity determining region 3 for antibody 52352
QQTYTTPLT

SEQ ID NO: 104704 - protein, 18 aa, Homo sapiens
  heavy chain complementarity determining region 3 for antibody 52352
AMIRWDKRLTWYEGPPAY

SEQ ID NO: 104705 - protein, 9 aa, Homo sapiens
  light chain complementarity determining region 3 for antibody 52353
QQSYSTPWT

SEQ ID NO: 104706 - protein, 19 aa, Homo sapiens
  heavy chain complementarity determining region 3 for antibody 52353
ARDLEDRSGYHYLRSPVHY

SEQ ID NO: 104707 - protein, 9 aa, Homo sapiens
  light chain complementarity determining region 3 for antibody 52354
QQSYSTPRT

SEQ ID NO: 104708 - protein, 15 aa, Homo sapiens
  heavy chain complementarity determining region 3 for antibody 52354
ARGSSSWTSGPYFDY

SEQ ID NO: 104709 - protein, 9 aa, Homo sapiens
  light chain complementarity determining region 3 for antibody 52355
QQSYSTLYT

SEQ ID NO: 104710 - protein, 12 aa, Homo sapiens
  heavy chain complementarity determining region 3 for antibody 52355
VREAPRTSHWKN

SEQ ID NO: 104711 - protein, 9 aa, Homo sapiens
  light chain complementarity determining region 3 for antibody 52356
QQSYSAPRT

SEQ ID NO: 104712 - protein, 13 aa, Homo sapiens
  heavy chain complementarity determining region 3 for antibody 52356
STDCTNGVCAFDY

SEQ ID NO: 104713 - protein, 10 aa, Homo sapiens
  light chain complementarity determining region 3 for antibody 52357
QQSLTAPQIT

SEQ ID NO: 104714 - protein, 20 aa, Homo sapiens
  heavy chain complementarity determining region 3 for antibody 52357
ARPSSEYFNGANYYPEAFQT

SEQ ID NO: 104715 - protein, 9 aa, Homo sapiens
  light chain complementarity determining region 3 for antibody 52358
QQCYSFPYT

SEQ ID NO: 104716 - protein, 14 aa, Homo sapiens
  heavy chain complementarity determining region 3 for antibody 52358
ARMMGWDGVAWFDP

SEQ ID NO: 104717 - protein, 9 aa, Homo sapiens
  light chain complementarity determining region 3 for antibody 52359
QHSINIPYS

SEQ ID NO: 104718 - protein, 17 aa, Homo sapiens
  heavy chain complementarity determining region 3 for antibody 52359
ARDAGTCSTSNCHHFDS

SEQ ID NO: 104719 - protein, 9 aa, Homo sapiens
  light chain complementarity determining region 3 for antibody 52360
MQGTHWPYT

SEQ ID NO: 104720 - protein, 10 aa, Homo sapiens
  heavy chain complementarity determining region 3 for antibody 52360
ARASSRSFSF

SEQ ID NO: 104721 - protein, 10 aa, Homo sapiens
  light chain complementarity determining region 3 for antibody 52361
LQRSIWPRFT

SEQ ID NO: 104722 - protein, 10 aa, Homo sapiens
  heavy chain complementarity determining region 3 for antibody 52361
ARDSGGYPDY

SEQ ID NO: 104723 - protein, 9 aa, Homo sapiens
  light chain complementarity determining region 3 for antibody 52362
LQHNSFPMT

SEQ ID NO: 104724 - protein, 17 aa, Homo sapiens
  heavy chain complementarity determining region 3 for antibody 52362
ARAGVRLGELSSDAFDV

SEQ ID NO: 104725 - protein, 9 aa, Homo sapiens
  light chain complementarity determining region 3 for antibody 52363
HQYDDLPIT

SEQ ID NO: 104726 - protein, 18 aa, Homo sapiens
  heavy chain complementarity determining region 3 for antibody 52363
ARDPTEVYSGDGGYDLDY

SEQ ID NO: 104727 - protein, 9 aa, Homo sapiens
  light chain complementarity determining region 3 for antibody 52364
VQGLQTPLT

SEQ ID NO: 104728 - protein, 16 aa, Homo sapiens
  heavy chain complementarity determining region 3 for antibody 52364
ASGPTGDSSGFSNFDF

SEQ ID NO: 104729 - protein, 9 aa, Homo sapiens
  light chain complementarity determining region 3 for antibody 52365
QQYYSTPLT

SEQ ID NO: 104730 - protein, 19 aa, Homo sapiens
  heavy chain complementarity determining region 3 for antibody 52365
ARSPQLWFGELLWNPYFDY

SEQ ID NO: 104731 - protein, 9 aa, Homo sapiens
  light chain complementarity determining region 3 for antibody 52366
QQYNSYPWM

SEQ ID NO: 104732 - protein, 7 aa, Homo sapiens
  heavy chain complementarity determining region 3 for antibody 52366
SPVSGRY

SEQ ID NO: 104733 - protein, 10 aa, Homo sapiens
  light chain complementarity determining region 3 for antibody 52367
QQYGSSRTLS

SEQ ID NO: 104734 - protein, 21 aa, Homo sapiens
  heavy chain complementarity determining region 3 for antibody 52367
ARAISEGSLEWLFYVNDAFDI

SEQ ID NO: 104735 - protein, 9 aa, Homo sapiens
  light chain complementarity determining region 3 for antibody 52368
QQYFTSPRT

SEQ ID NO: 104736 - protein, 15 aa, Homo sapiens
  heavy chain complementarity determining region 3 for antibody 52368
AGSPISSGGDYFFDS

SEQ ID NO: 104737 - protein, 9 aa, Homo sapiens
  light chain complementarity determining region 3 for antibody 52369
QQYDKYSWT

SEQ ID NO: 104738 - protein, 19 aa, Homo sapiens
  heavy chain complementarity determining region 3 for antibody 52369
VRLRDCTNRVCDTYWFFDM

SEQ ID NO: 104739 - protein, 9 aa, Homo sapiens
  light chain complementarity determining region 3 for antibody 52370
QQSYSTRFT

SEQ ID NO: 104740 - protein, 17 aa, Homo sapiens
  heavy chain complementarity determining region 3 for antibody 52370
ARLTEAVAGTLSDAFDI

SEQ ID NO: 104741 - protein, 9 aa, Homo sapiens
  light chain complementarity determining region 3 for antibody 52371
QQSYSTPYT

SEQ ID NO: 104742 - protein, 10 aa, Homo sapiens
  heavy chain complementarity determining region 3 for antibody 52371
ARDLRGSYGD

SEQ ID NO: 104743 - protein, 8 aa, Homo sapiens
  light chain complementarity determining region 3 for antibody 52372
QQSYRAPS

SEQ ID NO: 104744 - protein, 16 aa, Homo sapiens
  heavy chain complementarity determining region 3 for antibody 52372
ARSMDWGGTRWPYFDY

SEQ ID NO: 104745 - protein, 9 aa, Homo sapiens
  light chain complementarity determining region 3 for antibody 52373
QQRSNWPPT

SEQ ID NO: 104746 - protein, 17 aa, Homo sapiens
  heavy chain complementarity determining region 3 for antibody 52373
AHLMTPRKYYYYYGMDV

SEQ ID NO: 104747 - protein, 9 aa, Homo sapiens
  light chain complementarity determining region 3 for antibody 52374
QQGDIAPLT

SEQ ID NO: 104748 - protein, 14 aa, Homo sapiens
  heavy chain complementarity determining region 3 for antibody 52374
TRRMSYGSDWYIDF

SEQ ID NO: 104749 - protein, 9 aa, Homo sapiens
  light chain complementarity determining region 3 for antibody 52375
QHSINFPYT

SEQ ID NO: 104750 - protein, 17 aa, Homo sapiens
  heavy chain complementarity determining region 3 for antibody 52375
ARDSGTCITSNCHHFDS

SEQ ID NO: 104751 - protein, 9 aa, Homo sapiens
  light chain complementarity determining region 3 for antibody 52376
QHHNSYPWT

SEQ ID NO: 104752 - protein, 22 aa, Homo sapiens
  heavy chain complementarity determining region 3 for antibody 52376
ARDQEVITMIRGGKTYYYGMDV

SEQ ID NO: 104753 - protein, 9 aa, Homo sapiens
  light chain complementarity determining region 3 for antibody 52377
MQGTHWPPT

SEQ ID NO: 104754 - protein, 15 aa, Homo sapiens
  heavy chain complementarity determining region 3 for antibody 52377
ARGGGPYYDSSGYQQ

SEQ ID NO: 104755 - protein, 8 aa, Homo sapiens
  light chain complementarity determining region 3 for antibody 52378
HVRSNWLT

SEQ ID NO: 104756 - protein, 9 aa, Homo sapiens
  heavy chain complementarity determining region 3 for antibody 52378
ARGWLQPDN

SEQ ID NO: 104757 - protein, 8 aa, Homo sapiens
  light chain complementarity determining region 3 for antibody 52379
QQYNRFWT

SEQ ID NO: 104758 - protein, 15 aa, Homo sapiens
  heavy chain complementarity determining region 3 for antibody 52379
VKSWGDRGDYVTLDS

SEQ ID NO: 104759 - protein, 8 aa, Homo sapiens
  light chain complementarity determining region 3 for antibody 52380
QQYKSYWT

SEQ ID NO: 104760 - protein, 15 aa, Homo sapiens
  heavy chain complementarity determining region 3 for antibody 52380
AKETPPLVRLGYFDY

SEQ ID NO: 104761 - protein, 9 aa, Homo sapiens
  light chain complementarity determining region 3 for antibody 52381
QQYHSYPYT

SEQ ID NO: 104762 - protein, 12 aa, Homo sapiens
  heavy chain complementarity determining region 3 for antibody 52381
AKDGGGTAHWGY

SEQ ID NO: 104763 - protein, 10 aa, Homo sapiens
  light chain complementarity determining region 3 for antibody 52382
QQYGSSPLYS

SEQ ID NO: 104764 - protein, 12 aa, Homo sapiens
  heavy chain complementarity determining region 3 for antibody 52382
ARTSDGWHYFDN

SEQ ID NO: 104765 - protein, 9 aa, Homo sapiens
  light chain complementarity determining region 3 for antibody 52383
QQYGSSPET

SEQ ID NO: 104766 - protein, 15 aa, Homo sapiens
  heavy chain complementarity determining region 3 for antibody 52383
ARGVSDGSRYWWFDP

SEQ ID NO: 104767 - protein, 9 aa, Homo sapiens
  light chain complementarity determining region 3 for antibody 52384
QQYGNSPWT

SEQ ID NO: 104768 - protein, 20 aa, Homo sapiens
  heavy chain complementarity determining region 3 for antibody 52384
ARQNDYFSDGWRFPLGWFDS

SEQ ID NO: 104769 - protein, 8 aa, Homo sapiens
  light chain complementarity determining region 3 for antibody 52385
QQYDRSPS

SEQ ID NO: 104770 - protein, 18 aa, Homo sapiens
  heavy chain complementarity determining region 3 for antibody 52385
ASGGDSFGLKPPYNWFDL

SEQ ID NO: 104771 - protein, 9 aa, Homo sapiens
  light chain complementarity determining region 3 for antibody 52386
QQYARSPWT

SEQ ID NO: 104772 - protein, 12 aa, Homo sapiens
  heavy chain complementarity determining region 3 for antibody 52386
ARDHEAFGDFAT

SEQ ID NO: 104773 - protein, 9 aa, Homo sapiens
  light chain complementarity determining region 3 for antibody 52387
QQTKSFPLT

SEQ ID NO: 104774 - protein, 16 aa, Homo sapiens
  heavy chain complementarity determining region 3 for antibody 52387
SRPYYDRLTGYSEGGY

SEQ ID NO: 104775 - protein, 10 aa, Homo sapiens
  light chain complementarity determining region 3 for antibody 52388
QQSYSTPMST

SEQ ID NO: 104776 - protein, 18 aa, Homo sapiens
  heavy chain complementarity determining region 3 for antibody 52388
ARDDRRYSSGSYVECLDY

SEQ ID NO: 104777 - protein, 9 aa, Homo sapiens
  light chain complementarity determining region 3 for antibody 52389
QQSFSTRWT

SEQ ID NO: 104778 - protein, 20 aa, Homo sapiens
  heavy chain complementarity determining region 3 for antibody 52389
ARERRGLSSIVVVTTTGFDL

SEQ ID NO: 104779 - protein, 15 aa, Homo sapiens
  light chain complementarity determining region 3 for antibody 52390
QQLNSQQLNSYVLFT

SEQ ID NO: 104780 - protein, 13 aa, Homo sapiens
  heavy chain complementarity determining region 3 for antibody 52390
ARMAVRLHDAFDI

SEQ ID NO: 104781 - protein, 8 aa, Homo sapiens
  light chain complementarity determining region 3 for antibody 52391
QQHGDSHT

SEQ ID NO: 104782 - protein, 17 aa, Homo sapiens
  heavy chain complementarity determining region 3 for antibody 52391
ARGNFDWLATFYYGLDV

SEQ ID NO: 104783 - protein, 9 aa, Homo sapiens
  light chain complementarity determining region 3 for antibody 52392
QQANSFPRT

SEQ ID NO: 104784 - protein, 10 aa, Homo sapiens
  heavy chain complementarity determining region 3 for antibody 52392
AGGSPNQFDH

SEQ ID NO: 104785 - protein, 9 aa, Homo sapiens
  light chain complementarity determining region 3 for antibody 52393
QQANSFPPT

SEQ ID NO: 104786 - protein, 12 aa, Homo sapiens
  heavy chain complementarity determining region 3 for antibody 52393
ATALSLYSSSGV

SEQ ID NO: 104787 - protein, 9 aa, Homo sapiens
  light chain complementarity determining region 3 for antibody 52394
MQVLQTPLT

SEQ ID NO: 104788 - protein, 14 aa, Homo sapiens
  heavy chain complementarity determining region 3 for antibody 52394
ARGGTPAAAGPFDN

SEQ ID NO: 104789 - protein, 10 aa, Homo sapiens
  light chain complementarity determining region 3 for antibody 52395
YQYEHLPPYT

SEQ ID NO: 104790 - protein, 12 aa, Homo sapiens
  heavy chain complementarity determining region 3 for antibody 52395
STHRRGGHQFEY

SEQ ID NO: 104791 - protein, 8 aa, Homo sapiens
  light chain complementarity determining region 3 for antibody 52396
QQYNNWPL

SEQ ID NO: 104792 - protein, 22 aa, Homo sapiens
  heavy chain complementarity determining region 3 for antibody 52396
ARGTDYSDSSSWGLGLLGYFDY

SEQ ID NO: 104793 - protein, 9 aa, Homo sapiens
  light chain complementarity determining region 3 for antibody 52397
QQYNDYSWT

SEQ ID NO: 104794 - protein, 10 aa, Homo sapiens
  heavy chain complementarity determining region 3 for antibody 52397
ARPVSEEGID

SEQ ID NO: 104795 - protein, 9 aa, Homo sapiens
  light chain complementarity determining region 3 for antibody 52398
QQYKSSPLT

SEQ ID NO: 104796 - protein, 15 aa, Homo sapiens
  heavy chain complementarity determining region 3 for antibody 52398
AKDMAPRRTLDAFDI

SEQ ID NO: 104797 - protein, 9 aa, Homo sapiens
  light chain complementarity determining region 3 for antibody 52399
QQYGTSPFT

SEQ ID NO: 104798 - protein, 9 aa, Homo sapiens
  heavy chain complementarity determining region 3 for antibody 52399
ARGRTYSTH

SEQ ID NO: 104799 - protein, 8 aa, Homo sapiens
  light chain complementarity determining region 3 for antibody 52400
QQYGSSPP

SEQ ID NO: 104800 - protein, 13 aa, Homo sapiens
  heavy chain complementarity determining region 3 for antibody 52400
ARQGFGGLHLIRP

SEQ ID NO: 104801 - protein, 9 aa, Homo sapiens
  light chain complementarity determining region 3 for antibody 52401
QQYFNIPPT

SEQ ID NO: 104802 - protein, 17 aa, Homo sapiens
  heavy chain complementarity determining region 3 for antibody 52401
ARGPLIRGLIVPVPLDY

SEQ ID NO: 104803 - protein, 9 aa, Homo sapiens
  light chain complementarity determining region 3 for antibody 52402
QQYASPPIT

SEQ ID NO: 104804 - protein, 10 aa, Homo sapiens
  heavy chain complementarity determining region 3 for antibody 52402
AGGSGWLVDY

SEQ ID NO: 104805 - protein, 9 aa, Homo sapiens
  light chain complementarity determining region 3 for antibody 52403
QQSYSTSLT

SEQ ID NO: 104806 - protein, 14 aa, Homo sapiens
  heavy chain complementarity determining region 3 for antibody 52403
ARIALMGRVKTFDI

SEQ ID NO: 104807 - protein, 9 aa, Homo sapiens
  light chain complementarity determining region 3 for antibody 52404
QQSYSNTLT

SEQ ID NO: 104808 - protein, 19 aa, Homo sapiens
  heavy chain complementarity determining region 3 for antibody 52404
ARDSTYQHDSGGYLHCFDY

SEQ ID NO: 104809 - protein, 9 aa, Homo sapiens
  light chain complementarity determining region 3 for antibody 52405
QQCAGSSWT

SEQ ID NO: 104810 - protein, 18 aa, Homo sapiens
  heavy chain complementarity determining region 3 for antibody 52405
ARVRNYYETSTYYYYMDV

SEQ ID NO: 104811 - protein, 9 aa, Homo sapiens
  light chain complementarity determining region 3 for antibody 52406
QHYDEYSAT

SEQ ID NO: 104812 - protein, 17 aa, Homo sapiens
  heavy chain complementarity determining region 3 for antibody 52406
ARDRGEPNYFYYFYMEV

SEQ ID NO: 104813 - protein, 9 aa, Homo sapiens
  light chain complementarity determining region 3 for antibody 52407
LQHYNFPWT

SEQ ID NO: 104814 - protein, 18 aa, Homo sapiens
  heavy chain complementarity determining region 3 for antibody 52407
ATRIAEAGNNTYYYGLEV

SEQ ID NO: 104815 - protein, 9 aa, Homo sapiens
  light chain complementarity determining region 3 for antibody 52408
QQYNNWPLT

SEQ ID NO: 104816 - protein, 25 aa, Homo sapiens
  heavy chain complementarity determining region 3 for antibody 52408
ASGRVTFRGYGSGSYYNNGRGPFDY

SEQ ID NO: 104817 - protein, 8 aa, Homo sapiens
  light chain complementarity determining region 3 for antibody 52409
QQYGSSIT

SEQ ID NO: 104818 - protein, 22 aa, Homo sapiens
  heavy chain complementarity determining region 3 for antibody 52409
ARGGNNFFHDSSGYPDGHSLDI

SEQ ID NO: 104819 - protein, 9 aa, Homo sapiens
  light chain complementarity determining region 3 for antibody 52410
QQYGNSPWT

SEQ ID NO: 104820 - protein, 11 aa, Homo sapiens
  heavy chain complementarity determining region 3 for antibody 52410
AREEWELPLDY

SEQ ID NO: 104821 - protein, 9 aa, Homo sapiens
  light chain complementarity determining region 3 for antibody 52411
QQYDNWPLL

SEQ ID NO: 104822 - protein, 18 aa, Homo sapiens
  heavy chain complementarity determining region 3 for antibody 52411
ARDRGYDTSGYYHKNFDY

SEQ ID NO: 104823 - protein, 9 aa, Homo sapiens
  light chain complementarity determining region 3 for antibody 52412
QQSYSTPYT

SEQ ID NO: 104824 - protein, 14 aa, Homo sapiens
  heavy chain complementarity determining region 3 for antibody 52412
ARVSVTTFKDAFDI

SEQ ID NO: 104825 - protein, 10 aa, Homo sapiens
  light chain complementarity determining region 3 for antibody 52413
QQSYSTPPFT

SEQ ID NO: 104826 - protein, 15 aa, Homo sapiens
  heavy chain complementarity determining region 3 for antibody 52413
TRRGYYGPGKMAYDI

SEQ ID NO: 104827 - protein, 9 aa, Homo sapiens
  light chain complementarity determining region 3 for antibody 52414
QQSFRTPGT

SEQ ID NO: 104828 - protein, 17 aa, Homo sapiens
  heavy chain complementarity determining region 3 for antibody 52414
ARALGAPYSGYDGPYDF

SEQ ID NO: 104829 - protein, 8 aa, Homo sapiens
  light chain complementarity determining region 3 for antibody 52415
QQRAVWLT

SEQ ID NO: 104830 - protein, 11 aa, Homo sapiens
  heavy chain complementarity determining region 3 for antibody 52415
ARDRGGDFWNV

SEQ ID NO: 104831 - protein, 9 aa, Homo sapiens
  light chain complementarity determining region 3 for antibody 52416
QQLNSYPPT

SEQ ID NO: 104832 - protein, 16 aa, Homo sapiens
  heavy chain complementarity determining region 3 for antibody 52416
ARDRMQFTSHSSWPDY

SEQ ID NO: 104833 - protein, 9 aa, Homo sapiens
  light chain complementarity determining region 3 for antibody 52417
QQLNSYLVT

SEQ ID NO: 104834 - protein, 22 aa, Homo sapiens
  heavy chain complementarity determining region 3 for antibody 52417
ARTRGDIVATIKGTYYYYGMDV

SEQ ID NO: 104835 - protein, 10 aa, Homo sapiens
  light chain complementarity determining region 3 for antibody 52418
QQFGRSPPYT

SEQ ID NO: 104836 - protein, 24 aa, Homo sapiens
  heavy chain complementarity determining region 3 for antibody 52418
AKGSREYYDFWTGSIYYYYYGLDV

SEQ ID NO: 104837 - protein, 9 aa, Homo sapiens
  light chain complementarity determining region 3 for antibody 52419
QQFAGSPTT

SEQ ID NO: 104838 - protein, 14 aa, Homo sapiens
  heavy chain complementarity determining region 3 for antibody 52419
AKEVDSLGYPVLTN

SEQ ID NO: 104839 - protein, 9 aa, Homo sapiens
  light chain complementarity determining region 3 for antibody 52420
QQCSSTPIT

SEQ ID NO: 104840 - protein, 16 aa, Homo sapiens
  heavy chain complementarity determining region 3 for antibody 52420
AKCWQYGSGWYGRNDY

SEQ ID NO: 104841 - protein, 9 aa, Homo sapiens
  light chain complementarity determining region 3 for antibody 52421
QQCSHSPLT

SEQ ID NO: 104842 - protein, 10 aa, Homo sapiens
  heavy chain complementarity determining region 3 for antibody 52421
TGGRGWVSDY

SEQ ID NO: 104843 - protein, 9 aa, Homo sapiens
  light chain complementarity determining region 3 for antibody 52422
QQCIIILEA

SEQ ID NO: 104844 - protein, 20 aa, Homo sapiens
  heavy chain complementarity determining region 3 for antibody 52422
ARDGSRPRLAVAGTFTAFDI

SEQ ID NO: 104845 - protein, 9 aa, Homo sapiens
  light chain complementarity determining region 3 for antibody 52423
QKYNTAPPA

SEQ ID NO: 104846 - protein, 14 aa, Homo sapiens
  heavy chain complementarity determining region 3 for antibody 52423
ATYSGYDFGDAFDI

SEQ ID NO: 104847 - protein, 7 aa, Homo sapiens
  light chain complementarity determining region 3 for antibody 52424
QHYGRGT

SEQ ID NO: 104848 - protein, 20 aa, Homo sapiens
  heavy chain complementarity determining region 3 for antibody 52424
AKDMFYYDSSGYPYYYALGV

SEQ ID NO: 104849 - protein, 8 aa, Homo sapiens
  light chain complementarity determining region 3 for antibody 52425
MQTLQTPT

SEQ ID NO: 104850 - protein, 18 aa, Homo sapiens
  heavy chain complementarity determining region 3 for antibody 52425
ARKPQTPYSSTWPNWLDP

SEQ ID NO: 104851 - protein, 9 aa, Homo sapiens
  light chain complementarity determining region 3 for antibody 52426
MQGTHWPRT

SEQ ID NO: 104852 - protein, 21 aa, Homo sapiens
  heavy chain complementarity determining region 3 for antibody 52426
AKDPARYSDYVGFLPYYGMDV

SEQ ID NO: 104853 - protein, 9 aa, Homo sapiens
  light chain complementarity determining region 3 for antibody 52427
MQALQTVLT

SEQ ID NO: 104854 - protein, 16 aa, Homo sapiens
  heavy chain complementarity determining region 3 for antibody 52427
VRLFDAGDPGLISGAH

SEQ ID NO: 104855 - protein, 9 aa, Homo sapiens
  light chain complementarity determining region 3 for antibody 52428
LQDYSDRYS

SEQ ID NO: 104856 - protein, 15 aa, Homo sapiens
  heavy chain complementarity determining region 3 for antibody 52428
ARDYIVGRPFVAFDL

SEQ ID NO: 104857 - protein, 9 aa, Homo sapiens
  light chain complementarity determining region 3 for antibody 52429
QYYDSYSRT

SEQ ID NO: 104858 - protein, 12 aa, Homo sapiens
  heavy chain complementarity determining region 3 for antibody 52429
ARGLKIDRRFHP

SEQ ID NO: 104859 - protein, 10 aa, Homo sapiens
  light chain complementarity determining region 3 for antibody 52430
QQYYNNSPYT

SEQ ID NO: 104860 - protein, 24 aa, Homo sapiens
  heavy chain complementarity determining region 3 for antibody 52430
ARLSVYFGTVASSASKRYRSYFDY

SEQ ID NO: 104861 - protein, 9 aa, Homo sapiens
  light chain complementarity determining region 3 for antibody 52431
QQYNSYPIT

SEQ ID NO: 104862 - protein, 12 aa, Homo sapiens
  heavy chain complementarity determining region 3 for antibody 52431
ARYDGADYSIDF

SEQ ID NO: 104863 - protein, 9 aa, Homo sapiens
  light chain complementarity determining region 3 for antibody 52432
QQYNNWPVT

SEQ ID NO: 104864 - protein, 13 aa, Homo sapiens
  heavy chain complementarity determining region 3 for antibody 52432
ARDAADWRAAFDV

SEQ ID NO: 104865 - protein, 10 aa, Homo sapiens
  light chain complementarity determining region 3 for antibody 52433
QQYDTLPPLT

SEQ ID NO: 104866 - protein, 15 aa, Homo sapiens
  heavy chain complementarity determining region 3 for antibody 52433
ARVRHPYNEAGAFDI

SEQ ID NO: 104867 - protein, 9 aa, Homo sapiens
  light chain complementarity determining region 3 for antibody 52434
QQYDNLPLT

SEQ ID NO: 104868 - protein, 14 aa, Homo sapiens
  heavy chain complementarity determining region 3 for antibody 52434
ARGRMATSSWTNDH

SEQ ID NO: 104869 - protein, 8 aa, Homo sapiens
  light chain complementarity determining region 3 for antibody 52435
QQYATSWT

SEQ ID NO: 104870 - protein, 12 aa, Homo sapiens
  heavy chain complementarity determining region 3 for antibody 52435
VREGPRTSHWKN

SEQ ID NO: 104871 - protein, 9 aa, Homo sapiens
  light chain complementarity determining region 3 for antibody 52436
QQSYSTLYT

SEQ ID NO: 104872 - protein, 15 aa, Homo sapiens
  heavy chain complementarity determining region 3 for antibody 52436
ARGGGPYYDSSGYQQ

SEQ ID NO: 104873 - protein, 9 aa, Homo sapiens
  light chain complementarity determining region 3 for antibody 52437
QQGDSTPVT

SEQ ID NO: 104874 - protein, 23 aa, Homo sapiens
  heavy chain complementarity determining region 3 for antibody 52437
ARTQTISTRSSSHDYYYYYGMDV

SEQ ID NO: 104875 - protein, 9 aa, Homo sapiens
  light chain complementarity determining region 3 for antibody 52438
QQCYSFPYT

SEQ ID NO: 104876 - protein, 13 aa, Homo sapiens
  heavy chain complementarity determining region 3 for antibody 52438
ASESFGGPRGFNY

SEQ ID NO: 104877 - protein, 8 aa, Homo sapiens
  light chain complementarity determining region 3 for antibody 52439
MQALQTYT

SEQ ID NO: 104878 - protein, 20 aa, Homo sapiens
  heavy chain complementarity determining region 3 for antibody 52439
AREGGDAFVVARVYYYYMDV

SEQ ID NO: 104879 - protein, 9 aa, Homo sapiens
  light chain complementarity determining region 3 for antibody 52440
LQDYNYPWT

SEQ ID NO: 104880 - protein, 16 aa, Homo sapiens
  heavy chain complementarity determining region 3 for antibody 52440
ARDGGSSGGYYNWFDP

SEQ ID NO: 104881 - protein, 9 aa, Homo sapiens
  light chain complementarity determining region 3 for antibody 52441
HQVVTFPFT

SEQ ID NO: 104882 - protein, 12 aa, Homo sapiens
  heavy chain complementarity determining region 3 for antibody 52441
VRDRLSGWFTDF

SEQ ID NO: 104883 - protein, 9 aa, Homo sapiens
  light chain complementarity determining region 3 for antibody 52442
QQYRTYPLT

SEQ ID NO: 104884 - protein, 20 aa, Homo sapiens
  heavy chain complementarity determining region 3 for antibody 52442
ARGDPDSYGPGKYCYYGMDV

SEQ ID NO: 104885 - protein, 9 aa, Homo sapiens
  light chain complementarity determining region 3 for antibody 52443
QQYNTLQWA

SEQ ID NO: 104886 - protein, 14 aa, Homo sapiens
  heavy chain complementarity determining region 3 for antibody 52443
ARKMGWDGVAWFDP

SEQ ID NO: 104887 - protein, 9 aa, Homo sapiens
  light chain complementarity determining region 3 for antibody 52444
QQYNSYPYT

SEQ ID NO: 104888 - protein, 15 aa, Homo sapiens
  heavy chain complementarity determining region 3 for antibody 52444
AKGPGFAYGKKYFKH

SEQ ID NO: 104889 - protein, 9 aa, Homo sapiens
  light chain complementarity determining region 3 for antibody 52445
QQYNSYPLT

SEQ ID NO: 104890 - protein, 12 aa, Homo sapiens
  heavy chain complementarity determining region 3 for antibody 52445
ARVDSSWNPFNY

SEQ ID NO: 104891 - protein, 10 aa, Homo sapiens
  light chain complementarity determining region 3 for antibody 52446
QQYGSSPTWT

SEQ ID NO: 104892 - protein, 15 aa, Homo sapiens
  heavy chain complementarity determining region 3 for antibody 52446
AKDMARYTYGWGCDS

SEQ ID NO: 104893 - protein, 9 aa, Homo sapiens
  light chain complementarity determining region 3 for antibody 52447
QQYDSYPCT

SEQ ID NO: 104894 - protein, 14 aa, Homo sapiens
  heavy chain complementarity determining region 3 for antibody 52447
ARKMGWDGVAWFDP

SEQ ID NO: 104895 - protein, 9 aa, Homo sapiens
  light chain complementarity determining region 3 for antibody 52448
QQYDSYPCT

SEQ ID NO: 104896 - protein, 15 aa, Homo sapiens
  heavy chain complementarity determining region 3 for antibody 52448
AHSAFVDVLTPSFAY

SEQ ID NO: 104897 - protein, 10 aa, Homo sapiens
  light chain complementarity determining region 3 for antibody 52449
QQTYSTLLFT

SEQ ID NO: 104898 - protein, 16 aa, Homo sapiens
  heavy chain complementarity determining region 3 for antibody 52449
ARQGEYCSGDNCYTDY

SEQ ID NO: 104899 - protein, 9 aa, Homo sapiens
  light chain complementarity determining region 3 for antibody 52450
QQSYSTLYT

SEQ ID NO: 104900 - protein, 16 aa, Homo sapiens
  heavy chain complementarity determining region 3 for antibody 52450
ARGPVKAHYYYYYMDV

SEQ ID NO: 104901 - protein, 9 aa, Homo sapiens
  light chain complementarity determining region 3 for antibody 52451
QQSHSTPRT

SEQ ID NO: 104902 - protein, 16 aa, Homo sapiens
  heavy chain complementarity determining region 3 for antibody 52451
ARARWTLRGRDDAFDV

SEQ ID NO: 104903 - protein, 8 aa, Homo sapiens
  light chain complementarity determining region 3 for antibody 52452
QQRSYWFT

SEQ ID NO: 104904 - protein, 16 aa, Homo sapiens
  heavy chain complementarity determining region 3 for antibody 52452
VHRLTVITGPSNWFDF

SEQ ID NO: 104905 - protein, 8 aa, Homo sapiens
  light chain complementarity determining region 3 for antibody 52453
QQRSTWWT

SEQ ID NO: 104906 - protein, 18 aa, Homo sapiens
  heavy chain complementarity determining region 3 for antibody 52453
AKAPVAGTSRRTKYYSDY

SEQ ID NO: 104907 - protein, 10 aa, Homo sapiens
  light chain complementarity determining region 3 for antibody 52454
QQLNGYPLFT

SEQ ID NO: 104908 - protein, 17 aa, Homo sapiens
  heavy chain complementarity determining region 3 for antibody 52454
ARDLSGRRNYSYNGMDV

SEQ ID NO: 104909 - protein, 9 aa, Homo sapiens
  light chain complementarity determining region 3 for antibody 52455
QQALNYPWT

SEQ ID NO: 104910 - protein, 12 aa, Homo sapiens
  heavy chain complementarity determining region 3 for antibody 52455
VREGPRTSHWKN

SEQ ID NO: 104911 - protein, 9 aa, Homo sapiens
  light chain complementarity determining region 3 for antibody 52456
QKYNSAPPT

SEQ ID NO: 104912 - protein, 15 aa, Homo sapiens
  heavy chain complementarity determining region 3 for antibody 52456
ARGGGPYYDSSGYQH

SEQ ID NO: 104913 - protein, 9 aa, Homo sapiens
  light chain complementarity determining region 3 for antibody 52457
QHYYNYMVS

SEQ ID NO: 104914 - protein, 12 aa, Homo sapiens
  heavy chain complementarity determining region 3 for antibody 52457
ARGRFGGYGFEY

SEQ ID NO: 104915 - protein, 9 aa, Homo sapiens
  light chain complementarity determining region 3 for antibody 52458
QHQGSSPYT

SEQ ID NO: 104916 - protein, 13 aa, Homo sapiens
  heavy chain complementarity determining region 3 for antibody 52458
ARRRLPRRGYFDY

SEQ ID NO: 104917 - protein, 8 aa, Homo sapiens
  light chain complementarity determining region 3 for antibody 52459
MQSLQTLT

SEQ ID NO: 104918 - protein, 13 aa, Homo sapiens
  heavy chain complementarity determining region 3 for antibody 52459
AKSGSSWYSRFDI

SEQ ID NO: 104919 - protein, 9 aa, Homo sapiens
  light chain complementarity determining region 3 for antibody 52460
MQALQTPIT

SEQ ID NO: 104920 - protein, 14 aa, Homo sapiens
  heavy chain complementarity determining region 3 for antibody 52460
TRDRGMAVAAPGDC

SEQ ID NO: 104921 - protein, 9 aa, Homo sapiens
  light chain complementarity determining region 3 for antibody 52461
MQALQTALT

SEQ ID NO: 104922 - protein, 17 aa, Homo sapiens
  heavy chain complementarity determining region 3 for antibody 52461
ARGLLYYQGSENYYGEL

SEQ ID NO: 104923 - protein, 9 aa, Homo sapiens
  light chain complementarity determining region 3 for antibody 52462
QQYRSSPIT

SEQ ID NO: 104924 - protein, 15 aa, Homo sapiens
  heavy chain complementarity determining region 3 for antibody 52462
ARDSLYYASSGLLDY

SEQ ID NO: 104925 - protein, 9 aa, Homo sapiens
  light chain complementarity determining region 3 for antibody 52463
QQYNTLQWT

SEQ ID NO: 104926 - protein, 12 aa, Homo sapiens
  heavy chain complementarity determining region 3 for antibody 52463
VREGPRTSHWKN

SEQ ID NO: 104927 - protein, 9 aa, Homo sapiens
  light chain complementarity determining region 3 for antibody 52464
QQYNSYPVT

SEQ ID NO: 104928 - protein, 14 aa, Homo sapiens
  heavy chain complementarity determining region 3 for antibody 52464
ARVRTYSSSWYFDY

SEQ ID NO: 104929 - protein, 10 aa, Homo sapiens
  light chain complementarity determining region 3 for antibody 52465
QQYGASPPFT

SEQ ID NO: 104930 - protein, 14 aa, Homo sapiens
  heavy chain complementarity determining region 3 for antibody 52465
ARTSYFDSDVAIDF

SEQ ID NO: 104931 - protein, 8 aa, Homo sapiens
  light chain complementarity determining region 3 for antibody 52466
QQYDGSPL

SEQ ID NO: 104932 - protein, 13 aa, Homo sapiens
  heavy chain complementarity determining region 3 for antibody 52466
ATYSGYDRYCFDY

SEQ ID NO: 104933 - protein, 9 aa, Homo sapiens
  light chain complementarity determining region 3 for antibody 52467
QQTYSTPDT

SEQ ID NO: 104934 - protein, 21 aa, Homo sapiens
  heavy chain complementarity determining region 3 for antibody 52467
ARNKGLEGSKWYDPGAEGLDY

SEQ ID NO: 104935 - protein, 10 aa, Homo sapiens
  light chain complementarity determining region 3 for antibody 52468
QQSYSTPSIT

SEQ ID NO: 104936 - protein, 18 aa, Homo sapiens
  heavy chain complementarity determining region 3 for antibody 52468
ARGYCSGGSCYSGVLLNE

SEQ ID NO: 104937 - protein, 9 aa, Homo sapiens
  light chain complementarity determining region 3 for antibody 52469
QQSYSTPRT

SEQ ID NO: 104938 - protein, 18 aa, Homo sapiens
  heavy chain complementarity determining region 3 for antibody 52469
ARERIDLSGFLEWLAFDY

SEQ ID NO: 104939 - protein, 9 aa, Homo sapiens
  light chain complementarity determining region 3 for antibody 52470
QQSYSTPIT

SEQ ID NO: 104940 - protein, 15 aa, Homo sapiens
  heavy chain complementarity determining region 3 for antibody 52470
ARQGKRPLPHWYFDL

SEQ ID NO: 104941 - protein, 9 aa, Homo sapiens
  light chain complementarity determining region 3 for antibody 52471
QQSYSTLYT

SEQ ID NO: 104942 - protein, 12 aa, Homo sapiens
  heavy chain complementarity determining region 3 for antibody 52471
VRGGPRPSHWKN

SEQ ID NO: 104943 - protein, 9 aa, Homo sapiens
  light chain complementarity determining region 3 for antibody 52472
QQSYRSPRT

SEQ ID NO: 104944 - protein, 17 aa, Homo sapiens
  heavy chain complementarity determining region 3 for antibody 52472
TGESMTMIRGVIGWFDP

SEQ ID NO: 104945 - protein, 9 aa, Homo sapiens
  light chain complementarity determining region 3 for antibody 52473
QQLNSYPGA

SEQ ID NO: 104946 - protein, 21 aa, Homo sapiens
  heavy chain complementarity determining region 3 for antibody 52473
AREFLTYYDFWSGYRGGAFDI

SEQ ID NO: 104947 - protein, 9 aa, Homo sapiens
  light chain complementarity determining region 3 for antibody 52474
QQHYRNPRT

SEQ ID NO: 104948 - protein, 13 aa, Homo sapiens
  heavy chain complementarity determining region 3 for antibody 52474
ARGGGWSEIALDI

SEQ ID NO: 104949 - protein, 9 aa, Homo sapiens
  light chain complementarity determining region 3 for antibody 52475
QQGMSFPPT

SEQ ID NO: 104950 - protein, 18 aa, Homo sapiens
  heavy chain complementarity determining region 3 for antibody 52475
ASQLDSSVGSKAYWYFDI

SEQ ID NO: 104951 - protein, 9 aa, Homo sapiens
  light chain complementarity determining region 3 for antibody 52476
QQANSFPRT

SEQ ID NO: 104952 - protein, 11 aa, Homo sapiens
  heavy chain complementarity determining region 3 for antibody 52476
AKSMVDWYFDY

SEQ ID NO: 104953 - protein, 9 aa, Homo sapiens
  light chain complementarity determining region 3 for antibody 52477
QKYNSAPPT

SEQ ID NO: 104954 - protein, 15 aa, Homo sapiens
  heavy chain complementarity determining region 3 for antibody 52477
ARGGGPYYDSSGYHQ

SEQ ID NO: 104955 - protein, 9 aa, Homo sapiens
  light chain complementarity determining region 3 for antibody 52478
QHYNTIPYI

SEQ ID NO: 104956 - protein, 11 aa, Homo sapiens
  heavy chain complementarity determining region 3 for antibody 52478
VASTVMRYFDL

SEQ ID NO: 104957 - protein, 9 aa, Homo sapiens
  light chain complementarity determining region 3 for antibody 52479
MQGTHWPRT

SEQ ID NO: 104958 - protein, 20 aa, Homo sapiens
  heavy chain complementarity determining region 3 for antibody 52479
ASLSGVTTASRSYYYYGMDV

SEQ ID NO: 104959 - protein, 9 aa, Homo sapiens
  light chain complementarity determining region 3 for antibody 52480
MQALQTPWT

SEQ ID NO: 104960 - protein, 23 aa, Homo sapiens
  heavy chain complementarity determining region 3 for antibody 52480
ARGVVIAPNGAPLGHYNHYGMDV

SEQ ID NO: 104961 - protein, 9 aa, Homo sapiens
  light chain complementarity determining region 3 for antibody 52481
LQYYTTPGT

SEQ ID NO: 104962 - protein, 15 aa, Homo sapiens
  heavy chain complementarity determining region 3 for antibody 52481
ARLRGRQLVVSYYDY

SEQ ID NO: 104963 - protein, 9 aa, Homo sapiens
  light chain complementarity determining region 3 for antibody 52482
LQHHTHPRM

SEQ ID NO: 104964 - protein, 11 aa, Homo sapiens
  heavy chain complementarity determining region 3 for antibody 52482
AKDSSGYGLDH

SEQ ID NO: 104965 - protein, 9 aa, Homo sapiens
  light chain complementarity determining region 3 for antibody 52483
HQTDFLPWT

SEQ ID NO: 104966 - protein, 14 aa, Homo sapiens
  heavy chain complementarity determining region 3 for antibody 52483
AHIDNNSWPPFFDY

SEQ ID NO: 104967 - protein, 8 aa, Homo sapiens
  light chain complementarity determining region 3 for antibody 52484
HQSSSLPP

SEQ ID NO: 104968 - protein, 9 aa, Homo sapiens
  heavy chain complementarity determining region 3 for antibody 52484
AHRYEAFGA

SEQ ID NO: 104969 - protein, 9 aa, Homo sapiens
  light chain complementarity determining region 3 for antibody 52485
GQYAYAPKT

SEQ ID NO: 104970 - protein, 10 aa, Homo sapiens
  heavy chain complementarity determining region 3 for antibody 52485
AHGSGWLLDY

SEQ ID NO: 104971 - protein, 9 aa, Homo sapiens
  light chain complementarity determining region 3 for antibody 52486
QQYYNLPLT

SEQ ID NO: 104972 - protein, 16 aa, Homo sapiens
  heavy chain complementarity determining region 3 for antibody 52486
AKGRPQWELLIGWFDP

SEQ ID NO: 104973 - protein, 9 aa, Homo sapiens
  light chain complementarity determining region 3 for antibody 52487
QQYNSYSRT

SEQ ID NO: 104974 - protein, 22 aa, Homo sapiens
  heavy chain complementarity determining region 3 for antibody 52487
ARAQGLGYCTGGSCYSYYGMDV

SEQ ID NO: 104975 - protein, 9 aa, Homo sapiens
  light chain complementarity determining region 3 for antibody 52488
QQYNSYPYT

SEQ ID NO: 104976 - protein, 14 aa, Homo sapiens
  heavy chain complementarity determining region 3 for antibody 52488
ARKMGWDGVAWFDP

SEQ ID NO: 104977 - protein, 9 aa, Homo sapiens
  light chain complementarity determining region 3 for antibody 52489
QQYGSSPWT

SEQ ID NO: 104978 - protein, 12 aa, Homo sapiens
  heavy chain complementarity determining region 3 for antibody 52489
VREGPRTSHWKN

SEQ ID NO: 104979 - protein, 10 aa, Homo sapiens
  light chain complementarity determining region 3 for antibody 52490
QQYGSSPPYT

SEQ ID NO: 104980 - protein, 11 aa, Homo sapiens
  heavy chain complementarity determining region 3 for antibody 52490
ARSSGYTYFDS

SEQ ID NO: 104981 - protein, 9 aa, Homo sapiens
  light chain complementarity determining region 3 for antibody 52491
QQYGSSPKT

SEQ ID NO: 104982 - protein, 13 aa, Homo sapiens
  heavy chain complementarity determining region 3 for antibody 52491
VLQWSLPLWYFDY

SEQ ID NO: 104983 - protein, 9 aa, Homo sapiens
  light chain complementarity determining region 3 for antibody 52492
QQSYSTQVT

SEQ ID NO: 104984 - protein, 17 aa, Homo sapiens
  heavy chain complementarity determining region 3 for antibody 52492
ARRITIIRGMIYSGMDV

SEQ ID NO: 104985 - protein, 9 aa, Homo sapiens
  light chain complementarity determining region 3 for antibody 52493
QQSYSTLYT

SEQ ID NO: 104986 - protein, 12 aa, Homo sapiens
  heavy chain complementarity determining region 3 for antibody 52493
VREGPLTSHWKN

SEQ ID NO: 104987 - protein, 9 aa, Homo sapiens
  light chain complementarity determining region 3 for antibody 52494
QQSYSTLYT

SEQ ID NO: 104988 - protein, 12 aa, Homo sapiens
  heavy chain complementarity determining region 3 for antibody 52494
LREGPRTSHWKN

SEQ ID NO: 104989 - protein, 9 aa, Homo sapiens
  light chain complementarity determining region 3 for antibody 52495
QQSYSTLYT

SEQ ID NO: 104990 - protein, 12 aa, Homo sapiens
  heavy chain complementarity determining region 3 for antibody 52495
GREGPRPSHWKN

SEQ ID NO: 104991 - protein, 9 aa, Homo sapiens
  light chain complementarity determining region 3 for antibody 52496
QQSYSKPYT

SEQ ID NO: 104992 - protein, 14 aa, Homo sapiens
  heavy chain complementarity determining region 3 for antibody 52496
ARETFGSGSYYQDY

SEQ ID NO: 104993 - protein, 9 aa, Homo sapiens
  light chain complementarity determining region 3 for antibody 52497
QQSDSIPWT

SEQ ID NO: 104994 - protein, 13 aa, Homo sapiens
  heavy chain complementarity determining region 3 for antibody 52497
ARESSSFDKFFDP

SEQ ID NO: 104995 - protein, 9 aa, Homo sapiens
  light chain complementarity determining region 3 for antibody 52498
QQFNSYPPT

SEQ ID NO: 104996 - protein, 18 aa, Homo sapiens
  heavy chain complementarity determining region 3 for antibody 52498
ARDPRDSVTSWRKDAFDI

SEQ ID NO: 104997 - protein, 9 aa, Homo sapiens
  light chain complementarity determining region 3 for antibody 52499
QQFGGSPGT

SEQ ID NO: 104998 - protein, 18 aa, Homo sapiens
  heavy chain complementarity determining region 3 for antibody 52499
ATPKRYFDVWNRYPPFDY

SEQ ID NO: 104999 - protein, 9 aa, Homo sapiens
  light chain complementarity determining region 3 for antibody 52500
QQANSFSLT

SEQ ID NO: 105000 - protein, 15 aa, Homo sapiens
  heavy chain complementarity determining region 3 for antibody 52500
AKDYRGYGLIGYFDY

SEQ ID NO: 105001 - protein, 9 aa, Homo sapiens
  light chain complementarity determining region 3 for antibody 52501
QKYDGAPWT

SEQ ID NO: 105002 - protein, 15 aa, Homo sapiens
  heavy chain complementarity determining region 3 for antibody 52501
ARVVETASLWAPLDY

SEQ ID NO: 105003 - protein, 11 aa, Homo sapiens
  light chain complementarity determining region 3 for antibody 52502
QFYNNWPPVST

SEQ ID NO: 105004 - protein, 13 aa, Homo sapiens
  heavy chain complementarity determining region 3 for antibody 52502
ARWGSLWFGFFDY

SEQ ID NO: 105005 - protein, 9 aa, Homo sapiens
  light chain complementarity determining region 3 for antibody 52503
MQGTHWPPT

SEQ ID NO: 105006 - protein, 19 aa, Homo sapiens
  heavy chain complementarity determining region 3 for antibody 52503
VKALVQDIVVVPADDAFDF

SEQ ID NO: 105007 - protein, 9 aa, Homo sapiens
  light chain complementarity determining region 3 for antibody 52504
MQGTHWPPT

SEQ ID NO: 105008 - protein, 23 aa, Homo sapiens
  heavy chain complementarity determining region 3 for antibody 52504
ARDLTVGRVISFRPRYFYYGLDV

SEQ ID NO: 105009 - protein, 9 aa, Homo sapiens
  light chain complementarity determining region 3 for antibody 52505
QQYSRSPRT

SEQ ID NO: 105010 - protein, 9 aa, Homo sapiens
  heavy chain complementarity determining region 3 for antibody 52505
ARGHYDFGP

SEQ ID NO: 105011 - protein, 9 aa, Homo sapiens
  light chain complementarity determining region 3 for antibody 52506
QQYNSYPWT

SEQ ID NO: 105012 - protein, 12 aa, Homo sapiens
  heavy chain complementarity determining region 3 for antibody 52506
VREGPRTSHWKN

SEQ ID NO: 105013 - protein, 9 aa, Homo sapiens
  light chain complementarity determining region 3 for antibody 52507
QQYNSYPWT

SEQ ID NO: 105014 - protein, 14 aa, Homo sapiens
  heavy chain complementarity determining region 3 for antibody 52507
ARKMGWDGVAWFDP

SEQ ID NO: 105015 - protein, 9 aa, Homo sapiens
  light chain complementarity determining region 3 for antibody 52508
QQYGYSPIT

SEQ ID NO: 105016 - protein, 13 aa, Homo sapiens
  heavy chain complementarity determining region 3 for antibody 52508
ARDSSSYYGWFDP

SEQ ID NO: 105017 - protein, 9 aa, Homo sapiens
  light chain complementarity determining region 3 for antibody 52509
QQYGTSPGT

SEQ ID NO: 105018 - protein, 14 aa, Homo sapiens
  heavy chain complementarity determining region 3 for antibody 52509
ARGGPYSSGAEFDN

SEQ ID NO: 105019 - protein, 10 aa, Homo sapiens
  light chain complementarity determining region 3 for antibody 52510
QQYGSSPPWT

SEQ ID NO: 105020 - protein, 14 aa, Homo sapiens
  heavy chain complementarity determining region 3 for antibody 52510
AREGYNWIFYGMDV

SEQ ID NO: 105021 - protein, 10 aa, Homo sapiens
  light chain complementarity determining region 3 for antibody 52511
QQYGNSPPWT

SEQ ID NO: 105022 - protein, 15 aa, Homo sapiens
  heavy chain complementarity determining region 3 for antibody 52511
ARGLAVVYVSGAFDI

SEQ ID NO: 105023 - protein, 9 aa, Homo sapiens
  light chain complementarity determining region 3 for antibody 52512
QQYDSYPCT

SEQ ID NO: 105024 - protein, 15 aa, Homo sapiens
  heavy chain complementarity determining region 3 for antibody 52512
AHSAFADVLTPFFAY

SEQ ID NO: 105025 - protein, 8 aa, Homo sapiens
  light chain complementarity determining region 3 for antibody 52513
QQYATSWT

SEQ ID NO: 105026 - protein, 16 aa, Homo sapiens
  heavy chain complementarity determining region 3 for antibody 52513
AAGPSVEGVLREYFAH

SEQ ID NO: 105027 - protein, 9 aa, Homo sapiens
  light chain complementarity determining region 3 for antibody 52514
QQYATSPLT

SEQ ID NO: 105028 - protein, 10 aa, Homo sapiens
  heavy chain complementarity determining region 3 for antibody 52514
TTDVIYRFDS

SEQ ID NO: 105029 - protein, 10 aa, Homo sapiens
  light chain complementarity determining region 3 for antibody 52515
QQSYSTPPFT

SEQ ID NO: 105030 - protein, 12 aa, Homo sapiens
  heavy chain complementarity determining region 3 for antibody 52515
VREGPRTSHWKN

SEQ ID NO: 105031 - protein, 9 aa, Homo sapiens
  light chain complementarity determining region 3 for antibody 52516
QQSYSTLYT

SEQ ID NO: 105032 - protein, 16 aa, Homo sapiens
  heavy chain complementarity determining region 3 for antibody 52516
ARFSGYVNYLQFYMEV

SEQ ID NO: 105033 - protein, 9 aa, Homo sapiens
  light chain complementarity determining region 3 for antibody 52517
QQSYSTLYT

SEQ ID NO: 105034 - protein, 16 aa, Homo sapiens
  heavy chain complementarity determining region 3 for antibody 52517
AAGPSVEGVLREYFPH

SEQ ID NO: 105035 - protein, 9 aa, Homo sapiens
  light chain complementarity determining region 3 for antibody 52518
QQSYSSRWT

SEQ ID NO: 105036 - protein, 18 aa, Homo sapiens
  heavy chain complementarity determining region 3 for antibody 52518
ARDPPLRLGELSGGISDY

SEQ ID NO: 105037 - protein, 9 aa, Homo sapiens
  light chain complementarity determining region 3 for antibody 52519
QQSYRPPYT

SEQ ID NO: 105038 - protein, 14 aa, Homo sapiens
  heavy chain complementarity determining region 3 for antibody 52519
ARVPYGDYLFFFDY

SEQ ID NO: 105039 - protein, 7 aa, Homo sapiens
  light chain complementarity determining region 3 for antibody 52520
QQSIGRA

SEQ ID NO: 105040 - protein, 16 aa, Homo sapiens
  heavy chain complementarity determining region 3 for antibody 52520
ARDEYSSDFYAGAFDF

SEQ ID NO: 105041 - protein, 9 aa, Homo sapiens
  light chain complementarity determining region 3 for antibody 52521
QQLNSYPYT

SEQ ID NO: 105042 - protein, 14 aa, Homo sapiens
  heavy chain complementarity determining region 3 for antibody 52521
ARKMGWDGVAWFDP

SEQ ID NO: 105043 - protein, 9 aa, Homo sapiens
  light chain complementarity determining region 3 for antibody 52522
QQCYSFPYT

SEQ ID NO: 105044 - protein, 15 aa, Homo sapiens
  heavy chain complementarity determining region 3 for antibody 52522
ARRGYYGPGKMAYDI

SEQ ID NO: 105045 - protein, 9 aa, Homo sapiens
  light chain complementarity determining region 3 for antibody 52523
QQCYSFPYT

SEQ ID NO: 105046 - protein, 14 aa, Homo sapiens
  heavy chain complementarity determining region 3 for antibody 52523
ARKMGWDGVDWFDP

SEQ ID NO: 105047 - protein, 9 aa, Homo sapiens
  light chain complementarity determining region 3 for antibody 52524
QQCYSFPYT

SEQ ID NO: 105048 - protein, 14 aa, Homo sapiens
  heavy chain complementarity determining region 3 for antibody 52524
ARKMGWDGVAWFDH

SEQ ID NO: 105049 - protein, 9 aa, Homo sapiens
  light chain complementarity determining region 3 for antibody 52525
QKYNSAPPT

SEQ ID NO: 105050 - protein, 15 aa, Homo sapiens
  heavy chain complementarity determining region 3 for antibody 52525
ARGGGPYYDSSGYKQ

SEQ ID NO: 105051 - protein, 9 aa, Homo sapiens
  light chain complementarity determining region 3 for antibody 52526
QHYNSYSWG

SEQ ID NO: 105052 - protein, 8 aa, Homo sapiens
  heavy chain complementarity determining region 3 for antibody 52526
ARGPPNDY

SEQ ID NO: 105053 - protein, 9 aa, Homo sapiens
  light chain complementarity determining region 3 for antibody 52527
MQALHTPYT

SEQ ID NO: 105054 - protein, 13 aa, Homo sapiens
  heavy chain complementarity determining region 3 for antibody 52527
ARDGDSSMVELDY

SEQ ID NO: 105055 - protein, 8 aa, Homo sapiens
  light chain complementarity determining region 3 for antibody 52528
MQALEAPT

SEQ ID NO: 105056 - protein, 21 aa, Homo sapiens
  heavy chain complementarity determining region 3 for antibody 52528
ARQSYYDSRGHYRFWGDGFDI

SEQ ID NO: 105057 - protein, 9 aa, Homo sapiens
  light chain complementarity determining region 3 for antibody 52529
LQRTNWPYT

SEQ ID NO: 105058 - protein, 8 aa, Homo sapiens
  heavy chain complementarity determining region 3 for antibody 52529
ARGPNLDV

SEQ ID NO: 105059 - protein, 9 aa, Homo sapiens
  light chain complementarity determining region 3 for antibody 52530
LQHNSYPQT

SEQ ID NO: 105060 - protein, 13 aa, Homo sapiens
  heavy chain complementarity determining region 3 for antibody 52530
ARQRVIGQWLDEY

SEQ ID NO: 105061 - protein, 9 aa, Homo sapiens
  light chain complementarity determining region 3 for antibody 52531
QRYISAPQT

SEQ ID NO: 105062 - protein, 13 aa, Homo sapiens
  heavy chain complementarity determining region 3 for antibody 52531
ARDRLVGKALLDY

SEQ ID NO: 105063 - protein, 10 aa, Homo sapiens
  light chain complementarity determining region 3 for antibody 52532
QQYSNWPPLT

SEQ ID NO: 105064 - protein, 11 aa, Homo sapiens
  heavy chain complementarity determining region 3 for antibody 52532
ARERGTHVFDY

SEQ ID NO: 105065 - protein, 8 aa, Homo sapiens
  light chain complementarity determining region 3 for antibody 52533
QQYNSYWT

SEQ ID NO: 105066 - protein, 11 aa, Homo sapiens
  heavy chain complementarity determining region 3 for antibody 52533
ARGAWQYFFDL

SEQ ID NO: 105067 - protein, 9 aa, Homo sapiens
  light chain complementarity determining region 3 for antibody 52534
QQYNSYPRT

SEQ ID NO: 105068 - protein, 12 aa, Homo sapiens
  heavy chain complementarity determining region 3 for antibody 52534
ARINGWNRIPDY

SEQ ID NO: 105069 - protein, 9 aa, Homo sapiens
  light chain complementarity determining region 3 for antibody 52535
QQYNSYPLT

SEQ ID NO: 105070 - protein, 19 aa, Homo sapiens
  heavy chain complementarity determining region 3 for antibody 52535
ARDHYYEGSGYYNQDYFDY

SEQ ID NO: 105071 - protein, 9 aa, Homo sapiens
  light chain complementarity determining region 3 for antibody 52536
QQYKSYPYT

SEQ ID NO: 105072 - protein, 9 aa, Homo sapiens
  heavy chain complementarity determining region 3 for antibody 52536
VRGYNGFDS

SEQ ID NO: 105073 - protein, 9 aa, Homo sapiens
  light chain complementarity determining region 3 for antibody 52537
QQYGSSPYT

SEQ ID NO: 105074 - protein, 15 aa, Homo sapiens
  heavy chain complementarity determining region 3 for antibody 52537
ARVGGGGVRQLVLDS

SEQ ID NO: 105075 - protein, 9 aa, Homo sapiens
  light chain complementarity determining region 3 for antibody 52538
QQYGSSPLT

SEQ ID NO: 105076 - protein, 22 aa, Homo sapiens
  heavy chain complementarity determining region 3 for antibody 52538
TKDLSYDFWSGYYTSYDYGMDV

SEQ ID NO: 105077 - protein, 6 aa, Homo sapiens
  light chain complementarity determining region 3 for antibody 52539
QQYGIL

SEQ ID NO: 105078 - protein, 18 aa, Homo sapiens
  heavy chain complementarity determining region 3 for antibody 52539
TTVRVEWQYQLLPVGMDV

SEQ ID NO: 105079 - protein, 9 aa, Homo sapiens
  light chain complementarity determining region 3 for antibody 52540
QQYGDSLFT

SEQ ID NO: 105080 - protein, 12 aa, Homo sapiens
  heavy chain complementarity determining region 3 for antibody 52540
ASPSPYNDALFY

SEQ ID NO: 105081 - protein, 10 aa, Homo sapiens
  light chain complementarity determining region 3 for antibody 52541
QQYGDSHGLS

SEQ ID NO: 105082 - protein, 19 aa, Homo sapiens
  heavy chain complementarity determining region 3 for antibody 52541
ARHSDGGLFEFFYYYGIDV

SEQ ID NO: 105083 - protein, 9 aa, Homo sapiens
  light chain complementarity determining region 3 for antibody 52542
QQYDTSPVT

SEQ ID NO: 105084 - protein, 14 aa, Homo sapiens
  heavy chain complementarity determining region 3 for antibody 52542
ARARDWSLPDAFDV

SEQ ID NO: 105085 - protein, 11 aa, Homo sapiens
  light chain complementarity determining region 3 for antibody 52543
QQTYSNRPDIT

SEQ ID NO: 105086 - protein, 12 aa, Homo sapiens
  heavy chain complementarity determining region 3 for antibody 52543
VREGPRTSHWKN

SEQ ID NO: 105087 - protein, 9 aa, Homo sapiens
  light chain complementarity determining region 3 for antibody 52544
QQSYSTPYT

SEQ ID NO: 105088 - protein, 14 aa, Homo sapiens
  heavy chain complementarity determining region 3 for antibody 52544
ARKMGWDGVAWFDP

SEQ ID NO: 105089 - protein, 9 aa, Homo sapiens
  light chain complementarity determining region 3 for antibody 52545
QQSYSTLYT

SEQ ID NO: 105090 - protein, 12 aa, Homo sapiens
  heavy chain complementarity determining region 3 for antibody 52545
VREGPRTSHLKN

SEQ ID NO: 105091 - protein, 9 aa, Homo sapiens
  light chain complementarity determining region 3 for antibody 52546
QQSYSTLYT

SEQ ID NO: 105092 - protein, 19 aa, Homo sapiens
  heavy chain complementarity determining region 3 for antibody 52546
ARLATILRGNMRSIRRLDV

SEQ ID NO: 105093 - protein, 9 aa, Homo sapiens
  light chain complementarity determining region 3 for antibody 52547
QQSYSTLYT

SEQ ID NO: 105094 - protein, 17 aa, Homo sapiens
  heavy chain complementarity determining region 3 for antibody 52547
ARDSSYCGGDCSTASDY

SEQ ID NO: 105095 - protein, 9 aa, Homo sapiens
  light chain complementarity determining region 3 for antibody 52548
QQSYNTPYT

SEQ ID NO: 105096 - protein, 14 aa, Homo sapiens
  heavy chain complementarity determining region 3 for antibody 52548
AKMRGAHGDYVIDY

SEQ ID NO: 105097 - protein, 9 aa, Homo sapiens
  light chain complementarity determining region 3 for antibody 52549
QQSFNAPIT

SEQ ID NO: 105098 - protein, 4 aa, Homo sapiens
  heavy chain complementarity determining region 3 for antibody 52549
AMDV

SEQ ID NO: 105099 - protein, 9 aa, Homo sapiens
  light chain complementarity determining region 3 for antibody 52550
QQLNSYPYT

SEQ ID NO: 105100 - protein, 12 aa, Homo sapiens
  heavy chain complementarity determining region 3 for antibody 52550
VREGPRTSHWKN

SEQ ID NO: 105101 - protein, 9 aa, Homo sapiens
  light chain complementarity determining region 3 for antibody 52551
QQLNSYPYT

SEQ ID NO: 105102 - protein, 12 aa, Homo sapiens
  heavy chain complementarity determining region 3 for antibody 52551
ALSITMVVELDF

SEQ ID NO: 105103 - protein, 9 aa, Homo sapiens
  light chain complementarity determining region 3 for antibody 52552
QQGSTSPYT

SEQ ID NO: 105104 - protein, 13 aa, Homo sapiens
  heavy chain complementarity determining region 3 for antibody 52552
ASGPHIAASGIDY

SEQ ID NO: 105105 - protein, 10 aa, Homo sapiens
  light chain complementarity determining region 3 for antibody 52553
QQANSFPAVT

SEQ ID NO: 105106 - protein, 10 aa, Homo sapiens
  heavy chain complementarity determining region 3 for antibody 52553
ARYSRGYNDY

SEQ ID NO: 105107 - protein, 9 aa, Homo sapiens
  light chain complementarity determining region 3 for antibody 52554
QLFNNFLIT

SEQ ID NO: 105108 - protein, 13 aa, Homo sapiens
  heavy chain complementarity determining region 3 for antibody 52554
ARGIPGAAYALDV

SEQ ID NO: 105109 - protein, 9 aa, Homo sapiens
  light chain complementarity determining region 3 for antibody 52555
QHYNTYPWT

SEQ ID NO: 105110 - protein, 18 aa, Homo sapiens
  heavy chain complementarity determining region 3 for antibody 52555
ANPLDASGSYIPVNWFDP

SEQ ID NO: 105111 - protein, 8 aa, Homo sapiens
  light chain complementarity determining region 3 for antibody 52556
MQTLQTPT

SEQ ID NO: 105112 - protein, 18 aa, Homo sapiens
  heavy chain complementarity determining region 3 for antibody 52556
ARKPQTPYSSTWSNWLDP

SEQ ID NO: 105113 - protein, 8 aa, Homo sapiens
  light chain complementarity determining region 3 for antibody 52557
MQGTHFYT

SEQ ID NO: 105114 - protein, 14 aa, Homo sapiens
  heavy chain complementarity determining region 3 for antibody 52557
ARDGGPYGRDAFDI

SEQ ID NO: 105115 - protein, 10 aa, Homo sapiens
  light chain complementarity determining region 3 for antibody 52558
HQYEHLPPYT

SEQ ID NO: 105116 - protein, 12 aa, Homo sapiens
  heavy chain complementarity determining region 3 for antibody 52558
VREGPRTSHWKN

SEQ ID NO: 105117 - protein, 9 aa, Homo sapiens
  light chain complementarity determining region 3 for antibody 52559
QQYNTLQWT

SEQ ID NO: 105118 - protein, 14 aa, Homo sapiens
  heavy chain complementarity determining region 3 for antibody 52559
ARKMGWDGVAWSDP

SEQ ID NO: 105119 - protein, 9 aa, Homo sapiens
  light chain complementarity determining region 3 for antibody 52560
QQYNTFPYS

SEQ ID NO: 105120 - protein, 11 aa, Homo sapiens
  heavy chain complementarity determining region 3 for antibody 52560
ARDDETRGMDV

SEQ ID NO: 105121 - protein, 9 aa, Homo sapiens
  light chain complementarity determining region 3 for antibody 52561
QQYNSYPYT

SEQ ID NO: 105122 - protein, 12 aa, Homo sapiens
  heavy chain complementarity determining region 3 for antibody 52561
VREGPRTSHWKN

SEQ ID NO: 105123 - protein, 9 aa, Homo sapiens
  light chain complementarity determining region 3 for antibody 52562
QQYGSSPLT

SEQ ID NO: 105124 - protein, 12 aa, Homo sapiens
  heavy chain complementarity determining region 3 for antibody 52562
ARGSQYWNYMDV

SEQ ID NO: 105125 - protein, 10 aa, Homo sapiens
  light chain complementarity determining region 3 for antibody 52563
QQYGSSLSLT

SEQ ID NO: 105126 - protein, 14 aa, Homo sapiens
  heavy chain complementarity determining region 3 for antibody 52563
AISVWVRSGWYFDQ

SEQ ID NO: 105127 - protein, 9 aa, Homo sapiens
  light chain complementarity determining region 3 for antibody 52564
QQYDNWPRV

SEQ ID NO: 105128 - protein, 24 aa, Homo sapiens
  heavy chain complementarity determining region 3 for antibody 52564
ARARVEGGTIFGVVNRAYSYGTDV

SEQ ID NO: 105129 - protein, 11 aa, Homo sapiens
  light chain complementarity determining region 3 for antibody 52565
QQTYSNRPDIT

SEQ ID NO: 105130 - protein, 14 aa, Homo sapiens
  heavy chain complementarity determining region 3 for antibody 52565
ARKMGWDGVAWFDP

SEQ ID NO: 105131 - protein, 11 aa, Homo sapiens
  light chain complementarity determining region 3 for antibody 52566
QQTYSNRPDIT

SEQ ID NO: 105132 - protein, 20 aa, Homo sapiens
  heavy chain complementarity determining region 3 for antibody 52566
ANRPFTFHYDTGGYYNWFDP

SEQ ID NO: 105133 - protein, 11 aa, Homo sapiens
  light chain complementarity determining region 3 for antibody 52567
QQTYSNRPDIT

SEQ ID NO: 105134 - protein, 20 aa, Homo sapiens
  heavy chain complementarity determining region 3 for antibody 52567
AHRPFTCHYDTGGYYNWFDP

SEQ ID NO: 105135 - protein, 9 aa, Homo sapiens
  light chain complementarity determining region 3 for antibody 52568
QQSYSTPYT

SEQ ID NO: 105136 - protein, 26 aa, Homo sapiens
  heavy chain complementarity determining region 3 for antibody 52568
AKSGLELSLGSDYYYDSSGYSVYFDY

SEQ ID NO: 105137 - protein, 9 aa, Homo sapiens
  light chain complementarity determining region 3 for antibody 52569
QQSYSTLYT

SEQ ID NO: 105138 - protein, 12 aa, Homo sapiens
  heavy chain complementarity determining region 3 for antibody 52569
VSEGPRTSHWKN

SEQ ID NO: 105139 - protein, 9 aa, Homo sapiens
  light chain complementarity determining region 3 for antibody 52570
QQSYSTLYT

SEQ ID NO: 105140 - protein, 12 aa, Homo sapiens
  heavy chain complementarity determining region 3 for antibody 52570
VREGPSTSHWKN

SEQ ID NO: 105141 - protein, 9 aa, Homo sapiens
  light chain complementarity determining region 3 for antibody 52571
QQSYSTLYT

SEQ ID NO: 105142 - protein, 12 aa, Homo sapiens
  heavy chain complementarity determining region 3 for antibody 52571
VREGPRPSHWKD

SEQ ID NO: 105143 - protein, 9 aa, Homo sapiens
  light chain complementarity determining region 3 for antibody 52572
QQSYSTLYT

SEQ ID NO: 105144 - protein, 7 aa, Homo sapiens
  heavy chain complementarity determining region 3 for antibody 52572
SPVSGRY

SEQ ID NO: 105145 - protein, 9 aa, Homo sapiens
  light chain complementarity determining region 3 for antibody 52573
QQSHGSPIT

SEQ ID NO: 105146 - protein, 14 aa, Homo sapiens
  heavy chain complementarity determining region 3 for antibody 52573
ARYLPSPDYGEFDS

SEQ ID NO: 105147 - protein, 9 aa, Homo sapiens
  light chain complementarity determining region 3 for antibody 52574
QQFGGAPRT

SEQ ID NO: 105148 - protein, 16 aa, Homo sapiens
  heavy chain complementarity determining region 3 for antibody 52574
ARDPRGGVAVPADFNY

SEQ ID NO: 105149 - protein, 9 aa, Homo sapiens
  light chain complementarity determining region 3 for antibody 52575
QQFDTPPGT

SEQ ID NO: 105150 - protein, 15 aa, Homo sapiens
  heavy chain complementarity determining region 3 for antibody 52575
ARFEISFTTASAFNY

SEQ ID NO: 105151 - protein, 9 aa, Homo sapiens
  light chain complementarity determining region 3 for antibody 52576
QQCYSFPYT

SEQ ID NO: 105152 - protein, 12 aa, Homo sapiens
  heavy chain complementarity determining region 3 for antibody 52576
VREGPRPSHWKN

SEQ ID NO: 105153 - protein, 9 aa, Homo sapiens
  light chain complementarity determining region 3 for antibody 52577
QQCYSFPYT

SEQ ID NO: 105154 - protein, 12 aa, Homo sapiens
  heavy chain complementarity determining region 3 for antibody 52577
ALSITMVVEPDF

SEQ ID NO: 105155 - protein, 9 aa, Homo sapiens
  light chain complementarity determining region 3 for antibody 52578
QKYNTVPLT

SEQ ID NO: 105156 - protein, 20 aa, Homo sapiens
  heavy chain complementarity determining region 3 for antibody 52578
ARGSYCRDGNCYSWDNWLDT

SEQ ID NO: 105157 - protein, 10 aa, Homo sapiens
  light chain complementarity determining region 3 for antibody 52579
QSRGNWPPYT

SEQ ID NO: 105158 - protein, 15 aa, Homo sapiens
  heavy chain complementarity determining region 3 for antibody 52579
ATTGLIQMWSPYFEY

SEQ ID NO: 105159 - protein, 10 aa, Homo sapiens
  light chain complementarity determining region 3 for antibody 52580
QQYYNNSPYT

SEQ ID NO: 105160 - protein, 12 aa, Homo sapiens
  heavy chain complementarity determining region 3 for antibody 52580
VREGPRTSHWKN

SEQ ID NO: 105161 - protein, 10 aa, Homo sapiens
  light chain complementarity determining region 3 for antibody 52581
QQYYNNSPYT

SEQ ID NO: 105162 - protein, 24 aa, Homo sapiens
  heavy chain complementarity determining region 3 for antibody 52581
ARISVYFGTVASAASKRYRSYFDY

SEQ ID NO: 105163 - protein, 11 aa, Homo sapiens
  light chain complementarity determining region 3 for antibody 52582
QQYGTTPLGFT

SEQ ID NO: 105164 - protein, 17 aa, Homo sapiens
  heavy chain complementarity determining region 3 for antibody 52582
ARFDPAAGEKGRYWFDP

SEQ ID NO: 105165 - protein, 8 aa, Homo sapiens
  light chain complementarity determining region 3 for antibody 52583
QQYGSLIT

SEQ ID NO: 105166 - protein, 18 aa, Homo sapiens
  heavy chain complementarity determining region 3 for antibody 52583
AKGDLASCTGAICYPIDY

SEQ ID NO: 105167 - protein, 10 aa, Homo sapiens
  light chain complementarity determining region 3 for antibody 52584
QQYDTLLPIT

SEQ ID NO: 105168 - protein, 12 aa, Homo sapiens
  heavy chain complementarity determining region 3 for antibody 52584
VKDRGSSRAFGY

SEQ ID NO: 105169 - protein, 8 aa, Homo sapiens
  light chain complementarity determining region 3 for antibody 52585
QQYATSWT

SEQ ID NO: 105170 - protein, 16 aa, Homo sapiens
  heavy chain complementarity determining region 3 for antibody 52585
AAGPSVEGVLREYLPH

SEQ ID NO: 105171 - protein, 9 aa, Homo sapiens
  light chain complementarity determining region 3 for antibody 52586
QQSYSTPYT

SEQ ID NO: 105172 - protein, 12 aa, Homo sapiens
  heavy chain complementarity determining region 3 for antibody 52586
VREGPRTSHWKN

SEQ ID NO: 105173 - protein, 9 aa, Homo sapiens
  light chain complementarity determining region 3 for antibody 52587
QQSYSTPLT

SEQ ID NO: 105174 - protein, 10 aa, Homo sapiens
  heavy chain complementarity determining region 3 for antibody 52587
ARERGSAFDL

SEQ ID NO: 105175 - protein, 9 aa, Homo sapiens
  light chain complementarity determining region 3 for antibody 52588
QQSYSTLYT

SEQ ID NO: 105176 - protein, 15 aa, Homo sapiens
  heavy chain complementarity determining region 3 for antibody 52588
ATYMSGLYYYYAMDV

SEQ ID NO: 105177 - protein, 9 aa, Homo sapiens
  light chain complementarity determining region 3 for antibody 52589
QQSSSTPRT

SEQ ID NO: 105178 - protein, 19 aa, Homo sapiens
  heavy chain complementarity determining region 3 for antibody 52589
AKDSVYFGSGNNYIHYFDY

SEQ ID NO: 105179 - protein, 9 aa, Homo sapiens
  light chain complementarity determining region 3 for antibody 52590
QQSGSSILT

SEQ ID NO: 105180 - protein, 15 aa, Homo sapiens
  heavy chain complementarity determining region 3 for antibody 52590
ARGFTSGWYSEYFHH

SEQ ID NO: 105181 - protein, 9 aa, Homo sapiens
  light chain complementarity determining region 3 for antibody 52591
QQLSAYPWT

SEQ ID NO: 105182 - protein, 16 aa, Homo sapiens
  heavy chain complementarity determining region 3 for antibody 52591
AAGFTSWGGSDIRFDD

SEQ ID NO: 105183 - protein, 9 aa, Homo sapiens
  light chain complementarity determining region 3 for antibody 52592
QQHSNWPWT

SEQ ID NO: 105184 - protein, 9 aa, Homo sapiens
  heavy chain complementarity determining region 3 for antibody 52592
ARAFDYGDY

SEQ ID NO: 105185 - protein, 11 aa, Homo sapiens
  light chain complementarity determining region 3 for antibody 52593
QQHLTSPPHWA

SEQ ID NO: 105186 - protein, 12 aa, Homo sapiens
  heavy chain complementarity determining region 3 for antibody 52593
VKEKGGVRVLDL

SEQ ID NO: 105187 - protein, 9 aa, Homo sapiens
  light chain complementarity determining region 3 for antibody 52594
QQGYSSLIT

SEQ ID NO: 105188 - protein, 17 aa, Homo sapiens
  heavy chain complementarity determining region 3 for antibody 52594
ARDGNIDDSDALDSFDY

SEQ ID NO: 105189 - protein, 9 aa, Homo sapiens
  light chain complementarity determining region 3 for antibody 52595
QQCYSFPYT

SEQ ID NO: 105190 - protein, 14 aa, Homo sapiens
  heavy chain complementarity determining region 3 for antibody 52595
ARKMGWDGVAWLDP

SEQ ID NO: 105191 - protein, 9 aa, Homo sapiens
  light chain complementarity determining region 3 for antibody 52596
QQCYNTPLT

SEQ ID NO: 105192 - protein, 9 aa, Homo sapiens
  heavy chain complementarity determining region 3 for antibody 52596
ARDQGAMNS

SEQ ID NO: 105193 - protein, 11 aa, Homo sapiens
  light chain complementarity determining region 3 for antibody 52597
QKYSSAPLIYT

SEQ ID NO: 105194 - protein, 27 aa, Homo sapiens
  heavy chain complementarity determining region 3 for antibody 52597
ALGFQVTEKDFWSGFYRPKEYYYGMDV

SEQ ID NO: 105195 - protein, 9 aa, Homo sapiens
  light chain complementarity determining region 3 for antibody 52598
QKYNSAPPT

SEQ ID NO: 105196 - protein, 12 aa, Homo sapiens
  heavy chain complementarity determining region 3 for antibody 52598
VREGPRTSHWKN

SEQ ID NO: 105197 - protein, 9 aa, Homo sapiens
  light chain complementarity determining region 3 for antibody 52599
QHYNSYSLT

SEQ ID NO: 105198 - protein, 16 aa, Homo sapiens
  heavy chain complementarity determining region 3 for antibody 52599
ARFSGYVNYLQFYMDV

SEQ ID NO: 105199 - protein, 9 aa, Homo sapiens
  light chain complementarity determining region 3 for antibody 52600
QHYHTSMYT

SEQ ID NO: 105200 - protein, 12 aa, Homo sapiens
  heavy chain complementarity determining region 3 for antibody 52600
VREGPRPSHWKN

SEQ ID NO: 105201 - protein, 9 aa, Homo sapiens
  light chain complementarity determining region 3 for antibody 52601
MQGTHWPYT

SEQ ID NO: 105202 - protein, 10 aa, Homo sapiens
  heavy chain complementarity determining region 3 for antibody 52601
VRDVWFSADY

SEQ ID NO: 105203 - protein, 9 aa, Homo sapiens
  light chain complementarity determining region 3 for antibody 52602
MQGTHWPRT

SEQ ID NO: 105204 - protein, 18 aa, Homo sapiens
  heavy chain complementarity determining region 3 for antibody 52602
AKDLGHYYESSGFYLGDY

SEQ ID NO: 105205 - protein, 9 aa, Homo sapiens
  light chain complementarity determining region 3 for antibody 52603
LQSYSAPQT

SEQ ID NO: 105206 - protein, 24 aa, Homo sapiens
  heavy chain complementarity determining region 3 for antibody 52603
ARQGLGDTSSWYEWDEPDGYGMDV

SEQ ID NO: 105207 - protein, 9 aa, Homo sapiens
  light chain complementarity determining region 3 for antibody 52604
LQHDRFPLT

SEQ ID NO: 105208 - protein, 14 aa, Homo sapiens
  heavy chain complementarity determining region 3 for antibody 52604
ARKMGWDGVAWFDP

SEQ ID NO: 105209 - protein, 9 aa, Homo sapiens
  light chain complementarity determining region 3 for antibody 52605
HQYDTYSWT

SEQ ID NO: 105210 - protein, 17 aa, Homo sapiens
  heavy chain complementarity determining region 3 for antibody 52605
VRGRIAARPIWRPPNDY

SEQ ID NO: 105211 - protein, 9 aa, Homo sapiens
  light chain complementarity determining region 3 for antibody 52606
QQYSSYPLT

SEQ ID NO: 105212 - protein, 13 aa, Homo sapiens
  heavy chain complementarity determining region 3 for antibody 52606
ARNNDYLSAYILD

SEQ ID NO: 105213 - protein, 9 aa, Homo sapiens
  light chain complementarity determining region 3 for antibody 52607
QQYSNIPPT

SEQ ID NO: 105214 - protein, 17 aa, Homo sapiens
  heavy chain complementarity determining region 3 for antibody 52607
ARGPLIQGLIVPVPLDY

SEQ ID NO: 105215 - protein, 8 aa, Homo sapiens
  light chain complementarity determining region 3 for antibody 52608
QQYNSYWT

SEQ ID NO: 105216 - protein, 12 aa, Homo sapiens
  heavy chain complementarity determining region 3 for antibody 52608
VREGPRTSHWKN

SEQ ID NO: 105217 - protein, 8 aa, Homo sapiens
  light chain complementarity determining region 3 for antibody 52609
QQYNSYWT

SEQ ID NO: 105218 - protein, 14 aa, Homo sapiens
  heavy chain complementarity determining region 3 for antibody 52609
ARKMGWDGVAWFDP

SEQ ID NO: 105219 - protein, 8 aa, Homo sapiens
  light chain complementarity determining region 3 for antibody 52610
QQYNSYWT

SEQ ID NO: 105220 - protein, 11 aa, Homo sapiens
  heavy chain complementarity determining region 3 for antibody 52610
ARGAWPCFFDL

SEQ ID NO: 105221 - protein, 9 aa, Homo sapiens
  light chain complementarity determining region 3 for antibody 52611
QQYNSYSST

SEQ ID NO: 105222 - protein, 15 aa, Homo sapiens
  heavy chain complementarity determining region 3 for antibody 52611
ARGGGPYYDSSGYHQ

SEQ ID NO: 105223 - protein, 9 aa, Homo sapiens
  light chain complementarity determining region 3 for antibody 52612
QQYNSYSKT

SEQ ID NO: 105224 - protein, 12 aa, Homo sapiens
  heavy chain complementarity determining region 3 for antibody 52612
VREGPRTSHWKN

SEQ ID NO: 105225 - protein, 9 aa, Homo sapiens
  light chain complementarity determining region 3 for antibody 52613
QQYNSAPPT

SEQ ID NO: 105226 - protein, 15 aa, Homo sapiens
  heavy chain complementarity determining region 3 for antibody 52613
ARGGGPYYDSSGYQQ

SEQ ID NO: 105227 - protein, 8 aa, Homo sapiens
  light chain complementarity determining region 3 for antibody 52614
QQYNNYSS

SEQ ID NO: 105228 - protein, 19 aa, Homo sapiens
  heavy chain complementarity determining region 3 for antibody 52614
AHSGSQLLWFAELQNWFDP

SEQ ID NO: 105229 - protein, 9 aa, Homo sapiens
  light chain complementarity determining region 3 for antibody 52615
QQYHSWPKT

SEQ ID NO: 105230 - protein, 9 aa, Homo sapiens
  heavy chain complementarity determining region 3 for antibody 52615
ARGAGITDY

SEQ ID NO: 105231 - protein, 9 aa, Homo sapiens
  light chain complementarity determining region 3 for antibody 52616
QQYGSSPWT

SEQ ID NO: 105232 - protein, 14 aa, Homo sapiens
  heavy chain complementarity determining region 3 for antibody 52616
ARKMGWDGVAWFDP

SEQ ID NO: 105233 - protein, 10 aa, Homo sapiens
  light chain complementarity determining region 3 for antibody 52617
QQYGSSPRVA

SEQ ID NO: 105234 - protein, 20 aa, Homo sapiens
  heavy chain complementarity determining region 3 for antibody 52617
ANPPREWFGELFYYLEYFQE

SEQ ID NO: 105235 - protein, 9 aa, Homo sapiens
  light chain complementarity determining region 3 for antibody 52618
QQYGSSPRT

SEQ ID NO: 105236 - protein, 11 aa, Homo sapiens
  heavy chain complementarity determining region 3 for antibody 52618
TRTEVLAAFDI

SEQ ID NO: 105237 - protein, 9 aa, Homo sapiens
  light chain complementarity determining region 3 for antibody 52619
QQYGRSPRT

SEQ ID NO: 105238 - protein, 20 aa, Homo sapiens
  heavy chain complementarity determining region 3 for antibody 52619
GRARGYNGHGALSHYYYMDV

SEQ ID NO: 105239 - protein, 9 aa, Homo sapiens
  light chain complementarity determining region 3 for antibody 52620
QQYGGSPRT

SEQ ID NO: 105240 - protein, 16 aa, Homo sapiens
  heavy chain complementarity determining region 3 for antibody 52620
GRAPGIKAVEGYYLDY

SEQ ID NO: 105241 - protein, 9 aa, Homo sapiens
  light chain complementarity determining region 3 for antibody 52621
QQYFYIPPT

SEQ ID NO: 105242 - protein, 17 aa, Homo sapiens
  heavy chain complementarity determining region 3 for antibody 52621
ARGPLIRGLIVPVPLDY

SEQ ID NO: 105243 - protein, 7 aa, Homo sapiens
  light chain complementarity determining region 3 for antibody 52622
QQYDNRL

SEQ ID NO: 105244 - protein, 14 aa, Homo sapiens
  heavy chain complementarity determining region 3 for antibody 52622
ATDLYKWNDDTLDY

SEQ ID NO: 105245 - protein, 9 aa, Homo sapiens
  light chain complementarity determining region 3 for antibody 52623
QQYDNLPLT

SEQ ID NO: 105246 - protein, 14 aa, Homo sapiens
  heavy chain complementarity determining region 3 for antibody 52623
ARGRMATSSWTIDH

SEQ ID NO: 105247 - protein, 9 aa, Homo sapiens
  light chain complementarity determining region 3 for antibody 52624
QQSYSTSYT

SEQ ID NO: 105248 - protein, 12 aa, Homo sapiens
  heavy chain complementarity determining region 3 for antibody 52624
VREGPRTSHWKN

SEQ ID NO: 105249 - protein, 9 aa, Homo sapiens
  light chain complementarity determining region 3 for antibody 52625
QQSYSTLYT

SEQ ID NO: 105250 - protein, 12 aa, Homo sapiens
  heavy chain complementarity determining region 3 for antibody 52625
VREVPRTSHWKN

SEQ ID NO: 105251 - protein, 9 aa, Homo sapiens
  light chain complementarity determining region 3 for antibody 52626
QQSYSTLYT

SEQ ID NO: 105252 - protein, 12 aa, Homo sapiens
  heavy chain complementarity determining region 3 for antibody 52626
VREGPRTSHCKN

SEQ ID NO: 105253 - protein, 9 aa, Homo sapiens
  light chain complementarity determining region 3 for antibody 52627
QQSYSTLYT

SEQ ID NO: 105254 - protein, 12 aa, Homo sapiens
  heavy chain complementarity determining region 3 for antibody 52627
VREGPLPSHWKN

SEQ ID NO: 105255 - protein, 9 aa, Homo sapiens
  light chain complementarity determining region 3 for antibody 52628
QQSYSTLYT

SEQ ID NO: 105256 - protein, 12 aa, Homo sapiens
  heavy chain complementarity determining region 3 for antibody 52628
VREGPGPSHWKN

SEQ ID NO: 105257 - protein, 9 aa, Homo sapiens
  light chain complementarity determining region 3 for antibody 52629
QQSYSTLYT

SEQ ID NO: 105258 - protein, 12 aa, Homo sapiens
  heavy chain complementarity determining region 3 for antibody 52629
VREGPGASHWKN

SEQ ID NO: 105259 - protein, 9 aa, Homo sapiens
  light chain complementarity determining region 3 for antibody 52630
QQSYSTLYT

SEQ ID NO: 105260 - protein, 12 aa, Homo sapiens
  heavy chain complementarity determining region 3 for antibody 52630
VGEGPRTSHWKN

SEQ ID NO: 105261 - protein, 9 aa, Homo sapiens
  light chain complementarity determining region 3 for antibody 52631
QQSYSTLYT

SEQ ID NO: 105262 - protein, 24 aa, Homo sapiens
  heavy chain complementarity determining region 3 for antibody 52631
ARLSVYFGTVASAASKRYRSYFDY

SEQ ID NO: 105263 - protein, 9 aa, Homo sapiens
  light chain complementarity determining region 3 for antibody 52632
QQSYSTLYT

SEQ ID NO: 105264 - protein, 12 aa, Homo sapiens
  heavy chain complementarity determining region 3 for antibody 52632
ALSITMVVEPDF

SEQ ID NO: 105265 - protein, 9 aa, Homo sapiens
  light chain complementarity determining region 3 for antibody 52633
QQSYSSLRA

SEQ ID NO: 105266 - protein, 11 aa, Homo sapiens
  heavy chain complementarity determining region 3 for antibody 52633
ARINSLDAFDI

SEQ ID NO: 105267 - protein, 8 aa, Homo sapiens
  light chain complementarity determining region 3 for antibody 52634
QQSDTLWT

SEQ ID NO: 105268 - protein, 17 aa, Homo sapiens
  heavy chain complementarity determining region 3 for antibody 52634
ARHGGRSWIDAYYGMDV

SEQ ID NO: 105269 - protein, 9 aa, Homo sapiens
  light chain complementarity determining region 3 for antibody 52635
QQLNSYPYT

SEQ ID NO: 105270 - protein, 12 aa, Homo sapiens
  heavy chain complementarity determining region 3 for antibody 52635
ALSIAMVVEPDF

SEQ ID NO: 105271 - protein, 7 aa, Homo sapiens
  light chain complementarity determining region 3 for antibody 52636
QQLNSYL

SEQ ID NO: 105272 - protein, 13 aa, Homo sapiens
  heavy chain complementarity determining region 3 for antibody 52636
ANGIATGGAQFDY

SEQ ID NO: 105273 - protein, 9 aa, Homo sapiens
  light chain complementarity determining region 3 for antibody 52637
QQFDDLPIT

SEQ ID NO: 105274 - protein, 9 aa, Homo sapiens
  heavy chain complementarity determining region 3 for antibody 52637
ARSTHPRGP

SEQ ID NO: 105275 - protein, 9 aa, Homo sapiens
  light chain complementarity determining region 3 for antibody 52638
QQCYSFPYT

SEQ ID NO: 105276 - protein, 14 aa, Homo sapiens
  heavy chain complementarity determining region 3 for antibody 52638
ARKMGLDGVAWFDP

SEQ ID NO: 105277 - protein, 9 aa, Homo sapiens
  light chain complementarity determining region 3 for antibody 52639
QQCYSFPYT

SEQ ID NO: 105278 - protein, 14 aa, Homo sapiens
  heavy chain complementarity determining region 3 for antibody 52639
ARKIGWDGVAWFDP

SEQ ID NO: 105279 - protein, 9 aa, Homo sapiens
  light chain complementarity determining region 3 for antibody 52640
QQCYSFPYT

SEQ ID NO: 105280 - protein, 11 aa, Homo sapiens
  heavy chain complementarity determining region 3 for antibody 52640
ARGAWPYFFDL

SEQ ID NO: 105281 - protein, 9 aa, Homo sapiens
  light chain complementarity determining region 3 for antibody 52641
QQCATPPLT

SEQ ID NO: 105282 - protein, 10 aa, Homo sapiens
  heavy chain complementarity determining region 3 for antibody 52641
AWGFGWSSDY

SEQ ID NO: 105283 - protein, 9 aa, Homo sapiens
  light chain complementarity determining region 3 for antibody 52642
QQALNYPWT

SEQ ID NO: 105284 - protein, 7 aa, Homo sapiens
  heavy chain complementarity determining region 3 for antibody 52642
SPVSGRY

SEQ ID NO: 105285 - protein, 9 aa, Homo sapiens
  light chain complementarity determining region 3 for antibody 52643
QQALNYPWT

SEQ ID NO: 105286 - protein, 14 aa, Homo sapiens
  heavy chain complementarity determining region 3 for antibody 52643
ARKMGWDGVAWFDP

SEQ ID NO: 105287 - protein, 8 aa, Homo sapiens
  light chain complementarity determining region 3 for antibody 52644
QLYSASRT

SEQ ID NO: 105288 - protein, 14 aa, Homo sapiens
  heavy chain complementarity determining region 3 for antibody 52644
ARGGRWSTVAFLDL

SEQ ID NO: 105289 - protein, 9 aa, Homo sapiens
  light chain complementarity determining region 3 for antibody 52645
QKYNSAPPT

SEQ ID NO: 105290 - protein, 15 aa, Homo sapiens
  heavy chain complementarity determining region 3 for antibody 52645
ARRGYYGPGKMAYDI

SEQ ID NO: 105291 - protein, 9 aa, Homo sapiens
  light chain complementarity determining region 3 for antibody 52646
QKYNSAPPT

SEQ ID NO: 105292 - protein, 15 aa, Homo sapiens
  heavy chain complementarity determining region 3 for antibody 52646
ARGGGTYYDSSGYQQ

SEQ ID NO: 105293 - protein, 9 aa, Homo sapiens
  light chain complementarity determining region 3 for antibody 52647
QHYDASLLT

SEQ ID NO: 105294 - protein, 25 aa, Homo sapiens
  heavy chain complementarity determining region 3 for antibody 52647
AREEGRYYDSGGHYHLDHHYYGMDV

SEQ ID NO: 105295 - protein, 9 aa, Homo sapiens
  light chain complementarity determining region 3 for antibody 52648
MQTLQTPIT

SEQ ID NO: 105296 - protein, 20 aa, Homo sapiens
  heavy chain complementarity determining region 3 for antibody 52648
ARGGGVTMVRGLIVTYHLDH

SEQ ID NO: 105297 - protein, 9 aa, Homo sapiens
  light chain complementarity determining region 3 for antibody 52649
MQSIELPIT

SEQ ID NO: 105298 - protein, 14 aa, Homo sapiens
  heavy chain complementarity determining region 3 for antibody 52649
ARDRNSRFYLYFDQ

SEQ ID NO: 105299 - protein, 9 aa, Homo sapiens
  light chain complementarity determining region 3 for antibody 52650
MQGTHRPPT

SEQ ID NO: 105300 - protein, 22 aa, Homo sapiens
  heavy chain complementarity determining region 3 for antibody 52650
ARDKNDFWSGYYYPDYYYGMDV

SEQ ID NO: 105301 - protein, 9 aa, Homo sapiens
  light chain complementarity determining region 3 for antibody 52651
LQHDRFPLT

SEQ ID NO: 105302 - protein, 12 aa, Homo sapiens
  heavy chain complementarity determining region 3 for antibody 52651
VREGPRTSHWKN

SEQ ID NO: 105303 - protein, 9 aa, Homo sapiens
  light chain complementarity determining region 3 for antibody 52652
LQDYNYPWT

SEQ ID NO: 105304 - protein, 15 aa, Homo sapiens
  heavy chain complementarity determining region 3 for antibody 52652
ARRGYYGPGKMAYDI

SEQ ID NO: 105305 - protein, 9 aa, Homo sapiens
  light chain complementarity determining region 3 for antibody 52653
LQDSSYPRT

SEQ ID NO: 105306 - protein, 18 aa, Homo sapiens
  heavy chain complementarity determining region 3 for antibody 52653
ARDRTPVVAGTYYDAHDV

SEQ ID NO: 105307 - protein, 9 aa, Homo sapiens
  light chain complementarity determining region 3 for antibody 52654
HQYSTSPRT

SEQ ID NO: 105308 - protein, 17 aa, Homo sapiens
  heavy chain complementarity determining region 3 for antibody 52654
VKPRETYSSGWVDAFEM

SEQ ID NO: 105309 - protein, 9 aa, Homo sapiens
  light chain complementarity determining region 3 for antibody 52655
QQYYSSPQT

SEQ ID NO: 105310 - protein, 12 aa, Homo sapiens
  heavy chain complementarity determining region 3 for antibody 52655
VREGPRTSHWKN

SEQ ID NO: 105311 - protein, 9 aa, Homo sapiens
  light chain complementarity determining region 3 for antibody 52656
QQYSVYPIT

SEQ ID NO: 105312 - protein, 16 aa, Homo sapiens
  heavy chain complementarity determining region 3 for antibody 52656
ARYGGFASFSDGPIDC

SEQ ID NO: 105313 - protein, 9 aa, Homo sapiens
  light chain complementarity determining region 3 for antibody 52657
QQYNTLPWT

SEQ ID NO: 105314 - protein, 14 aa, Homo sapiens
  heavy chain complementarity determining region 3 for antibody 52657
ARKMGWDGVAWFDP

SEQ ID NO: 105315 - protein, 9 aa, Homo sapiens
  light chain complementarity determining region 3 for antibody 52658
QQYNSYSST

SEQ ID NO: 105316 - protein, 15 aa, Homo sapiens
  heavy chain complementarity determining region 3 for antibody 52658
ARGGGPYYDSSGYKQ

SEQ ID NO: 105317 - protein, 9 aa, Homo sapiens
  light chain complementarity determining region 3 for antibody 52659
QQYNSYSRT

SEQ ID NO: 105318 - protein, 12 aa, Homo sapiens
  heavy chain complementarity determining region 3 for antibody 52659
VREGPRTSHWKN

SEQ ID NO: 105319 - protein, 9 aa, Homo sapiens
  light chain complementarity determining region 3 for antibody 52660
QQYNSYPWT

SEQ ID NO: 105320 - protein, 11 aa, Homo sapiens
  heavy chain complementarity determining region 3 for antibody 52660
ARGAWPYFFDL

SEQ ID NO: 105321 - protein, 9 aa, Homo sapiens
  light chain complementarity determining region 3 for antibody 52661
QQYNSNPYT

SEQ ID NO: 105322 - protein, 16 aa, Homo sapiens
  heavy chain complementarity determining region 3 for antibody 52661
ARGGMNWGWKDWYLAL

SEQ ID NO: 105323 - protein, 9 aa, Homo sapiens
  light chain complementarity determining region 3 for antibody 52662
QQYNSFPYT

SEQ ID NO: 105324 - protein, 12 aa, Homo sapiens
  heavy chain complementarity determining region 3 for antibody 52662
ATDLGGKSAFDI

SEQ ID NO: 105325 - protein, 9 aa, Homo sapiens
  light chain complementarity determining region 3 for antibody 52663
QQYGSSPWT

SEQ ID NO: 105326 - protein, 24 aa, Homo sapiens
  heavy chain complementarity determining region 3 for antibody 52663
AHRLRTYDYIWDSNRPTVFDAFDI

SEQ ID NO: 105327 - protein, 9 aa, Homo sapiens
  light chain complementarity determining region 3 for antibody 52664
QQYGSSPRT

SEQ ID NO: 105328 - protein, 13 aa, Homo sapiens
  heavy chain complementarity determining region 3 for antibody 52664
ASPDSRSVGAFAI

SEQ ID NO: 105329 - protein, 10 aa, Homo sapiens
  light chain complementarity determining region 3 for antibody 52665
QQYGSSPAWT

SEQ ID NO: 105330 - protein, 17 aa, Homo sapiens
  heavy chain complementarity determining region 3 for antibody 52665
TRVKYCSDGTCYTGTDY

SEQ ID NO: 105331 - protein, 9 aa, Homo sapiens
  light chain complementarity determining region 3 for antibody 52666
QQYFNIPPT

SEQ ID NO: 105332 - protein, 17 aa, Homo sapiens
  heavy chain complementarity determining region 3 for antibody 52666
ARGPLIQGLIVPVPLDY

SEQ ID NO: 105333 - protein, 9 aa, Homo sapiens
  light chain complementarity determining region 3 for antibody 52667
QQYDSYPCT

SEQ ID NO: 105334 - protein, 12 aa, Homo sapiens
  heavy chain complementarity determining region 3 for antibody 52667
VREGPRTSHWKN

SEQ ID NO: 105335 - protein, 10 aa, Homo sapiens
  light chain complementarity determining region 3 for antibody 52668
QQYDNVPPLT

SEQ ID NO: 105336 - protein, 14 aa, Homo sapiens
  heavy chain complementarity determining region 3 for antibody 52668
ARKMGWDGVAWFDP

SEQ ID NO: 105337 - protein, 10 aa, Homo sapiens
  light chain complementarity determining region 3 for antibody 52669
QQYDNLLALT

SEQ ID NO: 105338 - protein, 14 aa, Homo sapiens
  heavy chain complementarity determining region 3 for antibody 52669
AGRWGDITPTILDY

SEQ ID NO: 105339 - protein, 10 aa, Homo sapiens
  light chain complementarity determining region 3 for antibody 52670
QQYDNFLSYT

SEQ ID NO: 105340 - protein, 12 aa, Homo sapiens
  heavy chain complementarity determining region 3 for antibody 52670
VREGPRTSHWKN

SEQ ID NO: 105341 - protein, 8 aa, Homo sapiens
  light chain complementarity determining region 3 for antibody 52671
QQYATSWT

SEQ ID NO: 105342 - protein, 11 aa, Homo sapiens
  heavy chain complementarity determining region 3 for antibody 52671
ARGAWPYFFDL

SEQ ID NO: 105343 - protein, 11 aa, Homo sapiens
  light chain complementarity determining region 3 for antibody 52672
QQTYSNRPAIT

SEQ ID NO: 105344 - protein, 20 aa, Homo sapiens
  heavy chain complementarity determining region 3 for antibody 52672
AHRPFTFHYDTGGYYNWFDP

SEQ ID NO: 105345 - protein, 9 aa, Homo sapiens
  light chain complementarity determining region 3 for antibody 52673
QQSYSTPYT

SEQ ID NO: 105346 - protein, 15 aa, Homo sapiens
  heavy chain complementarity determining region 3 for antibody 52673
ARRGYYGPGKMAYDI

SEQ ID NO: 105347 - protein, 10 aa, Homo sapiens
  light chain complementarity determining region 3 for antibody 52674
QQSYSTPPFT

SEQ ID NO: 105348 - protein, 15 aa, Homo sapiens
  heavy chain complementarity determining region 3 for antibody 52674
ARRGYYGPGKMAFDI

SEQ ID NO: 105349 - protein, 10 aa, Homo sapiens
  light chain complementarity determining region 3 for antibody 52675
QQSYSTPPFT

SEQ ID NO: 105350 - protein, 14 aa, Homo sapiens
  heavy chain complementarity determining region 3 for antibody 52675
ARKMGWDGVAWFDP

SEQ ID NO: 105351 - protein, 9 aa, Homo sapiens
  light chain complementarity determining region 3 for antibody 52676
QQSYSTPFT

SEQ ID NO: 105352 - protein, 15 aa, Homo sapiens
  heavy chain complementarity determining region 3 for antibody 52676
ARTSGRYVRSNYFDP

SEQ ID NO: 105353 - protein, 9 aa, Homo sapiens
  light chain complementarity determining region 3 for antibody 52677
QQSYSTLYT

SEQ ID NO: 105354 - protein, 12 aa, Homo sapiens
  heavy chain complementarity determining region 3 for antibody 52677
VRGGPRASHWKN

SEQ ID NO: 105355 - protein, 9 aa, Homo sapiens
  light chain complementarity determining region 3 for antibody 52678
QQSYSTLYT

SEQ ID NO: 105356 - protein, 12 aa, Homo sapiens
  heavy chain complementarity determining region 3 for antibody 52678
VREVPRPSHWKN

SEQ ID NO: 105357 - protein, 9 aa, Homo sapiens
  light chain complementarity determining region 3 for antibody 52679
QQSYSTLYT

SEQ ID NO: 105358 - protein, 12 aa, Homo sapiens
  heavy chain complementarity determining region 3 for antibody 52679
VREGPRTSHWNN

SEQ ID NO: 105359 - protein, 9 aa, Homo sapiens
  light chain complementarity determining region 3 for antibody 52680
QQSYSTLYT

SEQ ID NO: 105360 - protein, 12 aa, Homo sapiens
  heavy chain complementarity determining region 3 for antibody 52680
VREGPRTSHWKH

SEQ ID NO: 105361 - protein, 9 aa, Homo sapiens
  light chain complementarity determining region 3 for antibody 52681
QQSYSTLYT

SEQ ID NO: 105362 - protein, 12 aa, Homo sapiens
  heavy chain complementarity determining region 3 for antibody 52681
VREGPRTSHWEN

SEQ ID NO: 105363 - protein, 9 aa, Homo sapiens
  light chain complementarity determining region 3 for antibody 52682
QQSYSTLYT

SEQ ID NO: 105364 - protein, 12 aa, Homo sapiens
  heavy chain complementarity determining region 3 for antibody 52682
VREGPRTSHRKN

SEQ ID NO: 105365 - protein, 9 aa, Homo sapiens
  light chain complementarity determining region 3 for antibody 52683
QQSYSTLYT

SEQ ID NO: 105366 - protein, 12 aa, Homo sapiens
  heavy chain complementarity determining region 3 for antibody 52683
VREGPHTSHWKN

SEQ ID NO: 105367 - protein, 9 aa, Homo sapiens
  light chain complementarity determining region 3 for antibody 52684
QQSYSTLYT

SEQ ID NO: 105368 - protein, 12 aa, Homo sapiens
  heavy chain complementarity determining region 3 for antibody 52684
VREGHRTSHWKN

SEQ ID NO: 105369 - protein, 9 aa, Homo sapiens
  light chain complementarity determining region 3 for antibody 52685
QQSYSTLYT

SEQ ID NO: 105370 - protein, 12 aa, Homo sapiens
  heavy chain complementarity determining region 3 for antibody 52685
VREAPRPSHWKN

SEQ ID NO: 105371 - protein, 9 aa, Homo sapiens
  light chain complementarity determining region 3 for antibody 52686
QQSYSTLYT

SEQ ID NO: 105372 - protein, 12 aa, Homo sapiens
  heavy chain complementarity determining region 3 for antibody 52686
VRAGPRTSHWKN

SEQ ID NO: 105373 - protein, 9 aa, Homo sapiens
  light chain complementarity determining region 3 for antibody 52687
QQSYSTLYT

SEQ ID NO: 105374 - protein, 12 aa, Homo sapiens
  heavy chain complementarity determining region 3 for antibody 52687
STHRRGGHQFEY

SEQ ID NO: 105375 - protein, 9 aa, Homo sapiens
  light chain complementarity determining region 3 for antibody 52688
QQSYSTLYT

SEQ ID NO: 105376 - protein, 15 aa, Homo sapiens
  heavy chain complementarity determining region 3 for antibody 52688
ARVGTRYSHGSFFDY

SEQ ID NO: 105377 - protein, 9 aa, Homo sapiens
  light chain complementarity determining region 3 for antibody 52689
QQSYSTLYT

SEQ ID NO: 105378 - protein, 15 aa, Homo sapiens
  heavy chain complementarity determining region 3 for antibody 52689
AKGPGFAYGKKYFQH

SEQ ID NO: 105379 - protein, 9 aa, Homo sapiens
  light chain complementarity determining region 3 for antibody 52690
QQSYSSPFT

SEQ ID NO: 105380 - protein, 14 aa, Homo sapiens
  heavy chain complementarity determining region 3 for antibody 52690
ATMVRGVIGDWFDP

SEQ ID NO: 105381 - protein, 9 aa, Homo sapiens
  light chain complementarity determining region 3 for antibody 52691
QQSYSPLYT

SEQ ID NO: 105382 - protein, 12 aa, Homo sapiens
  heavy chain complementarity determining region 3 for antibody 52691
VREGPRTSHWKN

SEQ ID NO: 105383 - protein, 9 aa, Homo sapiens
  light chain complementarity determining region 3 for antibody 52692
QQSYSNPYT

SEQ ID NO: 105384 - protein, 15 aa, Homo sapiens
  heavy chain complementarity determining region 3 for antibody 52692
ARTSGRYVRSNYFDP

SEQ ID NO: 105385 - protein, 9 aa, Homo sapiens
  light chain complementarity determining region 3 for antibody 52693
QQSYSAPIT

SEQ ID NO: 105386 - protein, 16 aa, Homo sapiens
  heavy chain complementarity determining region 3 for antibody 52693
AKEGFGDGDYEKIFKF

SEQ ID NO: 105387 - protein, 9 aa, Homo sapiens
  light chain complementarity determining region 3 for antibody 52694
QQRSNWPPT

SEQ ID NO: 105388 - protein, 21 aa, Homo sapiens
  heavy chain complementarity determining region 3 for antibody 52694
ASCYSGSGSYYNPVRSVVFDI

SEQ ID NO: 105389 - protein, 11 aa, Homo sapiens
  light chain complementarity determining region 3 for antibody 52695
QQRSHWPPGAT

SEQ ID NO: 105390 - protein, 16 aa, Homo sapiens
  heavy chain complementarity determining region 3 for antibody 52695
AKEGDYAGRAYLAFDI

SEQ ID NO: 105391 - protein, 9 aa, Homo sapiens
  light chain complementarity determining region 3 for antibody 52696
QQRNNWPPT

SEQ ID NO: 105392 - protein, 19 aa, Homo sapiens
  heavy chain complementarity determining region 3 for antibody 52696
ASGHYYSSSGGGYLSSFPY

SEQ ID NO: 105393 - protein, 9 aa, Homo sapiens
  light chain complementarity determining region 3 for antibody 52697
QQLNSYPYT

SEQ ID NO: 105394 - protein, 12 aa, Homo sapiens
  heavy chain complementarity determining region 3 for antibody 52697
ALSSTMVVEPDF

SEQ ID NO: 105395 - protein, 9 aa, Homo sapiens
  light chain complementarity determining region 3 for antibody 52698
QQGLSFPHT

SEQ ID NO: 105396 - protein, 18 aa, Homo sapiens
  heavy chain complementarity determining region 3 for antibody 52698
ASQLDSSVGSKAYWYFDI

SEQ ID NO: 105397 - protein, 9 aa, Homo sapiens
  light chain complementarity determining region 3 for antibody 52699
QQGISFPHT

SEQ ID NO: 105398 - protein, 18 aa, Homo sapiens
  heavy chain complementarity determining region 3 for antibody 52699
ASQLDSSVGSKAYWYFDI

SEQ ID NO: 105399 - protein, 9 aa, Homo sapiens
  light chain complementarity determining region 3 for antibody 52700
QQFSSYWLS

SEQ ID NO: 105400 - protein, 23 aa, Homo sapiens
  heavy chain complementarity determining region 3 for antibody 52700
ASGGDILVVPSALETMIRGPGDS

SEQ ID NO: 105401 - protein, 9 aa, Homo sapiens
  light chain complementarity determining region 3 for antibody 52701
QQDFNIPPT

SEQ ID NO: 105402 - protein, 17 aa, Homo sapiens
  heavy chain complementarity determining region 3 for antibody 52701
ARGPLIRGLIVPVPLDY

SEQ ID NO: 105403 - protein, 9 aa, Homo sapiens
  light chain complementarity determining region 3 for antibody 52702
QQCYSTLYT

SEQ ID NO: 105404 - protein, 12 aa, Homo sapiens
  heavy chain complementarity determining region 3 for antibody 52702
VREGPRPSHWKN

SEQ ID NO: 105405 - protein, 9 aa, Homo sapiens
  light chain complementarity determining region 3 for antibody 52703
QQCYSFPYT

SEQ ID NO: 105406 - protein, 7 aa, Homo sapiens
  heavy chain complementarity determining region 3 for antibody 52703
SPVSGRY

SEQ ID NO: 105407 - protein, 9 aa, Homo sapiens
  light chain complementarity determining region 3 for antibody 52704
QQCYSFPYT

SEQ ID NO: 105408 - protein, 11 aa, Homo sapiens
  heavy chain complementarity determining region 3 for antibody 52704
ARTNSVRWFDP

SEQ ID NO: 105409 - protein, 9 aa, Homo sapiens
  light chain complementarity determining region 3 for antibody 52705
QQCYSFPYT

SEQ ID NO: 105410 - protein, 13 aa, Homo sapiens
  heavy chain complementarity determining region 3 for antibody 52705
ARTHHLGRSPFDL

SEQ ID NO: 105411 - protein, 9 aa, Homo sapiens
  light chain complementarity determining region 3 for antibody 52706
QQCYSFPYT

SEQ ID NO: 105412 - protein, 14 aa, Homo sapiens
  heavy chain complementarity determining region 3 for antibody 52706
ARKRGWDGVAWFDP

SEQ ID NO: 105413 - protein, 9 aa, Homo sapiens
  light chain complementarity determining region 3 for antibody 52707
QQCYSFPYT

SEQ ID NO: 105414 - protein, 16 aa, Homo sapiens
  heavy chain complementarity determining region 3 for antibody 52707
ARGPVKAHYYYYYMDV

SEQ ID NO: 105415 - protein, 9 aa, Homo sapiens
  light chain complementarity determining region 3 for antibody 52708
QQCYSFPYT

SEQ ID NO: 105416 - protein, 13 aa, Homo sapiens
  heavy chain complementarity determining region 3 for antibody 52708
ARDAADWRAAFDV

SEQ ID NO: 105417 - protein, 9 aa, Homo sapiens
  light chain complementarity determining region 3 for antibody 52709
QQCYSFPYT

SEQ ID NO: 105418 - protein, 17 aa, Homo sapiens
  heavy chain complementarity determining region 3 for antibody 52709
AKGPAPYNWTYGLLFDQ

SEQ ID NO: 105419 - protein, 8 aa, Homo sapiens
  light chain complementarity determining region 3 for antibody 52710
QPYGSSRP

SEQ ID NO: 105420 - protein, 7 aa, Homo sapiens
  heavy chain complementarity determining region 3 for antibody 52710
SPVSGRY

SEQ ID NO: 105421 - protein, 9 aa, Homo sapiens
  light chain complementarity determining region 3 for antibody 52711
QHYNSYSLT

SEQ ID NO: 105422 - protein, 14 aa, Homo sapiens
  heavy chain complementarity determining region 3 for antibody 52711
ARKMGWDGVAWFDP

SEQ ID NO: 105423 - protein, 11 aa, Homo sapiens
  light chain complementarity determining region 3 for antibody 52712
QHYGSSPPRFT

SEQ ID NO: 105424 - protein, 12 aa, Homo sapiens
  heavy chain complementarity determining region 3 for antibody 52712
ARYMGDYYAFDI

SEQ ID NO: 105425 - protein, 9 aa, Homo sapiens
  light chain complementarity determining region 3 for antibody 52713
QHFGSSGYT

SEQ ID NO: 105426 - protein, 22 aa, Homo sapiens
  heavy chain complementarity determining region 3 for antibody 52713
ARDIGRSGWYAESRYYYKAMDV

SEQ ID NO: 105427 - protein, 9 aa, Homo sapiens
  light chain complementarity determining region 3 for antibody 52714
QEYGSSSRT

SEQ ID NO: 105428 - protein, 13 aa, Homo sapiens
  heavy chain complementarity determining region 3 for antibody 52714
ARGSPYYSGSGGS

SEQ ID NO: 105429 - protein, 9 aa, Homo sapiens
  light chain complementarity determining region 3 for antibody 52715
MQGTHWPPT

SEQ ID NO: 105430 - protein, 15 aa, Homo sapiens
  heavy chain complementarity determining region 3 for antibody 52715
AKVRQPGYYYYGMDV

SEQ ID NO: 105431 - protein, 9 aa, Homo sapiens
  light chain complementarity determining region 3 for antibody 52716
MQALQTPLT

SEQ ID NO: 105432 - protein, 14 aa, Homo sapiens
  heavy chain complementarity determining region 3 for antibody 52716
ARGSASFGVRYFDF

SEQ ID NO: 105433 - protein, 9 aa, Homo sapiens
  light chain complementarity determining region 3 for antibody 52717
LQYYTTPGT

SEQ ID NO: 105434 - protein, 15 aa, Homo sapiens
  heavy chain complementarity determining region 3 for antibody 52717
ARLRGQQLVVSYYDY

SEQ ID NO: 105435 - protein, 9 aa, Homo sapiens
  light chain complementarity determining region 3 for antibody 52718
LQHDNLPYT

SEQ ID NO: 105436 - protein, 19 aa, Homo sapiens
  heavy chain complementarity determining region 3 for antibody 52718
ARDHTLGVGGTPGGNPLDF

SEQ ID NO: 105437 - protein, 9 aa, Homo sapiens
  light chain complementarity determining region 3 for antibody 52719
LQDYNYPWT

SEQ ID NO: 105438 - protein, 12 aa, Homo sapiens
  heavy chain complementarity determining region 3 for antibody 52719
VREGPRTSHWKN

SEQ ID NO: 105439 - protein, 9 aa, Homo sapiens
  light chain complementarity determining region 3 for antibody 52720
LQDYNYPWT

SEQ ID NO: 105440 - protein, 14 aa, Homo sapiens
  heavy chain complementarity determining region 3 for antibody 52720
ARKMGWDGVAWFDP

SEQ ID NO: 105441 - protein, 9 aa, Homo sapiens
  light chain complementarity determining region 3 for antibody 52721
LQDYNYPWT

SEQ ID NO: 105442 - protein, 15 aa, Homo sapiens
  heavy chain complementarity determining region 3 for antibody 52721
AKGPGFAYGKKYFQH

SEQ ID NO: 105443 - protein, 10 aa, Homo sapiens
  light chain complementarity determining region 3 for antibody 52722
HQYEHLPPYT

SEQ ID NO: 105444 - protein, 12 aa, Homo sapiens
  heavy chain complementarity determining region 3 for antibody 52722
STPRRGGHQFEY

SEQ ID NO: 105445 - protein, 10 aa, Homo sapiens
  light chain complementarity determining region 3 for antibody 52723
HQYEHLPPYT

SEQ ID NO: 105446 - protein, 15 aa, Homo sapiens
  heavy chain complementarity determining region 3 for antibody 52723
ARRGYYGPGKMAYDI

SEQ ID NO: 105447 - protein, 9 aa, Homo sapiens
  light chain complementarity determining region 3 for antibody 52724
QQYYTTPLT

SEQ ID NO: 105448 - protein, 15 aa, Homo sapiens
  heavy chain complementarity determining region 3 for antibody 52724
AHLPPYPNSPHFFDF

SEQ ID NO: 105449 - protein, 9 aa, Homo sapiens
  light chain complementarity determining region 3 for antibody 52725
QQYYTNRRT

SEQ ID NO: 105450 - protein, 14 aa, Homo sapiens
  heavy chain complementarity determining region 3 for antibody 52725
TKLGMTNGPEYFHH

SEQ ID NO: 105451 - protein, 9 aa, Homo sapiens
  light chain complementarity determining region 3 for antibody 52726
QQYYSYSWT

SEQ ID NO: 105452 - protein, 11 aa, Homo sapiens
  heavy chain complementarity determining region 3 for antibody 52726
ASKVGANPYGY

SEQ ID NO: 105453 - protein, 9 aa, Homo sapiens
  light chain complementarity determining region 3 for antibody 52727
QQYYSSPQT

SEQ ID NO: 105454 - protein, 13 aa, Homo sapiens
  heavy chain complementarity determining region 3 for antibody 52727
ASESFGGPRGFNY

SEQ ID NO: 105455 - protein, 9 aa, Homo sapiens
  light chain complementarity determining region 3 for antibody 52728
QQYYSFPYT

SEQ ID NO: 105456 - protein, 14 aa, Homo sapiens
  heavy chain complementarity determining region 3 for antibody 52728
ARKMGWDGVAWFDP

SEQ ID NO: 105457 - protein, 10 aa, Homo sapiens
  light chain complementarity determining region 3 for antibody 52729
QQYYNNSPYT

SEQ ID NO: 105458 - protein, 24 aa, Homo sapiens
  heavy chain complementarity determining region 3 for antibody 52729
ASLSVYFGTVASAASKRYRSYFDY

SEQ ID NO: 105459 - protein, 10 aa, Homo sapiens
  light chain complementarity determining region 3 for antibody 52730
QQYYNNSPYT

SEQ ID NO: 105460 - protein, 24 aa, Homo sapiens
  heavy chain complementarity determining region 3 for antibody 52730
ARLSVYVGTVASAASKRYRSYFDY

SEQ ID NO: 105461 - protein, 10 aa, Homo sapiens
  light chain complementarity determining region 3 for antibody 52731
QQYYNNSPYT

SEQ ID NO: 105462 - protein, 14 aa, Homo sapiens
  heavy chain complementarity determining region 3 for antibody 52731
ARKMGWDGVAWFDP

SEQ ID NO: 105463 - protein, 10 aa, Homo sapiens
  light chain complementarity determining region 3 for antibody 52732
QQYYNNSPYT

SEQ ID NO: 105464 - protein, 11 aa, Homo sapiens
  heavy chain complementarity determining region 3 for antibody 52732
ARGAWPYFFDL

SEQ ID NO: 105465 - protein, 9 aa, Homo sapiens
  light chain complementarity determining region 3 for antibody 52733
QQYNTLQWT

SEQ ID NO: 105466 - protein, 14 aa, Homo sapiens
  heavy chain complementarity determining region 3 for antibody 52733
ASKMGWDGVAWFDP

SEQ ID NO: 105467 - protein, 9 aa, Homo sapiens
  light chain complementarity determining region 3 for antibody 52734
QQYNTLQWT

SEQ ID NO: 105468 - protein, 19 aa, Homo sapiens
  heavy chain complementarity determining region 3 for antibody 52734
ARLATILRGNMRSIRRLDV

SEQ ID NO: 105469 - protein, 8 aa, Homo sapiens
  light chain complementarity determining region 3 for antibody 52735
QQYNSYWT

SEQ ID NO: 105470 - protein, 7 aa, Homo sapiens
  heavy chain complementarity determining region 3 for antibody 52735
SPVSGRY

SEQ ID NO: 105471 - protein, 8 aa, Homo sapiens
  light chain complementarity determining region 3 for antibody 52736
QQYNSYWT

SEQ ID NO: 105472 - protein, 11 aa, Homo sapiens
  heavy chain complementarity determining region 3 for antibody 52736
ARGAWRYFFDL

SEQ ID NO: 105473 - protein, 8 aa, Homo sapiens
  light chain complementarity determining region 3 for antibody 52737
QQYNSYWT

SEQ ID NO: 105474 - protein, 15 aa, Homo sapiens
  heavy chain complementarity determining region 3 for antibody 52737
AHSAFVDVLTPFFAY

SEQ ID NO: 105475 - protein, 9 aa, Homo sapiens
  light chain complementarity determining region 3 for antibody 52738
QQYNSYSST

SEQ ID NO: 105476 - protein, 12 aa, Homo sapiens
  heavy chain complementarity determining region 3 for antibody 52738
VREGPRTSHWKN

SEQ ID NO: 105477 - protein, 9 aa, Homo sapiens
  light chain complementarity determining region 3 for antibody 52739
QQYNSYSST

SEQ ID NO: 105478 - protein, 14 aa, Homo sapiens
  heavy chain complementarity determining region 3 for antibody 52739
ARKMGWDGVAWFDP

SEQ ID NO: 105479 - protein, 9 aa, Homo sapiens
  light chain complementarity determining region 3 for antibody 52740
QQYNSYSST

SEQ ID NO: 105480 - protein, 15 aa, Homo sapiens
  heavy chain complementarity determining region 3 for antibody 52740
ARGGGPYYDSSGYQH

SEQ ID NO: 105481 - protein, 9 aa, Homo sapiens
  light chain complementarity determining region 3 for antibody 52741
QQYNSYSRT

SEQ ID NO: 105482 - protein, 15 aa, Homo sapiens
  heavy chain complementarity determining region 3 for antibody 52741
AKGPGFAYGKKYFQH

SEQ ID NO: 105483 - protein, 9 aa, Homo sapiens
  light chain complementarity determining region 3 for antibody 52742
QQYNSYQIT

SEQ ID NO: 105484 - protein, 10 aa, Homo sapiens
  heavy chain complementarity determining region 3 for antibody 52742
ARMALTTMTA

SEQ ID NO: 105485 - protein, 9 aa, Homo sapiens
  light chain complementarity determining region 3 for antibody 52743
QQYNSYPYT

SEQ ID NO: 105486 - protein, 15 aa, Homo sapiens
  heavy chain complementarity determining region 3 for antibody 52743
ARRGYYGPGKMAYDI

SEQ ID NO: 105487 - protein, 9 aa, Homo sapiens
  light chain complementarity determining region 3 for antibody 52744
QQYNSYPWT

SEQ ID NO: 105488 - protein, 7 aa, Homo sapiens
  heavy chain complementarity determining region 3 for antibody 52744
SPVSGGY

SEQ ID NO: 105489 - protein, 9 aa, Homo sapiens
  light chain complementarity determining region 3 for antibody 52745
QQYNSYPWT

SEQ ID NO: 105490 - protein, 15 aa, Homo sapiens
  heavy chain complementarity determining region 3 for antibody 52745
ARRGYYGPGKMAYDI

SEQ ID NO: 105491 - protein, 9 aa, Homo sapiens
  light chain complementarity determining region 3 for antibody 52746
QQYNSYPWT

SEQ ID NO: 105492 - protein, 13 aa, Homo sapiens
  heavy chain complementarity determining region 3 for antibody 52746
ARDLSYGSGYPGY

SEQ ID NO: 105493 - protein, 9 aa, Homo sapiens
  light chain complementarity determining region 3 for antibody 52747
QQYNSYPWT

SEQ ID NO: 105494 - protein, 12 aa, Homo sapiens
  heavy chain complementarity determining region 3 for antibody 52747
ALSITMVVEPDF

SEQ ID NO: 105495 - protein, 9 aa, Homo sapiens
  light chain complementarity determining region 3 for antibody 52748
QQYNSYPWT

SEQ ID NO: 105496 - protein, 17 aa, Homo sapiens
  heavy chain complementarity determining region 3 for antibody 52748
AKGPAPYNWTYGLLFDQ

SEQ ID NO: 105497 - protein, 9 aa, Homo sapiens
  light chain complementarity determining region 3 for antibody 52749
QQYNSYPRT

SEQ ID NO: 105498 - protein, 7 aa, Homo sapiens
  heavy chain complementarity determining region 3 for antibody 52749
SPVSGRY

SEQ ID NO: 105499 - protein, 9 aa, Homo sapiens
  light chain complementarity determining region 3 for antibody 52750
QQYNSYPLT

SEQ ID NO: 105500 - protein, 12 aa, Homo sapiens
  heavy chain complementarity determining region 3 for antibody 52750
VREGPRTSHWKN

SEQ ID NO: 105501 - protein, 8 aa, Homo sapiens
  light chain complementarity determining region 3 for antibody 52751
QQYNSYLT

SEQ ID NO: 105502 - protein, 11 aa, Homo sapiens
  heavy chain complementarity determining region 3 for antibody 52751
ARGAWPYFFDL

SEQ ID NO: 105503 - protein, 9 aa, Homo sapiens
  light chain complementarity determining region 3 for antibody 52752
QQYNSFSVT

SEQ ID NO: 105504 - protein, 15 aa, Homo sapiens
  heavy chain complementarity determining region 3 for antibody 52752
TRGRGNTEGYKPFDL

SEQ ID NO: 105505 - protein, 10 aa, Homo sapiens
  light chain complementarity determining region 3 for antibody 52753
QQYNNWPSLT

SEQ ID NO: 105506 - protein, 16 aa, Homo sapiens
  heavy chain complementarity determining region 3 for antibody 52753
ARGYFMTIYSPYFFDY

SEQ ID NO: 105507 - protein, 9 aa, Homo sapiens
  light chain complementarity determining region 3 for antibody 52754
QQYGTSPWT

SEQ ID NO: 105508 - protein, 18 aa, Homo sapiens
  heavy chain complementarity determining region 3 for antibody 52754
ARWGDYYDSNGYYHYFHY

SEQ ID NO: 105509 - protein, 9 aa, Homo sapiens
  light chain complementarity determining region 3 for antibody 52755
QQYGTSPLT

SEQ ID NO: 105510 - protein, 19 aa, Homo sapiens
  heavy chain complementarity determining region 3 for antibody 52755
TKYGDRYFNSGWSPYYFDY

SEQ ID NO: 105511 - protein, 9 aa, Homo sapiens
  light chain complementarity determining region 3 for antibody 52756
QQYGSSSWT

SEQ ID NO: 105512 - protein, 20 aa, Homo sapiens
  heavy chain complementarity determining region 3 for antibody 52756
VFRASYTTSPGYHYYSVLDV

SEQ ID NO: 105513 - protein, 9 aa, Homo sapiens
  light chain complementarity determining region 3 for antibody 52757
QQYGSSPWT

SEQ ID NO: 105514 - protein, 14 aa, Homo sapiens
  heavy chain complementarity determining region 3 for antibody 52757
AKDTLWFGEEAPDY

SEQ ID NO: 105515 - protein, 9 aa, Homo sapiens
  light chain complementarity determining region 3 for antibody 52758
QQYGSSPWT

SEQ ID NO: 105516 - protein, 16 aa, Homo sapiens
  heavy chain complementarity determining region 3 for antibody 52758
AAGPSVEGVLREYFPH

SEQ ID NO: 105517 - protein, 10 aa, Homo sapiens
  light chain complementarity determining region 3 for antibody 52759
QQYGSSPRVA

SEQ ID NO: 105518 - protein, 20 aa, Homo sapiens
  heavy chain complementarity determining region 3 for antibody 52759
ATPPREWFGELFYYLEYFQE

SEQ ID NO: 105519 - protein, 9 aa, Homo sapiens
  light chain complementarity determining region 3 for antibody 52760
QQYGSSPRT

SEQ ID NO: 105520 - protein, 14 aa, Homo sapiens
  heavy chain complementarity determining region 3 for antibody 52760
ARKMGWDGVAWFDP

SEQ ID NO: 105521 - protein, 10 aa, Homo sapiens
  light chain complementarity determining region 3 for antibody 52761
QQYGSSLPYT

SEQ ID NO: 105522 - protein, 19 aa, Homo sapiens
  heavy chain complementarity determining region 3 for antibody 52761
ARGNIAAAGKRYYYYAMDV

SEQ ID NO: 105523 - protein, 9 aa, Homo sapiens
  light chain complementarity determining region 3 for antibody 52762
QQYGSAPLT

SEQ ID NO: 105524 - protein, 20 aa, Homo sapiens
  heavy chain complementarity determining region 3 for antibody 52762
ARGRRVGGNPAYSLFDPFDN

SEQ ID NO: 105525 - protein, 10 aa, Homo sapiens
  light chain complementarity determining region 3 for antibody 52763
QQYGGSPVFT

SEQ ID NO: 105526 - protein, 15 aa, Homo sapiens
  heavy chain complementarity determining region 3 for antibody 52763
ARVNDGDYYYYYIDV

SEQ ID NO: 105527 - protein, 9 aa, Homo sapiens
  light chain complementarity determining region 3 for antibody 52764
QQYFNYPWT

SEQ ID NO: 105528 - protein, 16 aa, Homo sapiens
  heavy chain complementarity determining region 3 for antibody 52764
STGECSGATCFRRLDY

SEQ ID NO: 105529 - protein, 9 aa, Homo sapiens
  light chain complementarity determining region 3 for antibody 52765
QQYFFIPWT

SEQ ID NO: 105530 - protein, 15 aa, Homo sapiens
  heavy chain complementarity determining region 3 for antibody 52765
ARGSGTTGFDSYFDY

SEQ ID NO: 105531 - protein, 9 aa, Homo sapiens
  light chain complementarity determining region 3 for antibody 52766
QQYDSYSKT

SEQ ID NO: 105532 - protein, 12 aa, Homo sapiens
  heavy chain complementarity determining region 3 for antibody 52766
VREGPRTSHWKN

SEQ ID NO: 105533 - protein, 9 aa, Homo sapiens
  light chain complementarity determining region 3 for antibody 52767
QQYDSYPCT

SEQ ID NO: 105534 - protein, 7 aa, Homo sapiens
  heavy chain complementarity determining region 3 for antibody 52767
SPVSGRY

SEQ ID NO: 105535 - protein, 9 aa, Homo sapiens
  light chain complementarity determining region 3 for antibody 52768
QQYDSYPCT

SEQ ID NO: 105536 - protein, 13 aa, Homo sapiens
  heavy chain complementarity determining region 3 for antibody 52768
ARDLSYGSGYPGY

SEQ ID NO: 105537 - protein, 9 aa, Homo sapiens
  light chain complementarity determining region 3 for antibody 52769
QQYDSYPCT

SEQ ID NO: 105538 - protein, 15 aa, Homo sapiens
  heavy chain complementarity determining region 3 for antibody 52769
AHSAFVDVVTPFFAY

SEQ ID NO: 105539 - protein, 9 aa, Homo sapiens
  light chain complementarity determining region 3 for antibody 52770
QQYDSYPCT

SEQ ID NO: 105540 - protein, 15 aa, Homo sapiens
  heavy chain complementarity determining region 3 for antibody 52770
AHSAFVDVLTPVFAY

SEQ ID NO: 105541 - protein, 9 aa, Homo sapiens
  light chain complementarity determining region 3 for antibody 52771
QQYDSYPCT

SEQ ID NO: 105542 - protein, 15 aa, Homo sapiens
  heavy chain complementarity determining region 3 for antibody 52771
AHSAFVDGLTPFFAY

SEQ ID NO: 105543 - protein, 9 aa, Homo sapiens
  light chain complementarity determining region 3 for antibody 52772
QQYDNLPYT

SEQ ID NO: 105544 - protein, 18 aa, Homo sapiens
  heavy chain complementarity determining region 3 for antibody 52772
AKEYYDFWVGYYVNFFDN

SEQ ID NO: 105545 - protein, 9 aa, Homo sapiens
  light chain complementarity determining region 3 for antibody 52773
QQYDNLPRT

SEQ ID NO: 105546 - protein, 15 aa, Homo sapiens
  heavy chain complementarity determining region 3 for antibody 52773
ASLPTTWGGSETQNL

SEQ ID NO: 105547 - protein, 9 aa, Homo sapiens
  light chain complementarity determining region 3 for antibody 52774
QQYDDLPLT

SEQ ID NO: 105548 - protein, 13 aa, Homo sapiens
  heavy chain complementarity determining region 3 for antibody 52774
ARHRGGSSLMHDL

SEQ ID NO: 105549 - protein, 8 aa, Homo sapiens
  light chain complementarity determining region 3 for antibody 52775
QQYATSWT

SEQ ID NO: 105550 - protein, 7 aa, Homo sapiens
  heavy chain complementarity determining region 3 for antibody 52775
SPVSGRY

SEQ ID NO: 105551 - protein, 8 aa, Homo sapiens
  light chain complementarity determining region 3 for antibody 52776
QQYATSWT

SEQ ID NO: 105552 - protein, 14 aa, Homo sapiens
  heavy chain complementarity determining region 3 for antibody 52776
ARKMGWDGVAWFDP

SEQ ID NO: 105553 - protein, 8 aa, Homo sapiens
  light chain complementarity determining region 3 for antibody 52777
QQYATSWT

SEQ ID NO: 105554 - protein, 16 aa, Homo sapiens
  heavy chain complementarity determining region 3 for antibody 52777
AAGPSVEGVLREYFPP

SEQ ID NO: 105555 - protein, 8 aa, Homo sapiens
  light chain complementarity determining region 3 for antibody 52778
QQYATSWT

SEQ ID NO: 105556 - protein, 16 aa, Homo sapiens
  heavy chain complementarity determining region 3 for antibody 52778
AAGPSVEGVLREYFHH

SEQ ID NO: 105557 - protein, 8 aa, Homo sapiens
  light chain complementarity determining region 3 for antibody 52779
QQYATSWT

SEQ ID NO: 105558 - protein, 16 aa, Homo sapiens
  heavy chain complementarity determining region 3 for antibody 52779
AAGPAVEGVLREYFPH

SEQ ID NO: 105559 - protein, 8 aa, Homo sapiens
  light chain complementarity determining region 3 for antibody 52780
QQYAASPT

SEQ ID NO: 105560 - protein, 21 aa, Homo sapiens
  heavy chain complementarity determining region 3 for antibody 52780
ARGTQAYDILNGFSTDNYFDH

SEQ ID NO: 105561 - protein, 9 aa, Homo sapiens
  light chain complementarity determining region 3 for antibody 52781
QQTYSTPLT

SEQ ID NO: 105562 - protein, 24 aa, Homo sapiens
  heavy chain complementarity determining region 3 for antibody 52781
AKDRRTYYDFWSGYYNHYYYGMDV

SEQ ID NO: 105563 - protein, 11 aa, Homo sapiens
  light chain complementarity determining region 3 for antibody 52782
QQTYSNRPDIT

SEQ ID NO: 105564 - protein, 20 aa, Homo sapiens
  heavy chain complementarity determining region 3 for antibody 52782
AHSPFTFHYDTGGYYNWFDP

SEQ ID NO: 105565 - protein, 11 aa, Homo sapiens
  light chain complementarity determining region 3 for antibody 52783
QQTYSNRPDIT

SEQ ID NO: 105566 - protein, 20 aa, Homo sapiens
  heavy chain complementarity determining region 3 for antibody 52783
AHRPFTVHYDTGGYYNWFDP

SEQ ID NO: 105567 - protein, 11 aa, Homo sapiens
  light chain complementarity determining region 3 for antibody 52784
QQTYSNRPDIT

SEQ ID NO: 105568 - protein, 20 aa, Homo sapiens
  heavy chain complementarity determining region 3 for antibody 52784
AHRPFTFHYDAGGYYNWFDP

SEQ ID NO: 105569 - protein, 11 aa, Homo sapiens
  light chain complementarity determining region 3 for antibody 52785
QQTYSNRPDIT

SEQ ID NO: 105570 - protein, 20 aa, Homo sapiens
  heavy chain complementarity determining region 3 for antibody 52785
AHRPFAFHYDTGGYYNWFDP

SEQ ID NO: 105571 - protein, 11 aa, Homo sapiens
  light chain complementarity determining region 3 for antibody 52786
QQTYSNRPDIT

SEQ ID NO: 105572 - protein, 20 aa, Homo sapiens
  heavy chain complementarity determining region 3 for antibody 52786
AHIPFTFHYDTGGYYNWFDP

SEQ ID NO: 105573 - protein, 9 aa, Homo sapiens
  light chain complementarity determining region 3 for antibody 52787
QQTDRFPLT

SEQ ID NO: 105574 - protein, 15 aa, Homo sapiens
  heavy chain complementarity determining region 3 for antibody 52787
VRAPVDGWRRDAFDL

SEQ ID NO: 105575 - protein, 10 aa, Homo sapiens
  light chain complementarity determining region 3 for antibody 52788
QQSYSTPPWT

SEQ ID NO: 105576 - protein, 11 aa, Homo sapiens
  heavy chain complementarity determining region 3 for antibody 52788
ARWNFRWYFDL

SEQ ID NO: 105577 - protein, 9 aa, Homo sapiens
  light chain complementarity determining region 3 for antibody 52789
QQSYSTPPT

SEQ ID NO: 105578 - protein, 20 aa, Homo sapiens
  heavy chain complementarity determining region 3 for antibody 52789
ATRLEWLVRSGSYYYYGMDA

SEQ ID NO: 105579 - protein, 9 aa, Homo sapiens
  light chain complementarity determining region 3 for antibody 52790
QQSYSTLYT

SEQ ID NO: 105580 - protein, 12 aa, Homo sapiens
  heavy chain complementarity determining region 3 for antibody 52790
VREGPRTSHWKI

SEQ ID NO: 105581 - protein, 9 aa, Homo sapiens
  light chain complementarity determining region 3 for antibody 52791
QQSYSTLYT

SEQ ID NO: 105582 - protein, 12 aa, Homo sapiens
  heavy chain complementarity determining region 3 for antibody 52791
VREGPRTRHWKN

SEQ ID NO: 105583 - protein, 9 aa, Homo sapiens
  light chain complementarity determining region 3 for antibody 52792
QQSYSTLYT

SEQ ID NO: 105584 - protein, 12 aa, Homo sapiens
  heavy chain complementarity determining region 3 for antibody 52792
VREGPRPSRWKN

SEQ ID NO: 105585 - protein, 9 aa, Homo sapiens
  light chain complementarity determining region 3 for antibody 52793
QQSYSTLYT

SEQ ID NO: 105586 - protein, 12 aa, Homo sapiens
  heavy chain complementarity determining region 3 for antibody 52793
VREGPRPSHLKN

SEQ ID NO: 105587 - protein, 9 aa, Homo sapiens
  light chain complementarity determining region 3 for antibody 52794
QQSYSTLYT

SEQ ID NO: 105588 - protein, 12 aa, Homo sapiens
  heavy chain complementarity determining region 3 for antibody 52794
VREGPRPSHCKN

SEQ ID NO: 105589 - protein, 9 aa, Homo sapiens
  light chain complementarity determining region 3 for antibody 52795
QQSYSTLYT

SEQ ID NO: 105590 - protein, 12 aa, Homo sapiens
  heavy chain complementarity determining region 3 for antibody 52795
VREGPRNSHWKN

SEQ ID NO: 105591 - protein, 9 aa, Homo sapiens
  light chain complementarity determining region 3 for antibody 52796
QQSYSTLYT

SEQ ID NO: 105592 - protein, 12 aa, Homo sapiens
  heavy chain complementarity determining region 3 for antibody 52796
VREGPCTSHWKN

SEQ ID NO: 105593 - protein, 9 aa, Homo sapiens
  light chain complementarity determining region 3 for antibody 52797
QQSYSTLYT

SEQ ID NO: 105594 - protein, 12 aa, Homo sapiens
  heavy chain complementarity determining region 3 for antibody 52797
VRDGPRTSHWKN

SEQ ID NO: 105595 - protein, 9 aa, Homo sapiens
  light chain complementarity determining region 3 for antibody 52798
QQSYSTLYT

SEQ ID NO: 105596 - protein, 12 aa, Homo sapiens
  heavy chain complementarity determining region 3 for antibody 52798
VKEGPRTSHWKN

SEQ ID NO: 105597 - protein, 9 aa, Homo sapiens
  light chain complementarity determining region 3 for antibody 52799
QQSYSTLYT

SEQ ID NO: 105598 - protein, 12 aa, Homo sapiens
  heavy chain complementarity determining region 3 for antibody 52799
VGEGPRASHWKN

SEQ ID NO: 105599 - protein, 9 aa, Homo sapiens
  light chain complementarity determining region 3 for antibody 52800
QQSYSTLYT

SEQ ID NO: 105600 - protein, 12 aa, Homo sapiens
  heavy chain complementarity determining region 3 for antibody 52800
GREGPGTSHWKN

SEQ ID NO: 105601 - protein, 9 aa, Homo sapiens
  light chain complementarity determining region 3 for antibody 52801
QQSYSTLYT

SEQ ID NO: 105602 - protein, 13 aa, Homo sapiens
  heavy chain complementarity determining region 3 for antibody 52801
ASESFGGPRGFNY

SEQ ID NO: 105603 - protein, 9 aa, Homo sapiens
  light chain complementarity determining region 3 for antibody 52802
QQSYSTLYT

SEQ ID NO: 105604 - protein, 11 aa, Homo sapiens
  heavy chain complementarity determining region 3 for antibody 52802
ARGAWPYFFDL

SEQ ID NO: 105605 - protein, 9 aa, Homo sapiens
  light chain complementarity determining region 3 for antibody 52803
QQSYSTLYT

SEQ ID NO: 105606 - protein, 13 aa, Homo sapiens
  heavy chain complementarity determining region 3 for antibody 52803
ARDLSYGSGYPGY

SEQ ID NO: 105607 - protein, 9 aa, Homo sapiens
  light chain complementarity determining region 3 for antibody 52804
QQSYSTLYT

SEQ ID NO: 105608 - protein, 15 aa, Homo sapiens
  heavy chain complementarity determining region 3 for antibody 52804
ARDGLGGGYHGGFDH

SEQ ID NO: 105609 - protein, 9 aa, Homo sapiens
  light chain complementarity determining region 3 for antibody 52805
QQSYSTLYT

SEQ ID NO: 105610 - protein, 17 aa, Homo sapiens
  heavy chain complementarity determining region 3 for antibody 52805
AKGPAPYNWTYGLLFDQ

SEQ ID NO: 105611 - protein, 9 aa, Homo sapiens
  light chain complementarity determining region 3 for antibody 52806
QQSYSTLYT

SEQ ID NO: 105612 - protein, 14 aa, Homo sapiens
  heavy chain complementarity determining region 3 for antibody 52806
AKDTLWFGEEAPDY

SEQ ID NO: 105613 - protein, 9 aa, Homo sapiens
  light chain complementarity determining region 3 for antibody 52807
QQSYSTLYT

SEQ ID NO: 105614 - protein, 9 aa, Homo sapiens
  heavy chain complementarity determining region 3 for antibody 52807
AILGGGSDP

SEQ ID NO: 105615 - protein, 9 aa, Homo sapiens
  light chain complementarity determining region 3 for antibody 52808
QQSYSTLYT

SEQ ID NO: 105616 - protein, 20 aa, Homo sapiens
  heavy chain complementarity determining region 3 for antibody 52808
AHRPFTFHYDTGGYYNWFDP

SEQ ID NO: 105617 - protein, 9 aa, Homo sapiens
  light chain complementarity determining region 3 for antibody 52809
QQSYSTLST

SEQ ID NO: 105618 - protein, 12 aa, Homo sapiens
  heavy chain complementarity determining region 3 for antibody 52809
VREGPRTSHWKN

SEQ ID NO: 105619 - protein, 9 aa, Homo sapiens
  light chain complementarity determining region 3 for antibody 52810
QQSYSSPYT

SEQ ID NO: 105620 - protein, 16 aa, Homo sapiens
  heavy chain complementarity determining region 3 for antibody 52810
ARDRRQTVVSFYGMDV

SEQ ID NO: 105621 - protein, 9 aa, Homo sapiens
  light chain complementarity determining region 3 for antibody 52811
QQSYNTPPT

SEQ ID NO: 105622 - protein, 14 aa, Homo sapiens
  heavy chain complementarity determining region 3 for antibody 52811
ARKMGWDGVAWFDP

SEQ ID NO: 105623 - protein, 9 aa, Homo sapiens
  light chain complementarity determining region 3 for antibody 52812
QQSYIIPFT

SEQ ID NO: 105624 - protein, 11 aa, Homo sapiens
  heavy chain complementarity determining region 3 for antibody 52812
ARGLGYGRFDY

SEQ ID NO: 105625 - protein, 9 aa, Homo sapiens
  light chain complementarity determining region 3 for antibody 52813
QQSLNYPWT

SEQ ID NO: 105626 - protein, 16 aa, Homo sapiens
  heavy chain complementarity determining region 3 for antibody 52813
ARGPVKAHYYYYYMDV

SEQ ID NO: 105627 - protein, 9 aa, Homo sapiens
  light chain complementarity determining region 3 for antibody 52814
QQSFNAPIT

SEQ ID NO: 105628 - protein, 15 aa, Homo sapiens
  heavy chain complementarity determining region 3 for antibody 52814
AKGGGGTVYYYAMDV

SEQ ID NO: 105629 - protein, 10 aa, Homo sapiens
  light chain complementarity determining region 3 for antibody 52815
QQRSNWPPYT

SEQ ID NO: 105630 - protein, 15 aa, Homo sapiens
  heavy chain complementarity determining region 3 for antibody 52815
AKGRVTMIPDTVFDP

SEQ ID NO: 105631 - protein, 9 aa, Homo sapiens
  light chain complementarity determining region 3 for antibody 52816
QQLNSYPYT

SEQ ID NO: 105632 - protein, 7 aa, Homo sapiens
  heavy chain complementarity determining region 3 for antibody 52816
SPVSGRY

SEQ ID NO: 105633 - protein, 9 aa, Homo sapiens
  light chain complementarity determining region 3 for antibody 52817
QQLNSYPYT

SEQ ID NO: 105634 - protein, 12 aa, Homo sapiens
  heavy chain complementarity determining region 3 for antibody 52817
ALSITRVVEPDF

SEQ ID NO: 105635 - protein, 9 aa, Homo sapiens
  light chain complementarity determining region 3 for antibody 52818
QQLNSYPYT

SEQ ID NO: 105636 - protein, 12 aa, Homo sapiens
  heavy chain complementarity determining region 3 for antibody 52818
ALSITMVVEHDF

SEQ ID NO: 105637 - protein, 9 aa, Homo sapiens
  light chain complementarity determining region 3 for antibody 52819
QQLNSYPYT

SEQ ID NO: 105638 - protein, 17 aa, Homo sapiens
  heavy chain complementarity determining region 3 for antibody 52819
AKGPAPYNWTYGLLFDQ

SEQ ID NO: 105639 - protein, 10 aa, Homo sapiens
  light chain complementarity determining region 3 for antibody 52820
QQLNSYPRYT

SEQ ID NO: 105640 - protein, 12 aa, Homo sapiens
  heavy chain complementarity determining region 3 for antibody 52820
VREGPRTSHWKN

SEQ ID NO: 105641 - protein, 11 aa, Homo sapiens
  light chain complementarity determining region 3 for antibody 52821
QQFNTSPPGDT

SEQ ID NO: 105642 - protein, 14 aa, Homo sapiens
  heavy chain complementarity determining region 3 for antibody 52821
ARCSVTSRKRSFDQ

SEQ ID NO: 105643 - protein, 9 aa, Homo sapiens
  light chain complementarity determining region 3 for antibody 52822
QQCYSFPYT

SEQ ID NO: 105644 - protein, 24 aa, Homo sapiens
  heavy chain complementarity determining region 3 for antibody 52822
ARLSVYFGTVASAASKRYRSYFDY

SEQ ID NO: 105645 - protein, 9 aa, Homo sapiens
  light chain complementarity determining region 3 for antibody 52823
QQCYSFPYT

SEQ ID NO: 105646 - protein, 14 aa, Homo sapiens
  heavy chain complementarity determining region 3 for antibody 52823
ARKMSWDGVAWFDP

SEQ ID NO: 105647 - protein, 9 aa, Homo sapiens
  light chain complementarity determining region 3 for antibody 52824
QQCYSFPYT

SEQ ID NO: 105648 - protein, 14 aa, Homo sapiens
  heavy chain complementarity determining region 3 for antibody 52824
ARKMGWDGVAWFDS

SEQ ID NO: 105649 - protein, 9 aa, Homo sapiens
  light chain complementarity determining region 3 for antibody 52825
QQCYSFPYT

SEQ ID NO: 105650 - protein, 14 aa, Homo sapiens
  heavy chain complementarity determining region 3 for antibody 52825
ARKMGGDGVAWFDP

SEQ ID NO: 105651 - protein, 9 aa, Homo sapiens
  light chain complementarity determining region 3 for antibody 52826
QQCYSFPYT

SEQ ID NO: 105652 - protein, 11 aa, Homo sapiens
  heavy chain complementarity determining region 3 for antibody 52826
ARGNSFYYMDV

SEQ ID NO: 105653 - protein, 9 aa, Homo sapiens
  light chain complementarity determining region 3 for antibody 52827
QQCYSFPYT

SEQ ID NO: 105654 - protein, 15 aa, Homo sapiens
  heavy chain complementarity determining region 3 for antibody 52827
AREGYSSSWSQPLDY

SEQ ID NO: 105655 - protein, 9 aa, Homo sapiens
  light chain complementarity determining region 3 for antibody 52828
QQCYSFPYT

SEQ ID NO: 105656 - protein, 15 aa, Homo sapiens
  heavy chain complementarity determining region 3 for antibody 52828
AKGPGFAYGKKYFQH

SEQ ID NO: 105657 - protein, 9 aa, Homo sapiens
  light chain complementarity determining region 3 for antibody 52829
QQCYSFPYT

SEQ ID NO: 105658 - protein, 12 aa, Homo sapiens
  heavy chain complementarity determining region 3 for antibody 52829
AKEREATGYFDY

SEQ ID NO: 105659 - protein, 9 aa, Homo sapiens
  light chain complementarity determining region 3 for antibody 52830
QQCYSFPYT

SEQ ID NO: 105660 - protein, 16 aa, Homo sapiens
  heavy chain complementarity determining region 3 for antibody 52830
AKEPTQLWSPTYYFDF

SEQ ID NO: 105661 - protein, 9 aa, Homo sapiens
  light chain complementarity determining region 3 for antibody 52831
QQCYSFPYT

SEQ ID NO: 105662 - protein, 20 aa, Homo sapiens
  heavy chain complementarity determining region 3 for antibody 52831
AHRPFTFHYDTGGYYNWFDP

SEQ ID NO: 105663 - protein, 9 aa, Homo sapiens
  light chain complementarity determining region 3 for antibody 52832
QQCYSFPYP

SEQ ID NO: 105664 - protein, 14 aa, Homo sapiens
  heavy chain complementarity determining region 3 for antibody 52832
ARKMGWDGVAWFDP

SEQ ID NO: 105665 - protein, 9 aa, Homo sapiens
  light chain complementarity determining region 3 for antibody 52833
QQCYSFPST

SEQ ID NO: 105666 - protein, 14 aa, Homo sapiens
  heavy chain complementarity determining region 3 for antibody 52833
ARKMGWDGVAWFDP

SEQ ID NO: 105667 - protein, 9 aa, Homo sapiens
  light chain complementarity determining region 3 for antibody 52834
QQCYRFPYT

SEQ ID NO: 105668 - protein, 14 aa, Homo sapiens
  heavy chain complementarity determining region 3 for antibody 52834
ARKMGWDGVAWFDP

SEQ ID NO: 105669 - protein, 9 aa, Homo sapiens
  light chain complementarity determining region 3 for antibody 52835
QQALNYPWT

SEQ ID NO: 105670 - protein, 16 aa, Homo sapiens
  heavy chain complementarity determining region 3 for antibody 52835
ARGPVKARYYYYYMDV

SEQ ID NO: 105671 - protein, 8 aa, Homo sapiens
  light chain complementarity determining region 3 for antibody 52836
QPYGSSRT

SEQ ID NO: 105672 - protein, 7 aa, Homo sapiens
  heavy chain complementarity determining region 3 for antibody 52836
SPVSGSY

SEQ ID NO: 105673 - protein, 9 aa, Homo sapiens
  light chain complementarity determining region 3 for antibody 52837
QKYNSAPPT

SEQ ID NO: 105674 - protein, 14 aa, Homo sapiens
  heavy chain complementarity determining region 3 for antibody 52837
ARKMGWDGVAWFDP

SEQ ID NO: 105675 - protein, 9 aa, Homo sapiens
  light chain complementarity determining region 3 for antibody 52838
QKYNSAPPT

SEQ ID NO: 105676 - protein, 15 aa, Homo sapiens
  heavy chain complementarity determining region 3 for antibody 52838
ARGGGPYYDSSGYHH

SEQ ID NO: 105677 - protein, 9 aa, Homo sapiens
  light chain complementarity determining region 3 for antibody 52839
QKYDSAPLT

SEQ ID NO: 105678 - protein, 14 aa, Homo sapiens
  heavy chain complementarity determining region 3 for antibody 52839
AKDIEIYGVSTPDY

SEQ ID NO: 105679 - protein, 8 aa, Homo sapiens
  light chain complementarity determining region 3 for antibody 52840
QHYGSTAT

SEQ ID NO: 105680 - protein, 13 aa, Homo sapiens
  heavy chain complementarity determining region 3 for antibody 52840
AKIAVVGLWYFDL

SEQ ID NO: 105681 - protein, 8 aa, Homo sapiens
  light chain complementarity determining region 3 for antibody 52841
QHRGIWPT

SEQ ID NO: 105682 - protein, 15 aa, Homo sapiens
  heavy chain complementarity determining region 3 for antibody 52841
AKDLVVLVIYGTFDS

SEQ ID NO: 105683 - protein, 7 aa, Homo sapiens
  light chain complementarity determining region 3 for antibody 52842
QHPLPLP

SEQ ID NO: 105684 - protein, 14 aa, Homo sapiens
  heavy chain complementarity determining region 3 for antibody 52842
ASDRGPSRIGIFDF

SEQ ID NO: 105685 - protein, 9 aa, Homo sapiens
  light chain complementarity determining region 3 for antibody 52843
QHFEESPIT

SEQ ID NO: 105686 - protein, 17 aa, Homo sapiens
  heavy chain complementarity determining region 3 for antibody 52843
ARIIPAILFSSGWYFDY

SEQ ID NO: 105687 - protein, 9 aa, Homo sapiens
  light chain complementarity determining region 3 for antibody 52844
QHFEESPIT

SEQ ID NO: 105688 - protein, 17 aa, Homo sapiens
  heavy chain complementarity determining region 3 for antibody 52844
AGIIPAILFSSGWYFDY

SEQ ID NO: 105689 - protein, 9 aa, Homo sapiens
  light chain complementarity determining region 3 for antibody 52845
MQALQTVLT

SEQ ID NO: 105690 - protein, 16 aa, Homo sapiens
  heavy chain complementarity determining region 3 for antibody 52845
VSLFDAGDPGLISGAH

SEQ ID NO: 105691 - protein, 9 aa, Homo sapiens
  light chain complementarity determining region 3 for antibody 52846
MQALQTLFT

SEQ ID NO: 105692 - protein, 12 aa, Homo sapiens
  heavy chain complementarity determining region 3 for antibody 52846
VREGPRTSHWKN

SEQ ID NO: 105693 - protein, 10 aa, Homo sapiens
  light chain complementarity determining region 3 for antibody 52847
LQHNSYPKYT

SEQ ID NO: 105694 - protein, 12 aa, Homo sapiens
  heavy chain complementarity determining region 3 for antibody 52847
VREGPRTSHWKN

SEQ ID NO: 105695 - protein, 9 aa, Homo sapiens
  light chain complementarity determining region 3 for antibody 52848
LQDYNYPWT

SEQ ID NO: 105696 - protein, 13 aa, Homo sapiens
  heavy chain complementarity determining region 3 for antibody 52848
ARDLSYGSGYQGY

SEQ ID NO: 105697 - protein, 9 aa, Homo sapiens
  light chain complementarity determining region 3 for antibody 52849
LQDYNYPWT

SEQ ID NO: 105698 - protein, 13 aa, Homo sapiens
  heavy chain complementarity determining region 3 for antibody 52849
ARDLSYGSGYPEY

SEQ ID NO: 105699 - protein, 9 aa, Homo sapiens
  light chain complementarity determining region 3 for antibody 52850
LQDYNYPWT

SEQ ID NO: 105700 - protein, 13 aa, Homo sapiens
  heavy chain complementarity determining region 3 for antibody 52850
ARDLSYGAGYPGY

SEQ ID NO: 105701 - protein, 9 aa, Homo sapiens
  light chain complementarity determining region 3 for antibody 52851
LQDYNYPLT

SEQ ID NO: 105702 - protein, 12 aa, Homo sapiens
  heavy chain complementarity determining region 3 for antibody 52851
VREGPRTSHWKN

SEQ ID NO: 105703 - protein, 11 aa, Homo sapiens
  light chain complementarity determining region 3 for antibody 52852
LLYSSSPRMFT

SEQ ID NO: 105704 - protein, 28 aa, Homo sapiens
  heavy chain complementarity determining region 3 for antibody 52852
ARSYCGSGCYRISRFDRAISQNNIFMNV

SEQ ID NO: 105705 - protein, 9 aa, Homo sapiens
  light chain complementarity determining region 3 for antibody 52853
KQSYSTLYT

SEQ ID NO: 105706 - protein, 12 aa, Homo sapiens
  heavy chain complementarity determining region 3 for antibody 52853
VREGPRTSHWKN

SEQ ID NO: 105707 - protein, 10 aa, Homo sapiens
  light chain complementarity determining region 3 for antibody 52854
HQYEHLPPYT

SEQ ID NO: 105708 - protein, 14 aa, Homo sapiens
  heavy chain complementarity determining region 3 for antibody 52854
ARKMGWDGVAWFDP

SEQ ID NO: 105709 - protein, 10 aa, Homo sapiens
  light chain complementarity determining region 3 for antibody 52855
HQYDHLPPYT

SEQ ID NO: 105710 - protein, 12 aa, Homo sapiens
  heavy chain complementarity determining region 3 for antibody 52855
STHRRGGHQFEY

SEQ ID NO: 105711 - protein, 9 aa, Homo sapiens
  light chain complementarity determining region 3 for antibody 52856
HQSSYLPQT

SEQ ID NO: 105712 - protein, 16 aa, Homo sapiens
  heavy chain complementarity determining region 3 for antibody 52856
SRGSYINLSDGLHFDY

SEQ ID NO: 105713 - protein, 9 aa, Homo sapiens
  light chain complementarity determining region 3 for antibody 52857
QYYDSYSRT

SEQ ID NO: 105714 - protein, 12 aa, Homo sapiens
  heavy chain complementarity determining region 3 for antibody 52857
ARGLKIDRRFNP

SEQ ID NO: 105715 - protein, 9 aa, Homo sapiens
  light chain complementarity determining region 3 for antibody 52858
QRYISAPQT

SEQ ID NO: 105716 - protein, 13 aa, Homo sapiens
  heavy chain complementarity determining region 3 for antibody 52858
ARDLSYGSGYPGY

SEQ ID NO: 105717 - protein, 9 aa, Homo sapiens
  light chain complementarity determining region 3 for antibody 52859
QRDYTARHT

SEQ ID NO: 105718 - protein, 12 aa, Homo sapiens
  heavy chain complementarity determining region 3 for antibody 52859
ALSITMVVEPDF

SEQ ID NO: 105719 - protein, 10 aa, Homo sapiens
  light chain complementarity determining region 3 for antibody 52860
QRCGSSPPWT

SEQ ID NO: 105720 - protein, 19 aa, Homo sapiens
  heavy chain complementarity determining region 3 for antibody 52860
ARGSDYDILTGPKAHGFDV

SEQ ID NO: 105721 - protein, 9 aa, Homo sapiens
  light chain complementarity determining region 3 for antibody 52861
QQYYSYPHT

SEQ ID NO: 105722 - protein, 12 aa, Homo sapiens
  heavy chain complementarity determining region 3 for antibody 52861
VREGPRTSHWKN

SEQ ID NO: 105723 - protein, 9 aa, Homo sapiens
  light chain complementarity determining region 3 for antibody 52862
QQYYSSPQT

SEQ ID NO: 105724 - protein, 13 aa, Homo sapiens
  heavy chain complementarity determining region 3 for antibody 52862
ARDASDWRAAFDV

SEQ ID NO: 105725 - protein, 10 aa, Homo sapiens
  light chain complementarity determining region 3 for antibody 52863
QQYYNNSPYT

SEQ ID NO: 105726 - protein, 24 aa, Homo sapiens
  heavy chain complementarity determining region 3 for antibody 52863
ARLSVYFGTVASAASKRSRSYFDY

SEQ ID NO: 105727 - protein, 9 aa, Homo sapiens
  light chain complementarity determining region 3 for antibody 52864
QQYTNLPPV

SEQ ID NO: 105728 - protein, 14 aa, Homo sapiens
  heavy chain complementarity determining region 3 for antibody 52864
ARKMGWDGVAWFDT

SEQ ID NO: 105729 - protein, 9 aa, Homo sapiens
  light chain complementarity determining region 3 for antibody 52865
QQYSNYPFT

SEQ ID NO: 105730 - protein, 14 aa, Homo sapiens
  heavy chain complementarity determining region 3 for antibody 52865
ARWDWDYYYDGMDV

SEQ ID NO: 105731 - protein, 9 aa, Homo sapiens
  light chain complementarity determining region 3 for antibody 52866
QQYSNYPFT

SEQ ID NO: 105732 - protein, 14 aa, Homo sapiens
  heavy chain complementarity determining region 3 for antibody 52866
ARKMGWDGVAWFDP

SEQ ID NO: 105733 - protein, 9 aa, Homo sapiens
  light chain complementarity determining region 3 for antibody 52867
QQYSNYPFT

SEQ ID NO: 105734 - protein, 16 aa, Homo sapiens
  heavy chain complementarity determining region 3 for antibody 52867
ARGPVKAHYYYYYMDV

SEQ ID NO: 105735 - protein, 9 aa, Homo sapiens
  light chain complementarity determining region 3 for antibody 52868
QQYSNFPNT

SEQ ID NO: 105736 - protein, 11 aa, Homo sapiens
  heavy chain complementarity determining region 3 for antibody 52868
ATNDYGDYASY

SEQ ID NO: 105737 - protein, 9 aa, Homo sapiens
  light chain complementarity determining region 3 for antibody 52869
QQYREYPYT

SEQ ID NO: 105738 - protein, 12 aa, Homo sapiens
  heavy chain complementarity determining region 3 for antibody 52869
VREGPRTSHWKN

SEQ ID NO: 105739 - protein, 8 aa, Homo sapiens
  light chain complementarity determining region 3 for antibody 52870
QQYNTYST

SEQ ID NO: 105740 - protein, 15 aa, Homo sapiens
  heavy chain complementarity determining region 3 for antibody 52870
AHSAFVDVLTPFFAY

SEQ ID NO: 105741 - protein, 8 aa, Homo sapiens
  light chain complementarity determining region 3 for antibody 52871
QQYNTSPT

SEQ ID NO: 105742 - protein, 13 aa, Homo sapiens
  heavy chain complementarity determining region 3 for antibody 52871
ASESFGGPRGFNY

SEQ ID NO: 105743 - protein, 9 aa, Homo sapiens
  light chain complementarity determining region 3 for antibody 52872
QQYNTLQWT

SEQ ID NO: 105744 - protein, 13 aa, Homo sapiens
  heavy chain complementarity determining region 3 for antibody 52872
ASESFGGPRGFNY

SEQ ID NO: 105745 - protein, 9 aa, Homo sapiens
  light chain complementarity determining region 3 for antibody 52873
QQYNTLQWT

SEQ ID NO: 105746 - protein, 15 aa, Homo sapiens
  heavy chain complementarity determining region 3 for antibody 52873
ARRGYYGPGKMAYDI

SEQ ID NO: 105747 - protein, 9 aa, Homo sapiens
  light chain complementarity determining region 3 for antibody 52874
QQYNTLQWT

SEQ ID NO: 105748 - protein, 14 aa, Homo sapiens
  heavy chain complementarity determining region 3 for antibody 52874
ARKMGWGGVAWFDP

SEQ ID NO: 105749 - protein, 9 aa, Homo sapiens
  light chain complementarity determining region 3 for antibody 52875
QQYNTLQWT

SEQ ID NO: 105750 - protein, 14 aa, Homo sapiens
  heavy chain complementarity determining region 3 for antibody 52875
ARKMGWDGVAGFDP

SEQ ID NO: 105751 - protein, 9 aa, Homo sapiens
  light chain complementarity determining region 3 for antibody 52876
QQYNTLQWT

SEQ ID NO: 105752 - protein, 13 aa, Homo sapiens
  heavy chain complementarity determining region 3 for antibody 52876
ARDLSYGSGYPGY

SEQ ID NO: 105753 - protein, 9 aa, Homo sapiens
  light chain complementarity determining region 3 for antibody 52877
QQYNTLQWT

SEQ ID NO: 105754 - protein, 12 aa, Homo sapiens
  heavy chain complementarity determining region 3 for antibody 52877
ALSITMVVEPDF

SEQ ID NO: 105755 - protein, 9 aa, Homo sapiens
  light chain complementarity determining region 3 for antibody 52878
QQYNTLQWT

SEQ ID NO: 105756 - protein, 20 aa, Homo sapiens
  heavy chain complementarity determining region 3 for antibody 52878
AHRPFTFHYDTGGYYNWFDP

SEQ ID NO: 105757 - protein, 9 aa, Homo sapiens
  light chain complementarity determining region 3 for antibody 52879
QQYNTLQWK

SEQ ID NO: 105758 - protein, 14 aa, Homo sapiens
  heavy chain complementarity determining region 3 for antibody 52879
ARKMGWDGVAWFDP

SEQ ID NO: 105759 - protein, 9 aa, Homo sapiens
  light chain complementarity determining region 3 for antibody 52880
QQYNSYYRT

SEQ ID NO: 105760 - protein, 16 aa, Homo sapiens
  heavy chain complementarity determining region 3 for antibody 52880
ARGPVKAHYYYYYMDV

SEQ ID NO: 105761 - protein, 8 aa, Homo sapiens
  light chain complementarity determining region 3 for antibody 52881
QQYNSYWT

SEQ ID NO: 105762 - protein, 13 aa, Homo sapiens
  heavy chain complementarity determining region 3 for antibody 52881
ASESFGGPRGFNY

SEQ ID NO: 105763 - protein, 8 aa, Homo sapiens
  light chain complementarity determining region 3 for antibody 52882
QQYNSYWT

SEQ ID NO: 105764 - protein, 15 aa, Homo sapiens
  heavy chain complementarity determining region 3 for antibody 52882
ARRGYYGPGKMAYDI

SEQ ID NO: 105765 - protein, 8 aa, Homo sapiens
  light chain complementarity determining region 3 for antibody 52883
QQYNSYWT

SEQ ID NO: 105766 - protein, 16 aa, Homo sapiens
  heavy chain complementarity determining region 3 for antibody 52883
ARGPVKAHYYYYYMDV

SEQ ID NO: 105767 - protein, 8 aa, Homo sapiens
  light chain complementarity determining region 3 for antibody 52884
QQYNSYWT

SEQ ID NO: 105768 - protein, 11 aa, Homo sapiens
  heavy chain complementarity determining region 3 for antibody 52884
ARGAWPYFFVL

SEQ ID NO: 105769 - protein, 8 aa, Homo sapiens
  light chain complementarity determining region 3 for antibody 52885
QQYNSYWT

SEQ ID NO: 105770 - protein, 11 aa, Homo sapiens
  heavy chain complementarity determining region 3 for antibody 52885
ARGAWPYCFDL

SEQ ID NO: 105771 - protein, 8 aa, Homo sapiens
  light chain complementarity determining region 3 for antibody 52886
QQYNSYWT

SEQ ID NO: 105772 - protein, 11 aa, Homo sapiens
  heavy chain complementarity determining region 3 for antibody 52886
ARGAGPYFFDL

SEQ ID NO: 105773 - protein, 8 aa, Homo sapiens
  light chain complementarity determining region 3 for antibody 52887
QQYNSYST

SEQ ID NO: 105774 - protein, 15 aa, Homo sapiens
  heavy chain complementarity determining region 3 for antibody 52887
ASLPTTWGGFETQNL

SEQ ID NO: 105775 - protein, 8 aa, Homo sapiens
  light chain complementarity determining region 3 for antibody 52888
QQYNSYST

SEQ ID NO: 105776 - protein, 16 aa, Homo sapiens
  heavy chain complementarity determining region 3 for antibody 52888
ARDKSQGWFGELAFDS

SEQ ID NO: 105777 - protein, 9 aa, Homo sapiens
  light chain complementarity determining region 3 for antibody 52889
QQYNSYSST

SEQ ID NO: 105778 - protein, 7 aa, Homo sapiens
  heavy chain complementarity determining region 3 for antibody 52889
SPVSGRY

SEQ ID NO: 105779 - protein, 9 aa, Homo sapiens
  light chain complementarity determining region 3 for antibody 52890
QQYNSYSST

SEQ ID NO: 105780 - protein, 15 aa, Homo sapiens
  heavy chain complementarity determining region 3 for antibody 52890
ATYMSGLYYYYAMDV

SEQ ID NO: 105781 - protein, 9 aa, Homo sapiens
  light chain complementarity determining region 3 for antibody 52891
QQYNSYSRT

SEQ ID NO: 105782 - protein, 7 aa, Homo sapiens
  heavy chain complementarity determining region 3 for antibody 52891
SPVSGRY

SEQ ID NO: 105783 - protein, 9 aa, Homo sapiens
  light chain complementarity determining region 3 for antibody 52892
QQYNSYSRT

SEQ ID NO: 105784 - protein, 14 aa, Homo sapiens
  heavy chain complementarity determining region 3 for antibody 52892
ARKMGWDGVAWFDP

SEQ ID NO: 105785 - protein, 9 aa, Homo sapiens
  light chain complementarity determining region 3 for antibody 52893
QQYNSYSRT

SEQ ID NO: 105786 - protein, 16 aa, Homo sapiens
  heavy chain complementarity determining region 3 for antibody 52893
ARGPVKAYYYYYYMDV

SEQ ID NO: 105787 - protein, 9 aa, Homo sapiens
  light chain complementarity determining region 3 for antibody 52894
QQYNSYSRT

SEQ ID NO: 105788 - protein, 16 aa, Homo sapiens
  heavy chain complementarity determining region 3 for antibody 52894
ARGPVKARYYYYYMDV

SEQ ID NO: 105789 - protein, 9 aa, Homo sapiens
  light chain complementarity determining region 3 for antibody 52895
QQYNSYSKT

SEQ ID NO: 105790 - protein, 7 aa, Homo sapiens
  heavy chain complementarity determining region 3 for antibody 52895
SPVSGRY

SEQ ID NO: 105791 - protein, 9 aa, Homo sapiens
  light chain complementarity determining region 3 for antibody 52896
QQYNSYSKT

SEQ ID NO: 105792 - protein, 19 aa, Homo sapiens
  heavy chain complementarity determining region 3 for antibody 52896
ARLATILRGNMRSISRLDV

SEQ ID NO: 105793 - protein, 9 aa, Homo sapiens
  light chain complementarity determining region 3 for antibody 52897
QQYNSYSKT

SEQ ID NO: 105794 - protein, 19 aa, Homo sapiens
  heavy chain complementarity determining region 3 for antibody 52897
ARLATILRGNMRAIRRLDV

SEQ ID NO: 105795 - protein, 9 aa, Homo sapiens
  light chain complementarity determining region 3 for antibody 52898
QQYNSYRYT

SEQ ID NO: 105796 - protein, 14 aa, Homo sapiens
  heavy chain complementarity determining region 3 for antibody 52898
ARKMGWDGVAWFDP

SEQ ID NO: 105797 - protein, 9 aa, Homo sapiens
  light chain complementarity determining region 3 for antibody 52899
QQYNSYPYT

SEQ ID NO: 105798 - protein, 7 aa, Homo sapiens
  heavy chain complementarity determining region 3 for antibody 52899
SPVSGRY

SEQ ID NO: 105799 - protein, 9 aa, Homo sapiens
  light chain complementarity determining region 3 for antibody 52900
QQYNSYPYT

SEQ ID NO: 105800 - protein, 15 aa, Homo sapiens
  heavy chain complementarity determining region 3 for antibody 52900
ARGGGPYYDSSGYQQ

SEQ ID NO: 105801 - protein, 9 aa, Homo sapiens
  light chain complementarity determining region 3 for antibody 52901
QQYNSYPYT

SEQ ID NO: 105802 - protein, 20 aa, Homo sapiens
  heavy chain complementarity determining region 3 for antibody 52901
ARDASYYYDIRGNYYYGMDV

SEQ ID NO: 105803 - protein, 9 aa, Homo sapiens
  light chain complementarity determining region 3 for antibody 52902
QQYNSYPYT

SEQ ID NO: 105804 - protein, 15 aa, Homo sapiens
  heavy chain complementarity determining region 3 for antibody 52902
AKGPGFAYGKKYFEH

SEQ ID NO: 105805 - protein, 9 aa, Homo sapiens
  light chain complementarity determining region 3 for antibody 52903
QQYNSYPYT

SEQ ID NO: 105806 - protein, 15 aa, Homo sapiens
  heavy chain complementarity determining region 3 for antibody 52903
AKGPGFAYGKKSFHH

SEQ ID NO: 105807 - protein, 9 aa, Homo sapiens
  light chain complementarity determining region 3 for antibody 52904
QQYNSYPWT

SEQ ID NO: 105808 - protein, 7 aa, Homo sapiens
  heavy chain complementarity determining region 3 for antibody 52904
STVSGRY

SEQ ID NO: 105809 - protein, 9 aa, Homo sapiens
  light chain complementarity determining region 3 for antibody 52905
QQYNSYPWT

SEQ ID NO: 105810 - protein, 7 aa, Homo sapiens
  heavy chain complementarity determining region 3 for antibody 52905
SPVSVRY

SEQ ID NO: 105811 - protein, 9 aa, Homo sapiens
  light chain complementarity determining region 3 for antibody 52906
QQYNSYPWT

SEQ ID NO: 105812 - protein, 7 aa, Homo sapiens
  heavy chain complementarity determining region 3 for antibody 52906
SPVSGHY

SEQ ID NO: 105813 - protein, 9 aa, Homo sapiens
  light chain complementarity determining region 3 for antibody 52907
QQYNSYPWT

SEQ ID NO: 105814 - protein, 7 aa, Homo sapiens
  heavy chain complementarity determining region 3 for antibody 52907
SPVSCRY

SEQ ID NO: 105815 - protein, 9 aa, Homo sapiens
  light chain complementarity determining region 3 for antibody 52908
QQYNSYPWT

SEQ ID NO: 105816 - protein, 14 aa, Homo sapiens
  heavy chain complementarity determining region 3 for antibody 52908
ARWDWDYYYYGMDV

SEQ ID NO: 105817 - protein, 9 aa, Homo sapiens
  light chain complementarity determining region 3 for antibody 52909
QQYNSYPWT

SEQ ID NO: 105818 - protein, 13 aa, Homo sapiens
  heavy chain complementarity determining region 3 for antibody 52909
ARSASSVPGTLDY

SEQ ID NO: 105819 - protein, 9 aa, Homo sapiens
  light chain complementarity determining region 3 for antibody 52910
QQYNSYPWT

SEQ ID NO: 105820 - protein, 13 aa, Homo sapiens
  heavy chain complementarity determining region 3 for antibody 52910
ARDAADWRAAFDV

SEQ ID NO: 105821 - protein, 9 aa, Homo sapiens
  light chain complementarity determining region 3 for antibody 52911
QQYNSYPWT

SEQ ID NO: 105822 - protein, 15 aa, Homo sapiens
  heavy chain complementarity determining region 3 for antibody 52911
AKGPGFAYGKKYFQH

SEQ ID NO: 105823 - protein, 9 aa, Homo sapiens
  light chain complementarity determining region 3 for antibody 52912
QQYNSYPWT

SEQ ID NO: 105824 - protein, 15 aa, Homo sapiens
  heavy chain complementarity determining region 3 for antibody 52912
AHSAFVDVLTPFFAY

SEQ ID NO: 105825 - protein, 9 aa, Homo sapiens
  light chain complementarity determining region 3 for antibody 52913
QQYNSYPWT

SEQ ID NO: 105826 - protein, 20 aa, Homo sapiens
  heavy chain complementarity determining region 3 for antibody 52913
AHRPFTFHYDTGGYYNWFDP

SEQ ID NO: 105827 - protein, 9 aa, Homo sapiens
  light chain complementarity determining region 3 for antibody 52914
QQYNSYPWP

SEQ ID NO: 105828 - protein, 14 aa, Homo sapiens
  heavy chain complementarity determining region 3 for antibody 52914
ARKMGWDGVAWFDP

SEQ ID NO: 105829 - protein, 9 aa, Homo sapiens
  light chain complementarity determining region 3 for antibody 52915
QQYNSYPVT

SEQ ID NO: 105830 - protein, 12 aa, Homo sapiens
  heavy chain complementarity determining region 3 for antibody 52915
VREGPRTSHWKN

SEQ ID NO: 105831 - protein, 9 aa, Homo sapiens
  light chain complementarity determining region 3 for antibody 52916
QQYNSYPVT

SEQ ID NO: 105832 - protein, 20 aa, Homo sapiens
  heavy chain complementarity determining region 3 for antibody 52916
ANTPRYDILTGYYPNWYFDL

SEQ ID NO: 105833 - protein, 9 aa, Homo sapiens
  light chain complementarity determining region 3 for antibody 52917
QQYNSYPVT

SEQ ID NO: 105834 - protein, 20 aa, Homo sapiens
  heavy chain complementarity determining region 3 for antibody 52917
AHTPRYDIVTGYYPNWYFDL

SEQ ID NO: 105835 - protein, 9 aa, Homo sapiens
  light chain complementarity determining region 3 for antibody 52918
QQYNSYPIT

SEQ ID NO: 105836 - protein, 20 aa, Homo sapiens
  heavy chain complementarity determining region 3 for antibody 52918
ANSLPESGYSYGKKYNWFDP

SEQ ID NO: 105837 - protein, 9 aa, Homo sapiens
  light chain complementarity determining region 3 for antibody 52919
QQYNSYPCT

SEQ ID NO: 105838 - protein, 7 aa, Homo sapiens
  heavy chain complementarity determining region 3 for antibody 52919
SPVSGRY

SEQ ID NO: 105839 - protein, 9 aa, Homo sapiens
  light chain complementarity determining region 3 for antibody 52920
QQYNSYAWT

SEQ ID NO: 105840 - protein, 7 aa, Homo sapiens
  heavy chain complementarity determining region 3 for antibody 52920
SPVSGRY

SEQ ID NO: 105841 - protein, 8 aa, Homo sapiens
  light chain complementarity determining region 3 for antibody 52921
QQYNSSWT

SEQ ID NO: 105842 - protein, 11 aa, Homo sapiens
  heavy chain complementarity determining region 3 for antibody 52921
ARGAWPYFFDL

SEQ ID NO: 105843 - protein, 9 aa, Homo sapiens
  light chain complementarity determining region 3 for antibody 52922
QQYNSFPYT

SEQ ID NO: 105844 - protein, 12 aa, Homo sapiens
  heavy chain complementarity determining region 3 for antibody 52922
VREGPRTSHWKN

SEQ ID NO: 105845 - protein, 9 aa, Homo sapiens
  light chain complementarity determining region 3 for antibody 52923
QQYNSFFYT

SEQ ID NO: 105846 - protein, 14 aa, Homo sapiens
  heavy chain complementarity determining region 3 for antibody 52923
ARKMGWDGVAWFDP

SEQ ID NO: 105847 - protein, 10 aa, Homo sapiens
  light chain complementarity determining region 3 for antibody 52924
QQYNNYWGFT

SEQ ID NO: 105848 - protein, 7 aa, Homo sapiens
  heavy chain complementarity determining region 3 for antibody 52924
SPVSGRY

SEQ ID NO: 105849 - protein, 10 aa, Homo sapiens
  light chain complementarity determining region 3 for antibody 52925
QQYNNYWGFT

SEQ ID NO: 105850 - protein, 14 aa, Homo sapiens
  heavy chain complementarity determining region 3 for antibody 52925
ARKMGWDGVAWFDP

SEQ ID NO: 105851 - protein, 10 aa, Homo sapiens
  light chain complementarity determining region 3 for antibody 52926
QQYNNYWGFT

SEQ ID NO: 105852 - protein, 16 aa, Homo sapiens
  heavy chain complementarity determining region 3 for antibody 52926
ARGPVKAHYYYYYMDV

SEQ ID NO: 105853 - protein, 10 aa, Homo sapiens
  light chain complementarity determining region 3 for antibody 52927
QQYNNYWGFT

SEQ ID NO: 105854 - protein, 12 aa, Homo sapiens
  heavy chain complementarity determining region 3 for antibody 52927
ALSITMVVEPDF

SEQ ID NO: 105855 - protein, 8 aa, Homo sapiens
  light chain complementarity determining region 3 for antibody 52928
QQYNNWWS

SEQ ID NO: 105856 - protein, 16 aa, Homo sapiens
  heavy chain complementarity determining region 3 for antibody 52928
ATTKNLVRGINWYFDL

SEQ ID NO: 105857 - protein, 8 aa, Homo sapiens
  light chain complementarity determining region 3 for antibody 52929
QQYNNWPS

SEQ ID NO: 105858 - protein, 14 aa, Homo sapiens
  heavy chain complementarity determining region 3 for antibody 52929
ARKMGWDGVAWFDP

SEQ ID NO: 105859 - protein, 9 aa, Homo sapiens
  light chain complementarity determining region 3 for antibody 52930
QQYNIYSET

SEQ ID NO: 105860 - protein, 12 aa, Homo sapiens
  heavy chain complementarity determining region 3 for antibody 52930
VREGPRTSHWKN

SEQ ID NO: 105861 - protein, 9 aa, Homo sapiens
  light chain complementarity determining region 3 for antibody 52931
QQYNIYSET

SEQ ID NO: 105862 - protein, 14 aa, Homo sapiens
  heavy chain complementarity determining region 3 for antibody 52931
ARKMGWDGVAWFDP

SEQ ID NO: 105863 - protein, 9 aa, Homo sapiens
  light chain complementarity determining region 3 for antibody 52932
QQYNDWPYT

SEQ ID NO: 105864 - protein, 12 aa, Homo sapiens
  heavy chain complementarity determining region 3 for antibody 52932
VREGPRTSHWKN

SEQ ID NO: 105865 - protein, 9 aa, Homo sapiens
  light chain complementarity determining region 3 for antibody 52933
QQYMTYPWT

SEQ ID NO: 105866 - protein, 12 aa, Homo sapiens
  heavy chain complementarity determining region 3 for antibody 52933
VREGPRTSHWKN

SEQ ID NO: 105867 - protein, 9 aa, Homo sapiens
  light chain complementarity determining region 3 for antibody 52934
QQYKSYPLI

SEQ ID NO: 105868 - protein, 8 aa, Homo sapiens
  heavy chain complementarity determining region 3 for antibody 52934
AKDYYDNP

SEQ ID NO: 105869 - protein, 9 aa, Homo sapiens
  light chain complementarity determining region 3 for antibody 52935
QQYGSSPWT

SEQ ID NO: 105870 - protein, 10 aa, Homo sapiens
  heavy chain complementarity determining region 3 for antibody 52935
ARDGQWLVTY

SEQ ID NO: 105871 - protein, 10 aa, Homo sapiens
  light chain complementarity determining region 3 for antibody 52936
QQYGSSPRYT

SEQ ID NO: 105872 - protein, 15 aa, Homo sapiens
  heavy chain complementarity determining region 3 for antibody 52936
AQAYSSSWYAHHFDY

SEQ ID NO: 105873 - protein, 9 aa, Homo sapiens
  light chain complementarity determining region 3 for antibody 52937
QQYGSSPRT

SEQ ID NO: 105874 - protein, 14 aa, Homo sapiens
  heavy chain complementarity determining region 3 for antibody 52937
ATPADYGGKLPFDY

SEQ ID NO: 105875 - protein, 9 aa, Homo sapiens
  light chain complementarity determining region 3 for antibody 52938
QQYGSSPRT

SEQ ID NO: 105876 - protein, 13 aa, Homo sapiens
  heavy chain complementarity determining region 3 for antibody 52938
ASPDSHSVGAFDI

SEQ ID NO: 105877 - protein, 10 aa, Homo sapiens
  light chain complementarity determining region 3 for antibody 52939
QQYGSSPPYS

SEQ ID NO: 105878 - protein, 13 aa, Homo sapiens
  heavy chain complementarity determining region 3 for antibody 52939
TRGAGYYTEYFQD

SEQ ID NO: 105879 - protein, 11 aa, Homo sapiens
  light chain complementarity determining region 3 for antibody 52940
QQYGSSPPRFT

SEQ ID NO: 105880 - protein, 15 aa, Homo sapiens
  heavy chain complementarity determining region 3 for antibody 52940
ARGGAYFEASGPFDY

SEQ ID NO: 105881 - protein, 10 aa, Homo sapiens
  light chain complementarity determining region 3 for antibody 52941
QQYGSSPMYT

SEQ ID NO: 105882 - protein, 24 aa, Homo sapiens
  heavy chain complementarity determining region 3 for antibody 52941
ARRYCSGGSCYSVRRPTTKDAFDI

SEQ ID NO: 105883 - protein, 10 aa, Homo sapiens
  light chain complementarity determining region 3 for antibody 52942
QQYGSSLLIT

SEQ ID NO: 105884 - protein, 15 aa, Homo sapiens
  heavy chain complementarity determining region 3 for antibody 52942
AHSALYSSGWYRLDY

SEQ ID NO: 105885 - protein, 9 aa, Homo sapiens
  light chain complementarity determining region 3 for antibody 52943
QQYGSPPWT

SEQ ID NO: 105886 - protein, 18 aa, Homo sapiens
  heavy chain complementarity determining region 3 for antibody 52943
ARDGGPPNNWNWVGFFDY

SEQ ID NO: 105887 - protein, 9 aa, Homo sapiens
  light chain complementarity determining region 3 for antibody 52944
QQYGIYPLT

SEQ ID NO: 105888 - protein, 14 aa, Homo sapiens
  heavy chain complementarity determining region 3 for antibody 52944
AKGEGGVAGALLVY

SEQ ID NO: 105889 - protein, 9 aa, Homo sapiens
  light chain complementarity determining region 3 for antibody 52945
QQYDSYSKT

SEQ ID NO: 105890 - protein, 15 aa, Homo sapiens
  heavy chain complementarity determining region 3 for antibody 52945
ARRGYYGPGKMAYDI

SEQ ID NO: 105891 - protein, 9 aa, Homo sapiens
  light chain complementarity determining region 3 for antibody 52946
QQYDSYSKT

SEQ ID NO: 105892 - protein, 14 aa, Homo sapiens
  heavy chain complementarity determining region 3 for antibody 52946
ARKMGWDGVAWFDP

SEQ ID NO: 105893 - protein, 9 aa, Homo sapiens
  light chain complementarity determining region 3 for antibody 52947
QQYDSYPYT

SEQ ID NO: 105894 - protein, 14 aa, Homo sapiens
  heavy chain complementarity determining region 3 for antibody 52947
ARKMGWDGVAWFDP

SEQ ID NO: 105895 - protein, 9 aa, Homo sapiens
  light chain complementarity determining region 3 for antibody 52948
QQYDSYPCT

SEQ ID NO: 105896 - protein, 15 aa, Homo sapiens
  heavy chain complementarity determining region 3 for antibody 52948
ARSAFVDVLTPFFAY

SEQ ID NO: 105897 - protein, 9 aa, Homo sapiens
  light chain complementarity determining region 3 for antibody 52949
QQYDSYPCT

SEQ ID NO: 105898 - protein, 14 aa, Homo sapiens
  heavy chain complementarity determining region 3 for antibody 52949
ARLVYHGGMFTFDV

SEQ ID NO: 105899 - protein, 9 aa, Homo sapiens
  light chain complementarity determining region 3 for antibody 52950
QQYDSYPCT

SEQ ID NO: 105900 - protein, 11 aa, Homo sapiens
  heavy chain complementarity determining region 3 for antibody 52950
ARGAWPYFFDL

SEQ ID NO: 105901 - protein, 9 aa, Homo sapiens
  light chain complementarity determining region 3 for antibody 52951
QQYDSYPCT

SEQ ID NO: 105902 - protein, 17 aa, Homo sapiens
  heavy chain complementarity determining region 3 for antibody 52951
ARDSSYCGGDCSTASDY

SEQ ID NO: 105903 - protein, 9 aa, Homo sapiens
  light chain complementarity determining region 3 for antibody 52952
QQYDSYPCT

SEQ ID NO: 105904 - protein, 15 aa, Homo sapiens
  heavy chain complementarity determining region 3 for antibody 52952
AQTYSSSWYAHHFDY

SEQ ID NO: 105905 - protein, 9 aa, Homo sapiens
  light chain complementarity determining region 3 for antibody 52953
QQYDSYPCT

SEQ ID NO: 105906 - protein, 15 aa, Homo sapiens
  heavy chain complementarity determining region 3 for antibody 52953
AKGPGFAYGKKYFQH

SEQ ID NO: 105907 - protein, 9 aa, Homo sapiens
  light chain complementarity determining region 3 for antibody 52954
QQYDSYPCT

SEQ ID NO: 105908 - protein, 15 aa, Homo sapiens
  heavy chain complementarity determining region 3 for antibody 52954
AHSAVVDVLTPCFAY

SEQ ID NO: 105909 - protein, 9 aa, Homo sapiens
  light chain complementarity determining region 3 for antibody 52955
QQYDSYPCT

SEQ ID NO: 105910 - protein, 15 aa, Homo sapiens
  heavy chain complementarity determining region 3 for antibody 52955
AHSAFVYVLTPFFAY

SEQ ID NO: 105911 - protein, 9 aa, Homo sapiens
  light chain complementarity determining region 3 for antibody 52956
QQYDSYPCT

SEQ ID NO: 105912 - protein, 15 aa, Homo sapiens
  heavy chain complementarity determining region 3 for antibody 52956
AHSAFVDVWTPFFAY

SEQ ID NO: 105913 - protein, 9 aa, Homo sapiens
  light chain complementarity determining region 3 for antibody 52957
QQYDSYPCT

SEQ ID NO: 105914 - protein, 15 aa, Homo sapiens
  heavy chain complementarity determining region 3 for antibody 52957
AHSAFVDVWTPFFAD

SEQ ID NO: 105915 - protein, 9 aa, Homo sapiens
  light chain complementarity determining region 3 for antibody 52958
QQYDSYPCT

SEQ ID NO: 105916 - protein, 15 aa, Homo sapiens
  heavy chain complementarity determining region 3 for antibody 52958
AHSAFVDVLTPFLAY

SEQ ID NO: 105917 - protein, 9 aa, Homo sapiens
  light chain complementarity determining region 3 for antibody 52959
QQYDSYPCT

SEQ ID NO: 105918 - protein, 15 aa, Homo sapiens
  heavy chain complementarity determining region 3 for antibody 52959
AHSAFVDVLTPFFAS

SEQ ID NO: 105919 - protein, 9 aa, Homo sapiens
  light chain complementarity determining region 3 for antibody 52960
QQYDSYPCT

SEQ ID NO: 105920 - protein, 15 aa, Homo sapiens
  heavy chain complementarity determining region 3 for antibody 52960
AHSAFVDVLTPFFAF

SEQ ID NO: 105921 - protein, 9 aa, Homo sapiens
  light chain complementarity determining region 3 for antibody 52961
QQYDSYPCT

SEQ ID NO: 105922 - protein, 15 aa, Homo sapiens
  heavy chain complementarity determining region 3 for antibody 52961
AHSAFVDVLTAFFAY

SEQ ID NO: 105923 - protein, 9 aa, Homo sapiens
  light chain complementarity determining region 3 for antibody 52962
QQYDSYPCT

SEQ ID NO: 105924 - protein, 15 aa, Homo sapiens
  heavy chain complementarity determining region 3 for antibody 52962
AHSAFVDGLTPFFDY

SEQ ID NO: 105925 - protein, 9 aa, Homo sapiens
  light chain complementarity determining region 3 for antibody 52963
QQYDSSLYT

SEQ ID NO: 105926 - protein, 13 aa, Homo sapiens
  heavy chain complementarity determining region 3 for antibody 52963
VRNFGDFHFRFDP

SEQ ID NO: 105927 - protein, 10 aa, Homo sapiens
  light chain complementarity determining region 3 for antibody 52964
QQYDNVPPLT

SEQ ID NO: 105928 - protein, 12 aa, Homo sapiens
  heavy chain complementarity determining region 3 for antibody 52964
VREGPRTSHWKN

SEQ ID NO: 105929 - protein, 10 aa, Homo sapiens
  light chain complementarity determining region 3 for antibody 52965
QQYDNSSPHT

SEQ ID NO: 105930 - protein, 16 aa, Homo sapiens
  heavy chain complementarity determining region 3 for antibody 52965
ARGGTSGWYKTGAFDY

SEQ ID NO: 105931 - protein, 9 aa, Homo sapiens
  light chain complementarity determining region 3 for antibody 52966
QQYDNLRFT

SEQ ID NO: 105932 - protein, 13 aa, Homo sapiens
  heavy chain complementarity determining region 3 for antibody 52966
ARQLPRHWGVVDY

SEQ ID NO: 105933 - protein, 10 aa, Homo sapiens
  light chain complementarity determining region 3 for antibody 52967
QQYDNLPPYT

SEQ ID NO: 105934 - protein, 12 aa, Homo sapiens
  heavy chain complementarity determining region 3 for antibody 52967
VREGPRTSHWKN

SEQ ID NO: 105935 - protein, 9 aa, Homo sapiens
  light chain complementarity determining region 3 for antibody 52968
QQYDNLPPV

SEQ ID NO: 105936 - protein, 14 aa, Homo sapiens
  heavy chain complementarity determining region 3 for antibody 52968
YYDGSGDTGDAFDI

SEQ ID NO: 105937 - protein, 10 aa, Homo sapiens
  light chain complementarity determining region 3 for antibody 52969
QQYDNLPMYT

SEQ ID NO: 105938 - protein, 6 aa, Homo sapiens
  heavy chain complementarity determining region 3 for antibody 52969
AREGRT

SEQ ID NO: 105939 - protein, 9 aa, Homo sapiens
  light chain complementarity determining region 3 for antibody 52970
QQYDNLPLT

SEQ ID NO: 105940 - protein, 12 aa, Homo sapiens
  heavy chain complementarity determining region 3 for antibody 52970
VREGPRTSHWKN

SEQ ID NO: 105941 - protein, 9 aa, Homo sapiens
  light chain complementarity determining region 3 for antibody 52971
QQYDDLPLT

SEQ ID NO: 105942 - protein, 7 aa, Homo sapiens
  heavy chain complementarity determining region 3 for antibody 52971
SPVSGRY

SEQ ID NO: 105943 - protein, 9 aa, Homo sapiens
  light chain complementarity determining region 3 for antibody 52972
QQYDDLPLT

SEQ ID NO: 105944 - protein, 13 aa, Homo sapiens
  heavy chain complementarity determining region 3 for antibody 52972
ARHRGGSSLMHDC

SEQ ID NO: 105945 - protein, 8 aa, Homo sapiens
  light chain complementarity determining region 3 for antibody 52973
QQYATSWT

SEQ ID NO: 105946 - protein, 12 aa, Homo sapiens
  heavy chain complementarity determining region 3 for antibody 52973
VREGPRPSHWKN

SEQ ID NO: 105947 - protein, 8 aa, Homo sapiens
  light chain complementarity determining region 3 for antibody 52974
QQYATSWT

SEQ ID NO: 105948 - protein, 15 aa, Homo sapiens
  heavy chain complementarity determining region 3 for antibody 52974
ATYMSGLYYYYAMDV

SEQ ID NO: 105949 - protein, 8 aa, Homo sapiens
  light chain complementarity determining region 3 for antibody 52975
QQYATSWT

SEQ ID NO: 105950 - protein, 24 aa, Homo sapiens
  heavy chain complementarity determining region 3 for antibody 52975
ARLSVYFGTVASAASKRYRSYFDY

SEQ ID NO: 105951 - protein, 8 aa, Homo sapiens
  light chain complementarity determining region 3 for antibody 52976
QQYATSWT

SEQ ID NO: 105952 - protein, 21 aa, Homo sapiens
  heavy chain complementarity determining region 3 for antibody 52976
ARHEEGDIVLVPAAMGGGFGY

SEQ ID NO: 105953 - protein, 8 aa, Homo sapiens
  light chain complementarity determining region 3 for antibody 52977
QQYATSWT

SEQ ID NO: 105954 - protein, 17 aa, Homo sapiens
  heavy chain complementarity determining region 3 for antibody 52977
ARDSSYCGGDCSTASDY

SEQ ID NO: 105955 - protein, 8 aa, Homo sapiens
  light chain complementarity determining region 3 for antibody 52978
QQYATSWT

SEQ ID NO: 105956 - protein, 13 aa, Homo sapiens
  heavy chain complementarity determining region 3 for antibody 52978
ARDLSYGSGYPGY

SEQ ID NO: 105957 - protein, 8 aa, Homo sapiens
  light chain complementarity determining region 3 for antibody 52979
QQYATSWT

SEQ ID NO: 105958 - protein, 12 aa, Homo sapiens
  heavy chain complementarity determining region 3 for antibody 52979
AKEREATGYFDY

SEQ ID NO: 105959 - protein, 8 aa, Homo sapiens
  light chain complementarity determining region 3 for antibody 52980
QQYATSWT

SEQ ID NO: 105960 - protein, 9 aa, Homo sapiens
  heavy chain complementarity determining region 3 for antibody 52980
AILGGGSDP

SEQ ID NO: 105961 - protein, 8 aa, Homo sapiens
  light chain complementarity determining region 3 for antibody 52981
QQYATSWT

SEQ ID NO: 105962 - protein, 16 aa, Homo sapiens
  heavy chain complementarity determining region 3 for antibody 52981
AAGPSVEGVLSEYFPH

SEQ ID NO: 105963 - protein, 8 aa, Homo sapiens
  light chain complementarity determining region 3 for antibody 52982
QQYATSWT

SEQ ID NO: 105964 - protein, 16 aa, Homo sapiens
  heavy chain complementarity determining region 3 for antibody 52982
AAGPSVEGVLRGYFQH

SEQ ID NO: 105965 - protein, 8 aa, Homo sapiens
  light chain complementarity determining region 3 for antibody 52983
QQYATSWT

SEQ ID NO: 105966 - protein, 16 aa, Homo sapiens
  heavy chain complementarity determining region 3 for antibody 52983
AAGPSVEGVLREYSPH

SEQ ID NO: 105967 - protein, 8 aa, Homo sapiens
  light chain complementarity determining region 3 for antibody 52984
QQYATSWT

SEQ ID NO: 105968 - protein, 16 aa, Homo sapiens
  heavy chain complementarity determining region 3 for antibody 52984
AAGPSVEGVLRDYFPH

SEQ ID NO: 105969 - protein, 9 aa, Homo sapiens
  light chain complementarity determining region 3 for antibody 52985
QQTYSSQWT

SEQ ID NO: 105970 - protein, 14 aa, Homo sapiens
  heavy chain complementarity determining region 3 for antibody 52985
ANSIRRFFDSSMDF

SEQ ID NO: 105971 - protein, 11 aa, Homo sapiens
  light chain complementarity determining region 3 for antibody 52986
QQTYSNRPDIT

SEQ ID NO: 105972 - protein, 15 aa, Homo sapiens
  heavy chain complementarity determining region 3 for antibody 52986
ARRGYYGPGKMAYDI

SEQ ID NO: 105973 - protein, 11 aa, Homo sapiens
  light chain complementarity determining region 3 for antibody 52987
QQTYSNRPDIT

SEQ ID NO: 105974 - protein, 15 aa, Homo sapiens
  heavy chain complementarity determining region 3 for antibody 52987
ARGGGPYYDSSGYQQ

SEQ ID NO: 105975 - protein, 11 aa, Homo sapiens
  light chain complementarity determining region 3 for antibody 52988
QQTYSNRPDIT

SEQ ID NO: 105976 - protein, 13 aa, Homo sapiens
  heavy chain complementarity determining region 3 for antibody 52988
ARDAADWRAAFDV

SEQ ID NO: 105977 - protein, 11 aa, Homo sapiens
  light chain complementarity determining region 3 for antibody 52989
QQTYSNRPDIT

SEQ ID NO: 105978 - protein, 12 aa, Homo sapiens
  heavy chain complementarity determining region 3 for antibody 52989
AKEREATGYFDY

SEQ ID NO: 105979 - protein, 11 aa, Homo sapiens
  light chain complementarity determining region 3 for antibody 52990
QQTYSNRPDIT

SEQ ID NO: 105980 - protein, 20 aa, Homo sapiens
  heavy chain complementarity determining region 3 for antibody 52990
AHRTFTFHYDTGGYYNWFDP

SEQ ID NO: 105981 - protein, 11 aa, Homo sapiens
  light chain complementarity determining region 3 for antibody 52991
QQTYSNRPDIT

SEQ ID NO: 105982 - protein, 20 aa, Homo sapiens
  heavy chain complementarity determining region 3 for antibody 52991
AHRPVTFHYDTGGYYNWFDP

SEQ ID NO: 105983 - protein, 11 aa, Homo sapiens
  light chain complementarity determining region 3 for antibody 52992
QQTYSNRPDIT

SEQ ID NO: 105984 - protein, 20 aa, Homo sapiens
  heavy chain complementarity determining region 3 for antibody 52992
AHRPFTLHYDTGGYYNWFDP

SEQ ID NO: 105985 - protein, 11 aa, Homo sapiens
  light chain complementarity determining region 3 for antibody 52993
QQTYSNRPDIT

SEQ ID NO: 105986 - protein, 20 aa, Homo sapiens
  heavy chain complementarity determining region 3 for antibody 52993
AHRPFTFHYDTGGYYNWFYP

SEQ ID NO: 105987 - protein, 11 aa, Homo sapiens
  light chain complementarity determining region 3 for antibody 52994
QQTYSNRPDIT

SEQ ID NO: 105988 - protein, 20 aa, Homo sapiens
  heavy chain complementarity determining region 3 for antibody 52994
AHRPFTFHYDTGGYSNWFDP

SEQ ID NO: 105989 - protein, 11 aa, Homo sapiens
  light chain complementarity determining region 3 for antibody 52995
QQTYSNRPDIT

SEQ ID NO: 105990 - protein, 20 aa, Homo sapiens
  heavy chain complementarity determining region 3 for antibody 52995
AHRPFTFHYDTGGDYNWFDP

SEQ ID NO: 105991 - protein, 11 aa, Homo sapiens
  light chain complementarity determining region 3 for antibody 52996
QQTYSNRPDIT

SEQ ID NO: 105992 - protein, 20 aa, Homo sapiens
  heavy chain complementarity determining region 3 for antibody 52996
AHRPFTFHDDTGGYYNWFDP

SEQ ID NO: 105993 - protein, 11 aa, Homo sapiens
  light chain complementarity determining region 3 for antibody 52997
QQTYSNRPDIT

SEQ ID NO: 105994 - protein, 20 aa, Homo sapiens
  heavy chain complementarity determining region 3 for antibody 52997
AHRPCTFHYDTGGYYNWFDP

SEQ ID NO: 105995 - protein, 9 aa, Homo sapiens
  light chain complementarity determining region 3 for antibody 52998
QQTYNTPFA

SEQ ID NO: 105996 - protein, 12 aa, Homo sapiens
  heavy chain complementarity determining region 3 for antibody 52998
VREGPRTSHWKN

SEQ ID NO: 105997 - protein, 9 aa, Homo sapiens
  light chain complementarity determining region 3 for antibody 52999
QQTSSTPPT

SEQ ID NO: 105998 - protein, 12 aa, Homo sapiens
  heavy chain complementarity determining region 3 for antibody 52999
VREGPRTSRWKN

SEQ ID NO: 105999 - protein, 9 aa, Homo sapiens
  light chain complementarity determining region 3 for antibody 53000
QQSYTTPYT

SEQ ID NO: 106000 - protein, 12 aa, Homo sapiens
  heavy chain complementarity determining region 3 for antibody 53000
ARRLVTEYYFDF

SEQ ID NO: 106001 - protein, 9 aa, Homo sapiens
  light chain complementarity determining region 3 for antibody 53001
QQSYSTPYT

SEQ ID NO: 106002 - protein, 15 aa, Homo sapiens
  heavy chain complementarity determining region 3 for antibody 53001
ATYRSGLYYYYAMDV

SEQ ID NO: 106003 - protein, 9 aa, Homo sapiens
  light chain complementarity determining region 3 for antibody 53002
QQSYSTPYT

SEQ ID NO: 106004 - protein, 15 aa, Homo sapiens
  heavy chain complementarity determining region 3 for antibody 53002
ATYMSGLYYYDAMDV

SEQ ID NO: 106005 - protein, 9 aa, Homo sapiens
  light chain complementarity determining region 3 for antibody 53003
QQSYSTPYT

SEQ ID NO: 106006 - protein, 13 aa, Homo sapiens
  heavy chain complementarity determining region 3 for antibody 53003
ASESFGGPRGFNY

SEQ ID NO: 106007 - protein, 9 aa, Homo sapiens
  light chain complementarity determining region 3 for antibody 53004
QQSYSTPYT

SEQ ID NO: 106008 - protein, 19 aa, Homo sapiens
  heavy chain complementarity determining region 3 for antibody 53004
ARDLQVTGSQWERPGYFDY

SEQ ID NO: 106009 - protein, 9 aa, Homo sapiens
  light chain complementarity determining region 3 for antibody 53005
QQSYSTPYT

SEQ ID NO: 106010 - protein, 19 aa, Homo sapiens
  heavy chain complementarity determining region 3 for antibody 53005
ARDLKVTGSQWELPGYFDY

SEQ ID NO: 106011 - protein, 9 aa, Homo sapiens
  light chain complementarity determining region 3 for antibody 53006
QQSYSTPYT

SEQ ID NO: 106012 - protein, 15 aa, Homo sapiens
  heavy chain complementarity determining region 3 for antibody 53006
APYMSGLYYYYAMDV

SEQ ID NO: 106013 - protein, 9 aa, Homo sapiens
  light chain complementarity determining region 3 for antibody 53007
QQSYSTPYP

SEQ ID NO: 106014 - protein, 15 aa, Homo sapiens
  heavy chain complementarity determining region 3 for antibody 53007
ARTSGRYVRSNYFDP

SEQ ID NO: 106015 - protein, 9 aa, Homo sapiens
  light chain complementarity determining region 3 for antibody 53008
QQSYSTPPT

SEQ ID NO: 106016 - protein, 15 aa, Homo sapiens
  heavy chain complementarity determining region 3 for antibody 53008
AREGYSSSWSHPLDY

SEQ ID NO: 106017 - protein, 11 aa, Homo sapiens
  light chain complementarity determining region 3 for antibody 53009
QQSYSTPPSLT

SEQ ID NO: 106018 - protein, 14 aa, Homo sapiens
  heavy chain complementarity determining region 3 for antibody 53009
ARKMGWDGVAWFDP

SEQ ID NO: 106019 - protein, 10 aa, Homo sapiens
  light chain complementarity determining region 3 for antibody 53010
QQSYSTPPLT

SEQ ID NO: 106020 - protein, 19 aa, Homo sapiens
  heavy chain complementarity determining region 3 for antibody 53010
ARGGYDILTGYSHYYYFDL

SEQ ID NO: 106021 - protein, 9 aa, Homo sapiens
  light chain complementarity determining region 3 for antibody 53011
QQSYSTPPG

SEQ ID NO: 106022 - protein, 14 aa, Homo sapiens
  heavy chain complementarity determining region 3 for antibody 53011
ARKMGWDGVAWFDP

SEQ ID NO: 106023 - protein, 10 aa, Homo sapiens
  light chain complementarity determining region 3 for antibody 53012
QQSYSTPPFT

SEQ ID NO: 106024 - protein, 13 aa, Homo sapiens
  heavy chain complementarity determining region 3 for antibody 53012
ATYSGYDRYYFDY

SEQ ID NO: 106025 - protein, 10 aa, Homo sapiens
  light chain complementarity determining region 3 for antibody 53013
QQSYSTPPFT

SEQ ID NO: 106026 - protein, 15 aa, Homo sapiens
  heavy chain complementarity determining region 3 for antibody 53013
ARRGYYGTGKMAYDI

SEQ ID NO: 106027 - protein, 10 aa, Homo sapiens
  light chain complementarity determining region 3 for antibody 53014
QQSYSTPPFT

SEQ ID NO: 106028 - protein, 15 aa, Homo sapiens
  heavy chain complementarity determining region 3 for antibody 53014
ARRGYYGPGKMAYDL

SEQ ID NO: 106029 - protein, 10 aa, Homo sapiens
  light chain complementarity determining region 3 for antibody 53015
QQSYSTPPFP

SEQ ID NO: 106030 - protein, 15 aa, Homo sapiens
  heavy chain complementarity determining region 3 for antibody 53015
ARRGYYGPGKMAYDI

SEQ ID NO: 106031 - protein, 9 aa, Homo sapiens
  light chain complementarity determining region 3 for antibody 53016
QQSYSTLYT

SEQ ID NO: 106032 - protein, 12 aa, Homo sapiens
  heavy chain complementarity determining region 3 for antibody 53016
VRKGPRTSHWKN

SEQ ID NO: 106033 - protein, 9 aa, Homo sapiens
  light chain complementarity determining region 3 for antibody 53017
QQSYSTLYT

SEQ ID NO: 106034 - protein, 12 aa, Homo sapiens
  heavy chain complementarity determining region 3 for antibody 53017
VREGPSASHWKN

SEQ ID NO: 106035 - protein, 9 aa, Homo sapiens
  light chain complementarity determining region 3 for antibody 53018
QQSYSTLYT

SEQ ID NO: 106036 - protein, 12 aa, Homo sapiens
  heavy chain complementarity determining region 3 for antibody 53018
VREGPRTSPWKN

SEQ ID NO: 106037 - protein, 9 aa, Homo sapiens
  light chain complementarity determining region 3 for antibody 53019
QQSYSTLYT

SEQ ID NO: 106038 - protein, 12 aa, Homo sapiens
  heavy chain complementarity determining region 3 for antibody 53019
VREGPRTSLWKN

SEQ ID NO: 106039 - protein, 9 aa, Homo sapiens
  light chain complementarity determining region 3 for antibody 53020
QQSYSTLYT

SEQ ID NO: 106040 - protein, 12 aa, Homo sapiens
  heavy chain complementarity determining region 3 for antibody 53020
VREGPRTSHWND

SEQ ID NO: 106041 - protein, 9 aa, Homo sapiens
  light chain complementarity determining region 3 for antibody 53021
QQSYSTLYT

SEQ ID NO: 106042 - protein, 12 aa, Homo sapiens
  heavy chain complementarity determining region 3 for antibody 53021
VREGPRTSHWKT

SEQ ID NO: 106043 - protein, 9 aa, Homo sapiens
  light chain complementarity determining region 3 for antibody 53022
QQSYSTLYT

SEQ ID NO: 106044 - protein, 12 aa, Homo sapiens
  heavy chain complementarity determining region 3 for antibody 53022
VREGPRTGHWKN

SEQ ID NO: 106045 - protein, 9 aa, Homo sapiens
  light chain complementarity determining region 3 for antibody 53023
QQSYSTLYT

SEQ ID NO: 106046 - protein, 12 aa, Homo sapiens
  heavy chain complementarity determining region 3 for antibody 53023
VREGPRSSHWKH

SEQ ID NO: 106047 - protein, 9 aa, Homo sapiens
  light chain complementarity determining region 3 for antibody 53024
QQSYSTLYT

SEQ ID NO: 106048 - protein, 12 aa, Homo sapiens
  heavy chain complementarity determining region 3 for antibody 53024
VREGPRPSPWKN

SEQ ID NO: 106049 - protein, 9 aa, Homo sapiens
  light chain complementarity determining region 3 for antibody 53025
QQSYSTLYT

SEQ ID NO: 106050 - protein, 12 aa, Homo sapiens
  heavy chain complementarity determining region 3 for antibody 53025
VREGPRISHWKN

SEQ ID NO: 106051 - protein, 9 aa, Homo sapiens
  light chain complementarity determining region 3 for antibody 53026
QQSYSTLYT

SEQ ID NO: 106052 - protein, 12 aa, Homo sapiens
  heavy chain complementarity determining region 3 for antibody 53026
VREGPRASHLKN

SEQ ID NO: 106053 - protein, 9 aa, Homo sapiens
  light chain complementarity determining region 3 for antibody 53027
QQSYSTLYT

SEQ ID NO: 106054 - protein, 12 aa, Homo sapiens
  heavy chain complementarity determining region 3 for antibody 53027
VREGPNTSHWKN

SEQ ID NO: 106055 - protein, 9 aa, Homo sapiens
  light chain complementarity determining region 3 for antibody 53028
QQSYSTLYT

SEQ ID NO: 106056 - protein, 12 aa, Homo sapiens
  heavy chain complementarity determining region 3 for antibody 53028
VREGARTSHWKN

SEQ ID NO: 106057 - protein, 9 aa, Homo sapiens
  light chain complementarity determining region 3 for antibody 53029
QQSYSTLYT

SEQ ID NO: 106058 - protein, 12 aa, Homo sapiens
  heavy chain complementarity determining region 3 for antibody 53029
VREDPRTSHWKN

SEQ ID NO: 106059 - protein, 9 aa, Homo sapiens
  light chain complementarity determining region 3 for antibody 53030
QQSYSTLYT

SEQ ID NO: 106060 - protein, 12 aa, Homo sapiens
  heavy chain complementarity determining region 3 for antibody 53030
VRECPRTSHWKT

SEQ ID NO: 106061 - protein, 9 aa, Homo sapiens
  light chain complementarity determining region 3 for antibody 53031
QQSYSTLYT

SEQ ID NO: 106062 - protein, 11 aa, Homo sapiens
  heavy chain complementarity determining region 3 for antibody 53031
TRGWVPRPFDY

SEQ ID NO: 106063 - protein, 9 aa, Homo sapiens
  light chain complementarity determining region 3 for antibody 53032
QQSYSTLYT

SEQ ID NO: 106064 - protein, 12 aa, Homo sapiens
  heavy chain complementarity determining region 3 for antibody 53032
MREGPRASHWKN

SEQ ID NO: 106065 - protein, 9 aa, Homo sapiens
  light chain complementarity determining region 3 for antibody 53033
QQSYSTLYT

SEQ ID NO: 106066 - protein, 12 aa, Homo sapiens
  heavy chain complementarity determining region 3 for antibody 53033
GREGPRTSHWKD

SEQ ID NO: 106067 - protein, 9 aa, Homo sapiens
  light chain complementarity determining region 3 for antibody 53034
QQSYSTLYT

SEQ ID NO: 106068 - protein, 12 aa, Homo sapiens
  heavy chain complementarity determining region 3 for antibody 53034
GREGPRASHWKN

SEQ ID NO: 106069 - protein, 9 aa, Homo sapiens
  light chain complementarity determining region 3 for antibody 53035
QQSYSTLYT

SEQ ID NO: 106070 - protein, 15 aa, Homo sapiens
  heavy chain complementarity determining region 3 for antibody 53035
ATDRGINWAYSRFDS

SEQ ID NO: 106071 - protein, 9 aa, Homo sapiens
  light chain complementarity determining region 3 for antibody 53036
QQSYSTLYT

SEQ ID NO: 106072 - protein, 12 aa, Homo sapiens
  heavy chain complementarity determining region 3 for antibody 53036
ATALSLYSSSGV

SEQ ID NO: 106073 - protein, 9 aa, Homo sapiens
  light chain complementarity determining region 3 for antibody 53037
QQSYSTLYT

SEQ ID NO: 106074 - protein, 16 aa, Homo sapiens
  heavy chain complementarity determining region 3 for antibody 53037
ARVAVTLRKQYNWFDP

SEQ ID NO: 106075 - protein, 9 aa, Homo sapiens
  light chain complementarity determining region 3 for antibody 53038
QQSYSTLYT

SEQ ID NO: 106076 - protein, 11 aa, Homo sapiens
  heavy chain complementarity determining region 3 for antibody 53038
ARTNSVRWFDP

SEQ ID NO: 106077 - protein, 9 aa, Homo sapiens
  light chain complementarity determining region 3 for antibody 53039
QQSYSTLYT

SEQ ID NO: 106078 - protein, 13 aa, Homo sapiens
  heavy chain complementarity determining region 3 for antibody 53039
ARSAPTSNWYFDL

SEQ ID NO: 106079 - protein, 9 aa, Homo sapiens
  light chain complementarity determining region 3 for antibody 53040
QQSYSTLYT

SEQ ID NO: 106080 - protein, 19 aa, Homo sapiens
  heavy chain complementarity determining region 3 for antibody 53040
ARITTDIVIVPGAIDGFDI

SEQ ID NO: 106081 - protein, 9 aa, Homo sapiens
  light chain complementarity determining region 3 for antibody 53041
QQSYSTLYT

SEQ ID NO: 106082 - protein, 12 aa, Homo sapiens
  heavy chain complementarity determining region 3 for antibody 53041
AREPPGGWYFDL

SEQ ID NO: 106083 - protein, 9 aa, Homo sapiens
  light chain complementarity determining region 3 for antibody 53042
QQSYSTLYT

SEQ ID NO: 106084 - protein, 20 aa, Homo sapiens
  heavy chain complementarity determining region 3 for antibody 53042
ARENRRLNYNSSWYYYGMDA

SEQ ID NO: 106085 - protein, 9 aa, Homo sapiens
  light chain complementarity determining region 3 for antibody 53043
QQSYSTLYT

SEQ ID NO: 106086 - protein, 10 aa, Homo sapiens
  heavy chain complementarity determining region 3 for antibody 53043
AREIPYYFDY

SEQ ID NO: 106087 - protein, 9 aa, Homo sapiens
  light chain complementarity determining region 3 for antibody 53044
QQSYSTLYT

SEQ ID NO: 106088 - protein, 22 aa, Homo sapiens
  heavy chain complementarity determining region 3 for antibody 53044
AREGGYCSGGRCDKYYHYGMDV

SEQ ID NO: 106089 - protein, 9 aa, Homo sapiens
  light chain complementarity determining region 3 for antibody 53045
QQSYSTLYT

SEQ ID NO: 106090 - protein, 17 aa, Homo sapiens
  heavy chain complementarity determining region 3 for antibody 53045
ARDRGEPNYFYYFYMEV

SEQ ID NO: 106091 - protein, 9 aa, Homo sapiens
  light chain complementarity determining region 3 for antibody 53046
QQSYSTLYT

SEQ ID NO: 106092 - protein, 12 aa, Homo sapiens
  heavy chain complementarity determining region 3 for antibody 53046
AKEREATGYFDY

SEQ ID NO: 106093 - protein, 8 aa, Homo sapiens
  light chain complementarity determining region 3 for antibody 53047
QQSYSTLT

SEQ ID NO: 106094 - protein, 12 aa, Homo sapiens
  heavy chain complementarity determining region 3 for antibody 53047
VREGPRTSHWKN

SEQ ID NO: 106095 - protein, 9 aa, Homo sapiens
  light chain complementarity determining region 3 for antibody 53048
QQSYSTLCT

SEQ ID NO: 106096 - protein, 12 aa, Homo sapiens
  heavy chain complementarity determining region 3 for antibody 53048
VREGPRTSHWKN

SEQ ID NO: 106097 - protein, 8 aa, Homo sapiens
  light chain complementarity determining region 3 for antibody 53049
QQSYSTGT

SEQ ID NO: 106098 - protein, 12 aa, Homo sapiens
  heavy chain complementarity determining region 3 for antibody 53049
VREGPRTSHWKN

SEQ ID NO: 106099 - protein, 9 aa, Homo sapiens
  light chain complementarity determining region 3 for antibody 53050
QQSYSTGLT

SEQ ID NO: 106100 - protein, 17 aa, Homo sapiens
  heavy chain complementarity determining region 3 for antibody 53050
AKGPVVTMVRKFGYFDS

SEQ ID NO: 106101 - protein, 9 aa, Homo sapiens
  light chain complementarity determining region 3 for antibody 53051
QQSYSNPRT

SEQ ID NO: 106102 - protein, 12 aa, Homo sapiens
  heavy chain complementarity determining region 3 for antibody 53051
VREGPRTSHWKN

SEQ ID NO: 106103 - protein, 9 aa, Homo sapiens
  light chain complementarity determining region 3 for antibody 53052
QQSYSNLYT

SEQ ID NO: 106104 - protein, 12 aa, Homo sapiens
  heavy chain complementarity determining region 3 for antibody 53052
VREGPRTSHWKN

SEQ ID NO: 106105 - protein, 9 aa, Homo sapiens
  light chain complementarity determining region 3 for antibody 53053
QQSYSLSRT

SEQ ID NO: 106106 - protein, 14 aa, Homo sapiens
  heavy chain complementarity determining region 3 for antibody 53053
ARKMGWDGVAWFDP

SEQ ID NO: 106107 - protein, 9 aa, Homo sapiens
  light chain complementarity determining region 3 for antibody 53054
QQSYSKLWA

SEQ ID NO: 106108 - protein, 12 aa, Homo sapiens
  heavy chain complementarity determining region 3 for antibody 53054
VREGPRTSHWKN

SEQ ID NO: 106109 - protein, 9 aa, Homo sapiens
  light chain complementarity determining region 3 for antibody 53055
QQSYSKLWA

SEQ ID NO: 106110 - protein, 14 aa, Homo sapiens
  heavy chain complementarity determining region 3 for antibody 53055
ARKMGWDGVAWFDP

SEQ ID NO: 106111 - protein, 9 aa, Homo sapiens
  light chain complementarity determining region 3 for antibody 53056
QQSYSIPRT

SEQ ID NO: 106112 - protein, 12 aa, Homo sapiens
  heavy chain complementarity determining region 3 for antibody 53056
VREGPRTSHWKN

SEQ ID NO: 106113 - protein, 9 aa, Homo sapiens
  light chain complementarity determining region 3 for antibody 53057
QQSYRPPYT

SEQ ID NO: 106114 - protein, 14 aa, Homo sapiens
  heavy chain complementarity determining region 3 for antibody 53057
ARKMGWDGVAWFDP

SEQ ID NO: 106115 - protein, 8 aa, Homo sapiens
  light chain complementarity determining region 3 for antibody 53058
QQSYRAPS

SEQ ID NO: 106116 - protein, 14 aa, Homo sapiens
  heavy chain complementarity determining region 3 for antibody 53058
ARKMGWDGVAWFDP

SEQ ID NO: 106117 - protein, 9 aa, Homo sapiens
  light chain complementarity determining region 3 for antibody 53059
QQSYNTPLT

SEQ ID NO: 106118 - protein, 17 aa, Homo sapiens
  heavy chain complementarity determining region 3 for antibody 53059
ARQDALPGDYYYYGLDV

SEQ ID NO: 106119 - protein, 9 aa, Homo sapiens
  light chain complementarity determining region 3 for antibody 53060
QQSYNTPLT

SEQ ID NO: 106120 - protein, 19 aa, Homo sapiens
  heavy chain complementarity determining region 3 for antibody 53060
ARLATILRGNMRSIRRLDV

SEQ ID NO: 106121 - protein, 9 aa, Homo sapiens
  light chain complementarity determining region 3 for antibody 53061
QQSYNFPRT

SEQ ID NO: 106122 - protein, 14 aa, Homo sapiens
  heavy chain complementarity determining region 3 for antibody 53061
ARKMGWDGVAWFDP

SEQ ID NO: 106123 - protein, 9 aa, Homo sapiens
  light chain complementarity determining region 3 for antibody 53062
QQSYHTPYT

SEQ ID NO: 106124 - protein, 15 aa, Homo sapiens
  heavy chain complementarity determining region 3 for antibody 53062
ARTSGRYVRSNYFDP

SEQ ID NO: 106125 - protein, 9 aa, Homo sapiens
  light chain complementarity determining region 3 for antibody 53063
QQSYGTLYT

SEQ ID NO: 106126 - protein, 12 aa, Homo sapiens
  heavy chain complementarity determining region 3 for antibody 53063
VREGPRTSHWKN

SEQ ID NO: 106127 - protein, 9 aa, Homo sapiens
  light chain complementarity determining region 3 for antibody 53064
QQSYDPQYT

SEQ ID NO: 106128 - protein, 12 aa, Homo sapiens
  heavy chain complementarity determining region 3 for antibody 53064
ARYDMVTGGFDY

SEQ ID NO: 106129 - protein, 10 aa, Homo sapiens
  light chain complementarity determining region 3 for antibody 53065
QQSLTAPQIT

SEQ ID NO: 106130 - protein, 20 aa, Homo sapiens
  heavy chain complementarity determining region 3 for antibody 53065
ARPSSEYFNGANYYPEAFHT

SEQ ID NO: 106131 - protein, 9 aa, Homo sapiens
  light chain complementarity determining region 3 for antibody 53066
QQSGSSILT

SEQ ID NO: 106132 - protein, 15 aa, Homo sapiens
  heavy chain complementarity determining region 3 for antibody 53066
ARGGGPYYDSSGYQQ

SEQ ID NO: 106133 - protein, 8 aa, Homo sapiens
  light chain complementarity determining region 3 for antibody 53067
QQRYSTPT

SEQ ID NO: 106134 - protein, 13 aa, Homo sapiens
  heavy chain complementarity determining region 3 for antibody 53067
ARVHHDSSNAFDI

SEQ ID NO: 106135 - protein, 9 aa, Homo sapiens
  light chain complementarity determining region 3 for antibody 53068
QQRYSTPHT

SEQ ID NO: 106136 - protein, 20 aa, Homo sapiens
  heavy chain complementarity determining region 3 for antibody 53068
ATRLEWLVRSGSYYYYGMDA

SEQ ID NO: 106137 - protein, 9 aa, Homo sapiens
  light chain complementarity determining region 3 for antibody 53069
QQRYSTLYT

SEQ ID NO: 106138 - protein, 12 aa, Homo sapiens
  heavy chain complementarity determining region 3 for antibody 53069
VREGPRTSHWKN

SEQ ID NO: 106139 - protein, 9 aa, Homo sapiens
  light chain complementarity determining region 3 for antibody 53070
QQRTNWPLT

SEQ ID NO: 106140 - protein, 16 aa, Homo sapiens
  heavy chain complementarity determining region 3 for antibody 53070
VSYDNSGYDRPDAFDI

SEQ ID NO: 106141 - protein, 11 aa, Homo sapiens
  light chain complementarity determining region 3 for antibody 53071
QQRSNWPPTYT

SEQ ID NO: 106142 - protein, 12 aa, Homo sapiens
  heavy chain complementarity determining region 3 for antibody 53071
AREIKAAAGILA

SEQ ID NO: 106143 - protein, 9 aa, Homo sapiens
  light chain complementarity determining region 3 for antibody 53072
QQRSNWPLT

SEQ ID NO: 106144 - protein, 14 aa, Homo sapiens
  heavy chain complementarity determining region 3 for antibody 53072
ARKMGWDGVAWFDP

SEQ ID NO: 106145 - protein, 9 aa, Homo sapiens
  light chain complementarity determining region 3 for antibody 53073
QQNYRTTIT

SEQ ID NO: 106146 - protein, 10 aa, Homo sapiens
  heavy chain complementarity determining region 3 for antibody 53073
SGYTLGRHVP

SEQ ID NO: 106147 - protein, 9 aa, Homo sapiens
  light chain complementarity determining region 3 for antibody 53074
QQLNSYPYT

SEQ ID NO: 106148 - protein, 12 aa, Homo sapiens
  heavy chain complementarity determining region 3 for antibody 53074
VREGPRPSHWKN

SEQ ID NO: 106149 - protein, 9 aa, Homo sapiens
  light chain complementarity determining region 3 for antibody 53075
QQLNSYPYT

SEQ ID NO: 106150 - protein, 14 aa, Homo sapiens
  heavy chain complementarity determining region 3 for antibody 53075
ARWDWDYYYYGMDV

SEQ ID NO: 106151 - protein, 9 aa, Homo sapiens
  light chain complementarity determining region 3 for antibody 53076
QQLNSYPYT

SEQ ID NO: 106152 - protein, 15 aa, Homo sapiens
  heavy chain complementarity determining region 3 for antibody 53076
ARVRGSAYAEEKLES

SEQ ID NO: 106153 - protein, 9 aa, Homo sapiens
  light chain complementarity determining region 3 for antibody 53077
QQLNSYPYT

SEQ ID NO: 106154 - protein, 12 aa, Homo sapiens
  heavy chain complementarity determining region 3 for antibody 53077
ARSSTMVVEPDF

SEQ ID NO: 106155 - protein, 9 aa, Homo sapiens
  light chain complementarity determining region 3 for antibody 53078
QQLNSYPYT

SEQ ID NO: 106156 - protein, 15 aa, Homo sapiens
  heavy chain complementarity determining region 3 for antibody 53078
AKGPGFAYGKKYFQH

SEQ ID NO: 106157 - protein, 9 aa, Homo sapiens
  light chain complementarity determining region 3 for antibody 53079
QQLNSYPYT

SEQ ID NO: 106158 - protein, 12 aa, Homo sapiens
  heavy chain complementarity determining region 3 for antibody 53079
AISITMVVEPDF

SEQ ID NO: 106159 - protein, 9 aa, Homo sapiens
  light chain complementarity determining region 3 for antibody 53080
QQLNSYPYT

SEQ ID NO: 106160 - protein, 20 aa, Homo sapiens
  heavy chain complementarity determining region 3 for antibody 53080
AHRPFTFHYDTGGYYNWFDP

SEQ ID NO: 106161 - protein, 9 aa, Homo sapiens
  light chain complementarity determining region 3 for antibody 53081
QQLNSYPST

SEQ ID NO: 106162 - protein, 12 aa, Homo sapiens
  heavy chain complementarity determining region 3 for antibody 53081
ALSITMVVEPDF

SEQ ID NO: 106163 - protein, 9 aa, Homo sapiens
  light chain complementarity determining region 3 for antibody 53082
QQLNSYPRT

SEQ ID NO: 106164 - protein, 14 aa, Homo sapiens
  heavy chain complementarity determining region 3 for antibody 53082
ARKMGWDGVAWFDP

SEQ ID NO: 106165 - protein, 9 aa, Homo sapiens
  light chain complementarity determining region 3 for antibody 53083
QQLNSYPRT

SEQ ID NO: 106166 - protein, 16 aa, Homo sapiens
  heavy chain complementarity determining region 3 for antibody 53083
ARGPVKAHYYYYYMDV

SEQ ID NO: 106167 - protein, 10 aa, Homo sapiens
  light chain complementarity determining region 3 for antibody 53084
QQLNSYPRNT

SEQ ID NO: 106168 - protein, 11 aa, Homo sapiens
  heavy chain complementarity determining region 3 for antibody 53084
ARTNSVRWFDP

SEQ ID NO: 106169 - protein, 9 aa, Homo sapiens
  light chain complementarity determining region 3 for antibody 53085
QQLNSYPLT

SEQ ID NO: 106170 - protein, 12 aa, Homo sapiens
  heavy chain complementarity determining region 3 for antibody 53085
AKEREATGYFDY

SEQ ID NO: 106171 - protein, 9 aa, Homo sapiens
  light chain complementarity determining region 3 for antibody 53086
QQLNSYPLT

SEQ ID NO: 106172 - protein, 16 aa, Homo sapiens
  heavy chain complementarity determining region 3 for antibody 53086
AAGPSVEGVLREYFPH

SEQ ID NO: 106173 - protein, 9 aa, Homo sapiens
  light chain complementarity determining region 3 for antibody 53087
QQLNSYLVT

SEQ ID NO: 106174 - protein, 22 aa, Homo sapiens
  heavy chain complementarity determining region 3 for antibody 53087
ARTRGDIVATIKGTYCYYCMDV

SEQ ID NO: 106175 - protein, 9 aa, Homo sapiens
  light chain complementarity determining region 3 for antibody 53088
QQHGSSPRT

SEQ ID NO: 106176 - protein, 9 aa, Homo sapiens
  heavy chain complementarity determining region 3 for antibody 53088
ARRRYGEDY

SEQ ID NO: 106177 - protein, 9 aa, Homo sapiens
  light chain complementarity determining region 3 for antibody 53089
QQHDSPPFT

SEQ ID NO: 106178 - protein, 16 aa, Homo sapiens
  heavy chain complementarity determining region 3 for antibody 53089
ARGPVKAHYYYYYMDV

SEQ ID NO: 106179 - protein, 9 aa, Homo sapiens
  light chain complementarity determining region 3 for antibody 53090
QQGMSFPYT

SEQ ID NO: 106180 - protein, 14 aa, Homo sapiens
  heavy chain complementarity determining region 3 for antibody 53090
ARKMGWDGVAWFDP

SEQ ID NO: 106181 - protein, 9 aa, Homo sapiens
  light chain complementarity determining region 3 for antibody 53091
QQGMSFPHP

SEQ ID NO: 106182 - protein, 18 aa, Homo sapiens
  heavy chain complementarity determining region 3 for antibody 53091
ASQLDSSVGSKAYWYFDI

SEQ ID NO: 106183 - protein, 9 aa, Homo sapiens
  light chain complementarity determining region 3 for antibody 53092
QQGMAFPHT

SEQ ID NO: 106184 - protein, 18 aa, Homo sapiens
  heavy chain complementarity determining region 3 for antibody 53092
ASQLDSSVGSKAYWYFDI

SEQ ID NO: 106185 - protein, 9 aa, Homo sapiens
  light chain complementarity determining region 3 for antibody 53093
QQGISFPPT

SEQ ID NO: 106186 - protein, 18 aa, Homo sapiens
  heavy chain complementarity determining region 3 for antibody 53093
ASQLDSSVGSKAYWYFDI

SEQ ID NO: 106187 - protein, 9 aa, Homo sapiens
  light chain complementarity determining region 3 for antibody 53094
QQGDIAPLT

SEQ ID NO: 106188 - protein, 14 aa, Homo sapiens
  heavy chain complementarity determining region 3 for antibody 53094
ARKMGWDGVAWFDP

SEQ ID NO: 106189 - protein, 9 aa, Homo sapiens
  light chain complementarity determining region 3 for antibody 53095
QQFYSPPGT

SEQ ID NO: 106190 - protein, 14 aa, Homo sapiens
  heavy chain complementarity determining region 3 for antibody 53095
TGYSSGWYPFGMDV

SEQ ID NO: 106191 - protein, 9 aa, Homo sapiens
  light chain complementarity determining region 3 for antibody 53096
QQFAGSPTT

SEQ ID NO: 106192 - protein, 12 aa, Homo sapiens
  heavy chain complementarity determining region 3 for antibody 53096
AKEREATGYFDY

SEQ ID NO: 106193 - protein, 9 aa, Homo sapiens
  light chain complementarity determining region 3 for antibody 53097
QQCYSLPYT

SEQ ID NO: 106194 - protein, 14 aa, Homo sapiens
  heavy chain complementarity determining region 3 for antibody 53097
ARKMGWDGVAWFDP

SEQ ID NO: 106195 - protein, 9 aa, Homo sapiens
  light chain complementarity determining region 3 for antibody 53098
QQCYSFPYT

SEQ ID NO: 106196 - protein, 14 aa, Homo sapiens
  heavy chain complementarity determining region 3 for antibody 53098
SRKMGWDGVAWFDP

SEQ ID NO: 106197 - protein, 9 aa, Homo sapiens
  light chain complementarity determining region 3 for antibody 53099
QQCYSFPYT

SEQ ID NO: 106198 - protein, 8 aa, Homo sapiens
  heavy chain complementarity determining region 3 for antibody 53099
ATHPSTGA

SEQ ID NO: 106199 - protein, 9 aa, Homo sapiens
  light chain complementarity determining region 3 for antibody 53100
QQCYSFPYT

SEQ ID NO: 106200 - protein, 12 aa, Homo sapiens
  heavy chain complementarity determining region 3 for antibody 53100
ATALSLYSSSGV

SEQ ID NO: 106201 - protein, 9 aa, Homo sapiens
  light chain complementarity determining region 3 for antibody 53101
QQCYSFPYT

SEQ ID NO: 106202 - protein, 15 aa, Homo sapiens
  heavy chain complementarity determining region 3 for antibody 53101
ARTSGRYVRSNYFDP

SEQ ID NO: 106203 - protein, 9 aa, Homo sapiens
  light chain complementarity determining region 3 for antibody 53102
QQCYSFPYT

SEQ ID NO: 106204 - protein, 14 aa, Homo sapiens
  heavy chain complementarity determining region 3 for antibody 53102
ARRMGWDGVAWFDP

SEQ ID NO: 106205 - protein, 9 aa, Homo sapiens
  light chain complementarity determining region 3 for antibody 53103
QQCYSFPYT

SEQ ID NO: 106206 - protein, 19 aa, Homo sapiens
  heavy chain complementarity determining region 3 for antibody 53103
ARLATILRGNMRSIRRLDV

SEQ ID NO: 106207 - protein, 9 aa, Homo sapiens
  light chain complementarity determining region 3 for antibody 53104
QQCYSFPYT

SEQ ID NO: 106208 - protein, 14 aa, Homo sapiens
  heavy chain complementarity determining region 3 for antibody 53104
ARKMVWDGVAWFDP

SEQ ID NO: 106209 - protein, 9 aa, Homo sapiens
  light chain complementarity determining region 3 for antibody 53105
QQCYSFPYT

SEQ ID NO: 106210 - protein, 14 aa, Homo sapiens
  heavy chain complementarity determining region 3 for antibody 53105
ARKMGWDGVAWSDP

SEQ ID NO: 106211 - protein, 9 aa, Homo sapiens
  light chain complementarity determining region 3 for antibody 53106
QQCYSFPYT

SEQ ID NO: 106212 - protein, 14 aa, Homo sapiens
  heavy chain complementarity determining region 3 for antibody 53106
ARKMGWDGVAWFNP

SEQ ID NO: 106213 - protein, 9 aa, Homo sapiens
  light chain complementarity determining region 3 for antibody 53107
QQCYSFPYT

SEQ ID NO: 106214 - protein, 14 aa, Homo sapiens
  heavy chain complementarity determining region 3 for antibody 53107
ARKMGWDGGAWFDP

SEQ ID NO: 106215 - protein, 9 aa, Homo sapiens
  light chain complementarity determining region 3 for antibody 53108
QQCYSFPYT

SEQ ID NO: 106216 - protein, 14 aa, Homo sapiens
  heavy chain complementarity determining region 3 for antibody 53108
ARKMGCDGVAWFDP

SEQ ID NO: 106217 - protein, 9 aa, Homo sapiens
  light chain complementarity determining region 3 for antibody 53109
QQCYSFPYT

SEQ ID NO: 106218 - protein, 14 aa, Homo sapiens
  heavy chain complementarity determining region 3 for antibody 53109
ARKLGWDGVAWFDP

SEQ ID NO: 106219 - protein, 9 aa, Homo sapiens
  light chain complementarity determining region 3 for antibody 53110
QQCYSFPYT

SEQ ID NO: 106220 - protein, 16 aa, Homo sapiens
  heavy chain complementarity determining region 3 for antibody 53110
ARGYYYDSSADYSFDY

SEQ ID NO: 106221 - protein, 9 aa, Homo sapiens
  light chain complementarity determining region 3 for antibody 53111
QQCYSFPYT

SEQ ID NO: 106222 - protein, 20 aa, Homo sapiens
  heavy chain complementarity determining region 3 for antibody 53111
ARGWPVAAVAGRKRLGAMDV

SEQ ID NO: 106223 - protein, 9 aa, Homo sapiens
  light chain complementarity determining region 3 for antibody 53112
QQCYSFPYT

SEQ ID NO: 106224 - protein, 13 aa, Homo sapiens
  heavy chain complementarity determining region 3 for antibody 53112
ARGASSSWYWVDY

SEQ ID NO: 106225 - protein, 9 aa, Homo sapiens
  light chain complementarity determining region 3 for antibody 53113
QQCYSFPYT

SEQ ID NO: 106226 - protein, 16 aa, Homo sapiens
  heavy chain complementarity determining region 3 for antibody 53113
ARFSGYVNYLQFYMEV

SEQ ID NO: 106227 - protein, 9 aa, Homo sapiens
  light chain complementarity determining region 3 for antibody 53114
QQCYSFPYT

SEQ ID NO: 106228 - protein, 17 aa, Homo sapiens
  heavy chain complementarity determining region 3 for antibody 53114
ARERGYCSDEHCYGFAH

SEQ ID NO: 106229 - protein, 9 aa, Homo sapiens
  light chain complementarity determining region 3 for antibody 53115
QQCYSFPYT

SEQ ID NO: 106230 - protein, 12 aa, Homo sapiens
  heavy chain complementarity determining region 3 for antibody 53115
ARELRGSKPFDY

SEQ ID NO: 106231 - protein, 9 aa, Homo sapiens
  light chain complementarity determining region 3 for antibody 53116
QQCYSFPYT

SEQ ID NO: 106232 - protein, 13 aa, Homo sapiens
  heavy chain complementarity determining region 3 for antibody 53116
AREIRRGPIWLDT

SEQ ID NO: 106233 - protein, 9 aa, Homo sapiens
  light chain complementarity determining region 3 for antibody 53117
QQCYSFPYT

SEQ ID NO: 106234 - protein, 15 aa, Homo sapiens
  heavy chain complementarity determining region 3 for antibody 53117
AREGGYDSGYWYFDL

SEQ ID NO: 106235 - protein, 9 aa, Homo sapiens
  light chain complementarity determining region 3 for antibody 53118
QQCYSFPYT

SEQ ID NO: 106236 - protein, 14 aa, Homo sapiens
  heavy chain complementarity determining region 3 for antibody 53118
ARAGDPIKWYYFDH

SEQ ID NO: 106237 - protein, 9 aa, Homo sapiens
  light chain complementarity determining region 3 for antibody 53119
QQCYSFPYT

SEQ ID NO: 106238 - protein, 15 aa, Homo sapiens
  heavy chain complementarity determining region 3 for antibody 53119
AQTYSSSWYAHHFDY

SEQ ID NO: 106239 - protein, 9 aa, Homo sapiens
  light chain complementarity determining region 3 for antibody 53120
QQCYSFPHT

SEQ ID NO: 106240 - protein, 14 aa, Homo sapiens
  heavy chain complementarity determining region 3 for antibody 53120
ARKMGWDGVAWFDP

SEQ ID NO: 106241 - protein, 9 aa, Homo sapiens
  light chain complementarity determining region 3 for antibody 53121
QQCDDLPLT

SEQ ID NO: 106242 - protein, 16 aa, Homo sapiens
  heavy chain complementarity determining region 3 for antibody 53121
ASPHHLGSGSYGTFES

SEQ ID NO: 106243 - protein, 9 aa, Homo sapiens
  light chain complementarity determining region 3 for antibody 53122
QQCDDLPLT

SEQ ID NO: 106244 - protein, 16 aa, Homo sapiens
  heavy chain complementarity determining region 3 for antibody 53122
ASPHHLGSGSYGAFQS

SEQ ID NO: 106245 - protein, 9 aa, Homo sapiens
  light chain complementarity determining region 3 for antibody 53123
QQANTFPLT

SEQ ID NO: 106246 - protein, 15 aa, Homo sapiens
  heavy chain complementarity determining region 3 for antibody 53123
ARRGYYGPGKMAYDI

SEQ ID NO: 106247 - protein, 9 aa, Homo sapiens
  light chain complementarity determining region 3 for antibody 53124
QQANTFPLT

SEQ ID NO: 106248 - protein, 14 aa, Homo sapiens
  heavy chain complementarity determining region 3 for antibody 53124
ARKMGWDGVAWFDP

SEQ ID NO: 106249 - protein, 9 aa, Homo sapiens
  light chain complementarity determining region 3 for antibody 53125
QQANTFPLT

SEQ ID NO: 106250 - protein, 13 aa, Homo sapiens
  heavy chain complementarity determining region 3 for antibody 53125
ARDLSYGSGYPGY

SEQ ID NO: 106251 - protein, 9 aa, Homo sapiens
  light chain complementarity determining region 3 for antibody 53126
QQANSFSLT

SEQ ID NO: 106252 - protein, 12 aa, Homo sapiens
  heavy chain complementarity determining region 3 for antibody 53126
VREGPRTSHWKN

SEQ ID NO: 106253 - protein, 9 aa, Homo sapiens
  light chain complementarity determining region 3 for antibody 53127
QQANSFPLT

SEQ ID NO: 106254 - protein, 12 aa, Homo sapiens
  heavy chain complementarity determining region 3 for antibody 53127
VREGPRTSHWKN

SEQ ID NO: 106255 - protein, 9 aa, Homo sapiens
  light chain complementarity determining region 3 for antibody 53128
QQANSFPLT

SEQ ID NO: 106256 - protein, 13 aa, Homo sapiens
  heavy chain complementarity determining region 3 for antibody 53128
ASESFGGPRGFNY

SEQ ID NO: 106257 - protein, 9 aa, Homo sapiens
  light chain complementarity determining region 3 for antibody 53129
QQANSFPLT

SEQ ID NO: 106258 - protein, 11 aa, Homo sapiens
  heavy chain complementarity determining region 3 for antibody 53129
ARGAWPYFFDL

SEQ ID NO: 106259 - protein, 9 aa, Homo sapiens
  light chain complementarity determining region 3 for antibody 53130
QQANSFPFT

SEQ ID NO: 106260 - protein, 14 aa, Homo sapiens
  heavy chain complementarity determining region 3 for antibody 53130
ARKMGWDGVAWFDP

SEQ ID NO: 106261 - protein, 9 aa, Homo sapiens
  light chain complementarity determining region 3 for antibody 53131
QQALNYPWT

SEQ ID NO: 106262 - protein, 16 aa, Homo sapiens
  heavy chain complementarity determining region 3 for antibody 53131
ARGPVKAPYYYYYMDV

SEQ ID NO: 106263 - protein, 9 aa, Homo sapiens
  light chain complementarity determining region 3 for antibody 53132
QQALNYPWT

SEQ ID NO: 106264 - protein, 16 aa, Homo sapiens
  heavy chain complementarity determining region 3 for antibody 53132
ARGPVKAHYYYYYIDV

SEQ ID NO: 106265 - protein, 9 aa, Homo sapiens
  light chain complementarity determining region 3 for antibody 53133
QQALNYPWT

SEQ ID NO: 106266 - protein, 16 aa, Homo sapiens
  heavy chain complementarity determining region 3 for antibody 53133
ARGPVKAHYYYSYMDV

SEQ ID NO: 106267 - protein, 9 aa, Homo sapiens
  light chain complementarity determining region 3 for antibody 53134
QQALNYPWT

SEQ ID NO: 106268 - protein, 16 aa, Homo sapiens
  heavy chain complementarity determining region 3 for antibody 53134
ARGLVKAHYYYYYMDV

SEQ ID NO: 106269 - protein, 9 aa, Homo sapiens
  light chain complementarity determining region 3 for antibody 53135
QQALNYPWT

SEQ ID NO: 106270 - protein, 14 aa, Homo sapiens
  heavy chain complementarity determining region 3 for antibody 53135
ARGLGAKTGRYFDL

SEQ ID NO: 106271 - protein, 9 aa, Homo sapiens
  light chain complementarity determining region 3 for antibody 53136
QQALNYPWT

SEQ ID NO: 106272 - protein, 17 aa, Homo sapiens
  heavy chain complementarity determining region 3 for antibody 53136
AKGPAPYNWTYGLLFDQ

SEQ ID NO: 106273 - protein, 9 aa, Homo sapiens
  light chain complementarity determining region 3 for antibody 53137
QQALNYPWT

SEQ ID NO: 106274 - protein, 12 aa, Homo sapiens
  heavy chain complementarity determining region 3 for antibody 53137
AKEREATGYFDY

SEQ ID NO: 106275 - protein, 9 aa, Homo sapiens
  light chain complementarity determining region 3 for antibody 53138
QPYYSAPQT

SEQ ID NO: 106276 - protein, 10 aa, Homo sapiens
  heavy chain complementarity determining region 3 for antibody 53138
ARDHNGDFDY

SEQ ID NO: 106277 - protein, 8 aa, Homo sapiens
  light chain complementarity determining region 3 for antibody 53139
QPYCSSRT

SEQ ID NO: 106278 - protein, 7 aa, Homo sapiens
  heavy chain complementarity determining region 3 for antibody 53139
SPVSGRY

SEQ ID NO: 106279 - protein, 9 aa, Homo sapiens
  light chain complementarity determining region 3 for antibody 53140
QPSYSTLYT

SEQ ID NO: 106280 - protein, 12 aa, Homo sapiens
  heavy chain complementarity determining region 3 for antibody 53140
VREGPRTSHWKN

SEQ ID NO: 106281 - protein, 9 aa, Homo sapiens
  light chain complementarity determining region 3 for antibody 53141
QNYYSAPQT

SEQ ID NO: 106282 - protein, 12 aa, Homo sapiens
  heavy chain complementarity determining region 3 for antibody 53141
VREGPRTSHWKN

SEQ ID NO: 106283 - protein, 9 aa, Homo sapiens
  light chain complementarity determining region 3 for antibody 53142
QNLNSYPLT

SEQ ID NO: 106284 - protein, 14 aa, Homo sapiens
  heavy chain complementarity determining region 3 for antibody 53142
ARKMGWDGVAWFDP

SEQ ID NO: 106285 - protein, 8 aa, Homo sapiens
  light chain complementarity determining region 3 for antibody 53143
QLYSASRT

SEQ ID NO: 106286 - protein, 12 aa, Homo sapiens
  heavy chain complementarity determining region 3 for antibody 53143
VREGPRTSHWKN

SEQ ID NO: 106287 - protein, 9 aa, Homo sapiens
  light chain complementarity determining region 3 for antibody 53144
QKYNSVPLT

SEQ ID NO: 106288 - protein, 12 aa, Homo sapiens
  heavy chain complementarity determining region 3 for antibody 53144
VREGPRTSHWKN

SEQ ID NO: 106289 - protein, 9 aa, Homo sapiens
  light chain complementarity determining region 3 for antibody 53145
QKYNSAPPT

SEQ ID NO: 106290 - protein, 15 aa, Homo sapiens
  heavy chain complementarity determining region 3 for antibody 53145
ARGGGPYDDSSGYQQ

SEQ ID NO: 106291 - protein, 9 aa, Homo sapiens
  light chain complementarity determining region 3 for antibody 53146
QKNNSAPPT

SEQ ID NO: 106292 - protein, 15 aa, Homo sapiens
  heavy chain complementarity determining region 3 for antibody 53146
ARGGGPYYDSSGYQQ

SEQ ID NO: 106293 - protein, 9 aa, Homo sapiens
  light chain complementarity determining region 3 for antibody 53147
QHYSRYPYT

SEQ ID NO: 106294 - protein, 15 aa, Homo sapiens
  heavy chain complementarity determining region 3 for antibody 53147
ASGEGDGTGWPFFDF

SEQ ID NO: 106295 - protein, 10 aa, Homo sapiens
  light chain complementarity determining region 3 for antibody 53148
QHYNSSSQCT

SEQ ID NO: 106296 - protein, 22 aa, Homo sapiens
  heavy chain complementarity determining region 3 for antibody 53148
ARWYAYGSGTYYDPSYCYGMDV

SEQ ID NO: 106297 - protein, 10 aa, Homo sapiens
  light chain complementarity determining region 3 for antibody 53149
QHYNSSSQCT

SEQ ID NO: 106298 - protein, 22 aa, Homo sapiens
  heavy chain complementarity determining region 3 for antibody 53149
ARWYAYGSGAYYDPSYYYGMDV

SEQ ID NO: 106299 - protein, 9 aa, Homo sapiens
  light chain complementarity determining region 3 for antibody 53150
QHYGSSPLT

SEQ ID NO: 106300 - protein, 19 aa, Homo sapiens
  heavy chain complementarity determining region 3 for antibody 53150
ARILGSSSPAPYFYYGMDV

SEQ ID NO: 106301 - protein, 9 aa, Homo sapiens
  light chain complementarity determining region 3 for antibody 53151
QHYDEYSAT

SEQ ID NO: 106302 - protein, 17 aa, Homo sapiens
  heavy chain complementarity determining region 3 for antibody 53151
ARDRGGPNYFYYFYMEV

SEQ ID NO: 106303 - protein, 9 aa, Homo sapiens
  light chain complementarity determining region 3 for antibody 53152
QHYDEYSAT

SEQ ID NO: 106304 - protein, 17 aa, Homo sapiens
  heavy chain complementarity determining region 3 for antibody 53152
ARDRGAPNYFYYFYMEV

SEQ ID NO: 106305 - protein, 9 aa, Homo sapiens
  light chain complementarity determining region 3 for antibody 53153
QHRVNWPLT

SEQ ID NO: 106306 - protein, 13 aa, Homo sapiens
  heavy chain complementarity determining region 3 for antibody 53153
ASMIRGVLGGLDV

SEQ ID NO: 106307 - protein, 9 aa, Homo sapiens
  light chain complementarity determining region 3 for antibody 53154
QHLNSYPFT

SEQ ID NO: 106308 - protein, 17 aa, Homo sapiens
  heavy chain complementarity determining region 3 for antibody 53154
ARDGYDGYAYASSVFDL

SEQ ID NO: 106309 - protein, 9 aa, Homo sapiens
  light chain complementarity determining region 3 for antibody 53155
QHCYSFPYT

SEQ ID NO: 106310 - protein, 14 aa, Homo sapiens
  heavy chain complementarity determining region 3 for antibody 53155
ARKMGWDGVAWFDP

SEQ ID NO: 106311 - protein, 9 aa, Homo sapiens
  light chain complementarity determining region 3 for antibody 53156
QEYASASHS

SEQ ID NO: 106312 - protein, 17 aa, Homo sapiens
  heavy chain complementarity determining region 3 for antibody 53156
ARMGYYESSGFYGYFNL

SEQ ID NO: 106313 - protein, 9 aa, Homo sapiens
  light chain complementarity determining region 3 for antibody 53157
MQVLHTPLT

SEQ ID NO: 106314 - protein, 14 aa, Homo sapiens
  heavy chain complementarity determining region 3 for antibody 53157
ARGGTPAAAGPFDN

SEQ ID NO: 106315 - protein, 9 aa, Homo sapiens
  light chain complementarity determining region 3 for antibody 53158
MQSLQTRLS

SEQ ID NO: 106316 - protein, 17 aa, Homo sapiens
  heavy chain complementarity determining region 3 for antibody 53158
ARALGRGQNSNHFWFDP

SEQ ID NO: 106317 - protein, 9 aa, Homo sapiens
  light chain complementarity determining region 3 for antibody 53159
MQARQPPRT

SEQ ID NO: 106318 - protein, 14 aa, Homo sapiens
  heavy chain complementarity determining region 3 for antibody 53159
ARKMGWDGVAWFDP

SEQ ID NO: 106319 - protein, 9 aa, Homo sapiens
  light chain complementarity determining region 3 for antibody 53160
MQARHPPRT

SEQ ID NO: 106320 - protein, 13 aa, Homo sapiens
  heavy chain complementarity determining region 3 for antibody 53160
ARAGGGYYNPFDY

SEQ ID NO: 106321 - protein, 9 aa, Homo sapiens
  light chain complementarity determining region 3 for antibody 53161
LQYNMYPRT

SEQ ID NO: 106322 - protein, 14 aa, Homo sapiens
  heavy chain complementarity determining region 3 for antibody 53161
ARKMGWDGVAWFDP

SEQ ID NO: 106323 - protein, 9 aa, Homo sapiens
  light chain complementarity determining region 3 for antibody 53162
LQHNSYPWT

SEQ ID NO: 106324 - protein, 7 aa, Homo sapiens
  heavy chain complementarity determining region 3 for antibody 53162
SPVSGRY

SEQ ID NO: 106325 - protein, 9 aa, Homo sapiens
  light chain complementarity determining region 3 for antibody 53163
LQHNSYPWT

SEQ ID NO: 106326 - protein, 14 aa, Homo sapiens
  heavy chain complementarity determining region 3 for antibody 53163
ARKMGWDGVAWFDP

SEQ ID NO: 106327 - protein, 9 aa, Homo sapiens
  light chain complementarity determining region 3 for antibody 53164
LQHHDFPRT

SEQ ID NO: 106328 - protein, 15 aa, Homo sapiens
  heavy chain complementarity determining region 3 for antibody 53164
ARDGLGGGCHGGFDH

SEQ ID NO: 106329 - protein, 9 aa, Homo sapiens
  light chain complementarity determining region 3 for antibody 53165
LQHDRFPLT

SEQ ID NO: 106330 - protein, 23 aa, Homo sapiens
  heavy chain complementarity determining region 3 for antibody 53165
ARGYCSGDRCHDITYYSYYGVDV

SEQ ID NO: 106331 - protein, 9 aa, Homo sapiens
  light chain complementarity determining region 3 for antibody 53166
LQHDNLPYT

SEQ ID NO: 106332 - protein, 12 aa, Homo sapiens
  heavy chain complementarity determining region 3 for antibody 53166
VREGPRTSHWKN

SEQ ID NO: 106333 - protein, 9 aa, Homo sapiens
  light chain complementarity determining region 3 for antibody 53167
LQDYNYPYT

SEQ ID NO: 106334 - protein, 14 aa, Homo sapiens
  heavy chain complementarity determining region 3 for antibody 53167
ARKMGWDGVAWFDP

SEQ ID NO: 106335 - protein, 9 aa, Homo sapiens
  light chain complementarity determining region 3 for antibody 53168
LQDYNYPWT

SEQ ID NO: 106336 - protein, 7 aa, Homo sapiens
  heavy chain complementarity determining region 3 for antibody 53168
SPVSGRY

SEQ ID NO: 106337 - protein, 9 aa, Homo sapiens
  light chain complementarity determining region 3 for antibody 53169
LQDYNYPWT

SEQ ID NO: 106338 - protein, 13 aa, Homo sapiens
  heavy chain complementarity determining region 3 for antibody 53169
ARDVSYGSGYPGY

SEQ ID NO: 106339 - protein, 9 aa, Homo sapiens
  light chain complementarity determining region 3 for antibody 53170
LQDYNYPWT

SEQ ID NO: 106340 - protein, 17 aa, Homo sapiens
  heavy chain complementarity determining region 3 for antibody 53170
AKGPAPYNWTYGLLFDQ

SEQ ID NO: 106341 - protein, 9 aa, Homo sapiens
  light chain complementarity determining region 3 for antibody 53171
LQDYNYPWT

SEQ ID NO: 106342 - protein, 14 aa, Homo sapiens
  heavy chain complementarity determining region 3 for antibody 53171
AGRPSNSGSPLVDY

SEQ ID NO: 106343 - protein, 9 aa, Homo sapiens
  light chain complementarity determining region 3 for antibody 53172
LQDYNYPLT

SEQ ID NO: 106344 - protein, 17 aa, Homo sapiens
  heavy chain complementarity determining region 3 for antibody 53172
ARGTLWFGELSDDAFDI

SEQ ID NO: 106345 - protein, 9 aa, Homo sapiens
  light chain complementarity determining region 3 for antibody 53173
LQDYNYPLT

SEQ ID NO: 106346 - protein, 13 aa, Homo sapiens
  heavy chain complementarity determining region 3 for antibody 53173
ARDLSYGSGYPGY

SEQ ID NO: 106347 - protein, 9 aa, Homo sapiens
  light chain complementarity determining region 3 for antibody 53174
LQDSNFPLT

SEQ ID NO: 106348 - protein, 14 aa, Homo sapiens
  heavy chain complementarity determining region 3 for antibody 53174
AGRPSNSGGPLVDY

SEQ ID NO: 106349 - protein, 9 aa, Homo sapiens
  light chain complementarity determining region 3 for antibody 53175
LQDSNFPLT

SEQ ID NO: 106350 - protein, 14 aa, Homo sapiens
  heavy chain complementarity determining region 3 for antibody 53175
AGRPSNSGCPLVDY

SEQ ID NO: 106351 - protein, 8 aa, Homo sapiens
  light chain complementarity determining region 3 for antibody 53176
HQYYFRPH

SEQ ID NO: 106352 - protein, 17 aa, Homo sapiens
  heavy chain complementarity determining region 3 for antibody 53176
AHSPAFLWTRRGDYFDS

SEQ ID NO: 106353 - protein, 9 aa, Homo sapiens
  light chain complementarity determining region 3 for antibody 53177
HQYNTLQWT

SEQ ID NO: 106354 - protein, 14 aa, Homo sapiens
  heavy chain complementarity determining region 3 for antibody 53177
ARKMGWDGVAWFDP

SEQ ID NO: 106355 - protein, 10 aa, Homo sapiens
  light chain complementarity determining region 3 for antibody 53178
HQYEHLPPYT

SEQ ID NO: 106356 - protein, 12 aa, Homo sapiens
  heavy chain complementarity determining region 3 for antibody 53178
STRRRGGHQFEY

SEQ ID NO: 106357 - protein, 10 aa, Homo sapiens
  light chain complementarity determining region 3 for antibody 53179
HQYEHLPPYT

SEQ ID NO: 106358 - protein, 12 aa, Homo sapiens
  heavy chain complementarity determining region 3 for antibody 53179
STHRRVGHQFEY

SEQ ID NO: 106359 - protein, 10 aa, Homo sapiens
  light chain complementarity determining region 3 for antibody 53180
HQYEHLPPYT

SEQ ID NO: 106360 - protein, 12 aa, Homo sapiens
  heavy chain complementarity determining region 3 for antibody 53180
STHRRGGQQFEY

SEQ ID NO: 106361 - protein, 10 aa, Homo sapiens
  light chain complementarity determining region 3 for antibody 53181
HQYEHLPPYT

SEQ ID NO: 106362 - protein, 7 aa, Homo sapiens
  heavy chain complementarity determining region 3 for antibody 53181
SPVSGRY

SEQ ID NO: 106363 - protein, 10 aa, Homo sapiens
  light chain complementarity determining region 3 for antibody 53182
HQYEHLPPYT

SEQ ID NO: 106364 - protein, 15 aa, Homo sapiens
  heavy chain complementarity determining region 3 for antibody 53182
ATYMSGLYYYYAMDV

SEQ ID NO: 106365 - protein, 10 aa, Homo sapiens
  light chain complementarity determining region 3 for antibody 53183
HQYEHLPPYT

SEQ ID NO: 106366 - protein, 12 aa, Homo sapiens
  heavy chain complementarity determining region 3 for antibody 53183
ALSITMVVEPDF

SEQ ID NO: 106367 - protein, 10 aa, Homo sapiens
  light chain complementarity determining region 3 for antibody 53184
HQYEHLPPST

SEQ ID NO: 106368 - protein, 12 aa, Homo sapiens
  heavy chain complementarity determining region 3 for antibody 53184
STHRRGGHQFEY

SEQ ID NO: 106369 - protein, 9 aa, Homo sapiens
  light chain complementarity determining region 3 for antibody 53185
HQTDSFPWT

SEQ ID NO: 106370 - protein, 12 aa, Homo sapiens
  heavy chain complementarity determining region 3 for antibody 53185
AKEREATGYFDY

SEQ ID NO: 106371 - protein, 9 aa, Homo sapiens
  light chain complementarity determining region 3 for antibody 53186
HQSYSTLYT

SEQ ID NO: 106372 - protein, 12 aa, Homo sapiens
  heavy chain complementarity determining region 3 for antibody 53186
VREGPRTSHWKN

SEQ ID NO: 106373 - protein, 9 aa, Homo sapiens
  light chain complementarity determining region 3 for antibody 53187
HQSSSLPRT

SEQ ID NO: 106374 - protein, 16 aa, Homo sapiens
  heavy chain complementarity determining region 3 for antibody 53187
GRSVFGVVDRRRVFDY

SEQ ID NO: 106375 - protein, 9 aa, Homo sapiens
  light chain complementarity determining region 3 for antibody 53188
HQCYSFPYT

SEQ ID NO: 106376 - protein, 14 aa, Homo sapiens
  heavy chain complementarity determining region 3 for antibody 53188
ARKMGWDGVAWFDP

SEQ ID NO: 106377 - protein, 10 aa, Homo sapiens
  light chain complementarity determining region 3 for antibody 53189
HHSGSSWGYT

SEQ ID NO: 106378 - protein, 14 aa, Homo sapiens
  heavy chain complementarity determining region 3 for antibody 53189
TTEGLLNYFSAFDN

SEQ ID NO: 106379 - protein, 9 aa, Homo sapiens
  light chain complementarity determining region 3 for antibody 53190
FQHNAYPRA

SEQ ID NO: 106380 - protein, 18 aa, Homo sapiens
  heavy chain complementarity determining region 3 for antibody 53190
TNTGHSGWNGVPYGPIAY

SEQ ID NO: 106381 - protein, 9 aa, Homo sapiens
  light chain complementarity determining region 3 for antibody 53191
QQYNSYPYT

SEQ ID NO: 106382 - protein, 17 aa, Homo sapiens
  heavy chain complementarity determining region 3 for antibody 53191
ARLVLRYSDWLLPHFDY

SEQ ID NO: 106383 - protein, 9 aa, Homo sapiens
  light chain complementarity determining region 3 for antibody 53192
QKYNSAPLT

SEQ ID NO: 106384 - protein, 8 aa, Homo sapiens
  heavy chain complementarity determining region 3 for antibody 53192
ARTGPLDY

SEQ ID NO: 106385 - protein, 9 aa, Homo sapiens
  light chain complementarity determining region 3 for antibody 53193
QQYISYPFT

SEQ ID NO: 106386 - protein, 13 aa, Homo sapiens
  heavy chain complementarity determining region 3 for antibody 53193
AADYGDYQYYFDY

SEQ ID NO: 106387 - protein, 9 aa, Homo sapiens
  light chain complementarity determining region 3 for antibody 53194
QQYNSFPFT

SEQ ID NO: 106388 - protein, 17 aa, Homo sapiens
  heavy chain complementarity determining region 3 for antibody 53194
AREYNDILTGYWGYFDY

SEQ ID NO: 106389 - protein, 9 aa, Homo sapiens
  light chain complementarity determining region 3 for antibody 53195
LQHNSYPYT

SEQ ID NO: 106390 - protein, 8 aa, Homo sapiens
  heavy chain complementarity determining region 3 for antibody 53195
ARDDGMDV

SEQ ID NO: 106391 - protein, 9 aa, Homo sapiens
  light chain complementarity determining region 3 for antibody 53196
LQHNSYPLT

SEQ ID NO: 106392 - protein, 22 aa, Homo sapiens
  heavy chain complementarity determining region 3 for antibody 53196
ARGDYDILTGYRGYYSYYGMDV

SEQ ID NO: 106393 - protein, 9 aa, Homo sapiens
  light chain complementarity determining region 3 for antibody 53197
QQLNSYPYT

SEQ ID NO: 106394 - protein, 9 aa, Homo sapiens
  heavy chain complementarity determining region 3 for antibody 53197
ARKRWYFDL

SEQ ID NO: 106395 - protein, 9 aa, Homo sapiens
  light chain complementarity determining region 3 for antibody 53198
LQHDNFPYT

SEQ ID NO: 106396 - protein, 13 aa, Homo sapiens
  heavy chain complementarity determining region 3 for antibody 53198
ARERYFASYGMDV

SEQ ID NO: 106397 - protein, 9 aa, Homo sapiens
  light chain complementarity determining region 3 for antibody 53199
QQFNNYPFT

SEQ ID NO: 106398 - protein, 16 aa, Homo sapiens
  heavy chain complementarity determining region 3 for antibody 53199
ARGRGYYGSGSPYFDY

SEQ ID NO: 106399 - protein, 9 aa, Homo sapiens
  light chain complementarity determining region 3 for antibody 53200
HQSSSLPFT

SEQ ID NO: 106400 - protein, 11 aa, Homo sapiens
  heavy chain complementarity determining region 3 for antibody 53200
ARLLWFGGFDY

SEQ ID NO: 106401 - protein, 9 aa, Homo sapiens
  light chain complementarity determining region 3 for antibody 53201
QQDYNLPLT

SEQ ID NO: 106402 - protein, 11 aa, Homo sapiens
  heavy chain complementarity determining region 3 for antibody 53201
AGNIAAAGTHR

SEQ ID NO: 106403 - protein, 9 aa, Homo sapiens
  light chain complementarity determining region 3 for antibody 53202
LQHNSYPHT

SEQ ID NO: 106404 - protein, 19 aa, Homo sapiens
  heavy chain complementarity determining region 3 for antibody 53202
ARDHDILTGYYRDYYGMDV

SEQ ID NO: 106405 - protein, 9 aa, Homo sapiens
  light chain complementarity determining region 3 for antibody 53203
QQYNNWPRT

SEQ ID NO: 106406 - protein, 12 aa, Homo sapiens
  heavy chain complementarity determining region 3 for antibody 53203
AREWEPGTTRDY

SEQ ID NO: 106407 - protein, 9 aa, Homo sapiens
  light chain complementarity determining region 3 for antibody 53204
QQLNSYPPT

SEQ ID NO: 106408 - protein, 13 aa, Homo sapiens
  heavy chain complementarity determining region 3 for antibody 53204
AADYGDYQYYFDY

SEQ ID NO: 106409 - protein, 9 aa, Homo sapiens
  light chain complementarity determining region 3 for antibody 53205
LQHDNFPYT

SEQ ID NO: 106410 - protein, 7 aa, Homo sapiens
  heavy chain complementarity determining region 3 for antibody 53205
ARDVGDY

SEQ ID NO: 106411 - protein, 9 aa, Homo sapiens
  light chain complementarity determining region 3 for antibody 53206
LQHNSYPWT

SEQ ID NO: 106412 - protein, 6 aa, Homo sapiens
  heavy chain complementarity determining region 3 for antibody 53206
ARDPDY

SEQ ID NO: 106413 - protein, 9 aa, Homo sapiens
  light chain complementarity determining region 3 for antibody 53207
LQDYNYPFT

SEQ ID NO: 106414 - protein, 15 aa, Homo sapiens
  heavy chain complementarity determining region 3 for antibody 53207
AREGDYYGSGSHLNY

SEQ ID NO: 106415 - protein, 9 aa, Homo sapiens
  light chain complementarity determining region 3 for antibody 53208
QQCNSYPYT

SEQ ID NO: 106416 - protein, 18 aa, Homo sapiens
  heavy chain complementarity determining region 3 for antibody 53208
ARERRDDILTGYFDAFDI

SEQ ID NO: 106417 - protein, 9 aa, Homo sapiens
  light chain complementarity determining region 3 for antibody 53209
LQHNSYPYT

SEQ ID NO: 106418 - protein, 17 aa, Homo sapiens
  heavy chain complementarity determining region 3 for antibody 53209
AKDQWELLLAYYYGMDV

SEQ ID NO: 106419 - protein, 9 aa, Homo sapiens
  light chain complementarity determining region 3 for antibody 53210
QQLNSYPYT

SEQ ID NO: 106420 - protein, 9 aa, Homo sapiens
  heavy chain complementarity determining region 3 for antibody 53210
ARKQRYFDY

SEQ ID NO: 106421 - protein, 9 aa, Homo sapiens
  light chain complementarity determining region 3 for antibody 53211
LQDYNYPRT

SEQ ID NO: 106422 - protein, 12 aa, Homo sapiens
  heavy chain complementarity determining region 3 for antibody 53211
AREIAVTGPFDY

SEQ ID NO: 106423 - protein, 9 aa, Homo sapiens
  light chain complementarity determining region 3 for antibody 53212
QKYDSAPLT

SEQ ID NO: 106424 - protein, 8 aa, Homo sapiens
  heavy chain complementarity determining region 3 for antibody 53212
ARTGPLDY

SEQ ID NO: 106425 - protein, 9 aa, Homo sapiens
  light chain complementarity determining region 3 for antibody 53213
LQHNSYPFT

SEQ ID NO: 106426 - protein, 15 aa, Homo sapiens
  heavy chain complementarity determining region 3 for antibody 53213
ARDGPTGAFYWYFDL

SEQ ID NO: 106427 - protein, 9 aa, Homo sapiens
  light chain complementarity determining region 3 for antibody 53214
LQDYNYPWT

SEQ ID NO: 106428 - protein, 15 aa, Homo sapiens
  heavy chain complementarity determining region 3 for antibody 53214
ARSRVGPYYYYGMDV

SEQ ID NO: 106429 - protein, 9 aa, Homo sapiens
  light chain complementarity determining region 3 for antibody 53215
LQHDNFPYT

SEQ ID NO: 106430 - protein, 7 aa, Homo sapiens
  heavy chain complementarity determining region 3 for antibody 53215
ARDSGDY

SEQ ID NO: 106431 - protein, 9 aa, Homo sapiens
  light chain complementarity determining region 3 for antibody 53216
QQYNSYPYT

SEQ ID NO: 106432 - protein, 17 aa, Homo sapiens
  heavy chain complementarity determining region 3 for antibody 53216
ARLVLRYSDWLFPHFDY

SEQ ID NO: 106433 - protein, 9 aa, Homo sapiens
  light chain complementarity determining region 3 for antibody 53217
QQLNSYPRT

SEQ ID NO: 106434 - protein, 15 aa, Homo sapiens
  heavy chain complementarity determining region 3 for antibody 53217
ARERRQLTGGYYFDY

SEQ ID NO: 106435 - protein, 9 aa, Homo sapiens
  light chain complementarity determining region 3 for antibody 53218
LQDYNYPWT

SEQ ID NO: 106436 - protein, 14 aa, Homo sapiens
  heavy chain complementarity determining region 3 for antibody 53218
ARAGTTGTSYGMDV

SEQ ID NO: 106437 - protein, 9 aa, Homo sapiens
  light chain complementarity determining region 3 for antibody 53219
QQRSNWMYT

SEQ ID NO: 106438 - protein, 10 aa, Homo sapiens
  heavy chain complementarity determining region 3 for antibody 53219
AKERWELLDY

SEQ ID NO: 106439 - protein, 9 aa, Homo sapiens
  light chain complementarity determining region 3 for antibody 53220
QQYDNLPIT

SEQ ID NO: 106440 - protein, 15 aa, Homo sapiens
  heavy chain complementarity determining region 3 for antibody 53220
ARATMVRGVIGAFDI

SEQ ID NO: 106441 - protein, 9 aa, Homo sapiens
  light chain complementarity determining region 3 for antibody 53221
QQLNSYPPT

SEQ ID NO: 106442 - protein, 13 aa, Homo sapiens
  heavy chain complementarity determining region 3 for antibody 53221
ARDQGSGRDYFDY

SEQ ID NO: 106443 - protein, 9 aa, Homo sapiens
  light chain complementarity determining region 3 for antibody 53222
LQHNSYPYT

SEQ ID NO: 106444 - protein, 17 aa, Homo sapiens
  heavy chain complementarity determining region 3 for antibody 53222
AREREEDLYYYYYGMDV

SEQ ID NO: 106445 - protein, 9 aa, Homo sapiens
  light chain complementarity determining region 3 for antibody 53223
QQSYSTPYT

SEQ ID NO: 106446 - protein, 16 aa, Homo sapiens
  heavy chain complementarity determining region 3 for antibody 53223
ATRSYYDILTGYYFDY

SEQ ID NO: 106447 - protein, 9 aa, Homo sapiens
  light chain complementarity determining region 3 for antibody 53224
HQSSSLPYT

SEQ ID NO: 106448 - protein, 17 aa, Homo sapiens
  heavy chain complementarity determining region 3 for antibody 53224
AKEDDYVWGSYRTVFDY

SEQ ID NO: 106449 - protein, 9 aa, Homo sapiens
  light chain complementarity determining region 3 for antibody 53225
QQLNNYPYT

SEQ ID NO: 106450 - protein, 9 aa, Homo sapiens
  heavy chain complementarity determining region 3 for antibody 53225
ARKRWYLDL

SEQ ID NO: 106451 - protein, 9 aa, Homo sapiens
  light chain complementarity determining region 3 for antibody 53226
HQSSSLPRT

SEQ ID NO: 106452 - protein, 9 aa, Homo sapiens
  heavy chain complementarity determining region 3 for antibody 53226
ARKRWYFDL

SEQ ID NO: 106453 - protein, 8 aa, Homo sapiens
  light chain complementarity determining region 3 for antibody 53227
QQYGSSFT

SEQ ID NO: 106454 - protein, 11 aa, Homo sapiens
  heavy chain complementarity determining region 3 for antibody 53227
ARDRILKGMDV

SEQ ID NO: 106455 - protein, 9 aa, Homo sapiens
  light chain complementarity determining region 3 for antibody 53228
QQYNNWLYT

SEQ ID NO: 106456 - protein, 12 aa, Homo sapiens
  heavy chain complementarity determining region 3 for antibody 53228
ARQSGSYFYFDY

SEQ ID NO: 106457 - protein, 9 aa, Homo sapiens
  light chain complementarity determining region 3 for antibody 53229
LQHNSYPFT

SEQ ID NO: 106458 - protein, 14 aa, Homo sapiens
  heavy chain complementarity determining region 3 for antibody 53229
ARDRDSSGYYLFDY

SEQ ID NO: 106459 - protein, 9 aa, Homo sapiens
  light chain complementarity determining region 3 for antibody 53230
QQCNSYPYT

SEQ ID NO: 106460 - protein, 18 aa, Homo sapiens
  heavy chain complementarity determining region 3 for antibody 53230
ARERRDDILTGYFDAFDF

SEQ ID NO: 106461 - protein, 9 aa, Homo sapiens
  light chain complementarity determining region 3 for antibody 53231
QKYNSAPLT

SEQ ID NO: 106462 - protein, 8 aa, Homo sapiens
  heavy chain complementarity determining region 3 for antibody 53231
ARTGPLDC

SEQ ID NO: 106463 - protein, 9 aa, Homo sapiens
  light chain complementarity determining region 3 for antibody 53232
QQYNSYPLT

SEQ ID NO: 106464 - protein, 17 aa, Homo sapiens
  heavy chain complementarity determining region 3 for antibody 53232
AREGVVTMVRGVGWFDP

SEQ ID NO: 106465 - protein, 9 aa, Homo sapiens
  light chain complementarity determining region 3 for antibody 53233
QQYNSYSYT

SEQ ID NO: 106466 - protein, 14 aa, Homo sapiens
  heavy chain complementarity determining region 3 for antibody 53233
ARHKERSRAFYFDY

SEQ ID NO: 106467 - protein, 9 aa, Homo sapiens
  light chain complementarity determining region 3 for antibody 53234
QQYNSYPYT

SEQ ID NO: 106468 - protein, 17 aa, Homo sapiens
  heavy chain complementarity determining region 3 for antibody 53234
ARLVLRYIDWLLPHFDY

SEQ ID NO: 106469 - protein, 9 aa, Homo sapiens
  light chain complementarity determining region 3 for antibody 53235
QHFNNYPYT

SEQ ID NO: 106470 - protein, 12 aa, Homo sapiens
  heavy chain complementarity determining region 3 for antibody 53235
ARDGGWNYNMDV

SEQ ID NO: 106471 - protein, 9 aa, Homo sapiens
  light chain complementarity determining region 3 for antibody 53236
HQSSSLPYT

SEQ ID NO: 106472 - protein, 9 aa, Homo sapiens
  heavy chain complementarity determining region 3 for antibody 53236
ARKRWYFDL

SEQ ID NO: 106473 - protein, 9 aa, Homo sapiens
  light chain complementarity determining region 3 for antibody 53237
QQYNSYPRT

SEQ ID NO: 106474 - protein, 15 aa, Homo sapiens
  heavy chain complementarity determining region 3 for antibody 53237
AKEDGLWFGGSYFDY

SEQ ID NO: 106475 - protein, 9 aa, Homo sapiens
  light chain complementarity determining region 3 for antibody 53238
LQHNSYPLT

SEQ ID NO: 106476 - protein, 17 aa, Homo sapiens
  heavy chain complementarity determining region 3 for antibody 53238
AREGDYFGSGSYPHFDY

SEQ ID NO: 106477 - protein, 9 aa, Homo sapiens
  light chain complementarity determining region 3 for antibody 53239
LQDYNYPWT

SEQ ID NO: 106478 - protein, 13 aa, Homo sapiens
  heavy chain complementarity determining region 3 for antibody 53239
AREEVTEGLYFDY

SEQ ID NO: 106479 - protein, 9 aa, Homo sapiens
  light chain complementarity determining region 3 for antibody 53240
LQHNSYPYT

SEQ ID NO: 106480 - protein, 14 aa, Homo sapiens
  heavy chain complementarity determining region 3 for antibody 53240
ARDGDYYYYYGMDV

SEQ ID NO: 106481 - protein, 9 aa, Homo sapiens
  light chain complementarity determining region 3 for antibody 53241
QQYNSYPYT

SEQ ID NO: 106482 - protein, 16 aa, Homo sapiens
  heavy chain complementarity determining region 3 for antibody 53241
ARERDNWNPYYYGMDV

SEQ ID NO: 106483 - protein, 9 aa, Homo sapiens
  light chain complementarity determining region 3 for antibody 53242
QQLNSYPYT

SEQ ID NO: 106484 - protein, 9 aa, Homo sapiens
  heavy chain complementarity determining region 3 for antibody 53242
ARKRWYFDV

SEQ ID NO: 106485 - protein, 9 aa, Homo sapiens
  light chain complementarity determining region 3 for antibody 53243
QQLNSYPYT

SEQ ID NO: 106486 - protein, 13 aa, Homo sapiens
  heavy chain complementarity determining region 3 for antibody 53243
AADYGDYQYYFDY

SEQ ID NO: 106487 - protein, 9 aa, Homo sapiens
  light chain complementarity determining region 3 for antibody 53244
QQYNIYPYT

SEQ ID NO: 106488 - protein, 18 aa, Homo sapiens
  heavy chain complementarity determining region 3 for antibody 53244
ARERRDDILTGYYDAFDI

SEQ ID NO: 106489 - protein, 9 aa, Homo sapiens
  light chain complementarity determining region 3 for antibody 53245
LQHDNFPYT

SEQ ID NO: 106490 - protein, 11 aa, Homo sapiens
  heavy chain complementarity determining region 3 for antibody 53245
ARGELGIGFDY

SEQ ID NO: 106491 - protein, 9 aa, Homo sapiens
  light chain complementarity determining region 3 for antibody 53246
LQHNSYPLT

SEQ ID NO: 106492 - protein, 10 aa, Homo sapiens
  heavy chain complementarity determining region 3 for antibody 53246
ARTGEEGFDY

SEQ ID NO: 106493 - protein, 9 aa, Homo sapiens
  light chain complementarity determining region 3 for antibody 53247
LQDYNYPWT

SEQ ID NO: 106494 - protein, 13 aa, Homo sapiens
  heavy chain complementarity determining region 3 for antibody 53247
ARAGYSGSYLFDY

SEQ ID NO: 106495 - protein, 9 aa, Homo sapiens
  light chain complementarity determining region 3 for antibody 53248
LQDYNYPWT

SEQ ID NO: 106496 - protein, 12 aa, Homo sapiens
  heavy chain complementarity determining region 3 for antibody 53248
AREKWELRGMDV

SEQ ID NO: 106497 - protein, 9 aa, Homo sapiens
  light chain complementarity determining region 3 for antibody 53249
LQDYNYPFT

SEQ ID NO: 106498 - protein, 14 aa, Homo sapiens
  heavy chain complementarity determining region 3 for antibody 53249
ARDNGYTSGWHFDY

SEQ ID NO: 106499 - protein, 9 aa, Homo sapiens
  light chain complementarity determining region 3 for antibody 53250
QQYNTYPRT

SEQ ID NO: 106500 - protein, 10 aa, Homo sapiens
  heavy chain complementarity determining region 3 for antibody 53250
ARDKGFYFDY

SEQ ID NO: 106501 - protein, 8 aa, Homo sapiens
  light chain complementarity determining region 3 for antibody 53251
QQFNDYYT

SEQ ID NO: 106502 - protein, 10 aa, Homo sapiens
  heavy chain complementarity determining region 3 for antibody 53251
ARGVRGVFDY

SEQ ID NO: 106503 - protein, 9 aa, Homo sapiens
  light chain complementarity determining region 3 for antibody 53252
QQYNSYPYT

SEQ ID NO: 106504 - protein, 17 aa, Homo sapiens
  heavy chain complementarity determining region 3 for antibody 53252
ARLVLRYLDWLLPHFDN

SEQ ID NO: 106505 - protein, 9 aa, Homo sapiens
  light chain complementarity determining region 3 for antibody 53253
HQSSSLPHT

SEQ ID NO: 106506 - protein, 17 aa, Homo sapiens
  heavy chain complementarity determining region 3 for antibody 53253
ARDRGYSGYDGDYGMDV

SEQ ID NO: 106507 - protein, 9 aa, Homo sapiens
  light chain complementarity determining region 3 for antibody 53254
QQSYSTPWT

SEQ ID NO: 106508 - protein, 17 aa, Homo sapiens
  heavy chain complementarity determining region 3 for antibody 53254
ARGTYYYGSGSYFYFDY

SEQ ID NO: 106509 - protein, 10 aa, Homo sapiens
  light chain complementarity determining region 3 for antibody 53255
MQTLQTPPYT

SEQ ID NO: 106510 - protein, 17 aa, Homo sapiens
  heavy chain complementarity determining region 3 for antibody 53255
AKGDSSSWYNYYYGMDV

SEQ ID NO: 106511 - protein, 9 aa, Homo sapiens
  light chain complementarity determining region 3 for antibody 53256
LQHNSYPWT

SEQ ID NO: 106512 - protein, 19 aa, Homo sapiens
  heavy chain complementarity determining region 3 for antibody 53256
AREDSSSWYVEYYYYGMDV

SEQ ID NO: 106513 - protein, 9 aa, Homo sapiens
  light chain complementarity determining region 3 for antibody 53257
LQDYNYPYT

SEQ ID NO: 106514 - protein, 19 aa, Homo sapiens
  heavy chain complementarity determining region 3 for antibody 53257
ARDSSYYDILTGSPYGMDV

SEQ ID NO: 106515 - protein, 9 aa, Homo sapiens
  light chain complementarity determining region 3 for antibody 53258
LQDYNYPYT

SEQ ID NO: 106516 - protein, 14 aa, Homo sapiens
  heavy chain complementarity determining region 3 for antibody 53258
ARDRDSSGYYLFDY

SEQ ID NO: 106517 - protein, 9 aa, Homo sapiens
  light chain complementarity determining region 3 for antibody 53259
LQDYNYPWT

SEQ ID NO: 106518 - protein, 11 aa, Homo sapiens
  heavy chain complementarity determining region 3 for antibody 53259
ARQLWSEGMDV

SEQ ID NO: 106519 - protein, 9 aa, Homo sapiens
  light chain complementarity determining region 3 for antibody 53260
LQDYNYPWT

SEQ ID NO: 106520 - protein, 14 aa, Homo sapiens
  heavy chain complementarity determining region 3 for antibody 53260
ARAVATITGWYFDL

SEQ ID NO: 106521 - protein, 9 aa, Homo sapiens
  light chain complementarity determining region 3 for antibody 53261
QQDYNLPLT

SEQ ID NO: 106522 - protein, 13 aa, Homo sapiens
  heavy chain complementarity determining region 3 for antibody 53261
ARASTVGYYGMDV

SEQ ID NO: 106523 - protein, 9 aa, Homo sapiens
  light chain complementarity determining region 3 for antibody 53262
LQDYNYPRT

SEQ ID NO: 106524 - protein, 12 aa, Homo sapiens
  heavy chain complementarity determining region 3 for antibody 53262
TLDLGISGWFDP

SEQ ID NO: 106525 - protein, 9 aa, Homo sapiens
  light chain complementarity determining region 3 for antibody 53263
QQYNNWPLT

SEQ ID NO: 106526 - protein, 14 aa, Homo sapiens
  heavy chain complementarity determining region 3 for antibody 53263
AREGGSGWYYGMDV

SEQ ID NO: 106527 - protein, 9 aa, Homo sapiens
  light chain complementarity determining region 3 for antibody 53264
QQLNSYPRT

SEQ ID NO: 106528 - protein, 13 aa, Homo sapiens
  heavy chain complementarity determining region 3 for antibody 53264
AKEMGQWLYYFDY

SEQ ID NO: 106529 - protein, 9 aa, Homo sapiens
  light chain complementarity determining region 3 for antibody 53265
LQHNSYPYT

SEQ ID NO: 106530 - protein, 13 aa, Homo sapiens
  heavy chain complementarity determining region 3 for antibody 53265
ARPLWFGELFPCY

SEQ ID NO: 106531 - protein, 9 aa, Homo sapiens
  light chain complementarity determining region 3 for antibody 53266
LQDYNYPYT

SEQ ID NO: 106532 - protein, 10 aa, Homo sapiens
  heavy chain complementarity determining region 3 for antibody 53266
ARGKAVAGDY

SEQ ID NO: 106533 - protein, 9 aa, Homo sapiens
  light chain complementarity determining region 3 for antibody 53267
LQDYNYPRT

SEQ ID NO: 106534 - protein, 14 aa, Homo sapiens
  heavy chain complementarity determining region 3 for antibody 53267
ARDQNNWNDEGFDY

SEQ ID NO: 106535 - protein, 9 aa, Homo sapiens
  light chain complementarity determining region 3 for antibody 53268
QQYNSYPWT

SEQ ID NO: 106536 - protein, 13 aa, Homo sapiens
  heavy chain complementarity determining region 3 for antibody 53268
AKEGRIAVVPFDY

SEQ ID NO: 106537 - protein, 9 aa, Homo sapiens
  light chain complementarity determining region 3 for antibody 53269
LQHNSYPWT

SEQ ID NO: 106538 - protein, 11 aa, Homo sapiens
  heavy chain complementarity determining region 3 for antibody 53269
ARANWGDAFDI

SEQ ID NO: 106539 - protein, 9 aa, Homo sapiens
  light chain complementarity determining region 3 for antibody 53270
HQSSSLPFT

SEQ ID NO: 106540 - protein, 15 aa, Homo sapiens
  heavy chain complementarity determining region 3 for antibody 53270
AREDYDILTGYYIDY

SEQ ID NO: 106541 - protein, 8 aa, Homo sapiens
  light chain complementarity determining region 3 for antibody 53271
QQFNNYYT

SEQ ID NO: 106542 - protein, 10 aa, Homo sapiens
  heavy chain complementarity determining region 3 for antibody 53271
ARGVRGVFDY

SEQ ID NO: 106543 - protein, 9 aa, Homo sapiens
  light chain complementarity determining region 3 for antibody 53272
QQYNSYPYT

SEQ ID NO: 106544 - protein, 17 aa, Homo sapiens
  heavy chain complementarity determining region 3 for antibody 53272
ARLVLRYSDWLLPHFGY

SEQ ID NO: 106545 - protein, 9 aa, Homo sapiens
  light chain complementarity determining region 3 for antibody 53273
QQFNNYMYT

SEQ ID NO: 106546 - protein, 11 aa, Homo sapiens
  heavy chain complementarity determining region 3 for antibody 53273
ARERTRLDFDY

SEQ ID NO: 106547 - protein, 9 aa, Homo sapiens
  light chain complementarity determining region 3 for antibody 53274
HQSNSLPHT

SEQ ID NO: 106548 - protein, 15 aa, Homo sapiens
  heavy chain complementarity determining region 3 for antibody 53274
ARDRYYGSGSYLFDY

SEQ ID NO: 106549 - protein, 9 aa, Homo sapiens
  light chain complementarity determining region 3 for antibody 53275
QQYNSYPYT

SEQ ID NO: 106550 - protein, 12 aa, Homo sapiens
  heavy chain complementarity determining region 3 for antibody 53275
ARDNNWNDGIDY

SEQ ID NO: 106551 - protein, 9 aa, Homo sapiens
  light chain complementarity determining region 3 for antibody 53276
LQDYNYPWT

SEQ ID NO: 106552 - protein, 18 aa, Homo sapiens
  heavy chain complementarity determining region 3 for antibody 53276
ARRRGAKADYYYYYGMDV

SEQ ID NO: 106553 - protein, 9 aa, Homo sapiens
  light chain complementarity determining region 3 for antibody 53277
LQHNNYPWT

SEQ ID NO: 106554 - protein, 10 aa, Homo sapiens
  heavy chain complementarity determining region 3 for antibody 53277
GRNKQWLVEY

SEQ ID NO: 106555 - protein, 9 aa, Homo sapiens
  light chain complementarity determining region 3 for antibody 53278
QQSYSTPYT

SEQ ID NO: 106556 - protein, 14 aa, Homo sapiens
  heavy chain complementarity determining region 3 for antibody 53278
ARDRDSSSWYGFDY

SEQ ID NO: 106557 - protein, 8 aa, Homo sapiens
  light chain complementarity determining region 3 for antibody 53279
QQYNSYWT

SEQ ID NO: 106558 - protein, 13 aa, Homo sapiens
  heavy chain complementarity determining region 3 for antibody 53279
AKDRIAAAGNFDY

SEQ ID NO: 106559 - protein, 9 aa, Homo sapiens
  light chain complementarity determining region 3 for antibody 53280
LQHNSYPFT

SEQ ID NO: 106560 - protein, 10 aa, Homo sapiens
  heavy chain complementarity determining region 3 for antibody 53280
ARGLYYGMDV

SEQ ID NO: 106561 - protein, 9 aa, Homo sapiens
  light chain complementarity determining region 3 for antibody 53281
QQYNSYPYT

SEQ ID NO: 106562 - protein, 14 aa, Homo sapiens
  heavy chain complementarity determining region 3 for antibody 53281
ARDRQLWLREGFDY

SEQ ID NO: 106563 - protein, 9 aa, Homo sapiens
  light chain complementarity determining region 3 for antibody 53282
QQYNSYPFT

SEQ ID NO: 106564 - protein, 7 aa, Homo sapiens
  heavy chain complementarity determining region 3 for antibody 53282
ARDDWVY

SEQ ID NO: 106565 - protein, 9 aa, Homo sapiens
  light chain complementarity determining region 3 for antibody 53283
QQFNNYPST

SEQ ID NO: 106566 - protein, 9 aa, Homo sapiens
  heavy chain complementarity determining region 3 for antibody 53283
AGGWGWVDY

SEQ ID NO: 106567 - protein, 9 aa, Homo sapiens
  light chain complementarity determining region 3 for antibody 53284
QQYGSSPFT

SEQ ID NO: 106568 - protein, 12 aa, Homo sapiens
  heavy chain complementarity determining region 3 for antibody 53284
ARDRGSYGLFDY

SEQ ID NO: 106569 - protein, 9 aa, Homo sapiens
  light chain complementarity determining region 3 for antibody 53285
QQLNSYPYT

SEQ ID NO: 106570 - protein, 9 aa, Homo sapiens
  heavy chain complementarity determining region 3 for antibody 53285
ARKRWYLDL

SEQ ID NO: 106571 - protein, 9 aa, Homo sapiens
  light chain complementarity determining region 3 for antibody 53286
LQHNSYPYT

SEQ ID NO: 106572 - protein, 8 aa, Homo sapiens
  heavy chain complementarity determining region 3 for antibody 53286
ANLNWRGY

SEQ ID NO: 106573 - protein, 9 aa, Homo sapiens
  light chain complementarity determining region 3 for antibody 53287
QQYNSSPYT

SEQ ID NO: 106574 - protein, 9 aa, Homo sapiens
  heavy chain complementarity determining region 3 for antibody 53287
ARKKLVFDY

SEQ ID NO: 106575 - protein, 9 aa, Homo sapiens
  light chain complementarity determining region 3 for antibody 53288
QQSYSSPLT

SEQ ID NO: 106576 - protein, 15 aa, Homo sapiens
  heavy chain complementarity determining region 3 for antibody 53288
ARDEGGILTGYYFDY

SEQ ID NO: 106577 - protein, 9 aa, Homo sapiens
  light chain complementarity determining region 3 for antibody 53289
LQHDTYPWT

SEQ ID NO: 106578 - protein, 14 aa, Homo sapiens
  heavy chain complementarity determining region 3 for antibody 53289
ARDRELLWFGELLP

SEQ ID NO: 106579 - protein, 9 aa, Homo sapiens
  light chain complementarity determining region 3 for antibody 53290
QQYNSYPLT

SEQ ID NO: 106580 - protein, 14 aa, Homo sapiens
  heavy chain complementarity determining region 3 for antibody 53290
ARGRYSGYDSFFDY

SEQ ID NO: 106581 - protein, 9 aa, Homo sapiens
  light chain complementarity determining region 3 for antibody 53291
QQLNGYPYT

SEQ ID NO: 106582 - protein, 9 aa, Homo sapiens
  heavy chain complementarity determining region 3 for antibody 53291
ARKRWYFDL

SEQ ID NO: 106583 - protein, 9 aa, Homo sapiens
  light chain complementarity determining region 3 for antibody 53292
QQYNSYSYT

SEQ ID NO: 106584 - protein, 14 aa, Homo sapiens
  heavy chain complementarity determining region 3 for antibody 53292
ARHKERSRAFYFDC

SEQ ID NO: 106585 - protein, 8 aa, Homo sapiens
  light chain complementarity determining region 3 for antibody 53293
QQFNNLYT

SEQ ID NO: 106586 - protein, 16 aa, Homo sapiens
  heavy chain complementarity determining region 3 for antibody 53293
ARERIWFGELFIPFDY

SEQ ID NO: 106587 - protein, 9 aa, Homo sapiens
  light chain complementarity determining region 3 for antibody 53294
QKYNSAPYT

SEQ ID NO: 106588 - protein, 12 aa, Homo sapiens
  heavy chain complementarity determining region 3 for antibody 53294
ARRGWFGEPGDY

SEQ ID NO: 106589 - protein, 9 aa, Homo sapiens
  light chain complementarity determining region 3 for antibody 53295
LQHDNFPVH

SEQ ID NO: 106590 - protein, 8 aa, Homo sapiens
  heavy chain complementarity determining region 3 for antibody 53295
ARDDGMDV

SEQ ID NO: 106591 - protein, 9 aa, Homo sapiens
  light chain complementarity determining region 3 for antibody 53296
QQLNSYPST

SEQ ID NO: 106592 - protein, 9 aa, Homo sapiens
  heavy chain complementarity determining region 3 for antibody 53296
ARKRWYFDL

SEQ ID NO: 106593 - protein, 9 aa, Homo sapiens
  light chain complementarity determining region 3 for antibody 53297
LQDYNYPHT

SEQ ID NO: 106594 - protein, 15 aa, Homo sapiens
  heavy chain complementarity determining region 3 for antibody 53297
ARDQGSGIAAAAFDY

SEQ ID NO: 106595 - protein, 9 aa, Homo sapiens
  light chain complementarity determining region 3 for antibody 53298
QQYNSYPYT

SEQ ID NO: 106596 - protein, 17 aa, Homo sapiens
  heavy chain complementarity determining region 3 for antibody 53298
ARLVLRYSDWLLPPFDY

SEQ ID NO: 106597 - protein, 9 aa, Homo sapiens
  light chain complementarity determining region 3 for antibody 53299
QQSYSTPLT

SEQ ID NO: 106598 - protein, 10 aa, Homo sapiens
  heavy chain complementarity determining region 3 for antibody 53299
AREKQQLVDY

SEQ ID NO: 106599 - protein, 9 aa, Homo sapiens
  light chain complementarity determining region 3 for antibody 53300
QQLNSYPFT

SEQ ID NO: 106600 - protein, 9 aa, Homo sapiens
  heavy chain complementarity determining region 3 for antibody 53300
ARKRWYFDL

SEQ ID NO: 106601 - protein, 9 aa, Homo sapiens
  light chain complementarity determining region 3 for antibody 53301
LQHNTYPYT

SEQ ID NO: 106602 - protein, 17 aa, Homo sapiens
  heavy chain complementarity determining region 3 for antibody 53301
ARERDYYGSGSYYIFDY

SEQ ID NO: 106603 - protein, 9 aa, Homo sapiens
  light chain complementarity determining region 3 for antibody 53302
LQHDNFPYT

SEQ ID NO: 106604 - protein, 13 aa, Homo sapiens
  heavy chain complementarity determining region 3 for antibody 53302
ARDHGYSSSWPDY

SEQ ID NO: 106605 - protein, 9 aa, Homo sapiens
  light chain complementarity determining region 3 for antibody 53303
LQDYNYPYT

SEQ ID NO: 106606 - protein, 18 aa, Homo sapiens
  heavy chain complementarity determining region 3 for antibody 53303
ARDQSSGSYYPYYYGMDV

SEQ ID NO: 106607 - protein, 9 aa, Homo sapiens
  light chain complementarity determining region 3 for antibody 53304
LQDNNYPLT

SEQ ID NO: 106608 - protein, 12 aa, Homo sapiens
  heavy chain complementarity determining region 3 for antibody 53304
ARDIGSYLGFDY

SEQ ID NO: 106609 - protein, 9 aa, Homo sapiens
  light chain complementarity determining region 3 for antibody 53305
HQSSSLPHT

SEQ ID NO: 106610 - protein, 15 aa, Homo sapiens
  heavy chain complementarity determining region 3 for antibody 53305
ARGYSGSYDWRYFDL

SEQ ID NO: 106611 - protein, 9 aa, Homo sapiens
  light chain complementarity determining region 3 for antibody 53306
QQYNSYPWT

SEQ ID NO: 106612 - protein, 20 aa, Homo sapiens
  heavy chain complementarity determining region 3 for antibody 53306
ASVTYYDILTGYSRAEYFQH

SEQ ID NO: 106613 - protein, 8 aa, Homo sapiens
  light chain complementarity determining region 3 for antibody 53307
QQFNNYPT

SEQ ID NO: 106614 - protein, 12 aa, Homo sapiens
  heavy chain complementarity determining region 3 for antibody 53307
AREMTVAGYFDY

SEQ ID NO: 106615 - protein, 9 aa, Homo sapiens
  light chain complementarity determining region 3 for antibody 53308
LQHNSYPYT

SEQ ID NO: 106616 - protein, 17 aa, Homo sapiens
  heavy chain complementarity determining region 3 for antibody 53308
ARERDYYGSGSYYIFDY

SEQ ID NO: 106617 - protein, 9 aa, Homo sapiens
  light chain complementarity determining region 3 for antibody 53309
HQSSSLPYT

SEQ ID NO: 106618 - protein, 17 aa, Homo sapiens
  heavy chain complementarity determining region 3 for antibody 53309
AREGGLLWFGESDAFDI

SEQ ID NO: 106619 - protein, 9 aa, Homo sapiens
  light chain complementarity determining region 3 for antibody 53310
QQYNSYPYT

SEQ ID NO: 106620 - protein, 19 aa, Homo sapiens
  heavy chain complementarity determining region 3 for antibody 53310
ARGGYYYDSSGYYHNAFAI

SEQ ID NO: 106621 - protein, 9 aa, Homo sapiens
  light chain complementarity determining region 3 for antibody 53311
LQDYNYPFT

SEQ ID NO: 106622 - protein, 20 aa, Homo sapiens
  heavy chain complementarity determining region 3 for antibody 53311
ARLTITMVRGVIIEDYGMDV

SEQ ID NO: 106623 - protein, 8 aa, Homo sapiens
  light chain complementarity determining region 3 for antibody 53312
QQYNSYPT

SEQ ID NO: 106624 - protein, 13 aa, Homo sapiens
  heavy chain complementarity determining region 3 for antibody 53312
AREIGGYVDYFDY

SEQ ID NO: 106625 - protein, 9 aa, Homo sapiens
  light chain complementarity determining region 3 for antibody 53313
QQYNSYPLT

SEQ ID NO: 106626 - protein, 10 aa, Homo sapiens
  heavy chain complementarity determining region 3 for antibody 53313
ARAGYYGMDV

SEQ ID NO: 106627 - protein, 9 aa, Homo sapiens
  light chain complementarity determining region 3 for antibody 53314
LQDYNYPLT

SEQ ID NO: 106628 - protein, 14 aa, Homo sapiens
  heavy chain complementarity determining region 3 for antibody 53314
ARSKDSWLVYYFDY

SEQ ID NO: 106629 - protein, 9 aa, Homo sapiens
  light chain complementarity determining region 3 for antibody 53315
LQDYNFPYT

SEQ ID NO: 106630 - protein, 14 aa, Homo sapiens
  heavy chain complementarity determining region 3 for antibody 53315
ARDRDSSGYYLFDY

SEQ ID NO: 106631 - protein, 9 aa, Homo sapiens
  light chain complementarity determining region 3 for antibody 53316
QQYNTYPYS

SEQ ID NO: 106632 - protein, 17 aa, Homo sapiens
  heavy chain complementarity determining region 3 for antibody 53316
AREHYDILTGYWNYFDY

SEQ ID NO: 106633 - protein, 9 aa, Homo sapiens
  light chain complementarity determining region 3 for antibody 53317
QQYNNWPLT

SEQ ID NO: 106634 - protein, 15 aa, Homo sapiens
  heavy chain complementarity determining region 3 for antibody 53317
ARASYNWNDVGAFDV

SEQ ID NO: 106635 - protein, 9 aa, Homo sapiens
  light chain complementarity determining region 3 for antibody 53318
QQYISYPFT

SEQ ID NO: 106636 - protein, 13 aa, Homo sapiens
  heavy chain complementarity determining region 3 for antibody 53318
AADYGDYQYSFDY

SEQ ID NO: 106637 - protein, 9 aa, Homo sapiens
  light chain complementarity determining region 3 for antibody 53319
QQYNRYPYT

SEQ ID NO: 106638 - protein, 18 aa, Homo sapiens
  heavy chain complementarity determining region 3 for antibody 53319
ARERRDDILTGYYDAFDI

SEQ ID NO: 106639 - protein, 9 aa, Homo sapiens
  light chain complementarity determining region 3 for antibody 53320
QQLNSYPYT

SEQ ID NO: 106640 - protein, 19 aa, Homo sapiens
  heavy chain complementarity determining region 3 for antibody 53320
ARDERFGEPFYYYYYGMDV

SEQ ID NO: 106641 - protein, 9 aa, Homo sapiens
  light chain complementarity determining region 3 for antibody 53321
LQHNSYPRT

SEQ ID NO: 106642 - protein, 15 aa, Homo sapiens
  heavy chain complementarity determining region 3 for antibody 53321
ARDDPTYYYGSGFDY

SEQ ID NO: 106643 - protein, 9 aa, Homo sapiens
  light chain complementarity determining region 3 for antibody 53322
LQDYNYPYT

SEQ ID NO: 106644 - protein, 11 aa, Homo sapiens
  heavy chain complementarity determining region 3 for antibody 53322
ARELERRYFDY

SEQ ID NO: 106645 - protein, 9 aa, Homo sapiens
  light chain complementarity determining region 3 for antibody 53323
LQDYNYPYT

SEQ ID NO: 106646 - protein, 18 aa, Homo sapiens
  heavy chain complementarity determining region 3 for antibody 53323
ARDKGGSYYDYYYYGMDV

SEQ ID NO: 106647 - protein, 9 aa, Homo sapiens
  light chain complementarity determining region 3 for antibody 53324
LQDYNYPRT

SEQ ID NO: 106648 - protein, 12 aa, Homo sapiens
  heavy chain complementarity determining region 3 for antibody 53324
ARREWELLGMDV

SEQ ID NO: 106649 - protein, 9 aa, Homo sapiens
  light chain complementarity determining region 3 for antibody 53325
LQDYNYPRT

SEQ ID NO: 106650 - protein, 12 aa, Homo sapiens
  heavy chain complementarity determining region 3 for antibody 53325
ARDPSNWSPFDY

SEQ ID NO: 106651 - protein, 9 aa, Homo sapiens
  light chain complementarity determining region 3 for antibody 53326
QQYNSYPWT

SEQ ID NO: 106652 - protein, 11 aa, Homo sapiens
  heavy chain complementarity determining region 3 for antibody 53326
AREGAAAGFDY

SEQ ID NO: 106653 - protein, 9 aa, Homo sapiens
  light chain complementarity determining region 3 for antibody 53327
QQYGISPYT

SEQ ID NO: 106654 - protein, 17 aa, Homo sapiens
  heavy chain complementarity determining region 3 for antibody 53327
ARGGAYYASGSSHYFDY

SEQ ID NO: 106655 - protein, 9 aa, Homo sapiens
  light chain complementarity determining region 3 for antibody 53328
QQDYNLPLT

SEQ ID NO: 106656 - protein, 17 aa, Homo sapiens
  heavy chain complementarity determining region 3 for antibody 53328
ARGLRYFDWLLSDAFDI

SEQ ID NO: 106657 - protein, 9 aa, Homo sapiens
  light chain complementarity determining region 3 for antibody 53329
LQHNSYPRT

SEQ ID NO: 106658 - protein, 13 aa, Homo sapiens
  heavy chain complementarity determining region 3 for antibody 53329
ARERGWNDGAFDI

SEQ ID NO: 106659 - protein, 9 aa, Homo sapiens
  light chain complementarity determining region 3 for antibody 53330
LQDYNYPWT

SEQ ID NO: 106660 - protein, 11 aa, Homo sapiens
  heavy chain complementarity determining region 3 for antibody 53330
ARELSSGCLDY

SEQ ID NO: 106661 - protein, 9 aa, Homo sapiens
  light chain complementarity determining region 3 for antibody 53331
HQSSSLPFT

SEQ ID NO: 106662 - protein, 11 aa, Homo sapiens
  heavy chain complementarity determining region 3 for antibody 53331
ARLPWFGGFDY

SEQ ID NO: 106663 - protein, 9 aa, Homo sapiens
  light chain complementarity determining region 3 for antibody 53332
QQYNSYPPT

SEQ ID NO: 106664 - protein, 14 aa, Homo sapiens
  heavy chain complementarity determining region 3 for antibody 53332
ATAYYDILTGRFDY

SEQ ID NO: 106665 - protein, 9 aa, Homo sapiens
  light chain complementarity determining region 3 for antibody 53333
QKYNSAPFT

SEQ ID NO: 106666 - protein, 18 aa, Homo sapiens
  heavy chain complementarity determining region 3 for antibody 53333
ARGQIYYNSGSYYSPFDY

SEQ ID NO: 106667 - protein, 9 aa, Homo sapiens
  light chain complementarity determining region 3 for antibody 53334
LQHNSYPYT

SEQ ID NO: 106668 - protein, 11 aa, Homo sapiens
  heavy chain complementarity determining region 3 for antibody 53334
ATAGYGIVGDP

SEQ ID NO: 106669 - protein, 9 aa, Homo sapiens
  light chain complementarity determining region 3 for antibody 53335
LQDYNYPRT

SEQ ID NO: 106670 - protein, 13 aa, Homo sapiens
  heavy chain complementarity determining region 3 for antibody 53335
ARGGAITRDWFDP

SEQ ID NO: 106671 - protein, 9 aa, Homo sapiens
  light chain complementarity determining region 3 for antibody 53336
LQDYNYPRT

SEQ ID NO: 106672 - protein, 6 aa, Homo sapiens
  heavy chain complementarity determining region 3 for antibody 53336
AKRFDY

SEQ ID NO: 106673 - protein, 9 aa, Homo sapiens
  light chain complementarity determining region 3 for antibody 53337
QQYNSYPHT

SEQ ID NO: 106674 - protein, 19 aa, Homo sapiens
  heavy chain complementarity determining region 3 for antibody 53337
ARERFGELEDYYYYYGMDV

SEQ ID NO: 106675 - protein, 9 aa, Homo sapiens
  light chain complementarity determining region 3 for antibody 53338
QQYGSSPYT

SEQ ID NO: 106676 - protein, 20 aa, Homo sapiens
  heavy chain complementarity determining region 3 for antibody 53338
ARKGGYYGSGSYYNVVYFDY

SEQ ID NO: 106677 - protein, 9 aa, Homo sapiens
  light chain complementarity determining region 3 for antibody 53339
QQSYSTPRT

SEQ ID NO: 106678 - protein, 18 aa, Homo sapiens
  heavy chain complementarity determining region 3 for antibody 53339
ARDLLVRGVIDYYYGMDV

SEQ ID NO: 106679 - protein, 9 aa, Homo sapiens
  light chain complementarity determining region 3 for antibody 53340
LQHNTYPWT

SEQ ID NO: 106680 - protein, 11 aa, Homo sapiens
  heavy chain complementarity determining region 3 for antibody 53340
ARANWGDAFDI

SEQ ID NO: 106681 - protein, 9 aa, Homo sapiens
  light chain complementarity determining region 3 for antibody 53341
LQDYNYPYT

SEQ ID NO: 106682 - protein, 17 aa, Homo sapiens
  heavy chain complementarity determining region 3 for antibody 53341
ARDLRYFDWSLDDAFDI

SEQ ID NO: 106683 - protein, 9 aa, Homo sapiens
  light chain complementarity determining region 3 for antibody 53342
LQDYNYPWT

SEQ ID NO: 106684 - protein, 11 aa, Homo sapiens
  heavy chain complementarity determining region 3 for antibody 53342
TRETGPDAFDI

SEQ ID NO: 106685 - protein, 9 aa, Homo sapiens
  light chain complementarity determining region 3 for antibody 53343
QQYDNLPYT

SEQ ID NO: 106686 - protein, 16 aa, Homo sapiens
  heavy chain complementarity determining region 3 for antibody 53343
ARDRYYYGSGSYPFDY

SEQ ID NO: 106687 - protein, 9 aa, Homo sapiens
  light chain complementarity determining region 3 for antibody 53344
LQDYNYPYT

SEQ ID NO: 106688 - protein, 14 aa, Homo sapiens
  heavy chain complementarity determining region 3 for antibody 53344
ARVGYSSSWYGMDV

SEQ ID NO: 106689 - protein, 9 aa, Homo sapiens
  light chain complementarity determining region 3 for antibody 53345
LQDYNYPRT

SEQ ID NO: 106690 - protein, 16 aa, Homo sapiens
  heavy chain complementarity determining region 3 for antibody 53345
AREGLRYFDWEGYFDL

SEQ ID NO: 106691 - protein, 9 aa, Homo sapiens
  light chain complementarity determining region 3 for antibody 53346
QQYNSYPYT

SEQ ID NO: 106692 - protein, 13 aa, Homo sapiens
  heavy chain complementarity determining region 3 for antibody 53346
ASMVRGVISGMDV

SEQ ID NO: 106693 - protein, 9 aa, Homo sapiens
  light chain complementarity determining region 3 for antibody 53347
QKYNSAPYT

SEQ ID NO: 106694 - protein, 17 aa, Homo sapiens
  heavy chain complementarity determining region 3 for antibody 53347
AREGYYGSGSYYSYFDY

SEQ ID NO: 106695 - protein, 9 aa, Homo sapiens
  light chain complementarity determining region 3 for antibody 53348
LQDYNYPRT

SEQ ID NO: 106696 - protein, 16 aa, Homo sapiens
  heavy chain complementarity determining region 3 for antibody 53348
ARVPYYYGSGSYAFDI

SEQ ID NO: 106697 - protein, 9 aa, Homo sapiens
  light chain complementarity determining region 3 for antibody 53349
LQDYNYPFT

SEQ ID NO: 106698 - protein, 21 aa, Homo sapiens
  heavy chain complementarity determining region 3 for antibody 53349
ARQRGYFGSGIYYNVSYYFDY

SEQ ID NO: 106699 - protein, 9 aa, Homo sapiens
  light chain complementarity determining region 3 for antibody 53350
QQYDNLPLT

SEQ ID NO: 106700 - protein, 17 aa, Homo sapiens
  heavy chain complementarity determining region 3 for antibody 53350
ARDHDYVWGSYRYAFDI

SEQ ID NO: 106701 - protein, 9 aa, Homo sapiens
  light chain complementarity determining region 3 for antibody 53351
QQLNSYPPT

SEQ ID NO: 106702 - protein, 12 aa, Homo sapiens
  heavy chain complementarity determining region 3 for antibody 53351
ARSGDYLYYFDY

SEQ ID NO: 106703 - protein, 9 aa, Homo sapiens
  light chain complementarity determining region 3 for antibody 53352
QQFNNYPST

SEQ ID NO: 106704 - protein, 15 aa, Homo sapiens
  heavy chain complementarity determining region 3 for antibody 53352
ATPYYYGSGSYALDV

SEQ ID NO: 106705 - protein, 9 aa, Homo sapiens
  light chain complementarity determining region 3 for antibody 53353
QKYNSAPLT

SEQ ID NO: 106706 - protein, 5 aa, Homo sapiens
  heavy chain complementarity determining region 3 for antibody 53353
TTPLL

SEQ ID NO: 106707 - protein, 9 aa, Homo sapiens
  light chain complementarity determining region 3 for antibody 53354
LQDYNYPYT

SEQ ID NO: 106708 - protein, 16 aa, Homo sapiens
  heavy chain complementarity determining region 3 for antibody 53354
ARDRIYDILTEGAFDI

SEQ ID NO: 106709 - protein, 9 aa, Homo sapiens
  light chain complementarity determining region 3 for antibody 53355
LQDYNYPWT

SEQ ID NO: 106710 - protein, 14 aa, Homo sapiens
  heavy chain complementarity determining region 3 for antibody 53355
ARDVYYGSGSPLDY

SEQ ID NO: 106711 - protein, 9 aa, Homo sapiens
  light chain complementarity determining region 3 for antibody 53356
LQDYNYPRT

SEQ ID NO: 106712 - protein, 13 aa, Homo sapiens
  heavy chain complementarity determining region 3 for antibody 53356
ATDPGFGEGAFDI

SEQ ID NO: 106713 - protein, 9 aa, Homo sapiens
  light chain complementarity determining region 3 for antibody 53357
HQSSSLPYT

SEQ ID NO: 106714 - protein, 13 aa, Homo sapiens
  heavy chain complementarity determining region 3 for antibody 53357
ARSGGNWGRWFDP

SEQ ID NO: 106715 - protein, 9 aa, Homo sapiens
  light chain complementarity determining region 3 for antibody 53358
QQYNSYPRT

SEQ ID NO: 106716 - protein, 10 aa, Homo sapiens
  heavy chain complementarity determining region 3 for antibody 53358
ARDEDWSFDY

SEQ ID NO: 106717 - protein, 9 aa, Homo sapiens
  light chain complementarity determining region 3 for antibody 53359
LQHNSYPYT

SEQ ID NO: 106718 - protein, 13 aa, Homo sapiens
  heavy chain complementarity determining region 3 for antibody 53359
ARDPHYGHDAFDI

SEQ ID NO: 106719 - protein, 9 aa, Homo sapiens
  light chain complementarity determining region 3 for antibody 53360
LQHNSYPYT

SEQ ID NO: 106720 - protein, 12 aa, Homo sapiens
  heavy chain complementarity determining region 3 for antibody 53360
ANVDTAMVYFDY

SEQ ID NO: 106721 - protein, 9 aa, Homo sapiens
  light chain complementarity determining region 3 for antibody 53361
LQHNSYPPT

SEQ ID NO: 106722 - protein, 17 aa, Homo sapiens
  heavy chain complementarity determining region 3 for antibody 53361
ARERGELLDYYYYGMDV

SEQ ID NO: 106723 - protein, 9 aa, Homo sapiens
  light chain complementarity determining region 3 for antibody 53362
LQHNSYPYT

SEQ ID NO: 106724 - protein, 8 aa, Homo sapiens
  heavy chain complementarity determining region 3 for antibody 53362
ARDDGVDV

SEQ ID NO: 106725 - protein, 9 aa, Homo sapiens
  light chain complementarity determining region 3 for antibody 53363
LQDYNYPYT

SEQ ID NO: 106726 - protein, 17 aa, Homo sapiens
  heavy chain complementarity determining region 3 for antibody 53363
ARDLRYFDWLLDDAFDI

SEQ ID NO: 106727 - protein, 9 aa, Homo sapiens
  light chain complementarity determining region 3 for antibody 53364
QQLNSYPLT

SEQ ID NO: 106728 - protein, 12 aa, Homo sapiens
  heavy chain complementarity determining region 3 for antibody 53364
ARDREVRGVLDY

SEQ ID NO: 106729 - protein, 9 aa, Homo sapiens
  light chain complementarity determining region 3 for antibody 53365
QKYYSAPLT

SEQ ID NO: 106730 - protein, 8 aa, Homo sapiens
  heavy chain complementarity determining region 3 for antibody 53365
ARTGPLDY

SEQ ID NO: 106731 - protein, 9 aa, Homo sapiens
  light chain complementarity determining region 3 for antibody 53366
QQYNSYPYT

SEQ ID NO: 106732 - protein, 19 aa, Homo sapiens
  heavy chain complementarity determining region 3 for antibody 53366
ARHGNSGSGNYNYYYGMDV

SEQ ID NO: 106733 - protein, 8 aa, Homo sapiens
  light chain complementarity determining region 3 for antibody 53367
QQRSNWLT

SEQ ID NO: 106734 - protein, 13 aa, Homo sapiens
  heavy chain complementarity determining region 3 for antibody 53367
ARDRGHSSGWYPY

SEQ ID NO: 106735 - protein, 9 aa, Homo sapiens
  light chain complementarity determining region 3 for antibody 53368
LQHNSYPFT

SEQ ID NO: 106736 - protein, 13 aa, Homo sapiens
  heavy chain complementarity determining region 3 for antibody 53368
AKEGRIAVVPFDY

SEQ ID NO: 106737 - protein, 9 aa, Homo sapiens
  light chain complementarity determining region 3 for antibody 53369
LQHDNFPYT

SEQ ID NO: 106738 - protein, 22 aa, Homo sapiens
  heavy chain complementarity determining region 3 for antibody 53369
ARDRYYYGSGSYPYYYYYGMDV

SEQ ID NO: 106739 - protein, 9 aa, Homo sapiens
  light chain complementarity determining region 3 for antibody 53370
LQDYNYPYT

SEQ ID NO: 106740 - protein, 12 aa, Homo sapiens
  heavy chain complementarity determining region 3 for antibody 53370
ARDNDILTGSDY

SEQ ID NO: 106741 - protein, 9 aa, Homo sapiens
  light chain complementarity determining region 3 for antibody 53371
LQDYNYPFT

SEQ ID NO: 106742 - protein, 14 aa, Homo sapiens
  heavy chain complementarity determining region 3 for antibody 53371
ARDNGFTSGWHFDS

SEQ ID NO: 106743 - protein, 9 aa, Homo sapiens
  light chain complementarity determining region 3 for antibody 53372
HQSSSLPYT

SEQ ID NO: 106744 - protein, 12 aa, Homo sapiens
  heavy chain complementarity determining region 3 for antibody 53372
VRGGIAAAAFDY

SEQ ID NO: 106745 - protein, 9 aa, Homo sapiens
  light chain complementarity determining region 3 for antibody 53373
HQSSSLPRT

SEQ ID NO: 106746 - protein, 10 aa, Homo sapiens
  heavy chain complementarity determining region 3 for antibody 53373
ARHGSGSYDY

SEQ ID NO: 106747 - protein, 9 aa, Homo sapiens
  light chain complementarity determining region 3 for antibody 53374
QRTYNAPYT

SEQ ID NO: 106748 - protein, 10 aa, Homo sapiens
  heavy chain complementarity determining region 3 for antibody 53374
ASDYSEGFDY

SEQ ID NO: 106749 - protein, 9 aa, Homo sapiens
  light chain complementarity determining region 3 for antibody 53375
QQYNNYPFT

SEQ ID NO: 106750 - protein, 17 aa, Homo sapiens
  heavy chain complementarity determining region 3 for antibody 53375
ARLVLRYSDWLLPHFDY

SEQ ID NO: 106751 - protein, 9 aa, Homo sapiens
  light chain complementarity determining region 3 for antibody 53376
QQVNSYPYT

SEQ ID NO: 106752 - protein, 9 aa, Homo sapiens
  heavy chain complementarity determining region 3 for antibody 53376
ARKRWYFDL

SEQ ID NO: 106753 - protein, 9 aa, Homo sapiens
  light chain complementarity determining region 3 for antibody 53377
QQSYSTPLT

SEQ ID NO: 106754 - protein, 19 aa, Homo sapiens
  heavy chain complementarity determining region 3 for antibody 53377
ARDPEIAVASPNYYYGMDV

SEQ ID NO: 106755 - protein, 9 aa, Homo sapiens
  light chain complementarity determining region 3 for antibody 53378
QQLNSYPYT

SEQ ID NO: 106756 - protein, 12 aa, Homo sapiens
  heavy chain complementarity determining region 3 for antibody 53378
ARLPPYYFGMDV

SEQ ID NO: 106757 - protein, 9 aa, Homo sapiens
  light chain complementarity determining region 3 for antibody 53379
QQFNNYPST

SEQ ID NO: 106758 - protein, 17 aa, Homo sapiens
  heavy chain complementarity determining region 3 for antibody 53379
ARERGGVAYYYYYGMDV

SEQ ID NO: 106759 - protein, 9 aa, Homo sapiens
  light chain complementarity determining region 3 for antibody 53380
LQHNSYPYT

SEQ ID NO: 106760 - protein, 19 aa, Homo sapiens
  heavy chain complementarity determining region 3 for antibody 53380
ARVSDILTGYYKGGHAFDI

SEQ ID NO: 106761 - protein, 9 aa, Homo sapiens
  light chain complementarity determining region 3 for antibody 53381
LQHNSYPWT

SEQ ID NO: 106762 - protein, 19 aa, Homo sapiens
  heavy chain complementarity determining region 3 for antibody 53381
ARDEYDILTGYYYYYGMDV

SEQ ID NO: 106763 - protein, 9 aa, Homo sapiens
  light chain complementarity determining region 3 for antibody 53382
LQHNSYPRT

SEQ ID NO: 106764 - protein, 15 aa, Homo sapiens
  heavy chain complementarity determining region 3 for antibody 53382
ARDRDYGDYGYGMDV

SEQ ID NO: 106765 - protein, 9 aa, Homo sapiens
  light chain complementarity determining region 3 for antibody 53383
LQHNSYPHT

SEQ ID NO: 106766 - protein, 19 aa, Homo sapiens
  heavy chain complementarity determining region 3 for antibody 53383
ARDHDILTGYYRDYCGMDV

SEQ ID NO: 106767 - protein, 9 aa, Homo sapiens
  light chain complementarity determining region 3 for antibody 53384
LQDYNYPRT

SEQ ID NO: 106768 - protein, 16 aa, Homo sapiens
  heavy chain complementarity determining region 3 for antibody 53384
ARERGGILTGYSHFQH

SEQ ID NO: 106769 - protein, 9 aa, Homo sapiens
  light chain complementarity determining region 3 for antibody 53385
HQSSSLPHT

SEQ ID NO: 106770 - protein, 18 aa, Homo sapiens
  heavy chain complementarity determining region 3 for antibody 53385
ARAPYDILTGYYYYGMDV

SEQ ID NO: 106771 - protein, 8 aa, Homo sapiens
  light chain complementarity determining region 3 for antibody 53386
QQYNSYST

SEQ ID NO: 106772 - protein, 14 aa, Homo sapiens
  heavy chain complementarity determining region 3 for antibody 53386
AKEEQQLVWDAFDI

SEQ ID NO: 106773 - protein, 9 aa, Homo sapiens
  light chain complementarity determining region 3 for antibody 53387
QQYNSYPRT

SEQ ID NO: 106774 - protein, 17 aa, Homo sapiens
  heavy chain complementarity determining region 3 for antibody 53387
AREKQLDPYYYYYGMDV

SEQ ID NO: 106775 - protein, 9 aa, Homo sapiens
  light chain complementarity determining region 3 for antibody 53388
LQHDNFPYT

SEQ ID NO: 106776 - protein, 13 aa, Homo sapiens
  heavy chain complementarity determining region 3 for antibody 53388
ARERYLASYGMDV

SEQ ID NO: 106777 - protein, 9 aa, Homo sapiens
  light chain complementarity determining region 3 for antibody 53389
LQDYNYPYT

SEQ ID NO: 106778 - protein, 13 aa, Homo sapiens
  heavy chain complementarity determining region 3 for antibody 53389
ARGGIAAAHAFDI

SEQ ID NO: 106779 - protein, 9 aa, Homo sapiens
  light chain complementarity determining region 3 for antibody 53390
LQDYNYPYT

SEQ ID NO: 106780 - protein, 18 aa, Homo sapiens
  heavy chain complementarity determining region 3 for antibody 53390
ARANTYYYGSGSSYYFDY

SEQ ID NO: 106781 - protein, 9 aa, Homo sapiens
  light chain complementarity determining region 3 for antibody 53391
LQDYNYPRT

SEQ ID NO: 106782 - protein, 12 aa, Homo sapiens
  heavy chain complementarity determining region 3 for antibody 53391
ARDSSGWSHFDY

SEQ ID NO: 106783 - protein, 9 aa, Homo sapiens
  light chain complementarity determining region 3 for antibody 53392
LQDYNYPRT

SEQ ID NO: 106784 - protein, 15 aa, Homo sapiens
  heavy chain complementarity determining region 3 for antibody 53392
ARDNYYGSGSNWFDP

SEQ ID NO: 106785 - protein, 9 aa, Homo sapiens
  light chain complementarity determining region 3 for antibody 53393
QQYNSYPYT

SEQ ID NO: 106786 - protein, 16 aa, Homo sapiens
  heavy chain complementarity determining region 3 for antibody 53393
ARDPLYNWNDEGAFDI

SEQ ID NO: 106787 - protein, 9 aa, Homo sapiens
  light chain complementarity determining region 3 for antibody 53394
QQLNSYPYT

SEQ ID NO: 106788 - protein, 14 aa, Homo sapiens
  heavy chain complementarity determining region 3 for antibody 53394
ARDHDYGDSDAFDI

SEQ ID NO: 106789 - protein, 9 aa, Homo sapiens
  light chain complementarity determining region 3 for antibody 53395
LQDYNYPYT

SEQ ID NO: 106790 - protein, 11 aa, Homo sapiens
  heavy chain complementarity determining region 3 for antibody 53395
ARGTVTSPFDY

SEQ ID NO: 106791 - protein, 9 aa, Homo sapiens
  light chain complementarity determining region 3 for antibody 53396
LQDYNYPYT

SEQ ID NO: 106792 - protein, 14 aa, Homo sapiens
  heavy chain complementarity determining region 3 for antibody 53396
AREGGSGTSYGMDV

SEQ ID NO: 106793 - protein, 9 aa, Homo sapiens
  light chain complementarity determining region 3 for antibody 53397
LQDYNYPFT

SEQ ID NO: 106794 - protein, 18 aa, Homo sapiens
  heavy chain complementarity determining region 3 for antibody 53397
ATGRRYSSGWEYYYGMDV

SEQ ID NO: 106795 - protein, 9 aa, Homo sapiens
  light chain complementarity determining region 3 for antibody 53398
QQYNIFPYT

SEQ ID NO: 106796 - protein, 18 aa, Homo sapiens
  heavy chain complementarity determining region 3 for antibody 53398
ARERRDDILTGYYDAFDI

SEQ ID NO: 106797 - protein, 9 aa, Homo sapiens
  light chain complementarity determining region 3 for antibody 53399
QQSYSTPYT

SEQ ID NO: 106798 - protein, 14 aa, Homo sapiens
  heavy chain complementarity determining region 3 for antibody 53399
ARDRDSSSWYGFHY

SEQ ID NO: 106799 - protein, 9 aa, Homo sapiens
  light chain complementarity determining region 3 for antibody 53400
QQLNSYPYT

SEQ ID NO: 106800 - protein, 14 aa, Homo sapiens
  heavy chain complementarity determining region 3 for antibody 53400
ARDLDTMVRGVFDY

SEQ ID NO: 106801 - protein, 8 aa, Homo sapiens
  light chain complementarity determining region 3 for antibody 53401
QQFNNYPT

SEQ ID NO: 106802 - protein, 15 aa, Homo sapiens
  heavy chain complementarity determining region 3 for antibody 53401
ARDRVWFGELSPFDY

SEQ ID NO: 106803 - protein, 9 aa, Homo sapiens
  light chain complementarity determining region 3 for antibody 53402
LQHNSYPRT

SEQ ID NO: 106804 - protein, 19 aa, Homo sapiens
  heavy chain complementarity determining region 3 for antibody 53402
AKDAGHYYDSSGYLNWFDP

SEQ ID NO: 106805 - protein, 10 aa, Homo sapiens
  light chain complementarity determining region 3 for antibody 53403
LQHNSYPPYT

SEQ ID NO: 106806 - protein, 18 aa, Homo sapiens
  heavy chain complementarity determining region 3 for antibody 53403
AKEGGGATLYYYYYGMDV

SEQ ID NO: 106807 - protein, 9 aa, Homo sapiens
  light chain complementarity determining region 3 for antibody 53404
LQHNSYPFT

SEQ ID NO: 106808 - protein, 16 aa, Homo sapiens
  heavy chain complementarity determining region 3 for antibody 53404
AKEGTVHNWNDDAFDI

SEQ ID NO: 106809 - protein, 9 aa, Homo sapiens
  light chain complementarity determining region 3 for antibody 53405
LQDYIYPYT

SEQ ID NO: 106810 - protein, 12 aa, Homo sapiens
  heavy chain complementarity determining region 3 for antibody 53405
ITDPQRIFPFDY

SEQ ID NO: 106811 - protein, 9 aa, Homo sapiens
  light chain complementarity determining region 3 for antibody 53406
LHYNSYPLT

SEQ ID NO: 106812 - protein, 19 aa, Homo sapiens
  heavy chain complementarity determining region 3 for antibody 53406
ARDRGYYGSGSYFPSYFDY

SEQ ID NO: 106813 - protein, 9 aa, Homo sapiens
  light chain complementarity determining region 3 for antibody 53407
QQYNSYPHT

SEQ ID NO: 106814 - protein, 19 aa, Homo sapiens
  heavy chain complementarity determining region 3 for antibody 53407
ARERFGELEEDYYYYGMDV

SEQ ID NO: 106815 - protein, 9 aa, Homo sapiens
  light chain complementarity determining region 3 for antibody 53408
QQYNSFPFT

SEQ ID NO: 106816 - protein, 17 aa, Homo sapiens
  heavy chain complementarity determining region 3 for antibody 53408
AREYNDILTGYWGSFDY

SEQ ID NO: 106817 - protein, 9 aa, Homo sapiens
  light chain complementarity determining region 3 for antibody 53409
QQLNSYPYT

SEQ ID NO: 106818 - protein, 9 aa, Homo sapiens
  heavy chain complementarity determining region 3 for antibody 53409
ARKRWYIDL

SEQ ID NO: 106819 - protein, 9 aa, Homo sapiens
  light chain complementarity determining region 3 for antibody 53410
LQHNSYPWT

SEQ ID NO: 106820 - protein, 19 aa, Homo sapiens
  heavy chain complementarity determining region 3 for antibody 53410
ARDDYDILTGHYYYYGMDV

SEQ ID NO: 106821 - protein, 9 aa, Homo sapiens
  light chain complementarity determining region 3 for antibody 53411
LQDYNYPHT

SEQ ID NO: 106822 - protein, 15 aa, Homo sapiens
  heavy chain complementarity determining region 3 for antibody 53411
ARDQGSGIAAAVFDY

SEQ ID NO: 106823 - protein, 9 aa, Homo sapiens
  light chain complementarity determining region 3 for antibody 53412
HQSSSLPYT

SEQ ID NO: 106824 - protein, 13 aa, Homo sapiens
  heavy chain complementarity determining region 3 for antibody 53412
ARKVRITMVRGVP

SEQ ID NO: 106825 - protein, 9 aa, Homo sapiens
  light chain complementarity determining region 3 for antibody 53413
QQYNSYPRT

SEQ ID NO: 106826 - protein, 13 aa, Homo sapiens
  heavy chain complementarity determining region 3 for antibody 53413
ARVYSSGWYAFDI

SEQ ID NO: 106827 - protein, 9 aa, Homo sapiens
  light chain complementarity determining region 3 for antibody 53414
QQYNSFPFT

SEQ ID NO: 106828 - protein, 17 aa, Homo sapiens
  heavy chain complementarity determining region 3 for antibody 53414
AREYNDILAGYWGYFDY

SEQ ID NO: 106829 - protein, 9 aa, Homo sapiens
  light chain complementarity determining region 3 for antibody 53415
LQHNSYPLT

SEQ ID NO: 106830 - protein, 22 aa, Homo sapiens
  heavy chain complementarity determining region 3 for antibody 53415
AGGDYDILTGYRGYYSYYGMDV

SEQ ID NO: 106831 - protein, 9 aa, Homo sapiens
  light chain complementarity determining region 3 for antibody 53416
LQHDNFPYT

SEQ ID NO: 106832 - protein, 13 aa, Homo sapiens
  heavy chain complementarity determining region 3 for antibody 53416
ARERYCASYGMDV

SEQ ID NO: 106833 - protein, 9 aa, Homo sapiens
  light chain complementarity determining region 3 for antibody 53417
LQHDNFPYT

SEQ ID NO: 106834 - protein, 20 aa, Homo sapiens
  heavy chain complementarity determining region 3 for antibody 53417
ARDRSRISMVREYYYYGMDV

SEQ ID NO: 106835 - protein, 9 aa, Homo sapiens
  light chain complementarity determining region 3 for antibody 53418
LQDYNYPWT

SEQ ID NO: 106836 - protein, 14 aa, Homo sapiens
  heavy chain complementarity determining region 3 for antibody 53418
ARAATTGTSYGMDV

SEQ ID NO: 106837 - protein, 9 aa, Homo sapiens
  light chain complementarity determining region 3 for antibody 53419
LQDYFYPPI

SEQ ID NO: 106838 - protein, 15 aa, Homo sapiens
  heavy chain complementarity determining region 3 for antibody 53419
ARDLWYSGSSYGMDV

SEQ ID NO: 106839 - protein, 9 aa, Homo sapiens
  light chain complementarity determining region 3 for antibody 53420
QQYNSYPWT

SEQ ID NO: 106840 - protein, 13 aa, Homo sapiens
  heavy chain complementarity determining region 3 for antibody 53420
AAYDILTGYYFDY

SEQ ID NO: 106841 - protein, 9 aa, Homo sapiens
  light chain complementarity determining region 3 for antibody 53421
QQYNSYPPT

SEQ ID NO: 106842 - protein, 14 aa, Homo sapiens
  heavy chain complementarity determining region 3 for antibody 53421
ARDGITMVRGVFDY

SEQ ID NO: 106843 - protein, 9 aa, Homo sapiens
  light chain complementarity determining region 3 for antibody 53422
QQLNSYPYT

SEQ ID NO: 106844 - protein, 9 aa, Homo sapiens
  heavy chain complementarity determining region 3 for antibody 53422
ARKTWYFDL

SEQ ID NO: 106845 - protein, 9 aa, Homo sapiens
  light chain complementarity determining region 3 for antibody 53423
LQHNSYPRT

SEQ ID NO: 106846 - protein, 13 aa, Homo sapiens
  heavy chain complementarity determining region 3 for antibody 53423
AREGYSSGWSFDY

SEQ ID NO: 106847 - protein, 9 aa, Homo sapiens
  light chain complementarity determining region 3 for antibody 53424
LQHNSYPLT

SEQ ID NO: 106848 - protein, 13 aa, Homo sapiens
  heavy chain complementarity determining region 3 for antibody 53424
AREGYYPFYGMDV

SEQ ID NO: 106849 - protein, 9 aa, Homo sapiens
  light chain complementarity determining region 3 for antibody 53425
LQDYNYPFT

SEQ ID NO: 106850 - protein, 20 aa, Homo sapiens
  heavy chain complementarity determining region 3 for antibody 53425
ARDRLTMVRGVIITPGAFDI

SEQ ID NO: 106851 - protein, 9 aa, Homo sapiens
  light chain complementarity determining region 3 for antibody 53426
QQYNSYPFT

SEQ ID NO: 106852 - protein, 17 aa, Homo sapiens
  heavy chain complementarity determining region 3 for antibody 53426
AREYYDILTGYWGYFDY

SEQ ID NO: 106853 - protein, 9 aa, Homo sapiens
  light chain complementarity determining region 3 for antibody 53427
QQCDSYPYT

SEQ ID NO: 106854 - protein, 18 aa, Homo sapiens
  heavy chain complementarity determining region 3 for antibody 53427
ARERRDDILTGYFDAFDI

SEQ ID NO: 106855 - protein, 9 aa, Homo sapiens
  light chain complementarity determining region 3 for antibody 53428
QKYNSAPYT

SEQ ID NO: 106856 - protein, 17 aa, Homo sapiens
  heavy chain complementarity determining region 3 for antibody 53428
ATALWFGELNYYYGMDV

SEQ ID NO: 106857 - protein, 9 aa, Homo sapiens
  light chain complementarity determining region 3 for antibody 53429
QKYNSAPLT

SEQ ID NO: 106858 - protein, 8 aa, Homo sapiens
  heavy chain complementarity determining region 3 for antibody 53429
ARSGPLDY

SEQ ID NO: 106859 - protein, 9 aa, Homo sapiens
  light chain complementarity determining region 3 for antibody 53430
LQHNSYPLT

SEQ ID NO: 106860 - protein, 22 aa, Homo sapiens
  heavy chain complementarity determining region 3 for antibody 53430
ARGDYDILTGYRGYSSYYGMDV

SEQ ID NO: 106861 - protein, 9 aa, Homo sapiens
  light chain complementarity determining region 3 for antibody 53431
LQHNSYPLT

SEQ ID NO: 106862 - protein, 17 aa, Homo sapiens
  heavy chain complementarity determining region 3 for antibody 53431
AREWGVRGVIISNYFDY

SEQ ID NO: 106863 - protein, 9 aa, Homo sapiens
  light chain complementarity determining region 3 for antibody 53432
LQDYNYPWT

SEQ ID NO: 106864 - protein, 19 aa, Homo sapiens
  heavy chain complementarity determining region 3 for antibody 53432
ARDGGVRGVPYYYYYGMDV

SEQ ID NO: 106865 - protein, 9 aa, Homo sapiens
  light chain complementarity determining region 3 for antibody 53433
HQSSSLPYT

SEQ ID NO: 106866 - protein, 15 aa, Homo sapiens
  heavy chain complementarity determining region 3 for antibody 53433
AKGEQLGYYYYGMDV

SEQ ID NO: 106867 - protein, 9 aa, Homo sapiens
  light chain complementarity determining region 3 for antibody 53434
HQSSSLPFT

SEQ ID NO: 106868 - protein, 11 aa, Homo sapiens
  heavy chain complementarity determining region 3 for antibody 53434
ARFLWFGGFDY

SEQ ID NO: 106869 - protein, 9 aa, Homo sapiens
  light chain complementarity determining region 3 for antibody 53435
QQYNSYPWT

SEQ ID NO: 106870 - protein, 15 aa, Homo sapiens
  heavy chain complementarity determining region 3 for antibody 53435
ARDPKYSYGSDAFDI

SEQ ID NO: 106871 - protein, 9 aa, Homo sapiens
  light chain complementarity determining region 3 for antibody 53436
QQLNSYPPT

SEQ ID NO: 106872 - protein, 17 aa, Homo sapiens
  heavy chain complementarity determining region 3 for antibody 53436
ARRNYDILTGSYNWFDP

SEQ ID NO: 106873 - protein, 9 aa, Homo sapiens
  light chain complementarity determining region 3 for antibody 53437
QQFNNYMYT

SEQ ID NO: 106874 - protein, 12 aa, Homo sapiens
  heavy chain complementarity determining region 3 for antibody 53437
ARQGYGDYYFDY

SEQ ID NO: 106875 - protein, 9 aa, Homo sapiens
  light chain complementarity determining region 3 for antibody 53438
LQDYNYPYT

SEQ ID NO: 106876 - protein, 15 aa, Homo sapiens
  heavy chain complementarity determining region 3 for antibody 53438
ARGSPNWGSGWYFDL

SEQ ID NO: 106877 - protein, 9 aa, Homo sapiens
  light chain complementarity determining region 3 for antibody 53439
HQSSSLPFT

SEQ ID NO: 106878 - protein, 11 aa, Homo sapiens
  heavy chain complementarity determining region 3 for antibody 53439
ARLLWSGGFDY

SEQ ID NO: 106879 - protein, 9 aa, Homo sapiens
  light chain complementarity determining region 3 for antibody 53440
QQYNSYPLT

SEQ ID NO: 106880 - protein, 13 aa, Homo sapiens
  heavy chain complementarity determining region 3 for antibody 53440
ARLDSSGWYAMDV

SEQ ID NO: 106881 - protein, 9 aa, Homo sapiens
  light chain complementarity determining region 3 for antibody 53441
QQYNNWPLT

SEQ ID NO: 106882 - protein, 14 aa, Homo sapiens
  heavy chain complementarity determining region 3 for antibody 53441
ARGYYDILTGFFDY

SEQ ID NO: 106883 - protein, 9 aa, Homo sapiens
  light chain complementarity determining region 3 for antibody 53442
QQYNNWPFT

SEQ ID NO: 106884 - protein, 14 aa, Homo sapiens
  heavy chain complementarity determining region 3 for antibody 53442
ARGGHYYDQGWFDP

SEQ ID NO: 106885 - protein, 9 aa, Homo sapiens
  light chain complementarity determining region 3 for antibody 53443
QQYISYPFT

SEQ ID NO: 106886 - protein, 13 aa, Homo sapiens
  heavy chain complementarity determining region 3 for antibody 53443
AADHGDYQYYFDY

SEQ ID NO: 106887 - protein, 9 aa, Homo sapiens
  light chain complementarity determining region 3 for antibody 53444
QQYGSSPLT

SEQ ID NO: 106888 - protein, 12 aa, Homo sapiens
  heavy chain complementarity determining region 3 for antibody 53444
ATGLLWFGESDY

SEQ ID NO: 106889 - protein, 9 aa, Homo sapiens
  light chain complementarity determining region 3 for antibody 53445
QQSYSTPYT

SEQ ID NO: 106890 - protein, 14 aa, Homo sapiens
  heavy chain complementarity determining region 3 for antibody 53445
ARDRTVATIGYFAY

SEQ ID NO: 106891 - protein, 10 aa, Homo sapiens
  light chain complementarity determining region 3 for antibody 53446
QQRSNWPPFT

SEQ ID NO: 106892 - protein, 12 aa, Homo sapiens
  heavy chain complementarity determining region 3 for antibody 53446
ARDSRPLLSFDY

SEQ ID NO: 106893 - protein, 9 aa, Homo sapiens
  light chain complementarity determining region 3 for antibody 53447
QQLNSYPYT

SEQ ID NO: 106894 - protein, 9 aa, Homo sapiens
  heavy chain complementarity determining region 3 for antibody 53447
ARKRWSFDL

SEQ ID NO: 106895 - protein, 9 aa, Homo sapiens
  light chain complementarity determining region 3 for antibody 53448
QQFNNYPST

SEQ ID NO: 106896 - protein, 11 aa, Homo sapiens
  heavy chain complementarity determining region 3 for antibody 53448
ARGDYGEAFDI

SEQ ID NO: 106897 - protein, 9 aa, Homo sapiens
  light chain complementarity determining region 3 for antibody 53449
LQHNSYPWT

SEQ ID NO: 106898 - protein, 12 aa, Homo sapiens
  heavy chain complementarity determining region 3 for antibody 53449
TRHHIVGATGDY

SEQ ID NO: 106899 - protein, 9 aa, Homo sapiens
  light chain complementarity determining region 3 for antibody 53450
LQHNSYPLT

SEQ ID NO: 106900 - protein, 22 aa, Homo sapiens
  heavy chain complementarity determining region 3 for antibody 53450
ARGEYDILTGYRGYYSYYGMDV

SEQ ID NO: 106901 - protein, 9 aa, Homo sapiens
  light chain complementarity determining region 3 for antibody 53451
QQYNSYPST

SEQ ID NO: 106902 - protein, 9 aa, Homo sapiens
  heavy chain complementarity determining region 3 for antibody 53451
ARKKLVFDY

SEQ ID NO: 106903 - protein, 9 aa, Homo sapiens
  light chain complementarity determining region 3 for antibody 53452
QQYNIYPYT

SEQ ID NO: 106904 - protein, 16 aa, Homo sapiens
  heavy chain complementarity determining region 3 for antibody 53452
AREDDILTGYYNHFDY

SEQ ID NO: 106905 - protein, 9 aa, Homo sapiens
  light chain complementarity determining region 3 for antibody 53453
QQLNSYPYT

SEQ ID NO: 106906 - protein, 18 aa, Homo sapiens
  heavy chain complementarity determining region 3 for antibody 53453
ARAEVDYDILTGYYPFDY

SEQ ID NO: 106907 - protein, 9 aa, Homo sapiens
  light chain complementarity determining region 3 for antibody 53454
QQLNSYPFT

SEQ ID NO: 106908 - protein, 19 aa, Homo sapiens
  heavy chain complementarity determining region 3 for antibody 53454
ARDPAYYDILTGSSDAFDI

SEQ ID NO: 106909 - protein, 9 aa, Homo sapiens
  light chain complementarity determining region 3 for antibody 53455
QKYNSAPYT

SEQ ID NO: 106910 - protein, 14 aa, Homo sapiens
  heavy chain complementarity determining region 3 for antibody 53455
ARGGGAKGSYGMDV

SEQ ID NO: 106911 - protein, 9 aa, Homo sapiens
  light chain complementarity determining region 3 for antibody 53456
QKYNSAPLT

SEQ ID NO: 106912 - protein, 8 aa, Homo sapiens
  heavy chain complementarity determining region 3 for antibody 53456
ARPGPLDY

SEQ ID NO: 106913 - protein, 9 aa, Homo sapiens
  light chain complementarity determining region 3 for antibody 53457
LQDYNYPYT

SEQ ID NO: 106914 - protein, 13 aa, Homo sapiens
  heavy chain complementarity determining region 3 for antibody 53457
ARDEYYYGSGLDY

SEQ ID NO: 106915 - protein, 9 aa, Homo sapiens
  light chain complementarity determining region 3 for antibody 53458
LQDYNYPFT

SEQ ID NO: 106916 - protein, 10 aa, Homo sapiens
  heavy chain complementarity determining region 3 for antibody 53458
ARDGGDYFDY

SEQ ID NO: 106917 - protein, 9 aa, Homo sapiens
  light chain complementarity determining region 3 for antibody 53459
HQSSTLPHT

SEQ ID NO: 106918 - protein, 8 aa, Homo sapiens
  heavy chain complementarity determining region 3 for antibody 53459
ARNWGFDY

SEQ ID NO: 106919 - protein, 9 aa, Homo sapiens
  light chain complementarity determining region 3 for antibody 53460
HQSSSLPYT

SEQ ID NO: 106920 - protein, 14 aa, Homo sapiens
  heavy chain complementarity determining region 3 for antibody 53460
AKEGQQLVRGYFDY

SEQ ID NO: 106921 - protein, 9 aa, Homo sapiens
  light chain complementarity determining region 3 for antibody 53461
QQYNSYPYT

SEQ ID NO: 106922 - protein, 17 aa, Homo sapiens
  heavy chain complementarity determining region 3 for antibody 53461
AREHYDILTGYWNYFDY

SEQ ID NO: 106923 - protein, 9 aa, Homo sapiens
  light chain complementarity determining region 3 for antibody 53462
QQYNSYPLT

SEQ ID NO: 106924 - protein, 11 aa, Homo sapiens
  heavy chain complementarity determining region 3 for antibody 53462
ATYYGSGSRGV

SEQ ID NO: 106925 - protein, 9 aa, Homo sapiens
  light chain complementarity determining region 3 for antibody 53463
QQSYSTPYT

SEQ ID NO: 106926 - protein, 15 aa, Homo sapiens
  heavy chain complementarity determining region 3 for antibody 53463
ARDYYGSGSYDAFDI

SEQ ID NO: 106927 - protein, 9 aa, Homo sapiens
  light chain complementarity determining region 3 for antibody 53464
QQLNSYPYT

SEQ ID NO: 106928 - protein, 13 aa, Homo sapiens
  heavy chain complementarity determining region 3 for antibody 53464
ARDPSMVRGPFDI

SEQ ID NO: 106929 - protein, 9 aa, Homo sapiens
  light chain complementarity determining region 3 for antibody 53465
QQFNNYPLT

SEQ ID NO: 106930 - protein, 18 aa, Homo sapiens
  heavy chain complementarity determining region 3 for antibody 53465
AKDRRVRGVTYYYYGMDV

SEQ ID NO: 106931 - protein, 9 aa, Homo sapiens
  light chain complementarity determining region 3 for antibody 53466
QQFNNYPFT

SEQ ID NO: 106932 - protein, 15 aa, Homo sapiens
  heavy chain complementarity determining region 3 for antibody 53466
ARDRLWFGELSPFDY

SEQ ID NO: 106933 - protein, 9 aa, Homo sapiens
  light chain complementarity determining region 3 for antibody 53467
QKYNSAPLT

SEQ ID NO: 106934 - protein, 8 aa, Homo sapiens
  heavy chain complementarity determining region 3 for antibody 53467
ARTGALDY

SEQ ID NO: 106935 - protein, 9 aa, Homo sapiens
  light chain complementarity determining region 3 for antibody 53468
LQHNSYPYT

SEQ ID NO: 106936 - protein, 18 aa, Homo sapiens
  heavy chain complementarity determining region 3 for antibody 53468
ARVYDILTGYYNGASLDY

SEQ ID NO: 106937 - protein, 9 aa, Homo sapiens
  light chain complementarity determining region 3 for antibody 53469
LQHNSYPLT

SEQ ID NO: 106938 - protein, 11 aa, Homo sapiens
  heavy chain complementarity determining region 3 for antibody 53469
ARDMVRGVIDS

SEQ ID NO: 106939 - protein, 9 aa, Homo sapiens
  light chain complementarity determining region 3 for antibody 53470
LQDYNYPYT

SEQ ID NO: 106940 - protein, 16 aa, Homo sapiens
  heavy chain complementarity determining region 3 for antibody 53470
ARARGYSGYDFDAFDI

SEQ ID NO: 106941 - protein, 9 aa, Homo sapiens
  light chain complementarity determining region 3 for antibody 53471
LQDYNYPWT

SEQ ID NO: 106942 - protein, 17 aa, Homo sapiens
  heavy chain complementarity determining region 3 for antibody 53471
ARDPLTGIYYYYYGMDV

SEQ ID NO: 106943 - protein, 9 aa, Homo sapiens
  light chain complementarity determining region 3 for antibody 53472
LQDYLYPPT

SEQ ID NO: 106944 - protein, 15 aa, Homo sapiens
  heavy chain complementarity determining region 3 for antibody 53472
ARDLWYSGRSYGMDV

SEQ ID NO: 106945 - protein, 9 aa, Homo sapiens
  light chain complementarity determining region 3 for antibody 53473
QRYNSYPYT

SEQ ID NO: 106946 - protein, 17 aa, Homo sapiens
  heavy chain complementarity determining region 3 for antibody 53473
ARLVLRYSDWLLPHFDY

SEQ ID NO: 106947 - protein, 9 aa, Homo sapiens
  light chain complementarity determining region 3 for antibody 53474
QQYYSYPYT

SEQ ID NO: 106948 - protein, 11 aa, Homo sapiens
  heavy chain complementarity determining region 3 for antibody 53474
ARAVGATPFDY

SEQ ID NO: 106949 - protein, 9 aa, Homo sapiens
  light chain complementarity determining region 3 for antibody 53475
QQYISYPFT

SEQ ID NO: 106950 - protein, 13 aa, Homo sapiens
  heavy chain complementarity determining region 3 for antibody 53475
AADYGGYQYYFDY

SEQ ID NO: 106951 - protein, 9 aa, Homo sapiens
  light chain complementarity determining region 3 for antibody 53476
QQLNSYPFT

SEQ ID NO: 106952 - protein, 15 aa, Homo sapiens
  heavy chain complementarity determining region 3 for antibody 53476
ARDPDYDILSPPLDL

SEQ ID NO: 106953 - protein, 8 aa, Homo sapiens
  light chain complementarity determining region 3 for antibody 53477
QDYNYPWT

SEQ ID NO: 106954 - protein, 13 aa, Homo sapiens
  heavy chain complementarity determining region 3 for antibody 53477
ARAGYSGSYLFDY

SEQ ID NO: 106955 - protein, 9 aa, Homo sapiens
  light chain complementarity determining region 3 for antibody 53478
MQALQTPWT

SEQ ID NO: 106956 - protein, 14 aa, Homo sapiens
  heavy chain complementarity determining region 3 for antibody 53478
ARSSGSYYYYGMDV

SEQ ID NO: 106957 - protein, 9 aa, Homo sapiens
  light chain complementarity determining region 3 for antibody 53479
LQHNSYPYT

SEQ ID NO: 106958 - protein, 17 aa, Homo sapiens
  heavy chain complementarity determining region 3 for antibody 53479
AKDQWELLLAYYYGIDV

SEQ ID NO: 106959 - protein, 9 aa, Homo sapiens
  light chain complementarity determining region 3 for antibody 53480
LQHNSYPYT

SEQ ID NO: 106960 - protein, 13 aa, Homo sapiens
  heavy chain complementarity determining region 3 for antibody 53480
AADYGDYQYYFDY

SEQ ID NO: 106961 - protein, 9 aa, Homo sapiens
  light chain complementarity determining region 3 for antibody 53481
LQHNSYPLT

SEQ ID NO: 106962 - protein, 22 aa, Homo sapiens
  heavy chain complementarity determining region 3 for antibody 53481
ARGDYDILTGDRGYYSYYGMDV

SEQ ID NO: 106963 - protein, 9 aa, Homo sapiens
  light chain complementarity determining region 3 for antibody 53482
LQDYTYPWT

SEQ ID NO: 106964 - protein, 13 aa, Homo sapiens
  heavy chain complementarity determining region 3 for antibody 53482
AKAGSYYVGYFDD

SEQ ID NO: 106965 - protein, 9 aa, Homo sapiens
  light chain complementarity determining region 3 for antibody 53483
LQDYNYPYT

SEQ ID NO: 106966 - protein, 17 aa, Homo sapiens
  heavy chain complementarity determining region 3 for antibody 53483
ARGIAVAGTLHYYGMDV

SEQ ID NO: 106967 - protein, 9 aa, Homo sapiens
  light chain complementarity determining region 3 for antibody 53484
LQDYNYPYT

SEQ ID NO: 106968 - protein, 17 aa, Homo sapiens
  heavy chain complementarity determining region 3 for antibody 53484
ARDPYYDILTGYSLFDY

SEQ ID NO: 106969 - protein, 9 aa, Homo sapiens
  light chain complementarity determining region 3 for antibody 53485
LQDYNYPWT

SEQ ID NO: 106970 - protein, 12 aa, Homo sapiens
  heavy chain complementarity determining region 3 for antibody 53485
ARDGDTMVRGVD

SEQ ID NO: 106971 - protein, 9 aa, Homo sapiens
  light chain complementarity determining region 3 for antibody 53486
QQYNTYPLT

SEQ ID NO: 106972 - protein, 19 aa, Homo sapiens
  heavy chain complementarity determining region 3 for antibody 53486
AREGGGSGSPYYYYYSMDV

SEQ ID NO: 106973 - protein, 9 aa, Homo sapiens
  light chain complementarity determining region 3 for antibody 53487
QQYNSLPFT

SEQ ID NO: 106974 - protein, 17 aa, Homo sapiens
  heavy chain complementarity determining region 3 for antibody 53487
AREYNDILTGYWGYFDY

SEQ ID NO: 106975 - protein, 9 aa, Homo sapiens
  light chain complementarity determining region 3 for antibody 53488
QQYNSFPFT

SEQ ID NO: 106976 - protein, 17 aa, Homo sapiens
  heavy chain complementarity determining region 3 for antibody 53488
AREYSDILTGYWGYFDY

SEQ ID NO: 106977 - protein, 9 aa, Homo sapiens
  light chain complementarity determining region 3 for antibody 53489
QQYNNWPRT

SEQ ID NO: 106978 - protein, 12 aa, Homo sapiens
  heavy chain complementarity determining region 3 for antibody 53489
AREWAPGTTRDY

SEQ ID NO: 106979 - protein, 9 aa, Homo sapiens
  light chain complementarity determining region 3 for antibody 53490
QQLNSYRRT

SEQ ID NO: 106980 - protein, 13 aa, Homo sapiens
  heavy chain complementarity determining region 3 for antibody 53490
AKEMGQWLYYFDY

SEQ ID NO: 106981 - protein, 9 aa, Homo sapiens
  light chain complementarity determining region 3 for antibody 53491
QQLNSYPYT

SEQ ID NO: 106982 - protein, 14 aa, Homo sapiens
  heavy chain complementarity determining region 3 for antibody 53491
ARRNFDWFYDAFDI

SEQ ID NO: 106983 - protein, 9 aa, Homo sapiens
  light chain complementarity determining region 3 for antibody 53492
QQLNSYPRT

SEQ ID NO: 106984 - protein, 10 aa, Homo sapiens
  heavy chain complementarity determining region 3 for antibody 53492
ARVWFGAVDY

SEQ ID NO: 106985 - protein, 9 aa, Homo sapiens
  light chain complementarity determining region 3 for antibody 53493
QQLNSYPPT

SEQ ID NO: 106986 - protein, 13 aa, Homo sapiens
  heavy chain complementarity determining region 3 for antibody 53493
ARLSIAVAGLFDY

SEQ ID NO: 106987 - protein, 9 aa, Homo sapiens
  light chain complementarity determining region 3 for antibody 53494
LQHNSYPWT

SEQ ID NO: 106988 - protein, 17 aa, Homo sapiens
  heavy chain complementarity determining region 3 for antibody 53494
ARTYYDILTGYSYGMDV

SEQ ID NO: 106989 - protein, 9 aa, Homo sapiens
  light chain complementarity determining region 3 for antibody 53495
LQDYNYPYT

SEQ ID NO: 106990 - protein, 21 aa, Homo sapiens
  heavy chain complementarity determining region 3 for antibody 53495
AKDGPTMVRGVMGYYYYGMDV

SEQ ID NO: 106991 - protein, 9 aa, Homo sapiens
  light chain complementarity determining region 3 for antibody 53496
LQDYNYPYT

SEQ ID NO: 106992 - protein, 13 aa, Homo sapiens
  heavy chain complementarity determining region 3 for antibody 53496
AADYGDYQYYFDY

SEQ ID NO: 106993 - protein, 9 aa, Homo sapiens
  light chain complementarity determining region 3 for antibody 53497
LQDYNYPWT

SEQ ID NO: 106994 - protein, 16 aa, Homo sapiens
  heavy chain complementarity determining region 3 for antibody 53497
ATGIVGATTPYDAFDI

SEQ ID NO: 106995 - protein, 9 aa, Homo sapiens
  light chain complementarity determining region 3 for antibody 53498
LQDYNYPWT

SEQ ID NO: 106996 - protein, 17 aa, Homo sapiens
  heavy chain complementarity determining region 3 for antibody 53498
ARSSSSWYEDFYYGLDV

SEQ ID NO: 106997 - protein, 9 aa, Homo sapiens
  light chain complementarity determining region 3 for antibody 53499
LQDYNYPWT

SEQ ID NO: 106998 - protein, 18 aa, Homo sapiens
  heavy chain complementarity determining region 3 for antibody 53499
ARSSFDWLSHYYYYGMDV

SEQ ID NO: 106999 - protein, 9 aa, Homo sapiens
  light chain complementarity determining region 3 for antibody 53500
QQYNSYPYT

SEQ ID NO: 107000 - protein, 17 aa, Homo sapiens
  heavy chain complementarity determining region 3 for antibody 53500
AGEYYYGSGSYYGNFDY

SEQ ID NO: 107001 - protein, 9 aa, Homo sapiens
  light chain complementarity determining region 3 for antibody 53501
QQYNNWPRT

SEQ ID NO: 107002 - protein, 12 aa, Homo sapiens
  heavy chain complementarity determining region 3 for antibody 53501
AREWEPGTARDY

SEQ ID NO: 107003 - protein, 9 aa, Homo sapiens
  light chain complementarity determining region 3 for antibody 53502
QQYNNWPRT

SEQ ID NO: 107004 - protein, 12 aa, Homo sapiens
  heavy chain complementarity determining region 3 for antibody 53502
AREDIVATHFDY

SEQ ID NO: 107005 - protein, 9 aa, Homo sapiens
  light chain complementarity determining region 3 for antibody 53503
QQLNSYPYT

SEQ ID NO: 107006 - protein, 25 aa, Homo sapiens
  heavy chain complementarity determining region 3 for antibody 53503
ARDRSHYYGSGSSKSHYYYYYGMDV

SEQ ID NO: 107007 - protein, 9 aa, Homo sapiens
  light chain complementarity determining region 3 for antibody 53504
QQFNNYPST

SEQ ID NO: 107008 - protein, 16 aa, Homo sapiens
  heavy chain complementarity determining region 3 for antibody 53504
ARDRNSGSLYYYGMDV

SEQ ID NO: 107009 - protein, 9 aa, Homo sapiens
  light chain complementarity determining region 3 for antibody 53505
QQFNNYPHT

SEQ ID NO: 107010 - protein, 15 aa, Homo sapiens
  heavy chain complementarity determining region 3 for antibody 53505
AREGKWFGELSIFGY

SEQ ID NO: 107011 - protein, 9 aa, Homo sapiens
  light chain complementarity determining region 3 for antibody 53506
MQGTHWPYT

SEQ ID NO: 107012 - protein, 13 aa, Homo sapiens
  heavy chain complementarity determining region 3 for antibody 53506
ARDIVVPAAIIDY

SEQ ID NO: 107013 - protein, 9 aa, Homo sapiens
  light chain complementarity determining region 3 for antibody 53507
LQHNSYPYT

SEQ ID NO: 107014 - protein, 16 aa, Homo sapiens
  heavy chain complementarity determining region 3 for antibody 53507
AREGVLWFGELKGMDV

SEQ ID NO: 107015 - protein, 9 aa, Homo sapiens
  light chain complementarity determining region 3 for antibody 53508
LQHNSYPYT

SEQ ID NO: 107016 - protein, 12 aa, Homo sapiens
  heavy chain complementarity determining region 3 for antibody 53508
ARDQGSADAFDI

SEQ ID NO: 107017 - protein, 9 aa, Homo sapiens
  light chain complementarity determining region 3 for antibody 53509
LQHNSYPWT

SEQ ID NO: 107018 - protein, 14 aa, Homo sapiens
  heavy chain complementarity determining region 3 for antibody 53509
ARSGTPYYYYGMDV

SEQ ID NO: 107019 - protein, 9 aa, Homo sapiens
  light chain complementarity determining region 3 for antibody 53510
LQHNSYPPT

SEQ ID NO: 107020 - protein, 19 aa, Homo sapiens
  heavy chain complementarity determining region 3 for antibody 53510
ARDSITMVRGVIDYYGMDV

SEQ ID NO: 107021 - protein, 10 aa, Homo sapiens
  light chain complementarity determining region 3 for antibody 53511
LQHDNFPLYT

SEQ ID NO: 107022 - protein, 14 aa, Homo sapiens
  heavy chain complementarity determining region 3 for antibody 53511
ARDRTTGTRGLFDY

SEQ ID NO: 107023 - protein, 9 aa, Homo sapiens
  light chain complementarity determining region 3 for antibody 53512
LQDYSYPWT

SEQ ID NO: 107024 - protein, 17 aa, Homo sapiens
  heavy chain complementarity determining region 3 for antibody 53512
AREGTLVRGGYYYGMDV

SEQ ID NO: 107025 - protein, 9 aa, Homo sapiens
  light chain complementarity determining region 3 for antibody 53513
LQDYNYPYT

SEQ ID NO: 107026 - protein, 15 aa, Homo sapiens
  heavy chain complementarity determining region 3 for antibody 53513
ARDRPYYDILTGFDY

SEQ ID NO: 107027 - protein, 9 aa, Homo sapiens
  light chain complementarity determining region 3 for antibody 53514
QQYYSYPRT

SEQ ID NO: 107028 - protein, 11 aa, Homo sapiens
  heavy chain complementarity determining region 3 for antibody 53514
AREVGATVFDY

SEQ ID NO: 107029 - protein, 9 aa, Homo sapiens
  light chain complementarity determining region 3 for antibody 53515
QQYNSYPYT

SEQ ID NO: 107030 - protein, 10 aa, Homo sapiens
  heavy chain complementarity determining region 3 for antibody 53515
AREGGGYLWY

SEQ ID NO: 107031 - protein, 9 aa, Homo sapiens
  light chain complementarity determining region 3 for antibody 53516
QQSYSTPLT

SEQ ID NO: 107032 - protein, 15 aa, Homo sapiens
  heavy chain complementarity determining region 3 for antibody 53516
ARDEGGILTGYYFDY

SEQ ID NO: 107033 - protein, 9 aa, Homo sapiens
  light chain complementarity determining region 3 for antibody 53517
QQLNSYPYT

SEQ ID NO: 107034 - protein, 9 aa, Homo sapiens
  heavy chain complementarity determining region 3 for antibody 53517
ARNRWYFDL

SEQ ID NO: 107035 - protein, 9 aa, Homo sapiens
  light chain complementarity determining region 3 for antibody 53518
QQLNSYPYT

SEQ ID NO: 107036 - protein, 9 aa, Homo sapiens
  heavy chain complementarity determining region 3 for antibody 53518
ARKSWYFDL

SEQ ID NO: 107037 - protein, 9 aa, Homo sapiens
  light chain complementarity determining region 3 for antibody 53519
QQLNSYPYT

SEQ ID NO: 107038 - protein, 9 aa, Homo sapiens
  heavy chain complementarity determining region 3 for antibody 53519
ARKRWYFEL

SEQ ID NO: 107039 - protein, 9 aa, Homo sapiens
  light chain complementarity determining region 3 for antibody 53520
QQLNSYPYT

SEQ ID NO: 107040 - protein, 9 aa, Homo sapiens
  heavy chain complementarity determining region 3 for antibody 53520
ARKRWDFDL

SEQ ID NO: 107041 - protein, 9 aa, Homo sapiens
  light chain complementarity determining region 3 for antibody 53521
QQLNSYPWT

SEQ ID NO: 107042 - protein, 13 aa, Homo sapiens
  heavy chain complementarity determining region 3 for antibody 53521
ARARYSGYAGFDY

SEQ ID NO: 107043 - protein, 9 aa, Homo sapiens
  light chain complementarity determining region 3 for antibody 53522
QQLNSYPPT

SEQ ID NO: 107044 - protein, 13 aa, Homo sapiens
  heavy chain complementarity determining region 3 for antibody 53522
AADYGAYQYYFDY

SEQ ID NO: 107045 - protein, 9 aa, Homo sapiens
  light chain complementarity determining region 3 for antibody 53523
QQLNSYPFT

SEQ ID NO: 107046 - protein, 9 aa, Homo sapiens
  heavy chain complementarity determining region 3 for antibody 53523
ARKRWYLDL

SEQ ID NO: 107047 - protein, 9 aa, Homo sapiens
  light chain complementarity determining region 3 for antibody 53524
LQHNSYPPT

SEQ ID NO: 107048 - protein, 13 aa, Homo sapiens
  heavy chain complementarity determining region 3 for antibody 53524
ATERGYSYGLFDY

SEQ ID NO: 107049 - protein, 9 aa, Homo sapiens
  light chain complementarity determining region 3 for antibody 53525
LQHNSYPLT

SEQ ID NO: 107050 - protein, 22 aa, Homo sapiens
  heavy chain complementarity determining region 3 for antibody 53525
ARGDYDILAGYRGYYSYYGMDV

SEQ ID NO: 107051 - protein, 9 aa, Homo sapiens
  light chain complementarity determining region 3 for antibody 53526
LQHNSYPLT

SEQ ID NO: 107052 - protein, 16 aa, Homo sapiens
  heavy chain complementarity determining region 3 for antibody 53526
ARDIYYGSGSYYAFDI

SEQ ID NO: 107053 - protein, 9 aa, Homo sapiens
  light chain complementarity determining region 3 for antibody 53527
LQDYNYPYT

SEQ ID NO: 107054 - protein, 15 aa, Homo sapiens
  heavy chain complementarity determining region 3 for antibody 53527
ARRDYYGSGSDAFDI

SEQ ID NO: 107055 - protein, 9 aa, Homo sapiens
  light chain complementarity determining region 3 for antibody 53528
LQDYNYPYT

SEQ ID NO: 107056 - protein, 14 aa, Homo sapiens
  heavy chain complementarity determining region 3 for antibody 53528
AKDSGYSGYSFFDY

SEQ ID NO: 107057 - protein, 9 aa, Homo sapiens
  light chain complementarity determining region 3 for antibody 53529
LQDYNYPWT

SEQ ID NO: 107058 - protein, 9 aa, Homo sapiens
  heavy chain complementarity determining region 3 for antibody 53529
ARDVGPFDY

SEQ ID NO: 107059 - protein, 9 aa, Homo sapiens
  light chain complementarity determining region 3 for antibody 53530
LQDYNYPWT

SEQ ID NO: 107060 - protein, 16 aa, Homo sapiens
  heavy chain complementarity determining region 3 for antibody 53530
ARDPPRIAAAGTLFDY

SEQ ID NO: 107061 - protein, 9 aa, Homo sapiens
  light chain complementarity determining region 3 for antibody 53531
LQDYNYPFT

SEQ ID NO: 107062 - protein, 15 aa, Homo sapiens
  heavy chain complementarity determining region 3 for antibody 53531
ARRGGIAVDLYYFDY

SEQ ID NO: 107063 - protein, 9 aa, Homo sapiens
  light chain complementarity determining region 3 for antibody 53532
QRTYNAPWT

SEQ ID NO: 107064 - protein, 11 aa, Homo sapiens
  heavy chain complementarity determining region 3 for antibody 53532
ATDYYGSGSYG

SEQ ID NO: 107065 - protein, 9 aa, Homo sapiens
  light chain complementarity determining region 3 for antibody 53533
QQYNSYPYT

SEQ ID NO: 107066 - protein, 17 aa, Homo sapiens
  heavy chain complementarity determining region 3 for antibody 53533
ARLVLRYSDWLLPRFDY

SEQ ID NO: 107067 - protein, 9 aa, Homo sapiens
  light chain complementarity determining region 3 for antibody 53534
QQYNSYPFT

SEQ ID NO: 107068 - protein, 17 aa, Homo sapiens
  heavy chain complementarity determining region 3 for antibody 53534
AREYYDILTGYWGYFDF

SEQ ID NO: 107069 - protein, 9 aa, Homo sapiens
  light chain complementarity determining region 3 for antibody 53535
QQYNSFPFT

SEQ ID NO: 107070 - protein, 17 aa, Homo sapiens
  heavy chain complementarity determining region 3 for antibody 53535
AREYNDILTGYWGCFDY

SEQ ID NO: 107071 - protein, 8 aa, Homo sapiens
  light chain complementarity determining region 3 for antibody 53536
QQYGSSLT

SEQ ID NO: 107072 - protein, 18 aa, Homo sapiens
  heavy chain complementarity determining region 3 for antibody 53536
AKGGLYYYGSGSYFPFDY

SEQ ID NO: 107073 - protein, 9 aa, Homo sapiens
  light chain complementarity determining region 3 for antibody 53537
QQLNSYPYT

SEQ ID NO: 107074 - protein, 17 aa, Homo sapiens
  heavy chain complementarity determining region 3 for antibody 53537
ARLVLRYSDWLLPHFDY

SEQ ID NO: 107075 - protein, 9 aa, Homo sapiens
  light chain complementarity determining region 3 for antibody 53538
QQLNSYPYT

SEQ ID NO: 107076 - protein, 14 aa, Homo sapiens
  heavy chain complementarity determining region 3 for antibody 53538
ARDLGYSSGRYFDY

SEQ ID NO: 107077 - protein, 9 aa, Homo sapiens
  light chain complementarity determining region 3 for antibody 53539
QQLNSYPWT

SEQ ID NO: 107078 - protein, 16 aa, Homo sapiens
  heavy chain complementarity determining region 3 for antibody 53539
ARVPYYYGSGSYLFDY

SEQ ID NO: 107079 - protein, 9 aa, Homo sapiens
  light chain complementarity determining region 3 for antibody 53540
QQLNSYPLT

SEQ ID NO: 107080 - protein, 10 aa, Homo sapiens
  heavy chain complementarity determining region 3 for antibody 53540
ATGEGDAFDI

SEQ ID NO: 107081 - protein, 9 aa, Homo sapiens
  light chain complementarity determining region 3 for antibody 53541
QQLNNYPRT

SEQ ID NO: 107082 - protein, 22 aa, Homo sapiens
  heavy chain complementarity determining region 3 for antibody 53541
SRGDYDILTGYSSYYYYYGMDV

SEQ ID NO: 107083 - protein, 9 aa, Homo sapiens
  light chain complementarity determining region 3 for antibody 53542
QQFNNYPLT

SEQ ID NO: 107084 - protein, 15 aa, Homo sapiens
  heavy chain complementarity determining region 3 for antibody 53542
ARDRLWFGELTSFDY

SEQ ID NO: 107085 - protein, 8 aa, Homo sapiens
  light chain complementarity determining region 3 for antibody 53543
QQANSFLT

SEQ ID NO: 107086 - protein, 17 aa, Homo sapiens
  heavy chain complementarity determining region 3 for antibody 53543
ARCIAAAGYYYYYGMDV

SEQ ID NO: 107087 - protein, 9 aa, Homo sapiens
  light chain complementarity determining region 3 for antibody 53544
QKYSSAPLT

SEQ ID NO: 107088 - protein, 8 aa, Homo sapiens
  heavy chain complementarity determining region 3 for antibody 53544
ARTGPLDY

SEQ ID NO: 107089 - protein, 9 aa, Homo sapiens
  light chain complementarity determining region 3 for antibody 53545
LQHNSHPLT

SEQ ID NO: 107090 - protein, 22 aa, Homo sapiens
  heavy chain complementarity determining region 3 for antibody 53545
ARGDYDILTGYRGYYSYYGMDV

SEQ ID NO: 107091 - protein, 9 aa, Homo sapiens
  light chain complementarity determining region 3 for antibody 53546
LQHDNFPYT

SEQ ID NO: 107092 - protein, 13 aa, Homo sapiens
  heavy chain complementarity determining region 3 for antibody 53546
ARGRYFASYGMDV

SEQ ID NO: 107093 - protein, 9 aa, Homo sapiens
  light chain complementarity determining region 3 for antibody 53547
LQDYNYPYT

SEQ ID NO: 107094 - protein, 19 aa, Homo sapiens
  heavy chain complementarity determining region 3 for antibody 53547
AKDRSGSFGALYNYYGMDV

SEQ ID NO: 107095 - protein, 9 aa, Homo sapiens
  light chain complementarity determining region 3 for antibody 53548
HQSSSLPYT

SEQ ID NO: 107096 - protein, 18 aa, Homo sapiens
  heavy chain complementarity determining region 3 for antibody 53548
ARHPLYSSSWYDEGVFDY

SEQ ID NO: 107097 - protein, 9 aa, Homo sapiens
  light chain complementarity determining region 3 for antibody 53549
HQSSSLMYT

SEQ ID NO: 107098 - protein, 21 aa, Homo sapiens
  heavy chain complementarity determining region 3 for antibody 53549
ARDGSDYYDRSGYYYVGAFDI

SEQ ID NO: 107099 - protein, 9 aa, Homo sapiens
  light chain complementarity determining region 3 for antibody 53550
QQYNSYPYT

SEQ ID NO: 107100 - protein, 15 aa, Homo sapiens
  heavy chain complementarity determining region 3 for antibody 53550
AREGEITMVRGGKDY

SEQ ID NO: 107101 - protein, 9 aa, Homo sapiens
  light chain complementarity determining region 3 for antibody 53551
QQYNSYPYT

SEQ ID NO: 107102 - protein, 15 aa, Homo sapiens
  heavy chain complementarity determining region 3 for antibody 53551
ANVLRYFVGYSVWDV

SEQ ID NO: 107103 - protein, 9 aa, Homo sapiens
  light chain complementarity determining region 3 for antibody 53552
QQYNNWPWT

SEQ ID NO: 107104 - protein, 15 aa, Homo sapiens
  heavy chain complementarity determining region 3 for antibody 53552
ALRYFDWLFLGAFDI

SEQ ID NO: 107105 - protein, 9 aa, Homo sapiens
  light chain complementarity determining region 3 for antibody 53553
QQLNSYPIT

SEQ ID NO: 107106 - protein, 16 aa, Homo sapiens
  heavy chain complementarity determining region 3 for antibody 53553
ARDPDYDILTGPPLDY

SEQ ID NO: 107107 - protein, 9 aa, Homo sapiens
  light chain complementarity determining region 3 for antibody 53554
QQFNNYPFT

SEQ ID NO: 107108 - protein, 17 aa, Homo sapiens
  heavy chain complementarity determining region 3 for antibody 53554
ARDEGKWLVRGYYGMDV

SEQ ID NO: 107109 - protein, 9 aa, Homo sapiens
  light chain complementarity determining region 3 for antibody 53555
QQDYNLPFT

SEQ ID NO: 107110 - protein, 20 aa, Homo sapiens
  heavy chain complementarity determining region 3 for antibody 53555
ARGEYYDILTGYHTPAAFDI

SEQ ID NO: 107111 - protein, 9 aa, Homo sapiens
  light chain complementarity determining region 3 for antibody 53556
QKYNSAPWT

SEQ ID NO: 107112 - protein, 13 aa, Homo sapiens
  heavy chain complementarity determining region 3 for antibody 53556
AADYGDYQYYFDY

SEQ ID NO: 107113 - protein, 9 aa, Homo sapiens
  light chain complementarity determining region 3 for antibody 53557
QKYNSAPLT

SEQ ID NO: 107114 - protein, 8 aa, Homo sapiens
  heavy chain complementarity determining region 3 for antibody 53557
ARAGPLDY

SEQ ID NO: 107115 - protein, 9 aa, Homo sapiens
  light chain complementarity determining region 3 for antibody 53558
QKYNSAPFT

SEQ ID NO: 107116 - protein, 8 aa, Homo sapiens
  heavy chain complementarity determining region 3 for antibody 53558
ARDILTDY

SEQ ID NO: 107117 - protein, 10 aa, Homo sapiens
  light chain complementarity determining region 3 for antibody 53559
MQTLQTPPYT

SEQ ID NO: 107118 - protein, 17 aa, Homo sapiens
  heavy chain complementarity determining region 3 for antibody 53559
ANGDSSSWYNYYYGMDV

SEQ ID NO: 107119 - protein, 9 aa, Homo sapiens
  light chain complementarity determining region 3 for antibody 53560
MQALQTPFT

SEQ ID NO: 107120 - protein, 13 aa, Homo sapiens
  heavy chain complementarity determining region 3 for antibody 53560
ARDRDILTGAFDY

SEQ ID NO: 107121 - protein, 9 aa, Homo sapiens
  light chain complementarity determining region 3 for antibody 53561
LQHNSYPYT

SEQ ID NO: 107122 - protein, 17 aa, Homo sapiens
  heavy chain complementarity determining region 3 for antibody 53561
AREYNDILTGYWGYFDY

SEQ ID NO: 107123 - protein, 9 aa, Homo sapiens
  light chain complementarity determining region 3 for antibody 53562
LQHNSYPWT

SEQ ID NO: 107124 - protein, 11 aa, Homo sapiens
  heavy chain complementarity determining region 3 for antibody 53562
ARTNWGDAFDI

SEQ ID NO: 107125 - protein, 9 aa, Homo sapiens
  light chain complementarity determining region 3 for antibody 53563
LQHNSYPFT

SEQ ID NO: 107126 - protein, 19 aa, Homo sapiens
  heavy chain complementarity determining region 3 for antibody 53563
ARDNDILTGYYQDYYGMDV

SEQ ID NO: 107127 - protein, 9 aa, Homo sapiens
  light chain complementarity determining region 3 for antibody 53564
LQHDNFLWT

SEQ ID NO: 107128 - protein, 12 aa, Homo sapiens
  heavy chain complementarity determining region 3 for antibody 53564
AKEGLEPLYFDY

SEQ ID NO: 107129 - protein, 9 aa, Homo sapiens
  light chain complementarity determining region 3 for antibody 53565
LQDYNYPYT

SEQ ID NO: 107130 - protein, 14 aa, Homo sapiens
  heavy chain complementarity determining region 3 for antibody 53565
ARRYPDYYYYGMDV

SEQ ID NO: 107131 - protein, 9 aa, Homo sapiens
  light chain complementarity determining region 3 for antibody 53566
LQDYNYPRT

SEQ ID NO: 107132 - protein, 10 aa, Homo sapiens
  heavy chain complementarity determining region 3 for antibody 53566
ARRGYYGMDV

SEQ ID NO: 107133 - protein, 9 aa, Homo sapiens
  light chain complementarity determining region 3 for antibody 53567
LQDYNYPRT

SEQ ID NO: 107134 - protein, 18 aa, Homo sapiens
  heavy chain complementarity determining region 3 for antibody 53567
AKDGVVVVTHYYYYGMDV

SEQ ID NO: 107135 - protein, 9 aa, Homo sapiens
  light chain complementarity determining region 3 for antibody 53568
LQDYNYPLT

SEQ ID NO: 107136 - protein, 12 aa, Homo sapiens
  heavy chain complementarity determining region 3 for antibody 53568
TRHHIVGATGDY

SEQ ID NO: 107137 - protein, 9 aa, Homo sapiens
  light chain complementarity determining region 3 for antibody 53569
LQDYNYPFT

SEQ ID NO: 107138 - protein, 15 aa, Homo sapiens
  heavy chain complementarity determining region 3 for antibody 53569
AREGDYYGSGSPLNY

SEQ ID NO: 107139 - protein, 8 aa, Homo sapiens
  light chain complementarity determining region 3 for antibody 53570
HQSSSLPT

SEQ ID NO: 107140 - protein, 17 aa, Homo sapiens
  heavy chain complementarity determining region 3 for antibody 53570
ARETHDILTGYYNPFDY

SEQ ID NO: 107141 - protein, 9 aa, Homo sapiens
  light chain complementarity determining region 3 for antibody 53571
QQYNSYPYT

SEQ ID NO: 107142 - protein, 17 aa, Homo sapiens
  heavy chain complementarity determining region 3 for antibody 53571
ARLVLRYSDWLLPHLDY

SEQ ID NO: 107143 - protein, 9 aa, Homo sapiens
  light chain complementarity determining region 3 for antibody 53572
QQYNSYPYT

SEQ ID NO: 107144 - protein, 17 aa, Homo sapiens
  heavy chain complementarity determining region 3 for antibody 53572
AGLVLRYSDWLLPHFDY

SEQ ID NO: 107145 - protein, 9 aa, Homo sapiens
  light chain complementarity determining region 3 for antibody 53573
QQYNSYPYT

SEQ ID NO: 107146 - protein, 13 aa, Homo sapiens
  heavy chain complementarity determining region 3 for antibody 53573
AADYGDYQYYFDY

SEQ ID NO: 107147 - protein, 9 aa, Homo sapiens
  light chain complementarity determining region 3 for antibody 53574
QQYNSSPLT

SEQ ID NO: 107148 - protein, 11 aa, Homo sapiens
  heavy chain complementarity determining region 3 for antibody 53574
ATFYGSGSRGV

SEQ ID NO: 107149 - protein, 9 aa, Homo sapiens
  light chain complementarity determining region 3 for antibody 53575
QQYNSFPST

SEQ ID NO: 107150 - protein, 17 aa, Homo sapiens
  heavy chain complementarity determining region 3 for antibody 53575
AREYNDILTGYWGYFDY

SEQ ID NO: 107151 - protein, 9 aa, Homo sapiens
  light chain complementarity determining region 3 for antibody 53576
QQYNNWPYT

SEQ ID NO: 107152 - protein, 11 aa, Homo sapiens
  heavy chain complementarity determining region 3 for antibody 53576
AASGSYNWFDP

SEQ ID NO: 107153 - protein, 9 aa, Homo sapiens
  light chain complementarity determining region 3 for antibody 53577
QQYNNWPLT

SEQ ID NO: 107154 - protein, 11 aa, Homo sapiens
  heavy chain complementarity determining region 3 for antibody 53577
AAGYSSSWLDY

SEQ ID NO: 107155 - protein, 9 aa, Homo sapiens
  light chain complementarity determining region 3 for antibody 53578
QQYISYPFT

SEQ ID NO: 107156 - protein, 13 aa, Homo sapiens
  heavy chain complementarity determining region 3 for antibody 53578
AADYGDSQYYFDY

SEQ ID NO: 107157 - protein, 10 aa, Homo sapiens
  light chain complementarity determining region 3 for antibody 53579
QQYGSSPPYT

SEQ ID NO: 107158 - protein, 12 aa, Homo sapiens
  heavy chain complementarity determining region 3 for antibody 53579
ARVGGNYSFFDY

SEQ ID NO: 107159 - protein, 9 aa, Homo sapiens
  light chain complementarity determining region 3 for antibody 53580
QQSYSTPYT

SEQ ID NO: 107160 - protein, 16 aa, Homo sapiens
  heavy chain complementarity determining region 3 for antibody 53580
AKAMVRGVDYYYGMDV

SEQ ID NO: 107161 - protein, 9 aa, Homo sapiens
  light chain complementarity determining region 3 for antibody 53581
QQLNSYPYT

SEQ ID NO: 107162 - protein, 16 aa, Homo sapiens
  heavy chain complementarity determining region 3 for antibody 53581
ARGVRGALYYYYGMDV

SEQ ID NO: 107163 - protein, 8 aa, Homo sapiens
  light chain complementarity determining region 3 for antibody 53582
QQFINYPT

SEQ ID NO: 107164 - protein, 12 aa, Homo sapiens
  heavy chain complementarity determining region 3 for antibody 53582
AREMTVAGYFDY

SEQ ID NO: 107165 - protein, 9 aa, Homo sapiens
  light chain complementarity determining region 3 for antibody 53583
QKYNSAPLT

SEQ ID NO: 107166 - protein, 8 aa, Homo sapiens
  heavy chain complementarity determining region 3 for antibody 53583
ASTGPLDY

SEQ ID NO: 107167 - protein, 9 aa, Homo sapiens
  light chain complementarity determining region 3 for antibody 53584
MQALQTPYT

SEQ ID NO: 107168 - protein, 18 aa, Homo sapiens
  heavy chain complementarity determining region 3 for antibody 53584
AREGYSSGPIYYYYGMDV

SEQ ID NO: 107169 - protein, 9 aa, Homo sapiens
  light chain complementarity determining region 3 for antibody 53585
MQALQTPLT

SEQ ID NO: 107170 - protein, 13 aa, Homo sapiens
  heavy chain complementarity determining region 3 for antibody 53585
ARDDILTGYHLDY

SEQ ID NO: 107171 - protein, 9 aa, Homo sapiens
  light chain complementarity determining region 3 for antibody 53586
LQRDNFPYT

SEQ ID NO: 107172 - protein, 7 aa, Homo sapiens
  heavy chain complementarity determining region 3 for antibody 53586
ARDSGDY

SEQ ID NO: 107173 - protein, 9 aa, Homo sapiens
  light chain complementarity determining region 3 for antibody 53587
LQHNTYPWT

SEQ ID NO: 107174 - protein, 14 aa, Homo sapiens
  heavy chain complementarity determining region 3 for antibody 53587
ARDQYSNGSYYFDY

SEQ ID NO: 107175 - protein, 9 aa, Homo sapiens
  light chain complementarity determining region 3 for antibody 53588
LQHNSYPYT

SEQ ID NO: 107176 - protein, 19 aa, Homo sapiens
  heavy chain complementarity determining region 3 for antibody 53588
ARGNDILTGYYPHYYDMDV

SEQ ID NO: 107177 - protein, 9 aa, Homo sapiens
  light chain complementarity determining region 3 for antibody 53589
LQHNSYPYT

SEQ ID NO: 107178 - protein, 15 aa, Homo sapiens
  heavy chain complementarity determining region 3 for antibody 53589
ARDRLWFGEVDAFDI

SEQ ID NO: 107179 - protein, 9 aa, Homo sapiens
  light chain complementarity determining region 3 for antibody 53590
LQHNSYPYT

SEQ ID NO: 107180 - protein, 8 aa, Homo sapiens
  heavy chain complementarity determining region 3 for antibody 53590
AGDDGMDV

SEQ ID NO: 107181 - protein, 9 aa, Homo sapiens
  light chain complementarity determining region 3 for antibody 53591
LQGFTYPRT

SEQ ID NO: 107182 - protein, 21 aa, Homo sapiens
  heavy chain complementarity determining region 3 for antibody 53591
AREATMVRGVPSADFYYGLDV

SEQ ID NO: 107183 - protein, 9 aa, Homo sapiens
  light chain complementarity determining region 3 for antibody 53592
LQDYNYPRT

SEQ ID NO: 107184 - protein, 22 aa, Homo sapiens
  heavy chain complementarity determining region 3 for antibody 53592
AKDQRAYYYGSGTYRGYYGMDV

SEQ ID NO: 107185 - protein, 9 aa, Homo sapiens
  light chain complementarity determining region 3 for antibody 53593
HQSSVLPHT

SEQ ID NO: 107186 - protein, 8 aa, Homo sapiens
  heavy chain complementarity determining region 3 for antibody 53593
ARNWGFDY

SEQ ID NO: 107187 - protein, 9 aa, Homo sapiens
  light chain complementarity determining region 3 for antibody 53594
QQYNSYPYT

SEQ ID NO: 107188 - protein, 17 aa, Homo sapiens
  heavy chain complementarity determining region 3 for antibody 53594
ARLVLRHSDWLLPHFDY

SEQ ID NO: 107189 - protein, 9 aa, Homo sapiens
  light chain complementarity determining region 3 for antibody 53595
QQYNSFPFT

SEQ ID NO: 107190 - protein, 17 aa, Homo sapiens
  heavy chain complementarity determining region 3 for antibody 53595
AREYNDVLTGYWGYFDY

SEQ ID NO: 107191 - protein, 9 aa, Homo sapiens
  light chain complementarity determining region 3 for antibody 53596
QQYNSFPFT

SEQ ID NO: 107192 - protein, 17 aa, Homo sapiens
  heavy chain complementarity determining region 3 for antibody 53596
AREYNDSLTGYWGYFDY

SEQ ID NO: 107193 - protein, 9 aa, Homo sapiens
  light chain complementarity determining region 3 for antibody 53597
QQYISYPFT

SEQ ID NO: 107194 - protein, 13 aa, Homo sapiens
  heavy chain complementarity determining region 3 for antibody 53597
AADYGAYQYYFDY

SEQ ID NO: 107195 - protein, 9 aa, Homo sapiens
  light chain complementarity determining region 3 for antibody 53598
QQYGSSPFT

SEQ ID NO: 107196 - protein, 13 aa, Homo sapiens
  heavy chain complementarity determining region 3 for antibody 53598
ARDLDIYYYGMDV

SEQ ID NO: 107197 - protein, 9 aa, Homo sapiens
  light chain complementarity determining region 3 for antibody 53599
QQLNSYPYT

SEQ ID NO: 107198 - protein, 13 aa, Homo sapiens
  heavy chain complementarity determining region 3 for antibody 53599
ATHIIIIPVAGDY

SEQ ID NO: 107199 - protein, 9 aa, Homo sapiens
  light chain complementarity determining region 3 for antibody 53600
QQLNSYPPT

SEQ ID NO: 107200 - protein, 13 aa, Homo sapiens
  heavy chain complementarity determining region 3 for antibody 53600
AADYGDYQYSFDY

SEQ ID NO: 107201 - protein, 9 aa, Homo sapiens
  light chain complementarity determining region 3 for antibody 53601
QQLNSYPPT

SEQ ID NO: 107202 - protein, 13 aa, Homo sapiens
  heavy chain complementarity determining region 3 for antibody 53601
AAAYGDYQYYFDY

SEQ ID NO: 107203 - protein, 9 aa, Homo sapiens
  light chain complementarity determining region 3 for antibody 53602
LQHNSYPYT

SEQ ID NO: 107204 - protein, 19 aa, Homo sapiens
  heavy chain complementarity determining region 3 for antibody 53602
ARGNDILTGYYPHYYEMDV

SEQ ID NO: 107205 - protein, 9 aa, Homo sapiens
  light chain complementarity determining region 3 for antibody 53603
LQHNSYPYT

SEQ ID NO: 107206 - protein, 17 aa, Homo sapiens
  heavy chain complementarity determining region 3 for antibody 53603
AREREEDLYYCYYGMDV

SEQ ID NO: 107207 - protein, 9 aa, Homo sapiens
  light chain complementarity determining region 3 for antibody 53604
LQHNSYPYT

SEQ ID NO: 107208 - protein, 14 aa, Homo sapiens
  heavy chain complementarity determining region 3 for antibody 53604
ARDPYSSSWYGMDV

SEQ ID NO: 107209 - protein, 9 aa, Homo sapiens
  light chain complementarity determining region 3 for antibody 53605
LQHDNFPYT

SEQ ID NO: 107210 - protein, 7 aa, Homo sapiens
  heavy chain complementarity determining region 3 for antibody 53605
ARDVGDF

SEQ ID NO: 107211 - protein, 9 aa, Homo sapiens
  light chain complementarity determining region 3 for antibody 53606
LQDFNYPRT

SEQ ID NO: 107212 - protein, 11 aa, Homo sapiens
  heavy chain complementarity determining region 3 for antibody 53606
ARGRTGEGFDY

SEQ ID NO: 107213 - protein, 9 aa, Homo sapiens
  light chain complementarity determining region 3 for antibody 53607
HQSSSLPQT

SEQ ID NO: 107214 - protein, 15 aa, Homo sapiens
  heavy chain complementarity determining region 3 for antibody 53607
AREGGILTGYSPFDY

SEQ ID NO: 107215 - protein, 9 aa, Homo sapiens
  light chain complementarity determining region 3 for antibody 53608
HQSSSLPNT

SEQ ID NO: 107216 - protein, 15 aa, Homo sapiens
  heavy chain complementarity determining region 3 for antibody 53608
AKGEQLGYYYYGMDV

SEQ ID NO: 107217 - protein, 8 aa, Homo sapiens
  light chain complementarity determining region 3 for antibody 53609
QQYNSYWT

SEQ ID NO: 107218 - protein, 17 aa, Homo sapiens
  heavy chain complementarity determining region 3 for antibody 53609
ARDYYYGSGSSPHWFDP

SEQ ID NO: 107219 - protein, 9 aa, Homo sapiens
  light chain complementarity determining region 3 for antibody 53610
QQYNSYPYT

SEQ ID NO: 107220 - protein, 17 aa, Homo sapiens
  heavy chain complementarity determining region 3 for antibody 53610
ARLVLRYSGWLLPHFDY

SEQ ID NO: 107221 - protein, 9 aa, Homo sapiens
  light chain complementarity determining region 3 for antibody 53611
QQYNSYPYT

SEQ ID NO: 107222 - protein, 10 aa, Homo sapiens
  heavy chain complementarity determining region 3 for antibody 53611
AREGGGYLSY

SEQ ID NO: 107223 - protein, 9 aa, Homo sapiens
  light chain complementarity determining region 3 for antibody 53612
QQYNSYPYT

SEQ ID NO: 107224 - protein, 13 aa, Homo sapiens
  heavy chain complementarity determining region 3 for antibody 53612
ARDQGSGRDYFDY

SEQ ID NO: 107225 - protein, 9 aa, Homo sapiens
  light chain complementarity determining region 3 for antibody 53613
QQYNSYPLT

SEQ ID NO: 107226 - protein, 17 aa, Homo sapiens
  heavy chain complementarity determining region 3 for antibody 53613
AREGVVTMVRGVGWFDH

SEQ ID NO: 107227 - protein, 9 aa, Homo sapiens
  light chain complementarity determining region 3 for antibody 53614
QQYNSYPFT

SEQ ID NO: 107228 - protein, 9 aa, Homo sapiens
  heavy chain complementarity determining region 3 for antibody 53614
ARDPGIADY

SEQ ID NO: 107229 - protein, 9 aa, Homo sapiens
  light chain complementarity determining region 3 for antibody 53615
QQYNNWPLT

SEQ ID NO: 107230 - protein, 12 aa, Homo sapiens
  heavy chain complementarity determining region 3 for antibody 53615
ARDRNTMNGMDV

SEQ ID NO: 107231 - protein, 9 aa, Homo sapiens
  light chain complementarity determining region 3 for antibody 53616
QQYISYPFT

SEQ ID NO: 107232 - protein, 13 aa, Homo sapiens
  heavy chain complementarity determining region 3 for antibody 53616
AADCGDYQYYFDY

SEQ ID NO: 107233 - protein, 9 aa, Homo sapiens
  light chain complementarity determining region 3 for antibody 53617
QQSYSTPWT

SEQ ID NO: 107234 - protein, 17 aa, Homo sapiens
  heavy chain complementarity determining region 3 for antibody 53617
ARDEGYYGSGSYNPFDY

SEQ ID NO: 107235 - protein, 9 aa, Homo sapiens
  light chain complementarity determining region 3 for antibody 53618
QQRSNWPLT

SEQ ID NO: 107236 - protein, 10 aa, Homo sapiens
  heavy chain complementarity determining region 3 for antibody 53618
AREDGEDFDY

SEQ ID NO: 107237 - protein, 9 aa, Homo sapiens
  light chain complementarity determining region 3 for antibody 53619
QQLNSYPRT

SEQ ID NO: 107238 - protein, 20 aa, Homo sapiens
  heavy chain complementarity determining region 3 for antibody 53619
AREGPYYYGSGSLDYYGMDV

SEQ ID NO: 107239 - protein, 9 aa, Homo sapiens
  light chain complementarity determining region 3 for antibody 53620
QQLNSYPLT

SEQ ID NO: 107240 - protein, 10 aa, Homo sapiens
  heavy chain complementarity determining region 3 for antibody 53620
ARGYSYGLDY

SEQ ID NO: 107241 - protein, 9 aa, Homo sapiens
  light chain complementarity determining region 3 for antibody 53621
QQDYNLPLT

SEQ ID NO: 107242 - protein, 13 aa, Homo sapiens
  heavy chain complementarity determining region 3 for antibody 53621
AREGDSGSQGFDY

SEQ ID NO: 107243 - protein, 9 aa, Homo sapiens
  light chain complementarity determining region 3 for antibody 53622
QKYNSAPLA

SEQ ID NO: 107244 - protein, 8 aa, Homo sapiens
  heavy chain complementarity determining region 3 for antibody 53622
ARTGPLDY

SEQ ID NO: 107245 - protein, 9 aa, Homo sapiens
  light chain complementarity determining region 3 for antibody 53623
MQALQTPYT

SEQ ID NO: 107246 - protein, 14 aa, Homo sapiens
  heavy chain complementarity determining region 3 for antibody 53623
ARASGSYYYYGMDV

SEQ ID NO: 107247 - protein, 9 aa, Homo sapiens
  light chain complementarity determining region 3 for antibody 53624
LQYNSYPLT

SEQ ID NO: 107248 - protein, 11 aa, Homo sapiens
  heavy chain complementarity determining region 3 for antibody 53624
VREMVRGLIDF

SEQ ID NO: 107249 - protein, 9 aa, Homo sapiens
  light chain complementarity determining region 3 for antibody 53625
LQHNSYPYT

SEQ ID NO: 107250 - protein, 16 aa, Homo sapiens
  heavy chain complementarity determining region 3 for antibody 53625
AGDLLWFGELLSPLDY

SEQ ID NO: 107251 - protein, 9 aa, Homo sapiens
  light chain complementarity determining region 3 for antibody 53626
LQHNSYPPT

SEQ ID NO: 107252 - protein, 13 aa, Homo sapiens
  heavy chain complementarity determining region 3 for antibody 53626
ATERGYSYGLLDY

SEQ ID NO: 107253 - protein, 9 aa, Homo sapiens
  light chain complementarity determining region 3 for antibody 53627
LQHNSYPIT

SEQ ID NO: 107254 - protein, 19 aa, Homo sapiens
  heavy chain complementarity determining region 3 for antibody 53627
ARDRGYYGSGSYLPSYFDY

SEQ ID NO: 107255 - protein, 9 aa, Homo sapiens
  light chain complementarity determining region 3 for antibody 53628
LQHNSYPHT

SEQ ID NO: 107256 - protein, 14 aa, Homo sapiens
  heavy chain complementarity determining region 3 for antibody 53628
ARDPPQLGGGPFDY

SEQ ID NO: 107257 - protein, 9 aa, Homo sapiens
  light chain complementarity determining region 3 for antibody 53629
LQDYNYPYT

SEQ ID NO: 107258 - protein, 21 aa, Homo sapiens
  heavy chain complementarity determining region 3 for antibody 53629
ATDRPYYDILTGYYKKLLFDY

SEQ ID NO: 107259 - protein, 9 aa, Homo sapiens
  light chain complementarity determining region 3 for antibody 53630
LQDYNYPYT

SEQ ID NO: 107260 - protein, 14 aa, Homo sapiens
  heavy chain complementarity determining region 3 for antibody 53630
ARDPPRIVGALFDY

SEQ ID NO: 107261 - protein, 9 aa, Homo sapiens
  light chain complementarity determining region 3 for antibody 53631
LQDYNYPRT

SEQ ID NO: 107262 - protein, 12 aa, Homo sapiens
  heavy chain complementarity determining region 3 for antibody 53631
ARDTGYYYGMDV

SEQ ID NO: 107263 - protein, 9 aa, Homo sapiens
  light chain complementarity determining region 3 for antibody 53632
HQSSSLPQT

SEQ ID NO: 107264 - protein, 13 aa, Homo sapiens
  heavy chain complementarity determining region 3 for antibody 53632
ARDDSSGWYVFDY

SEQ ID NO: 107265 - protein, 9 aa, Homo sapiens
  light chain complementarity determining region 3 for antibody 53633
HQSSSLPIT

SEQ ID NO: 107266 - protein, 16 aa, Homo sapiens
  heavy chain complementarity determining region 3 for antibody 53633
AGNYDILTGYSSGMDV

SEQ ID NO: 107267 - protein, 8 aa, Homo sapiens
  light chain complementarity determining region 3 for antibody 53634
HQSSSLLT

SEQ ID NO: 107268 - protein, 13 aa, Homo sapiens
  heavy chain complementarity determining region 3 for antibody 53634
ARDPHYGHDAFDI

SEQ ID NO: 107269 - protein, 9 aa, Homo sapiens
  light chain complementarity determining region 3 for antibody 53635
HQSNSLPHT

SEQ ID NO: 107270 - protein, 14 aa, Homo sapiens
  heavy chain complementarity determining region 3 for antibody 53635
AKETITLVRGVMDY

SEQ ID NO: 107271 - protein, 9 aa, Homo sapiens
  light chain complementarity determining region 3 for antibody 53636
QQYNSYPYT

SEQ ID NO: 107272 - protein, 9 aa, Homo sapiens
  heavy chain complementarity determining region 3 for antibody 53636
ARKRWYFDL

SEQ ID NO: 107273 - protein, 9 aa, Homo sapiens
  light chain complementarity determining region 3 for antibody 53637
QQYISYPFT

SEQ ID NO: 107274 - protein, 13 aa, Homo sapiens
  heavy chain complementarity determining region 3 for antibody 53637
AADYGDYQYYFGY

SEQ ID NO: 107275 - protein, 9 aa, Homo sapiens
  light chain complementarity determining region 3 for antibody 53638
QQYISYPFT

SEQ ID NO: 107276 - protein, 13 aa, Homo sapiens
  heavy chain complementarity determining region 3 for antibody 53638
AADYGDYQYDFDY

SEQ ID NO: 107277 - protein, 9 aa, Homo sapiens
  light chain complementarity determining region 3 for antibody 53639
QQYGSSPIT

SEQ ID NO: 107278 - protein, 13 aa, Homo sapiens
  heavy chain complementarity determining region 3 for antibody 53639
ARVRYFDWFFFDY

SEQ ID NO: 107279 - protein, 9 aa, Homo sapiens
  light chain complementarity determining region 3 for antibody 53640
QNYNSAPLT

SEQ ID NO: 107280 - protein, 8 aa, Homo sapiens
  heavy chain complementarity determining region 3 for antibody 53640
ARTGPLDY

SEQ ID NO: 107281 - protein, 9 aa, Homo sapiens
  light chain complementarity determining region 3 for antibody 53641
QKYNSAPFT

SEQ ID NO: 107282 - protein, 15 aa, Homo sapiens
  heavy chain complementarity determining region 3 for antibody 53641
ARAPPHYDILTGYDY

SEQ ID NO: 107283 - protein, 9 aa, Homo sapiens
  light chain complementarity determining region 3 for antibody 53642
LQYNSYPFT

SEQ ID NO: 107284 - protein, 14 aa, Homo sapiens
  heavy chain complementarity determining region 3 for antibody 53642
ARDRDSSGYYLFDY

SEQ ID NO: 107285 - protein, 9 aa, Homo sapiens
  light chain complementarity determining region 3 for antibody 53643
LQYKSFPLT

SEQ ID NO: 107286 - protein, 19 aa, Homo sapiens
  heavy chain complementarity determining region 3 for antibody 53643
ARDRGYYGSGSYFPSYFDY

SEQ ID NO: 107287 - protein, 9 aa, Homo sapiens
  light chain complementarity determining region 3 for antibody 53644
LQDYNYPYT

SEQ ID NO: 107288 - protein, 8 aa, Homo sapiens
  heavy chain complementarity determining region 3 for antibody 53644
ARTGPLDY

SEQ ID NO: 107289 - protein, 9 aa, Homo sapiens
  light chain complementarity determining region 3 for antibody 53645
LQDYNYPYT

SEQ ID NO: 107290 - protein, 19 aa, Homo sapiens
  heavy chain complementarity determining region 3 for antibody 53645
ARGHFVFLTNYYKESYFDY

SEQ ID NO: 107291 - protein, 9 aa, Homo sapiens
  light chain complementarity determining region 3 for antibody 53646
LQDYNYPPT

SEQ ID NO: 107292 - protein, 17 aa, Homo sapiens
  heavy chain complementarity determining region 3 for antibody 53646
AREEYYDILTGSSSFDY

SEQ ID NO: 107293 - protein, 9 aa, Homo sapiens
  light chain complementarity determining region 3 for antibody 53647
LQDYNYPLT

SEQ ID NO: 107294 - protein, 12 aa, Homo sapiens
  heavy chain complementarity determining region 3 for antibody 53647
ARGEPYYYGMDV

SEQ ID NO: 107295 - protein, 9 aa, Homo sapiens
  light chain complementarity determining region 3 for antibody 53648
LQDYNYPFT

SEQ ID NO: 107296 - protein, 19 aa, Homo sapiens
  heavy chain complementarity determining region 3 for antibody 53648
ARDTGAYCGGDCYLNWFDP

SEQ ID NO: 107297 - protein, 9 aa, Homo sapiens
  light chain complementarity determining region 3 for antibody 53649
LQDYIFPPT

SEQ ID NO: 107298 - protein, 15 aa, Homo sapiens
  heavy chain complementarity determining region 3 for antibody 53649
VRDLWYSGSSFGLDV

SEQ ID NO: 107299 - protein, 9 aa, Homo sapiens
  light chain complementarity determining region 3 for antibody 53650
HQSSSLPYT

SEQ ID NO: 107300 - protein, 13 aa, Homo sapiens
  heavy chain complementarity determining region 3 for antibody 53650
ARDKDIVATPFDY

SEQ ID NO: 107301 - protein, 9 aa, Homo sapiens
  light chain complementarity determining region 3 for antibody 53651
HQSSSLPLT

SEQ ID NO: 107302 - protein, 12 aa, Homo sapiens
  heavy chain complementarity determining region 3 for antibody 53651
ATRSYSSRSMDV

SEQ ID NO: 107303 - protein, 9 aa, Homo sapiens
  light chain complementarity determining region 3 for antibody 53652
HQSSSLPHT

SEQ ID NO: 107304 - protein, 14 aa, Homo sapiens
  heavy chain complementarity determining region 3 for antibody 53652
ARVSYSDYEGYFDY

SEQ ID NO: 107305 - protein, 9 aa, Homo sapiens
  light chain complementarity determining region 3 for antibody 53653
HQSSSLPFT

SEQ ID NO: 107306 - protein, 11 aa, Homo sapiens
  heavy chain complementarity determining region 3 for antibody 53653
ARLLCFGGFDY

SEQ ID NO: 107307 - protein, 10 aa, Homo sapiens
  light chain complementarity determining region 3 for antibody 53654
QQYNSYSPLT

SEQ ID NO: 107308 - protein, 12 aa, Homo sapiens
  heavy chain complementarity determining region 3 for antibody 53654
ARDRDIYWYFDL

SEQ ID NO: 107309 - protein, 9 aa, Homo sapiens
  light chain complementarity determining region 3 for antibody 53655
QQYNSYPYT

SEQ ID NO: 107310 - protein, 17 aa, Homo sapiens
  heavy chain complementarity determining region 3 for antibody 53655
ARLVLRYSDRLLPHFDY

SEQ ID NO: 107311 - protein, 9 aa, Homo sapiens
  light chain complementarity determining region 3 for antibody 53656
QQYNSYPIT

SEQ ID NO: 107312 - protein, 17 aa, Homo sapiens
  heavy chain complementarity determining region 3 for antibody 53656
ARGGYYGSGSYYPPYDY

SEQ ID NO: 107313 - protein, 9 aa, Homo sapiens
  light chain complementarity determining region 3 for antibody 53657
QQYNSYPCT

SEQ ID NO: 107314 - protein, 17 aa, Homo sapiens
  heavy chain complementarity determining region 3 for antibody 53657
ARLVLRYSDWLLPHFDY

SEQ ID NO: 107315 - protein, 9 aa, Homo sapiens
  light chain complementarity determining region 3 for antibody 53658
QQYISYPFT

SEQ ID NO: 107316 - protein, 13 aa, Homo sapiens
  heavy chain complementarity determining region 3 for antibody 53658
AADYGDYQYCFDY

SEQ ID NO: 107317 - protein, 10 aa, Homo sapiens
  light chain complementarity determining region 3 for antibody 53659
QQYGSSPPYT

SEQ ID NO: 107318 - protein, 12 aa, Homo sapiens
  heavy chain complementarity determining region 3 for antibody 53659
ARVGGSYSFFDY

SEQ ID NO: 107319 - protein, 9 aa, Homo sapiens
  light chain complementarity determining region 3 for antibody 53660
QQYGSSPFT

SEQ ID NO: 107320 - protein, 13 aa, Homo sapiens
  heavy chain complementarity determining region 3 for antibody 53660
AADYGDYQYYFDY

SEQ ID NO: 107321 - protein, 9 aa, Homo sapiens
  light chain complementarity determining region 3 for antibody 53661
QQSYSTPYT

SEQ ID NO: 107322 - protein, 16 aa, Homo sapiens
  heavy chain complementarity determining region 3 for antibody 53661
AARSYYDILTGYYFDY

SEQ ID NO: 107323 - protein, 9 aa, Homo sapiens
  light chain complementarity determining region 3 for antibody 53662
QQLNSYPYT

SEQ ID NO: 107324 - protein, 11 aa, Homo sapiens
  heavy chain complementarity determining region 3 for antibody 53662
ARALLGIPFDY

SEQ ID NO: 107325 - protein, 9 aa, Homo sapiens
  light chain complementarity determining region 3 for antibody 53663
QQLNSYPPT

SEQ ID NO: 107326 - protein, 13 aa, Homo sapiens
  heavy chain complementarity determining region 3 for antibody 53663
ARADTAMVDPFDY

SEQ ID NO: 107327 - protein, 8 aa, Homo sapiens
  light chain complementarity determining region 3 for antibody 53664
QQFNNYPT

SEQ ID NO: 107328 - protein, 21 aa, Homo sapiens
  heavy chain complementarity determining region 3 for antibody 53664
AKDQYDILTGSFYYYYYGMDV

SEQ ID NO: 107329 - protein, 9 aa, Homo sapiens
  light chain complementarity determining region 3 for antibody 53665
QQFNNYPRT

SEQ ID NO: 107330 - protein, 12 aa, Homo sapiens
  heavy chain complementarity determining region 3 for antibody 53665
ARRGWGFDAFDI

SEQ ID NO: 107331 - protein, 9 aa, Homo sapiens
  light chain complementarity determining region 3 for antibody 53666
QQDYNLPLT

SEQ ID NO: 107332 - protein, 13 aa, Homo sapiens
  heavy chain complementarity determining region 3 for antibody 53666
AKDLTIAAAGTGY

SEQ ID NO: 107333 - protein, 9 aa, Homo sapiens
  light chain complementarity determining region 3 for antibody 53667
QKLNSYPYT

SEQ ID NO: 107334 - protein, 9 aa, Homo sapiens
  heavy chain complementarity determining region 3 for antibody 53667
ARKQRYLDY

SEQ ID NO: 107335 - protein, 9 aa, Homo sapiens
  light chain complementarity determining region 3 for antibody 53668
LQHNSYPLT

SEQ ID NO: 107336 - protein, 22 aa, Homo sapiens
  heavy chain complementarity determining region 3 for antibody 53668
ARGDYDILTGYRGYYPYYGMDV

SEQ ID NO: 107337 - protein, 9 aa, Homo sapiens
  light chain complementarity determining region 3 for antibody 53669
LQDYNYPWT

SEQ ID NO: 107338 - protein, 16 aa, Homo sapiens
  heavy chain complementarity determining region 3 for antibody 53669
ARSGGYYGSGSYYFDY

SEQ ID NO: 107339 - protein, 9 aa, Homo sapiens
  light chain complementarity determining region 3 for antibody 53670
LQDYNYPWT

SEQ ID NO: 107340 - protein, 12 aa, Homo sapiens
  heavy chain complementarity determining region 3 for antibody 53670
ARQQWLVYGMDV

SEQ ID NO: 107341 - protein, 9 aa, Homo sapiens
  light chain complementarity determining region 3 for antibody 53671
LQDYNYPWT

SEQ ID NO: 107342 - protein, 7 aa, Homo sapiens
  heavy chain complementarity determining region 3 for antibody 53671
ARLTEDY

SEQ ID NO: 107343 - protein, 9 aa, Homo sapiens
  light chain complementarity determining region 3 for antibody 53672
LQDYNYPWT

SEQ ID NO: 107344 - protein, 9 aa, Homo sapiens
  heavy chain complementarity determining region 3 for antibody 53672
ARAAALFDY

SEQ ID NO: 107345 - protein, 9 aa, Homo sapiens
  light chain complementarity determining region 3 for antibody 53673
LQDYNYPRT

SEQ ID NO: 107346 - protein, 13 aa, Homo sapiens
  heavy chain complementarity determining region 3 for antibody 53673
ARDRGSPHYGMDV

SEQ ID NO: 107347 - protein, 9 aa, Homo sapiens
  light chain complementarity determining region 3 for antibody 53674
LQDYNYPRT

SEQ ID NO: 107348 - protein, 11 aa, Homo sapiens
  heavy chain complementarity determining region 3 for antibody 53674
ARDLGMRAFDI

SEQ ID NO: 107349 - protein, 9 aa, Homo sapiens
  light chain complementarity determining region 3 for antibody 53675
LQDYNYPLT

SEQ ID NO: 107350 - protein, 15 aa, Homo sapiens
  heavy chain complementarity determining region 3 for antibody 53675
ARDREITMVRGVMDV

SEQ ID NO: 107351 - protein, 9 aa, Homo sapiens
  light chain complementarity determining region 3 for antibody 53676
LQDYNYPLT

SEQ ID NO: 107352 - protein, 17 aa, Homo sapiens
  heavy chain complementarity determining region 3 for antibody 53676
ARDGEVRGVPYYYDMDV

SEQ ID NO: 107353 - protein, 9 aa, Homo sapiens
  light chain complementarity determining region 3 for antibody 53677
HQSSSLPYT

SEQ ID NO: 107354 - protein, 13 aa, Homo sapiens
  heavy chain complementarity determining region 3 for antibody 53677
AADYGDYQYYFDY

SEQ ID NO: 107355 - protein, 9 aa, Homo sapiens
  light chain complementarity determining region 3 for antibody 53678
HQSSSLPLT

SEQ ID NO: 107356 - protein, 15 aa, Homo sapiens
  heavy chain complementarity determining region 3 for antibody 53678
ARDCDYGDYLYYFDY

SEQ ID NO: 107357 - protein, 9 aa, Homo sapiens
  light chain complementarity determining region 3 for antibody 53679
QQYNSYPYT

SEQ ID NO: 107358 - protein, 17 aa, Homo sapiens
  heavy chain complementarity determining region 3 for antibody 53679
ARLVSRYSDWLLPHFDY

SEQ ID NO: 107359 - protein, 9 aa, Homo sapiens
  light chain complementarity determining region 3 for antibody 53680
QQYNSYPYT

SEQ ID NO: 107360 - protein, 17 aa, Homo sapiens
  heavy chain complementarity determining region 3 for antibody 53680
ARLVLRYIDWLLPHFGY

SEQ ID NO: 107361 - protein, 9 aa, Homo sapiens
  light chain complementarity determining region 3 for antibody 53681
QQYNSYPRT

SEQ ID NO: 107362 - protein, 10 aa, Homo sapiens
  heavy chain complementarity determining region 3 for antibody 53681
ARDKGYYFDY

SEQ ID NO: 107363 - protein, 8 aa, Homo sapiens
  light chain complementarity determining region 3 for antibody 53682
QQYGSSYT

SEQ ID NO: 107364 - protein, 14 aa, Homo sapiens
  heavy chain complementarity determining region 3 for antibody 53682
ARILLWFGESPFDY

SEQ ID NO: 107365 - protein, 9 aa, Homo sapiens
  light chain complementarity determining region 3 for antibody 53683
QQYGSSPYT

SEQ ID NO: 107366 - protein, 10 aa, Homo sapiens
  heavy chain complementarity determining region 3 for antibody 53683
TGTGYYGMDV

SEQ ID NO: 107367 - protein, 10 aa, Homo sapiens
  light chain complementarity determining region 3 for antibody 53684
QQYGSSPMYT

SEQ ID NO: 107368 - protein, 19 aa, Homo sapiens
  heavy chain complementarity determining region 3 for antibody 53684
ARGYCSSTSCGAVAANFDY

SEQ ID NO: 107369 - protein, 9 aa, Homo sapiens
  light chain complementarity determining region 3 for antibody 53685
QQYGSSLYT

SEQ ID NO: 107370 - protein, 8 aa, Homo sapiens
  heavy chain complementarity determining region 3 for antibody 53685
TTGSAFDI

SEQ ID NO: 107371 - protein, 10 aa, Homo sapiens
  light chain complementarity determining region 3 for antibody 53686
QQYGSSLMYT

SEQ ID NO: 107372 - protein, 14 aa, Homo sapiens
  heavy chain complementarity determining region 3 for antibody 53686
ARDGRLTMVRGVDY

SEQ ID NO: 107373 - protein, 9 aa, Homo sapiens
  light chain complementarity determining region 3 for antibody 53687
QQLNSYPYT

SEQ ID NO: 107374 - protein, 9 aa, Homo sapiens
  heavy chain complementarity determining region 3 for antibody 53687
ARKGWYFDL

SEQ ID NO: 107375 - protein, 9 aa, Homo sapiens
  light chain complementarity determining region 3 for antibody 53688
QQLNSYPPT

SEQ ID NO: 107376 - protein, 13 aa, Homo sapiens
  heavy chain complementarity determining region 3 for antibody 53688
AADYGDYQYDFDY

SEQ ID NO: 107377 - protein, 9 aa, Homo sapiens
  light chain complementarity determining region 3 for antibody 53689
QQLNSYPLT

SEQ ID NO: 107378 - protein, 12 aa, Homo sapiens
  heavy chain complementarity determining region 3 for antibody 53689
ARVVRGVIGFDY

SEQ ID NO: 107379 - protein, 9 aa, Homo sapiens
  light chain complementarity determining region 3 for antibody 53690
QQLNSYPIT

SEQ ID NO: 107380 - protein, 12 aa, Homo sapiens
  heavy chain complementarity determining region 3 for antibody 53690
AKERVRGALFDY

SEQ ID NO: 107381 - protein, 9 aa, Homo sapiens
  light chain complementarity determining region 3 for antibody 53691
QQLNSFPRT

SEQ ID NO: 107382 - protein, 14 aa, Homo sapiens
  heavy chain complementarity determining region 3 for antibody 53691
ARDRDSSGYYLFDY

SEQ ID NO: 107383 - protein, 9 aa, Homo sapiens
  light chain complementarity determining region 3 for antibody 53692
QQHNSYPYT

SEQ ID NO: 107384 - protein, 17 aa, Homo sapiens
  heavy chain complementarity determining region 3 for antibody 53692
AGEYYYGSGSYYGNFDY

SEQ ID NO: 107385 - protein, 9 aa, Homo sapiens
  light chain complementarity determining region 3 for antibody 53693
QQFNNYPFT

SEQ ID NO: 107386 - protein, 16 aa, Homo sapiens
  heavy chain complementarity determining region 3 for antibody 53693
AGGRGYYGSGSPYFDY

SEQ ID NO: 107387 - protein, 9 aa, Homo sapiens
  light chain complementarity determining region 3 for antibody 53694
QQDYNLPWT

SEQ ID NO: 107388 - protein, 11 aa, Homo sapiens
  heavy chain complementarity determining region 3 for antibody 53694
ARITMVRGVDY

SEQ ID NO: 107389 - protein, 9 aa, Homo sapiens
  light chain complementarity determining region 3 for antibody 53695
QQCNSFPFT

SEQ ID NO: 107390 - protein, 17 aa, Homo sapiens
  heavy chain complementarity determining region 3 for antibody 53695
AREYNDILTGYWGYFDY

SEQ ID NO: 107391 - protein, 9 aa, Homo sapiens
  light chain complementarity determining region 3 for antibody 53696
QKYNSAPPT

SEQ ID NO: 107392 - protein, 8 aa, Homo sapiens
  heavy chain complementarity determining region 3 for antibody 53696
ARTGPLDY

SEQ ID NO: 107393 - protein, 9 aa, Homo sapiens
  light chain complementarity determining region 3 for antibody 53697
QKYNSAPLT

SEQ ID NO: 107394 - protein, 8 aa, Homo sapiens
  heavy chain complementarity determining region 3 for antibody 53697
ARTGPIDY

SEQ ID NO: 107395 - protein, 9 aa, Homo sapiens
  light chain complementarity determining region 3 for antibody 53698
LQHNSYPYT

SEQ ID NO: 107396 - protein, 8 aa, Homo sapiens
  heavy chain complementarity determining region 3 for antibody 53698
ARDGGMDV

SEQ ID NO: 107397 - protein, 9 aa, Homo sapiens
  light chain complementarity determining region 3 for antibody 53699
LQHNSYPWT

SEQ ID NO: 107398 - protein, 14 aa, Homo sapiens
  heavy chain complementarity determining region 3 for antibody 53699
VRDYYGSGTYYFDY

SEQ ID NO: 107399 - protein, 9 aa, Homo sapiens
  light chain complementarity determining region 3 for antibody 53700
LQHNSYPWT

SEQ ID NO: 107400 - protein, 11 aa, Homo sapiens
  heavy chain complementarity determining region 3 for antibody 53700
ARVNWGDAFDI

SEQ ID NO: 107401 - protein, 9 aa, Homo sapiens
  light chain complementarity determining region 3 for antibody 53701
LQHNSYPWT

SEQ ID NO: 107402 - protein, 14 aa, Homo sapiens
  heavy chain complementarity determining region 3 for antibody 53701
ARDYYGSGSYYFDY

SEQ ID NO: 107403 - protein, 9 aa, Homo sapiens
  light chain complementarity determining region 3 for antibody 53702
LQHNSYPLT

SEQ ID NO: 107404 - protein, 17 aa, Homo sapiens
  heavy chain complementarity determining region 3 for antibody 53702
AREYNDILTGYWGYFDY

SEQ ID NO: 107405 - protein, 9 aa, Homo sapiens
  light chain complementarity determining region 3 for antibody 53703
LQHNNYPWT

SEQ ID NO: 107406 - protein, 11 aa, Homo sapiens
  heavy chain complementarity determining region 3 for antibody 53703
ARANWGDAFDI

SEQ ID NO: 107407 - protein, 9 aa, Homo sapiens
  light chain complementarity determining region 3 for antibody 53704
LQHNNYPLT

SEQ ID NO: 107408 - protein, 11 aa, Homo sapiens
  heavy chain complementarity determining region 3 for antibody 53704
VRDPTIGAFDL

SEQ ID NO: 107409 - protein, 9 aa, Homo sapiens
  light chain complementarity determining region 3 for antibody 53705
LQHDNFPYT

SEQ ID NO: 107410 - protein, 20 aa, Homo sapiens
  heavy chain complementarity determining region 3 for antibody 53705
ARDRSRISIVREYYYYGMDV

SEQ ID NO: 107411 - protein, 9 aa, Homo sapiens
  light chain complementarity determining region 3 for antibody 53706
LQDYTYPYT

SEQ ID NO: 107412 - protein, 19 aa, Homo sapiens
  heavy chain complementarity determining region 3 for antibody 53706
ARGNLGDYVGNHYFYGMDV

SEQ ID NO: 107413 - protein, 9 aa, Homo sapiens
  light chain complementarity determining region 3 for antibody 53707
LQDYNYPYT

SEQ ID NO: 107414 - protein, 16 aa, Homo sapiens
  heavy chain complementarity determining region 3 for antibody 53707
ARREVRGVYYYYGMDV

SEQ ID NO: 107415 - protein, 9 aa, Homo sapiens
  light chain complementarity determining region 3 for antibody 53708
LQDYNYPYT

SEQ ID NO: 107416 - protein, 19 aa, Homo sapiens
  heavy chain complementarity determining region 3 for antibody 53708
ARDRYYDILTGYYTLNFDY

SEQ ID NO: 107417 - protein, 9 aa, Homo sapiens
  light chain complementarity determining region 3 for antibody 53709
LQDYNYPYT

SEQ ID NO: 107418 - protein, 17 aa, Homo sapiens
  heavy chain complementarity determining region 3 for antibody 53709
ARDRDYDILTGYSLFDY

SEQ ID NO: 107419 - protein, 9 aa, Homo sapiens
  light chain complementarity determining region 3 for antibody 53710
LQDYNYPYT

SEQ ID NO: 107420 - protein, 19 aa, Homo sapiens
  heavy chain complementarity determining region 3 for antibody 53710
ARDPPYYDILTGYFYGMDV

SEQ ID NO: 107421 - protein, 9 aa, Homo sapiens
  light chain complementarity determining region 3 for antibody 53711
LQDYNYPWT

SEQ ID NO: 107422 - protein, 13 aa, Homo sapiens
  heavy chain complementarity determining region 3 for antibody 53711
AADYGDYQYYFDY

SEQ ID NO: 107423 - protein, 9 aa, Homo sapiens
  light chain complementarity determining region 3 for antibody 53712
LQDYNYPRT

SEQ ID NO: 107424 - protein, 11 aa, Homo sapiens
  heavy chain complementarity determining region 3 for antibody 53712
ARGGPTGPFDY

SEQ ID NO: 107425 - protein, 9 aa, Homo sapiens
  light chain complementarity determining region 3 for antibody 53713
LQDYNYPLT

SEQ ID NO: 107426 - protein, 18 aa, Homo sapiens
  heavy chain complementarity determining region 3 for antibody 53713
ARDPEVRGLMGYYYAMDV

SEQ ID NO: 107427 - protein, 9 aa, Homo sapiens
  light chain complementarity determining region 3 for antibody 53714
LQDYNYPIT

SEQ ID NO: 107428 - protein, 11 aa, Homo sapiens
  heavy chain complementarity determining region 3 for antibody 53714
ARDRLTGDSDY

SEQ ID NO: 107429 - protein, 9 aa, Homo sapiens
  light chain complementarity determining region 3 for antibody 53715
HQSSSLPYT

SEQ ID NO: 107430 - protein, 16 aa, Homo sapiens
  heavy chain complementarity determining region 3 for antibody 53715
ARAGRYFDWLRDAFDI

SEQ ID NO: 107431 - protein, 9 aa, Homo sapiens
  light chain complementarity determining region 3 for antibody 53716
HQSSSLPWT

SEQ ID NO: 107432 - protein, 10 aa, Homo sapiens
  heavy chain complementarity determining region 3 for antibody 53716
ARLGSGSCDY

SEQ ID NO: 107433 - protein, 9 aa, Homo sapiens
  light chain complementarity determining region 3 for antibody 53717
HQSSSLPRT

SEQ ID NO: 107434 - protein, 10 aa, Homo sapiens
  heavy chain complementarity determining region 3 for antibody 53717
ARDGSGSYRY

SEQ ID NO: 107435 - protein, 9 aa, Homo sapiens
  light chain complementarity determining region 3 for antibody 53718
HQSSSLPQT

SEQ ID NO: 107436 - protein, 14 aa, Homo sapiens
  heavy chain complementarity determining region 3 for antibody 53718
ARDTYYDILTGFDY

SEQ ID NO: 107437 - protein, 9 aa, Homo sapiens
  light chain complementarity determining region 3 for antibody 53719
QQYNSYPYT

SEQ ID NO: 107438 - protein, 17 aa, Homo sapiens
  heavy chain complementarity determining region 3 for antibody 53719
ARVVLRYSDWLLPHFDY

SEQ ID NO: 107439 - protein, 9 aa, Homo sapiens
  light chain complementarity determining region 3 for antibody 53720
QQYNSYPLT

SEQ ID NO: 107440 - protein, 13 aa, Homo sapiens
  heavy chain complementarity determining region 3 for antibody 53720
ARSGKDYYYGMDV

SEQ ID NO: 107441 - protein, 9 aa, Homo sapiens
  light chain complementarity determining region 3 for antibody 53721
QQYNSFPFT

SEQ ID NO: 107442 - protein, 17 aa, Homo sapiens
  heavy chain complementarity determining region 3 for antibody 53721
AREYNGILTGYWGYFDY

SEQ ID NO: 107443 - protein, 9 aa, Homo sapiens
  light chain complementarity determining region 3 for antibody 53722
QQYNSFPFT

SEQ ID NO: 107444 - protein, 17 aa, Homo sapiens
  heavy chain complementarity determining region 3 for antibody 53722
AREYNDILTGYWGDFDY

SEQ ID NO: 107445 - protein, 9 aa, Homo sapiens
  light chain complementarity determining region 3 for antibody 53723
QQYNSFPFT

SEQ ID NO: 107446 - protein, 17 aa, Homo sapiens
  heavy chain complementarity determining region 3 for antibody 53723
AREYNDILPGYWGYFDY

SEQ ID NO: 107447 - protein, 9 aa, Homo sapiens
  light chain complementarity determining region 3 for antibody 53724
QQYNSFPFT

SEQ ID NO: 107448 - protein, 17 aa, Homo sapiens
  heavy chain complementarity determining region 3 for antibody 53724
AREYDDILTGYWGYFDY

SEQ ID NO: 107449 - protein, 9 aa, Homo sapiens
  light chain complementarity determining region 3 for antibody 53725
QQYNNWPLT

SEQ ID NO: 107450 - protein, 16 aa, Homo sapiens
  heavy chain complementarity determining region 3 for antibody 53725
ARGPYYDILTGDAFDI

SEQ ID NO: 107451 - protein, 9 aa, Homo sapiens
  light chain complementarity determining region 3 for antibody 53726
QQYGSSPYT

SEQ ID NO: 107452 - protein, 16 aa, Homo sapiens
  heavy chain complementarity determining region 3 for antibody 53726
ARDRGLGIGTAGYFDY

SEQ ID NO: 107453 - protein, 10 aa, Homo sapiens
  light chain complementarity determining region 3 for antibody 53727
QQYGSSPPYT

SEQ ID NO: 107454 - protein, 13 aa, Homo sapiens
  heavy chain complementarity determining region 3 for antibody 53727
AKEGRIAVVPFDY

SEQ ID NO: 107455 - protein, 9 aa, Homo sapiens
  light chain complementarity determining region 3 for antibody 53728
QQSYNTPYT

SEQ ID NO: 107456 - protein, 14 aa, Homo sapiens
  heavy chain complementarity determining region 3 for antibody 53728
ARDRTVATIGNFDY

SEQ ID NO: 107457 - protein, 9 aa, Homo sapiens
  light chain complementarity determining region 3 for antibody 53729
QQLSSYPLT

SEQ ID NO: 107458 - protein, 10 aa, Homo sapiens
  heavy chain complementarity determining region 3 for antibody 53729
ARGYSYGLDY

SEQ ID NO: 107459 - protein, 9 aa, Homo sapiens
  light chain complementarity determining region 3 for antibody 53730
QQLNTYPRT

SEQ ID NO: 107460 - protein, 18 aa, Homo sapiens
  heavy chain complementarity determining region 3 for antibody 53730
AKDQSIAAAGTYYYGMDV

SEQ ID NO: 107461 - protein, 9 aa, Homo sapiens
  light chain complementarity determining region 3 for antibody 53731
QQLNSYPYT

SEQ ID NO: 107462 - protein, 19 aa, Homo sapiens
  heavy chain complementarity determining region 3 for antibody 53731
SRDERFGEPFYYYYYGMDV

SEQ ID NO: 107463 - protein, 9 aa, Homo sapiens
  light chain complementarity determining region 3 for antibody 53732
QQLNSYPYT

SEQ ID NO: 107464 - protein, 23 aa, Homo sapiens
  heavy chain complementarity determining region 3 for antibody 53732
AREQEIDIFYYYDSSGYYSYFDY

SEQ ID NO: 107465 - protein, 9 aa, Homo sapiens
  light chain complementarity determining region 3 for antibody 53733
QQLNSYPWT

SEQ ID NO: 107466 - protein, 16 aa, Homo sapiens
  heavy chain complementarity determining region 3 for antibody 53733
ARVPYYYGAGSYLFDY

SEQ ID NO: 107467 - protein, 9 aa, Homo sapiens
  light chain complementarity determining region 3 for antibody 53734
QQFNNYPFT

SEQ ID NO: 107468 - protein, 16 aa, Homo sapiens
  heavy chain complementarity determining region 3 for antibody 53734
ARGRGYYGSGSPSFDY

SEQ ID NO: 107469 - protein, 9 aa, Homo sapiens
  light chain complementarity determining region 3 for antibody 53735
QKYNSAPYT

SEQ ID NO: 107470 - protein, 9 aa, Homo sapiens
  heavy chain complementarity determining region 3 for antibody 53735
ARYGDSLDV

SEQ ID NO: 107471 - protein, 9 aa, Homo sapiens
  light chain complementarity determining region 3 for antibody 53736
QKYNSAPLT

SEQ ID NO: 107472 - protein, 8 aa, Homo sapiens
  heavy chain complementarity determining region 3 for antibody 53736
ARDDGMDV

SEQ ID NO: 107473 - protein, 9 aa, Homo sapiens
  light chain complementarity determining region 3 for antibody 53737
LQHSSYPFT

SEQ ID NO: 107474 - protein, 18 aa, Homo sapiens
  heavy chain complementarity determining region 3 for antibody 53737
AKDRVLRYFDWLSDAFDV

SEQ ID NO: 107475 - protein, 9 aa, Homo sapiens
  light chain complementarity determining region 3 for antibody 53738
LQHNSYPYT

SEQ ID NO: 107476 - protein, 17 aa, Homo sapiens
  heavy chain complementarity determining region 3 for antibody 53738
ARLVLRYSDWLLPHFDY

SEQ ID NO: 107477 - protein, 9 aa, Homo sapiens
  light chain complementarity determining region 3 for antibody 53739
LQHNSYPYT

SEQ ID NO: 107478 - protein, 17 aa, Homo sapiens
  heavy chain complementarity determining region 3 for antibody 53739
AREREKDLYYYYYGMDV

SEQ ID NO: 107479 - protein, 9 aa, Homo sapiens
  light chain complementarity determining region 3 for antibody 53740
LQHNSYPYT

SEQ ID NO: 107480 - protein, 17 aa, Homo sapiens
  heavy chain complementarity determining region 3 for antibody 53740
AREREEDLYYYYCGMDV

SEQ ID NO: 107481 - protein, 9 aa, Homo sapiens
  light chain complementarity determining region 3 for antibody 53741
LQHNSYPWT

SEQ ID NO: 107482 - protein, 14 aa, Homo sapiens
  heavy chain complementarity determining region 3 for antibody 53741
ARDRELLWFGELLP

SEQ ID NO: 107483 - protein, 9 aa, Homo sapiens
  light chain complementarity determining region 3 for antibody 53742
LQHNSCPYT

SEQ ID NO: 107484 - protein, 8 aa, Homo sapiens
  heavy chain complementarity determining region 3 for antibody 53742
ARDDGMDV

SEQ ID NO: 107485 - protein, 9 aa, Homo sapiens
  light chain complementarity determining region 3 for antibody 53743
LQHDNFPYT

SEQ ID NO: 107486 - protein, 16 aa, Homo sapiens
  heavy chain complementarity determining region 3 for antibody 53743
ARDKSGPLTAYYGMDV

SEQ ID NO: 107487 - protein, 9 aa, Homo sapiens
  light chain complementarity determining region 3 for antibody 53744
LQHDNFPWT

SEQ ID NO: 107488 - protein, 21 aa, Homo sapiens
  heavy chain complementarity determining region 3 for antibody 53744
AASMVRGIIIPPYYYYYGMDV

SEQ ID NO: 107489 - protein, 9 aa, Homo sapiens
  light chain complementarity determining region 3 for antibody 53745
LQDYNYPYT

SEQ ID NO: 107490 - protein, 14 aa, Homo sapiens
  heavy chain complementarity determining region 3 for antibody 53745
ASPRGYSYGDAFDI

SEQ ID NO: 107491 - protein, 9 aa, Homo sapiens
  light chain complementarity determining region 3 for antibody 53746
LQDYNYPYT

SEQ ID NO: 107492 - protein, 19 aa, Homo sapiens
  heavy chain complementarity determining region 3 for antibody 53746
ARDPPYYDFLTGSLYGMDV

SEQ ID NO: 107493 - protein, 9 aa, Homo sapiens
  light chain complementarity determining region 3 for antibody 53747
LQDYNYPWT

SEQ ID NO: 107494 - protein, 12 aa, Homo sapiens
  heavy chain complementarity determining region 3 for antibody 53747
AREDDILTGYDY

SEQ ID NO: 107495 - protein, 9 aa, Homo sapiens
  light chain complementarity determining region 3 for antibody 53748
LQDYNYPRT

SEQ ID NO: 107496 - protein, 14 aa, Homo sapiens
  heavy chain complementarity determining region 3 for antibody 53748
ARQGIVGASDAFDI

SEQ ID NO: 107497 - protein, 9 aa, Homo sapiens
  light chain complementarity determining region 3 for antibody 53749
LQDYNYPFT

SEQ ID NO: 107498 - protein, 17 aa, Homo sapiens
  heavy chain complementarity determining region 3 for antibody 53749
AKDLAAAGYYYYYGMDV

SEQ ID NO: 107499 - protein, 9 aa, Homo sapiens
  light chain complementarity determining region 3 for antibody 53750
HQSSSLPYT

SEQ ID NO: 107500 - protein, 8 aa, Homo sapiens
  heavy chain complementarity determining region 3 for antibody 53750
TRDRPFDY

SEQ ID NO: 107501 - protein, 9 aa, Homo sapiens
  light chain complementarity determining region 3 for antibody 53751
HQSSSLPHT

SEQ ID NO: 107502 - protein, 8 aa, Homo sapiens
  heavy chain complementarity determining region 3 for antibody 53751
ARNWAFDY

SEQ ID NO: 107503 - protein, 9 aa, Homo sapiens
  light chain complementarity determining region 3 for antibody 53752
HQSSSLPHT

SEQ ID NO: 107504 - protein, 16 aa, Homo sapiens
  heavy chain complementarity determining region 3 for antibody 53752
ARENDILTGEYPSGDY

SEQ ID NO: 107505 - protein, 9 aa, Homo sapiens
  light chain complementarity determining region 3 for antibody 53753
HQSSSLPHT

SEQ ID NO: 107506 - protein, 13 aa, Homo sapiens
  heavy chain complementarity determining region 3 for antibody 53753
AREARSSSYAFDI

SEQ ID NO: 107507 - protein, 9 aa, Homo sapiens
  light chain complementarity determining region 3 for antibody 53754
QRLNSYPYT

SEQ ID NO: 107508 - protein, 9 aa, Homo sapiens
  heavy chain complementarity determining region 3 for antibody 53754
ARKRWYFDL

SEQ ID NO: 107509 - protein, 9 aa, Homo sapiens
  light chain complementarity determining region 3 for antibody 53755
QQYNTYPYT

SEQ ID NO: 107510 - protein, 17 aa, Homo sapiens
  heavy chain complementarity determining region 3 for antibody 53755
AREHYDILTGYWNYFDY

SEQ ID NO: 107511 - protein, 9 aa, Homo sapiens
  light chain complementarity determining region 3 for antibody 53756
QQYNSYPYT

SEQ ID NO: 107512 - protein, 17 aa, Homo sapiens
  heavy chain complementarity determining region 3 for antibody 53756
ARRVLRYSDWLLPHFDY

SEQ ID NO: 107513 - protein, 9 aa, Homo sapiens
  light chain complementarity determining region 3 for antibody 53757
QQYNSYPYT

SEQ ID NO: 107514 - protein, 17 aa, Homo sapiens
  heavy chain complementarity determining region 3 for antibody 53757
ARLVLRYSDWLFPPFDY

SEQ ID NO: 107515 - protein, 9 aa, Homo sapiens
  light chain complementarity determining region 3 for antibody 53758
QQYNSYPYT

SEQ ID NO: 107516 - protein, 11 aa, Homo sapiens
  heavy chain complementarity determining region 3 for antibody 53758
AKDLRYFDSNY

SEQ ID NO: 107517 - protein, 9 aa, Homo sapiens
  light chain complementarity determining region 3 for antibody 53759
QQYNSYPLT

SEQ ID NO: 107518 - protein, 13 aa, Homo sapiens
  heavy chain complementarity determining region 3 for antibody 53759
ARDRAAGTLYFDY

SEQ ID NO: 107519 - protein, 9 aa, Homo sapiens
  light chain complementarity determining region 3 for antibody 53760
QQYNSFPFT

SEQ ID NO: 107520 - protein, 11 aa, Homo sapiens
  heavy chain complementarity determining region 3 for antibody 53760
AREYNDILTGY

SEQ ID NO: 107521 - protein, 9 aa, Homo sapiens
  light chain complementarity determining region 3 for antibody 53761
QQYNSFPFT

SEQ ID NO: 107522 - protein, 13 aa, Homo sapiens
  heavy chain complementarity determining region 3 for antibody 53761
AADYGDYQYYFDY

SEQ ID NO: 107523 - protein, 9 aa, Homo sapiens
  light chain complementarity determining region 3 for antibody 53762
QQYNNWPRT

SEQ ID NO: 107524 - protein, 12 aa, Homo sapiens
  heavy chain complementarity determining region 3 for antibody 53762
AREWEPGPTRDY

SEQ ID NO: 107525 - protein, 9 aa, Homo sapiens
  light chain complementarity determining region 3 for antibody 53763
QQYNNWPRT

SEQ ID NO: 107526 - protein, 20 aa, Homo sapiens
  heavy chain complementarity determining region 3 for antibody 53763
ARAFVLLWFGESPGGYGMDV

SEQ ID NO: 107527 - protein, 9 aa, Homo sapiens
  light chain complementarity determining region 3 for antibody 53764
QQYNNWPLT

SEQ ID NO: 107528 - protein, 11 aa, Homo sapiens
  heavy chain complementarity determining region 3 for antibody 53764
ARDYGDYCFDY

SEQ ID NO: 107529 - protein, 9 aa, Homo sapiens
  light chain complementarity determining region 3 for antibody 53765
QQYISYPFT

SEQ ID NO: 107530 - protein, 13 aa, Homo sapiens
  heavy chain complementarity determining region 3 for antibody 53765
AADYGVYQYYFDY

SEQ ID NO: 107531 - protein, 9 aa, Homo sapiens
  light chain complementarity determining region 3 for antibody 53766
QQYGSSPYT

SEQ ID NO: 107532 - protein, 17 aa, Homo sapiens
  heavy chain complementarity determining region 3 for antibody 53766
ARTFNVLRYFDWLFLDY

SEQ ID NO: 107533 - protein, 9 aa, Homo sapiens
  light chain complementarity determining region 3 for antibody 53767
QQYGSSPRT

SEQ ID NO: 107534 - protein, 13 aa, Homo sapiens
  heavy chain complementarity determining region 3 for antibody 53767
ARREVLLYWYFDL

SEQ ID NO: 107535 - protein, 8 aa, Homo sapiens
  light chain complementarity determining region 3 for antibody 53768
QQRSNWYT

SEQ ID NO: 107536 - protein, 11 aa, Homo sapiens
  heavy chain complementarity determining region 3 for antibody 53768
ARDLRYSYGYY

SEQ ID NO: 107537 - protein, 9 aa, Homo sapiens
  light chain complementarity determining region 3 for antibody 53769
QQRSNWPPT

SEQ ID NO: 107538 - protein, 15 aa, Homo sapiens
  heavy chain complementarity determining region 3 for antibody 53769
ARGYSSGPLLGGMDV

SEQ ID NO: 107539 - protein, 10 aa, Homo sapiens
  light chain complementarity determining region 3 for antibody 53770
QQRSNWPPIT

SEQ ID NO: 107540 - protein, 9 aa, Homo sapiens
  heavy chain complementarity determining region 3 for antibody 53770
ARLVGAIDY

SEQ ID NO: 107541 - protein, 9 aa, Homo sapiens
  light chain complementarity determining region 3 for antibody 53771
QQRSNWMYT

SEQ ID NO: 107542 - protein, 10 aa, Homo sapiens
  heavy chain complementarity determining region 3 for antibody 53771
AKERWEPLDY

SEQ ID NO: 107543 - protein, 9 aa, Homo sapiens
  light chain complementarity determining region 3 for antibody 53772
QQLNSYPYT

SEQ ID NO: 107544 - protein, 9 aa, Homo sapiens
  heavy chain complementarity determining region 3 for antibody 53772
ARKRWYFDH

SEQ ID NO: 107545 - protein, 9 aa, Homo sapiens
  light chain complementarity determining region 3 for antibody 53773
QQLNSYPST

SEQ ID NO: 107546 - protein, 9 aa, Homo sapiens
  heavy chain complementarity determining region 3 for antibody 53773
ARRRWYFDL

SEQ ID NO: 107547 - protein, 9 aa, Homo sapiens
  light chain complementarity determining region 3 for antibody 53774
QQLNSFPRT

SEQ ID NO: 107548 - protein, 13 aa, Homo sapiens
  heavy chain complementarity determining region 3 for antibody 53774
VKEMGQWLYYFDY

SEQ ID NO: 107549 - protein, 9 aa, Homo sapiens
  light chain complementarity determining region 3 for antibody 53775
QQFSNYPLT

SEQ ID NO: 107550 - protein, 16 aa, Homo sapiens
  heavy chain complementarity determining region 3 for antibody 53775
AREHSGSYYVGYFFDY

SEQ ID NO: 107551 - protein, 9 aa, Homo sapiens
  light chain complementarity determining region 3 for antibody 53776
QQFNNYPFT

SEQ ID NO: 107552 - protein, 16 aa, Homo sapiens
  heavy chain complementarity determining region 3 for antibody 53776
ARGRGYYGSGSPYSDY

SEQ ID NO: 107553 - protein, 9 aa, Homo sapiens
  light chain complementarity determining region 3 for antibody 53777
QQDYNLPLT

SEQ ID NO: 107554 - protein, 11 aa, Homo sapiens
  heavy chain complementarity determining region 3 for antibody 53777
AGNIAAAGKHR

SEQ ID NO: 107555 - protein, 9 aa, Homo sapiens
  light chain complementarity determining region 3 for antibody 53778
QKYNSAPYT

SEQ ID NO: 107556 - protein, 12 aa, Homo sapiens
  heavy chain complementarity determining region 3 for antibody 53778
AKYDVLTGWADP

SEQ ID NO: 107557 - protein, 9 aa, Homo sapiens
  light chain complementarity determining region 3 for antibody 53779
QKYNSAPLT

SEQ ID NO: 107558 - protein, 8 aa, Homo sapiens
  heavy chain complementarity determining region 3 for antibody 53779
ARTGPLNY

SEQ ID NO: 107559 - protein, 9 aa, Homo sapiens
  light chain complementarity determining region 3 for antibody 53780
QKYNSAPLT

SEQ ID NO: 107560 - protein, 8 aa, Homo sapiens
  heavy chain complementarity determining region 3 for antibody 53780
ARTGPLAY

SEQ ID NO: 107561 - protein, 9 aa, Homo sapiens
  light chain complementarity determining region 3 for antibody 53781
QKYNSAPLT

SEQ ID NO: 107562 - protein, 22 aa, Homo sapiens
  heavy chain complementarity determining region 3 for antibody 53781
ARGDYDILTGYRGYYSYYGMDV

SEQ ID NO: 107563 - protein, 9 aa, Homo sapiens
  light chain complementarity determining region 3 for antibody 53782
QKHNSAPLT

SEQ ID NO: 107564 - protein, 8 aa, Homo sapiens
  heavy chain complementarity determining region 3 for antibody 53782
ARTGPLDY

SEQ ID NO: 107565 - protein, 9 aa, Homo sapiens
  light chain complementarity determining region 3 for antibody 53783
MQGTHWPWT

SEQ ID NO: 107566 - protein, 16 aa, Homo sapiens
  heavy chain complementarity determining region 3 for antibody 53783
ARDRYYYGSGSYPFDY

SEQ ID NO: 107567 - protein, 9 aa, Homo sapiens
  light chain complementarity determining region 3 for antibody 53784
LQHNSYPYT

SEQ ID NO: 107568 - protein, 8 aa, Homo sapiens
  heavy chain complementarity determining region 3 for antibody 53784
ASDDGMDV

SEQ ID NO: 107569 - protein, 9 aa, Homo sapiens
  light chain complementarity determining region 3 for antibody 53785
LQHNSYPYT

SEQ ID NO: 107570 - protein, 20 aa, Homo sapiens
  heavy chain complementarity determining region 3 for antibody 53785
ARDRDDILTGWVPSYRGLDV

SEQ ID NO: 107571 - protein, 9 aa, Homo sapiens
  light chain complementarity determining region 3 for antibody 53786
LQHNSYPWT

SEQ ID NO: 107572 - protein, 9 aa, Homo sapiens
  heavy chain complementarity determining region 3 for antibody 53786
ASLWFGVDY

SEQ ID NO: 107573 - protein, 9 aa, Homo sapiens
  light chain complementarity determining region 3 for antibody 53787
LQHNSYPWT

SEQ ID NO: 107574 - protein, 9 aa, Homo sapiens
  heavy chain complementarity determining region 3 for antibody 53787
ARDQRGPHY

SEQ ID NO: 107575 - protein, 9 aa, Homo sapiens
  light chain complementarity determining region 3 for antibody 53788
LQHNSYPWT

SEQ ID NO: 107576 - protein, 6 aa, Homo sapiens
  heavy chain complementarity determining region 3 for antibody 53788
ARDHDY

SEQ ID NO: 107577 - protein, 9 aa, Homo sapiens
  light chain complementarity determining region 3 for antibody 53789
LQHNSYPRT

SEQ ID NO: 107578 - protein, 8 aa, Homo sapiens
  heavy chain complementarity determining region 3 for antibody 53789
ARTGPLDY

SEQ ID NO: 107579 - protein, 9 aa, Homo sapiens
  light chain complementarity determining region 3 for antibody 53790
LQHNSYPLT

SEQ ID NO: 107580 - protein, 22 aa, Homo sapiens
  heavy chain complementarity determining region 3 for antibody 53790
ARGDYEILTGYRGYYSYYGMDV

SEQ ID NO: 107581 - protein, 9 aa, Homo sapiens
  light chain complementarity determining region 3 for antibody 53791
LQHNSYPLT

SEQ ID NO: 107582 - protein, 8 aa, Homo sapiens
  heavy chain complementarity determining region 3 for antibody 53791
ARDDGMDV

SEQ ID NO: 107583 - protein, 9 aa, Homo sapiens
  light chain complementarity determining region 3 for antibody 53792
LQHDNFPYT

SEQ ID NO: 107584 - protein, 13 aa, Homo sapiens
  heavy chain complementarity determining region 3 for antibody 53792
ARERYSASYGMDV

SEQ ID NO: 107585 - protein, 9 aa, Homo sapiens
  light chain complementarity determining region 3 for antibody 53793
LQDYVYPYT

SEQ ID NO: 107586 - protein, 12 aa, Homo sapiens
  heavy chain complementarity determining region 3 for antibody 53793
TTDPQRVFPFDY

SEQ ID NO: 107587 - protein, 9 aa, Homo sapiens
  light chain complementarity determining region 3 for antibody 53794
LQDYNYPRT

SEQ ID NO: 107588 - protein, 14 aa, Homo sapiens
  heavy chain complementarity determining region 3 for antibody 53794
ARDHGGYSGYDTDY

SEQ ID NO: 107589 - protein, 9 aa, Homo sapiens
  light chain complementarity determining region 3 for antibody 53795
LQDYNYPRT

SEQ ID NO: 107590 - protein, 12 aa, Homo sapiens
  heavy chain complementarity determining region 3 for antibody 53795
AGEIAVTGPFDY

SEQ ID NO: 107591 - protein, 9 aa, Homo sapiens
  light chain complementarity determining region 3 for antibody 53796
LQDYNYPPT

SEQ ID NO: 107592 - protein, 14 aa, Homo sapiens
  heavy chain complementarity determining region 3 for antibody 53796
ARVGELPDYYGMDV

SEQ ID NO: 107593 - protein, 9 aa, Homo sapiens
  light chain complementarity determining region 3 for antibody 53797
LQDYNYPLT

SEQ ID NO: 107594 - protein, 13 aa, Homo sapiens
  heavy chain complementarity determining region 3 for antibody 53797
ARGRIAAAGRLDY

SEQ ID NO: 107595 - protein, 9 aa, Homo sapiens
  light chain complementarity determining region 3 for antibody 53798
LQDYNYPLT

SEQ ID NO: 107596 - protein, 10 aa, Homo sapiens
  heavy chain complementarity determining region 3 for antibody 53798
ARDSDYSFDY

SEQ ID NO: 107597 - protein, 9 aa, Homo sapiens
  light chain complementarity determining region 3 for antibody 53799
HQSSSLPYT

SEQ ID NO: 107598 - protein, 19 aa, Homo sapiens
  heavy chain complementarity determining region 3 for antibody 53799
ASQEYYDILTGYSYDAFDI

SEQ ID NO: 107599 - protein, 9 aa, Homo sapiens
  light chain complementarity determining region 3 for antibody 53800
HQSSSLPLT

SEQ ID NO: 107600 - protein, 18 aa, Homo sapiens
  heavy chain complementarity determining region 3 for antibody 53800
VKGGPGESFYYYYYGVDV

SEQ ID NO: 107601 - protein, 9 aa, Homo sapiens
  light chain complementarity determining region 3 for antibody 53801
HQSSSLPIT

SEQ ID NO: 107602 - protein, 13 aa, Homo sapiens
  heavy chain complementarity determining region 3 for antibody 53801
TTDGYFDWLSFDY

SEQ ID NO: 107603 - protein, 9 aa, Homo sapiens
  light chain complementarity determining region 3 for antibody 53802
SQHDNFPYT

SEQ ID NO: 107604 - protein, 13 aa, Homo sapiens
  heavy chain complementarity determining region 3 for antibody 53802
ARERYFASYGMDV

SEQ ID NO: 107605 - protein, 9 aa, Homo sapiens
  light chain complementarity determining region 3 for antibody 53803
QQYYGFPLT

SEQ ID NO: 107606 - protein, 10 aa, Homo sapiens
  heavy chain complementarity determining region 3 for antibody 53803
ARDWNDAFDI

SEQ ID NO: 107607 - protein, 9 aa, Homo sapiens
  light chain complementarity determining region 3 for antibody 53804
QQYNSYPYT

SEQ ID NO: 107608 - protein, 19 aa, Homo sapiens
  heavy chain complementarity determining region 3 for antibody 53804
VRDKVPLYSSPYYYFGMDV

SEQ ID NO: 107609 - protein, 9 aa, Homo sapiens
  light chain complementarity determining region 3 for antibody 53805
QQYNSYPYT

SEQ ID NO: 107610 - protein, 17 aa, Homo sapiens
  heavy chain complementarity determining region 3 for antibody 53805
ASLVLRYSDWLLPHFDY

SEQ ID NO: 107611 - protein, 9 aa, Homo sapiens
  light chain complementarity determining region 3 for antibody 53806
QQYNSYPYT

SEQ ID NO: 107612 - protein, 11 aa, Homo sapiens
  heavy chain complementarity determining region 3 for antibody 53806
ARGYSSGFFDY

SEQ ID NO: 107613 - protein, 9 aa, Homo sapiens
  light chain complementarity determining region 3 for antibody 53807
QQYNSYPYT

SEQ ID NO: 107614 - protein, 17 aa, Homo sapiens
  heavy chain complementarity determining region 3 for antibody 53807
AREYNDILTGYWGYFDY

SEQ ID NO: 107615 - protein, 9 aa, Homo sapiens
  light chain complementarity determining region 3 for antibody 53808
QQYNSYPYT

SEQ ID NO: 107616 - protein, 8 aa, Homo sapiens
  heavy chain complementarity determining region 3 for antibody 53808
ARDDGMDV

SEQ ID NO: 107617 - protein, 9 aa, Homo sapiens
  light chain complementarity determining region 3 for antibody 53809
QQYNSYPRT

SEQ ID NO: 107618 - protein, 14 aa, Homo sapiens
  heavy chain complementarity determining region 3 for antibody 53809
AREYYYGSGSYFDY

SEQ ID NO: 107619 - protein, 9 aa, Homo sapiens
  light chain complementarity determining region 3 for antibody 53810
QQYNSYPFT

SEQ ID NO: 107620 - protein, 15 aa, Homo sapiens
  heavy chain complementarity determining region 3 for antibody 53810
AREGGWFGELLYPCY

SEQ ID NO: 107621 - protein, 9 aa, Homo sapiens
  light chain complementarity determining region 3 for antibody 53811
QQYNSYLRT

SEQ ID NO: 107622 - protein, 10 aa, Homo sapiens
  heavy chain complementarity determining region 3 for antibody 53811
ARDEDWSFDY

SEQ ID NO: 107623 - protein, 9 aa, Homo sapiens
  light chain complementarity determining region 3 for antibody 53812
QQYNSFPFT

SEQ ID NO: 107624 - protein, 17 aa, Homo sapiens
  heavy chain complementarity determining region 3 for antibody 53812
AREYNDTLTGYWGYFDY

SEQ ID NO: 107625 - protein, 9 aa, Homo sapiens
  light chain complementarity determining region 3 for antibody 53813
QQYNSFPFT

SEQ ID NO: 107626 - protein, 8 aa, Homo sapiens
  heavy chain complementarity determining region 3 for antibody 53813
ARDDGMDV

SEQ ID NO: 107627 - protein, 9 aa, Homo sapiens
  light chain complementarity determining region 3 for antibody 53814
QQYNSFPFT

SEQ ID NO: 107628 - protein, 17 aa, Homo sapiens
  heavy chain complementarity determining region 3 for antibody 53814
AGEYNDILTGYWGYFDY

SEQ ID NO: 107629 - protein, 9 aa, Homo sapiens
  light chain complementarity determining region 3 for antibody 53815
QQYNSFPFA

SEQ ID NO: 107630 - protein, 17 aa, Homo sapiens
  heavy chain complementarity determining region 3 for antibody 53815
AREYNDILTGYWGYFDY

SEQ ID NO: 107631 - protein, 9 aa, Homo sapiens
  light chain complementarity determining region 3 for antibody 53816
QQYNNYPHT

SEQ ID NO: 107632 - protein, 13 aa, Homo sapiens
  heavy chain complementarity determining region 3 for antibody 53816
AADYGDYQYYFDY

SEQ ID NO: 107633 - protein, 9 aa, Homo sapiens
  light chain complementarity determining region 3 for antibody 53817
QQYNNWPRT

SEQ ID NO: 107634 - protein, 12 aa, Homo sapiens
  heavy chain complementarity determining region 3 for antibody 53817
AREWEPGATRDY

SEQ ID NO: 107635 - protein, 9 aa, Homo sapiens
  light chain complementarity determining region 3 for antibody 53818
QQYNNWPRT

SEQ ID NO: 107636 - protein, 12 aa, Homo sapiens
  heavy chain complementarity determining region 3 for antibody 53818
AREWEPATTRDY

SEQ ID NO: 107637 - protein, 9 aa, Homo sapiens
  light chain complementarity determining region 3 for antibody 53819
QQYNNWLIT

SEQ ID NO: 107638 - protein, 12 aa, Homo sapiens
  heavy chain complementarity determining region 3 for antibody 53819
AKGLLWFGELGY

SEQ ID NO: 107639 - protein, 9 aa, Homo sapiens
  light chain complementarity determining region 3 for antibody 53820
QQYISYPFT

SEQ ID NO: 107640 - protein, 13 aa, Homo sapiens
  heavy chain complementarity determining region 3 for antibody 53820
AAAYGDYQYYFDY

SEQ ID NO: 107641 - protein, 9 aa, Homo sapiens
  light chain complementarity determining region 3 for antibody 53821
QQYGRSPPT

SEQ ID NO: 107642 - protein, 19 aa, Homo sapiens
  heavy chain complementarity determining region 3 for antibody 53821
AREGGGSGSPYYYYYSMDV

SEQ ID NO: 107643 - protein, 9 aa, Homo sapiens
  light chain complementarity determining region 3 for antibody 53822
QQSYSTPRT

SEQ ID NO: 107644 - protein, 15 aa, Homo sapiens
  heavy chain complementarity determining region 3 for antibody 53822
ARRYYDILTGYLFDY

SEQ ID NO: 107645 - protein, 10 aa, Homo sapiens
  light chain complementarity determining region 3 for antibody 53823
QQRSNWPLYT

SEQ ID NO: 107646 - protein, 12 aa, Homo sapiens
  heavy chain complementarity determining region 3 for antibody 53823
AKDDILTGYHDY

SEQ ID NO: 107647 - protein, 9 aa, Homo sapiens
  light chain complementarity determining region 3 for antibody 53824
QQLNSYPWT

SEQ ID NO: 107648 - protein, 13 aa, Homo sapiens
  heavy chain complementarity determining region 3 for antibody 53824
AREGGQGSYYFDY

SEQ ID NO: 107649 - protein, 9 aa, Homo sapiens
  light chain complementarity determining region 3 for antibody 53825
QQLNSYPLT

SEQ ID NO: 107650 - protein, 17 aa, Homo sapiens
  heavy chain complementarity determining region 3 for antibody 53825
ARDPYSGYDWAGDWFDP

SEQ ID NO: 107651 - protein, 9 aa, Homo sapiens
  light chain complementarity determining region 3 for antibody 53826
QQFNNYPYT

SEQ ID NO: 107652 - protein, 15 aa, Homo sapiens
  heavy chain complementarity determining region 3 for antibody 53826
ARDRLWFGELSPFDY

SEQ ID NO: 107653 - protein, 9 aa, Homo sapiens
  light chain complementarity determining region 3 for antibody 53827
QKYNSAPYT

SEQ ID NO: 107654 - protein, 16 aa, Homo sapiens
  heavy chain complementarity determining region 3 for antibody 53827
AKDSGSYHYYYYGMDV

SEQ ID NO: 107655 - protein, 9 aa, Homo sapiens
  light chain complementarity determining region 3 for antibody 53828
QKYNSAPLT

SEQ ID NO: 107656 - protein, 17 aa, Homo sapiens
  heavy chain complementarity determining region 3 for antibody 53828
AREYNDILTGYWGYFDY

SEQ ID NO: 107657 - protein, 10 aa, Homo sapiens
  light chain complementarity determining region 3 for antibody 53829
MQALQTPMYT

SEQ ID NO: 107658 - protein, 9 aa, Homo sapiens
  heavy chain complementarity determining region 3 for antibody 53829
ARRLDAFDI

SEQ ID NO: 107659 - protein, 9 aa, Homo sapiens
  light chain complementarity determining region 3 for antibody 53830
LQRNSYPLT

SEQ ID NO: 107660 - protein, 22 aa, Homo sapiens
  heavy chain complementarity determining region 3 for antibody 53830
ARGDYDILTGYRGYYSYYGMDV

SEQ ID NO: 107661 - protein, 9 aa, Homo sapiens
  light chain complementarity determining region 3 for antibody 53831
LQHNSYPYT

SEQ ID NO: 107662 - protein, 8 aa, Homo sapiens
  heavy chain complementarity determining region 3 for antibody 53831
ARGTTLDY

SEQ ID NO: 107663 - protein, 9 aa, Homo sapiens
  light chain complementarity determining region 3 for antibody 53832
LQHNSYPYT

SEQ ID NO: 107664 - protein, 8 aa, Homo sapiens
  heavy chain complementarity determining region 3 for antibody 53832
ARGDGMDV

SEQ ID NO: 107665 - protein, 9 aa, Homo sapiens
  light chain complementarity determining region 3 for antibody 53833
LQHNSYPYT

SEQ ID NO: 107666 - protein, 16 aa, Homo sapiens
  heavy chain complementarity determining region 3 for antibody 53833
AKDSGSYHYYYYGMDV

SEQ ID NO: 107667 - protein, 9 aa, Homo sapiens
  light chain complementarity determining region 3 for antibody 53834
LQHNSYPWT

SEQ ID NO: 107668 - protein, 13 aa, Homo sapiens
  heavy chain complementarity determining region 3 for antibody 53834
AKEGRIAVVPFDY

SEQ ID NO: 107669 - protein, 9 aa, Homo sapiens
  light chain complementarity determining region 3 for antibody 53835
LQHNSYPLT

SEQ ID NO: 107670 - protein, 22 aa, Homo sapiens
  heavy chain complementarity determining region 3 for antibody 53835
ARGDYDIVTGYRGYYSYYGMDV

SEQ ID NO: 107671 - protein, 9 aa, Homo sapiens
  light chain complementarity determining region 3 for antibody 53836
LQHNSYPLT

SEQ ID NO: 107672 - protein, 22 aa, Homo sapiens
  heavy chain complementarity determining region 3 for antibody 53836
ARGDYDILTGYQGYYSYYGMDV

SEQ ID NO: 107673 - protein, 9 aa, Homo sapiens
  light chain complementarity determining region 3 for antibody 53837
LQHNSYPFT

SEQ ID NO: 107674 - protein, 13 aa, Homo sapiens
  heavy chain complementarity determining region 3 for antibody 53837
ATRGYDILTGYPP

SEQ ID NO: 107675 - protein, 9 aa, Homo sapiens
  light chain complementarity determining region 3 for antibody 53838
LQHDNFPYT

SEQ ID NO: 107676 - protein, 11 aa, Homo sapiens
  heavy chain complementarity determining region 3 for antibody 53838
ARGRTGEGFDY

SEQ ID NO: 107677 - protein, 9 aa, Homo sapiens
  light chain complementarity determining region 3 for antibody 53839
LQHDNFPYT

SEQ ID NO: 107678 - protein, 13 aa, Homo sapiens
  heavy chain complementarity determining region 3 for antibody 53839
ARDHGYSSSCPDY

SEQ ID NO: 107679 - protein, 9 aa, Homo sapiens
  light chain complementarity determining region 3 for antibody 53840
LQDYNYPYT

SEQ ID NO: 107680 - protein, 12 aa, Homo sapiens
  heavy chain complementarity determining region 3 for antibody 53840
TTDPQRVFPFDY

SEQ ID NO: 107681 - protein, 9 aa, Homo sapiens
  light chain complementarity determining region 3 for antibody 53841
LQDYNYPYT

SEQ ID NO: 107682 - protein, 12 aa, Homo sapiens
  heavy chain complementarity determining region 3 for antibody 53841
AKDQLLWDGMDV

SEQ ID NO: 107683 - protein, 9 aa, Homo sapiens
  light chain complementarity determining region 3 for antibody 53842
LQDYNYPWT

SEQ ID NO: 107684 - protein, 17 aa, Homo sapiens
  heavy chain complementarity determining region 3 for antibody 53842
ARGVTMVRGDYYYGMDV

SEQ ID NO: 107685 - protein, 9 aa, Homo sapiens
  light chain complementarity determining region 3 for antibody 53843
LQDYNYPWT

SEQ ID NO: 107686 - protein, 8 aa, Homo sapiens
  heavy chain complementarity determining region 3 for antibody 53843
AMVQPKDY

SEQ ID NO: 107687 - protein, 9 aa, Homo sapiens
  light chain complementarity determining region 3 for antibody 53844
LQDYNYPRT

SEQ ID NO: 107688 - protein, 13 aa, Homo sapiens
  heavy chain complementarity determining region 3 for antibody 53844
ARDELGTGDYFDY

SEQ ID NO: 107689 - protein, 9 aa, Homo sapiens
  light chain complementarity determining region 3 for antibody 53845
LQDYNYPRT

SEQ ID NO: 107690 - protein, 18 aa, Homo sapiens
  heavy chain complementarity determining region 3 for antibody 53845
AKEGIVVVPAAMYWYFDL

SEQ ID NO: 107691 - protein, 9 aa, Homo sapiens
  light chain complementarity determining region 3 for antibody 53846
LQDYNYPLT

SEQ ID NO: 107692 - protein, 16 aa, Homo sapiens
  heavy chain complementarity determining region 3 for antibody 53846
ARHEPPGIAAAGVFDY

SEQ ID NO: 107693 - protein, 9 aa, Homo sapiens
  light chain complementarity determining region 3 for antibody 53847
HQSSSLPYT

SEQ ID NO: 107694 - protein, 12 aa, Homo sapiens
  heavy chain complementarity determining region 3 for antibody 53847
ARNILTGGGMDV

SEQ ID NO: 107695 - protein, 9 aa, Homo sapiens
  light chain complementarity determining region 3 for antibody 53848
HQSSSLPHT

SEQ ID NO: 107696 - protein, 10 aa, Homo sapiens
  heavy chain complementarity determining region 3 for antibody 53848
TTEGTGNFDY

SEQ ID NO: 107697 - protein, 9 aa, Homo sapiens
  light chain complementarity determining region 3 for antibody 53849
HQSSSLPHT

SEQ ID NO: 107698 - protein, 8 aa, Homo sapiens
  heavy chain complementarity determining region 3 for antibody 53849
ARNWGFDY

SEQ ID NO: 107699 - protein, 9 aa, Homo sapiens
  light chain complementarity determining region 3 for antibody 53850
HQSSSLPFT

SEQ ID NO: 107700 - protein, 11 aa, Homo sapiens
  heavy chain complementarity determining region 3 for antibody 53850
ARVLWFGGFDY

SEQ ID NO: 107701 - protein, 9 aa, Homo sapiens
  light chain complementarity determining region 3 for antibody 53851
QQYYSYPLT

SEQ ID NO: 107702 - protein, 20 aa, Homo sapiens
  heavy chain complementarity determining region 3 for antibody 53851
ARDRDYDILTGYSKGDYFDY

SEQ ID NO: 107703 - protein, 9 aa, Homo sapiens
  light chain complementarity determining region 3 for antibody 53852
QQYYSTPYT

SEQ ID NO: 107704 - protein, 12 aa, Homo sapiens
  heavy chain complementarity determining region 3 for antibody 53852
AREEIEGATFDY

SEQ ID NO: 107705 - protein, 9 aa, Homo sapiens
  light chain complementarity determining region 3 for antibody 53853
QQYSNWPYT

SEQ ID NO: 107706 - protein, 11 aa, Homo sapiens
  heavy chain complementarity determining region 3 for antibody 53853
AASGSYNWFDP

SEQ ID NO: 107707 - protein, 9 aa, Homo sapiens
  light chain complementarity determining region 3 for antibody 53854
QQYNSYSYT

SEQ ID NO: 107708 - protein, 21 aa, Homo sapiens
  heavy chain complementarity determining region 3 for antibody 53854
ARGGDIVVVPAAIYYYYGMDV

SEQ ID NO: 107709 - protein, 9 aa, Homo sapiens
  light chain complementarity determining region 3 for antibody 53855
QQYNSYSRT

SEQ ID NO: 107710 - protein, 17 aa, Homo sapiens
  heavy chain complementarity determining region 3 for antibody 53855
ARDRDVSTYYDIFPFDY

SEQ ID NO: 107711 - protein, 9 aa, Homo sapiens
  light chain complementarity determining region 3 for antibody 53856
QQYNSYQYT

SEQ ID NO: 107712 - protein, 19 aa, Homo sapiens
  heavy chain complementarity determining region 3 for antibody 53856
VRDKVPLYSSPYYYFGMDV

SEQ ID NO: 107713 - protein, 9 aa, Homo sapiens
  light chain complementarity determining region 3 for antibody 53857
QQYNSYPYT

SEQ ID NO: 107714 - protein, 8 aa, Homo sapiens
  heavy chain complementarity determining region 3 for antibody 53857
ARTGPLDY

SEQ ID NO: 107715 - protein, 9 aa, Homo sapiens
  light chain complementarity determining region 3 for antibody 53858
QQYNSYPYT

SEQ ID NO: 107716 - protein, 17 aa, Homo sapiens
  heavy chain complementarity determining region 3 for antibody 53858
ARLGLRYSDWLLPHFDY

SEQ ID NO: 107717 - protein, 9 aa, Homo sapiens
  light chain complementarity determining region 3 for antibody 53859
QQYNSYPYT

SEQ ID NO: 107718 - protein, 15 aa, Homo sapiens
  heavy chain complementarity determining region 3 for antibody 53859
ARGGGSGWYPGCFDY

SEQ ID NO: 107719 - protein, 9 aa, Homo sapiens
  light chain complementarity determining region 3 for antibody 53860
QQYNSYPYT

SEQ ID NO: 107720 - protein, 18 aa, Homo sapiens
  heavy chain complementarity determining region 3 for antibody 53860
ARERRDDILTGYYDTFDI

SEQ ID NO: 107721 - protein, 9 aa, Homo sapiens
  light chain complementarity determining region 3 for antibody 53861
QQYNSYPWT

SEQ ID NO: 107722 - protein, 13 aa, Homo sapiens
  heavy chain complementarity determining region 3 for antibody 53861
ARGATMVRGVFDY

SEQ ID NO: 107723 - protein, 9 aa, Homo sapiens
  light chain complementarity determining region 3 for antibody 53862
QQYNSYPWT

SEQ ID NO: 107724 - protein, 14 aa, Homo sapiens
  heavy chain complementarity determining region 3 for antibody 53862
AREDYYGSGDAFDI

SEQ ID NO: 107725 - protein, 9 aa, Homo sapiens
  light chain complementarity determining region 3 for antibody 53863
QQYNSYPIT

SEQ ID NO: 107726 - protein, 17 aa, Homo sapiens
  heavy chain complementarity determining region 3 for antibody 53863
ARGGYCGSGSYYPPFDY

SEQ ID NO: 107727 - protein, 9 aa, Homo sapiens
  light chain complementarity determining region 3 for antibody 53864
QQYNSYPHT

SEQ ID NO: 107728 - protein, 19 aa, Homo sapiens
  heavy chain complementarity determining region 3 for antibody 53864
ARERFVELEDYYYYYGMDV

SEQ ID NO: 107729 - protein, 9 aa, Homo sapiens
  light chain complementarity determining region 3 for antibody 53865
QQYNSYPFT

SEQ ID NO: 107730 - protein, 11 aa, Homo sapiens
  heavy chain complementarity determining region 3 for antibody 53865
AKDDTEYGMDV

SEQ ID NO: 107731 - protein, 9 aa, Homo sapiens
  light chain complementarity determining region 3 for antibody 53866
QQYNSFPFT

SEQ ID NO: 107732 - protein, 17 aa, Homo sapiens
  heavy chain complementarity determining region 3 for antibody 53866
ARLVLRYSDWLLPHFDY

SEQ ID NO: 107733 - protein, 9 aa, Homo sapiens
  light chain complementarity determining region 3 for antibody 53867
QQYNSFPFT

SEQ ID NO: 107734 - protein, 17 aa, Homo sapiens
  heavy chain complementarity determining region 3 for antibody 53867
AREYNDILTGYWGYFEY

SEQ ID NO: 107735 - protein, 9 aa, Homo sapiens
  light chain complementarity determining region 3 for antibody 53868
QQYNSAPLT

SEQ ID NO: 107736 - protein, 8 aa, Homo sapiens
  heavy chain complementarity determining region 3 for antibody 53868
ARTGPLDY

SEQ ID NO: 107737 - protein, 9 aa, Homo sapiens
  light chain complementarity determining region 3 for antibody 53869
QQYNNWPYT

SEQ ID NO: 107738 - protein, 11 aa, Homo sapiens
  heavy chain complementarity determining region 3 for antibody 53869
ARSSSWYYFAY

SEQ ID NO: 107739 - protein, 9 aa, Homo sapiens
  light chain complementarity determining region 3 for antibody 53870
QQYISYPFT

SEQ ID NO: 107740 - protein, 13 aa, Homo sapiens
  heavy chain complementarity determining region 3 for antibody 53870
AADYGDFQYYFDY

SEQ ID NO: 107741 - protein, 9 aa, Homo sapiens
  light chain complementarity determining region 3 for antibody 53871
QQYISYLFT

SEQ ID NO: 107742 - protein, 13 aa, Homo sapiens
  heavy chain complementarity determining region 3 for antibody 53871
AADYGDYQYYFDY

SEQ ID NO: 107743 - protein, 9 aa, Homo sapiens
  light chain complementarity determining region 3 for antibody 53872
QQYGSSPYT

SEQ ID NO: 107744 - protein, 12 aa, Homo sapiens
  heavy chain complementarity determining region 3 for antibody 53872
ARDPYSSGPFDY

SEQ ID NO: 107745 - protein, 9 aa, Homo sapiens
  light chain complementarity determining region 3 for antibody 53873
QQLNSYPYT

SEQ ID NO: 107746 - protein, 9 aa, Homo sapiens
  heavy chain complementarity determining region 3 for antibody 53873
ARRRWYLDL

SEQ ID NO: 107747 - protein, 9 aa, Homo sapiens
  light chain complementarity determining region 3 for antibody 53874
QQLNSYPYT

SEQ ID NO: 107748 - protein, 13 aa, Homo sapiens
  heavy chain complementarity determining region 3 for antibody 53874
ARPPYSSGWYFDY

SEQ ID NO: 107749 - protein, 9 aa, Homo sapiens
  light chain complementarity determining region 3 for antibody 53875
QQLNSYPYT

SEQ ID NO: 107750 - protein, 9 aa, Homo sapiens
  heavy chain complementarity determining region 3 for antibody 53875
ARKWWYFDL

SEQ ID NO: 107751 - protein, 9 aa, Homo sapiens
  light chain complementarity determining region 3 for antibody 53876
QQLNSYPYT

SEQ ID NO: 107752 - protein, 9 aa, Homo sapiens
  heavy chain complementarity determining region 3 for antibody 53876
ARKRWYFDP

SEQ ID NO: 107753 - protein, 9 aa, Homo sapiens
  light chain complementarity determining region 3 for antibody 53877
QQLNSYPRT

SEQ ID NO: 107754 - protein, 19 aa, Homo sapiens
  heavy chain complementarity determining region 3 for antibody 53877
AGNYDILTGYYNYYYGVDV

SEQ ID NO: 107755 - protein, 9 aa, Homo sapiens
  light chain complementarity determining region 3 for antibody 53878
QQLNSYPLT

SEQ ID NO: 107756 - protein, 13 aa, Homo sapiens
  heavy chain complementarity determining region 3 for antibody 53878
ARAPYGSGKYFQH

SEQ ID NO: 107757 - protein, 9 aa, Homo sapiens
  light chain complementarity determining region 3 for antibody 53879
QQHNNWLYT

SEQ ID NO: 107758 - protein, 12 aa, Homo sapiens
  heavy chain complementarity determining region 3 for antibody 53879
ARQSGSYFYFDY

SEQ ID NO: 107759 - protein, 9 aa, Homo sapiens
  light chain complementarity determining region 3 for antibody 53880
QQFSNYPLT

SEQ ID NO: 107760 - protein, 16 aa, Homo sapiens
  heavy chain complementarity determining region 3 for antibody 53880
ARGHSGSYYVGYFFDY

SEQ ID NO: 107761 - protein, 9 aa, Homo sapiens
  light chain complementarity determining region 3 for antibody 53881
QQFNNYPYT

SEQ ID NO: 107762 - protein, 20 aa, Homo sapiens
  heavy chain complementarity determining region 3 for antibody 53881
ARDRPYYDILTGHSSNAFDI

SEQ ID NO: 107763 - protein, 9 aa, Homo sapiens
  light chain complementarity determining region 3 for antibody 53882
QQDYNLPYI

SEQ ID NO: 107764 - protein, 17 aa, Homo sapiens
  heavy chain complementarity determining region 3 for antibody 53882
ARDRGYSGYDGDYGMDV

SEQ ID NO: 107765 - protein, 9 aa, Homo sapiens
  light chain complementarity determining region 3 for antibody 53883
QQDYNLPLT

SEQ ID NO: 107766 - protein, 11 aa, Homo sapiens
  heavy chain complementarity determining region 3 for antibody 53883
AGNTAAAGTHR

SEQ ID NO: 107767 - protein, 9 aa, Homo sapiens
  light chain complementarity determining region 3 for antibody 53884
QQCNSYPYT

SEQ ID NO: 107768 - protein, 18 aa, Homo sapiens
  heavy chain complementarity determining region 3 for antibody 53884
ARERRDDILTGYFDALDI

SEQ ID NO: 107769 - protein, 9 aa, Homo sapiens
  light chain complementarity determining region 3 for antibody 53885
QKYNSAPWT

SEQ ID NO: 107770 - protein, 15 aa, Homo sapiens
  heavy chain complementarity determining region 3 for antibody 53885
ARVGWSGSYYDAFDI

SEQ ID NO: 107771 - protein, 9 aa, Homo sapiens
  light chain complementarity determining region 3 for antibody 53886
QKYNSAPLT

SEQ ID NO: 107772 - protein, 8 aa, Homo sapiens
  heavy chain complementarity determining region 3 for antibody 53886
VRTGPLDY

SEQ ID NO: 107773 - protein, 9 aa, Homo sapiens
  light chain complementarity determining region 3 for antibody 53887
QKYNSAPLT

SEQ ID NO: 107774 - protein, 8 aa, Homo sapiens
  heavy chain complementarity determining region 3 for antibody 53887
ARTGPLGY

SEQ ID NO: 107775 - protein, 9 aa, Homo sapiens
  light chain complementarity determining region 3 for antibody 53888
QKYNSAPLT

SEQ ID NO: 107776 - protein, 8 aa, Homo sapiens
  heavy chain complementarity determining region 3 for antibody 53888
ARTDPLDY

SEQ ID NO: 107777 - protein, 9 aa, Homo sapiens
  light chain complementarity determining region 3 for antibody 53889
LRHNSYPYT

SEQ ID NO: 107778 - protein, 8 aa, Homo sapiens
  heavy chain complementarity determining region 3 for antibody 53889
ARDDGMDV

SEQ ID NO: 107779 - protein, 9 aa, Homo sapiens
  light chain complementarity determining region 3 for antibody 53890
LQHSSYPWT

SEQ ID NO: 107780 - protein, 6 aa, Homo sapiens
  heavy chain complementarity determining region 3 for antibody 53890
ARDPDY

SEQ ID NO: 107781 - protein, 9 aa, Homo sapiens
  light chain complementarity determining region 3 for antibody 53891
LQHNSYPWT

SEQ ID NO: 107782 - protein, 11 aa, Homo sapiens
  heavy chain complementarity determining region 3 for antibody 53891
ARANWGDAFGI

SEQ ID NO: 107783 - protein, 9 aa, Homo sapiens
  light chain complementarity determining region 3 for antibody 53892
LQHNSYPLT

SEQ ID NO: 107784 - protein, 22 aa, Homo sapiens
  heavy chain complementarity determining region 3 for antibody 53892
ARGDYDSLTGYRGYYSYYGMDV

SEQ ID NO: 107785 - protein, 9 aa, Homo sapiens
  light chain complementarity determining region 3 for antibody 53893
LQHNSYPLT

SEQ ID NO: 107786 - protein, 22 aa, Homo sapiens
  heavy chain complementarity determining region 3 for antibody 53893
ARGDYDILTGYRGYCSYYGMDV

SEQ ID NO: 107787 - protein, 9 aa, Homo sapiens
  light chain complementarity determining region 3 for antibody 53894
LQHNSYPIT

SEQ ID NO: 107788 - protein, 16 aa, Homo sapiens
  heavy chain complementarity determining region 3 for antibody 53894
ARDLLLWVRELSPKDV

SEQ ID NO: 107789 - protein, 9 aa, Homo sapiens
  light chain complementarity determining region 3 for antibody 53895
LQHNSYPFT

SEQ ID NO: 107790 - protein, 19 aa, Homo sapiens
  heavy chain complementarity determining region 3 for antibody 53895
ARDQEYYYGSGSYYNEVDY

SEQ ID NO: 107791 - protein, 9 aa, Homo sapiens
  light chain complementarity determining region 3 for antibody 53896
LQHNGYPYT

SEQ ID NO: 107792 - protein, 8 aa, Homo sapiens
  heavy chain complementarity determining region 3 for antibody 53896
ARDDGMDV

SEQ ID NO: 107793 - protein, 9 aa, Homo sapiens
  light chain complementarity determining region 3 for antibody 53897
LQHDNFPYT

SEQ ID NO: 107794 - protein, 17 aa, Homo sapiens
  heavy chain complementarity determining region 3 for antibody 53897
ARLVLRYSDWLLPHFDY

SEQ ID NO: 107795 - protein, 9 aa, Homo sapiens
  light chain complementarity determining region 3 for antibody 53898
LQHDNFPWT

SEQ ID NO: 107796 - protein, 15 aa, Homo sapiens
  heavy chain complementarity determining region 3 for antibody 53898
ARPGTYDYYYYGMDV

SEQ ID NO: 107797 - protein, 9 aa, Homo sapiens
  light chain complementarity determining region 3 for antibody 53899
LQDYNYPYT

SEQ ID NO: 107798 - protein, 10 aa, Homo sapiens
  heavy chain complementarity determining region 3 for antibody 53899
ATGSSSWYHY

SEQ ID NO: 107799 - protein, 9 aa, Homo sapiens
  light chain complementarity determining region 3 for antibody 53900
LQDYNYPYT

SEQ ID NO: 107800 - protein, 17 aa, Homo sapiens
  heavy chain complementarity determining region 3 for antibody 53900
ASVLRYFDWLPNDAFDI

SEQ ID NO: 107801 - protein, 9 aa, Homo sapiens
  light chain complementarity determining region 3 for antibody 53901
LQDYNYPYT

SEQ ID NO: 107802 - protein, 17 aa, Homo sapiens
  heavy chain complementarity determining region 3 for antibody 53901
ARGAAVAGYYYYYGMDV

SEQ ID NO: 107803 - protein, 9 aa, Homo sapiens
  light chain complementarity determining region 3 for antibody 53902
LQDYNYPYT

SEQ ID NO: 107804 - protein, 15 aa, Homo sapiens
  heavy chain complementarity determining region 3 for antibody 53902
AKDRGYSYGPDAFDI

SEQ ID NO: 107805 - protein, 9 aa, Homo sapiens
  light chain complementarity determining region 3 for antibody 53903
LQDYNYPRT

SEQ ID NO: 107806 - protein, 13 aa, Homo sapiens
  heavy chain complementarity determining region 3 for antibody 53903
ARDREWLREGFDY

SEQ ID NO: 107807 - protein, 9 aa, Homo sapiens
  light chain complementarity determining region 3 for antibody 53904
LQDYNYPRT

SEQ ID NO: 107808 - protein, 20 aa, Homo sapiens
  heavy chain complementarity determining region 3 for antibody 53904
AKDQGDIVATIMDYYYGMDV

SEQ ID NO: 107809 - protein, 9 aa, Homo sapiens
  light chain complementarity determining region 3 for antibody 53905
LQDYNYPLT

SEQ ID NO: 107810 - protein, 20 aa, Homo sapiens
  heavy chain complementarity determining region 3 for antibody 53905
ATRDIITSQNIVIQGNWFDP

SEQ ID NO: 107811 - protein, 9 aa, Homo sapiens
  light chain complementarity determining region 3 for antibody 53906
LQDYNYPFT

SEQ ID NO: 107812 - protein, 18 aa, Homo sapiens
  heavy chain complementarity determining region 3 for antibody 53906
AARITMVRGEDYYYGMDV

SEQ ID NO: 107813 - protein, 9 aa, Homo sapiens
  light chain complementarity determining region 3 for antibody 53907
LQDYFYLPI

SEQ ID NO: 107814 - protein, 15 aa, Homo sapiens
  heavy chain complementarity determining region 3 for antibody 53907
ARDLWYSGSSYGMDV

SEQ ID NO: 107815 - protein, 9 aa, Homo sapiens
  light chain complementarity determining region 3 for antibody 53908
HQSSSLPHT

SEQ ID NO: 107816 - protein, 18 aa, Homo sapiens
  heavy chain complementarity determining region 3 for antibody 53908
ARGGDYDILTGYYKRIDP

SEQ ID NO: 107817 - protein, 9 aa, Homo sapiens
  light chain complementarity determining region 3 for antibody 53909
HQSSSLPFT

SEQ ID NO: 107818 - protein, 11 aa, Homo sapiens
  heavy chain complementarity determining region 3 for antibody 53909
ARLRWFGGFDY

SEQ ID NO: 107819 - protein, 9 aa, Homo sapiens
  light chain complementarity determining region 3 for antibody 53910
HQSSSLPFT

SEQ ID NO: 107820 - protein, 11 aa, Homo sapiens
  heavy chain complementarity determining region 3 for antibody 53910
ARFPWFGGFDY

SEQ ID NO: 107821 - protein, 9 aa, Homo sapiens
  light chain complementarity determining region 3 for antibody 53911
HQSSSLPFT

SEQ ID NO: 107822 - protein, 12 aa, Homo sapiens
  heavy chain complementarity determining region 3 for antibody 53911
AREPIYYYGMDV

SEQ ID NO: 107823 - protein, 9 aa, Homo sapiens
  light chain complementarity determining region 3 for antibody 53912
QQYYSYPLT

SEQ ID NO: 107824 - protein, 13 aa, Homo sapiens
  heavy chain complementarity determining region 3 for antibody 53912
AKQVPAAMSYFDY

SEQ ID NO: 107825 - protein, 8 aa, Homo sapiens
  light chain complementarity determining region 3 for antibody 53913
QQYNSYST

SEQ ID NO: 107826 - protein, 14 aa, Homo sapiens
  heavy chain complementarity determining region 3 for antibody 53913
ARQGYSSGWPYFDY

SEQ ID NO: 107827 - protein, 9 aa, Homo sapiens
  light chain complementarity determining region 3 for antibody 53914
QQYNSYPYT

SEQ ID NO: 107828 - protein, 11 aa, Homo sapiens
  heavy chain complementarity determining region 3 for antibody 53914
ARSGSGDAFDI

SEQ ID NO: 107829 - protein, 9 aa, Homo sapiens
  light chain complementarity determining region 3 for antibody 53915
QQYNSYPYT

SEQ ID NO: 107830 - protein, 17 aa, Homo sapiens
  heavy chain complementarity determining region 3 for antibody 53915
ARLVLRYADWLLPHFDY

SEQ ID NO: 107831 - protein, 9 aa, Homo sapiens
  light chain complementarity determining region 3 for antibody 53916
QQYNSYPYT

SEQ ID NO: 107832 - protein, 17 aa, Homo sapiens
  heavy chain complementarity determining region 3 for antibody 53916
ARLVFRYSDWLLPHFDY

SEQ ID NO: 107833 - protein, 9 aa, Homo sapiens
  light chain complementarity determining region 3 for antibody 53917
QQYNSYPLT

SEQ ID NO: 107834 - protein, 12 aa, Homo sapiens
  heavy chain complementarity determining region 3 for antibody 53917
AREDYDILTGYD

SEQ ID NO: 107835 - protein, 9 aa, Homo sapiens
  light chain complementarity determining region 3 for antibody 53918
QQYNSYPIT

SEQ ID NO: 107836 - protein, 17 aa, Homo sapiens
  heavy chain complementarity determining region 3 for antibody 53918
ARGGYYGSGSYYPPFDY

SEQ ID NO: 107837 - protein, 9 aa, Homo sapiens
  light chain complementarity determining region 3 for antibody 53919
QQYNSYPFT

SEQ ID NO: 107838 - protein, 17 aa, Homo sapiens
  heavy chain complementarity determining region 3 for antibody 53919
ARLVLRYSDWLLPHFDY

SEQ ID NO: 107839 - protein, 9 aa, Homo sapiens
  light chain complementarity determining region 3 for antibody 53920
QQYNSHPLT

SEQ ID NO: 107840 - protein, 17 aa, Homo sapiens
  heavy chain complementarity determining region 3 for antibody 53920
AREGVVTMVRGVGWFDP

SEQ ID NO: 107841 - protein, 9 aa, Homo sapiens
  light chain complementarity determining region 3 for antibody 53921
QQYNSFPFT

SEQ ID NO: 107842 - protein, 17 aa, Homo sapiens
  heavy chain complementarity determining region 3 for antibody 53921
ARGYNDILTGYWGYFDY

SEQ ID NO: 107843 - protein, 9 aa, Homo sapiens
  light chain complementarity determining region 3 for antibody 53922
QQYNSFPFT

SEQ ID NO: 107844 - protein, 17 aa, Homo sapiens
  heavy chain complementarity determining region 3 for antibody 53922
AREYNDMLTGYWGYFDY

SEQ ID NO: 107845 - protein, 9 aa, Homo sapiens
  light chain complementarity determining region 3 for antibody 53923
QQYNSFPFT

SEQ ID NO: 107846 - protein, 17 aa, Homo sapiens
  heavy chain complementarity determining region 3 for antibody 53923
AREYNDIVTGYWGYFDY

SEQ ID NO: 107847 - protein, 9 aa, Homo sapiens
  light chain complementarity determining region 3 for antibody 53924
QQYNSFPFT

SEQ ID NO: 107848 - protein, 17 aa, Homo sapiens
  heavy chain complementarity determining region 3 for antibody 53924
AREYNDILTGYWGYFAY

SEQ ID NO: 107849 - protein, 9 aa, Homo sapiens
  light chain complementarity determining region 3 for antibody 53925
QQYNNYPRT

SEQ ID NO: 107850 - protein, 10 aa, Homo sapiens
  heavy chain complementarity determining region 3 for antibody 53925
ARDKGYYFDY

SEQ ID NO: 107851 - protein, 9 aa, Homo sapiens
  light chain complementarity determining region 3 for antibody 53926
QQYNNWPLT

SEQ ID NO: 107852 - protein, 14 aa, Homo sapiens
  heavy chain complementarity determining region 3 for antibody 53926
ARDHMTMVRGVFDY

SEQ ID NO: 107853 - protein, 10 aa, Homo sapiens
  light chain complementarity determining region 3 for antibody 53927
QQYNNWLMYT

SEQ ID NO: 107854 - protein, 17 aa, Homo sapiens
  heavy chain complementarity determining region 3 for antibody 53927
AREYYYGSGSYYNPFDY

SEQ ID NO: 107855 - protein, 9 aa, Homo sapiens
  light chain complementarity determining region 3 for antibody 53928
QQYISYQFT

SEQ ID NO: 107856 - protein, 13 aa, Homo sapiens
  heavy chain complementarity determining region 3 for antibody 53928
AADYGDYQYYFDY

SEQ ID NO: 107857 - protein, 9 aa, Homo sapiens
  light chain complementarity determining region 3 for antibody 53929
QQYISYPFI

SEQ ID NO: 107858 - protein, 13 aa, Homo sapiens
  heavy chain complementarity determining region 3 for antibody 53929
AADYGDYQYYFDY

SEQ ID NO: 107859 - protein, 9 aa, Homo sapiens
  light chain complementarity determining region 3 for antibody 53930
QQYIGYPFT

SEQ ID NO: 107860 - protein, 13 aa, Homo sapiens
  heavy chain complementarity determining region 3 for antibody 53930
AADYGDYQYYFDY

SEQ ID NO: 107861 - protein, 10 aa, Homo sapiens
  light chain complementarity determining region 3 for antibody 53931
QQYGSSPMYT

SEQ ID NO: 107862 - protein, 14 aa, Homo sapiens
  heavy chain complementarity determining region 3 for antibody 53931
AREGFRGYYYGMDV

SEQ ID NO: 107863 - protein, 9 aa, Homo sapiens
  light chain complementarity determining region 3 for antibody 53932
QQYGSSPFT

SEQ ID NO: 107864 - protein, 14 aa, Homo sapiens
  heavy chain complementarity determining region 3 for antibody 53932
ARGDYDILTGPFDY

SEQ ID NO: 107865 - protein, 9 aa, Homo sapiens
  light chain complementarity determining region 3 for antibody 53933
QQYGNSPYT

SEQ ID NO: 107866 - protein, 15 aa, Homo sapiens
  heavy chain complementarity determining region 3 for antibody 53933
AKVPTMVRGVGWFDP

SEQ ID NO: 107867 - protein, 8 aa, Homo sapiens
  light chain complementarity determining region 3 for antibody 53934
QQRSNWLT

SEQ ID NO: 107868 - protein, 15 aa, Homo sapiens
  heavy chain complementarity determining region 3 for antibody 53934
ATDRARGYYYYGMDV

SEQ ID NO: 107869 - protein, 9 aa, Homo sapiens
  light chain complementarity determining region 3 for antibody 53935
QQLNSYPYT

SEQ ID NO: 107870 - protein, 9 aa, Homo sapiens
  heavy chain complementarity determining region 3 for antibody 53935
ARKRWYFDI

SEQ ID NO: 107871 - protein, 9 aa, Homo sapiens
  light chain complementarity determining region 3 for antibody 53936
QQLNSYPYT

SEQ ID NO: 107872 - protein, 12 aa, Homo sapiens
  heavy chain complementarity determining region 3 for antibody 53936
ARESGSYSDFDY

SEQ ID NO: 107873 - protein, 9 aa, Homo sapiens
  light chain complementarity determining region 3 for antibody 53937
QQLNSYPYT

SEQ ID NO: 107874 - protein, 9 aa, Homo sapiens
  heavy chain complementarity determining region 3 for antibody 53937
ARERWYFDL

SEQ ID NO: 107875 - protein, 9 aa, Homo sapiens
  light chain complementarity determining region 3 for antibody 53938
QQLNSYPWT

SEQ ID NO: 107876 - protein, 18 aa, Homo sapiens
  heavy chain complementarity determining region 3 for antibody 53938
AREGYFDWSSYYYYGMDV

SEQ ID NO: 107877 - protein, 9 aa, Homo sapiens
  light chain complementarity determining region 3 for antibody 53939
QQLNSYPPT

SEQ ID NO: 107878 - protein, 13 aa, Homo sapiens
  heavy chain complementarity determining region 3 for antibody 53939
ARADTAMVNPFDY

SEQ ID NO: 107879 - protein, 9 aa, Homo sapiens
  light chain complementarity determining region 3 for antibody 53940
QQLNSYPPT

SEQ ID NO: 107880 - protein, 13 aa, Homo sapiens
  heavy chain complementarity determining region 3 for antibody 53940
AADYGDYQYYIDY

SEQ ID NO: 107881 - protein, 9 aa, Homo sapiens
  light chain complementarity determining region 3 for antibody 53941
QQFSNYPFT

SEQ ID NO: 107882 - protein, 16 aa, Homo sapiens
  heavy chain complementarity determining region 3 for antibody 53941
ARGRGYYGSGSPYFDY

SEQ ID NO: 107883 - protein, 9 aa, Homo sapiens
  light chain complementarity determining region 3 for antibody 53942
QQDYNLPLT

SEQ ID NO: 107884 - protein, 13 aa, Homo sapiens
  heavy chain complementarity determining region 3 for antibody 53942
ARRNWGSPDAFDI

SEQ ID NO: 107885 - protein, 9 aa, Homo sapiens
  light chain complementarity determining region 3 for antibody 53943
QQDYNLPLT

SEQ ID NO: 107886 - protein, 11 aa, Homo sapiens
  heavy chain complementarity determining region 3 for antibody 53943
AGNIAAAGTHL

SEQ ID NO: 107887 - protein, 9 aa, Homo sapiens
  light chain complementarity determining region 3 for antibody 53944
QKYKSAPLT

SEQ ID NO: 107888 - protein, 8 aa, Homo sapiens
  heavy chain complementarity determining region 3 for antibody 53944
ARTGPLDY

SEQ ID NO: 107889 - protein, 9 aa, Homo sapiens
  light chain complementarity determining region 3 for antibody 53945
QHLNSYPIT

SEQ ID NO: 107890 - protein, 13 aa, Homo sapiens
  heavy chain complementarity determining region 3 for antibody 53945
ARIAAPAVQYFQH

SEQ ID NO: 107891 - protein, 9 aa, Homo sapiens
  light chain complementarity determining region 3 for antibody 53946
LQRNSYPWT

SEQ ID NO: 107892 - protein, 6 aa, Homo sapiens
  heavy chain complementarity determining region 3 for antibody 53946
ARDPDY

SEQ ID NO: 107893 - protein, 9 aa, Homo sapiens
  light chain complementarity determining region 3 for antibody 53947
LQHNSYPYT

SEQ ID NO: 107894 - protein, 8 aa, Homo sapiens
  heavy chain complementarity determining region 3 for antibody 53947
ARTGPLDY

SEQ ID NO: 107895 - protein, 9 aa, Homo sapiens
  light chain complementarity determining region 3 for antibody 53948
LQHNSYPYT

SEQ ID NO: 107896 - protein, 19 aa, Homo sapiens
  heavy chain complementarity determining region 3 for antibody 53948
ARDYDILTGYYENYYGMDV

SEQ ID NO: 107897 - protein, 9 aa, Homo sapiens
  light chain complementarity determining region 3 for antibody 53949
LQHNSYPYT

SEQ ID NO: 107898 - protein, 19 aa, Homo sapiens
  heavy chain complementarity determining region 3 for antibody 53949
ARDHDILTGYYRDYYGMDV

SEQ ID NO: 107899 - protein, 9 aa, Homo sapiens
  light chain complementarity determining region 3 for antibody 53950
LQHNSYPPT

SEQ ID NO: 107900 - protein, 15 aa, Homo sapiens
  heavy chain complementarity determining region 3 for antibody 53950
ARGEDSSSWYGAFDI

SEQ ID NO: 107901 - protein, 9 aa, Homo sapiens
  light chain complementarity determining region 3 for antibody 53951
LQHNSYPLT

SEQ ID NO: 107902 - protein, 17 aa, Homo sapiens
  heavy chain complementarity determining region 3 for antibody 53951
ARLVLRYSDWLLPHFDY

SEQ ID NO: 107903 - protein, 9 aa, Homo sapiens
  light chain complementarity determining region 3 for antibody 53952
LQHNSYPLT

SEQ ID NO: 107904 - protein, 22 aa, Homo sapiens
  heavy chain complementarity determining region 3 for antibody 53952
ARGDYDIWTGYRGYYSYYGMDV

SEQ ID NO: 107905 - protein, 9 aa, Homo sapiens
  light chain complementarity determining region 3 for antibody 53953
LQHNSYPLT

SEQ ID NO: 107906 - protein, 22 aa, Homo sapiens
  heavy chain complementarity determining region 3 for antibody 53953
ARGDYDILTGCRGYYSYYGMDV

SEQ ID NO: 107907 - protein, 9 aa, Homo sapiens
  light chain complementarity determining region 3 for antibody 53954
LQHNSYPLT

SEQ ID NO: 107908 - protein, 13 aa, Homo sapiens
  heavy chain complementarity determining region 3 for antibody 53954
ARARIAVAALFDY

SEQ ID NO: 107909 - protein, 9 aa, Homo sapiens
  light chain complementarity determining region 3 for antibody 53955
LQHNSYPFT

SEQ ID NO: 107910 - protein, 16 aa, Homo sapiens
  heavy chain complementarity determining region 3 for antibody 53955
ARRGYDILTGYSYFDY

SEQ ID NO: 107911 - protein, 9 aa, Homo sapiens
  light chain complementarity determining region 3 for antibody 53956
LQHDNFPYT

SEQ ID NO: 107912 - protein, 7 aa, Homo sapiens
  heavy chain complementarity determining region 3 for antibody 53956
ARDAGDY

SEQ ID NO: 107913 - protein, 9 aa, Homo sapiens
  light chain complementarity determining region 3 for antibody 53957
LQDYSYPWT

SEQ ID NO: 107914 - protein, 17 aa, Homo sapiens
  heavy chain complementarity determining region 3 for antibody 53957
AREGTLVRGGYYYGTDV

SEQ ID NO: 107915 - protein, 9 aa, Homo sapiens
  light chain complementarity determining region 3 for antibody 53958
LQDYNYPYT

SEQ ID NO: 107916 - protein, 17 aa, Homo sapiens
  heavy chain complementarity determining region 3 for antibody 53958
ARLVLRYSDWLLPHFDY

SEQ ID NO: 107917 - protein, 9 aa, Homo sapiens
  light chain complementarity determining region 3 for antibody 53959
LQDYNYPYT

SEQ ID NO: 107918 - protein, 14 aa, Homo sapiens
  heavy chain complementarity determining region 3 for antibody 53959
ARDSGLGSSYGMDV

SEQ ID NO: 107919 - protein, 9 aa, Homo sapiens
  light chain complementarity determining region 3 for antibody 53960
LQDYNYPYT

SEQ ID NO: 107920 - protein, 11 aa, Homo sapiens
  heavy chain complementarity determining region 3 for antibody 53960
ARDPYQPLGDY

SEQ ID NO: 107921 - protein, 9 aa, Homo sapiens
  light chain complementarity determining region 3 for antibody 53961
LQDYNYPYT

SEQ ID NO: 107922 - protein, 18 aa, Homo sapiens
  heavy chain complementarity determining region 3 for antibody 53961
ARAYDILTGYDYYYGMDV

SEQ ID NO: 107923 - protein, 9 aa, Homo sapiens
  light chain complementarity determining region 3 for antibody 53962
LQDYNYPYT

SEQ ID NO: 107924 - protein, 19 aa, Homo sapiens
  heavy chain complementarity determining region 3 for antibody 53962
AQDRSGSFGALYHYYGMDV

SEQ ID NO: 107925 - protein, 9 aa, Homo sapiens
  light chain complementarity determining region 3 for antibody 53963
LQDYNYPWT

SEQ ID NO: 107926 - protein, 21 aa, Homo sapiens
  heavy chain complementarity determining region 3 for antibody 53963
ARVYYGSGSYSPIGYYYGMDV

SEQ ID NO: 107927 - protein, 9 aa, Homo sapiens
  light chain complementarity determining region 3 for antibody 53964
LQDYNYPWT

SEQ ID NO: 107928 - protein, 22 aa, Homo sapiens
  heavy chain complementarity determining region 3 for antibody 53964
ARGDYDILTGYRGYYSYYGMDV

SEQ ID NO: 107929 - protein, 9 aa, Homo sapiens
  light chain complementarity determining region 3 for antibody 53965
LQDYNYPWT

SEQ ID NO: 107930 - protein, 15 aa, Homo sapiens
  heavy chain complementarity determining region 3 for antibody 53965
ARDRYYGSGSYLFDY

SEQ ID NO: 107931 - protein, 9 aa, Homo sapiens
  light chain complementarity determining region 3 for antibody 53966
LQDYNYPWT

SEQ ID NO: 107932 - protein, 14 aa, Homo sapiens
  heavy chain complementarity determining region 3 for antibody 53966
ARAGTTGTSYGIDV

SEQ ID NO: 107933 - protein, 9 aa, Homo sapiens
  light chain complementarity determining region 3 for antibody 53967
LQDYNYPRT

SEQ ID NO: 107934 - protein, 12 aa, Homo sapiens
  heavy chain complementarity determining region 3 for antibody 53967
TLDLGISGWFDH

SEQ ID NO: 107935 - protein, 9 aa, Homo sapiens
  light chain complementarity determining region 3 for antibody 53968
LQDYNYPRT

SEQ ID NO: 107936 - protein, 14 aa, Homo sapiens
  heavy chain complementarity determining region 3 for antibody 53968
AREVLWFGVNYFDY

SEQ ID NO: 107937 - protein, 9 aa, Homo sapiens
  light chain complementarity determining region 3 for antibody 53969
LQDYNYPRT

SEQ ID NO: 107938 - protein, 21 aa, Homo sapiens
  heavy chain complementarity determining region 3 for antibody 53969
ARETTMVRGVPSADYYYGMDV

SEQ ID NO: 107939 - protein, 9 aa, Homo sapiens
  light chain complementarity determining region 3 for antibody 53970
LQDYNYPLT

SEQ ID NO: 107940 - protein, 17 aa, Homo sapiens
  heavy chain complementarity determining region 3 for antibody 53970
ARDKKVGATDYYYGMDV

SEQ ID NO: 107941 - protein, 9 aa, Homo sapiens
  light chain complementarity determining region 3 for antibody 53971
LQDYNYPHT

SEQ ID NO: 107942 - protein, 16 aa, Homo sapiens
  heavy chain complementarity determining region 3 for antibody 53971
ARDPGLTGVGEYGMDV

SEQ ID NO: 107943 - protein, 9 aa, Homo sapiens
  light chain complementarity determining region 3 for antibody 53972
LQDYNYPFT

SEQ ID NO: 107944 - protein, 18 aa, Homo sapiens
  heavy chain complementarity determining region 3 for antibody 53972
ARGIAVAGTRDYYYGMDV

SEQ ID NO: 107945 - protein, 9 aa, Homo sapiens
  light chain complementarity determining region 3 for antibody 53973
LQDYFYPPI

SEQ ID NO: 107946 - protein, 15 aa, Homo sapiens
  heavy chain complementarity determining region 3 for antibody 53973
ARDLWCSGSSYGMDV

SEQ ID NO: 107947 - protein, 9 aa, Homo sapiens
  light chain complementarity determining region 3 for antibody 53974
LKYNSAPLT

SEQ ID NO: 107948 - protein, 8 aa, Homo sapiens
  heavy chain complementarity determining region 3 for antibody 53974
ARTGPLDY

SEQ ID NO: 107949 - protein, 9 aa, Homo sapiens
  light chain complementarity determining region 3 for antibody 53975
HQSSSLPYS

SEQ ID NO: 107950 - protein, 18 aa, Homo sapiens
  heavy chain complementarity determining region 3 for antibody 53975
ARHPLYSSSWYDEGVFDY

SEQ ID NO: 107951 - protein, 9 aa, Homo sapiens
  light chain complementarity determining region 3 for antibody 53976
HQSSSLPLT

SEQ ID NO: 107952 - protein, 15 aa, Homo sapiens
  heavy chain complementarity determining region 3 for antibody 53976
ARAGRYSSDWSHFDY

SEQ ID NO: 107953 - protein, 9 aa, Homo sapiens
  light chain complementarity determining region 3 for antibody 53977
HQSSSLPHT

SEQ ID NO: 107954 - protein, 16 aa, Homo sapiens
  heavy chain complementarity determining region 3 for antibody 53977
AKDSGSYHYYYYGMDV

SEQ ID NO: 107955 - protein, 9 aa, Homo sapiens
  light chain complementarity determining region 3 for antibody 53978
HQSSSLPFT

SEQ ID NO: 107956 - protein, 11 aa, Homo sapiens
  heavy chain complementarity determining region 3 for antibody 53978
ARLPWSGGFDY

SEQ ID NO: 107957 - protein, 9 aa, Homo sapiens
  light chain complementarity determining region 3 for antibody 53979
QQYSSYPYT

SEQ ID NO: 107958 - protein, 17 aa, Homo sapiens
  heavy chain complementarity determining region 3 for antibody 53979
ARLVLRYSDWLLPHFDY

SEQ ID NO: 107959 - protein, 9 aa, Homo sapiens
  light chain complementarity determining region 3 for antibody 53980
QQYNSYPYT

SEQ ID NO: 107960 - protein, 17 aa, Homo sapiens
  heavy chain complementarity determining region 3 for antibody 53980
ARLVLRYSEWLLPHFDY

SEQ ID NO: 107961 - protein, 9 aa, Homo sapiens
  light chain complementarity determining region 3 for antibody 53981
QQYNSYPYT

SEQ ID NO: 107962 - protein, 17 aa, Homo sapiens
  heavy chain complementarity determining region 3 for antibody 53981
ARLVLRYSDWLSPHFDY

SEQ ID NO: 107963 - protein, 9 aa, Homo sapiens
  light chain complementarity determining region 3 for antibody 53982
QQYNSYPYT

SEQ ID NO: 107964 - protein, 17 aa, Homo sapiens
  heavy chain complementarity determining region 3 for antibody 53982
ARLVLRYSDWLLPYFDY

SEQ ID NO: 107965 - protein, 9 aa, Homo sapiens
  light chain complementarity determining region 3 for antibody 53983
QQYNSYPYT

SEQ ID NO: 107966 - protein, 17 aa, Homo sapiens
  heavy chain complementarity determining region 3 for antibody 53983
ARLGLRYSDWLFPHFDY

SEQ ID NO: 107967 - protein, 9 aa, Homo sapiens
  light chain complementarity determining region 3 for antibody 53984
QQYNSYPYT

SEQ ID NO: 107968 - protein, 17 aa, Homo sapiens
  heavy chain complementarity determining region 3 for antibody 53984
ARLELRYSDWLLPHFDY

SEQ ID NO: 107969 - protein, 9 aa, Homo sapiens
  light chain complementarity determining region 3 for antibody 53985
QQYNSYPYT

SEQ ID NO: 107970 - protein, 10 aa, Homo sapiens
  heavy chain complementarity determining region 3 for antibody 53985
ARERDWGKDY

SEQ ID NO: 107971 - protein, 9 aa, Homo sapiens
  light chain complementarity determining region 3 for antibody 53986
QQYNSYPYA

SEQ ID NO: 107972 - protein, 17 aa, Homo sapiens
  heavy chain complementarity determining region 3 for antibody 53986
ARLVLRYSDWLLPHFDY

SEQ ID NO: 107973 - protein, 9 aa, Homo sapiens
  light chain complementarity determining region 3 for antibody 53987
QQYNSYPRT

SEQ ID NO: 107974 - protein, 17 aa, Homo sapiens
  heavy chain complementarity determining region 3 for antibody 53987
ARKDYDILTGYSRGMDV

SEQ ID NO: 107975 - protein, 9 aa, Homo sapiens
  light chain complementarity determining region 3 for antibody 53988
QQYNSYPLT

SEQ ID NO: 107976 - protein, 10 aa, Homo sapiens
  heavy chain complementarity determining region 3 for antibody 53988
ARASYYGMDV

SEQ ID NO: 107977 - protein, 9 aa, Homo sapiens
  light chain complementarity determining region 3 for antibody 53989
QQYNSYPIT

SEQ ID NO: 107978 - protein, 12 aa, Homo sapiens
  heavy chain complementarity determining region 3 for antibody 53989
AIVVRGVKGFDY

SEQ ID NO: 107979 - protein, 9 aa, Homo sapiens
  light chain complementarity determining region 3 for antibody 53990
QQYNSFPFT

SEQ ID NO: 107980 - protein, 8 aa, Homo sapiens
  heavy chain complementarity determining region 3 for antibody 53990
ARTGPLDY

SEQ ID NO: 107981 - protein, 9 aa, Homo sapiens
  light chain complementarity determining region 3 for antibody 53991
QQYNSFPFT

SEQ ID NO: 107982 - protein, 17 aa, Homo sapiens
  heavy chain complementarity determining region 3 for antibody 53991
AREYNDIWTGYWGYFDY

SEQ ID NO: 107983 - protein, 9 aa, Homo sapiens
  light chain complementarity determining region 3 for antibody 53992
QQYNRYPYT

SEQ ID NO: 107984 - protein, 14 aa, Homo sapiens
  heavy chain complementarity determining region 3 for antibody 53992
AKEYYDILTGYFDY

SEQ ID NO: 107985 - protein, 9 aa, Homo sapiens
  light chain complementarity determining region 3 for antibody 53993
QQYNRFPFT

SEQ ID NO: 107986 - protein, 17 aa, Homo sapiens
  heavy chain complementarity determining region 3 for antibody 53993
AREYNDILTGYWGYFDY

SEQ ID NO: 107987 - protein, 9 aa, Homo sapiens
  light chain complementarity determining region 3 for antibody 53994
QQYNNWPRT

SEQ ID NO: 107988 - protein, 13 aa, Homo sapiens
  heavy chain complementarity determining region 3 for antibody 53994
AKALNTVVTFFDY

SEQ ID NO: 107989 - protein, 10 aa, Homo sapiens
  light chain complementarity determining region 3 for antibody 53995
QQYNNWPPLT

SEQ ID NO: 107990 - protein, 13 aa, Homo sapiens
  heavy chain complementarity determining region 3 for antibody 53995
AVITMVRGVYFDY

SEQ ID NO: 107991 - protein, 9 aa, Homo sapiens
  light chain complementarity determining region 3 for antibody 53996
QQYNNWPLT

SEQ ID NO: 107992 - protein, 11 aa, Homo sapiens
  heavy chain complementarity determining region 3 for antibody 53996
AAGCSSSWLDY

SEQ ID NO: 107993 - protein, 9 aa, Homo sapiens
  light chain complementarity determining region 3 for antibody 53997
QQYNNWPFT

SEQ ID NO: 107994 - protein, 11 aa, Homo sapiens
  heavy chain complementarity determining region 3 for antibody 53997
AIQGIVGAMRY

SEQ ID NO: 107995 - protein, 9 aa, Homo sapiens
  light chain complementarity determining region 3 for antibody 53998
QQYISYPFT

SEQ ID NO: 107996 - protein, 8 aa, Homo sapiens
  heavy chain complementarity determining region 3 for antibody 53998
ARTGPLDY

SEQ ID NO: 107997 - protein, 9 aa, Homo sapiens
  light chain complementarity determining region 3 for antibody 53999
QQYISYPFT

SEQ ID NO: 107998 - protein, 13 aa, Homo sapiens
  heavy chain complementarity determining region 3 for antibody 53999
AADYGDYQYYFDH

SEQ ID NO: 107999 - protein, 9 aa, Homo sapiens
  light chain complementarity determining region 3 for antibody 54000
QQYGSSPYT

SEQ ID NO: 108000 - protein, 9 aa, Homo sapiens
  heavy chain complementarity determining region 3 for antibody 54000
ARARGPSDY

SEQ ID NO: 108001 - protein, 10 aa, Homo sapiens
  light chain complementarity determining region 3 for antibody 54001
QQYGSSPPYT

SEQ ID NO: 108002 - protein, 12 aa, Homo sapiens
  heavy chain complementarity determining region 3 for antibody 54001
ARQMYSNYYFDY

SEQ ID NO: 108003 - protein, 9 aa, Homo sapiens
  light chain complementarity determining region 3 for antibody 54002
QQYGSSPLT

SEQ ID NO: 108004 - protein, 16 aa, Homo sapiens
  heavy chain complementarity determining region 3 for antibody 54002
ARFTVRGIITPDAFDI

SEQ ID NO: 108005 - protein, 9 aa, Homo sapiens
  light chain complementarity determining region 3 for antibody 54003
QQSYSTPYT

SEQ ID NO: 108006 - protein, 16 aa, Homo sapiens
  heavy chain complementarity determining region 3 for antibody 54003
ASRSYYDILTGYYFDY

SEQ ID NO: 108007 - protein, 10 aa, Homo sapiens
  light chain complementarity determining region 3 for antibody 54004
QQRSNWPMYT

SEQ ID NO: 108008 - protein, 11 aa, Homo sapiens
  heavy chain complementarity determining region 3 for antibody 54004
ATRWGGHAFDI

SEQ ID NO: 108009 - protein, 9 aa, Homo sapiens
  light chain complementarity determining region 3 for antibody 54005
QQLNSYPYT

SEQ ID NO: 108010 - protein, 9 aa, Homo sapiens
  heavy chain complementarity determining region 3 for antibody 54005
ASKRWYFDL

SEQ ID NO: 108011 - protein, 9 aa, Homo sapiens
  light chain complementarity determining region 3 for antibody 54006
QQLNSYPYT

SEQ ID NO: 108012 - protein, 9 aa, Homo sapiens
  heavy chain complementarity determining region 3 for antibody 54006
ARKTWYIDL

SEQ ID NO: 108013 - protein, 9 aa, Homo sapiens
  light chain complementarity determining region 3 for antibody 54007
QQLNSYPYT

SEQ ID NO: 108014 - protein, 9 aa, Homo sapiens
  heavy chain complementarity determining region 3 for antibody 54007
ARKRWYYDL

SEQ ID NO: 108015 - protein, 9 aa, Homo sapiens
  light chain complementarity determining region 3 for antibody 54008
QQLNSYPYT

SEQ ID NO: 108016 - protein, 9 aa, Homo sapiens
  heavy chain complementarity determining region 3 for antibody 54008
ARKRCYFDL

SEQ ID NO: 108017 - protein, 9 aa, Homo sapiens
  light chain complementarity determining region 3 for antibody 54009
QQLNSYPYA

SEQ ID NO: 108018 - protein, 9 aa, Homo sapiens
  heavy chain complementarity determining region 3 for antibody 54009
ARKRWYFDL

SEQ ID NO: 108019 - protein, 9 aa, Homo sapiens
  light chain complementarity determining region 3 for antibody 54010
QQLNSYPWT

SEQ ID NO: 108020 - protein, 16 aa, Homo sapiens
  heavy chain complementarity determining region 3 for antibody 54010
AREGYYYGSGRGAFDI

SEQ ID NO: 108021 - protein, 9 aa, Homo sapiens
  light chain complementarity determining region 3 for antibody 54011
QQLNSYPPT

SEQ ID NO: 108022 - protein, 13 aa, Homo sapiens
  heavy chain complementarity determining region 3 for antibody 54011
AADYVDYQYYFDY

SEQ ID NO: 108023 - protein, 9 aa, Homo sapiens
  light chain complementarity determining region 3 for antibody 54012
QQLNSYPPT

SEQ ID NO: 108024 - protein, 13 aa, Homo sapiens
  heavy chain complementarity determining region 3 for antibody 54012
AADYGDFQYYFDY

SEQ ID NO: 108025 - protein, 9 aa, Homo sapiens
  light chain complementarity determining region 3 for antibody 54013
QQLNSYPPT

SEQ ID NO: 108026 - protein, 13 aa, Homo sapiens
  heavy chain complementarity determining region 3 for antibody 54013
AADYGAYQYSFDY

SEQ ID NO: 108027 - protein, 9 aa, Homo sapiens
  light chain complementarity determining region 3 for antibody 54014
QQLNSHPYT

SEQ ID NO: 108028 - protein, 9 aa, Homo sapiens
  heavy chain complementarity determining region 3 for antibody 54014
ARKRWYFDL

SEQ ID NO: 108029 - protein, 9 aa, Homo sapiens
  light chain complementarity determining region 3 for antibody 54015
QQDYNLPFT

SEQ ID NO: 108030 - protein, 20 aa, Homo sapiens
  heavy chain complementarity determining region 3 for antibody 54015
ARREYYDILTGYHTPAAFDI

SEQ ID NO: 108031 - protein, 9 aa, Homo sapiens
  light chain complementarity determining region 3 for antibody 54016
QQDYNLPFT

SEQ ID NO: 108032 - protein, 11 aa, Homo sapiens
  heavy chain complementarity determining region 3 for antibody 54016
AGNIAAAGTHR

SEQ ID NO: 108033 - protein, 9 aa, Homo sapiens
  light chain complementarity determining region 3 for antibody 54017
QQCNSYPYT

SEQ ID NO: 108034 - protein, 18 aa, Homo sapiens
  heavy chain complementarity determining region 3 for antibody 54017
AREGRDDILTGYFDAFDI

SEQ ID NO: 108035 - protein, 9 aa, Homo sapiens
  light chain complementarity determining region 3 for antibody 54018
QKYNSAPLT

SEQ ID NO: 108036 - protein, 8 aa, Homo sapiens
  heavy chain complementarity determining region 3 for antibody 54018
ARTGHLDY

SEQ ID NO: 108037 - protein, 9 aa, Homo sapiens
  light chain complementarity determining region 3 for antibody 54019
QKYNSAPLT

SEQ ID NO: 108038 - protein, 8 aa, Homo sapiens
  heavy chain complementarity determining region 3 for antibody 54019
AGTGPLDY

SEQ ID NO: 108039 - protein, 9 aa, Homo sapiens
  light chain complementarity determining region 3 for antibody 54020
QKYNSAPLT

SEQ ID NO: 108040 - protein, 13 aa, Homo sapiens
  heavy chain complementarity determining region 3 for antibody 54020
AADYGDYQYYFDY

SEQ ID NO: 108041 - protein, 9 aa, Homo sapiens
  light chain complementarity determining region 3 for antibody 54021
PQHNSYPYT

SEQ ID NO: 108042 - protein, 8 aa, Homo sapiens
  heavy chain complementarity determining region 3 for antibody 54021
ARDDGMDA

SEQ ID NO: 108043 - protein, 9 aa, Homo sapiens
  light chain complementarity determining region 3 for antibody 54022
LRDYNYPYT

SEQ ID NO: 108044 - protein, 20 aa, Homo sapiens
  heavy chain complementarity determining region 3 for antibody 54022
AKDGPTMVRGVMGYYYGMDV

SEQ ID NO: 108045 - protein, 9 aa, Homo sapiens
  light chain complementarity determining region 3 for antibody 54023
LQHNSYPYT

SEQ ID NO: 108046 - protein, 8 aa, Homo sapiens
  heavy chain complementarity determining region 3 for antibody 54023
AREDGMDV

SEQ ID NO: 108047 - protein, 9 aa, Homo sapiens
  light chain complementarity determining region 3 for antibody 54024
LQHNSYPYT

SEQ ID NO: 108048 - protein, 13 aa, Homo sapiens
  heavy chain complementarity determining region 3 for antibody 54024
ARDGDYYYYGMDV

SEQ ID NO: 108049 - protein, 9 aa, Homo sapiens
  light chain complementarity determining region 3 for antibody 54025
LQHNSYPYT

SEQ ID NO: 108050 - protein, 14 aa, Homo sapiens
  heavy chain complementarity determining region 3 for antibody 54025
ARDGDFYYYYGMDV

SEQ ID NO: 108051 - protein, 9 aa, Homo sapiens
  light chain complementarity determining region 3 for antibody 54026
LQHNSYPLT

SEQ ID NO: 108052 - protein, 8 aa, Homo sapiens
  heavy chain complementarity determining region 3 for antibody 54026
ARTGPLDY

SEQ ID NO: 108053 - protein, 9 aa, Homo sapiens
  light chain complementarity determining region 3 for antibody 54027
LQHNSYPLT

SEQ ID NO: 108054 - protein, 22 aa, Homo sapiens
  heavy chain complementarity determining region 3 for antibody 54027
ARGDYDVLTGYRGYYSYYGMDV

SEQ ID NO: 108055 - protein, 9 aa, Homo sapiens
  light chain complementarity determining region 3 for antibody 54028
LQHNSYPLT

SEQ ID NO: 108056 - protein, 22 aa, Homo sapiens
  heavy chain complementarity determining region 3 for antibody 54028
ARGDYDILTGYRGYYSYYGIDV

SEQ ID NO: 108057 - protein, 9 aa, Homo sapiens
  light chain complementarity determining region 3 for antibody 54029
LQHNSYPLT

SEQ ID NO: 108058 - protein, 22 aa, Homo sapiens
  heavy chain complementarity determining region 3 for antibody 54029
ARGDYDILTGYRGYYSYSGMDV

SEQ ID NO: 108059 - protein, 9 aa, Homo sapiens
  light chain complementarity determining region 3 for antibody 54030
LQHNSYPLT

SEQ ID NO: 108060 - protein, 22 aa, Homo sapiens
  heavy chain complementarity determining region 3 for antibody 54030
ARGDYDILTGYRGYYSSYGMDV

SEQ ID NO: 108061 - protein, 9 aa, Homo sapiens
  light chain complementarity determining region 3 for antibody 54031
LQHNSYPCT

SEQ ID NO: 108062 - protein, 8 aa, Homo sapiens
  heavy chain complementarity determining region 3 for antibody 54031
AGDDGMDV

SEQ ID NO: 108063 - protein, 9 aa, Homo sapiens
  light chain complementarity determining region 3 for antibody 54032
LQHDNFPYT

SEQ ID NO: 108064 - protein, 22 aa, Homo sapiens
  heavy chain complementarity determining region 3 for antibody 54032
ARGGDIVVVPAAIDYYYYGMDV

SEQ ID NO: 108065 - protein, 9 aa, Homo sapiens
  light chain complementarity determining region 3 for antibody 54033
LQDYNYPYT

SEQ ID NO: 108066 - protein, 15 aa, Homo sapiens
  heavy chain complementarity determining region 3 for antibody 54033
ARITMVRGVIITGDY

SEQ ID NO: 108067 - protein, 9 aa, Homo sapiens
  light chain complementarity determining region 3 for antibody 54034
LQDYNYPYT

SEQ ID NO: 108068 - protein, 22 aa, Homo sapiens
  heavy chain complementarity determining region 3 for antibody 54034
ARGYYDILTGYYNVGNYYGTGV

SEQ ID NO: 108069 - protein, 9 aa, Homo sapiens
  light chain complementarity determining region 3 for antibody 54035
LQDYNYPYT

SEQ ID NO: 108070 - protein, 17 aa, Homo sapiens
  heavy chain complementarity determining region 3 for antibody 54035
ARELRYFDWSLDDAFDI

SEQ ID NO: 108071 - protein, 9 aa, Homo sapiens
  light chain complementarity determining region 3 for antibody 54036
LQDYNYPYT

SEQ ID NO: 108072 - protein, 11 aa, Homo sapiens
  heavy chain complementarity determining region 3 for antibody 54036
ARAYYYYGMDV

SEQ ID NO: 108073 - protein, 9 aa, Homo sapiens
  light chain complementarity determining region 3 for antibody 54037
LQDYNYPRT

SEQ ID NO: 108074 - protein, 15 aa, Homo sapiens
  heavy chain complementarity determining region 3 for antibody 54037
ARGYCSGGDCYSFDY

SEQ ID NO: 108075 - protein, 9 aa, Homo sapiens
  light chain complementarity determining region 3 for antibody 54038
LQDYNYPRT

SEQ ID NO: 108076 - protein, 12 aa, Homo sapiens
  heavy chain complementarity determining region 3 for antibody 54038
ARDRSGWSHFDY

SEQ ID NO: 108077 - protein, 9 aa, Homo sapiens
  light chain complementarity determining region 3 for antibody 54039
LQDYNYPRT

SEQ ID NO: 108078 - protein, 16 aa, Homo sapiens
  heavy chain complementarity determining region 3 for antibody 54039
AKDSGSYHYYYYGMDV

SEQ ID NO: 108079 - protein, 9 aa, Homo sapiens
  light chain complementarity determining region 3 for antibody 54040
LQDYNYPLT

SEQ ID NO: 108080 - protein, 17 aa, Homo sapiens
  heavy chain complementarity determining region 3 for antibody 54040
ARDKKVGATDFYYGMDV

SEQ ID NO: 108081 - protein, 9 aa, Homo sapiens
  light chain complementarity determining region 3 for antibody 54041
LQDYNYPFT

SEQ ID NO: 108082 - protein, 20 aa, Homo sapiens
  heavy chain complementarity determining region 3 for antibody 54041
ARLTITMVRGVIIEDYGMGV

SEQ ID NO: 108083 - protein, 9 aa, Homo sapiens
  light chain complementarity determining region 3 for antibody 54042
LQDYNYPFT

SEQ ID NO: 108084 - protein, 14 aa, Homo sapiens
  heavy chain complementarity determining region 3 for antibody 54042
ARIEVAGTAEYFQH

SEQ ID NO: 108085 - protein, 9 aa, Homo sapiens
  light chain complementarity determining region 3 for antibody 54043
LQDYNYPFT

SEQ ID NO: 108086 - protein, 16 aa, Homo sapiens
  heavy chain complementarity determining region 3 for antibody 54043
AKEGRITVAGTGGMDV

SEQ ID NO: 108087 - protein, 9 aa, Homo sapiens
  light chain complementarity determining region 3 for antibody 54044
LQDNNYPLT

SEQ ID NO: 108088 - protein, 12 aa, Homo sapiens
  heavy chain complementarity determining region 3 for antibody 54044
ARDFGTYLGFDY

SEQ ID NO: 108089 - protein, 9 aa, Homo sapiens
  light chain complementarity determining region 3 for antibody 54045
IQHNSYPYT

SEQ ID NO: 108090 - protein, 8 aa, Homo sapiens
  heavy chain complementarity determining region 3 for antibody 54045
ARDDGMDV

SEQ ID NO: 108091 - protein, 9 aa, Homo sapiens
  light chain complementarity determining region 3 for antibody 54046
IQHNSYPFT

SEQ ID NO: 108092 - protein, 15 aa, Homo sapiens
  heavy chain complementarity determining region 3 for antibody 54046
ARDGPTGAFYWYFDL

SEQ ID NO: 108093 - protein, 9 aa, Homo sapiens
  light chain complementarity determining region 3 for antibody 54047
HQSSSLPYT

SEQ ID NO: 108094 - protein, 18 aa, Homo sapiens
  heavy chain complementarity determining region 3 for antibody 54047
ARHPLYSSSWYDEGVFDN

SEQ ID NO: 108095 - protein, 9 aa, Homo sapiens
  light chain complementarity determining region 3 for antibody 54048
HQSSSLPYT

SEQ ID NO: 108096 - protein, 17 aa, Homo sapiens
  heavy chain complementarity determining region 3 for antibody 54048
AKEDDYVWGSYRTAFDY

SEQ ID NO: 108097 - protein, 9 aa, Homo sapiens
  light chain complementarity determining region 3 for antibody 54049
HQSSSLPHT

SEQ ID NO: 108098 - protein, 13 aa, Homo sapiens
  heavy chain complementarity determining region 3 for antibody 54049
AKGGILTGYSNDY

SEQ ID NO: 108099 - protein, 9 aa, Homo sapiens
  light chain complementarity determining region 3 for antibody 54050
HQSSSLPFT

SEQ ID NO: 108100 - protein, 11 aa, Homo sapiens
  heavy chain complementarity determining region 3 for antibody 54050
ARLPCFGGFDY

SEQ ID NO: 108101 - protein, 9 aa, Homo sapiens
  light chain complementarity determining region 3 for antibody 54051
HQSSSLPFT

SEQ ID NO: 108102 - protein, 11 aa, Homo sapiens
  heavy chain complementarity determining region 3 for antibody 54051
ARLLWCGGFDY

SEQ ID NO: 108103 - protein, 9 aa, Homo sapiens
  light chain complementarity determining region 3 for antibody 54052
HQSSSLPFT

SEQ ID NO: 108104 - protein, 11 aa, Homo sapiens
  heavy chain complementarity determining region 3 for antibody 54052
ARFLWSGGFDY

SEQ ID NO: 108105 - protein, 8 aa, Homo sapiens
  light chain complementarity determining region 3 for antibody 54053
HQSGSLWT

SEQ ID NO: 108106 - protein, 15 aa, Homo sapiens
  heavy chain complementarity determining region 3 for antibody 54053
AREGDYYGSGSYLDP

SEQ ID NO: 108107 - protein, 9 aa, Homo sapiens
  light chain complementarity determining region 3 for antibody 54054
RQYNSYPYT

SEQ ID NO: 108108 - protein, 16 aa, Homo sapiens
  heavy chain complementarity determining region 3 for antibody 54054
ARERDNWNPYYYGMDV

SEQ ID NO: 108109 - protein, 9 aa, Homo sapiens
  light chain complementarity determining region 3 for antibody 54055
RQFNNYPFT

SEQ ID NO: 108110 - protein, 16 aa, Homo sapiens
  heavy chain complementarity determining region 3 for antibody 54055
ARGRGYYGSGSPYFDY

SEQ ID NO: 108111 - protein, 9 aa, Homo sapiens
  light chain complementarity determining region 3 for antibody 54056
RKYNSAPLT

SEQ ID NO: 108112 - protein, 8 aa, Homo sapiens
  heavy chain complementarity determining region 3 for antibody 54056
ARTGPLDY

SEQ ID NO: 108113 - protein, 9 aa, Homo sapiens
  light chain complementarity determining region 3 for antibody 54057
QRYNSFPFT

SEQ ID NO: 108114 - protein, 17 aa, Homo sapiens
  heavy chain complementarity determining region 3 for antibody 54057
AREYNDILTGYWGYFDY

SEQ ID NO: 108115 - protein, 8 aa, Homo sapiens
  light chain complementarity determining region 3 for antibody 54058
QQYYSTPT

SEQ ID NO: 108116 - protein, 12 aa, Homo sapiens
  heavy chain complementarity determining region 3 for antibody 54058
ARGTAAGHYFDY

SEQ ID NO: 108117 - protein, 9 aa, Homo sapiens
  light chain complementarity determining region 3 for antibody 54059
QQYNTYPYT

SEQ ID NO: 108118 - protein, 17 aa, Homo sapiens
  heavy chain complementarity determining region 3 for antibody 54059
AREYYDLLTGYWNYFDY

SEQ ID NO: 108119 - protein, 9 aa, Homo sapiens
  light chain complementarity determining region 3 for antibody 54060
QQYNTYPRT

SEQ ID NO: 108120 - protein, 10 aa, Homo sapiens
  heavy chain complementarity determining region 3 for antibody 54060
ARDKGYYVDY

SEQ ID NO: 108121 - protein, 9 aa, Homo sapiens
  light chain complementarity determining region 3 for antibody 54061
QQYNSYPYT

SEQ ID NO: 108122 - protein, 17 aa, Homo sapiens
  heavy chain complementarity determining region 3 for antibody 54061
ARLVVRYSDWLLPHFDY

SEQ ID NO: 108123 - protein, 9 aa, Homo sapiens
  light chain complementarity determining region 3 for antibody 54062
QQYNSYPYT

SEQ ID NO: 108124 - protein, 17 aa, Homo sapiens
  heavy chain complementarity determining region 3 for antibody 54062
ARLVLRYSDWLLPDFDY

SEQ ID NO: 108125 - protein, 9 aa, Homo sapiens
  light chain complementarity determining region 3 for antibody 54063
QQYNSYPYT

SEQ ID NO: 108126 - protein, 17 aa, Homo sapiens
  heavy chain complementarity determining region 3 for antibody 54063
ARLVLRYLDWLFPHFDN

SEQ ID NO: 108127 - protein, 9 aa, Homo sapiens
  light chain complementarity determining region 3 for antibody 54064
QQYNSYPYT

SEQ ID NO: 108128 - protein, 17 aa, Homo sapiens
  heavy chain complementarity determining region 3 for antibody 54064
ARLVLRYIDWLFPHFDY

SEQ ID NO: 108129 - protein, 9 aa, Homo sapiens
  light chain complementarity determining region 3 for antibody 54065
QQYNSYPLT

SEQ ID NO: 108130 - protein, 17 aa, Homo sapiens
  heavy chain complementarity determining region 3 for antibody 54065
AREGVGTMVRGVGWFDP

SEQ ID NO: 108131 - protein, 9 aa, Homo sapiens
  light chain complementarity determining region 3 for antibody 54066
QQYNSSPFT

SEQ ID NO: 108132 - protein, 17 aa, Homo sapiens
  heavy chain complementarity determining region 3 for antibody 54066
AREYNDILTGYWGYFDY

SEQ ID NO: 108133 - protein, 9 aa, Homo sapiens
  light chain complementarity determining region 3 for antibody 54067
QQYNSFPFT

SEQ ID NO: 108134 - protein, 17 aa, Homo sapiens
  heavy chain complementarity determining region 3 for antibody 54067
ASEYNDILTGYWGYFDY

SEQ ID NO: 108135 - protein, 9 aa, Homo sapiens
  light chain complementarity determining region 3 for antibody 54068
QQYNSFPFT

SEQ ID NO: 108136 - protein, 22 aa, Homo sapiens
  heavy chain complementarity determining region 3 for antibody 54068
ARGDYDILTGYRGYYSYYGMDV

SEQ ID NO: 108137 - protein, 10 aa, Homo sapiens
  light chain complementarity determining region 3 for antibody 54069
QQYNNWPPYT

SEQ ID NO: 108138 - protein, 12 aa, Homo sapiens
  heavy chain complementarity determining region 3 for antibody 54069
ARHLVRGVFFDY

SEQ ID NO: 108139 - protein, 10 aa, Homo sapiens
  light chain complementarity determining region 3 for antibody 54070
QQYNNWPMYT

SEQ ID NO: 108140 - protein, 19 aa, Homo sapiens
  heavy chain complementarity determining region 3 for antibody 54070
AREGYYYDSSGYYYGYFDY

SEQ ID NO: 108141 - protein, 9 aa, Homo sapiens
  light chain complementarity determining region 3 for antibody 54071
QQYNNWPLT

SEQ ID NO: 108142 - protein, 15 aa, Homo sapiens
  heavy chain complementarity determining region 3 for antibody 54071
ARASYNWNDVEAFDV

SEQ ID NO: 108143 - protein, 9 aa, Homo sapiens
  light chain complementarity determining region 3 for antibody 54072
QQYNIYPYT

SEQ ID NO: 108144 - protein, 18 aa, Homo sapiens
  heavy chain complementarity determining region 3 for antibody 54072
ARERRDDILTGYYDDFDI

SEQ ID NO: 108145 - protein, 9 aa, Homo sapiens
  light chain complementarity determining region 3 for antibody 54073
QQYISYPFT

SEQ ID NO: 108146 - protein, 17 aa, Homo sapiens
  heavy chain complementarity determining region 3 for antibody 54073
ARLVLRYSDWLLPHFDY

SEQ ID NO: 108147 - protein, 9 aa, Homo sapiens
  light chain complementarity determining region 3 for antibody 54074
QQYISYPFT

SEQ ID NO: 108148 - protein, 13 aa, Homo sapiens
  heavy chain complementarity determining region 3 for antibody 54074
AADYGDYQYYSDY

SEQ ID NO: 108149 - protein, 9 aa, Homo sapiens
  light chain complementarity determining region 3 for antibody 54075
QQYISYPFT

SEQ ID NO: 108150 - protein, 13 aa, Homo sapiens
  heavy chain complementarity determining region 3 for antibody 54075
AADDGDYQYYFDY

SEQ ID NO: 108151 - protein, 9 aa, Homo sapiens
  light chain complementarity determining region 3 for antibody 54076
QQYGSSPYT

SEQ ID NO: 108152 - protein, 11 aa, Homo sapiens
  heavy chain complementarity determining region 3 for antibody 54076
ARGLWFGMFDY

SEQ ID NO: 108153 - protein, 8 aa, Homo sapiens
  light chain complementarity determining region 3 for antibody 54077
QQYGSSLT

SEQ ID NO: 108154 - protein, 18 aa, Homo sapiens
  heavy chain complementarity determining region 3 for antibody 54077
AKGGLYYYGSGSYLPFDY

SEQ ID NO: 108155 - protein, 10 aa, Homo sapiens
  light chain complementarity determining region 3 for antibody 54078
QQRSNWPPYT

SEQ ID NO: 108156 - protein, 15 aa, Homo sapiens
  heavy chain complementarity determining region 3 for antibody 54078
AKSVYYDILTGYFDY

SEQ ID NO: 108157 - protein, 9 aa, Homo sapiens
  light chain complementarity determining region 3 for antibody 54079
QQLNSYPYT

SEQ ID NO: 108158 - protein, 16 aa, Homo sapiens
  heavy chain complementarity determining region 3 for antibody 54079
ARGRGYYGSGSPYFDY

SEQ ID NO: 108159 - protein, 9 aa, Homo sapiens
  light chain complementarity determining region 3 for antibody 54080
QQLNSYPWT

SEQ ID NO: 108160 - protein, 14 aa, Homo sapiens
  heavy chain complementarity determining region 3 for antibody 54080
ARPFGGYYYYGMDV

SEQ ID NO: 108161 - protein, 9 aa, Homo sapiens
  light chain complementarity determining region 3 for antibody 54081
QQLNSYPRT

SEQ ID NO: 108162 - protein, 9 aa, Homo sapiens
  heavy chain complementarity determining region 3 for antibody 54081
ARDAVFFDY

SEQ ID NO: 108163 - protein, 9 aa, Homo sapiens
  light chain complementarity determining region 3 for antibody 54082
QQLNSYPPT

SEQ ID NO: 108164 - protein, 13 aa, Homo sapiens
  heavy chain complementarity determining region 3 for antibody 54082
ARDQGSGRDSFDY

SEQ ID NO: 108165 - protein, 9 aa, Homo sapiens
  light chain complementarity determining region 3 for antibody 54083
QQLNSYPPT

SEQ ID NO: 108166 - protein, 13 aa, Homo sapiens
  heavy chain complementarity determining region 3 for antibody 54083
AADYGDYHYYFDY

SEQ ID NO: 108167 - protein, 9 aa, Homo sapiens
  light chain complementarity determining region 3 for antibody 54084
QQLNSYPPT

SEQ ID NO: 108168 - protein, 13 aa, Homo sapiens
  heavy chain complementarity determining region 3 for antibody 54084
AADFGDYQYYFDY

SEQ ID NO: 108169 - protein, 9 aa, Homo sapiens
  light chain complementarity determining region 3 for antibody 54085
QQLNSYPFT

SEQ ID NO: 108170 - protein, 22 aa, Homo sapiens
  heavy chain complementarity determining region 3 for antibody 54085
ATDHYGSGSYYNVRYYYYGMDV

SEQ ID NO: 108171 - protein, 10 aa, Homo sapiens
  light chain complementarity determining region 3 for antibody 54086
QQLNSYLMYT

SEQ ID NO: 108172 - protein, 12 aa, Homo sapiens
  heavy chain complementarity determining region 3 for antibody 54086
AKEGGSYWYFDL

SEQ ID NO: 108173 - protein, 9 aa, Homo sapiens
  light chain complementarity determining region 3 for antibody 54087
QQFNNYPWT

SEQ ID NO: 108174 - protein, 12 aa, Homo sapiens
  heavy chain complementarity determining region 3 for antibody 54087
AELGHYYYGMDV

SEQ ID NO: 108175 - protein, 9 aa, Homo sapiens
  light chain complementarity determining region 3 for antibody 54088
QQFNNYMYT

SEQ ID NO: 108176 - protein, 11 aa, Homo sapiens
  heavy chain complementarity determining region 3 for antibody 54088
ARERARLDFDY

SEQ ID NO: 108177 - protein, 8 aa, Homo sapiens
  light chain complementarity determining region 3 for antibody 54089
QQFNNYHT

SEQ ID NO: 108178 - protein, 11 aa, Homo sapiens
  heavy chain complementarity determining region 3 for antibody 54089
ARRGYYYGMDV

SEQ ID NO: 108179 - protein, 9 aa, Homo sapiens
  light chain complementarity determining region 3 for antibody 54090
QQDYNLPYT

SEQ ID NO: 108180 - protein, 9 aa, Homo sapiens
  heavy chain complementarity determining region 3 for antibody 54090
ARKRWYFDL

SEQ ID NO: 108181 - protein, 9 aa, Homo sapiens
  light chain complementarity determining region 3 for antibody 54091
QQDYNLPYT

SEQ ID NO: 108182 - protein, 17 aa, Homo sapiens
  heavy chain complementarity determining region 3 for antibody 54091
ARDRGYSGYDGDYGMDV

SEQ ID NO: 108183 - protein, 9 aa, Homo sapiens
  light chain complementarity determining region 3 for antibody 54092
QQCNSYPYT

SEQ ID NO: 108184 - protein, 17 aa, Homo sapiens
  heavy chain complementarity determining region 3 for antibody 54092
ARLVLRYSDWLLPHFDY

SEQ ID NO: 108185 - protein, 9 aa, Homo sapiens
  light chain complementarity determining region 3 for antibody 54093
QQCNSYPYT

SEQ ID NO: 108186 - protein, 18 aa, Homo sapiens
  heavy chain complementarity determining region 3 for antibody 54093
ARDRRDDILTGYFDAFDI

SEQ ID NO: 108187 - protein, 9 aa, Homo sapiens
  light chain complementarity determining region 3 for antibody 54094
QKYNSASLT

SEQ ID NO: 108188 - protein, 8 aa, Homo sapiens
  heavy chain complementarity determining region 3 for antibody 54094
ARTGPLDY

SEQ ID NO: 108189 - protein, 9 aa, Homo sapiens
  light chain complementarity determining region 3 for antibody 54095
QKYNSAPYT

SEQ ID NO: 108190 - protein, 9 aa, Homo sapiens
  heavy chain complementarity determining region 3 for antibody 54095
AGYGDSLDV

SEQ ID NO: 108191 - protein, 9 aa, Homo sapiens
  light chain complementarity determining region 3 for antibody 54096
QKYNSAPLT

SEQ ID NO: 108192 - protein, 16 aa, Homo sapiens
  heavy chain complementarity determining region 3 for antibody 54096
TTTYYYGSGSYSPFDY

SEQ ID NO: 108193 - protein, 9 aa, Homo sapiens
  light chain complementarity determining region 3 for antibody 54097
QKYNSAPLT

SEQ ID NO: 108194 - protein, 17 aa, Homo sapiens
  heavy chain complementarity determining region 3 for antibody 54097
ARLVLRYSDWLLPHFDY

SEQ ID NO: 108195 - protein, 9 aa, Homo sapiens
  light chain complementarity determining region 3 for antibody 54098
QKYNSAPLT

SEQ ID NO: 108196 - protein, 16 aa, Homo sapiens
  heavy chain complementarity determining region 3 for antibody 54098
AKGGGYSYGFYWYFDL

SEQ ID NO: 108197 - protein, 9 aa, Homo sapiens
  light chain complementarity determining region 3 for antibody 54099
QKYNSAPHT

SEQ ID NO: 108198 - protein, 8 aa, Homo sapiens
  heavy chain complementarity determining region 3 for antibody 54099
ARTGPLDY

SEQ ID NO: 108199 - protein, 9 aa, Homo sapiens
  light chain complementarity determining region 3 for antibody 54100
QKYNGAPLT

SEQ ID NO: 108200 - protein, 8 aa, Homo sapiens
  heavy chain complementarity determining region 3 for antibody 54100
ARTGPLDY

SEQ ID NO: 108201 - protein, 9 aa, Homo sapiens
  light chain complementarity determining region 3 for antibody 54101
QKYISAPLT

SEQ ID NO: 108202 - protein, 8 aa, Homo sapiens
  heavy chain complementarity determining region 3 for antibody 54101
ARTGPLDY

SEQ ID NO: 108203 - protein, 9 aa, Homo sapiens
  light chain complementarity determining region 3 for antibody 54102
QKYDSAPPT

SEQ ID NO: 108204 - protein, 8 aa, Homo sapiens
  heavy chain complementarity determining region 3 for antibody 54102
ARTGPLDY

SEQ ID NO: 108205 - protein, 9 aa, Homo sapiens
  light chain complementarity determining region 3 for antibody 54103
QEYNSAPLT

SEQ ID NO: 108206 - protein, 8 aa, Homo sapiens
  heavy chain complementarity determining region 3 for antibody 54103
ARTSPLDC

SEQ ID NO: 108207 - protein, 9 aa, Homo sapiens
  light chain complementarity determining region 3 for antibody 54104
PQHNSYPYT

SEQ ID NO: 108208 - protein, 8 aa, Homo sapiens
  heavy chain complementarity determining region 3 for antibody 54104
ARDDGMDV

SEQ ID NO: 108209 - protein, 10 aa, Homo sapiens
  light chain complementarity determining region 3 for antibody 54105
MQTLQTPPYT

SEQ ID NO: 108210 - protein, 17 aa, Homo sapiens
  heavy chain complementarity determining region 3 for antibody 54105
AKGDSSSWYNYCYGMDV

SEQ ID NO: 108211 - protein, 9 aa, Homo sapiens
  light chain complementarity determining region 3 for antibody 54106
LRDYNYPFT

SEQ ID NO: 108212 - protein, 6 aa, Homo sapiens
  heavy chain complementarity determining region 3 for antibody 54106
AREGDY

SEQ ID NO: 108213 - protein, 9 aa, Homo sapiens
  light chain complementarity determining region 3 for antibody 54107
LQHNSYPYT

SEQ ID NO: 108214 - protein, 13 aa, Homo sapiens
  heavy chain complementarity determining region 3 for antibody 54107
ARPLWFGELFHCY

SEQ ID NO: 108215 - protein, 9 aa, Homo sapiens
  light chain complementarity determining region 3 for antibody 54108
LQHNSYPYT

SEQ ID NO: 108216 - protein, 14 aa, Homo sapiens
  heavy chain complementarity determining region 3 for antibody 54108
ARGGHYYDQGWFDP

SEQ ID NO: 108217 - protein, 9 aa, Homo sapiens
  light chain complementarity determining region 3 for antibody 54109
LQHNSYPYT

SEQ ID NO: 108218 - protein, 17 aa, Homo sapiens
  heavy chain complementarity determining region 3 for antibody 54109
AREREEDLYHYYYGMDV

SEQ ID NO: 108219 - protein, 9 aa, Homo sapiens
  light chain complementarity determining region 3 for antibody 54110
LQHNSYPYT

SEQ ID NO: 108220 - protein, 13 aa, Homo sapiens
  heavy chain complementarity determining region 3 for antibody 54110
ARDRGGWSEGFDY

SEQ ID NO: 108221 - protein, 9 aa, Homo sapiens
  light chain complementarity determining region 3 for antibody 54111
LQHNSYPYA

SEQ ID NO: 108222 - protein, 17 aa, Homo sapiens
  heavy chain complementarity determining region 3 for antibody 54111
AREREEDLYYYYYGMDV

SEQ ID NO: 108223 - protein, 9 aa, Homo sapiens
  light chain complementarity determining region 3 for antibody 54112
LQHNSYPWT

SEQ ID NO: 108224 - protein, 17 aa, Homo sapiens
  heavy chain complementarity determining region 3 for antibody 54112
AREWEDYVRNHYYGMDV

SEQ ID NO: 108225 - protein, 9 aa, Homo sapiens
  light chain complementarity determining region 3 for antibody 54113
LQHNSYPWT

SEQ ID NO: 108226 - protein, 15 aa, Homo sapiens
  heavy chain complementarity determining region 3 for antibody 54113
ARDPDYYGSGSYGDY

SEQ ID NO: 108227 - protein, 9 aa, Homo sapiens
  light chain complementarity determining region 3 for antibody 54114
LQHNSYPWT

SEQ ID NO: 108228 - protein, 8 aa, Homo sapiens
  heavy chain complementarity determining region 3 for antibody 54114
ARDDGMDV

SEQ ID NO: 108229 - protein, 9 aa, Homo sapiens
  light chain complementarity determining region 3 for antibody 54115
LQHNSYPST

SEQ ID NO: 108230 - protein, 15 aa, Homo sapiens
  heavy chain complementarity determining region 3 for antibody 54115
ARDGPTGAFYWYFDL

SEQ ID NO: 108231 - protein, 9 aa, Homo sapiens
  light chain complementarity determining region 3 for antibody 54116
LQHNSYPRT

SEQ ID NO: 108232 - protein, 20 aa, Homo sapiens
  heavy chain complementarity determining region 3 for antibody 54116
ARERDDILTGYYDYYYGMDV

SEQ ID NO: 108233 - protein, 9 aa, Homo sapiens
  light chain complementarity determining region 3 for antibody 54117
LQHNSYPRT

SEQ ID NO: 108234 - protein, 19 aa, Homo sapiens
  heavy chain complementarity determining region 3 for antibody 54117
AKDAGHYYDSSGCLNWFDP

SEQ ID NO: 108235 - protein, 9 aa, Homo sapiens
  light chain complementarity determining region 3 for antibody 54118
LQHNSYPLT

SEQ ID NO: 108236 - protein, 22 aa, Homo sapiens
  heavy chain complementarity determining region 3 for antibody 54118
ARGDYDMLTGYRGYYSYYGMDV

SEQ ID NO: 108237 - protein, 9 aa, Homo sapiens
  light chain complementarity determining region 3 for antibody 54119
LQHNSYPIT

SEQ ID NO: 108238 - protein, 19 aa, Homo sapiens
  heavy chain complementarity determining region 3 for antibody 54119
ARDGGYYGSGSYLPSYFDY

SEQ ID NO: 108239 - protein, 9 aa, Homo sapiens
  light chain complementarity determining region 3 for antibody 54120
LQHNSYPFT

SEQ ID NO: 108240 - protein, 14 aa, Homo sapiens
  heavy chain complementarity determining region 3 for antibody 54120
ARDRDSSGYYPFDY

SEQ ID NO: 108241 - protein, 9 aa, Homo sapiens
  light chain complementarity determining region 3 for antibody 54121
LQHNSYPFT

SEQ ID NO: 108242 - protein, 14 aa, Homo sapiens
  heavy chain complementarity determining region 3 for antibody 54121
ARDRDSSGYSLFDY

SEQ ID NO: 108243 - protein, 9 aa, Homo sapiens
  light chain complementarity determining region 3 for antibody 54122
LQHNSYPFT

SEQ ID NO: 108244 - protein, 9 aa, Homo sapiens
  heavy chain complementarity determining region 3 for antibody 54122
AKGEQQPVY

SEQ ID NO: 108245 - protein, 9 aa, Homo sapiens
  light chain complementarity determining region 3 for antibody 54123
LQHNSSPWT

SEQ ID NO: 108246 - protein, 21 aa, Homo sapiens
  heavy chain complementarity determining region 3 for antibody 54123
ATEGSPPIVGTTSDYYYGMDV

SEQ ID NO: 108247 - protein, 9 aa, Homo sapiens
  light chain complementarity determining region 3 for antibody 54124
LQHNSFPFT

SEQ ID NO: 108248 - protein, 20 aa, Homo sapiens
  heavy chain complementarity determining region 3 for antibody 54124
ARDRDDILTGWVPSYYGVDV

SEQ ID NO: 108249 - protein, 9 aa, Homo sapiens
  light chain complementarity determining region 3 for antibody 54125
LQHNNYPLT

SEQ ID NO: 108250 - protein, 22 aa, Homo sapiens
  heavy chain complementarity determining region 3 for antibody 54125
ARGDYDILTGYRGYYSYYGMDV

SEQ ID NO: 108251 - protein, 9 aa, Homo sapiens
  light chain complementarity determining region 3 for antibody 54126
LQHDTYPWT

SEQ ID NO: 108252 - protein, 14 aa, Homo sapiens
  heavy chain complementarity determining region 3 for antibody 54126
ARDRELLWFGELLH

SEQ ID NO: 108253 - protein, 9 aa, Homo sapiens
  light chain complementarity determining region 3 for antibody 54127
LQHDNFPYT

SEQ ID NO: 108254 - protein, 13 aa, Homo sapiens
  heavy chain complementarity determining region 3 for antibody 54127
ARERYVASYGMDV

SEQ ID NO: 108255 - protein, 9 aa, Homo sapiens
  light chain complementarity determining region 3 for antibody 54128
LQHDNFPYT

SEQ ID NO: 108256 - protein, 13 aa, Homo sapiens
  heavy chain complementarity determining region 3 for antibody 54128
ARERYFSSYGMDV

SEQ ID NO: 108257 - protein, 9 aa, Homo sapiens
  light chain complementarity determining region 3 for antibody 54129
LQHDNFPYT

SEQ ID NO: 108258 - protein, 13 aa, Homo sapiens
  heavy chain complementarity determining region 3 for antibody 54129
AGERYFASYGMDV

SEQ ID NO: 108259 - protein, 9 aa, Homo sapiens
  light chain complementarity determining region 3 for antibody 54130
LQHDNFPWT

SEQ ID NO: 108260 - protein, 14 aa, Homo sapiens
  heavy chain complementarity determining region 3 for antibody 54130
ARDGSGWWEGYFQH

SEQ ID NO: 108261 - protein, 9 aa, Homo sapiens
  light chain complementarity determining region 3 for antibody 54131
LQDYNYPYT

SEQ ID NO: 108262 - protein, 18 aa, Homo sapiens
  heavy chain complementarity determining region 3 for antibody 54131
VKGGPGESFYYYYYGVDV

SEQ ID NO: 108263 - protein, 9 aa, Homo sapiens
  light chain complementarity determining region 3 for antibody 54132
LQDYNYPYT

SEQ ID NO: 108264 - protein, 20 aa, Homo sapiens
  heavy chain complementarity determining region 3 for antibody 54132
AKDGPTMVRGVMGYYYGMDV

SEQ ID NO: 108265 - protein, 9 aa, Homo sapiens
  light chain complementarity determining region 3 for antibody 54133
LQDYNYPWT

SEQ ID NO: 108266 - protein, 15 aa, Homo sapiens
  heavy chain complementarity determining region 3 for antibody 54133
ARSRVGPSYYYGMDV

SEQ ID NO: 108267 - protein, 9 aa, Homo sapiens
  light chain complementarity determining region 3 for antibody 54134
LQDYNYPWT

SEQ ID NO: 108268 - protein, 14 aa, Homo sapiens
  heavy chain complementarity determining region 3 for antibody 54134
ARDPPRILGALFDY

SEQ ID NO: 108269 - protein, 9 aa, Homo sapiens
  light chain complementarity determining region 3 for antibody 54135
LQDYNYPWT

SEQ ID NO: 108270 - protein, 8 aa, Homo sapiens
  heavy chain complementarity determining region 3 for antibody 54135
ARDDGMDV

SEQ ID NO: 108271 - protein, 9 aa, Homo sapiens
  light chain complementarity determining region 3 for antibody 54136
LQDYNYPRT

SEQ ID NO: 108272 - protein, 18 aa, Homo sapiens
  heavy chain complementarity determining region 3 for antibody 54136
ATKGSYYDILTGYSHFDY

SEQ ID NO: 108273 - protein, 9 aa, Homo sapiens
  light chain complementarity determining region 3 for antibody 54137
LQDYNYPRT

SEQ ID NO: 108274 - protein, 12 aa, Homo sapiens
  heavy chain complementarity determining region 3 for antibody 54137
AREIAVTGAFDY

SEQ ID NO: 108275 - protein, 9 aa, Homo sapiens
  light chain complementarity determining region 3 for antibody 54138
LQDYNYPRT

SEQ ID NO: 108276 - protein, 8 aa, Homo sapiens
  heavy chain complementarity determining region 3 for antibody 54138
ARDDGMDV

SEQ ID NO: 108277 - protein, 9 aa, Homo sapiens
  light chain complementarity determining region 3 for antibody 54139
LQDYNYPPT

SEQ ID NO: 108278 - protein, 15 aa, Homo sapiens
  heavy chain complementarity determining region 3 for antibody 54139
AREGDYYGSGSHLNY

SEQ ID NO: 108279 - protein, 9 aa, Homo sapiens
  light chain complementarity determining region 3 for antibody 54140
LQDYNYPFT

SEQ ID NO: 108280 - protein, 15 aa, Homo sapiens
  heavy chain complementarity determining region 3 for antibody 54140
AREGLRITVAPYLDY

SEQ ID NO: 108281 - protein, 9 aa, Homo sapiens
  light chain complementarity determining region 3 for antibody 54141
LQDYNYPFT

SEQ ID NO: 108282 - protein, 15 aa, Homo sapiens
  heavy chain complementarity determining region 3 for antibody 54141
AREGDYYGSGSHINY

SEQ ID NO: 108283 - protein, 9 aa, Homo sapiens
  light chain complementarity determining region 3 for antibody 54142
LQDYNYPFT

SEQ ID NO: 108284 - protein, 15 aa, Homo sapiens
  heavy chain complementarity determining region 3 for antibody 54142
AREGDYDGSGSHLNY

SEQ ID NO: 108285 - protein, 9 aa, Homo sapiens
  light chain complementarity determining region 3 for antibody 54143
LQDYFYLPI

SEQ ID NO: 108286 - protein, 15 aa, Homo sapiens
  heavy chain complementarity determining region 3 for antibody 54143
ARDRWYSGSSYGMDV

SEQ ID NO: 108287 - protein, 8 aa, Homo sapiens
  light chain complementarity determining region 3 for antibody 54144
HQSSTLYT

SEQ ID NO: 108288 - protein, 9 aa, Homo sapiens
  heavy chain complementarity determining region 3 for antibody 54144
ARDSSWFDY

SEQ ID NO: 108289 - protein, 9 aa, Homo sapiens
  light chain complementarity determining region 3 for antibody 54145
HQSSSLPYT

SEQ ID NO: 108290 - protein, 15 aa, Homo sapiens
  heavy chain complementarity determining region 3 for antibody 54145
AKGGQLGYYYYGMDV

SEQ ID NO: 108291 - protein, 9 aa, Homo sapiens
  light chain complementarity determining region 3 for antibody 54146
HQSSSLPYT

SEQ ID NO: 108292 - protein, 16 aa, Homo sapiens
  heavy chain complementarity determining region 3 for antibody 54146
AKEGDVLRYFDWLFDY

SEQ ID NO: 108293 - protein, 9 aa, Homo sapiens
  light chain complementarity determining region 3 for antibody 54147
HQSSSLPWT

SEQ ID NO: 108294 - protein, 16 aa, Homo sapiens
  heavy chain complementarity determining region 3 for antibody 54147
ARGGYDILTGYGWFDP

SEQ ID NO: 108295 - protein, 9 aa, Homo sapiens
  light chain complementarity determining region 3 for antibody 54148
HQSSSLPRT

SEQ ID NO: 108296 - protein, 9 aa, Homo sapiens
  heavy chain complementarity determining region 3 for antibody 54148
ARKTWYFDL

SEQ ID NO: 108297 - protein, 9 aa, Homo sapiens
  light chain complementarity determining region 3 for antibody 54149
HQSSSLPHT

SEQ ID NO: 108298 - protein, 16 aa, Homo sapiens
  heavy chain complementarity determining region 3 for antibody 54149
ARGVLRYFDWLLNFDY

SEQ ID NO: 108299 - protein, 9 aa, Homo sapiens
  light chain complementarity determining region 3 for antibody 54150
HQSSSLPFT

SEQ ID NO: 108300 - protein, 11 aa, Homo sapiens
  heavy chain complementarity determining region 3 for antibody 54150
ARLLWFWGFDY

SEQ ID NO: 108301 - protein, 9 aa, Homo sapiens
  light chain complementarity determining region 3 for antibody 54151
HQSSSLPFT

SEQ ID NO: 108302 - protein, 11 aa, Homo sapiens
  heavy chain complementarity determining region 3 for antibody 54151
ARLLWFGGIDY

SEQ ID NO: 108303 - protein, 9 aa, Homo sapiens
  light chain complementarity determining region 3 for antibody 54152
HQSSSLPFT

SEQ ID NO: 108304 - protein, 11 aa, Homo sapiens
  heavy chain complementarity determining region 3 for antibody 54152
ARLLWFGAFDY

SEQ ID NO: 108305 - protein, 9 aa, Homo sapiens
  light chain complementarity determining region 3 for antibody 54153
RQYNSFPFT

SEQ ID NO: 108306 - protein, 17 aa, Homo sapiens
  heavy chain complementarity determining region 3 for antibody 54153
AREYNDILTGYWGYFDY

SEQ ID NO: 108307 - protein, 9 aa, Homo sapiens
  light chain complementarity determining region 3 for antibody 54154
QRTYNAPYT

SEQ ID NO: 108308 - protein, 20 aa, Homo sapiens
  heavy chain complementarity determining region 3 for antibody 54154
AREYYYGSGSYYNLYYGMDV

SEQ ID NO: 108309 - protein, 9 aa, Homo sapiens
  light chain complementarity determining region 3 for antibody 54155
QQYYSYPYT

SEQ ID NO: 108310 - protein, 14 aa, Homo sapiens
  heavy chain complementarity determining region 3 for antibody 54155
AKEKAVAGIWYFDL

SEQ ID NO: 108311 - protein, 9 aa, Homo sapiens
  light chain complementarity determining region 3 for antibody 54156
QQYYSYPYT

SEQ ID NO: 108312 - protein, 11 aa, Homo sapiens
  heavy chain complementarity determining region 3 for antibody 54156
AGAVGATPFDY

SEQ ID NO: 108313 - protein, 9 aa, Homo sapiens
  light chain complementarity determining region 3 for antibody 54157
QQYYSTPYT

SEQ ID NO: 108314 - protein, 13 aa, Homo sapiens
  heavy chain complementarity determining region 3 for antibody 54157
ARDYYGSGRGFDY

SEQ ID NO: 108315 - protein, 9 aa, Homo sapiens
  light chain complementarity determining region 3 for antibody 54158
QQYNSYTYT

SEQ ID NO: 108316 - protein, 17 aa, Homo sapiens
  heavy chain complementarity determining region 3 for antibody 54158
ARLVLRYSDWLLPHFDY

SEQ ID NO: 108317 - protein, 9 aa, Homo sapiens
  light chain complementarity determining region 3 for antibody 54159
QQYNSYPYT

SEQ ID NO: 108318 - protein, 17 aa, Homo sapiens
  heavy chain complementarity determining region 3 for antibody 54159
VRLVLRYSDWLLPHFDY

SEQ ID NO: 108319 - protein, 9 aa, Homo sapiens
  light chain complementarity determining region 3 for antibody 54160
QQYNSYPYT

SEQ ID NO: 108320 - protein, 19 aa, Homo sapiens
  heavy chain complementarity determining region 3 for antibody 54160
ATGVRGVIITLYYYYGMDV

SEQ ID NO: 108321 - protein, 9 aa, Homo sapiens
  light chain complementarity determining region 3 for antibody 54161
QQYNSYPYT

SEQ ID NO: 108322 - protein, 17 aa, Homo sapiens
  heavy chain complementarity determining region 3 for antibody 54161
ARPVLRYSDWLLPHFDY

SEQ ID NO: 108323 - protein, 9 aa, Homo sapiens
  light chain complementarity determining region 3 for antibody 54162
QQYNSYPYT

SEQ ID NO: 108324 - protein, 17 aa, Homo sapiens
  heavy chain complementarity determining region 3 for antibody 54162
ARLVLRYSDWLLPLFDY

SEQ ID NO: 108325 - protein, 9 aa, Homo sapiens
  light chain complementarity determining region 3 for antibody 54163
QQYNSYPYT

SEQ ID NO: 108326 - protein, 17 aa, Homo sapiens
  heavy chain complementarity determining region 3 for antibody 54163
ARLVLRDSDWLLPHFDY

SEQ ID NO: 108327 - protein, 9 aa, Homo sapiens
  light chain complementarity determining region 3 for antibody 54164
QQYNSYPYT

SEQ ID NO: 108328 - protein, 22 aa, Homo sapiens
  heavy chain complementarity determining region 3 for antibody 54164
ARGDYDILTGYRGYYSYYGMDV

SEQ ID NO: 108329 - protein, 9 aa, Homo sapiens
  light chain complementarity determining region 3 for antibody 54165
QQYNSYPYT

SEQ ID NO: 108330 - protein, 14 aa, Homo sapiens
  heavy chain complementarity determining region 3 for antibody 54165
ARDRDSSGYYLFDY

SEQ ID NO: 108331 - protein, 9 aa, Homo sapiens
  light chain complementarity determining region 3 for antibody 54166
QQYNSYPYT

SEQ ID NO: 108332 - protein, 17 aa, Homo sapiens
  heavy chain complementarity determining region 3 for antibody 54166
AILVLRYSDWLLPHFDY

SEQ ID NO: 108333 - protein, 9 aa, Homo sapiens
  light chain complementarity determining region 3 for antibody 54167
QQYNSYPRT

SEQ ID NO: 108334 - protein, 17 aa, Homo sapiens
  heavy chain complementarity determining region 3 for antibody 54167
AREKQLDPYYYSYGMDV

SEQ ID NO: 108335 - protein, 9 aa, Homo sapiens
  light chain complementarity determining region 3 for antibody 54168
QQYNSYPRT

SEQ ID NO: 108336 - protein, 17 aa, Homo sapiens
  heavy chain complementarity determining region 3 for antibody 54168
AREGYYDILTGYNWFDP

SEQ ID NO: 108337 - protein, 9 aa, Homo sapiens
  light chain complementarity determining region 3 for antibody 54169
QQYNSYPLT

SEQ ID NO: 108338 - protein, 12 aa, Homo sapiens
  heavy chain complementarity determining region 3 for antibody 54169
ARVVRGVIGFDY

SEQ ID NO: 108339 - protein, 9 aa, Homo sapiens
  light chain complementarity determining region 3 for antibody 54170
QQYNSYPLT

SEQ ID NO: 108340 - protein, 17 aa, Homo sapiens
  heavy chain complementarity determining region 3 for antibody 54170
AREGMVTMVRGVGWFDP

SEQ ID NO: 108341 - protein, 9 aa, Homo sapiens
  light chain complementarity determining region 3 for antibody 54171
QQYNSYPHT

SEQ ID NO: 108342 - protein, 17 aa, Homo sapiens
  heavy chain complementarity determining region 3 for antibody 54171
ARLVLRYSDWLLPHFDY

SEQ ID NO: 108343 - protein, 9 aa, Homo sapiens
  light chain complementarity determining region 3 for antibody 54172
QQYNSYPHT

SEQ ID NO: 108344 - protein, 19 aa, Homo sapiens
  heavy chain complementarity determining region 3 for antibody 54172
ARERCGELEDYYYYYGMDV

SEQ ID NO: 108345 - protein, 9 aa, Homo sapiens
  light chain complementarity determining region 3 for antibody 54173
QQYNSYPHT

SEQ ID NO: 108346 - protein, 19 aa, Homo sapiens
  heavy chain complementarity determining region 3 for antibody 54173
AREKFGELEDYYYYYGMDV

SEQ ID NO: 108347 - protein, 9 aa, Homo sapiens
  light chain complementarity determining region 3 for antibody 54174
QQYNSFPFT

SEQ ID NO: 108348 - protein, 9 aa, Homo sapiens
  heavy chain complementarity determining region 3 for antibody 54174
ARKRWYFDL

SEQ ID NO: 108349 - protein, 9 aa, Homo sapiens
  light chain complementarity determining region 3 for antibody 54175
QQYNSFPFT

SEQ ID NO: 108350 - protein, 17 aa, Homo sapiens
  heavy chain complementarity determining region 3 for antibody 54175
AREYYDILTGYWGYFDY

SEQ ID NO: 108351 - protein, 9 aa, Homo sapiens
  light chain complementarity determining region 3 for antibody 54176
QQYNSFPFT

SEQ ID NO: 108352 - protein, 17 aa, Homo sapiens
  heavy chain complementarity determining region 3 for antibody 54176
AREYNDILTGYCGYFDY

SEQ ID NO: 108353 - protein, 9 aa, Homo sapiens
  light chain complementarity determining region 3 for antibody 54177
QQYNSFPFT

SEQ ID NO: 108354 - protein, 17 aa, Homo sapiens
  heavy chain complementarity determining region 3 for antibody 54177
AREYNDILTDYWGYFDY

SEQ ID NO: 108355 - protein, 9 aa, Homo sapiens
  light chain complementarity determining region 3 for antibody 54178
QQYNSFPFT

SEQ ID NO: 108356 - protein, 17 aa, Homo sapiens
  heavy chain complementarity determining region 3 for antibody 54178
AREYNDILSGYWGYFDY

SEQ ID NO: 108357 - protein, 9 aa, Homo sapiens
  light chain complementarity determining region 3 for antibody 54179
QQYNSFPFT

SEQ ID NO: 108358 - protein, 17 aa, Homo sapiens
  heavy chain complementarity determining region 3 for antibody 54179
AREYDDILAGYWGYFDY

SEQ ID NO: 108359 - protein, 9 aa, Homo sapiens
  light chain complementarity determining region 3 for antibody 54180
QQYNNYPHT

SEQ ID NO: 108360 - protein, 13 aa, Homo sapiens
  heavy chain complementarity determining region 3 for antibody 54180
AADYGDYQYSFDY

SEQ ID NO: 108361 - protein, 9 aa, Homo sapiens
  light chain complementarity determining region 3 for antibody 54181
QQYNNWPYT

SEQ ID NO: 108362 - protein, 14 aa, Homo sapiens
  heavy chain complementarity determining region 3 for antibody 54181
AREGLYYYYYGMDV

SEQ ID NO: 108363 - protein, 9 aa, Homo sapiens
  light chain complementarity determining region 3 for antibody 54182
QQYNNWPWT

SEQ ID NO: 108364 - protein, 13 aa, Homo sapiens
  heavy chain complementarity determining region 3 for antibody 54182
ARDGDIVATIGDY

SEQ ID NO: 108365 - protein, 10 aa, Homo sapiens
  light chain complementarity determining region 3 for antibody 54183
QQYNNWPPFT

SEQ ID NO: 108366 - protein, 18 aa, Homo sapiens
  heavy chain complementarity determining region 3 for antibody 54183
ARGLWFGELLRPYNWFDP

SEQ ID NO: 108367 - protein, 9 aa, Homo sapiens
  light chain complementarity determining region 3 for antibody 54184
QQYNNWPLT

SEQ ID NO: 108368 - protein, 20 aa, Homo sapiens
  heavy chain complementarity determining region 3 for antibody 54184
ASPYYDILTGYNYYYYGMDV

SEQ ID NO: 108369 - protein, 9 aa, Homo sapiens
  light chain complementarity determining region 3 for antibody 54185
QQYISYPFT

SEQ ID NO: 108370 - protein, 13 aa, Homo sapiens
  heavy chain complementarity determining region 3 for antibody 54185
EADYGDYQYYFDY

SEQ ID NO: 108371 - protein, 9 aa, Homo sapiens
  light chain complementarity determining region 3 for antibody 54186
QQYISYPFT

SEQ ID NO: 108372 - protein, 22 aa, Homo sapiens
  heavy chain complementarity determining region 3 for antibody 54186
ARGDYDILTGYRGYYSYYGMDV

SEQ ID NO: 108373 - protein, 9 aa, Homo sapiens
  light chain complementarity determining region 3 for antibody 54187
QQYISYPFT

SEQ ID NO: 108374 - protein, 17 aa, Homo sapiens
  heavy chain complementarity determining region 3 for antibody 54187
AREYNDILTGYWGYFDY

SEQ ID NO: 108375 - protein, 9 aa, Homo sapiens
  light chain complementarity determining region 3 for antibody 54188
QQYISYPFT

SEQ ID NO: 108376 - protein, 13 aa, Homo sapiens
  heavy chain complementarity determining region 3 for antibody 54188
AADYGDYQYYLDY

SEQ ID NO: 108377 - protein, 9 aa, Homo sapiens
  light chain complementarity determining region 3 for antibody 54189
QQYISYPFT

SEQ ID NO: 108378 - protein, 13 aa, Homo sapiens
  heavy chain complementarity determining region 3 for antibody 54189
AADYGDYHYYFDY

SEQ ID NO: 108379 - protein, 9 aa, Homo sapiens
  light chain complementarity determining region 3 for antibody 54190
QQYISYPFT

SEQ ID NO: 108380 - protein, 13 aa, Homo sapiens
  heavy chain complementarity determining region 3 for antibody 54190
AADYGDCQYYFDY

SEQ ID NO: 108381 - protein, 9 aa, Homo sapiens
  light chain complementarity determining region 3 for antibody 54191
QQYISYPFA

SEQ ID NO: 108382 - protein, 13 aa, Homo sapiens
  heavy chain complementarity determining region 3 for antibody 54191
AADYGDYQYYFDY

SEQ ID NO: 108383 - protein, 8 aa, Homo sapiens
  light chain complementarity determining region 3 for antibody 54192
QQYGSSPT

SEQ ID NO: 108384 - protein, 13 aa, Homo sapiens
  heavy chain complementarity determining region 3 for antibody 54192
ARAKPVAGSLFDY

SEQ ID NO: 108385 - protein, 9 aa, Homo sapiens
  light chain complementarity determining region 3 for antibody 54193
QQYGSSPLT

SEQ ID NO: 108386 - protein, 13 aa, Homo sapiens
  heavy chain complementarity determining region 3 for antibody 54193
ARDRTGSYYYFDY

SEQ ID NO: 108387 - protein, 9 aa, Homo sapiens
  light chain complementarity determining region 3 for antibody 54194
QQYGSSPLT

SEQ ID NO: 108388 - protein, 13 aa, Homo sapiens
  heavy chain complementarity determining region 3 for antibody 54194
ARAGAVAGPLFDY

SEQ ID NO: 108389 - protein, 7 aa, Homo sapiens
  light chain complementarity determining region 3 for antibody 54195
QQYGSSP

SEQ ID NO: 108390 - protein, 10 aa, Homo sapiens
  heavy chain complementarity determining region 3 for antibody 54195
ARERDWGKDY

SEQ ID NO: 108391 - protein, 8 aa, Homo sapiens
  light chain complementarity determining region 3 for antibody 54196
QQYGSSLT

SEQ ID NO: 108392 - protein, 13 aa, Homo sapiens
  heavy chain complementarity determining region 3 for antibody 54196
ARHLYSSSWPLDY

SEQ ID NO: 108393 - protein, 9 aa, Homo sapiens
  light chain complementarity determining region 3 for antibody 54197
QQYGSSALT

SEQ ID NO: 108394 - protein, 16 aa, Homo sapiens
  heavy chain complementarity determining region 3 for antibody 54197
ATEAWLGLYYYYVMDV

SEQ ID NO: 108395 - protein, 9 aa, Homo sapiens
  light chain complementarity determining region 3 for antibody 54198
QQSGSSPYT

SEQ ID NO: 108396 - protein, 9 aa, Homo sapiens
  heavy chain complementarity determining region 3 for antibody 54198
ARGVVGMDV

SEQ ID NO: 108397 - protein, 9 aa, Homo sapiens
  light chain complementarity determining region 3 for antibody 54199
QQRSNWMYT

SEQ ID NO: 108398 - protein, 10 aa, Homo sapiens
  heavy chain complementarity determining region 3 for antibody 54199
AKDRWELLDY

SEQ ID NO: 108399 - protein, 9 aa, Homo sapiens
  light chain complementarity determining region 3 for antibody 54200
QQLNSYPYT

SEQ ID NO: 108400 - protein, 19 aa, Homo sapiens
  heavy chain complementarity determining region 3 for antibody 54200
ARPTYYYGSGSYKGYYFDY

SEQ ID NO: 108401 - protein, 9 aa, Homo sapiens
  light chain complementarity determining region 3 for antibody 54201
QQLNSYPYT

SEQ ID NO: 108402 - protein, 9 aa, Homo sapiens
  heavy chain complementarity determining region 3 for antibody 54201
ARNRWSFDL

SEQ ID NO: 108403 - protein, 9 aa, Homo sapiens
  light chain complementarity determining region 3 for antibody 54202
QQLNSYPYT

SEQ ID NO: 108404 - protein, 9 aa, Homo sapiens
  heavy chain complementarity determining region 3 for antibody 54202
ARKRWHFDL

SEQ ID NO: 108405 - protein, 9 aa, Homo sapiens
  light chain complementarity determining region 3 for antibody 54203
QQLNSYPYT

SEQ ID NO: 108406 - protein, 9 aa, Homo sapiens
  heavy chain complementarity determining region 3 for antibody 54203
ARKRWCFDL

SEQ ID NO: 108407 - protein, 9 aa, Homo sapiens
  light chain complementarity determining region 3 for antibody 54204
QQLNSYPYT

SEQ ID NO: 108408 - protein, 13 aa, Homo sapiens
  heavy chain complementarity determining region 3 for antibody 54204
AADYGDYQYSFDY

SEQ ID NO: 108409 - protein, 9 aa, Homo sapiens
  light chain complementarity determining region 3 for antibody 54205
QQLNSYPRT

SEQ ID NO: 108410 - protein, 15 aa, Homo sapiens
  heavy chain complementarity determining region 3 for antibody 54205
ARERRQLTGGYSFDY

SEQ ID NO: 108411 - protein, 9 aa, Homo sapiens
  light chain complementarity determining region 3 for antibody 54206
QQLNSYPPT

SEQ ID NO: 108412 - protein, 13 aa, Homo sapiens
  heavy chain complementarity determining region 3 for antibody 54206
AADYGDSQYYFDY

SEQ ID NO: 108413 - protein, 9 aa, Homo sapiens
  light chain complementarity determining region 3 for antibody 54207
QQLNSYPLT

SEQ ID NO: 108414 - protein, 18 aa, Homo sapiens
  heavy chain complementarity determining region 3 for antibody 54207
GKDGGLRYFDWSPDAFDI

SEQ ID NO: 108415 - protein, 8 aa, Homo sapiens
  light chain complementarity determining region 3 for antibody 54208
QQFNSYRT

SEQ ID NO: 108416 - protein, 18 aa, Homo sapiens
  heavy chain complementarity determining region 3 for antibody 54208
ARDLSYYDYVWGMGHFDY

SEQ ID NO: 108417 - protein, 9 aa, Homo sapiens
  light chain complementarity determining region 3 for antibody 54209
QQFNNYPFT

SEQ ID NO: 108418 - protein, 16 aa, Homo sapiens
  heavy chain complementarity determining region 3 for antibody 54209
ARGRGYYGSGRPYFDY

SEQ ID NO: 108419 - protein, 9 aa, Homo sapiens
  light chain complementarity determining region 3 for antibody 54210
QQFNNYPFT

SEQ ID NO: 108420 - protein, 16 aa, Homo sapiens
  heavy chain complementarity determining region 3 for antibody 54210
ARGRGYHGSGSPYFDY

SEQ ID NO: 108421 - protein, 9 aa, Homo sapiens
  light chain complementarity determining region 3 for antibody 54211
QQDYNLPYT

SEQ ID NO: 108422 - protein, 11 aa, Homo sapiens
  heavy chain complementarity determining region 3 for antibody 54211
AVLGATTRFDY

SEQ ID NO: 108423 - protein, 9 aa, Homo sapiens
  light chain complementarity determining region 3 for antibody 54212
QQDYNLPYT

SEQ ID NO: 108424 - protein, 14 aa, Homo sapiens
  heavy chain complementarity determining region 3 for antibody 54212
ARDRIVGAHYGMDV

SEQ ID NO: 108425 - protein, 9 aa, Homo sapiens
  light chain complementarity determining region 3 for antibody 54213
QQDYNLPWT

SEQ ID NO: 108426 - protein, 10 aa, Homo sapiens
  heavy chain complementarity determining region 3 for antibody 54213
ARGYYYGLDV

SEQ ID NO: 108427 - protein, 9 aa, Homo sapiens
  light chain complementarity determining region 3 for antibody 54214
QQDYNLPWT

SEQ ID NO: 108428 - protein, 15 aa, Homo sapiens
  heavy chain complementarity determining region 3 for antibody 54214
ARDRDDILTGYYIGY

SEQ ID NO: 108429 - protein, 9 aa, Homo sapiens
  light chain complementarity determining region 3 for antibody 54215
QQDYNLPLT

SEQ ID NO: 108430 - protein, 11 aa, Homo sapiens
  heavy chain complementarity determining region 3 for antibody 54215
AGNIAAAGTHH

SEQ ID NO: 108431 - protein, 9 aa, Homo sapiens
  light chain complementarity determining region 3 for antibody 54216
QQCGRSPPT

SEQ ID NO: 108432 - protein, 19 aa, Homo sapiens
  heavy chain complementarity determining region 3 for antibody 54216
AREGGGSGSPYYYYYSMDV

SEQ ID NO: 108433 - protein, 9 aa, Homo sapiens
  light chain complementarity determining region 3 for antibody 54217
QKYNSDPLT

SEQ ID NO: 108434 - protein, 8 aa, Homo sapiens
  heavy chain complementarity determining region 3 for antibody 54217
ARTGPLDY

SEQ ID NO: 108435 - protein, 9 aa, Homo sapiens
  light chain complementarity determining region 3 for antibody 54218
QKYNSAPYT

SEQ ID NO: 108436 - protein, 14 aa, Homo sapiens
  heavy chain complementarity determining region 3 for antibody 54218
AGGGGAKGSYGMDV

SEQ ID NO: 108437 - protein, 9 aa, Homo sapiens
  light chain complementarity determining region 3 for antibody 54219
QKYNSAPLT

SEQ ID NO: 108438 - protein, 8 aa, Homo sapiens
  heavy chain complementarity determining region 3 for antibody 54219
ARTGPPDY

SEQ ID NO: 108439 - protein, 9 aa, Homo sapiens
  light chain complementarity determining region 3 for antibody 54220
QKYNSAPLT

SEQ ID NO: 108440 - protein, 8 aa, Homo sapiens
  heavy chain complementarity determining region 3 for antibody 54220
AITGPLDY

SEQ ID NO: 108441 - protein, 9 aa, Homo sapiens
  light chain complementarity determining region 3 for antibody 54221
QHLNSYPRT

SEQ ID NO: 108442 - protein, 16 aa, Homo sapiens
  heavy chain complementarity determining region 3 for antibody 54221
ARDRGMTTVSHDASDI

SEQ ID NO: 108443 - protein, 9 aa, Homo sapiens
  light chain complementarity determining region 3 for antibody 54222
MQGTHWPYT

SEQ ID NO: 108444 - protein, 13 aa, Homo sapiens
  heavy chain complementarity determining region 3 for antibody 54222
ARDIVVPATIIDY

SEQ ID NO: 108445 - protein, 9 aa, Homo sapiens
  light chain complementarity determining region 3 for antibody 54223
LRHNSYPLT

SEQ ID NO: 108446 - protein, 22 aa, Homo sapiens
  heavy chain complementarity determining region 3 for antibody 54223
ARGDYDILTGYRGYYSYYGMDV

SEQ ID NO: 108447 - protein, 9 aa, Homo sapiens
  light chain complementarity determining region 3 for antibody 54224
LRHNSYPFT

SEQ ID NO: 108448 - protein, 15 aa, Homo sapiens
  heavy chain complementarity determining region 3 for antibody 54224
ARDGPTGAFYWYFDL

SEQ ID NO: 108449 - protein, 9 aa, Homo sapiens
  light chain complementarity determining region 3 for antibody 54225
LRDYNYPFT

SEQ ID NO: 108450 - protein, 15 aa, Homo sapiens
  heavy chain complementarity determining region 3 for antibody 54225
AREGDYYGSGSHLNY

SEQ ID NO: 108451 - protein, 9 aa, Homo sapiens
  light chain complementarity determining region 3 for antibody 54226
LQRNSYPLT

SEQ ID NO: 108452 - protein, 17 aa, Homo sapiens
  heavy chain complementarity determining region 3 for antibody 54226
AREGDYFGSGSYPHFDY

SEQ ID NO: 108453 - protein, 9 aa, Homo sapiens
  light chain complementarity determining region 3 for antibody 54227
LQHYSYPLT

SEQ ID NO: 108454 - protein, 22 aa, Homo sapiens
  heavy chain complementarity determining region 3 for antibody 54227
ARGDYDILTGYRGYYSYYGMDV

SEQ ID NO: 108455 - protein, 9 aa, Homo sapiens
  light chain complementarity determining region 3 for antibody 54228
LQHNTYPWT

SEQ ID NO: 108456 - protein, 17 aa, Homo sapiens
  heavy chain complementarity determining region 3 for antibody 54228
AREWEDYVRNHYYGMDV

SEQ ID NO: 108457 - protein, 9 aa, Homo sapiens
  light chain complementarity determining region 3 for antibody 54229
LQHNSYPYT

SEQ ID NO: 108458 - protein, 8 aa, Homo sapiens
  heavy chain complementarity determining region 3 for antibody 54229
ARYDGMDV

SEQ ID NO: 108459 - protein, 9 aa, Homo sapiens
  light chain complementarity determining region 3 for antibody 54230
LQHNSYPYT

SEQ ID NO: 108460 - protein, 22 aa, Homo sapiens
  heavy chain complementarity determining region 3 for antibody 54230
ARGDYDILTGYRGYYSYYGMDV

SEQ ID NO: 108461 - protein, 9 aa, Homo sapiens
  light chain complementarity determining region 3 for antibody 54231
LQHNSYPYT

SEQ ID NO: 108462 - protein, 17 aa, Homo sapiens
  heavy chain complementarity determining region 3 for antibody 54231
AREREEDLYSYYYGMDV

SEQ ID NO: 108463 - protein, 9 aa, Homo sapiens
  light chain complementarity determining region 3 for antibody 54232
LQHNSYPYT

SEQ ID NO: 108464 - protein, 12 aa, Homo sapiens
  heavy chain complementarity determining region 3 for antibody 54232
ARDQGSSDAFDI

SEQ ID NO: 108465 - protein, 9 aa, Homo sapiens
  light chain complementarity determining region 3 for antibody 54233
LQHNSYPYT

SEQ ID NO: 108466 - protein, 16 aa, Homo sapiens
  heavy chain complementarity determining region 3 for antibody 54233
ARDLLWFGELLSPLDY

SEQ ID NO: 108467 - protein, 9 aa, Homo sapiens
  light chain complementarity determining region 3 for antibody 54234
LQHNSYPYT

SEQ ID NO: 108468 - protein, 8 aa, Homo sapiens
  heavy chain complementarity determining region 3 for antibody 54234
ARDDGMDF

SEQ ID NO: 108469 - protein, 9 aa, Homo sapiens
  light chain complementarity determining region 3 for antibody 54235
LQHNSYPYT

SEQ ID NO: 108470 - protein, 8 aa, Homo sapiens
  heavy chain complementarity determining region 3 for antibody 54235
ARDDGMDD

SEQ ID NO: 108471 - protein, 9 aa, Homo sapiens
  light chain complementarity determining region 3 for antibody 54236
LQHNSYPYT

SEQ ID NO: 108472 - protein, 8 aa, Homo sapiens
  heavy chain complementarity determining region 3 for antibody 54236
ARDDGIDV

SEQ ID NO: 108473 - protein, 9 aa, Homo sapiens
  light chain complementarity determining region 3 for antibody 54237
LQHNSYPYT

SEQ ID NO: 108474 - protein, 17 aa, Homo sapiens
  heavy chain complementarity determining region 3 for antibody 54237
AKDQWELRLAYYYGMDV

SEQ ID NO: 108475 - protein, 9 aa, Homo sapiens
  light chain complementarity determining region 3 for antibody 54238
LQHNSYPYT

SEQ ID NO: 108476 - protein, 17 aa, Homo sapiens
  heavy chain complementarity determining region 3 for antibody 54238
AGEREEDLYYYYYGMDV

SEQ ID NO: 108477 - protein, 9 aa, Homo sapiens
  light chain complementarity determining region 3 for antibody 54239
LQHNSYPWA

SEQ ID NO: 108478 - protein, 9 aa, Homo sapiens
  heavy chain complementarity determining region 3 for antibody 54239
ASLWFGVDY

SEQ ID NO: 108479 - protein, 9 aa, Homo sapiens
  light chain complementarity determining region 3 for antibody 54240
LQHNSYPWA

SEQ ID NO: 108480 - protein, 6 aa, Homo sapiens
  heavy chain complementarity determining region 3 for antibody 54240
ARDPDY

SEQ ID NO: 108481 - protein, 9 aa, Homo sapiens
  light chain complementarity determining region 3 for antibody 54241
LQHNSYPLT

SEQ ID NO: 108482 - protein, 22 aa, Homo sapiens
  heavy chain complementarity determining region 3 for antibody 54241
ARGDYDISTGYRGYYSYYGMDV

SEQ ID NO: 108483 - protein, 9 aa, Homo sapiens
  light chain complementarity determining region 3 for antibody 54242
LQHNSYPLT

SEQ ID NO: 108484 - protein, 22 aa, Homo sapiens
  heavy chain complementarity determining region 3 for antibody 54242
ARGDYDILTGYRGSYSYYGMDV

SEQ ID NO: 108485 - protein, 9 aa, Homo sapiens
  light chain complementarity determining region 3 for antibody 54243
LQHNSYPLT

SEQ ID NO: 108486 - protein, 22 aa, Homo sapiens
  heavy chain complementarity determining region 3 for antibody 54243
ARGDYDILPGYRGYYSYYGMDV

SEQ ID NO: 108487 - protein, 9 aa, Homo sapiens
  light chain complementarity determining region 3 for antibody 54244
LQHNSYPHT

SEQ ID NO: 108488 - protein, 22 aa, Homo sapiens
  heavy chain complementarity determining region 3 for antibody 54244
ARGDYDILTGYRGYYSYYGMDV

SEQ ID NO: 108489 - protein, 9 aa, Homo sapiens
  light chain complementarity determining region 3 for antibody 54245
LQHNSYPHT

SEQ ID NO: 108490 - protein, 19 aa, Homo sapiens
  heavy chain complementarity determining region 3 for antibody 54245
AREHDILTGYYRDYYGMDV

SEQ ID NO: 108491 - protein, 9 aa, Homo sapiens
  light chain complementarity determining region 3 for antibody 54246
LQHNSYPHT

SEQ ID NO: 108492 - protein, 19 aa, Homo sapiens
  heavy chain complementarity determining region 3 for antibody 54246
ARDHDIVTGYYRDYYGMDV

SEQ ID NO: 108493 - protein, 9 aa, Homo sapiens
  light chain complementarity determining region 3 for antibody 54247
LQHNSYPHT

SEQ ID NO: 108494 - protein, 19 aa, Homo sapiens
  heavy chain complementarity determining region 3 for antibody 54247
ARDHDILAGYYRDYYGMDV

SEQ ID NO: 108495 - protein, 9 aa, Homo sapiens
  light chain complementarity determining region 3 for antibody 54248
LQHNSYPFT

SEQ ID NO: 108496 - protein, 11 aa, Homo sapiens
  heavy chain complementarity determining region 3 for antibody 54248
ATDYYYYGMDV

SEQ ID NO: 108497 - protein, 9 aa, Homo sapiens
  light chain complementarity determining region 3 for antibody 54249
LQHNSYPFT

SEQ ID NO: 108498 - protein, 15 aa, Homo sapiens
  heavy chain complementarity determining region 3 for antibody 54249
ARDRPTGAFYWYFDL

SEQ ID NO: 108499 - protein, 9 aa, Homo sapiens
  light chain complementarity determining region 3 for antibody 54250
LQHNSYPFT

SEQ ID NO: 108500 - protein, 15 aa, Homo sapiens
  heavy chain complementarity determining region 3 for antibody 54250
ARDGPTGAFYWSFDL

SEQ ID NO: 108501 - protein, 9 aa, Homo sapiens
  light chain complementarity determining region 3 for antibody 54251
LQHNSYPFT

SEQ ID NO: 108502 - protein, 9 aa, Homo sapiens
  heavy chain complementarity determining region 3 for antibody 54251
AKGEQQLVY

SEQ ID NO: 108503 - protein, 9 aa, Homo sapiens
  light chain complementarity determining region 3 for antibody 54252
LQHDNFPYT

SEQ ID NO: 108504 - protein, 9 aa, Homo sapiens
  heavy chain complementarity determining region 3 for antibody 54252
ARKRWYFDL

SEQ ID NO: 108505 - protein, 9 aa, Homo sapiens
  light chain complementarity determining region 3 for antibody 54253
LQHDNFPYT

SEQ ID NO: 108506 - protein, 13 aa, Homo sapiens
  heavy chain complementarity determining region 3 for antibody 54253
ARDHGYSSSWHDY

SEQ ID NO: 108507 - protein, 9 aa, Homo sapiens
  light chain complementarity determining region 3 for antibody 54254
LQHDNFPYT

SEQ ID NO: 108508 - protein, 7 aa, Homo sapiens
  heavy chain complementarity determining region 3 for antibody 54254
ARDGGDY

SEQ ID NO: 108509 - protein, 10 aa, Homo sapiens
  light chain complementarity determining region 3 for antibody 54255
LQHDNFPMYT

SEQ ID NO: 108510 - protein, 19 aa, Homo sapiens
  heavy chain complementarity determining region 3 for antibody 54255
ARERDWGSLYYYYYYGMDV

SEQ ID NO: 108511 - protein, 9 aa, Homo sapiens
  light chain complementarity determining region 3 for antibody 54256
LQHDDFPHT

SEQ ID NO: 108512 - protein, 20 aa, Homo sapiens
  heavy chain complementarity determining region 3 for antibody 54256
AREGPYYFHSENYYNNWFDP

SEQ ID NO: 108513 - protein, 9 aa, Homo sapiens
  light chain complementarity determining region 3 for antibody 54257
LQDYNYPYT

SEQ ID NO: 108514 - protein, 9 aa, Homo sapiens
  heavy chain complementarity determining region 3 for antibody 54257
ARKRWYFDL

SEQ ID NO: 108515 - protein, 9 aa, Homo sapiens
  light chain complementarity determining region 3 for antibody 54258
LQDYNYPYT

SEQ ID NO: 108516 - protein, 13 aa, Homo sapiens
  heavy chain complementarity determining region 3 for antibody 54258
ARDTAMVTRGFVY

SEQ ID NO: 108517 - protein, 9 aa, Homo sapiens
  light chain complementarity determining region 3 for antibody 54259
LQDYNYPYT

SEQ ID NO: 108518 - protein, 11 aa, Homo sapiens
  heavy chain complementarity determining region 3 for antibody 54259
ARAGGVYGMDV

SEQ ID NO: 108519 - protein, 9 aa, Homo sapiens
  light chain complementarity determining region 3 for antibody 54260
LQDYNYPYA

SEQ ID NO: 108520 - protein, 17 aa, Homo sapiens
  heavy chain complementarity determining region 3 for antibody 54260
ARDLRYFDWSLDDAFDI

SEQ ID NO: 108521 - protein, 9 aa, Homo sapiens
  light chain complementarity determining region 3 for antibody 54261
LQDYNYPWT

SEQ ID NO: 108522 - protein, 15 aa, Homo sapiens
  heavy chain complementarity determining region 3 for antibody 54261
ARDGDYYGSGSFFDY

SEQ ID NO: 108523 - protein, 9 aa, Homo sapiens
  light chain complementarity determining region 3 for antibody 54262
LQDYNYPWT

SEQ ID NO: 108524 - protein, 12 aa, Homo sapiens
  heavy chain complementarity determining region 3 for antibody 54262
ARDGDTMVRGAD

SEQ ID NO: 108525 - protein, 9 aa, Homo sapiens
  light chain complementarity determining region 3 for antibody 54263
LQDYNYPRT

SEQ ID NO: 108526 - protein, 12 aa, Homo sapiens
  heavy chain complementarity determining region 3 for antibody 54263
ARDPSGWSPFDY

SEQ ID NO: 108527 - protein, 9 aa, Homo sapiens
  light chain complementarity determining region 3 for antibody 54264
LQDYNYPRT

SEQ ID NO: 108528 - protein, 15 aa, Homo sapiens
  heavy chain complementarity determining region 3 for antibody 54264
ARDNYYGSGSNWFDH

SEQ ID NO: 108529 - protein, 9 aa, Homo sapiens
  light chain complementarity determining region 3 for antibody 54265
LQDYNYPPT

SEQ ID NO: 108530 - protein, 16 aa, Homo sapiens
  heavy chain complementarity determining region 3 for antibody 54265
ARDRDITMVRGAPFDY

SEQ ID NO: 108531 - protein, 9 aa, Homo sapiens
  light chain complementarity determining region 3 for antibody 54266
LQDYNYPHT

SEQ ID NO: 108532 - protein, 16 aa, Homo sapiens
  heavy chain complementarity determining region 3 for antibody 54266
ARDSRVTMVRGVLNYY

SEQ ID NO: 108533 - protein, 9 aa, Homo sapiens
  light chain complementarity determining region 3 for antibody 54267
LQDYNYPFT

SEQ ID NO: 108534 - protein, 20 aa, Homo sapiens
  heavy chain complementarity determining region 3 for antibody 54267
ARLTIAMVRGVIIEDYGMDV

SEQ ID NO: 108535 - protein, 9 aa, Homo sapiens
  light chain complementarity determining region 3 for antibody 54268
LQDYNYPFT

SEQ ID NO: 108536 - protein, 15 aa, Homo sapiens
  heavy chain complementarity determining region 3 for antibody 54268
AREGDCYGSGSHLNY

SEQ ID NO: 108537 - protein, 9 aa, Homo sapiens
  light chain complementarity determining region 3 for antibody 54269
LQDYNYPFT

SEQ ID NO: 108538 - protein, 20 aa, Homo sapiens
  heavy chain complementarity determining region 3 for antibody 54269
ARDRLTTVRGVIITPGAFDI

SEQ ID NO: 108539 - protein, 9 aa, Homo sapiens
  light chain complementarity determining region 3 for antibody 54270
LQDYFYPPI

SEQ ID NO: 108540 - protein, 15 aa, Homo sapiens
  heavy chain complementarity determining region 3 for antibody 54270
ARDRWYSGSSYGMDV

SEQ ID NO: 108541 - protein, 9 aa, Homo sapiens
  light chain complementarity determining region 3 for antibody 54271
HQSSSLPYT

SEQ ID NO: 108542 - protein, 13 aa, Homo sapiens
  heavy chain complementarity determining region 3 for antibody 54271
ARSGGNWGRWFDH

SEQ ID NO: 108543 - protein, 9 aa, Homo sapiens
  light chain complementarity determining region 3 for antibody 54272
HQSSSLPYT

SEQ ID NO: 108544 - protein, 9 aa, Homo sapiens
  heavy chain complementarity determining region 3 for antibody 54272
ARKRWSFDL

SEQ ID NO: 108545 - protein, 9 aa, Homo sapiens
  light chain complementarity determining region 3 for antibody 54273
HQSSSLPYT

SEQ ID NO: 108546 - protein, 12 aa, Homo sapiens
  heavy chain complementarity determining region 3 for antibody 54273
ARDHSGSGGFDY

SEQ ID NO: 108547 - protein, 9 aa, Homo sapiens
  light chain complementarity determining region 3 for antibody 54274
HQSSSLPWT

SEQ ID NO: 108548 - protein, 10 aa, Homo sapiens
  heavy chain complementarity determining region 3 for antibody 54274
ASAYSSSWNY

SEQ ID NO: 108549 - protein, 9 aa, Homo sapiens
  light chain complementarity determining region 3 for antibody 54275
HQSSSLPWT

SEQ ID NO: 108550 - protein, 15 aa, Homo sapiens
  heavy chain complementarity determining region 3 for antibody 54275
ARSYYDILTGYYEDY

SEQ ID NO: 108551 - protein, 9 aa, Homo sapiens
  light chain complementarity determining region 3 for antibody 54276
HQSSSLPRT

SEQ ID NO: 108552 - protein, 9 aa, Homo sapiens
  heavy chain complementarity determining region 3 for antibody 54276
ARKRWYIDL

SEQ ID NO: 108553 - protein, 9 aa, Homo sapiens
  light chain complementarity determining region 3 for antibody 54277
HQSSSLPQT

SEQ ID NO: 108554 - protein, 12 aa, Homo sapiens
  heavy chain complementarity determining region 3 for antibody 54277
AANWNDGYAFDI

SEQ ID NO: 108555 - protein, 9 aa, Homo sapiens
  light chain complementarity determining region 3 for antibody 54278
HQSSSLPIT

SEQ ID NO: 108556 - protein, 16 aa, Homo sapiens
  heavy chain complementarity determining region 3 for antibody 54278
AREYYDILTGYYITDY

SEQ ID NO: 108557 - protein, 9 aa, Homo sapiens
  light chain complementarity determining region 3 for antibody 54279
HQSSSLPIT

SEQ ID NO: 108558 - protein, 15 aa, Homo sapiens
  heavy chain complementarity determining region 3 for antibody 54279
ARDGIQLWLQDAFDI

SEQ ID NO: 108559 - protein, 9 aa, Homo sapiens
  light chain complementarity determining region 3 for antibody 54280
HQSSSLPHT

SEQ ID NO: 108560 - protein, 5 aa, Homo sapiens
  heavy chain complementarity determining region 3 for antibody 54280
ASLDI

SEQ ID NO: 108561 - protein, 9 aa, Homo sapiens
  light chain complementarity determining region 3 for antibody 54281
HQSSSLPHT

SEQ ID NO: 108562 - protein, 14 aa, Homo sapiens
  heavy chain complementarity determining region 3 for antibody 54281
AKETITLVRGVMDY

SEQ ID NO: 108563 - protein, 9 aa, Homo sapiens
  light chain complementarity determining region 3 for antibody 54282
HQSSSLPFT

SEQ ID NO: 108564 - protein, 11 aa, Homo sapiens
  heavy chain complementarity determining region 3 for antibody 54282
ARLLWFGGFDS

SEQ ID NO: 108565 - protein, 9 aa, Homo sapiens
  light chain complementarity determining region 3 for antibody 54283
HQSSSLPFT

SEQ ID NO: 108566 - protein, 17 aa, Homo sapiens
  heavy chain complementarity determining region 3 for antibody 54283
AREYNDILTGYWGYFDY

SEQ ID NO: 108567 - protein, 8 aa, Homo sapiens
  light chain complementarity determining region 3 for antibody 54284
HQSSSLLT

SEQ ID NO: 108568 - protein, 13 aa, Homo sapiens
  heavy chain complementarity determining region 3 for antibody 54284
ARDLHYGHDAFDI

SEQ ID NO: 108569 - protein, 9 aa, Homo sapiens
  light chain complementarity determining region 3 for antibody 54285
HQSSRLPYT

SEQ ID NO: 108570 - protein, 15 aa, Homo sapiens
  heavy chain complementarity determining region 3 for antibody 54285
AKGEQLGYYYYGMDV

SEQ ID NO: 108571 - protein, 9 aa, Homo sapiens
  light chain complementarity determining region 3 for antibody 54286
VQHNSYPYT

SEQ ID NO: 108572 - protein, 8 aa, Homo sapiens
  heavy chain complementarity determining region 3 for antibody 54286
ARDDGMDV

SEQ ID NO: 108573 - protein, 10 aa, Homo sapiens
  light chain complementarity determining region 3 for antibody 54287
TQTLQTPPYT

SEQ ID NO: 108574 - protein, 17 aa, Homo sapiens
  heavy chain complementarity determining region 3 for antibody 54287
ANGDSSSWYNYYYGMDV

SEQ ID NO: 108575 - protein, 9 aa, Homo sapiens
  light chain complementarity determining region 3 for antibody 54288
QQYNSYSYT

SEQ ID NO: 108576 - protein, 11 aa, Homo sapiens
  heavy chain complementarity determining region 3 for antibody 54288
ARWGLVPPFDY

SEQ ID NO: 108577 - protein, 9 aa, Homo sapiens
  light chain complementarity determining region 3 for antibody 54289
QQYNSYSWK

SEQ ID NO: 108578 - protein, 16 aa, Homo sapiens
  heavy chain complementarity determining region 3 for antibody 54289
AGSGSYLDYYYYGMDV

SEQ ID NO: 108579 - protein, 8 aa, Homo sapiens
  light chain complementarity determining region 3 for antibody 54290
QQYNSYST

SEQ ID NO: 108580 - protein, 14 aa, Homo sapiens
  heavy chain complementarity determining region 3 for antibody 54290
AKEEQQPVWDAFDI

SEQ ID NO: 108581 - protein, 8 aa, Homo sapiens
  light chain complementarity determining region 3 for antibody 54291
QQYNSYST

SEQ ID NO: 108582 - protein, 14 aa, Homo sapiens
  heavy chain complementarity determining region 3 for antibody 54291
AKEEQQLVWGAFDI

SEQ ID NO: 108583 - protein, 9 aa, Homo sapiens
  light chain complementarity determining region 3 for antibody 54292
QQYNSYPYT

SEQ ID NO: 108584 - protein, 4 aa, Homo sapiens
  heavy chain complementarity determining region 3 for antibody 54292
GMDV

SEQ ID NO: 108585 - protein, 9 aa, Homo sapiens
  light chain complementarity determining region 3 for antibody 54293
QQYNSYPYT

SEQ ID NO: 108586 - protein, 17 aa, Homo sapiens
  heavy chain complementarity determining region 3 for antibody 54293
ASLVLRYSDWLFPHFDY

SEQ ID NO: 108587 - protein, 9 aa, Homo sapiens
  light chain complementarity determining region 3 for antibody 54294
QQYNSYPYT

SEQ ID NO: 108588 - protein, 15 aa, Homo sapiens
  heavy chain complementarity determining region 3 for antibody 54294
ASIAAEDYYYYGMDV

SEQ ID NO: 108589 - protein, 9 aa, Homo sapiens
  light chain complementarity determining region 3 for antibody 54295
QQYNSYPYT

SEQ ID NO: 108590 - protein, 17 aa, Homo sapiens
  heavy chain complementarity determining region 3 for antibody 54295
ARLVLRYSNWLLPHFDY

SEQ ID NO: 108591 - protein, 9 aa, Homo sapiens
  light chain complementarity determining region 3 for antibody 54296
QQYNSYPYT

SEQ ID NO: 108592 - protein, 17 aa, Homo sapiens
  heavy chain complementarity determining region 3 for antibody 54296
ARLVLRYSDWLLPHFNY

SEQ ID NO: 108593 - protein, 9 aa, Homo sapiens
  light chain complementarity determining region 3 for antibody 54297
QQYNSYPYT

SEQ ID NO: 108594 - protein, 17 aa, Homo sapiens
  heavy chain complementarity determining region 3 for antibody 54297
ARLVLRYSDWLLPHFDH

SEQ ID NO: 108595 - protein, 9 aa, Homo sapiens
  light chain complementarity determining region 3 for antibody 54298
QQYNSYPYT

SEQ ID NO: 108596 - protein, 17 aa, Homo sapiens
  heavy chain complementarity determining region 3 for antibody 54298
ARLVLRYSDWLLPHFDD

SEQ ID NO: 108597 - protein, 9 aa, Homo sapiens
  light chain complementarity determining region 3 for antibody 54299
QQYNSYPYT

SEQ ID NO: 108598 - protein, 17 aa, Homo sapiens
  heavy chain complementarity determining region 3 for antibody 54299
ARLVLRYSDWLLLHFDY

SEQ ID NO: 108599 - protein, 9 aa, Homo sapiens
  light chain complementarity determining region 3 for antibody 54300
QQYNSYPYT

SEQ ID NO: 108600 - protein, 17 aa, Homo sapiens
  heavy chain complementarity determining region 3 for antibody 54300
ARLVLRYSDWLFPRFDY

SEQ ID NO: 108601 - protein, 9 aa, Homo sapiens
  light chain complementarity determining region 3 for antibody 54301
QQYNSYPYT

SEQ ID NO: 108602 - protein, 17 aa, Homo sapiens
  heavy chain complementarity determining region 3 for antibody 54301
ARLVLRYSDLLLPHFDY

SEQ ID NO: 108603 - protein, 9 aa, Homo sapiens
  light chain complementarity determining region 3 for antibody 54302
QQYNSYPYT

SEQ ID NO: 108604 - protein, 17 aa, Homo sapiens
  heavy chain complementarity determining region 3 for antibody 54302
ARLVLRNSDWLLPHFDY

SEQ ID NO: 108605 - protein, 9 aa, Homo sapiens
  light chain complementarity determining region 3 for antibody 54303
QQYNSYPYT

SEQ ID NO: 108606 - protein, 17 aa, Homo sapiens
  heavy chain complementarity determining region 3 for antibody 54303
ARLVLRCSDWLLPHFDY

SEQ ID NO: 108607 - protein, 9 aa, Homo sapiens
  light chain complementarity determining region 3 for antibody 54304
QQYNSYPYT

SEQ ID NO: 108608 - protein, 17 aa, Homo sapiens
  heavy chain complementarity determining region 3 for antibody 54304
ARHVLRYSDWLLPHFDY

SEQ ID NO: 108609 - protein, 9 aa, Homo sapiens
  light chain complementarity determining region 3 for antibody 54305
QQYNSYPYT

SEQ ID NO: 108610 - protein, 16 aa, Homo sapiens
  heavy chain complementarity determining region 3 for antibody 54305
ARDPLYNWNDEGAFDL

SEQ ID NO: 108611 - protein, 9 aa, Homo sapiens
  light chain complementarity determining region 3 for antibody 54306
QQYNSYPYP

SEQ ID NO: 108612 - protein, 17 aa, Homo sapiens
  heavy chain complementarity determining region 3 for antibody 54306
ARLVLRYSDWLLPHFDY

SEQ ID NO: 108613 - protein, 9 aa, Homo sapiens
  light chain complementarity determining region 3 for antibody 54307
QQYNSYPWT

SEQ ID NO: 108614 - protein, 15 aa, Homo sapiens
  heavy chain complementarity determining region 3 for antibody 54307
ARDAKYSYGSDAFDI

SEQ ID NO: 108615 - protein, 9 aa, Homo sapiens
  light chain complementarity determining region 3 for antibody 54308
QQYNSYPRT

SEQ ID NO: 108616 - protein, 17 aa, Homo sapiens
  heavy chain complementarity determining region 3 for antibody 54308
AREKQLAPYYYYYGMDV

SEQ ID NO: 108617 - protein, 9 aa, Homo sapiens
  light chain complementarity determining region 3 for antibody 54309
QQYNSYPRT

SEQ ID NO: 108618 - protein, 15 aa, Homo sapiens
  heavy chain complementarity determining region 3 for antibody 54309
AREGDILTGYYNFDY

SEQ ID NO: 108619 - protein, 9 aa, Homo sapiens
  light chain complementarity determining region 3 for antibody 54310
QQYNSYPLT

SEQ ID NO: 108620 - protein, 17 aa, Homo sapiens
  heavy chain complementarity determining region 3 for antibody 54310
ARLVLRYSDWLLPHFDY

SEQ ID NO: 108621 - protein, 9 aa, Homo sapiens
  light chain complementarity determining region 3 for antibody 54311
QQYNSYPLT

SEQ ID NO: 108622 - protein, 10 aa, Homo sapiens
  heavy chain complementarity determining region 3 for antibody 54311
ARAGSYGMDV

SEQ ID NO: 108623 - protein, 9 aa, Homo sapiens
  light chain complementarity determining region 3 for antibody 54312
QQYNSFQFT

SEQ ID NO: 108624 - protein, 17 aa, Homo sapiens
  heavy chain complementarity determining region 3 for antibody 54312
AREYNDILTGYWGYFDY

SEQ ID NO: 108625 - protein, 9 aa, Homo sapiens
  light chain complementarity determining region 3 for antibody 54313
QQYNSFPFT

SEQ ID NO: 108626 - protein, 17 aa, Homo sapiens
  heavy chain complementarity determining region 3 for antibody 54313
AREYNDILTGYWRYFDY

SEQ ID NO: 108627 - protein, 9 aa, Homo sapiens
  light chain complementarity determining region 3 for antibody 54314
QQYNSFPFT

SEQ ID NO: 108628 - protein, 17 aa, Homo sapiens
  heavy chain complementarity determining region 3 for antibody 54314
AREYNDILTGYWGYIDY

SEQ ID NO: 108629 - protein, 9 aa, Homo sapiens
  light chain complementarity determining region 3 for antibody 54315
QQYNSFPFT

SEQ ID NO: 108630 - protein, 17 aa, Homo sapiens
  heavy chain complementarity determining region 3 for antibody 54315
AREYNDILTGYWGYFGY

SEQ ID NO: 108631 - protein, 9 aa, Homo sapiens
  light chain complementarity determining region 3 for antibody 54316
QQYNSFPFT

SEQ ID NO: 108632 - protein, 17 aa, Homo sapiens
  heavy chain complementarity determining region 3 for antibody 54316
AREYNDILTGYRGYFDY

SEQ ID NO: 108633 - protein, 9 aa, Homo sapiens
  light chain complementarity determining region 3 for antibody 54317
QQYNSFPFT

SEQ ID NO: 108634 - protein, 17 aa, Homo sapiens
  heavy chain complementarity determining region 3 for antibody 54317
AREYNDILTGDWGYFDY

SEQ ID NO: 108635 - protein, 9 aa, Homo sapiens
  light chain complementarity determining region 3 for antibody 54318
QQYNSFPFT

SEQ ID NO: 108636 - protein, 17 aa, Homo sapiens
  heavy chain complementarity determining region 3 for antibody 54318
AREYHDILTGYWGYFDY

SEQ ID NO: 108637 - protein, 9 aa, Homo sapiens
  light chain complementarity determining region 3 for antibody 54319
QQYNSFPFT

SEQ ID NO: 108638 - protein, 17 aa, Homo sapiens
  heavy chain complementarity determining region 3 for antibody 54319
AREDNDILTGYWGYFDY

SEQ ID NO: 108639 - protein, 9 aa, Homo sapiens
  light chain complementarity determining region 3 for antibody 54320
QQYNSFPFT

SEQ ID NO: 108640 - protein, 14 aa, Homo sapiens
  heavy chain complementarity determining region 3 for antibody 54320
ARAGTTGTSYGMDV

SEQ ID NO: 108641 - protein, 9 aa, Homo sapiens
  light chain complementarity determining region 3 for antibody 54321
QQYNSAPLT

SEQ ID NO: 108642 - protein, 8 aa, Homo sapiens
  heavy chain complementarity determining region 3 for antibody 54321
ARTGALDY

SEQ ID NO: 108643 - protein, 9 aa, Homo sapiens
  light chain complementarity determining region 3 for antibody 54322
QQYNNWPWT

SEQ ID NO: 108644 - protein, 18 aa, Homo sapiens
  heavy chain complementarity determining region 3 for antibody 54322
AREEGSTYYDILTGLPDV

SEQ ID NO: 108645 - protein, 9 aa, Homo sapiens
  light chain complementarity determining region 3 for antibody 54323
QQYNNWPRT

SEQ ID NO: 108646 - protein, 12 aa, Homo sapiens
  heavy chain complementarity determining region 3 for antibody 54323
ATEWEPGTTRDY

SEQ ID NO: 108647 - protein, 9 aa, Homo sapiens
  light chain complementarity determining region 3 for antibody 54324
QQYNNWPRT

SEQ ID NO: 108648 - protein, 11 aa, Homo sapiens
  heavy chain complementarity determining region 3 for antibody 54324
ARLRWLDYFDY

SEQ ID NO: 108649 - protein, 9 aa, Homo sapiens
  light chain complementarity determining region 3 for antibody 54325
QQYNNWPRT

SEQ ID NO: 108650 - protein, 12 aa, Homo sapiens
  heavy chain complementarity determining region 3 for antibody 54325
AREWEPGTTRDS

SEQ ID NO: 108651 - protein, 9 aa, Homo sapiens
  light chain complementarity determining region 3 for antibody 54326
QQYNNWPRT

SEQ ID NO: 108652 - protein, 12 aa, Homo sapiens
  heavy chain complementarity determining region 3 for antibody 54326
AREWEPGTTGDY

SEQ ID NO: 108653 - protein, 9 aa, Homo sapiens
  light chain complementarity determining region 3 for antibody 54327
QQYNNWPRT

SEQ ID NO: 108654 - protein, 12 aa, Homo sapiens
  heavy chain complementarity determining region 3 for antibody 54327
AREWEPATARDY

SEQ ID NO: 108655 - protein, 9 aa, Homo sapiens
  light chain complementarity determining region 3 for antibody 54328
QQYNNWPRT

SEQ ID NO: 108656 - protein, 12 aa, Homo sapiens
  heavy chain complementarity determining region 3 for antibody 54328
AREWAPGTARDY

SEQ ID NO: 108657 - protein, 9 aa, Homo sapiens
  light chain complementarity determining region 3 for antibody 54329
QQYNNWPRT

SEQ ID NO: 108658 - protein, 12 aa, Homo sapiens
  heavy chain complementarity determining region 3 for antibody 54329
ARECEPGTTRDY

SEQ ID NO: 108659 - protein, 9 aa, Homo sapiens
  light chain complementarity determining region 3 for antibody 54330
QQYNNWPRT

SEQ ID NO: 108660 - protein, 12 aa, Homo sapiens
  heavy chain complementarity determining region 3 for antibody 54330
AGEWEPGTTRDY

SEQ ID NO: 108661 - protein, 9 aa, Homo sapiens
  light chain complementarity determining region 3 for antibody 54331
QQYNNWPPT

SEQ ID NO: 108662 - protein, 15 aa, Homo sapiens
  heavy chain complementarity determining region 3 for antibody 54331
AREYYDILTGYLPAS

SEQ ID NO: 108663 - protein, 11 aa, Homo sapiens
  light chain complementarity determining region 3 for antibody 54332
QQYNNWPPEYT

SEQ ID NO: 108664 - protein, 14 aa, Homo sapiens
  heavy chain complementarity determining region 3 for antibody 54332
ARSFGYSYGFYFDY

SEQ ID NO: 108665 - protein, 9 aa, Homo sapiens
  light chain complementarity determining region 3 for antibody 54333
QQYNNWPLT

SEQ ID NO: 108666 - protein, 15 aa, Homo sapiens
  heavy chain complementarity determining region 3 for antibody 54333
ARVDSGSYYSHAFDI

SEQ ID NO: 108667 - protein, 9 aa, Homo sapiens
  light chain complementarity determining region 3 for antibody 54334
QQYNNWPLT

SEQ ID NO: 108668 - protein, 14 aa, Homo sapiens
  heavy chain complementarity determining region 3 for antibody 54334
AREGGSGWSYGMDV

SEQ ID NO: 108669 - protein, 9 aa, Homo sapiens
  light chain complementarity determining region 3 for antibody 54335
QQYNNWPLT

SEQ ID NO: 108670 - protein, 13 aa, Homo sapiens
  heavy chain complementarity determining region 3 for antibody 54335
ARDRIAVAGYFDY

SEQ ID NO: 108671 - protein, 9 aa, Homo sapiens
  light chain complementarity determining region 3 for antibody 54336
QQYNIYPYT

SEQ ID NO: 108672 - protein, 18 aa, Homo sapiens
  heavy chain complementarity determining region 3 for antibody 54336
AREGRDDILTGYYDAFDI

SEQ ID NO: 108673 - protein, 9 aa, Homo sapiens
  light chain complementarity determining region 3 for antibody 54337
QQYNIYPFT

SEQ ID NO: 108674 - protein, 9 aa, Homo sapiens
  heavy chain complementarity determining region 3 for antibody 54337
ARELTGGDY

SEQ ID NO: 108675 - protein, 9 aa, Homo sapiens
  light chain complementarity determining region 3 for antibody 54338
QQYNGFPFT

SEQ ID NO: 108676 - protein, 17 aa, Homo sapiens
  heavy chain complementarity determining region 3 for antibody 54338
AREYNDILTGYWGYFDY

SEQ ID NO: 108677 - protein, 9 aa, Homo sapiens
  light chain complementarity determining region 3 for antibody 54339
QQYISYPFT

SEQ ID NO: 108678 - protein, 13 aa, Homo sapiens
  heavy chain complementarity determining region 3 for antibody 54339
ASDYGDYQYYFDY

SEQ ID NO: 108679 - protein, 9 aa, Homo sapiens
  light chain complementarity determining region 3 for antibody 54340
QQYISYPFT

SEQ ID NO: 108680 - protein, 13 aa, Homo sapiens
  heavy chain complementarity determining region 3 for antibody 54340
AAGYGDYQYYFDY

SEQ ID NO: 108681 - protein, 9 aa, Homo sapiens
  light chain complementarity determining region 3 for antibody 54341
QQYISYPFT

SEQ ID NO: 108682 - protein, 13 aa, Homo sapiens
  heavy chain complementarity determining region 3 for antibody 54341
AADYGDYQYYFDD

SEQ ID NO: 108683 - protein, 9 aa, Homo sapiens
  light chain complementarity determining region 3 for antibody 54342
QQYISYPFT

SEQ ID NO: 108684 - protein, 13 aa, Homo sapiens
  heavy chain complementarity determining region 3 for antibody 54342
AADYGDYQYYFAY

SEQ ID NO: 108685 - protein, 9 aa, Homo sapiens
  light chain complementarity determining region 3 for antibody 54343
QQYISYPFT

SEQ ID NO: 108686 - protein, 13 aa, Homo sapiens
  heavy chain complementarity determining region 3 for antibody 54343
AADYGDYQCYFDY

SEQ ID NO: 108687 - protein, 9 aa, Homo sapiens
  light chain complementarity determining region 3 for antibody 54344
QQYISYPFT

SEQ ID NO: 108688 - protein, 13 aa, Homo sapiens
  heavy chain complementarity determining region 3 for antibody 54344
AADYGDSQYSFDY

SEQ ID NO: 108689 - protein, 9 aa, Homo sapiens
  light chain complementarity determining region 3 for antibody 54345
QQYISYPFT

SEQ ID NO: 108690 - protein, 13 aa, Homo sapiens
  heavy chain complementarity determining region 3 for antibody 54345
AADYGAYQYSFDY

SEQ ID NO: 108691 - protein, 9 aa, Homo sapiens
  light chain complementarity determining region 3 for antibody 54346
QQYGSSPYT

SEQ ID NO: 108692 - protein, 20 aa, Homo sapiens
  heavy chain complementarity determining region 3 for antibody 54346
ARKGGYYGSGSYCNVVYFDY

SEQ ID NO: 108693 - protein, 9 aa, Homo sapiens
  light chain complementarity determining region 3 for antibody 54347
QQYGSSPYT

SEQ ID NO: 108694 - protein, 16 aa, Homo sapiens
  heavy chain complementarity determining region 3 for antibody 54347
ARDWLFSGSYGSGMDV

SEQ ID NO: 108695 - protein, 9 aa, Homo sapiens
  light chain complementarity determining region 3 for antibody 54348
QQYGSSPYT

SEQ ID NO: 108696 - protein, 16 aa, Homo sapiens
  heavy chain complementarity determining region 3 for antibody 54348
ARDRGIGIGSAGYFDY

SEQ ID NO: 108697 - protein, 9 aa, Homo sapiens
  light chain complementarity determining region 3 for antibody 54349
QQYGSSPYT

SEQ ID NO: 108698 - protein, 16 aa, Homo sapiens
  heavy chain complementarity determining region 3 for antibody 54349
ARDRGIGIGAAGYFDY

SEQ ID NO: 108699 - protein, 9 aa, Homo sapiens
  light chain complementarity determining region 3 for antibody 54350
QQYGSSPYT

SEQ ID NO: 108700 - protein, 13 aa, Homo sapiens
  heavy chain complementarity determining region 3 for antibody 54350
AADYGDYQYYFDY

SEQ ID NO: 108701 - protein, 9 aa, Homo sapiens
  light chain complementarity determining region 3 for antibody 54351
QQYGSSPWT

SEQ ID NO: 108702 - protein, 20 aa, Homo sapiens
  heavy chain complementarity determining region 3 for antibody 54351
ARDRDDILTGWVPSYYGVDV

SEQ ID NO: 108703 - protein, 10 aa, Homo sapiens
  light chain complementarity determining region 3 for antibody 54352
QQYGSSPMYT

SEQ ID NO: 108704 - protein, 19 aa, Homo sapiens
  heavy chain complementarity determining region 3 for antibody 54352
ARGYCSSASCGAVAANFDY

SEQ ID NO: 108705 - protein, 9 aa, Homo sapiens
  light chain complementarity determining region 3 for antibody 54353
QQYGSSPLT

SEQ ID NO: 108706 - protein, 12 aa, Homo sapiens
  heavy chain complementarity determining region 3 for antibody 54353
ATGLLWFGEYDY

SEQ ID NO: 108707 - protein, 9 aa, Homo sapiens
  light chain complementarity determining region 3 for antibody 54354
QQYDSYPYT

SEQ ID NO: 108708 - protein, 17 aa, Homo sapiens
  heavy chain complementarity determining region 3 for antibody 54354
ARLVLRYSDWLLPHFDY

SEQ ID NO: 108709 - protein, 9 aa, Homo sapiens
  light chain complementarity determining region 3 for antibody 54355
QQSYSTPYT

SEQ ID NO: 108710 - protein, 16 aa, Homo sapiens
  heavy chain complementarity determining region 3 for antibody 54355
ATRSYYGILTGYYFDY

SEQ ID NO: 108711 - protein, 9 aa, Homo sapiens
  light chain complementarity determining region 3 for antibody 54356
QQSYSTPYT

SEQ ID NO: 108712 - protein, 16 aa, Homo sapiens
  heavy chain complementarity determining region 3 for antibody 54356
ATRSYYDILTGYSFDY

SEQ ID NO: 108713 - protein, 9 aa, Homo sapiens
  light chain complementarity determining region 3 for antibody 54357
QQSYSTPYT

SEQ ID NO: 108714 - protein, 17 aa, Homo sapiens
  heavy chain complementarity determining region 3 for antibody 54357
ARDPITMVRGVSDAFDT

SEQ ID NO: 108715 - protein, 9 aa, Homo sapiens
  light chain complementarity determining region 3 for antibody 54358
QQSYSTPYT

SEQ ID NO: 108716 - protein, 16 aa, Homo sapiens
  heavy chain complementarity determining region 3 for antibody 54358
AARSYYDISTGYYFDY

SEQ ID NO: 108717 - protein, 9 aa, Homo sapiens
  light chain complementarity determining region 3 for antibody 54359
QQSYSTPYT

SEQ ID NO: 108718 - protein, 13 aa, Homo sapiens
  heavy chain complementarity determining region 3 for antibody 54359
AADYGDYQYYFDY

SEQ ID NO: 108719 - protein, 9 aa, Homo sapiens
  light chain complementarity determining region 3 for antibody 54360
QQSYSTPWT

SEQ ID NO: 108720 - protein, 17 aa, Homo sapiens
  heavy chain complementarity determining region 3 for antibody 54360
ARGTYYYGSGSYFSFDY

SEQ ID NO: 108721 - protein, 9 aa, Homo sapiens
  light chain complementarity determining region 3 for antibody 54361
QQRSNWPLT

SEQ ID NO: 108722 - protein, 15 aa, Homo sapiens
  heavy chain complementarity determining region 3 for antibody 54361
ARQGYNWNAPDAFDI

SEQ ID NO: 108723 - protein, 9 aa, Homo sapiens
  light chain complementarity determining region 3 for antibody 54362
QQRSNWPLT

SEQ ID NO: 108724 - protein, 15 aa, Homo sapiens
  heavy chain complementarity determining region 3 for antibody 54362
ARESLIVGATNWFDP

SEQ ID NO: 108725 - protein, 9 aa, Homo sapiens
  light chain complementarity determining region 3 for antibody 54363
QQRSNWMYT

SEQ ID NO: 108726 - protein, 10 aa, Homo sapiens
  heavy chain complementarity determining region 3 for antibody 54363
AKERWELIDY

SEQ ID NO: 108727 - protein, 9 aa, Homo sapiens
  light chain complementarity determining region 3 for antibody 54364
QQRSNWMYT

SEQ ID NO: 108728 - protein, 10 aa, Homo sapiens
  heavy chain complementarity determining region 3 for antibody 54364
AKERSELLDY

SEQ ID NO: 108729 - protein, 9 aa, Homo sapiens
  light chain complementarity determining region 3 for antibody 54365
QQLNSYPYT

SEQ ID NO: 108730 - protein, 14 aa, Homo sapiens
  heavy chain complementarity determining region 3 for antibody 54365
ARTNDILTGFPFDY

SEQ ID NO: 108731 - protein, 9 aa, Homo sapiens
  light chain complementarity determining region 3 for antibody 54366
QQLNSYPYT

SEQ ID NO: 108732 - protein, 8 aa, Homo sapiens
  heavy chain complementarity determining region 3 for antibody 54366
ARTGPLDY

SEQ ID NO: 108733 - protein, 9 aa, Homo sapiens
  light chain complementarity determining region 3 for antibody 54367
QQLNSYPYT

SEQ ID NO: 108734 - protein, 9 aa, Homo sapiens
  heavy chain complementarity determining region 3 for antibody 54367
ARNSWYFDL

SEQ ID NO: 108735 - protein, 9 aa, Homo sapiens
  light chain complementarity determining region 3 for antibody 54368
QQLNSYPYT

SEQ ID NO: 108736 - protein, 9 aa, Homo sapiens
  heavy chain complementarity determining region 3 for antibody 54368
ARNRWYIDL

SEQ ID NO: 108737 - protein, 9 aa, Homo sapiens
  light chain complementarity determining region 3 for antibody 54369
QQLNSYPYT

SEQ ID NO: 108738 - protein, 9 aa, Homo sapiens
  heavy chain complementarity determining region 3 for antibody 54369
ARKRWYFNL

SEQ ID NO: 108739 - protein, 9 aa, Homo sapiens
  light chain complementarity determining region 3 for antibody 54370
QQLNSYPYT

SEQ ID NO: 108740 - protein, 9 aa, Homo sapiens
  heavy chain complementarity determining region 3 for antibody 54370
ARKQRSFDY

SEQ ID NO: 108741 - protein, 9 aa, Homo sapiens
  light chain complementarity determining region 3 for antibody 54371
QQLNSYPYT

SEQ ID NO: 108742 - protein, 16 aa, Homo sapiens
  heavy chain complementarity determining region 3 for antibody 54371
ARGVRGDLYYYYGMDV

SEQ ID NO: 108743 - protein, 9 aa, Homo sapiens
  light chain complementarity determining region 3 for antibody 54372
QQLNSYPYT

SEQ ID NO: 108744 - protein, 13 aa, Homo sapiens
  heavy chain complementarity determining region 3 for antibody 54372
ARERYFASYGMDV

SEQ ID NO: 108745 - protein, 9 aa, Homo sapiens
  light chain complementarity determining region 3 for antibody 54373
QQLNSYPYT

SEQ ID NO: 108746 - protein, 19 aa, Homo sapiens
  heavy chain complementarity determining region 3 for antibody 54373
ARDERFGEPFYSYYYGMDV

SEQ ID NO: 108747 - protein, 9 aa, Homo sapiens
  light chain complementarity determining region 3 for antibody 54374
QQLNSYPWT

SEQ ID NO: 108748 - protein, 12 aa, Homo sapiens
  heavy chain complementarity determining region 3 for antibody 54374
ARGDQPLLYFDY

SEQ ID NO: 108749 - protein, 9 aa, Homo sapiens
  light chain complementarity determining region 3 for antibody 54375
QQLNSYPPT

SEQ ID NO: 108750 - protein, 13 aa, Homo sapiens
  heavy chain complementarity determining region 3 for antibody 54375
AADYGDYQCYFDY

SEQ ID NO: 108751 - protein, 9 aa, Homo sapiens
  light chain complementarity determining region 3 for antibody 54376
QQLNSYPPT

SEQ ID NO: 108752 - protein, 13 aa, Homo sapiens
  heavy chain complementarity determining region 3 for antibody 54376
AADYGDYPYYFDY

SEQ ID NO: 108753 - protein, 9 aa, Homo sapiens
  light chain complementarity determining region 3 for antibody 54377
QQLNSYPPT

SEQ ID NO: 108754 - protein, 13 aa, Homo sapiens
  heavy chain complementarity determining region 3 for antibody 54377
AADSGDYQYYFDY

SEQ ID NO: 108755 - protein, 9 aa, Homo sapiens
  light chain complementarity determining region 3 for antibody 54378
QQLNSYPPT

SEQ ID NO: 108756 - protein, 13 aa, Homo sapiens
  heavy chain complementarity determining region 3 for antibody 54378
AAAYGAYQYYFDY

SEQ ID NO: 108757 - protein, 9 aa, Homo sapiens
  light chain complementarity determining region 3 for antibody 54379
QQLNSYPLT

SEQ ID NO: 108758 - protein, 12 aa, Homo sapiens
  heavy chain complementarity determining region 3 for antibody 54379
ARDREVRGALDY

SEQ ID NO: 108759 - protein, 9 aa, Homo sapiens
  light chain complementarity determining region 3 for antibody 54380
QQLNSYPIT

SEQ ID NO: 108760 - protein, 16 aa, Homo sapiens
  heavy chain complementarity determining region 3 for antibody 54380
ARDPDYDISTGPPLDY

SEQ ID NO: 108761 - protein, 9 aa, Homo sapiens
  light chain complementarity determining region 3 for antibody 54381
QQLNSYLYT

SEQ ID NO: 108762 - protein, 9 aa, Homo sapiens
  heavy chain complementarity determining region 3 for antibody 54381
ARKRWYFDL

SEQ ID NO: 108763 - protein, 9 aa, Homo sapiens
  light chain complementarity determining region 3 for antibody 54382
QQLNSYLFT

SEQ ID NO: 108764 - protein, 17 aa, Homo sapiens
  heavy chain complementarity determining region 3 for antibody 54382
AKGIAAAGTYYYYGMDV

SEQ ID NO: 108765 - protein, 9 aa, Homo sapiens
  light chain complementarity determining region 3 for antibody 54383
QQHNSFPFT

SEQ ID NO: 108766 - protein, 17 aa, Homo sapiens
  heavy chain complementarity determining region 3 for antibody 54383
AREYNDILTGYWGYFDY

SEQ ID NO: 108767 - protein, 8 aa, Homo sapiens
  light chain complementarity determining region 3 for antibody 54384
QQFVNYPT

SEQ ID NO: 108768 - protein, 12 aa, Homo sapiens
  heavy chain complementarity determining region 3 for antibody 54384
AREMTVAGYFDY

SEQ ID NO: 108769 - protein, 9 aa, Homo sapiens
  light chain complementarity determining region 3 for antibody 54385
QQFNSYPYT

SEQ ID NO: 108770 - protein, 9 aa, Homo sapiens
  heavy chain complementarity determining region 3 for antibody 54385
ARKRWYFDL

SEQ ID NO: 108771 - protein, 9 aa, Homo sapiens
  light chain complementarity determining region 3 for antibody 54386
QQFNNYTFT

SEQ ID NO: 108772 - protein, 16 aa, Homo sapiens
  heavy chain complementarity determining region 3 for antibody 54386
ARGRGYYGSGSPYFDY

SEQ ID NO: 108773 - protein, 9 aa, Homo sapiens
  light chain complementarity determining region 3 for antibody 54387
QQFNNYPLT

SEQ ID NO: 108774 - protein, 15 aa, Homo sapiens
  heavy chain complementarity determining region 3 for antibody 54387
ARDRLWFRELTSFDY

SEQ ID NO: 108775 - protein, 9 aa, Homo sapiens
  light chain complementarity determining region 3 for antibody 54388
QQFNNYPHT

SEQ ID NO: 108776 - protein, 13 aa, Homo sapiens
  heavy chain complementarity determining region 3 for antibody 54388
ATGRYFDWSLFDY

SEQ ID NO: 108777 - protein, 9 aa, Homo sapiens
  light chain complementarity determining region 3 for antibody 54389
QQFNNYPHT

SEQ ID NO: 108778 - protein, 14 aa, Homo sapiens
  heavy chain complementarity determining region 3 for antibody 54389
ARGRYSGYNSFFDY

SEQ ID NO: 108779 - protein, 9 aa, Homo sapiens
  light chain complementarity determining region 3 for antibody 54390
QQFNNYPFT

SEQ ID NO: 108780 - protein, 9 aa, Homo sapiens
  heavy chain complementarity determining region 3 for antibody 54390
ARKRWYFDL

SEQ ID NO: 108781 - protein, 9 aa, Homo sapiens
  light chain complementarity determining region 3 for antibody 54391
QQFNNYPFT

SEQ ID NO: 108782 - protein, 15 aa, Homo sapiens
  heavy chain complementarity determining region 3 for antibody 54391
ARGRLWFGELSPFDY

SEQ ID NO: 108783 - protein, 9 aa, Homo sapiens
  light chain complementarity determining region 3 for antibody 54392
QQFNNYPFT

SEQ ID NO: 108784 - protein, 16 aa, Homo sapiens
  heavy chain complementarity determining region 3 for antibody 54392
ARGRGYYGSWSPYFDY

SEQ ID NO: 108785 - protein, 9 aa, Homo sapiens
  light chain complementarity determining region 3 for antibody 54393
QQFNNYPFT

SEQ ID NO: 108786 - protein, 16 aa, Homo sapiens
  heavy chain complementarity determining region 3 for antibody 54393
ARDRVWFGEFHDAFDI

SEQ ID NO: 108787 - protein, 9 aa, Homo sapiens
  light chain complementarity determining region 3 for antibody 54394
QQFNNWPLT

SEQ ID NO: 108788 - protein, 11 aa, Homo sapiens
  heavy chain complementarity determining region 3 for antibody 54394
ARHGEWLRFDF

SEQ ID NO: 108789 - protein, 9 aa, Homo sapiens
  light chain complementarity determining region 3 for antibody 54395
QQDYNLPYT

SEQ ID NO: 108790 - protein, 16 aa, Homo sapiens
  heavy chain complementarity determining region 3 for antibody 54395
AKDSGTYHYYYYGMDV

SEQ ID NO: 108791 - protein, 9 aa, Homo sapiens
  light chain complementarity determining region 3 for antibody 54396
QQDYNLPWT

SEQ ID NO: 108792 - protein, 20 aa, Homo sapiens
  heavy chain complementarity determining region 3 for antibody 54396
ARRGSYDILTGYYNEGAFDI

SEQ ID NO: 108793 - protein, 9 aa, Homo sapiens
  light chain complementarity determining region 3 for antibody 54397
QQDYNLPWT

SEQ ID NO: 108794 - protein, 9 aa, Homo sapiens
  heavy chain complementarity determining region 3 for antibody 54397
ARRELGLDY

SEQ ID NO: 108795 - protein, 9 aa, Homo sapiens
  light chain complementarity determining region 3 for antibody 54398
QQDYNLPLT

SEQ ID NO: 108796 - protein, 17 aa, Homo sapiens
  heavy chain complementarity determining region 3 for antibody 54398
ARGLRYFDWFLSDAFDI

SEQ ID NO: 108797 - protein, 9 aa, Homo sapiens
  light chain complementarity determining region 3 for antibody 54399
QQDYNLPLT

SEQ ID NO: 108798 - protein, 11 aa, Homo sapiens
  heavy chain complementarity determining region 3 for antibody 54399
AGNRAAAGTHR

SEQ ID NO: 108799 - protein, 9 aa, Homo sapiens
  light chain complementarity determining region 3 for antibody 54400
QQDYNLPLT

SEQ ID NO: 108800 - protein, 11 aa, Homo sapiens
  heavy chain complementarity determining region 3 for antibody 54400
AGDIAAAGTHR

SEQ ID NO: 108801 - protein, 9 aa, Homo sapiens
  light chain complementarity determining region 3 for antibody 54401
QQDYNLPFT

SEQ ID NO: 108802 - protein, 10 aa, Homo sapiens
  heavy chain complementarity determining region 3 for antibody 54401
ARDILTSMDV

SEQ ID NO: 108803 - protein, 8 aa, Homo sapiens
  light chain complementarity determining region 3 for antibody 54402
QQDYNLLT

SEQ ID NO: 108804 - protein, 15 aa, Homo sapiens
  heavy chain complementarity determining region 3 for antibody 54402
AKTYYYGSGSSHFDF

SEQ ID NO: 108805 - protein, 9 aa, Homo sapiens
  light chain complementarity determining region 3 for antibody 54403
QQCNSYPYT

SEQ ID NO: 108806 - protein, 18 aa, Homo sapiens
  heavy chain complementarity determining region 3 for antibody 54403
ARERSDDILTGYFDAFDI

SEQ ID NO: 108807 - protein, 9 aa, Homo sapiens
  light chain complementarity determining region 3 for antibody 54404
QQCNSYPYT

SEQ ID NO: 108808 - protein, 18 aa, Homo sapiens
  heavy chain complementarity determining region 3 for antibody 54404
ARERRDDILTGYFDASDF

SEQ ID NO: 108809 - protein, 9 aa, Homo sapiens
  light chain complementarity determining region 3 for antibody 54405
QQCNSYPYT

SEQ ID NO: 108810 - protein, 18 aa, Homo sapiens
  heavy chain complementarity determining region 3 for antibody 54405
ARERRDDILTGYCDAFDI

SEQ ID NO: 108811 - protein, 9 aa, Homo sapiens
  light chain complementarity determining region 3 for antibody 54406
QQCNSYPYT

SEQ ID NO: 108812 - protein, 18 aa, Homo sapiens
  heavy chain complementarity determining region 3 for antibody 54406
AGERRDDILTGYFDAFDI

SEQ ID NO: 108813 - protein, 9 aa, Homo sapiens
  light chain complementarity determining region 3 for antibody 54407
QQCNSYPHT

SEQ ID NO: 108814 - protein, 18 aa, Homo sapiens
  heavy chain complementarity determining region 3 for antibody 54407
ARERRDDILTGYFDAFDI

SEQ ID NO: 108815 - protein, 9 aa, Homo sapiens
  light chain complementarity determining region 3 for antibody 54408
QKYNSSPLT

SEQ ID NO: 108816 - protein, 8 aa, Homo sapiens
  heavy chain complementarity determining region 3 for antibody 54408
ARTGPLDY

SEQ ID NO: 108817 - protein, 9 aa, Homo sapiens
  light chain complementarity determining region 3 for antibody 54409
QKYNSFPFT

SEQ ID NO: 108818 - protein, 17 aa, Homo sapiens
  heavy chain complementarity determining region 3 for antibody 54409
AREYNDILTGYWGYFDY

SEQ ID NO: 108819 - protein, 9 aa, Homo sapiens
  light chain complementarity determining region 3 for antibody 54410
QKYNSATLT

SEQ ID NO: 108820 - protein, 8 aa, Homo sapiens
  heavy chain complementarity determining region 3 for antibody 54410
ARTGPLDY

SEQ ID NO: 108821 - protein, 9 aa, Homo sapiens
  light chain complementarity determining region 3 for antibody 54411
QKYNSAPYI

SEQ ID NO: 108822 - protein, 14 aa, Homo sapiens
  heavy chain complementarity determining region 3 for antibody 54411
ARGGGAKGSYGMDV

SEQ ID NO: 108823 - protein, 9 aa, Homo sapiens
  light chain complementarity determining region 3 for antibody 54412
QKYNSAPLT

SEQ ID NO: 108824 - protein, 8 aa, Homo sapiens
  heavy chain complementarity determining region 3 for antibody 54412
ARTGPLYY

SEQ ID NO: 108825 - protein, 9 aa, Homo sapiens
  light chain complementarity determining region 3 for antibody 54413
QKYNSAPLT

SEQ ID NO: 108826 - protein, 8 aa, Homo sapiens
  heavy chain complementarity determining region 3 for antibody 54413
ARTGPLDF

SEQ ID NO: 108827 - protein, 9 aa, Homo sapiens
  light chain complementarity determining region 3 for antibody 54414
QKYNSAPLT

SEQ ID NO: 108828 - protein, 8 aa, Homo sapiens
  heavy chain complementarity determining region 3 for antibody 54414
ARTGPFDY

SEQ ID NO: 108829 - protein, 9 aa, Homo sapiens
  light chain complementarity determining region 3 for antibody 54415
QKYNSAPLT

SEQ ID NO: 108830 - protein, 8 aa, Homo sapiens
  heavy chain complementarity determining region 3 for antibody 54415
ARNGPLDY

SEQ ID NO: 108831 - protein, 9 aa, Homo sapiens
  light chain complementarity determining region 3 for antibody 54416
QKYNSAPLT

SEQ ID NO: 108832 - protein, 16 aa, Homo sapiens
  heavy chain complementarity determining region 3 for antibody 54416
AKWGGYSYGFYWYFDL

SEQ ID NO: 108833 - protein, 9 aa, Homo sapiens
  light chain complementarity determining region 3 for antibody 54417
QKYDSATLT

SEQ ID NO: 108834 - protein, 8 aa, Homo sapiens
  heavy chain complementarity determining region 3 for antibody 54417
ARTGPLDY

SEQ ID NO: 108835 - protein, 9 aa, Homo sapiens
  light chain complementarity determining region 3 for antibody 54418
QKSYSTPYT

SEQ ID NO: 108836 - protein, 16 aa, Homo sapiens
  heavy chain complementarity determining region 3 for antibody 54418
ATRSYYDILTGYYFDY

SEQ ID NO: 108837 - protein, 9 aa, Homo sapiens
  light chain complementarity determining region 3 for antibody 54419
QHLNSYPIT

SEQ ID NO: 108838 - protein, 13 aa, Homo sapiens
  heavy chain complementarity determining region 3 for antibody 54419
ARIAAPAVQSFQH

SEQ ID NO: 108839 - protein, 9 aa, Homo sapiens
  light chain complementarity determining region 3 for antibody 54420
QHDYNLPLT

SEQ ID NO: 108840 - protein, 11 aa, Homo sapiens
  heavy chain complementarity determining region 3 for antibody 54420
AGNIAAAGTHR

SEQ ID NO: 108841 - protein, 10 aa, Homo sapiens
  light chain complementarity determining region 3 for antibody 54421
MQTLQTPPYT

SEQ ID NO: 108842 - protein, 17 aa, Homo sapiens
  heavy chain complementarity determining region 3 for antibody 54421
ANGDSSSWYNYYCGMDV

SEQ ID NO: 108843 - protein, 10 aa, Homo sapiens
  light chain complementarity determining region 3 for antibody 54422
MQTLQTPPYT

SEQ ID NO: 108844 - protein, 17 aa, Homo sapiens
  heavy chain complementarity determining region 3 for antibody 54422
AKGDSSSWYNYSYGMDV

SEQ ID NO: 108845 - protein, 10 aa, Homo sapiens
  light chain complementarity determining region 3 for antibody 54423
MQTLQTPPYT

SEQ ID NO: 108846 - protein, 17 aa, Homo sapiens
  heavy chain complementarity determining region 3 for antibody 54423
AKGDSGSWYNYYYGMDV

SEQ ID NO: 108847 - protein, 10 aa, Homo sapiens
  light chain complementarity determining region 3 for antibody 54424
MQTLQTPPYT

SEQ ID NO: 108848 - protein, 17 aa, Homo sapiens
  heavy chain complementarity determining region 3 for antibody 54424
AEGDSSSWYNYYYGMDV

SEQ ID NO: 108849 - protein, 9 aa, Homo sapiens
  light chain complementarity determining region 3 for antibody 54425
MQGIHLPLT

SEQ ID NO: 108850 - protein, 13 aa, Homo sapiens
  heavy chain complementarity determining region 3 for antibody 54425
ARDLVLWFGEWDY

SEQ ID NO: 108851 - protein, 9 aa, Homo sapiens
  light chain complementarity determining region 3 for antibody 54426
MQALQTPYT

SEQ ID NO: 108852 - protein, 14 aa, Homo sapiens
  heavy chain complementarity determining region 3 for antibody 54426
ATEISRYYYYGMDV

SEQ ID NO: 108853 - protein, 9 aa, Homo sapiens
  light chain complementarity determining region 3 for antibody 54427
LRHNSYPYT

SEQ ID NO: 108854 - protein, 17 aa, Homo sapiens
  heavy chain complementarity determining region 3 for antibody 54427
AKDQWELLLAYYYGMDV

SEQ ID NO: 108855 - protein, 9 aa, Homo sapiens
  light chain complementarity determining region 3 for antibody 54428
LRHNSHPLT

SEQ ID NO: 108856 - protein, 22 aa, Homo sapiens
  heavy chain complementarity determining region 3 for antibody 54428
ARGDYDILTGYRGYYSYYGMDV

SEQ ID NO: 108857 - protein, 9 aa, Homo sapiens
  light chain complementarity determining region 3 for antibody 54429
LRHDNFPYT

SEQ ID NO: 108858 - protein, 7 aa, Homo sapiens
  heavy chain complementarity determining region 3 for antibody 54429
ARDVGDY

SEQ ID NO: 108859 - protein, 9 aa, Homo sapiens
  light chain complementarity determining region 3 for antibody 54430
LQHNSYPYT

SEQ ID NO: 108860 - protein, 19 aa, Homo sapiens
  heavy chain complementarity determining region 3 for antibody 54430
ARVSDILTGYYKGGRAFDI

SEQ ID NO: 108861 - protein, 9 aa, Homo sapiens
  light chain complementarity determining region 3 for antibody 54431
LQHNSYPYT

SEQ ID NO: 108862 - protein, 19 aa, Homo sapiens
  heavy chain complementarity determining region 3 for antibody 54431
ARVSDILTDYYKGGDAFDI

SEQ ID NO: 108863 - protein, 9 aa, Homo sapiens
  light chain complementarity determining region 3 for antibody 54432
LQHNSYPYT

SEQ ID NO: 108864 - protein, 9 aa, Homo sapiens
  heavy chain complementarity determining region 3 for antibody 54432
ARKRWYFDL

SEQ ID NO: 108865 - protein, 9 aa, Homo sapiens
  light chain complementarity determining region 3 for antibody 54433
LQHNSYPYT

SEQ ID NO: 108866 - protein, 9 aa, Homo sapiens
  heavy chain complementarity determining region 3 for antibody 54433
ARKQRYFDY

SEQ ID NO: 108867 - protein, 9 aa, Homo sapiens
  light chain complementarity determining region 3 for antibody 54434
LQHNSYPYT

SEQ ID NO: 108868 - protein, 16 aa, Homo sapiens
  heavy chain complementarity determining region 3 for antibody 54434
ARGRGYYGSGSPYFDY

SEQ ID NO: 108869 - protein, 9 aa, Homo sapiens
  light chain complementarity determining region 3 for antibody 54435
LQHNSYPYT

SEQ ID NO: 108870 - protein, 15 aa, Homo sapiens
  heavy chain complementarity determining region 3 for antibody 54435
ARESSSGLYYYGMDV

SEQ ID NO: 108871 - protein, 9 aa, Homo sapiens
  light chain complementarity determining region 3 for antibody 54436
LQHNSYPYT

SEQ ID NO: 108872 - protein, 18 aa, Homo sapiens
  heavy chain complementarity determining region 3 for antibody 54436
ARERRDDILTGYFDAFDI

SEQ ID NO: 108873 - protein, 9 aa, Homo sapiens
  light chain complementarity determining region 3 for antibody 54437
LQHNSYPYT

SEQ ID NO: 108874 - protein, 16 aa, Homo sapiens
  heavy chain complementarity determining region 3 for antibody 54437
ARERDNWNPYYYGMDV

SEQ ID NO: 108875 - protein, 9 aa, Homo sapiens
  light chain complementarity determining region 3 for antibody 54438
LQHNSYPYT

SEQ ID NO: 108876 - protein, 12 aa, Homo sapiens
  heavy chain complementarity determining region 3 for antibody 54438
AREQGSADAFDI

SEQ ID NO: 108877 - protein, 9 aa, Homo sapiens
  light chain complementarity determining region 3 for antibody 54439
LQHNSYPYT

SEQ ID NO: 108878 - protein, 17 aa, Homo sapiens
  heavy chain complementarity determining region 3 for antibody 54439
AKEQWELLLAYYYGMDV

SEQ ID NO: 108879 - protein, 9 aa, Homo sapiens
  light chain complementarity determining region 3 for antibody 54440
LQHNSYPYT

SEQ ID NO: 108880 - protein, 17 aa, Homo sapiens
  heavy chain complementarity determining region 3 for antibody 54440
AEDQWELLLAYYYGMDV

SEQ ID NO: 108881 - protein, 9 aa, Homo sapiens
  light chain complementarity determining region 3 for antibody 54441
LQHNSYPWT

SEQ ID NO: 108882 - protein, 12 aa, Homo sapiens
  heavy chain complementarity determining region 3 for antibody 54441
TRLHIVGATGDY

SEQ ID NO: 108883 - protein, 9 aa, Homo sapiens
  light chain complementarity determining region 3 for antibody 54442
LQHNSYPWT

SEQ ID NO: 108884 - protein, 21 aa, Homo sapiens
  heavy chain complementarity determining region 3 for antibody 54442
ATEGSPPIVGGTTDYYYGMDV

SEQ ID NO: 108885 - protein, 9 aa, Homo sapiens
  light chain complementarity determining region 3 for antibody 54443
LQHNSYPWT

SEQ ID NO: 108886 - protein, 8 aa, Homo sapiens
  heavy chain complementarity determining region 3 for antibody 54443
ARTGPLDY

SEQ ID NO: 108887 - protein, 9 aa, Homo sapiens
  light chain complementarity determining region 3 for antibody 54444
LQHNSYPWT

SEQ ID NO: 108888 - protein, 19 aa, Homo sapiens
  heavy chain complementarity determining region 3 for antibody 54444
AREDSSSWYVEYSYYGMDV

SEQ ID NO: 108889 - protein, 9 aa, Homo sapiens
  light chain complementarity determining region 3 for antibody 54445
LQHNSYPWT

SEQ ID NO: 108890 - protein, 19 aa, Homo sapiens
  heavy chain complementarity determining region 3 for antibody 54445
AREDRSSWYVEYYYYGMDV

SEQ ID NO: 108891 - protein, 9 aa, Homo sapiens
  light chain complementarity determining region 3 for antibody 54446
LQHNSYPWT

SEQ ID NO: 108892 - protein, 14 aa, Homo sapiens
  heavy chain complementarity determining region 3 for antibody 54446
ARASFGGVIVIPDY

SEQ ID NO: 108893 - protein, 9 aa, Homo sapiens
  light chain complementarity determining region 3 for antibody 54447
LQHNSYPRT

SEQ ID NO: 108894 - protein, 9 aa, Homo sapiens
  heavy chain complementarity determining region 3 for antibody 54447
ARGEVPGAY

SEQ ID NO: 108895 - protein, 9 aa, Homo sapiens
  light chain complementarity determining region 3 for antibody 54448
LQHNSYPRT

SEQ ID NO: 108896 - protein, 19 aa, Homo sapiens
  heavy chain complementarity determining region 3 for antibody 54448
AKDAGHYYDSGGYLNWFDP

SEQ ID NO: 108897 - protein, 9 aa, Homo sapiens
  light chain complementarity determining region 3 for antibody 54449
LQHNSYPRT

SEQ ID NO: 108898 - protein, 15 aa, Homo sapiens
  heavy chain complementarity determining region 3 for antibody 54449
AGDDPTYYYGSGFDY

SEQ ID NO: 108899 - protein, 9 aa, Homo sapiens
  light chain complementarity determining region 3 for antibody 54450
LQHNSYPLT

SEQ ID NO: 108900 - protein, 9 aa, Homo sapiens
  heavy chain complementarity determining region 3 for antibody 54450
ARKRWYFDL

SEQ ID NO: 108901 - protein, 9 aa, Homo sapiens
  light chain complementarity determining region 3 for antibody 54451
LQHNSYPLT

SEQ ID NO: 108902 - protein, 22 aa, Homo sapiens
  heavy chain complementarity determining region 3 for antibody 54451
ARGGYDILTGYRGYYSYYGMDV

SEQ ID NO: 108903 - protein, 9 aa, Homo sapiens
  light chain complementarity determining region 3 for antibody 54452
LQHNSYPLT

SEQ ID NO: 108904 - protein, 22 aa, Homo sapiens
  heavy chain complementarity determining region 3 for antibody 54452
ARGDYDTLTGYRGYYSYYGMDV

SEQ ID NO: 108905 - protein, 9 aa, Homo sapiens
  light chain complementarity determining region 3 for antibody 54453
LQHNSYPLT

SEQ ID NO: 108906 - protein, 22 aa, Homo sapiens
  heavy chain complementarity determining region 3 for antibody 54453
ARGDYDILTGYRGYYYYYGMDV

SEQ ID NO: 108907 - protein, 9 aa, Homo sapiens
  light chain complementarity determining region 3 for antibody 54454
LQHNSYPLT

SEQ ID NO: 108908 - protein, 22 aa, Homo sapiens
  heavy chain complementarity determining region 3 for antibody 54454
ARGDYDILTGYRGYYSYYGMDF

SEQ ID NO: 108909 - protein, 9 aa, Homo sapiens
  light chain complementarity determining region 3 for antibody 54455
LQHNSYPLT

SEQ ID NO: 108910 - protein, 22 aa, Homo sapiens
  heavy chain complementarity determining region 3 for antibody 54455
ARGDYDILTGYRGYYSYYGMAV

SEQ ID NO: 108911 - protein, 9 aa, Homo sapiens
  light chain complementarity determining region 3 for antibody 54456
LQHNSYPLT

SEQ ID NO: 108912 - protein, 22 aa, Homo sapiens
  heavy chain complementarity determining region 3 for antibody 54456
ARGDYDILTGYRGYYSCYGMDV

SEQ ID NO: 108913 - protein, 9 aa, Homo sapiens
  light chain complementarity determining region 3 for antibody 54457
LQHNSYPLT

SEQ ID NO: 108914 - protein, 22 aa, Homo sapiens
  heavy chain complementarity determining region 3 for antibody 54457
ARGDYDILSGYRGYYSYYGMDV

SEQ ID NO: 108915 - protein, 9 aa, Homo sapiens
  light chain complementarity determining region 3 for antibody 54458
LQHNSYPLT

SEQ ID NO: 108916 - protein, 22 aa, Homo sapiens
  heavy chain complementarity determining region 3 for antibody 54458
ARGDDDILTGYRGYYSYYGMDV

SEQ ID NO: 108917 - protein, 9 aa, Homo sapiens
  light chain complementarity determining region 3 for antibody 54459
LQHNSYPLT

SEQ ID NO: 108918 - protein, 17 aa, Homo sapiens
  heavy chain complementarity determining region 3 for antibody 54459
AREGDYFGSGSYPPFDY

SEQ ID NO: 108919 - protein, 9 aa, Homo sapiens
  light chain complementarity determining region 3 for antibody 54460
LQHNSYPHT

SEQ ID NO: 108920 - protein, 19 aa, Homo sapiens
  heavy chain complementarity determining region 3 for antibody 54460
ARDQDILTGYYRDYYGMDV

SEQ ID NO: 108921 - protein, 9 aa, Homo sapiens
  light chain complementarity determining region 3 for antibody 54461
LQHNSYPHT

SEQ ID NO: 108922 - protein, 19 aa, Homo sapiens
  heavy chain complementarity determining region 3 for antibody 54461
ARDHDILTGYYRVYYGMDV

SEQ ID NO: 108923 - protein, 9 aa, Homo sapiens
  light chain complementarity determining region 3 for antibody 54462
LQHNSYPHT

SEQ ID NO: 108924 - protein, 19 aa, Homo sapiens
  heavy chain complementarity determining region 3 for antibody 54462
ARDHDILTGYYRDYYGVDV

SEQ ID NO: 108925 - protein, 9 aa, Homo sapiens
  light chain complementarity determining region 3 for antibody 54463
LQHNSYPHT

SEQ ID NO: 108926 - protein, 19 aa, Homo sapiens
  heavy chain complementarity determining region 3 for antibody 54463
ARDHDILTGYDRDYYGMDV

SEQ ID NO: 108927 - protein, 9 aa, Homo sapiens
  light chain complementarity determining region 3 for antibody 54464
LQHNSYPFT

SEQ ID NO: 108928 - protein, 11 aa, Homo sapiens
  heavy chain complementarity determining region 3 for antibody 54464
ATDSYYYGMDV

SEQ ID NO: 108929 - protein, 9 aa, Homo sapiens
  light chain complementarity determining region 3 for antibody 54465
LQHNSYPFT

SEQ ID NO: 108930 - protein, 15 aa, Homo sapiens
  heavy chain complementarity determining region 3 for antibody 54465
ASDGPTGAFYWYFDL

SEQ ID NO: 108931 - protein, 9 aa, Homo sapiens
  light chain complementarity determining region 3 for antibody 54466
LQHNSYPFT

SEQ ID NO: 108932 - protein, 9 aa, Homo sapiens
  heavy chain complementarity determining region 3 for antibody 54466
ARKRWYFDL

SEQ ID NO: 108933 - protein, 9 aa, Homo sapiens
  light chain complementarity determining region 3 for antibody 54467
LQHNSYPFT

SEQ ID NO: 108934 - protein, 17 aa, Homo sapiens
  heavy chain complementarity determining region 3 for antibody 54467
AREYNDILTGYWGYFDY

SEQ ID NO: 108935 - protein, 9 aa, Homo sapiens
  light chain complementarity determining region 3 for antibody 54468
LQHNSYPFT

SEQ ID NO: 108936 - protein, 10 aa, Homo sapiens
  heavy chain complementarity determining region 3 for antibody 54468
ARELYYGMDV

SEQ ID NO: 108937 - protein, 9 aa, Homo sapiens
  light chain complementarity determining region 3 for antibody 54469
LQHNSYPFT

SEQ ID NO: 108938 - protein, 15 aa, Homo sapiens
  heavy chain complementarity determining region 3 for antibody 54469
ARDGPTGAFSWYFDL

SEQ ID NO: 108939 - protein, 9 aa, Homo sapiens
  light chain complementarity determining region 3 for antibody 54470
LQHNSYPFT

SEQ ID NO: 108940 - protein, 8 aa, Homo sapiens
  heavy chain complementarity determining region 3 for antibody 54470
ARDDGMDV

SEQ ID NO: 108941 - protein, 9 aa, Homo sapiens
  light chain complementarity determining region 3 for antibody 54471
LQHNSYPFT

SEQ ID NO: 108942 - protein, 13 aa, Homo sapiens
  heavy chain complementarity determining region 3 for antibody 54471
AADYGDYQYYFDY

SEQ ID NO: 108943 - protein, 9 aa, Homo sapiens
  light chain complementarity determining region 3 for antibody 54472
LQHDTYPWT

SEQ ID NO: 108944 - protein, 14 aa, Homo sapiens
  heavy chain complementarity determining region 3 for antibody 54472
ARDRELLWFGELVP

SEQ ID NO: 108945 - protein, 9 aa, Homo sapiens
  light chain complementarity determining region 3 for antibody 54473
LQHDNFPYT

SEQ ID NO: 108946 - protein, 7 aa, Homo sapiens
  heavy chain complementarity determining region 3 for antibody 54473
ASDVGDY

SEQ ID NO: 108947 - protein, 9 aa, Homo sapiens
  light chain complementarity determining region 3 for antibody 54474
LQHDNFPYT

SEQ ID NO: 108948 - protein, 22 aa, Homo sapiens
  heavy chain complementarity determining region 3 for antibody 54474
ARGGDIVVVPAAIDSYYYGMDV

SEQ ID NO: 108949 - protein, 9 aa, Homo sapiens
  light chain complementarity determining region 3 for antibody 54475
LQHDNFPYT

SEQ ID NO: 108950 - protein, 11 aa, Homo sapiens
  heavy chain complementarity determining region 3 for antibody 54475
ARGELGTGFDY

SEQ ID NO: 108951 - protein, 9 aa, Homo sapiens
  light chain complementarity determining region 3 for antibody 54476
LQHDNFPYT

SEQ ID NO: 108952 - protein, 11 aa, Homo sapiens
  heavy chain complementarity determining region 3 for antibody 54476
ARGDLGIGFDY

SEQ ID NO: 108953 - protein, 9 aa, Homo sapiens
  light chain complementarity determining region 3 for antibody 54477
LQHDNFPYT

SEQ ID NO: 108954 - protein, 13 aa, Homo sapiens
  heavy chain complementarity determining region 3 for antibody 54477
ARERYRASYGMDV

SEQ ID NO: 108955 - protein, 9 aa, Homo sapiens
  light chain complementarity determining region 3 for antibody 54478
LQHDNFPYT

SEQ ID NO: 108956 - protein, 7 aa, Homo sapiens
  heavy chain complementarity determining region 3 for antibody 54478
ARDVRDY

SEQ ID NO: 108957 - protein, 9 aa, Homo sapiens
  light chain complementarity determining region 3 for antibody 54479
LQHDNFPYT

SEQ ID NO: 108958 - protein, 20 aa, Homo sapiens
  heavy chain complementarity determining region 3 for antibody 54479
ARDRSRISMVRESYYYGMDV

SEQ ID NO: 108959 - protein, 9 aa, Homo sapiens
  light chain complementarity determining region 3 for antibody 54480
LQHDNFPYT

SEQ ID NO: 108960 - protein, 8 aa, Homo sapiens
  heavy chain complementarity determining region 3 for antibody 54480
ARDDGMDV

SEQ ID NO: 108961 - protein, 9 aa, Homo sapiens
  light chain complementarity determining region 3 for antibody 54481
LQGYNYPRT

SEQ ID NO: 108962 - protein, 13 aa, Homo sapiens
  heavy chain complementarity determining region 3 for antibody 54481
ARGGAITRDWFDP

SEQ ID NO: 108963 - protein, 9 aa, Homo sapiens
  light chain complementarity determining region 3 for antibody 54482
LQDYSYPWT

SEQ ID NO: 108964 - protein, 17 aa, Homo sapiens
  heavy chain complementarity determining region 3 for antibody 54482
ARVGTLVRGGYYYGMDV

SEQ ID NO: 108965 - protein, 9 aa, Homo sapiens
  light chain complementarity determining region 3 for antibody 54483
LQDYNYPYT

SEQ ID NO: 108966 - protein, 17 aa, Homo sapiens
  heavy chain complementarity determining region 3 for antibody 54483
ARTFNVLRYFDWLFLDY

SEQ ID NO: 108967 - protein, 9 aa, Homo sapiens
  light chain complementarity determining region 3 for antibody 54484
LQDYNYPYT

SEQ ID NO: 108968 - protein, 14 aa, Homo sapiens
  heavy chain complementarity determining region 3 for antibody 54484
ARRYPDYYSYGMDV

SEQ ID NO: 108969 - protein, 9 aa, Homo sapiens
  light chain complementarity determining region 3 for antibody 54485
LQDYNYPYT

SEQ ID NO: 108970 - protein, 10 aa, Homo sapiens
  heavy chain complementarity determining region 3 for antibody 54485
ARGKAVASDY

SEQ ID NO: 108971 - protein, 9 aa, Homo sapiens
  light chain complementarity determining region 3 for antibody 54486
LQDYNYPYT

SEQ ID NO: 108972 - protein, 17 aa, Homo sapiens
  heavy chain complementarity determining region 3 for antibody 54486
ARERDYDILTGYSLFDY

SEQ ID NO: 108973 - protein, 9 aa, Homo sapiens
  light chain complementarity determining region 3 for antibody 54487
LQDYNYPYT

SEQ ID NO: 108974 - protein, 11 aa, Homo sapiens
  heavy chain complementarity determining region 3 for antibody 54487
ARELERRSFDY

SEQ ID NO: 108975 - protein, 9 aa, Homo sapiens
  light chain complementarity determining region 3 for antibody 54488
LQDYNYPYT

SEQ ID NO: 108976 - protein, 19 aa, Homo sapiens
  heavy chain complementarity determining region 3 for antibody 54488
ARDPPYYDILTGYLYGMDV

SEQ ID NO: 108977 - protein, 9 aa, Homo sapiens
  light chain complementarity determining region 3 for antibody 54489
LQDYNYPYT

SEQ ID NO: 108978 - protein, 14 aa, Homo sapiens
  heavy chain complementarity determining region 3 for antibody 54489
ARDPPRIVGAPFDY

SEQ ID NO: 108979 - protein, 9 aa, Homo sapiens
  light chain complementarity determining region 3 for antibody 54490
LQDYNYPYT

SEQ ID NO: 108980 - protein, 8 aa, Homo sapiens
  heavy chain complementarity determining region 3 for antibody 54490
ARDDGMDV

SEQ ID NO: 108981 - protein, 9 aa, Homo sapiens
  light chain complementarity determining region 3 for antibody 54491
LQDYNYPYT

SEQ ID NO: 108982 - protein, 18 aa, Homo sapiens
  heavy chain complementarity determining region 3 for antibody 54491
ARAYDIVTGYDYYYGMDV

SEQ ID NO: 108983 - protein, 9 aa, Homo sapiens
  light chain complementarity determining region 3 for antibody 54492
LQDYNYPYT

SEQ ID NO: 108984 - protein, 16 aa, Homo sapiens
  heavy chain complementarity determining region 3 for antibody 54492
AKDSGSYHYYYYGMDV

SEQ ID NO: 108985 - protein, 9 aa, Homo sapiens
  light chain complementarity determining region 3 for antibody 54493
LQDYNYPYT

SEQ ID NO: 108986 - protein, 18 aa, Homo sapiens
  heavy chain complementarity determining region 3 for antibody 54493
AGDQSSGSYYPYYYGMDV

SEQ ID NO: 108987 - protein, 9 aa, Homo sapiens
  light chain complementarity determining region 3 for antibody 54494
LQDYNYPYT

SEQ ID NO: 108988 - protein, 18 aa, Homo sapiens
  heavy chain complementarity determining region 3 for antibody 54494
AGDKGGSYYDYYYYGMDV

SEQ ID NO: 108989 - protein, 9 aa, Homo sapiens
  light chain complementarity determining region 3 for antibody 54495
LQDYNYPWT

SEQ ID NO: 108990 - protein, 8 aa, Homo sapiens
  heavy chain complementarity determining region 3 for antibody 54495
ARTGPLDY

SEQ ID NO: 108991 - protein, 9 aa, Homo sapiens
  light chain complementarity determining region 3 for antibody 54496
LQDYNYPWT

SEQ ID NO: 108992 - protein, 9 aa, Homo sapiens
  heavy chain complementarity determining region 3 for antibody 54496
ARKRWYFDL

SEQ ID NO: 108993 - protein, 9 aa, Homo sapiens
  light chain complementarity determining region 3 for antibody 54497
LQDYNYPWT

SEQ ID NO: 108994 - protein, 15 aa, Homo sapiens
  heavy chain complementarity determining region 3 for antibody 54497
ARGRVGPYYYYGMDV

SEQ ID NO: 108995 - protein, 9 aa, Homo sapiens
  light chain complementarity determining region 3 for antibody 54498
LQDYNYPWT

SEQ ID NO: 108996 - protein, 15 aa, Homo sapiens
  heavy chain complementarity determining region 3 for antibody 54498
AREGDYYGSGSHLNY

SEQ ID NO: 108997 - protein, 9 aa, Homo sapiens
  light chain complementarity determining region 3 for antibody 54499
LQDYNYPWT

SEQ ID NO: 108998 - protein, 13 aa, Homo sapiens
  heavy chain complementarity determining region 3 for antibody 54499
AREEVTEGPYFDY

SEQ ID NO: 108999 - protein, 9 aa, Homo sapiens
  light chain complementarity determining region 3 for antibody 54500
LQDYNYPWT

SEQ ID NO: 109000 - protein, 17 aa, Homo sapiens
  heavy chain complementarity determining region 3 for antibody 54500
ARDPLTGIYSYYYGMDV

SEQ ID NO: 109001 - protein, 9 aa, Homo sapiens
  light chain complementarity determining region 3 for antibody 54501
LQDYNYPWT

SEQ ID NO: 109002 - protein, 16 aa, Homo sapiens
  heavy chain complementarity determining region 3 for antibody 54501
AKYDILTGYYKGGFDY

SEQ ID NO: 109003 - protein, 9 aa, Homo sapiens
  light chain complementarity determining region 3 for antibody 54502
LQDYNYPWT

SEQ ID NO: 109004 - protein, 16 aa, Homo sapiens
  heavy chain complementarity determining region 3 for antibody 54502
AAGIVGATTPYDAFDI

SEQ ID NO: 109005 - protein, 9 aa, Homo sapiens
  light chain complementarity determining region 3 for antibody 54503
LQDYNYPWK

SEQ ID NO: 109006 - protein, 14 aa, Homo sapiens
  heavy chain complementarity determining region 3 for antibody 54503
ARAATTGTSYGMDV

SEQ ID NO: 109007 - protein, 9 aa, Homo sapiens
  light chain complementarity determining region 3 for antibody 54504
LQDYNYPRT

SEQ ID NO: 109008 - protein, 8 aa, Homo sapiens
  heavy chain complementarity determining region 3 for antibody 54504
ARTGPLDY

SEQ ID NO: 109009 - protein, 9 aa, Homo sapiens
  light chain complementarity determining region 3 for antibody 54505
LQDYNYPRT

SEQ ID NO: 109010 - protein, 15 aa, Homo sapiens
  heavy chain complementarity determining region 3 for antibody 54505
ARGYCSGGNCYSFDY

SEQ ID NO: 109011 - protein, 9 aa, Homo sapiens
  light chain complementarity determining region 3 for antibody 54506
LQDYNYPRT

SEQ ID NO: 109012 - protein, 12 aa, Homo sapiens
  heavy chain complementarity determining region 3 for antibody 54506
AREIAVTGPFDD

SEQ ID NO: 109013 - protein, 9 aa, Homo sapiens
  light chain complementarity determining region 3 for antibody 54507
LQDYNYPRT

SEQ ID NO: 109014 - protein, 18 aa, Homo sapiens
  heavy chain complementarity determining region 3 for antibody 54507
AAKGSYYDILTGYSHFDY

SEQ ID NO: 109015 - protein, 9 aa, Homo sapiens
  light chain complementarity determining region 3 for antibody 54508
LQDYNYPFT

SEQ ID NO: 109016 - protein, 20 aa, Homo sapiens
  heavy chain complementarity determining region 3 for antibody 54508
ARLTISMVRGVIIEDYGMDV

SEQ ID NO: 109017 - protein, 9 aa, Homo sapiens
  light chain complementarity determining region 3 for antibody 54509
LQDYNYPFT

SEQ ID NO: 109018 - protein, 15 aa, Homo sapiens
  heavy chain complementarity determining region 3 for antibody 54509
AREGDYYGSASHLNY

SEQ ID NO: 109019 - protein, 9 aa, Homo sapiens
  light chain complementarity determining region 3 for antibody 54510
LQDYNYPFT

SEQ ID NO: 109020 - protein, 14 aa, Homo sapiens
  heavy chain complementarity determining region 3 for antibody 54510
ARDNGYTSGWPFDY

SEQ ID NO: 109021 - protein, 9 aa, Homo sapiens
  light chain complementarity determining region 3 for antibody 54511
LQDYNYPFT

SEQ ID NO: 109022 - protein, 13 aa, Homo sapiens
  heavy chain complementarity determining region 3 for antibody 54511
AADYGDYQYYFDY

SEQ ID NO: 109023 - protein, 9 aa, Homo sapiens
  light chain complementarity determining region 3 for antibody 54512
LQDYILPPT

SEQ ID NO: 109024 - protein, 15 aa, Homo sapiens
  heavy chain complementarity determining region 3 for antibody 54512
VRDLWYSGSSFGLDV

SEQ ID NO: 109025 - protein, 9 aa, Homo sapiens
  light chain complementarity determining region 3 for antibody 54513
LQDYDYPFT

SEQ ID NO: 109026 - protein, 15 aa, Homo sapiens
  heavy chain complementarity determining region 3 for antibody 54513
AREGDYYGSGSHLNY

SEQ ID NO: 109027 - protein, 9 aa, Homo sapiens
  light chain complementarity determining region 3 for antibody 54514
LQDCNYPRT

SEQ ID NO: 109028 - protein, 16 aa, Homo sapiens
  heavy chain complementarity determining region 3 for antibody 54514
ATVEITFGGVIAYFDY

SEQ ID NO: 109029 - protein, 9 aa, Homo sapiens
  light chain complementarity determining region 3 for antibody 54515
KQYNSYPYT

SEQ ID NO: 109030 - protein, 17 aa, Homo sapiens
  heavy chain complementarity determining region 3 for antibody 54515
ARLVLRYSDWLLPHFDY

SEQ ID NO: 109031 - protein, 9 aa, Homo sapiens
  light chain complementarity determining region 3 for antibody 54516
HQSSSLTYT

SEQ ID NO: 109032 - protein, 9 aa, Homo sapiens
  heavy chain complementarity determining region 3 for antibody 54516
ARKRWYFDL

SEQ ID NO: 109033 - protein, 9 aa, Homo sapiens
  light chain complementarity determining region 3 for antibody 54517
HQSSSLPYT

SEQ ID NO: 109034 - protein, 16 aa, Homo sapiens
  heavy chain complementarity determining region 3 for antibody 54517
ARTYYYGSGSYGWFDP

SEQ ID NO: 109035 - protein, 9 aa, Homo sapiens
  light chain complementarity determining region 3 for antibody 54518
HQSSSLPYT

SEQ ID NO: 109036 - protein, 9 aa, Homo sapiens
  heavy chain complementarity determining region 3 for antibody 54518
ARKTWYFDL

SEQ ID NO: 109037 - protein, 9 aa, Homo sapiens
  light chain complementarity determining region 3 for antibody 54519
HQSSSLPYT

SEQ ID NO: 109038 - protein, 9 aa, Homo sapiens
  heavy chain complementarity determining region 3 for antibody 54519
ARKRWYIDL

SEQ ID NO: 109039 - protein, 9 aa, Homo sapiens
  light chain complementarity determining region 3 for antibody 54520
HQSSSLPYT

SEQ ID NO: 109040 - protein, 9 aa, Homo sapiens
  heavy chain complementarity determining region 3 for antibody 54520
ARKRWYFEL

SEQ ID NO: 109041 - protein, 9 aa, Homo sapiens
  light chain complementarity determining region 3 for antibody 54521
HQSSSLPYT

SEQ ID NO: 109042 - protein, 22 aa, Homo sapiens
  heavy chain complementarity determining region 3 for antibody 54521
ARGDYDILTGYRGYYSYYGMDV

SEQ ID NO: 109043 - protein, 9 aa, Homo sapiens
  light chain complementarity determining region 3 for antibody 54522
HQSSSLPRT

SEQ ID NO: 109044 - protein, 9 aa, Homo sapiens
  heavy chain complementarity determining region 3 for antibody 54522
ARKRWSFDL

SEQ ID NO: 109045 - protein, 9 aa, Homo sapiens
  light chain complementarity determining region 3 for antibody 54523
HQSSSLPQT

SEQ ID NO: 109046 - protein, 13 aa, Homo sapiens
  heavy chain complementarity determining region 3 for antibody 54523
AADYGDYQYYFDY

SEQ ID NO: 109047 - protein, 9 aa, Homo sapiens
  light chain complementarity determining region 3 for antibody 54524
HQSSSLPHT

SEQ ID NO: 109048 - protein, 17 aa, Homo sapiens
  heavy chain complementarity determining region 3 for antibody 54524
ARHDLLIVGAFYWYFDL

SEQ ID NO: 109049 - protein, 9 aa, Homo sapiens
  light chain complementarity determining region 3 for antibody 54525
HQSSSLPHT

SEQ ID NO: 109050 - protein, 19 aa, Homo sapiens
  heavy chain complementarity determining region 3 for antibody 54525
AREDYDILTGYFHYYGMDV

SEQ ID NO: 109051 - protein, 9 aa, Homo sapiens
  light chain complementarity determining region 3 for antibody 54526
HQSSSLPHT

SEQ ID NO: 109052 - protein, 17 aa, Homo sapiens
  heavy chain complementarity determining region 3 for antibody 54526
ARDRGYSGYDRDYGMDV

SEQ ID NO: 109053 - protein, 9 aa, Homo sapiens
  light chain complementarity determining region 3 for antibody 54527
HQSSSLPFT

SEQ ID NO: 109054 - protein, 11 aa, Homo sapiens
  heavy chain complementarity determining region 3 for antibody 54527
ARVPWFGGFDY

SEQ ID NO: 109055 - protein, 9 aa, Homo sapiens
  light chain complementarity determining region 3 for antibody 54528
HQSSSLPFT

SEQ ID NO: 109056 - protein, 11 aa, Homo sapiens
  heavy chain complementarity determining region 3 for antibody 54528
ARLPLFGGFDY

SEQ ID NO: 109057 - protein, 9 aa, Homo sapiens
  light chain complementarity determining region 3 for antibody 54529
HQSSSLPFT

SEQ ID NO: 109058 - protein, 11 aa, Homo sapiens
  heavy chain complementarity determining region 3 for antibody 54529
ARLLWSGGIDY

SEQ ID NO: 109059 - protein, 9 aa, Homo sapiens
  light chain complementarity determining region 3 for antibody 54530
HQSSSLPFT

SEQ ID NO: 109060 - protein, 11 aa, Homo sapiens
  heavy chain complementarity determining region 3 for antibody 54530
ARLLWFGGLDY

SEQ ID NO: 109061 - protein, 9 aa, Homo sapiens
  light chain complementarity determining region 3 for antibody 54531
HQSSSLPFT

SEQ ID NO: 109062 - protein, 11 aa, Homo sapiens
  heavy chain complementarity determining region 3 for antibody 54531
ARFPWSGGFDY

SEQ ID NO: 109063 - protein, 9 aa, Homo sapiens
  light chain complementarity determining region 3 for antibody 54532
RRTYNAPYT

SEQ ID NO: 109064 - protein, 10 aa, Homo sapiens
  heavy chain complementarity determining region 3 for antibody 54532
ASDYSEGFDY

SEQ ID NO: 109065 - protein, 9 aa, Homo sapiens
  light chain complementarity determining region 3 for antibody 54533
RQYNSFPFT

SEQ ID NO: 109066 - protein, 17 aa, Homo sapiens
  heavy chain complementarity determining region 3 for antibody 54533
AREYNGILTGYWGYFDY

SEQ ID NO: 109067 - protein, 9 aa, Homo sapiens
  light chain complementarity determining region 3 for antibody 54534
RQSSSLPYT

SEQ ID NO: 109068 - protein, 13 aa, Homo sapiens
  heavy chain complementarity determining region 3 for antibody 54534
ARDKDIVATPFDY

SEQ ID NO: 109069 - protein, 9 aa, Homo sapiens
  light chain complementarity determining region 3 for antibody 54535
RQLNSYPYT

SEQ ID NO: 109070 - protein, 14 aa, Homo sapiens
  heavy chain complementarity determining region 3 for antibody 54535
ARDLDTMVRGVFDY

SEQ ID NO: 109071 - protein, 9 aa, Homo sapiens
  light chain complementarity determining region 3 for antibody 54536
QRYNSAPLT

SEQ ID NO: 109072 - protein, 8 aa, Homo sapiens
  heavy chain complementarity determining region 3 for antibody 54536
ARTGPLDY

SEQ ID NO: 109073 - protein, 9 aa, Homo sapiens
  light chain complementarity determining region 3 for antibody 54537
QRTYNAPYT

SEQ ID NO: 109074 - protein, 10 aa, Homo sapiens
  heavy chain complementarity determining region 3 for antibody 54537
AIDYSEGFDY

SEQ ID NO: 109075 - protein, 9 aa, Homo sapiens
  light chain complementarity determining region 3 for antibody 54538
QRTYNAPYT

SEQ ID NO: 109076 - protein, 10 aa, Homo sapiens
  heavy chain complementarity determining region 3 for antibody 54538
AGDYSEGFDY

SEQ ID NO: 109077 - protein, 9 aa, Homo sapiens
  light chain complementarity determining region 3 for antibody 54539
QQYYSTPYT

SEQ ID NO: 109078 - protein, 19 aa, Homo sapiens
  heavy chain complementarity determining region 3 for antibody 54539
ARDGSYYQGYYYYYYGMDV

SEQ ID NO: 109079 - protein, 9 aa, Homo sapiens
  light chain complementarity determining region 3 for antibody 54540
QQYYSFPWT

SEQ ID NO: 109080 - protein, 22 aa, Homo sapiens
  heavy chain complementarity determining region 3 for antibody 54540
ARGGDIVVVPAAIDYYYYGMDV

SEQ ID NO: 109081 - protein, 9 aa, Homo sapiens
  light chain complementarity determining region 3 for antibody 54541
QQYNTYPRT

SEQ ID NO: 109082 - protein, 10 aa, Homo sapiens
  heavy chain complementarity determining region 3 for antibody 54541
ARDKGYYFDY

SEQ ID NO: 109083 - protein, 9 aa, Homo sapiens
  light chain complementarity determining region 3 for antibody 54542
QQYNTYPLT

SEQ ID NO: 109084 - protein, 19 aa, Homo sapiens
  heavy chain complementarity determining region 3 for antibody 54542
AREGGGAGSPYYYYYSMDV

SEQ ID NO: 109085 - protein, 9 aa, Homo sapiens
  light chain complementarity determining region 3 for antibody 54543
QQYNSYSYT

SEQ ID NO: 109086 - protein, 14 aa, Homo sapiens
  heavy chain complementarity determining region 3 for antibody 54543
ARHKERSRAVYFDC

SEQ ID NO: 109087 - protein, 9 aa, Homo sapiens
  light chain complementarity determining region 3 for antibody 54544
QQYNSYSYT

SEQ ID NO: 109088 - protein, 14 aa, Homo sapiens
  heavy chain complementarity determining region 3 for antibody 54544
ARHKERSRAFDFDY

SEQ ID NO: 109089 - protein, 9 aa, Homo sapiens
  light chain complementarity determining region 3 for antibody 54545
QQYNSYSYT

SEQ ID NO: 109090 - protein, 14 aa, Homo sapiens
  heavy chain complementarity determining region 3 for antibody 54545
AGHKERSRAFYFDY

SEQ ID NO: 109091 - protein, 8 aa, Homo sapiens
  light chain complementarity determining region 3 for antibody 54546
QQYNSYST

SEQ ID NO: 109092 - protein, 14 aa, Homo sapiens
  heavy chain complementarity determining region 3 for antibody 54546
AKEEQQLVCDAFDI

SEQ ID NO: 109093 - protein, 9 aa, Homo sapiens
  light chain complementarity determining region 3 for antibody 54547
QQYNSYPYT

SEQ ID NO: 109094 - protein, 19 aa, Homo sapiens
  heavy chain complementarity determining region 3 for antibody 54547
VRDKVPPYSSPYYYFGMDV

SEQ ID NO: 109095 - protein, 9 aa, Homo sapiens
  light chain complementarity determining region 3 for antibody 54548
QQYNSYPYT

SEQ ID NO: 109096 - protein, 17 aa, Homo sapiens
  heavy chain complementarity determining region 3 for antibody 54548
ERLVLRYSDWLLPHFDY

SEQ ID NO: 109097 - protein, 9 aa, Homo sapiens
  light chain complementarity determining region 3 for antibody 54549
QQYNSYPYT

SEQ ID NO: 109098 - protein, 17 aa, Homo sapiens
  heavy chain complementarity determining region 3 for antibody 54549
ARVVLRYSDWLFPHFDY

SEQ ID NO: 109099 - protein, 9 aa, Homo sapiens
  light chain complementarity determining region 3 for antibody 54550
QQYNSYPYT

SEQ ID NO: 109100 - protein, 17 aa, Homo sapiens
  heavy chain complementarity determining region 3 for antibody 54550
ARRVLRYSDWLFPHFDY

SEQ ID NO: 109101 - protein, 9 aa, Homo sapiens
  light chain complementarity determining region 3 for antibody 54551
QQYNSYPYT

SEQ ID NO: 109102 - protein, 18 aa, Homo sapiens
  heavy chain complementarity determining region 3 for antibody 54551
ARRRGAKADYYYYYGMDV

SEQ ID NO: 109103 - protein, 9 aa, Homo sapiens
  light chain complementarity determining region 3 for antibody 54552
QQYNSYPYT

SEQ ID NO: 109104 - protein, 17 aa, Homo sapiens
  heavy chain complementarity determining region 3 for antibody 54552
ARLVLRYSDWLLPHFDC

SEQ ID NO: 109105 - protein, 9 aa, Homo sapiens
  light chain complementarity determining region 3 for antibody 54553
QQYNSYPYT

SEQ ID NO: 109106 - protein, 17 aa, Homo sapiens
  heavy chain complementarity determining region 3 for antibody 54553
ARLVLRYSDWLFPHFGY

SEQ ID NO: 109107 - protein, 9 aa, Homo sapiens
  light chain complementarity determining region 3 for antibody 54554
QQYNSYPYT

SEQ ID NO: 109108 - protein, 17 aa, Homo sapiens
  heavy chain complementarity determining region 3 for antibody 54554
ARLVLRYSDWFLPHFDY

SEQ ID NO: 109109 - protein, 9 aa, Homo sapiens
  light chain complementarity determining region 3 for antibody 54555
QQYNSYPYT

SEQ ID NO: 109110 - protein, 17 aa, Homo sapiens
  heavy chain complementarity determining region 3 for antibody 54555
ARLVLRYSDSLLPHFDY

SEQ ID NO: 109111 - protein, 9 aa, Homo sapiens
  light chain complementarity determining region 3 for antibody 54556
QQYNSYPYT

SEQ ID NO: 109112 - protein, 17 aa, Homo sapiens
  heavy chain complementarity determining region 3 for antibody 54556
ARLVLRYSDCLLPHFDY

SEQ ID NO: 109113 - protein, 9 aa, Homo sapiens
  light chain complementarity determining region 3 for antibody 54557
QQYNSYPYT

SEQ ID NO: 109114 - protein, 17 aa, Homo sapiens
  heavy chain complementarity determining region 3 for antibody 54557
ARLVLRYFDWLLPHFDY

SEQ ID NO: 109115 - protein, 9 aa, Homo sapiens
  light chain complementarity determining region 3 for antibody 54558
QQYNSYPYT

SEQ ID NO: 109116 - protein, 17 aa, Homo sapiens
  heavy chain complementarity determining region 3 for antibody 54558
ARLVFRYSDWLFPHFDY

SEQ ID NO: 109117 - protein, 9 aa, Homo sapiens
  light chain complementarity determining region 3 for antibody 54559
QQYNSYPYT

SEQ ID NO: 109118 - protein, 9 aa, Homo sapiens
  heavy chain complementarity determining region 3 for antibody 54559
ARKQRYFDY

SEQ ID NO: 109119 - protein, 9 aa, Homo sapiens
  light chain complementarity determining region 3 for antibody 54560
QQYNSYPYT

SEQ ID NO: 109120 - protein, 17 aa, Homo sapiens
  heavy chain complementarity determining region 3 for antibody 54560
ARFVLRYSDWLLPHFDY

SEQ ID NO: 109121 - protein, 9 aa, Homo sapiens
  light chain complementarity determining region 3 for antibody 54561
QQYNSYPYT

SEQ ID NO: 109122 - protein, 16 aa, Homo sapiens
  heavy chain complementarity determining region 3 for antibody 54561
ARERDNWNPYYYGTDV

SEQ ID NO: 109123 - protein, 9 aa, Homo sapiens
  light chain complementarity determining region 3 for antibody 54562
QQYNSYPYT

SEQ ID NO: 109124 - protein, 12 aa, Homo sapiens
  heavy chain complementarity determining region 3 for antibody 54562
AREIAVTGPFDY

SEQ ID NO: 109125 - protein, 9 aa, Homo sapiens
  light chain complementarity determining region 3 for antibody 54563
QQYNSYPYT

SEQ ID NO: 109126 - protein, 17 aa, Homo sapiens
  heavy chain complementarity determining region 3 for antibody 54563
AREHYDILTGYWNSFDY

SEQ ID NO: 109127 - protein, 9 aa, Homo sapiens
  light chain complementarity determining region 3 for antibody 54564
QQYNSYPYT

SEQ ID NO: 109128 - protein, 10 aa, Homo sapiens
  heavy chain complementarity determining region 3 for antibody 54564
AREGGGSLWY

SEQ ID NO: 109129 - protein, 9 aa, Homo sapiens
  light chain complementarity determining region 3 for antibody 54565
QQYNSYPYT

SEQ ID NO: 109130 - protein, 15 aa, Homo sapiens
  heavy chain complementarity determining region 3 for antibody 54565
AREGEITTVRGGKDY

SEQ ID NO: 109131 - protein, 9 aa, Homo sapiens
  light chain complementarity determining region 3 for antibody 54566
QQYNSYPYT

SEQ ID NO: 109132 - protein, 12 aa, Homo sapiens
  heavy chain complementarity determining region 3 for antibody 54566
ARDNTWNDGIDY

SEQ ID NO: 109133 - protein, 9 aa, Homo sapiens
  light chain complementarity determining region 3 for antibody 54567
QQYNSYPYT

SEQ ID NO: 109134 - protein, 11 aa, Homo sapiens
  heavy chain complementarity determining region 3 for antibody 54567
ARDNTMAPNGY

SEQ ID NO: 109135 - protein, 9 aa, Homo sapiens
  light chain complementarity determining region 3 for antibody 54568
QQYNSYPYT

SEQ ID NO: 109136 - protein, 12 aa, Homo sapiens
  heavy chain complementarity determining region 3 for antibody 54568
ARDNNWTDGIDY

SEQ ID NO: 109137 - protein, 9 aa, Homo sapiens
  light chain complementarity determining region 3 for antibody 54569
QQYNSYPYT

SEQ ID NO: 109138 - protein, 19 aa, Homo sapiens
  heavy chain complementarity determining region 3 for antibody 54569
ARDHDILTGYYRDYYGMDV

SEQ ID NO: 109139 - protein, 9 aa, Homo sapiens
  light chain complementarity determining region 3 for antibody 54570
QQYNSYPYT

SEQ ID NO: 109140 - protein, 15 aa, Homo sapiens
  heavy chain complementarity determining region 3 for antibody 54570
ARDGPTGAFYWYFDL

SEQ ID NO: 109141 - protein, 9 aa, Homo sapiens
  light chain complementarity determining region 3 for antibody 54571
QQYNSYPYT

SEQ ID NO: 109142 - protein, 15 aa, Homo sapiens
  heavy chain complementarity determining region 3 for antibody 54571
ARATMVRGVIGAFDI

SEQ ID NO: 109143 - protein, 9 aa, Homo sapiens
  light chain complementarity determining region 3 for antibody 54572
QQYNSYPYT

SEQ ID NO: 109144 - protein, 15 aa, Homo sapiens
  heavy chain complementarity determining region 3 for antibody 54572
ANVLRYFGGYSVWDV

SEQ ID NO: 109145 - protein, 9 aa, Homo sapiens
  light chain complementarity determining region 3 for antibody 54573
QQYNSYPYT

SEQ ID NO: 109146 - protein, 11 aa, Homo sapiens
  heavy chain complementarity determining region 3 for antibody 54573
AGNIAAAGTHR

SEQ ID NO: 109147 - protein, 9 aa, Homo sapiens
  light chain complementarity determining region 3 for antibody 54574
QQYNSYPYT

SEQ ID NO: 109148 - protein, 17 aa, Homo sapiens
  heavy chain complementarity determining region 3 for antibody 54574
AGLVLRYSDWLLPPFDY

SEQ ID NO: 109149 - protein, 9 aa, Homo sapiens
  light chain complementarity determining region 3 for antibody 54575
QQYNSYPYT

SEQ ID NO: 109150 - protein, 18 aa, Homo sapiens
  heavy chain complementarity determining region 3 for antibody 54575
AGERRDDILTGYYDTFDI

SEQ ID NO: 109151 - protein, 9 aa, Homo sapiens
  light chain complementarity determining region 3 for antibody 54576
QQYNSYPYT

SEQ ID NO: 109152 - protein, 16 aa, Homo sapiens
  heavy chain complementarity determining region 3 for antibody 54576
AGERDNWNPYYYGMDV

SEQ ID NO: 109153 - protein, 9 aa, Homo sapiens
  light chain complementarity determining region 3 for antibody 54577
QQYNSYPYT

SEQ ID NO: 109154 - protein, 14 aa, Homo sapiens
  heavy chain complementarity determining region 3 for antibody 54577
AGDRQLWLREGFDY

SEQ ID NO: 109155 - protein, 9 aa, Homo sapiens
  light chain complementarity determining region 3 for antibody 54578
QQYNSYPYN

SEQ ID NO: 109156 - protein, 17 aa, Homo sapiens
  heavy chain complementarity determining region 3 for antibody 54578
ARLVLRYSDWLLPHFDY

SEQ ID NO: 109157 - protein, 9 aa, Homo sapiens
  light chain complementarity determining region 3 for antibody 54579
QQYNSYPST

SEQ ID NO: 109158 - protein, 17 aa, Homo sapiens
  heavy chain complementarity determining region 3 for antibody 54579
ARLVLRYSDWLLPHFDY

SEQ ID NO: 109159 - protein, 9 aa, Homo sapiens
  light chain complementarity determining region 3 for antibody 54580
QQYNSYPRT

SEQ ID NO: 109160 - protein, 17 aa, Homo sapiens
  heavy chain complementarity determining region 3 for antibody 54580
ARLVLRYSDWLLPHFDY

SEQ ID NO: 109161 - protein, 9 aa, Homo sapiens
  light chain complementarity determining region 3 for antibody 54581
QQYNSYPRT

SEQ ID NO: 109162 - protein, 17 aa, Homo sapiens
  heavy chain complementarity determining region 3 for antibody 54581
AREKQRDPYYYYYGMDV

SEQ ID NO: 109163 - protein, 9 aa, Homo sapiens
  light chain complementarity determining region 3 for antibody 54582
QQYNSYPRT

SEQ ID NO: 109164 - protein, 17 aa, Homo sapiens
  heavy chain complementarity determining region 3 for antibody 54582
AREKQLDPYSYYYGMDV

SEQ ID NO: 109165 - protein, 9 aa, Homo sapiens
  light chain complementarity determining region 3 for antibody 54583
QQYNSYPRT

SEQ ID NO: 109166 - protein, 17 aa, Homo sapiens
  heavy chain complementarity determining region 3 for antibody 54583
AREKQLDPYSYYYGIDV

SEQ ID NO: 109167 - protein, 9 aa, Homo sapiens
  light chain complementarity determining region 3 for antibody 54584
QQYNSYPRT

SEQ ID NO: 109168 - protein, 10 aa, Homo sapiens
  heavy chain complementarity determining region 3 for antibody 54584
ARDEDWAFDY

SEQ ID NO: 109169 - protein, 9 aa, Homo sapiens
  light chain complementarity determining region 3 for antibody 54585
QQYNSYPRT

SEQ ID NO: 109170 - protein, 15 aa, Homo sapiens
  heavy chain complementarity determining region 3 for antibody 54585
AKEDGLWFGGSYLDY

SEQ ID NO: 109171 - protein, 9 aa, Homo sapiens
  light chain complementarity determining region 3 for antibody 54586
QQYNSYPRT

SEQ ID NO: 109172 - protein, 15 aa, Homo sapiens
  heavy chain complementarity determining region 3 for antibody 54586
AKEDGLWFGGSYFDH

SEQ ID NO: 109173 - protein, 9 aa, Homo sapiens
  light chain complementarity determining region 3 for antibody 54587
QQYNSYPRT

SEQ ID NO: 109174 - protein, 17 aa, Homo sapiens
  heavy chain complementarity determining region 3 for antibody 54587
AGEKQLDPYYYYYGMDV

SEQ ID NO: 109175 - protein, 9 aa, Homo sapiens
  light chain complementarity determining region 3 for antibody 54588
QQYNSYPPT

SEQ ID NO: 109176 - protein, 17 aa, Homo sapiens
  heavy chain complementarity determining region 3 for antibody 54588
AREYNDILTGYWGYFDY

SEQ ID NO: 109177 - protein, 9 aa, Homo sapiens
  light chain complementarity determining region 3 for antibody 54589
QQYNSYPPT

SEQ ID NO: 109178 - protein, 13 aa, Homo sapiens
  heavy chain complementarity determining region 3 for antibody 54589
AADYGDYQYYFDY

SEQ ID NO: 109179 - protein, 9 aa, Homo sapiens
  light chain complementarity determining region 3 for antibody 54590
QQYNSYPPT

SEQ ID NO: 109180 - protein, 14 aa, Homo sapiens
  heavy chain complementarity determining region 3 for antibody 54590
AAAYYDILTGRFDY

SEQ ID NO: 109181 - protein, 9 aa, Homo sapiens
  light chain complementarity determining region 3 for antibody 54591
QQYNSYPLT

SEQ ID NO: 109182 - protein, 11 aa, Homo sapiens
  heavy chain complementarity determining region 3 for antibody 54591
TKYFGSGSRGV

SEQ ID NO: 109183 - protein, 9 aa, Homo sapiens
  light chain complementarity determining region 3 for antibody 54592
QQYNSYPLT

SEQ ID NO: 109184 - protein, 14 aa, Homo sapiens
  heavy chain complementarity determining region 3 for antibody 54592
ARGRYSGYDSSFDY

SEQ ID NO: 109185 - protein, 9 aa, Homo sapiens
  light chain complementarity determining region 3 for antibody 54593
QQYNSYPLT

SEQ ID NO: 109186 - protein, 17 aa, Homo sapiens
  heavy chain complementarity determining region 3 for antibody 54593
AREYNDILTGYWGYFDY

SEQ ID NO: 109187 - protein, 9 aa, Homo sapiens
  light chain complementarity determining region 3 for antibody 54594
QQYNSYPLT

SEQ ID NO: 109188 - protein, 17 aa, Homo sapiens
  heavy chain complementarity determining region 3 for antibody 54594
AREGVVTMVRGVGWFAP

SEQ ID NO: 109189 - protein, 9 aa, Homo sapiens
  light chain complementarity determining region 3 for antibody 54595
QQYNSYPHT

SEQ ID NO: 109190 - protein, 19 aa, Homo sapiens
  heavy chain complementarity determining region 3 for antibody 54595
ARERFGELEDYYYYYGMGV

SEQ ID NO: 109191 - protein, 9 aa, Homo sapiens
  light chain complementarity determining region 3 for antibody 54596
QQYNSYPFT

SEQ ID NO: 109192 - protein, 13 aa, Homo sapiens
  heavy chain complementarity determining region 3 for antibody 54596
ATHYDTLTGYFDY

SEQ ID NO: 109193 - protein, 9 aa, Homo sapiens
  light chain complementarity determining region 3 for antibody 54597
QQYNSYPFT

SEQ ID NO: 109194 - protein, 13 aa, Homo sapiens
  heavy chain complementarity determining region 3 for antibody 54597
ATHYDILTGYFDY

SEQ ID NO: 109195 - protein, 9 aa, Homo sapiens
  light chain complementarity determining region 3 for antibody 54598
QQYNSYPFT

SEQ ID NO: 109196 - protein, 17 aa, Homo sapiens
  heavy chain complementarity determining region 3 for antibody 54598
AREYYDILTGYWGYFGF

SEQ ID NO: 109197 - protein, 9 aa, Homo sapiens
  light chain complementarity determining region 3 for antibody 54599
QQYNSYPFT

SEQ ID NO: 109198 - protein, 11 aa, Homo sapiens
  heavy chain complementarity determining region 3 for antibody 54599
AKDDAEYGMDV

SEQ ID NO: 109199 - protein, 9 aa, Homo sapiens
  light chain complementarity determining region 3 for antibody 54600
QQYNSYPFT

SEQ ID NO: 109200 - protein, 13 aa, Homo sapiens
  heavy chain complementarity determining region 3 for antibody 54600
AADYGDYQYYFDY

SEQ ID NO: 109201 - protein, 9 aa, Homo sapiens
  light chain complementarity determining region 3 for antibody 54601
QQYNSYPCT

SEQ ID NO: 109202 - protein, 17 aa, Homo sapiens
  heavy chain complementarity determining region 3 for antibody 54601
ARLVLRYSDWLFPHFDY

SEQ ID NO: 109203 - protein, 9 aa, Homo sapiens
  light chain complementarity determining region 3 for antibody 54602
QQYNSSPYT

SEQ ID NO: 109204 - protein, 17 aa, Homo sapiens
  heavy chain complementarity determining region 3 for antibody 54602
ARLVLRYSDWLLPHFDY

SEQ ID NO: 109205 - protein, 9 aa, Homo sapiens
  light chain complementarity determining region 3 for antibody 54603
QQYNSSPYT

SEQ ID NO: 109206 - protein, 9 aa, Homo sapiens
  heavy chain complementarity determining region 3 for antibody 54603
ARKNLVFDY

SEQ ID NO: 109207 - protein, 9 aa, Homo sapiens
  light chain complementarity determining region 3 for antibody 54604
QQYNSHPLT

SEQ ID NO: 109208 - protein, 17 aa, Homo sapiens
  heavy chain complementarity determining region 3 for antibody 54604
AREGVVTMVRGVGWFDH

SEQ ID NO: 109209 - protein, 9 aa, Homo sapiens
  light chain complementarity determining region 3 for antibody 54605
QQYNSFPFT

SEQ ID NO: 109210 - protein, 11 aa, Homo sapiens
  heavy chain complementarity determining region 3 for antibody 54605
ARLLWFGGFDY

SEQ ID NO: 109211 - protein, 9 aa, Homo sapiens
  light chain complementarity determining region 3 for antibody 54606
QQYNSFPFT

SEQ ID NO: 109212 - protein, 10 aa, Homo sapiens
  heavy chain complementarity determining region 3 for antibody 54606
ARGLYYGMDV

SEQ ID NO: 109213 - protein, 9 aa, Homo sapiens
  light chain complementarity determining region 3 for antibody 54607
QQYNSFPFT

SEQ ID NO: 109214 - protein, 17 aa, Homo sapiens
  heavy chain complementarity determining region 3 for antibody 54607
AREYYDILTGYWGSFDY

SEQ ID NO: 109215 - protein, 9 aa, Homo sapiens
  light chain complementarity determining region 3 for antibody 54608
QQYNSFPFT

SEQ ID NO: 109216 - protein, 17 aa, Homo sapiens
  heavy chain complementarity determining region 3 for antibody 54608
AREYNDTLTGYWGSFDY

SEQ ID NO: 109217 - protein, 9 aa, Homo sapiens
  light chain complementarity determining region 3 for antibody 54609
QQYNSFPFT

SEQ ID NO: 109218 - protein, 17 aa, Homo sapiens
  heavy chain complementarity determining region 3 for antibody 54609
AREYNDNLTGYWGYFDY

SEQ ID NO: 109219 - protein, 9 aa, Homo sapiens
  light chain complementarity determining region 3 for antibody 54610
QQYNSFPFT

SEQ ID NO: 109220 - protein, 17 aa, Homo sapiens
  heavy chain complementarity determining region 3 for antibody 54610
AREYNDIWTGDWGYFDY

SEQ ID NO: 109221 - protein, 9 aa, Homo sapiens
  light chain complementarity determining region 3 for antibody 54611
QQYNSFPFT

SEQ ID NO: 109222 - protein, 17 aa, Homo sapiens
  heavy chain complementarity determining region 3 for antibody 54611
AREYNDILTGYWWYFDY

SEQ ID NO: 109223 - protein, 9 aa, Homo sapiens
  light chain complementarity determining region 3 for antibody 54612
QQYNSFPFT

SEQ ID NO: 109224 - protein, 17 aa, Homo sapiens
  heavy chain complementarity determining region 3 for antibody 54612
AREYNDILTGYWVYFDY

SEQ ID NO: 109225 - protein, 9 aa, Homo sapiens
  light chain complementarity determining region 3 for antibody 54613
QQYNSFPFT

SEQ ID NO: 109226 - protein, 17 aa, Homo sapiens
  heavy chain complementarity determining region 3 for antibody 54613
AREYNDILTGYWGYLDY

SEQ ID NO: 109227 - protein, 9 aa, Homo sapiens
  light chain complementarity determining region 3 for antibody 54614
QQYNSFPFT

SEQ ID NO: 109228 - protein, 17 aa, Homo sapiens
  heavy chain complementarity determining region 3 for antibody 54614
AREYNDILTGYWGYFDS

SEQ ID NO: 109229 - protein, 9 aa, Homo sapiens
  light chain complementarity determining region 3 for antibody 54615
QQYNSFPFT

SEQ ID NO: 109230 - protein, 17 aa, Homo sapiens
  heavy chain complementarity determining region 3 for antibody 54615
AREYNDILTGYWGFFDY

SEQ ID NO: 109231 - protein, 9 aa, Homo sapiens
  light chain complementarity determining region 3 for antibody 54616
QQYNSFPFT

SEQ ID NO: 109232 - protein, 17 aa, Homo sapiens
  heavy chain complementarity determining region 3 for antibody 54616
AREYNDILTGYSGYFDY

SEQ ID NO: 109233 - protein, 9 aa, Homo sapiens
  light chain complementarity determining region 3 for antibody 54617
QQYNSFPFT

SEQ ID NO: 109234 - protein, 17 aa, Homo sapiens
  heavy chain complementarity determining region 3 for antibody 54617
AREYNDILTAYWGYFDY

SEQ ID NO: 109235 - protein, 9 aa, Homo sapiens
  light chain complementarity determining region 3 for antibody 54618
QQYNSFPFT

SEQ ID NO: 109236 - protein, 17 aa, Homo sapiens
  heavy chain complementarity determining region 3 for antibody 54618
AREYDDILTGYWGCFDY

SEQ ID NO: 109237 - protein, 9 aa, Homo sapiens
  light chain complementarity determining region 3 for antibody 54619
QQYNSFPFT

SEQ ID NO: 109238 - protein, 15 aa, Homo sapiens
  heavy chain complementarity determining region 3 for antibody 54619
ARERRQLTGGYYFDY

SEQ ID NO: 109239 - protein, 9 aa, Homo sapiens
  light chain complementarity determining region 3 for antibody 54620
QQYNSFPFT

SEQ ID NO: 109240 - protein, 18 aa, Homo sapiens
  heavy chain complementarity determining region 3 for antibody 54620
ARERRDDILTGYYDAFDI

SEQ ID NO: 109241 - protein, 9 aa, Homo sapiens
  light chain complementarity determining region 3 for antibody 54621
QQYNSFPFT

SEQ ID NO: 109242 - protein, 17 aa, Homo sapiens
  heavy chain complementarity determining region 3 for antibody 54621
AREHNDILTGYWGYFDY

SEQ ID NO: 109243 - protein, 9 aa, Homo sapiens
  light chain complementarity determining region 3 for antibody 54622
QQYNSFPFT

SEQ ID NO: 109244 - protein, 14 aa, Homo sapiens
  heavy chain complementarity determining region 3 for antibody 54622
ARDRDSSGYYLFDY

SEQ ID NO: 109245 - protein, 9 aa, Homo sapiens
  light chain complementarity determining region 3 for antibody 54623
QQYNSFPFT

SEQ ID NO: 109246 - protein, 17 aa, Homo sapiens
  heavy chain complementarity determining region 3 for antibody 54623
AKDQWELLLAYYYGMDV

SEQ ID NO: 109247 - protein, 9 aa, Homo sapiens
  light chain complementarity determining region 3 for antibody 54624
QQYNSFPFT

SEQ ID NO: 109248 - protein, 17 aa, Homo sapiens
  heavy chain complementarity determining region 3 for antibody 54624
AIEYNDILTGYWGYFDY

SEQ ID NO: 109249 - protein, 9 aa, Homo sapiens
  light chain complementarity determining region 3 for antibody 54625
QQYNSFPFT

SEQ ID NO: 109250 - protein, 17 aa, Homo sapiens
  heavy chain complementarity determining region 3 for antibody 54625
AGEYNDILAGYWGYFDY

SEQ ID NO: 109251 - protein, 9 aa, Homo sapiens
  light chain complementarity determining region 3 for antibody 54626
QQYNSCPYT

SEQ ID NO: 109252 - protein, 17 aa, Homo sapiens
  heavy chain complementarity determining region 3 for antibody 54626
ARLVLRYIDWLLPHFDY

SEQ ID NO: 109253 - protein, 9 aa, Homo sapiens
  light chain complementarity determining region 3 for antibody 54627
QQYNNWPYT

SEQ ID NO: 109254 - protein, 12 aa, Homo sapiens
  heavy chain complementarity determining region 3 for antibody 54627
AREGGIRAFFDY

SEQ ID NO: 109255 - protein, 9 aa, Homo sapiens
  light chain complementarity determining region 3 for antibody 54628
QQYNNWPWT

SEQ ID NO: 109256 - protein, 18 aa, Homo sapiens
  heavy chain complementarity determining region 3 for antibody 54628
AREEGSAYYDILTGLPDV

SEQ ID NO: 109257 - protein, 9 aa, Homo sapiens
  light chain complementarity determining region 3 for antibody 54629
QQYNNWPRT

SEQ ID NO: 109258 - protein, 12 aa, Homo sapiens
  heavy chain complementarity determining region 3 for antibody 54629
ATEWEPGTARDY

SEQ ID NO: 109259 - protein, 9 aa, Homo sapiens
  light chain complementarity determining region 3 for antibody 54630
QQYNNWPRT

SEQ ID NO: 109260 - protein, 12 aa, Homo sapiens
  heavy chain complementarity determining region 3 for antibody 54630
AREWGPGTTRDY

SEQ ID NO: 109261 - protein, 9 aa, Homo sapiens
  light chain complementarity determining region 3 for antibody 54631
QQYNNWPRT

SEQ ID NO: 109262 - protein, 12 aa, Homo sapiens
  heavy chain complementarity determining region 3 for antibody 54631
AREWEPGSTRDY

SEQ ID NO: 109263 - protein, 9 aa, Homo sapiens
  light chain complementarity determining region 3 for antibody 54632
QQYNNWPRT

SEQ ID NO: 109264 - protein, 12 aa, Homo sapiens
  heavy chain complementarity determining region 3 for antibody 54632
AREWDPGTTRDY

SEQ ID NO: 109265 - protein, 9 aa, Homo sapiens
  light chain complementarity determining region 3 for antibody 54633
QQYNNWPRT

SEQ ID NO: 109266 - protein, 12 aa, Homo sapiens
  heavy chain complementarity determining region 3 for antibody 54633
AREWAPATTRDY

SEQ ID NO: 109267 - protein, 9 aa, Homo sapiens
  light chain complementarity determining region 3 for antibody 54634
QQYNNWPRT

SEQ ID NO: 109268 - protein, 12 aa, Homo sapiens
  heavy chain complementarity determining region 3 for antibody 54634
ARELEPGTTRDY

SEQ ID NO: 109269 - protein, 9 aa, Homo sapiens
  light chain complementarity determining region 3 for antibody 54635
QQYNNWPRT

SEQ ID NO: 109270 - protein, 13 aa, Homo sapiens
  heavy chain complementarity determining region 3 for antibody 54635
AKALTTVVTFFDY

SEQ ID NO: 109271 - protein, 10 aa, Homo sapiens
  light chain complementarity determining region 3 for antibody 54636
QQYNNWPPFT

SEQ ID NO: 109272 - protein, 18 aa, Homo sapiens
  heavy chain complementarity determining region 3 for antibody 54636
ARGLWFGELLRPYNWLDP

SEQ ID NO: 109273 - protein, 10 aa, Homo sapiens
  light chain complementarity determining region 3 for antibody 54637
QQYNNWPMYT

SEQ ID NO: 109274 - protein, 14 aa, Homo sapiens
  heavy chain complementarity determining region 3 for antibody 54637
AREGYSSGGYGMDV

SEQ ID NO: 109275 - protein, 9 aa, Homo sapiens
  light chain complementarity determining region 3 for antibody 54638
QQYNNWPLT

SEQ ID NO: 109276 - protein, 14 aa, Homo sapiens
  heavy chain complementarity determining region 3 for antibody 54638
ARDGDTMVRGVFDY

SEQ ID NO: 109277 - protein, 9 aa, Homo sapiens
  light chain complementarity determining region 3 for antibody 54639
QQYNNWPLT

SEQ ID NO: 109278 - protein, 15 aa, Homo sapiens
  heavy chain complementarity determining region 3 for antibody 54639
ARASYNWNDVGAFGV

SEQ ID NO: 109279 - protein, 9 aa, Homo sapiens
  light chain complementarity determining region 3 for antibody 54640
QQYNNWPLT

SEQ ID NO: 109280 - protein, 14 aa, Homo sapiens
  heavy chain complementarity determining region 3 for antibody 54640
ARAPSTTPHDAFDI

SEQ ID NO: 109281 - protein, 9 aa, Homo sapiens
  light chain complementarity determining region 3 for antibody 54641
QQYNNWPLT

SEQ ID NO: 109282 - protein, 15 aa, Homo sapiens
  heavy chain complementarity determining region 3 for antibody 54641
ARAAYNWNDVGAFDV

SEQ ID NO: 109283 - protein, 9 aa, Homo sapiens
  light chain complementarity determining region 3 for antibody 54642
QQYNNWPLT

SEQ ID NO: 109284 - protein, 13 aa, Homo sapiens
  heavy chain complementarity determining region 3 for antibody 54642
AADYGDYQYYFDY

SEQ ID NO: 109285 - protein, 9 aa, Homo sapiens
  light chain complementarity determining region 3 for antibody 54643
QQYNNWPIT

SEQ ID NO: 109286 - protein, 13 aa, Homo sapiens
  heavy chain complementarity determining region 3 for antibody 54643
ARENYGSGSYFDY

SEQ ID NO: 109287 - protein, 9 aa, Homo sapiens
  light chain complementarity determining region 3 for antibody 54644
QQYNNWLYT

SEQ ID NO: 109288 - protein, 12 aa, Homo sapiens
  heavy chain complementarity determining region 3 for antibody 54644
ARQSGSYCYFDY

SEQ ID NO: 109289 - protein, 9 aa, Homo sapiens
  light chain complementarity determining region 3 for antibody 54645
QQYNNWLIT

SEQ ID NO: 109290 - protein, 12 aa, Homo sapiens
  heavy chain complementarity determining region 3 for antibody 54645
AKGLLWFGELDY

SEQ ID NO: 109291 - protein, 9 aa, Homo sapiens
  light chain complementarity determining region 3 for antibody 54646
QQYNIYPYT

SEQ ID NO: 109292 - protein, 18 aa, Homo sapiens
  heavy chain complementarity determining region 3 for antibody 54646
ARERRDGILAGYYDAFDI

SEQ ID NO: 109293 - protein, 9 aa, Homo sapiens
  light chain complementarity determining region 3 for antibody 54647
QQYNIYPYT

SEQ ID NO: 109294 - protein, 18 aa, Homo sapiens
  heavy chain complementarity determining region 3 for antibody 54647
AGERRDDILTGYYDAFDI

SEQ ID NO: 109295 - protein, 9 aa, Homo sapiens
  light chain complementarity determining region 3 for antibody 54648
QQYISYPYT

SEQ ID NO: 109296 - protein, 17 aa, Homo sapiens
  heavy chain complementarity determining region 3 for antibody 54648
ARLVLRYSDWLLPHFDY

SEQ ID NO: 109297 - protein, 9 aa, Homo sapiens
  light chain complementarity determining region 3 for antibody 54649
QQYISYPLT

SEQ ID NO: 109298 - protein, 13 aa, Homo sapiens
  heavy chain complementarity determining region 3 for antibody 54649
AADYGDYQYYFDY

SEQ ID NO: 109299 - protein, 9 aa, Homo sapiens
  light chain complementarity determining region 3 for antibody 54650
QQYISYPFT

SEQ ID NO: 109300 - protein, 11 aa, Homo sapiens
  heavy chain complementarity determining region 3 for antibody 54650
ARLLWFGGFDY

SEQ ID NO: 109301 - protein, 9 aa, Homo sapiens
  light chain complementarity determining region 3 for antibody 54651
QQYISYPFT

SEQ ID NO: 109302 - protein, 14 aa, Homo sapiens
  heavy chain complementarity determining region 3 for antibody 54651
ARDRDSSGYYLFDY

SEQ ID NO: 109303 - protein, 9 aa, Homo sapiens
  light chain complementarity determining region 3 for antibody 54652
QQYISYPFT

SEQ ID NO: 109304 - protein, 13 aa, Homo sapiens
  heavy chain complementarity determining region 3 for antibody 54652
AGDYGDYQYYFDY

SEQ ID NO: 109305 - protein, 9 aa, Homo sapiens
  light chain complementarity determining region 3 for antibody 54653
QQYISYPFT

SEQ ID NO: 109306 - protein, 13 aa, Homo sapiens
  heavy chain complementarity determining region 3 for antibody 54653
AAYYGDYQYYFDY

SEQ ID NO: 109307 - protein, 9 aa, Homo sapiens
  light chain complementarity determining region 3 for antibody 54654
QQYISYPFT

SEQ ID NO: 109308 - protein, 13 aa, Homo sapiens
  heavy chain complementarity determining region 3 for antibody 54654
AADYVDYQYYFDY

SEQ ID NO: 109309 - protein, 9 aa, Homo sapiens
  light chain complementarity determining region 3 for antibody 54655
QQYISYPFT

SEQ ID NO: 109310 - protein, 13 aa, Homo sapiens
  heavy chain complementarity determining region 3 for antibody 54655
AADYGGYQYGFDY

SEQ ID NO: 109311 - protein, 9 aa, Homo sapiens
  light chain complementarity determining region 3 for antibody 54656
QQYISYPFT

SEQ ID NO: 109312 - protein, 13 aa, Homo sapiens
  heavy chain complementarity determining region 3 for antibody 54656
AADYGDYQYYIDY

SEQ ID NO: 109313 - protein, 9 aa, Homo sapiens
  light chain complementarity determining region 3 for antibody 54657
QQYISYPFT

SEQ ID NO: 109314 - protein, 13 aa, Homo sapiens
  heavy chain complementarity determining region 3 for antibody 54657
AADYGDYQYYCDY

SEQ ID NO: 109315 - protein, 9 aa, Homo sapiens
  light chain complementarity determining region 3 for antibody 54658
QQYISYPFT

SEQ ID NO: 109316 - protein, 13 aa, Homo sapiens
  heavy chain complementarity determining region 3 for antibody 54658
AADYGDYQYGFDY

SEQ ID NO: 109317 - protein, 9 aa, Homo sapiens
  light chain complementarity determining region 3 for antibody 54659
QQYISYPFT

SEQ ID NO: 109318 - protein, 13 aa, Homo sapiens
  heavy chain complementarity determining region 3 for antibody 54659
AADYGDYQYFFDY

SEQ ID NO: 109319 - protein, 9 aa, Homo sapiens
  light chain complementarity determining region 3 for antibody 54660
QQYISYPFT

SEQ ID NO: 109320 - protein, 13 aa, Homo sapiens
  heavy chain complementarity determining region 3 for antibody 54660
AADYGDYQSYFDY

SEQ ID NO: 109321 - protein, 9 aa, Homo sapiens
  light chain complementarity determining region 3 for antibody 54661
QQYISYPFT

SEQ ID NO: 109322 - protein, 13 aa, Homo sapiens
  heavy chain complementarity determining region 3 for antibody 54661
AADYGDYQFYFDY

SEQ ID NO: 109323 - protein, 9 aa, Homo sapiens
  light chain complementarity determining region 3 for antibody 54662
QQYISYPFT

SEQ ID NO: 109324 - protein, 13 aa, Homo sapiens
  heavy chain complementarity determining region 3 for antibody 54662
AADYGDDQYYFDY

SEQ ID NO: 109325 - protein, 9 aa, Homo sapiens
  light chain complementarity determining region 3 for antibody 54663
QQYISYPFT

SEQ ID NO: 109326 - protein, 13 aa, Homo sapiens
  heavy chain complementarity determining region 3 for antibody 54663
AADSGDYQYSFDY

SEQ ID NO: 109327 - protein, 9 aa, Homo sapiens
  light chain complementarity determining region 3 for antibody 54664
QQYGSSPYT

SEQ ID NO: 109328 - protein, 18 aa, Homo sapiens
  heavy chain complementarity determining region 3 for antibody 54664
ATHYDILTGYYKGRYFDL

SEQ ID NO: 109329 - protein, 9 aa, Homo sapiens
  light chain complementarity determining region 3 for antibody 54665
QQYGSSPYT

SEQ ID NO: 109330 - protein, 20 aa, Homo sapiens
  heavy chain complementarity determining region 3 for antibody 54665
ARDPGITFGGVIVIPGYFDL

SEQ ID NO: 109331 - protein, 9 aa, Homo sapiens
  light chain complementarity determining region 3 for antibody 54666
QQYGSSPYT

SEQ ID NO: 109332 - protein, 12 aa, Homo sapiens
  heavy chain complementarity determining region 3 for antibody 54666
ARAELRYFDFQH

SEQ ID NO: 109333 - protein, 9 aa, Homo sapiens
  light chain complementarity determining region 3 for antibody 54667
QQYGSSPWT

SEQ ID NO: 109334 - protein, 16 aa, Homo sapiens
  heavy chain complementarity determining region 3 for antibody 54667
AREGYSSGWYYYGMDV

SEQ ID NO: 109335 - protein, 9 aa, Homo sapiens
  light chain complementarity determining region 3 for antibody 54668
QQYGSSPWT

SEQ ID NO: 109336 - protein, 17 aa, Homo sapiens
  heavy chain complementarity determining region 3 for antibody 54668
AIGIGYSSGWYGDYFDY

SEQ ID NO: 109337 - protein, 8 aa, Homo sapiens
  light chain complementarity determining region 3 for antibody 54669
QQYGSSPT

SEQ ID NO: 109338 - protein, 13 aa, Homo sapiens
  heavy chain complementarity determining region 3 for antibody 54669
ARAIAVAGYLFDY

SEQ ID NO: 109339 - protein, 10 aa, Homo sapiens
  light chain complementarity determining region 3 for antibody 54670
QQYGSSPPYT

SEQ ID NO: 109340 - protein, 16 aa, Homo sapiens
  heavy chain complementarity determining region 3 for antibody 54670
AKEGGYAYYYYYGMDV

SEQ ID NO: 109341 - protein, 9 aa, Homo sapiens
  light chain complementarity determining region 3 for antibody 54671
QQYGSSPLT

SEQ ID NO: 109342 - protein, 12 aa, Homo sapiens
  heavy chain complementarity determining region 3 for antibody 54671
ATGLLWFGDSDY

SEQ ID NO: 109343 - protein, 9 aa, Homo sapiens
  light chain complementarity determining region 3 for antibody 54672
QQYGSSPLT

SEQ ID NO: 109344 - protein, 16 aa, Homo sapiens
  heavy chain complementarity determining region 3 for antibody 54672
ARFTIRGLITPDAFDI

SEQ ID NO: 109345 - protein, 9 aa, Homo sapiens
  light chain complementarity determining region 3 for antibody 54673
QQYGSSPFT

SEQ ID NO: 109346 - protein, 12 aa, Homo sapiens
  heavy chain complementarity determining region 3 for antibody 54673
ARDRGCYGLFDY

SEQ ID NO: 109347 - protein, 9 aa, Homo sapiens
  light chain complementarity determining region 3 for antibody 54674
QQYGNSPWT

SEQ ID NO: 109348 - protein, 20 aa, Homo sapiens
  heavy chain complementarity determining region 3 for antibody 54674
ARDRDDILTGWVPSYRGLDV

SEQ ID NO: 109349 - protein, 9 aa, Homo sapiens
  light chain complementarity determining region 3 for antibody 54675
QQYGISPYT

SEQ ID NO: 109350 - protein, 17 aa, Homo sapiens
  heavy chain complementarity determining region 3 for antibody 54675
ARGGAYYASGSSHSFDY

SEQ ID NO: 109351 - protein, 9 aa, Homo sapiens
  light chain complementarity determining region 3 for antibody 54676
QQYGISPYT

SEQ ID NO: 109352 - protein, 17 aa, Homo sapiens
  heavy chain complementarity determining region 3 for antibody 54676
ARGGAYYAAGSSHYFDY

SEQ ID NO: 109353 - protein, 9 aa, Homo sapiens
  light chain complementarity determining region 3 for antibody 54677
QQYDSYPYT

SEQ ID NO: 109354 - protein, 17 aa, Homo sapiens
  heavy chain complementarity determining region 3 for antibody 54677
ARLVLRYLDWLLPHFDN

SEQ ID NO: 109355 - protein, 9 aa, Homo sapiens
  light chain complementarity determining region 3 for antibody 54678
QQYDNLPYT

SEQ ID NO: 109356 - protein, 16 aa, Homo sapiens
  heavy chain complementarity determining region 3 for antibody 54678
ARDRDYYGSGSYPFDY

SEQ ID NO: 109357 - protein, 9 aa, Homo sapiens
  light chain complementarity determining region 3 for antibody 54679
QQYDNLPIT

SEQ ID NO: 109358 - protein, 15 aa, Homo sapiens
  heavy chain complementarity determining region 3 for antibody 54679
ARATMVRGFIGAFDI

SEQ ID NO: 109359 - protein, 9 aa, Homo sapiens
  light chain complementarity determining region 3 for antibody 54680
QQSYSTPYT

SEQ ID NO: 109360 - protein, 16 aa, Homo sapiens
  heavy chain complementarity determining region 3 for antibody 54680
ATRSYYEILTGYYFDY

SEQ ID NO: 109361 - protein, 9 aa, Homo sapiens
  light chain complementarity determining region 3 for antibody 54681
QQSYSTPYT

SEQ ID NO: 109362 - protein, 16 aa, Homo sapiens
  heavy chain complementarity determining region 3 for antibody 54681
ATRSYYDIVTGYYFDY

SEQ ID NO: 109363 - protein, 9 aa, Homo sapiens
  light chain complementarity determining region 3 for antibody 54682
QQSYSTPYT

SEQ ID NO: 109364 - protein, 17 aa, Homo sapiens
  heavy chain complementarity determining region 3 for antibody 54682
ARLVLRYSDWLLPHFDY

SEQ ID NO: 109365 - protein, 9 aa, Homo sapiens
  light chain complementarity determining region 3 for antibody 54683
QQSYSTPYT

SEQ ID NO: 109366 - protein, 9 aa, Homo sapiens
  heavy chain complementarity determining region 3 for antibody 54683
ARKRWYFDL

SEQ ID NO: 109367 - protein, 9 aa, Homo sapiens
  light chain complementarity determining region 3 for antibody 54684
QQSYSTPYT

SEQ ID NO: 109368 - protein, 16 aa, Homo sapiens
  heavy chain complementarity determining region 3 for antibody 54684
AKWGTGYHYYYYGMDV

SEQ ID NO: 109369 - protein, 9 aa, Homo sapiens
  light chain complementarity determining region 3 for antibody 54685
QQSYSTPYT

SEQ ID NO: 109370 - protein, 16 aa, Homo sapiens
  heavy chain complementarity determining region 3 for antibody 54685
AKAMVRGVGYYYGMDV

SEQ ID NO: 109371 - protein, 9 aa, Homo sapiens
  light chain complementarity determining region 3 for antibody 54686
QQSYSTPYT

SEQ ID NO: 109372 - protein, 16 aa, Homo sapiens
  heavy chain complementarity determining region 3 for antibody 54686
AARSYYEILTGYYFDY

SEQ ID NO: 109373 - protein, 9 aa, Homo sapiens
  light chain complementarity determining region 3 for antibody 54687
QQSYSTPYN

SEQ ID NO: 109374 - protein, 16 aa, Homo sapiens
  heavy chain complementarity determining region 3 for antibody 54687
ATRSYYDILTGYYFDY

SEQ ID NO: 109375 - protein, 9 aa, Homo sapiens
  light chain complementarity determining region 3 for antibody 54688
QQSYSTPWT

SEQ ID NO: 109376 - protein, 17 aa, Homo sapiens
  heavy chain complementarity determining region 3 for antibody 54688
ARGTYDYGSGSYFYFDY

SEQ ID NO: 109377 - protein, 9 aa, Homo sapiens
  light chain complementarity determining region 3 for antibody 54689
QQSYSTPRT

SEQ ID NO: 109378 - protein, 18 aa, Homo sapiens
  heavy chain complementarity determining region 3 for antibody 54689
ARDLLVRGVIAYYYGMDV

SEQ ID NO: 109379 - protein, 9 aa, Homo sapiens
  light chain complementarity determining region 3 for antibody 54690
QQSYSTPLT

SEQ ID NO: 109380 - protein, 19 aa, Homo sapiens
  heavy chain complementarity determining region 3 for antibody 54690
ARDAEIAVASPNYYYGMDV

SEQ ID NO: 109381 - protein, 9 aa, Homo sapiens
  light chain complementarity determining region 3 for antibody 54691
QQSYSSPLT

SEQ ID NO: 109382 - protein, 15 aa, Homo sapiens
  heavy chain complementarity determining region 3 for antibody 54691
ARDEGGISTGYYFDY

SEQ ID NO: 109383 - protein, 9 aa, Homo sapiens
  light chain complementarity determining region 3 for antibody 54692
QQRSNWMYT

SEQ ID NO: 109384 - protein, 10 aa, Homo sapiens
  heavy chain complementarity determining region 3 for antibody 54692
AKERWGLLDY

SEQ ID NO: 109385 - protein, 9 aa, Homo sapiens
  light chain complementarity determining region 3 for antibody 54693
QQRSNWLYT

SEQ ID NO: 109386 - protein, 10 aa, Homo sapiens
  heavy chain complementarity determining region 3 for antibody 54693
AKERWELLDY

SEQ ID NO: 109387 - protein, 9 aa, Homo sapiens
  light chain complementarity determining region 3 for antibody 54694
QQPNSYPYT

SEQ ID NO: 109388 - protein, 9 aa, Homo sapiens
  heavy chain complementarity determining region 3 for antibody 54694
ARKRWYFDL

SEQ ID NO: 109389 - protein, 9 aa, Homo sapiens
  light chain complementarity determining region 3 for antibody 54695
QQNISYPFT

SEQ ID NO: 109390 - protein, 13 aa, Homo sapiens
  heavy chain complementarity determining region 3 for antibody 54695
AADYGDYQYYFDY

SEQ ID NO: 109391 - protein, 9 aa, Homo sapiens
  light chain complementarity determining region 3 for antibody 54696
QQLNSYPYT

SEQ ID NO: 109392 - protein, 12 aa, Homo sapiens
  heavy chain complementarity determining region 3 for antibody 54696
TLDLGISGWFDP

SEQ ID NO: 109393 - protein, 9 aa, Homo sapiens
  light chain complementarity determining region 3 for antibody 54697
QQLNSYPYT

SEQ ID NO: 109394 - protein, 9 aa, Homo sapiens
  heavy chain complementarity determining region 3 for antibody 54697
ERKRWYFDL

SEQ ID NO: 109395 - protein, 9 aa, Homo sapiens
  light chain complementarity determining region 3 for antibody 54698
QQLNSYPYT

SEQ ID NO: 109396 - protein, 9 aa, Homo sapiens
  heavy chain complementarity determining region 3 for antibody 54698
ATKRWYFDL

SEQ ID NO: 109397 - protein, 9 aa, Homo sapiens
  light chain complementarity determining region 3 for antibody 54699
QQLNSYPYT

SEQ ID NO: 109398 - protein, 14 aa, Homo sapiens
  heavy chain complementarity determining region 3 for antibody 54699
ARTNDISTGFPFDY

SEQ ID NO: 109399 - protein, 9 aa, Homo sapiens
  light chain complementarity determining region 3 for antibody 54700
QQLNSYPYT

SEQ ID NO: 109400 - protein, 9 aa, Homo sapiens
  heavy chain complementarity determining region 3 for antibody 54700
ARKRWYFEH

SEQ ID NO: 109401 - protein, 9 aa, Homo sapiens
  light chain complementarity determining region 3 for antibody 54701
QQLNSYPYT

SEQ ID NO: 109402 - protein, 9 aa, Homo sapiens
  heavy chain complementarity determining region 3 for antibody 54701
ARKRWYCDL

SEQ ID NO: 109403 - protein, 9 aa, Homo sapiens
  light chain complementarity determining region 3 for antibody 54702
QQLNSYPYT

SEQ ID NO: 109404 - protein, 9 aa, Homo sapiens
  heavy chain complementarity determining region 3 for antibody 54702
ARKRWSFEL

SEQ ID NO: 109405 - protein, 9 aa, Homo sapiens
  light chain complementarity determining region 3 for antibody 54703
QQLNSYPYT

SEQ ID NO: 109406 - protein, 9 aa, Homo sapiens
  heavy chain complementarity determining region 3 for antibody 54703
ARKQRYLDY

SEQ ID NO: 109407 - protein, 9 aa, Homo sapiens
  light chain complementarity determining region 3 for antibody 54704
QQLNSYPYT

SEQ ID NO: 109408 - protein, 9 aa, Homo sapiens
  heavy chain complementarity determining region 3 for antibody 54704
ARKMWYFDL

SEQ ID NO: 109409 - protein, 9 aa, Homo sapiens
  light chain complementarity determining region 3 for antibody 54705
QQLNSYPYT

SEQ ID NO: 109410 - protein, 17 aa, Homo sapiens
  heavy chain complementarity determining region 3 for antibody 54705
AREYNDILTGYWGYFDY

SEQ ID NO: 109411 - protein, 9 aa, Homo sapiens
  light chain complementarity determining region 3 for antibody 54706
QQLNSYPYT

SEQ ID NO: 109412 - protein, 9 aa, Homo sapiens
  heavy chain complementarity determining region 3 for antibody 54706
ARERWYIDL

SEQ ID NO: 109413 - protein, 9 aa, Homo sapiens
  light chain complementarity determining region 3 for antibody 54707
QQLNSYPYT

SEQ ID NO: 109414 - protein, 15 aa, Homo sapiens
  heavy chain complementarity determining region 3 for antibody 54707
ARERRQLTGGYYFDY

SEQ ID NO: 109415 - protein, 9 aa, Homo sapiens
  light chain complementarity determining region 3 for antibody 54708
QQLNSYPYT

SEQ ID NO: 109416 - protein, 14 aa, Homo sapiens
  heavy chain complementarity determining region 3 for antibody 54708
ARDLDTTVRGVFDY

SEQ ID NO: 109417 - protein, 9 aa, Homo sapiens
  light chain complementarity determining region 3 for antibody 54709
QQLNSYPYT

SEQ ID NO: 109418 - protein, 8 aa, Homo sapiens
  heavy chain complementarity determining region 3 for antibody 54709
ARDDGMDV

SEQ ID NO: 109419 - protein, 9 aa, Homo sapiens
  light chain complementarity determining region 3 for antibody 54710
QQLNSYPYT

SEQ ID NO: 109420 - protein, 18 aa, Homo sapiens
  heavy chain complementarity determining region 3 for antibody 54710
ARAEVDDDILTGYYPFDY

SEQ ID NO: 109421 - protein, 9 aa, Homo sapiens
  light chain complementarity determining region 3 for antibody 54711
QQLNSYPYT

SEQ ID NO: 109422 - protein, 13 aa, Homo sapiens
  heavy chain complementarity determining region 3 for antibody 54711
AADYGDYQYDFDY

SEQ ID NO: 109423 - protein, 9 aa, Homo sapiens
  light chain complementarity determining region 3 for antibody 54712
QQLNSYPRT

SEQ ID NO: 109424 - protein, 10 aa, Homo sapiens
  heavy chain complementarity determining region 3 for antibody 54712
AREYSRYFDY

SEQ ID NO: 109425 - protein, 9 aa, Homo sapiens
  light chain complementarity determining region 3 for antibody 54713
QQLNSYPRT

SEQ ID NO: 109426 - protein, 15 aa, Homo sapiens
  heavy chain complementarity determining region 3 for antibody 54713
ARERRQLPGGYYFDY

SEQ ID NO: 109427 - protein, 9 aa, Homo sapiens
  light chain complementarity determining region 3 for antibody 54714
QQLNSYPPT

SEQ ID NO: 109428 - protein, 8 aa, Homo sapiens
  heavy chain complementarity determining region 3 for antibody 54714
ARTGPLDY

SEQ ID NO: 109429 - protein, 9 aa, Homo sapiens
  light chain complementarity determining region 3 for antibody 54715
QQLNSYPPT

SEQ ID NO: 109430 - protein, 17 aa, Homo sapiens
  heavy chain complementarity determining region 3 for antibody 54715
ARRNYDILTGSYNWFDH

SEQ ID NO: 109431 - protein, 9 aa, Homo sapiens
  light chain complementarity determining region 3 for antibody 54716
QQLNSYPPT

SEQ ID NO: 109432 - protein, 17 aa, Homo sapiens
  heavy chain complementarity determining region 3 for antibody 54716
ARLVLRYSDWLLPHFDY

SEQ ID NO: 109433 - protein, 9 aa, Homo sapiens
  light chain complementarity determining region 3 for antibody 54717
QQLNSYPPT

SEQ ID NO: 109434 - protein, 17 aa, Homo sapiens
  heavy chain complementarity determining region 3 for antibody 54717
AREYNDILTGYWGYFDY

SEQ ID NO: 109435 - protein, 9 aa, Homo sapiens
  light chain complementarity determining region 3 for antibody 54718
QQLNSYPPT

SEQ ID NO: 109436 - protein, 23 aa, Homo sapiens
  heavy chain complementarity determining region 3 for antibody 54718
ARERAHYDILTGSPYYYYYGMDV

SEQ ID NO: 109437 - protein, 9 aa, Homo sapiens
  light chain complementarity determining region 3 for antibody 54719
QQLNSYPPT

SEQ ID NO: 109438 - protein, 13 aa, Homo sapiens
  heavy chain complementarity determining region 3 for antibody 54719
ARDQGSGSDYFDY

SEQ ID NO: 109439 - protein, 9 aa, Homo sapiens
  light chain complementarity determining region 3 for antibody 54720
QQLNSYPPT

SEQ ID NO: 109440 - protein, 13 aa, Homo sapiens
  heavy chain complementarity determining region 3 for antibody 54720
ARDQGSGRYYFDY

SEQ ID NO: 109441 - protein, 9 aa, Homo sapiens
  light chain complementarity determining region 3 for antibody 54721
QQLNSYPPT

SEQ ID NO: 109442 - protein, 13 aa, Homo sapiens
  heavy chain complementarity determining region 3 for antibody 54721
AGDQGSGRDYFDY

SEQ ID NO: 109443 - protein, 9 aa, Homo sapiens
  light chain complementarity determining region 3 for antibody 54722
QQLNSYPPT

SEQ ID NO: 109444 - protein, 13 aa, Homo sapiens
  heavy chain complementarity determining region 3 for antibody 54722
AADYGDYQYYFAY

SEQ ID NO: 109445 - protein, 9 aa, Homo sapiens
  light chain complementarity determining region 3 for antibody 54723
QQLNSYPPT

SEQ ID NO: 109446 - protein, 13 aa, Homo sapiens
  heavy chain complementarity determining region 3 for antibody 54723
AADYGDYQYDIDY

SEQ ID NO: 109447 - protein, 9 aa, Homo sapiens
  light chain complementarity determining region 3 for antibody 54724
QQLNSYPPT

SEQ ID NO: 109448 - protein, 13 aa, Homo sapiens
  heavy chain complementarity determining region 3 for antibody 54724
AADYGDYQYCFDY

SEQ ID NO: 109449 - protein, 9 aa, Homo sapiens
  light chain complementarity determining region 3 for antibody 54725
QQLNSYPPT

SEQ ID NO: 109450 - protein, 13 aa, Homo sapiens
  heavy chain complementarity determining region 3 for antibody 54725
AADYGDSQYSFDY

SEQ ID NO: 109451 - protein, 9 aa, Homo sapiens
  light chain complementarity determining region 3 for antibody 54726
QQLNSYPPT

SEQ ID NO: 109452 - protein, 13 aa, Homo sapiens
  heavy chain complementarity determining region 3 for antibody 54726
AADYGDDQYYFDY

SEQ ID NO: 109453 - protein, 9 aa, Homo sapiens
  light chain complementarity determining region 3 for antibody 54727
QQLNSYPPT

SEQ ID NO: 109454 - protein, 13 aa, Homo sapiens
  heavy chain complementarity determining region 3 for antibody 54727
AADYGAYQYDFDY

SEQ ID NO: 109455 - protein, 9 aa, Homo sapiens
  light chain complementarity determining region 3 for antibody 54728
QQLNSYPPT

SEQ ID NO: 109456 - protein, 13 aa, Homo sapiens
  heavy chain complementarity determining region 3 for antibody 54728
AADYGAYHYSFDS

SEQ ID NO: 109457 - protein, 9 aa, Homo sapiens
  light chain complementarity determining region 3 for antibody 54729
QQLNSYPPT

SEQ ID NO: 109458 - protein, 13 aa, Homo sapiens
  heavy chain complementarity determining region 3 for antibody 54729
AADDGDYQYYFDY

SEQ ID NO: 109459 - protein, 9 aa, Homo sapiens
  light chain complementarity determining region 3 for antibody 54730
QQLNSYPPT

SEQ ID NO: 109460 - protein, 13 aa, Homo sapiens
  heavy chain complementarity determining region 3 for antibody 54730
AAAYGDYQYSFDY

SEQ ID NO: 109461 - protein, 9 aa, Homo sapiens
  light chain complementarity determining region 3 for antibody 54731
QQLNSYPPT

SEQ ID NO: 109462 - protein, 13 aa, Homo sapiens
  heavy chain complementarity determining region 3 for antibody 54731
AAAYGASQYYFDY

SEQ ID NO: 109463 - protein, 9 aa, Homo sapiens
  light chain complementarity determining region 3 for antibody 54732
QQLNSYPPT

SEQ ID NO: 109464 - protein, 13 aa, Homo sapiens
  heavy chain complementarity determining region 3 for antibody 54732
AAACGDYQYYFDY

SEQ ID NO: 109465 - protein, 9 aa, Homo sapiens
  light chain complementarity determining region 3 for antibody 54733
QQLNSYPLT

SEQ ID NO: 109466 - protein, 10 aa, Homo sapiens
  heavy chain complementarity determining region 3 for antibody 54733
ATGEADAFDI

SEQ ID NO: 109467 - protein, 9 aa, Homo sapiens
  light chain complementarity determining region 3 for antibody 54734
QQLNSYPLT

SEQ ID NO: 109468 - protein, 10 aa, Homo sapiens
  heavy chain complementarity determining region 3 for antibody 54734
ARGYSYGIDY

SEQ ID NO: 109469 - protein, 9 aa, Homo sapiens
  light chain complementarity determining region 3 for antibody 54735
QQLNSYPLT

SEQ ID NO: 109470 - protein, 11 aa, Homo sapiens
  heavy chain complementarity determining region 3 for antibody 54735
AREGVGTAFDI

SEQ ID NO: 109471 - protein, 9 aa, Homo sapiens
  light chain complementarity determining region 3 for antibody 54736
QQLNSYPLT

SEQ ID NO: 109472 - protein, 12 aa, Homo sapiens
  heavy chain complementarity determining region 3 for antibody 54736
ARDREVPGVLDY

SEQ ID NO: 109473 - protein, 9 aa, Homo sapiens
  light chain complementarity determining region 3 for antibody 54737
QQLNSYPIT

SEQ ID NO: 109474 - protein, 16 aa, Homo sapiens
  heavy chain complementarity determining region 3 for antibody 54737
ARDPDYDILTAPPLDY

SEQ ID NO: 109475 - protein, 9 aa, Homo sapiens
  light chain complementarity determining region 3 for antibody 54738
QQLNSYPFT

SEQ ID NO: 109476 - protein, 17 aa, Homo sapiens
  heavy chain complementarity determining region 3 for antibody 54738
ARLVLRYSDWLLPHFDY

SEQ ID NO: 109477 - protein, 9 aa, Homo sapiens
  light chain complementarity determining region 3 for antibody 54739
QQLNSYPFT

SEQ ID NO: 109478 - protein, 14 aa, Homo sapiens
  heavy chain complementarity determining region 3 for antibody 54739
ARKGGGLGYYGMDV

SEQ ID NO: 109479 - protein, 9 aa, Homo sapiens
  light chain complementarity determining region 3 for antibody 54740
QQLNSYPCT

SEQ ID NO: 109480 - protein, 9 aa, Homo sapiens
  heavy chain complementarity determining region 3 for antibody 54740
ARKRWYFDL

SEQ ID NO: 109481 - protein, 9 aa, Homo sapiens
  light chain complementarity determining region 3 for antibody 54741
QQLNSYLYT

SEQ ID NO: 109482 - protein, 16 aa, Homo sapiens
  heavy chain complementarity determining region 3 for antibody 54741
ARGAPYYDILTGYSDY

SEQ ID NO: 109483 - protein, 9 aa, Homo sapiens
  light chain complementarity determining region 3 for antibody 54742
QQLNSLPYT

SEQ ID NO: 109484 - protein, 9 aa, Homo sapiens
  heavy chain complementarity determining region 3 for antibody 54742
ARKRWYFDL

SEQ ID NO: 109485 - protein, 9 aa, Homo sapiens
  light chain complementarity determining region 3 for antibody 54743
QQLNNYPYT

SEQ ID NO: 109486 - protein, 9 aa, Homo sapiens
  heavy chain complementarity determining region 3 for antibody 54743
ARKRWSLDL

SEQ ID NO: 109487 - protein, 9 aa, Homo sapiens
  light chain complementarity determining region 3 for antibody 54744
QQLNNYPRT

SEQ ID NO: 109488 - protein, 22 aa, Homo sapiens
  heavy chain complementarity determining region 3 for antibody 54744
SRGDYDILTGYSSYYYSYGMDV

SEQ ID NO: 109489 - protein, 9 aa, Homo sapiens
  light chain complementarity determining region 3 for antibody 54745
QQLNGYPYT

SEQ ID NO: 109490 - protein, 9 aa, Homo sapiens
  heavy chain complementarity determining region 3 for antibody 54745
ARKRWYLDL

SEQ ID NO: 109491 - protein, 9 aa, Homo sapiens
  light chain complementarity determining region 3 for antibody 54746
QQINSYPYT

SEQ ID NO: 109492 - protein, 9 aa, Homo sapiens
  heavy chain complementarity determining region 3 for antibody 54746
ARKRWYFDL

SEQ ID NO: 109493 - protein, 9 aa, Homo sapiens
  light chain complementarity determining region 3 for antibody 54747
QQHNSYPYT

SEQ ID NO: 109494 - protein, 17 aa, Homo sapiens
  heavy chain complementarity determining region 3 for antibody 54747
ARLVLRYSDWLLPHFDY

SEQ ID NO: 109495 - protein, 9 aa, Homo sapiens
  light chain complementarity determining region 3 for antibody 54748
QQHISYPFT

SEQ ID NO: 109496 - protein, 13 aa, Homo sapiens
  heavy chain complementarity determining region 3 for antibody 54748
AADYGDYQYYFDY

SEQ ID NO: 109497 - protein, 9 aa, Homo sapiens
  light chain complementarity determining region 3 for antibody 54749
QQFNSYPYT

SEQ ID NO: 109498 - protein, 17 aa, Homo sapiens
  heavy chain complementarity determining region 3 for antibody 54749
ARLVLRYSDWLLPHFDY

SEQ ID NO: 109499 - protein, 9 aa, Homo sapiens
  light chain complementarity determining region 3 for antibody 54750
QQFNSYPFT

SEQ ID NO: 109500 - protein, 16 aa, Homo sapiens
  heavy chain complementarity determining region 3 for antibody 54750
ARGRGYYGSGSPYFDY

SEQ ID NO: 109501 - protein, 9 aa, Homo sapiens
  light chain complementarity determining region 3 for antibody 54751
QQFNNYPYT

SEQ ID NO: 109502 - protein, 24 aa, Homo sapiens
  heavy chain complementarity determining region 3 for antibody 54751
AREWEGNYGSGSYYKSAYYYGMDV

SEQ ID NO: 109503 - protein, 9 aa, Homo sapiens
  light chain complementarity determining region 3 for antibody 54752
QQFNNYPWT

SEQ ID NO: 109504 - protein, 12 aa, Homo sapiens
  heavy chain complementarity determining region 3 for antibody 54752
AELGPYYYGMDV

SEQ ID NO: 109505 - protein, 9 aa, Homo sapiens
  light chain complementarity determining region 3 for antibody 54753
QQFNNYPWT

SEQ ID NO: 109506 - protein, 12 aa, Homo sapiens
  heavy chain complementarity determining region 3 for antibody 54753
AELGHYYYGMGV

SEQ ID NO: 109507 - protein, 8 aa, Homo sapiens
  light chain complementarity determining region 3 for antibody 54754
QQFNNYPT

SEQ ID NO: 109508 - protein, 12 aa, Homo sapiens
  heavy chain complementarity determining region 3 for antibody 54754
AREMTVSGYFDY

SEQ ID NO: 109509 - protein, 8 aa, Homo sapiens
  light chain complementarity determining region 3 for antibody 54755
QQFNNYPT

SEQ ID NO: 109510 - protein, 18 aa, Homo sapiens
  heavy chain complementarity determining region 3 for antibody 54755
ARAPYDILTGYYYYGMDV

SEQ ID NO: 109511 - protein, 9 aa, Homo sapiens
  light chain complementarity determining region 3 for antibody 54756
QQFNNYPST

SEQ ID NO: 109512 - protein, 17 aa, Homo sapiens
  heavy chain complementarity determining region 3 for antibody 54756
AREGGGVAYYYYYGMDV

SEQ ID NO: 109513 - protein, 9 aa, Homo sapiens
  light chain complementarity determining region 3 for antibody 54757
QQFNNYPST

SEQ ID NO: 109514 - protein, 15 aa, Homo sapiens
  heavy chain complementarity determining region 3 for antibody 54757
AAPYYYGSGSYALDV

SEQ ID NO: 109515 - protein, 9 aa, Homo sapiens
  light chain complementarity determining region 3 for antibody 54758
QQFNNYPFT

SEQ ID NO: 109516 - protein, 17 aa, Homo sapiens
  heavy chain complementarity determining region 3 for antibody 54758
ARLVLRYSDWLLPHFDY

SEQ ID NO: 109517 - protein, 9 aa, Homo sapiens
  light chain complementarity determining region 3 for antibody 54759
QQFNNYPFT

SEQ ID NO: 109518 - protein, 16 aa, Homo sapiens
  heavy chain complementarity determining region 3 for antibody 54759
ARGRGYYGSVSPYFDY

SEQ ID NO: 109519 - protein, 9 aa, Homo sapiens
  light chain complementarity determining region 3 for antibody 54760
QQFNNYPFT

SEQ ID NO: 109520 - protein, 16 aa, Homo sapiens
  heavy chain complementarity determining region 3 for antibody 54760
ARGRGYYGSGSPYLDY

SEQ ID NO: 109521 - protein, 9 aa, Homo sapiens
  light chain complementarity determining region 3 for antibody 54761
QQFNNYPFT

SEQ ID NO: 109522 - protein, 16 aa, Homo sapiens
  heavy chain complementarity determining region 3 for antibody 54761
ARGRGYYGSGSPDFDY

SEQ ID NO: 109523 - protein, 9 aa, Homo sapiens
  light chain complementarity determining region 3 for antibody 54762
QQFNNYPFT

SEQ ID NO: 109524 - protein, 16 aa, Homo sapiens
  heavy chain complementarity determining region 3 for antibody 54762
ARGRGYYGSGSPCFDY

SEQ ID NO: 109525 - protein, 9 aa, Homo sapiens
  light chain complementarity determining region 3 for antibody 54763
QQFNNYPFT

SEQ ID NO: 109526 - protein, 16 aa, Homo sapiens
  heavy chain complementarity determining region 3 for antibody 54763
ARGRGYYGSGCPYFDY

SEQ ID NO: 109527 - protein, 9 aa, Homo sapiens
  light chain complementarity determining region 3 for antibody 54764
QQFNNYPFT

SEQ ID NO: 109528 - protein, 16 aa, Homo sapiens
  heavy chain complementarity determining region 3 for antibody 54764
ARGRGYYGAGSPYFDY

SEQ ID NO: 109529 - protein, 9 aa, Homo sapiens
  light chain complementarity determining region 3 for antibody 54765
QQFNNYPFT

SEQ ID NO: 109530 - protein, 6 aa, Homo sapiens
  heavy chain complementarity determining region 3 for antibody 54765
ARGRGY

SEQ ID NO: 109531 - protein, 9 aa, Homo sapiens
  light chain complementarity determining region 3 for antibody 54766
QQFNNYPFT

SEQ ID NO: 109532 - protein, 16 aa, Homo sapiens
  heavy chain complementarity determining region 3 for antibody 54766
ARGGGYYGSGSPYFDY

SEQ ID NO: 109533 - protein, 9 aa, Homo sapiens
  light chain complementarity determining region 3 for antibody 54767
QQFNNYPFT

SEQ ID NO: 109534 - protein, 18 aa, Homo sapiens
  heavy chain complementarity determining region 3 for antibody 54767
ARERRDDILTGYFDAFDI

SEQ ID NO: 109535 - protein, 9 aa, Homo sapiens
  light chain complementarity determining region 3 for antibody 54768
QQFNNYPFT

SEQ ID NO: 109536 - protein, 13 aa, Homo sapiens
  heavy chain complementarity determining region 3 for antibody 54768
AADYGDYQYYFDY

SEQ ID NO: 109537 - protein, 9 aa, Homo sapiens
  light chain complementarity determining region 3 for antibody 54769
QQFNNYMYT

SEQ ID NO: 109538 - protein, 9 aa, Homo sapiens
  heavy chain complementarity determining region 3 for antibody 54769
ARKRWYFDL

SEQ ID NO: 109539 - protein, 9 aa, Homo sapiens
  light chain complementarity determining region 3 for antibody 54770
QQFNNYMYT

SEQ ID NO: 109540 - protein, 11 aa, Homo sapiens
  heavy chain complementarity determining region 3 for antibody 54770
ARERTSLDFDY

SEQ ID NO: 109541 - protein, 9 aa, Homo sapiens
  light chain complementarity determining region 3 for antibody 54771
QQFNNYLYT

SEQ ID NO: 109542 - protein, 13 aa, Homo sapiens
  heavy chain complementarity determining region 3 for antibody 54771
AADYGDYQYYFDY

SEQ ID NO: 109543 - protein, 8 aa, Homo sapiens
  light chain complementarity determining region 3 for antibody 54772
QQFNNLYT

SEQ ID NO: 109544 - protein, 16 aa, Homo sapiens
  heavy chain complementarity determining region 3 for antibody 54772
ARERIWFGELFTPFDY

SEQ ID NO: 109545 - protein, 8 aa, Homo sapiens
  light chain complementarity determining region 3 for antibody 54773
QQFNDYYT

SEQ ID NO: 109546 - protein, 10 aa, Homo sapiens
  heavy chain complementarity determining region 3 for antibody 54773
VRGVRGVFDY

SEQ ID NO: 109547 - protein, 9 aa, Homo sapiens
  light chain complementarity determining region 3 for antibody 54774
QQDYNLPYT

SEQ ID NO: 109548 - protein, 15 aa, Homo sapiens
  heavy chain complementarity determining region 3 for antibody 54774
ATEDGYYGSGKLFDY

SEQ ID NO: 109549 - protein, 9 aa, Homo sapiens
  light chain complementarity determining region 3 for antibody 54775
QQDYNLPWT

SEQ ID NO: 109550 - protein, 11 aa, Homo sapiens
  heavy chain complementarity determining region 3 for antibody 54775
ARGGWGSNFDY

SEQ ID NO: 109551 - protein, 10 aa, Homo sapiens
  light chain complementarity determining region 3 for antibody 54776
QQDYNLPPWT

SEQ ID NO: 109552 - protein, 17 aa, Homo sapiens
  heavy chain complementarity determining region 3 for antibody 54776
ARESRPRIAVAGTGFDY

SEQ ID NO: 109553 - protein, 9 aa, Homo sapiens
  light chain complementarity determining region 3 for antibody 54777
QQDYNLPLT

SEQ ID NO: 109554 - protein, 17 aa, Homo sapiens
  heavy chain complementarity determining region 3 for antibody 54777
ARGLRYFDWSLSDAFDI

SEQ ID NO: 109555 - protein, 9 aa, Homo sapiens
  light chain complementarity determining region 3 for antibody 54778
QQDYNLPLT

SEQ ID NO: 109556 - protein, 17 aa, Homo sapiens
  heavy chain complementarity determining region 3 for antibody 54778
ARGLRYFDWLLSDALDI

SEQ ID NO: 109557 - protein, 9 aa, Homo sapiens
  light chain complementarity determining region 3 for antibody 54779
QQDYNLPLT

SEQ ID NO: 109558 - protein, 11 aa, Homo sapiens
  heavy chain complementarity determining region 3 for antibody 54779
AREGWGFLSDY

SEQ ID NO: 109559 - protein, 9 aa, Homo sapiens
  light chain complementarity determining region 3 for antibody 54780
QQDYNLPLT

SEQ ID NO: 109560 - protein, 19 aa, Homo sapiens
  heavy chain complementarity determining region 3 for antibody 54780
AKDQEYSGSYYSYYYGMDV

SEQ ID NO: 109561 - protein, 9 aa, Homo sapiens
  light chain complementarity determining region 3 for antibody 54781
QQDYNLPLT

SEQ ID NO: 109562 - protein, 11 aa, Homo sapiens
  heavy chain complementarity determining region 3 for antibody 54781
AGNIASAGTHR

SEQ ID NO: 109563 - protein, 9 aa, Homo sapiens
  light chain complementarity determining region 3 for antibody 54782
QQDYNLPLT

SEQ ID NO: 109564 - protein, 11 aa, Homo sapiens
  heavy chain complementarity determining region 3 for antibody 54782
AGNIAAASTHR

SEQ ID NO: 109565 - protein, 9 aa, Homo sapiens
  light chain complementarity determining region 3 for antibody 54783
QQDYNLPLT

SEQ ID NO: 109566 - protein, 11 aa, Homo sapiens
  heavy chain complementarity determining region 3 for antibody 54783
AGNIAAAGTPR

SEQ ID NO: 109567 - protein, 8 aa, Homo sapiens
  light chain complementarity determining region 3 for antibody 54784
QQDYNLLT

SEQ ID NO: 109568 - protein, 10 aa, Homo sapiens
  heavy chain complementarity determining region 3 for antibody 54784
ARNWGHAFDI

SEQ ID NO: 109569 - protein, 8 aa, Homo sapiens
  light chain complementarity determining region 3 for antibody 54785
QQDYNLFT

SEQ ID NO: 109570 - protein, 15 aa, Homo sapiens
  heavy chain complementarity determining region 3 for antibody 54785
AKGTGIRYFYYGMDV

SEQ ID NO: 109571 - protein, 8 aa, Homo sapiens
  light chain complementarity determining region 3 for antibody 54786
QQDYNLFT

SEQ ID NO: 109572 - protein, 15 aa, Homo sapiens
  heavy chain complementarity determining region 3 for antibody 54786
AKDFSMVRGVGGMDV

SEQ ID NO: 109573 - protein, 9 aa, Homo sapiens
  light chain complementarity determining region 3 for antibody 54787
QQDSNLPWT

SEQ ID NO: 109574 - protein, 16 aa, Homo sapiens
  heavy chain complementarity determining region 3 for antibody 54787
AREGVVGATGRGWFDP

SEQ ID NO: 109575 - protein, 9 aa, Homo sapiens
  light chain complementarity determining region 3 for antibody 54788
QQDNSYPYT

SEQ ID NO: 109576 - protein, 17 aa, Homo sapiens
  heavy chain complementarity determining region 3 for antibody 54788
ARLVLRYSDWLLPHFDY

SEQ ID NO: 109577 - protein, 9 aa, Homo sapiens
  light chain complementarity determining region 3 for antibody 54789
QQCNSYSYT

SEQ ID NO: 109578 - protein, 18 aa, Homo sapiens
  heavy chain complementarity determining region 3 for antibody 54789
ARERRDDILTGYFDAFDI

SEQ ID NO: 109579 - protein, 9 aa, Homo sapiens
  light chain complementarity determining region 3 for antibody 54790
QQCNSYPYT

SEQ ID NO: 109580 - protein, 18 aa, Homo sapiens
  heavy chain complementarity determining region 3 for antibody 54790
ARERSDDILTGYFDAFDF

SEQ ID NO: 109581 - protein, 9 aa, Homo sapiens
  light chain complementarity determining region 3 for antibody 54791
QQCNSYPYT

SEQ ID NO: 109582 - protein, 18 aa, Homo sapiens
  heavy chain complementarity determining region 3 for antibody 54791
ARERRDDIWTGYFDAFDF

SEQ ID NO: 109583 - protein, 9 aa, Homo sapiens
  light chain complementarity determining region 3 for antibody 54792
QQCNSYPYT

SEQ ID NO: 109584 - protein, 18 aa, Homo sapiens
  heavy chain complementarity determining region 3 for antibody 54792
ARERRDDILTGYSDAFDI

SEQ ID NO: 109585 - protein, 9 aa, Homo sapiens
  light chain complementarity determining region 3 for antibody 54793
QQCNSYPYT

SEQ ID NO: 109586 - protein, 18 aa, Homo sapiens
  heavy chain complementarity determining region 3 for antibody 54793
ARERRDDILAGYFDAFDI

SEQ ID NO: 109587 - protein, 9 aa, Homo sapiens
  light chain complementarity determining region 3 for antibody 54794
QQCNSYPRT

SEQ ID NO: 109588 - protein, 15 aa, Homo sapiens
  heavy chain complementarity determining region 3 for antibody 54794
AKEDGLWFGGSYFDY

SEQ ID NO: 109589 - protein, 9 aa, Homo sapiens
  light chain complementarity determining region 3 for antibody 54795
QPYNSFPFT

SEQ ID NO: 109590 - protein, 17 aa, Homo sapiens
  heavy chain complementarity determining region 3 for antibody 54795
AREYNDILTGYWGYFDY

SEQ ID NO: 109591 - protein, 9 aa, Homo sapiens
  light chain complementarity determining region 3 for antibody 54796
QKYNTAPLT

SEQ ID NO: 109592 - protein, 8 aa, Homo sapiens
  heavy chain complementarity determining region 3 for antibody 54796
ARTGPLDY

SEQ ID NO: 109593 - protein, 9 aa, Homo sapiens
  light chain complementarity determining region 3 for antibody 54797
QKYNSAPYT

SEQ ID NO: 109594 - protein, 8 aa, Homo sapiens
  heavy chain complementarity determining region 3 for antibody 54797
ARTGPLDY

SEQ ID NO: 109595 - protein, 9 aa, Homo sapiens
  light chain complementarity determining region 3 for antibody 54798
QKYNSAPYT

SEQ ID NO: 109596 - protein, 8 aa, Homo sapiens
  heavy chain complementarity determining region 3 for antibody 54798
ARDDGMDV

SEQ ID NO: 109597 - protein, 9 aa, Homo sapiens
  light chain complementarity determining region 3 for antibody 54799
QKYNSAPWT

SEQ ID NO: 109598 - protein, 15 aa, Homo sapiens
  heavy chain complementarity determining region 3 for antibody 54799
ARVGWSGSFYDAFDI

SEQ ID NO: 109599 - protein, 9 aa, Homo sapiens
  light chain complementarity determining region 3 for antibody 54800
QKYNSAPWT

SEQ ID NO: 109600 - protein, 13 aa, Homo sapiens
  heavy chain complementarity determining region 3 for antibody 54800
AADCGDYQYYFDY

SEQ ID NO: 109601 - protein, 9 aa, Homo sapiens
  light chain complementarity determining region 3 for antibody 54801
QKYNSAPPT

SEQ ID NO: 109602 - protein, 8 aa, Homo sapiens
  heavy chain complementarity determining region 3 for antibody 54801
AITGPLDY

SEQ ID NO: 109603 - protein, 9 aa, Homo sapiens
  light chain complementarity determining region 3 for antibody 54802
QKYNSAPLT

SEQ ID NO: 109604 - protein, 5 aa, Homo sapiens
  heavy chain complementarity determining region 3 for antibody 54802
TTPVL

SEQ ID NO: 109605 - protein, 9 aa, Homo sapiens
  light chain complementarity determining region 3 for antibody 54803
QKYNSAPLT

SEQ ID NO: 109606 - protein, 8 aa, Homo sapiens
  heavy chain complementarity determining region 3 for antibody 54803
SRTGPLDY

SEQ ID NO: 109607 - protein, 9 aa, Homo sapiens
  light chain complementarity determining region 3 for antibody 54804
QKYNSAPLT

SEQ ID NO: 109608 - protein, 8 aa, Homo sapiens
  heavy chain complementarity determining region 3 for antibody 54804
ERTGPLDY

SEQ ID NO: 109609 - protein, 9 aa, Homo sapiens
  light chain complementarity determining region 3 for antibody 54805
QKYNSAPLT

SEQ ID NO: 109610 - protein, 8 aa, Homo sapiens
  heavy chain complementarity determining region 3 for antibody 54805
ARTGTLDY

SEQ ID NO: 109611 - protein, 9 aa, Homo sapiens
  light chain complementarity determining region 3 for antibody 54806
QKYNSAPLT

SEQ ID NO: 109612 - protein, 8 aa, Homo sapiens
  heavy chain complementarity determining region 3 for antibody 54806
ARTGRLDY

SEQ ID NO: 109613 - protein, 9 aa, Homo sapiens
  light chain complementarity determining region 3 for antibody 54807
QKYNSAPLT

SEQ ID NO: 109614 - protein, 8 aa, Homo sapiens
  heavy chain complementarity determining region 3 for antibody 54807
ARTGPRDY

SEQ ID NO: 109615 - protein, 9 aa, Homo sapiens
  light chain complementarity determining region 3 for antibody 54808
QKYNSAPLT

SEQ ID NO: 109616 - protein, 8 aa, Homo sapiens
  heavy chain complementarity determining region 3 for antibody 54808
ARTCPLDY

SEQ ID NO: 109617 - protein, 9 aa, Homo sapiens
  light chain complementarity determining region 3 for antibody 54809
QKYNSAPLT

SEQ ID NO: 109618 - protein, 8 aa, Homo sapiens
  heavy chain complementarity determining region 3 for antibody 54809
ARSGALDY

SEQ ID NO: 109619 - protein, 9 aa, Homo sapiens
  light chain complementarity determining region 3 for antibody 54810
QKYNSAPLT

SEQ ID NO: 109620 - protein, 9 aa, Homo sapiens
  heavy chain complementarity determining region 3 for antibody 54810
ARKRWYFDL

SEQ ID NO: 109621 - protein, 9 aa, Homo sapiens
  light chain complementarity determining region 3 for antibody 54811
QKYNSAPLT

SEQ ID NO: 109622 - protein, 6 aa, Homo sapiens
  heavy chain complementarity determining region 3 for antibody 54811
ARDPDY

SEQ ID NO: 109623 - protein, 9 aa, Homo sapiens
  light chain complementarity determining region 3 for antibody 54812
QKYNSAPLT

SEQ ID NO: 109624 - protein, 8 aa, Homo sapiens
  heavy chain complementarity determining region 3 for antibody 54812
ARAGPLDC

SEQ ID NO: 109625 - protein, 9 aa, Homo sapiens
  light chain complementarity determining region 3 for antibody 54813
QKYNSAPFT

SEQ ID NO: 109626 - protein, 15 aa, Homo sapiens
  heavy chain complementarity determining region 3 for antibody 54813
ARDGPTGAFYWYFDL

SEQ ID NO: 109627 - protein, 9 aa, Homo sapiens
  light chain complementarity determining region 3 for antibody 54814
QKYNRAPLT

SEQ ID NO: 109628 - protein, 8 aa, Homo sapiens
  heavy chain complementarity determining region 3 for antibody 54814
ARTGPLDY

SEQ ID NO: 109629 - protein, 9 aa, Homo sapiens
  light chain complementarity determining region 3 for antibody 54815
QKYDGAPLT

SEQ ID NO: 109630 - protein, 8 aa, Homo sapiens
  heavy chain complementarity determining region 3 for antibody 54815
ARTGPLDY

SEQ ID NO: 109631 - protein, 9 aa, Homo sapiens
  light chain complementarity determining region 3 for antibody 54816
QKNNSAPLT

SEQ ID NO: 109632 - protein, 8 aa, Homo sapiens
  heavy chain complementarity determining region 3 for antibody 54816
ARTGPLDY

SEQ ID NO: 109633 - protein, 9 aa, Homo sapiens
  light chain complementarity determining region 3 for antibody 54817
QKDNSAPLT

SEQ ID NO: 109634 - protein, 8 aa, Homo sapiens
  heavy chain complementarity determining region 3 for antibody 54817
ARTGPLDY

SEQ ID NO: 109635 - protein, 9 aa, Homo sapiens
  light chain complementarity determining region 3 for antibody 54818
QHYNIYPYT

SEQ ID NO: 109636 - protein, 18 aa, Homo sapiens
  heavy chain complementarity determining region 3 for antibody 54818
ARERRDDILTGYYDAFDI

SEQ ID NO: 109637 - protein, 9 aa, Homo sapiens
  light chain complementarity determining region 3 for antibody 54819
QHFNNYPYT

SEQ ID NO: 109638 - protein, 12 aa, Homo sapiens
  heavy chain complementarity determining region 3 for antibody 54819
ARDGGWNYDMDV

SEQ ID NO: 109639 - protein, 10 aa, Homo sapiens
  light chain complementarity determining region 3 for antibody 54820
MRTLQTPPYT

SEQ ID NO: 109640 - protein, 17 aa, Homo sapiens
  heavy chain complementarity determining region 3 for antibody 54820
AKGDSSSWYNYYYGMDV

SEQ ID NO: 109641 - protein, 10 aa, Homo sapiens
  light chain complementarity determining region 3 for antibody 54821
MQTLQTPPYT

SEQ ID NO: 109642 - protein, 8 aa, Homo sapiens
  heavy chain complementarity determining region 3 for antibody 54821
ARTGPLDY

SEQ ID NO: 109643 - protein, 10 aa, Homo sapiens
  light chain complementarity determining region 3 for antibody 54822
MQTLQTPPYT

SEQ ID NO: 109644 - protein, 17 aa, Homo sapiens
  heavy chain complementarity determining region 3 for antibody 54822
ANGDSSSWYNYSYGMDV

SEQ ID NO: 109645 - protein, 10 aa, Homo sapiens
  light chain complementarity determining region 3 for antibody 54823
MQTLQTPPYT

SEQ ID NO: 109646 - protein, 17 aa, Homo sapiens
  heavy chain complementarity determining region 3 for antibody 54823
AKGDSSSWYTYYYGMDV

SEQ ID NO: 109647 - protein, 10 aa, Homo sapiens
  light chain complementarity determining region 3 for antibody 54824
MQTLQTPPYT

SEQ ID NO: 109648 - protein, 17 aa, Homo sapiens
  heavy chain complementarity determining region 3 for antibody 54824
AKGDSSSWYNFYYGMDV

SEQ ID NO: 109649 - protein, 10 aa, Homo sapiens
  light chain complementarity determining region 3 for antibody 54825
MQGTHWPLYT

SEQ ID NO: 109650 - protein, 15 aa, Homo sapiens
  heavy chain complementarity determining region 3 for antibody 54825
ARGGYYGSGSYGMDV

SEQ ID NO: 109651 - protein, 9 aa, Homo sapiens
  light chain complementarity determining region 3 for antibody 54826
MQALQTPLT

SEQ ID NO: 109652 - protein, 13 aa, Homo sapiens
  heavy chain complementarity determining region 3 for antibody 54826
ARDDILTGYHLHY

SEQ ID NO: 109653 - protein, 9 aa, Homo sapiens
  light chain complementarity determining region 3 for antibody 54827
MQALQTPFT

SEQ ID NO: 109654 - protein, 13 aa, Homo sapiens
  heavy chain complementarity determining region 3 for antibody 54827
ARDRDSLTGAFDY

SEQ ID NO: 109655 - protein, 9 aa, Homo sapiens
  light chain complementarity determining region 3 for antibody 54828
LQYNSYPHT

SEQ ID NO: 109656 - protein, 19 aa, Homo sapiens
  heavy chain complementarity determining region 3 for antibody 54828
ARDHDILTGYYRDYYGMDV

SEQ ID NO: 109657 - protein, 9 aa, Homo sapiens
  light chain complementarity determining region 3 for antibody 54829
LQHSSYPYT

SEQ ID NO: 109658 - protein, 14 aa, Homo sapiens
  heavy chain complementarity determining region 3 for antibody 54829
ARDGDYYYYYGMDV

SEQ ID NO: 109659 - protein, 9 aa, Homo sapiens
  light chain complementarity determining region 3 for antibody 54830
LQHNTYPYT

SEQ ID NO: 109660 - protein, 17 aa, Homo sapiens
  heavy chain complementarity determining region 3 for antibody 54830
ARERDYYGSGSYYTFDY

SEQ ID NO: 109661 - protein, 9 aa, Homo sapiens
  light chain complementarity determining region 3 for antibody 54831
LQHNTYPYT

SEQ ID NO: 109662 - protein, 17 aa, Homo sapiens
  heavy chain complementarity determining region 3 for antibody 54831
ARERDYYGSGSYYSFDY

SEQ ID NO: 109663 - protein, 9 aa, Homo sapiens
  light chain complementarity determining region 3 for antibody 54832
LQHNTYPWT

SEQ ID NO: 109664 - protein, 14 aa, Homo sapiens
  heavy chain complementarity determining region 3 for antibody 54832
ARDQYSNGSYCFDY

SEQ ID NO: 109665 - protein, 9 aa, Homo sapiens
  light chain complementarity determining region 3 for antibody 54833
LQHNSYQLT

SEQ ID NO: 109666 - protein, 22 aa, Homo sapiens
  heavy chain complementarity determining region 3 for antibody 54833
ARGDYDILTGYRGYYSYYGMDV

SEQ ID NO: 109667 - protein, 9 aa, Homo sapiens
  light chain complementarity determining region 3 for antibody 54834
LQHNSYPYT

SEQ ID NO: 109668 - protein, 8 aa, Homo sapiens
  heavy chain complementarity determining region 3 for antibody 54834
VRDDGMDV

SEQ ID NO: 109669 - protein, 9 aa, Homo sapiens
  light chain complementarity determining region 3 for antibody 54835
LQHNSYPYT

SEQ ID NO: 109670 - protein, 11 aa, Homo sapiens
  heavy chain complementarity determining region 3 for antibody 54835
ATAGYGIVGDH

SEQ ID NO: 109671 - protein, 9 aa, Homo sapiens
  light chain complementarity determining region 3 for antibody 54836
LQHNSYPYT

SEQ ID NO: 109672 - protein, 8 aa, Homo sapiens
  heavy chain complementarity determining region 3 for antibody 54836
ARTGPLDC

SEQ ID NO: 109673 - protein, 9 aa, Homo sapiens
  light chain complementarity determining region 3 for antibody 54837
LQHNSYPYT

SEQ ID NO: 109674 - protein, 13 aa, Homo sapiens
  heavy chain complementarity determining region 3 for antibody 54837
ARPLWFGELFPGY

SEQ ID NO: 109675 - protein, 9 aa, Homo sapiens
  light chain complementarity determining region 3 for antibody 54838
LQHNSYPYT

SEQ ID NO: 109676 - protein, 13 aa, Homo sapiens
  heavy chain complementarity determining region 3 for antibody 54838
ARPLCFGELFPCY

SEQ ID NO: 109677 - protein, 9 aa, Homo sapiens
  light chain complementarity determining region 3 for antibody 54839
LQHNSYPYT

SEQ ID NO: 109678 - protein, 19 aa, Homo sapiens
  heavy chain complementarity determining region 3 for antibody 54839
ARGNDSLTGYYPHYYEMDV

SEQ ID NO: 109679 - protein, 9 aa, Homo sapiens
  light chain complementarity determining region 3 for antibody 54840
LQHNSYPYT

SEQ ID NO: 109680 - protein, 19 aa, Homo sapiens
  heavy chain complementarity determining region 3 for antibody 54840
ARGNDILAGYYPHYYEMDV

SEQ ID NO: 109681 - protein, 9 aa, Homo sapiens
  light chain complementarity determining region 3 for antibody 54841
LQHNSYPYT

SEQ ID NO: 109682 - protein, 13 aa, Homo sapiens
  heavy chain complementarity determining region 3 for antibody 54841
ARGGRYFDWLLYY

SEQ ID NO: 109683 - protein, 9 aa, Homo sapiens
  light chain complementarity determining region 3 for antibody 54842
LQHNSYPYT

SEQ ID NO: 109684 - protein, 14 aa, Homo sapiens
  heavy chain complementarity determining region 3 for antibody 54842
ARGGDYYYYYGMDV

SEQ ID NO: 109685 - protein, 9 aa, Homo sapiens
  light chain complementarity determining region 3 for antibody 54843
LQHNSYPYT

SEQ ID NO: 109686 - protein, 15 aa, Homo sapiens
  heavy chain complementarity determining region 3 for antibody 54843
ARESSSGLSYYGMDV

SEQ ID NO: 109687 - protein, 9 aa, Homo sapiens
  light chain complementarity determining region 3 for antibody 54844
LQHNSYPYT

SEQ ID NO: 109688 - protein, 17 aa, Homo sapiens
  heavy chain complementarity determining region 3 for antibody 54844
AREREEDLYYYYYGMDA

SEQ ID NO: 109689 - protein, 9 aa, Homo sapiens
  light chain complementarity determining region 3 for antibody 54845
LQHNSYPYT

SEQ ID NO: 109690 - protein, 17 aa, Homo sapiens
  heavy chain complementarity determining region 3 for antibody 54845
AREREEDLYYYSYGMDV

SEQ ID NO: 109691 - protein, 9 aa, Homo sapiens
  light chain complementarity determining region 3 for antibody 54846
LQHNSYPYT

SEQ ID NO: 109692 - protein, 11 aa, Homo sapiens
  heavy chain complementarity determining region 3 for antibody 54846
ARELERRYFDY

SEQ ID NO: 109693 - protein, 9 aa, Homo sapiens
  light chain complementarity determining region 3 for antibody 54847
LQHNSYPYT

SEQ ID NO: 109694 - protein, 15 aa, Homo sapiens
  heavy chain complementarity determining region 3 for antibody 54847
AREGDYYGSGSHLNY

SEQ ID NO: 109695 - protein, 9 aa, Homo sapiens
  light chain complementarity determining region 3 for antibody 54848
LQHNSYPYT

SEQ ID NO: 109696 - protein, 7 aa, Homo sapiens
  heavy chain complementarity determining region 3 for antibody 54848
ARDVGDY

SEQ ID NO: 109697 - protein, 9 aa, Homo sapiens
  light chain complementarity determining region 3 for antibody 54849
LQHNSYPYT

SEQ ID NO: 109698 - protein, 13 aa, Homo sapiens
  heavy chain complementarity determining region 3 for antibody 54849
ARDQGSGRDYFDY

SEQ ID NO: 109699 - protein, 9 aa, Homo sapiens
  light chain complementarity determining region 3 for antibody 54850
LQHNSYPYT

SEQ ID NO: 109700 - protein, 13 aa, Homo sapiens
  heavy chain complementarity determining region 3 for antibody 54850
ARDPLYGHDAFDI

SEQ ID NO: 109701 - protein, 9 aa, Homo sapiens
  light chain complementarity determining region 3 for antibody 54851
LQHNSYPYT

SEQ ID NO: 109702 - protein, 13 aa, Homo sapiens
  heavy chain complementarity determining region 3 for antibody 54851
ARDIVVPAAIIDY

SEQ ID NO: 109703 - protein, 9 aa, Homo sapiens
  light chain complementarity determining region 3 for antibody 54852
LQHNSYPYT

SEQ ID NO: 109704 - protein, 15 aa, Homo sapiens
  heavy chain complementarity determining region 3 for antibody 54852
ARDGPTGAFYWYFDL

SEQ ID NO: 109705 - protein, 9 aa, Homo sapiens
  light chain complementarity determining region 3 for antibody 54853
LQHNSYPYT

SEQ ID NO: 109706 - protein, 8 aa, Homo sapiens
  heavy chain complementarity determining region 3 for antibody 54853
ARDEGMDV

SEQ ID NO: 109707 - protein, 9 aa, Homo sapiens
  light chain complementarity determining region 3 for antibody 54854
LQHNSYPYT

SEQ ID NO: 109708 - protein, 8 aa, Homo sapiens
  heavy chain complementarity determining region 3 for antibody 54854
ARDDVMDV

SEQ ID NO: 109709 - protein, 9 aa, Homo sapiens
  light chain complementarity determining region 3 for antibody 54855
LQHNSYPYT

SEQ ID NO: 109710 - protein, 8 aa, Homo sapiens
  heavy chain complementarity determining region 3 for antibody 54855
ARDDGMDA

SEQ ID NO: 109711 - protein, 9 aa, Homo sapiens
  light chain complementarity determining region 3 for antibody 54856
LQHNSYPYT

SEQ ID NO: 109712 - protein, 8 aa, Homo sapiens
  heavy chain complementarity determining region 3 for antibody 54856
ARDDGMAV

SEQ ID NO: 109713 - protein, 9 aa, Homo sapiens
  light chain complementarity determining region 3 for antibody 54857
LQHNSYPYT

SEQ ID NO: 109714 - protein, 8 aa, Homo sapiens
  heavy chain complementarity determining region 3 for antibody 54857
ARDAGMDV

SEQ ID NO: 109715 - protein, 9 aa, Homo sapiens
  light chain complementarity determining region 3 for antibody 54858
LQHNSYPYT

SEQ ID NO: 109716 - protein, 8 aa, Homo sapiens
  heavy chain complementarity determining region 3 for antibody 54858
ARADGMDV

SEQ ID NO: 109717 - protein, 9 aa, Homo sapiens
  light chain complementarity determining region 3 for antibody 54859
LQHNSYPYT

SEQ ID NO: 109718 - protein, 8 aa, Homo sapiens
  heavy chain complementarity determining region 3 for antibody 54859
ANRNWRGY

SEQ ID NO: 109719 - protein, 9 aa, Homo sapiens
  light chain complementarity determining region 3 for antibody 54860
LQHNSYPYT

SEQ ID NO: 109720 - protein, 17 aa, Homo sapiens
  heavy chain complementarity determining region 3 for antibody 54860
AKDQWGLLLAYYYGMDV

SEQ ID NO: 109721 - protein, 9 aa, Homo sapiens
  light chain complementarity determining region 3 for antibody 54861
LQHNSYPYT

SEQ ID NO: 109722 - protein, 17 aa, Homo sapiens
  heavy chain complementarity determining region 3 for antibody 54861
AKDQWELLRAYYYGMDV

SEQ ID NO: 109723 - protein, 9 aa, Homo sapiens
  light chain complementarity determining region 3 for antibody 54862
LQHNSYPYT

SEQ ID NO: 109724 - protein, 17 aa, Homo sapiens
  heavy chain complementarity determining region 3 for antibody 54862
AKDQWELLLAYCYGMDV

SEQ ID NO: 109725 - protein, 9 aa, Homo sapiens
  light chain complementarity determining region 3 for antibody 54863
LQHNSYPYT

SEQ ID NO: 109726 - protein, 17 aa, Homo sapiens
  heavy chain complementarity determining region 3 for antibody 54863
AKDQWELLLASYYGMDV

SEQ ID NO: 109727 - protein, 9 aa, Homo sapiens
  light chain complementarity determining region 3 for antibody 54864
LQHNSYPYT

SEQ ID NO: 109728 - protein, 17 aa, Homo sapiens
  heavy chain complementarity determining region 3 for antibody 54864
AKDQWELLLACYYGMDV

SEQ ID NO: 109729 - protein, 9 aa, Homo sapiens
  light chain complementarity determining region 3 for antibody 54865
LQHNSYPYT

SEQ ID NO: 109730 - protein, 8 aa, Homo sapiens
  heavy chain complementarity determining region 3 for antibody 54865
AIDDGMDV

SEQ ID NO: 109731 - protein, 9 aa, Homo sapiens
  light chain complementarity determining region 3 for antibody 54866
LQHNSYPYN

SEQ ID NO: 109732 - protein, 8 aa, Homo sapiens
  heavy chain complementarity determining region 3 for antibody 54866
ARDDGMDV

SEQ ID NO: 109733 - protein, 9 aa, Homo sapiens
  light chain complementarity determining region 3 for antibody 54867
LQHNSYPWT

SEQ ID NO: 109734 - protein, 12 aa, Homo sapiens
  heavy chain complementarity determining region 3 for antibody 54867
TRHHTVGATSDY

SEQ ID NO: 109735 - protein, 9 aa, Homo sapiens
  light chain complementarity determining region 3 for antibody 54868
LQHNSYPWT

SEQ ID NO: 109736 - protein, 21 aa, Homo sapiens
  heavy chain complementarity determining region 3 for antibody 54868
ATEGSPPVVGATTDYFNGMDV

SEQ ID NO: 109737 - protein, 9 aa, Homo sapiens
  light chain complementarity determining region 3 for antibody 54869
LQHNSYPWT

SEQ ID NO: 109738 - protein, 22 aa, Homo sapiens
  heavy chain complementarity determining region 3 for antibody 54869
ARGDYDILTGYRGYYSYYGMDV

SEQ ID NO: 109739 - protein, 9 aa, Homo sapiens
  light chain complementarity determining region 3 for antibody 54870
LQHNSYPWT

SEQ ID NO: 109740 - protein, 6 aa, Homo sapiens
  heavy chain complementarity determining region 3 for antibody 54870
AREPDY

SEQ ID NO: 109741 - protein, 9 aa, Homo sapiens
  light chain complementarity determining region 3 for antibody 54871
LQHNSYPWT

SEQ ID NO: 109742 - protein, 19 aa, Homo sapiens
  heavy chain complementarity determining region 3 for antibody 54871
AREDSSSWYVEYYSYGMDV

SEQ ID NO: 109743 - protein, 9 aa, Homo sapiens
  light chain complementarity determining region 3 for antibody 54872
LQHNSYPWT

SEQ ID NO: 109744 - protein, 19 aa, Homo sapiens
  heavy chain complementarity determining region 3 for antibody 54872
AREDSSSGYVEYYYYGMDV

SEQ ID NO: 109745 - protein, 9 aa, Homo sapiens
  light chain complementarity determining region 3 for antibody 54873
LQHNSYPWT

SEQ ID NO: 109746 - protein, 19 aa, Homo sapiens
  heavy chain complementarity determining region 3 for antibody 54873
AREDSSRWYVEYYYYGMDV

SEQ ID NO: 109747 - protein, 9 aa, Homo sapiens
  light chain complementarity determining region 3 for antibody 54874
LQHNSYPWT

SEQ ID NO: 109748 - protein, 19 aa, Homo sapiens
  heavy chain complementarity determining region 3 for antibody 54874
AREDCSSWYVEYYYYGMDV

SEQ ID NO: 109749 - protein, 9 aa, Homo sapiens
  light chain complementarity determining region 3 for antibody 54875
LQHNSYPWT

SEQ ID NO: 109750 - protein, 6 aa, Homo sapiens
  heavy chain complementarity determining region 3 for antibody 54875
ARDTDY

SEQ ID NO: 109751 - protein, 9 aa, Homo sapiens
  light chain complementarity determining region 3 for antibody 54876
LQHNSYPWT

SEQ ID NO: 109752 - protein, 6 aa, Homo sapiens
  heavy chain complementarity determining region 3 for antibody 54876
ARDPAY

SEQ ID NO: 109753 - protein, 9 aa, Homo sapiens
  light chain complementarity determining region 3 for antibody 54877
LQHNSYPWT

SEQ ID NO: 109754 - protein, 6 aa, Homo sapiens
  heavy chain complementarity determining region 3 for antibody 54877
ARDLDY

SEQ ID NO: 109755 - protein, 9 aa, Homo sapiens
  light chain complementarity determining region 3 for antibody 54878
LQHNSYPWT

SEQ ID NO: 109756 - protein, 19 aa, Homo sapiens
  heavy chain complementarity determining region 3 for antibody 54878
ARDEYDILTGYYYYYGTDV

SEQ ID NO: 109757 - protein, 9 aa, Homo sapiens
  light chain complementarity determining region 3 for antibody 54879
LQHNSYPWT

SEQ ID NO: 109758 - protein, 18 aa, Homo sapiens
  heavy chain complementarity determining region 3 for antibody 54879
ARDEYDILTGYYYYGMDV

SEQ ID NO: 109759 - protein, 9 aa, Homo sapiens
  light chain complementarity determining region 3 for antibody 54880
LQHNSYPWT

SEQ ID NO: 109760 - protein, 19 aa, Homo sapiens
  heavy chain complementarity determining region 3 for antibody 54880
ARDDYDILTGHYYYSGMDV

SEQ ID NO: 109761 - protein, 9 aa, Homo sapiens
  light chain complementarity determining region 3 for antibody 54881
LQHNSYPWT

SEQ ID NO: 109762 - protein, 11 aa, Homo sapiens
  heavy chain complementarity determining region 3 for antibody 54881
ARASWGDAFDI

SEQ ID NO: 109763 - protein, 9 aa, Homo sapiens
  light chain complementarity determining region 3 for antibody 54882
LQHNSYPRT

SEQ ID NO: 109764 - protein, 16 aa, Homo sapiens
  heavy chain complementarity determining region 3 for antibody 54882
ASYYYGSGVQDYGMDV

SEQ ID NO: 109765 - protein, 9 aa, Homo sapiens
  light chain complementarity determining region 3 for antibody 54883
LQHNSYPRT

SEQ ID NO: 109766 - protein, 17 aa, Homo sapiens
  heavy chain complementarity determining region 3 for antibody 54883
AREYNDILTGYWGYFDY

SEQ ID NO: 109767 - protein, 9 aa, Homo sapiens
  light chain complementarity determining region 3 for antibody 54884
LQHNSYPRT

SEQ ID NO: 109768 - protein, 19 aa, Homo sapiens
  heavy chain complementarity determining region 3 for antibody 54884
AKDAGHYYDSSGYLNWFDH

SEQ ID NO: 109769 - protein, 9 aa, Homo sapiens
  light chain complementarity determining region 3 for antibody 54885
LQHNSYPRT

SEQ ID NO: 109770 - protein, 19 aa, Homo sapiens
  heavy chain complementarity determining region 3 for antibody 54885
AKDAGHYYDSSGCLNWFDH

SEQ ID NO: 109771 - protein, 10 aa, Homo sapiens
  light chain complementarity determining region 3 for antibody 54886
LQHNSYPPYT

SEQ ID NO: 109772 - protein, 18 aa, Homo sapiens
  heavy chain complementarity determining region 3 for antibody 54886
AKEGGGATLYYSYYGMDV

SEQ ID NO: 109773 - protein, 9 aa, Homo sapiens
  light chain complementarity determining region 3 for antibody 54887
LQHNSYPPT

SEQ ID NO: 109774 - protein, 8 aa, Homo sapiens
  heavy chain complementarity determining region 3 for antibody 54887
ARTGPLDY

SEQ ID NO: 109775 - protein, 9 aa, Homo sapiens
  light chain complementarity determining region 3 for antibody 54888
LQHNSYPPT

SEQ ID NO: 109776 - protein, 19 aa, Homo sapiens
  heavy chain complementarity determining region 3 for antibody 54888
ARDSITMVRGVSDYYGMDV

SEQ ID NO: 109777 - protein, 9 aa, Homo sapiens
  light chain complementarity determining region 3 for antibody 54889
LQHNSYPLT

SEQ ID NO: 109778 - protein, 22 aa, Homo sapiens
  heavy chain complementarity determining region 3 for antibody 54889
ERGDYDILTGYRGYYSYYGMDV

SEQ ID NO: 109779 - protein, 9 aa, Homo sapiens
  light chain complementarity determining region 3 for antibody 54890
LQHNSYPLT

SEQ ID NO: 109780 - protein, 22 aa, Homo sapiens
  heavy chain complementarity determining region 3 for antibody 54890
ARVDYDILTGYRGYYSYYGMDV

SEQ ID NO: 109781 - protein, 9 aa, Homo sapiens
  light chain complementarity determining region 3 for antibody 54891
LQHNSYPLT

SEQ ID NO: 109782 - protein, 22 aa, Homo sapiens
  heavy chain complementarity determining region 3 for antibody 54891
ARGDYDVLTGYRGYDSYYGMDV

SEQ ID NO: 109783 - protein, 9 aa, Homo sapiens
  light chain complementarity determining region 3 for antibody 54892
LQHNSYPLT

SEQ ID NO: 109784 - protein, 22 aa, Homo sapiens
  heavy chain complementarity determining region 3 for antibody 54892
ARGDYDMLTGDRGYYSYYGMDV

SEQ ID NO: 109785 - protein, 9 aa, Homo sapiens
  light chain complementarity determining region 3 for antibody 54893
LQHNSYPLT

SEQ ID NO: 109786 - protein, 22 aa, Homo sapiens
  heavy chain complementarity determining region 3 for antibody 54893
ARGDYDILTGYRGYYSYCGMDV

SEQ ID NO: 109787 - protein, 9 aa, Homo sapiens
  light chain complementarity determining region 3 for antibody 54894
LQHNSYPLT

SEQ ID NO: 109788 - protein, 22 aa, Homo sapiens
  heavy chain complementarity determining region 3 for antibody 54894
ARGDYDILTGYRGYSAYYGMDV

SEQ ID NO: 109789 - protein, 9 aa, Homo sapiens
  light chain complementarity determining region 3 for antibody 54895
LQHNSYPLT

SEQ ID NO: 109790 - protein, 22 aa, Homo sapiens
  heavy chain complementarity determining region 3 for antibody 54895
ARGDYDILTGYRGYDSYYGMDV

SEQ ID NO: 109791 - protein, 9 aa, Homo sapiens
  light chain complementarity determining region 3 for antibody 54896
LQHNSYPLT

SEQ ID NO: 109792 - protein, 22 aa, Homo sapiens
  heavy chain complementarity determining region 3 for antibody 54896
ARGDYDILTGYRGHYSYYGMDV

SEQ ID NO: 109793 - protein, 9 aa, Homo sapiens
  light chain complementarity determining region 3 for antibody 54897
LQHNSYPLT

SEQ ID NO: 109794 - protein, 22 aa, Homo sapiens
  heavy chain complementarity determining region 3 for antibody 54897
ARGDYDILTGYRGHHSYYGMDV

SEQ ID NO: 109795 - protein, 9 aa, Homo sapiens
  light chain complementarity determining region 3 for antibody 54898
LQHNSYPLT

SEQ ID NO: 109796 - protein, 22 aa, Homo sapiens
  heavy chain complementarity determining region 3 for antibody 54898
ARGDYDILTGYPGYYSYYGMDV

SEQ ID NO: 109797 - protein, 9 aa, Homo sapiens
  light chain complementarity determining region 3 for antibody 54899
LQHNSYPLT

SEQ ID NO: 109798 - protein, 22 aa, Homo sapiens
  heavy chain complementarity determining region 3 for antibody 54899
ARGDYDILTDYRGYYSYYGMDV

SEQ ID NO: 109799 - protein, 9 aa, Homo sapiens
  light chain complementarity determining region 3 for antibody 54900
LQHNSYPLT

SEQ ID NO: 109800 - protein, 22 aa, Homo sapiens
  heavy chain complementarity determining region 3 for antibody 54900
ARGDYDILTCYRGYYSYYGMDV

SEQ ID NO: 109801 - protein, 9 aa, Homo sapiens
  light chain complementarity determining region 3 for antibody 54901
LQHNSYPLT

SEQ ID NO: 109802 - protein, 22 aa, Homo sapiens
  heavy chain complementarity determining region 3 for antibody 54901
ARGDYDILAGDRGYYSYYGMDV

SEQ ID NO: 109803 - protein, 9 aa, Homo sapiens
  light chain complementarity determining region 3 for antibody 54902
LQHNSYPLT

SEQ ID NO: 109804 - protein, 17 aa, Homo sapiens
  heavy chain complementarity determining region 3 for antibody 54902
AREWGVRGVIISNSFDY

SEQ ID NO: 109805 - protein, 9 aa, Homo sapiens
  light chain complementarity determining region 3 for antibody 54903
LQHNSYPLT

SEQ ID NO: 109806 - protein, 19 aa, Homo sapiens
  heavy chain complementarity determining region 3 for antibody 54903
ARDSSYYDILTGSPYGMDV

SEQ ID NO: 109807 - protein, 9 aa, Homo sapiens
  light chain complementarity determining region 3 for antibody 54904
LQHNSYPLT

SEQ ID NO: 109808 - protein, 6 aa, Homo sapiens
  heavy chain complementarity determining region 3 for antibody 54904
ARDPDY

SEQ ID NO: 109809 - protein, 9 aa, Homo sapiens
  light chain complementarity determining region 3 for antibody 54905
LQHNSYPLT

SEQ ID NO: 109810 - protein, 11 aa, Homo sapiens
  heavy chain complementarity determining region 3 for antibody 54905
ARDMVRGVIDY

SEQ ID NO: 109811 - protein, 9 aa, Homo sapiens
  light chain complementarity determining region 3 for antibody 54906
LQHNSYPLT

SEQ ID NO: 109812 - protein, 16 aa, Homo sapiens
  heavy chain complementarity determining region 3 for antibody 54906
ARDIDYGSGSYYAFDI

SEQ ID NO: 109813 - protein, 9 aa, Homo sapiens
  light chain complementarity determining region 3 for antibody 54907
LQHNSYPLT

SEQ ID NO: 109814 - protein, 19 aa, Homo sapiens
  heavy chain complementarity determining region 3 for antibody 54907
ARDHDILTGYYRDYYGMDV

SEQ ID NO: 109815 - protein, 9 aa, Homo sapiens
  light chain complementarity determining region 3 for antibody 54908
LQHNSYPLT

SEQ ID NO: 109816 - protein, 13 aa, Homo sapiens
  heavy chain complementarity determining region 3 for antibody 54908
ARARIAVAAPFDY

SEQ ID NO: 109817 - protein, 9 aa, Homo sapiens
  light chain complementarity determining region 3 for antibody 54909
LQHNSYPLT

SEQ ID NO: 109818 - protein, 14 aa, Homo sapiens
  heavy chain complementarity determining region 3 for antibody 54909
ARAGTTGTSYGMDV

SEQ ID NO: 109819 - protein, 9 aa, Homo sapiens
  light chain complementarity determining region 3 for antibody 54910
LQHNSYPHT

SEQ ID NO: 109820 - protein, 17 aa, Homo sapiens
  heavy chain complementarity determining region 3 for antibody 54910
AREYNDILTGYWGYFDY

SEQ ID NO: 109821 - protein, 9 aa, Homo sapiens
  light chain complementarity determining region 3 for antibody 54911
LQHNSYPHT

SEQ ID NO: 109822 - protein, 19 aa, Homo sapiens
  heavy chain complementarity determining region 3 for antibody 54911
ARDHEIVTGYYRDYYGMDV

SEQ ID NO: 109823 - protein, 9 aa, Homo sapiens
  light chain complementarity determining region 3 for antibody 54912
LQHNSYPHT

SEQ ID NO: 109824 - protein, 19 aa, Homo sapiens
  heavy chain complementarity determining region 3 for antibody 54912
ARDHEILTGYYRDYYGMDV

SEQ ID NO: 109825 - protein, 9 aa, Homo sapiens
  light chain complementarity determining region 3 for antibody 54913
LQHNSYPHT

SEQ ID NO: 109826 - protein, 19 aa, Homo sapiens
  heavy chain complementarity determining region 3 for antibody 54913
ARDHDILTGYYSDYYGMDV

SEQ ID NO: 109827 - protein, 9 aa, Homo sapiens
  light chain complementarity determining region 3 for antibody 54914
LQHNSYPHT

SEQ ID NO: 109828 - protein, 19 aa, Homo sapiens
  heavy chain complementarity determining region 3 for antibody 54914
ARDHDILTGYYRDYDGMDV

SEQ ID NO: 109829 - protein, 9 aa, Homo sapiens
  light chain complementarity determining region 3 for antibody 54915
LQHNSYPHT

SEQ ID NO: 109830 - protein, 19 aa, Homo sapiens
  heavy chain complementarity determining region 3 for antibody 54915
ARDHDILTGYYRDSYGMDV

SEQ ID NO: 109831 - protein, 9 aa, Homo sapiens
  light chain complementarity determining region 3 for antibody 54916
LQHNSYPHT

SEQ ID NO: 109832 - protein, 19 aa, Homo sapiens
  heavy chain complementarity determining region 3 for antibody 54916
ARDDDILTGYYRDYYGMDV

SEQ ID NO: 109833 - protein, 9 aa, Homo sapiens
  light chain complementarity determining region 3 for antibody 54917
LQHNSYPFT

SEQ ID NO: 109834 - protein, 15 aa, Homo sapiens
  heavy chain complementarity determining region 3 for antibody 54917
SRDGPTGAFYWYFDL

SEQ ID NO: 109835 - protein, 9 aa, Homo sapiens
  light chain complementarity determining region 3 for antibody 54918
LQHNSYPFT

SEQ ID NO: 109836 - protein, 15 aa, Homo sapiens
  heavy chain complementarity determining region 3 for antibody 54918
ERDGPTGAFYWYFDL

SEQ ID NO: 109837 - protein, 9 aa, Homo sapiens
  light chain complementarity determining region 3 for antibody 54919
LQHNSYPFT

SEQ ID NO: 109838 - protein, 14 aa, Homo sapiens
  heavy chain complementarity determining region 3 for antibody 54919
ARDRESSGYYLFDY

SEQ ID NO: 109839 - protein, 9 aa, Homo sapiens
  light chain complementarity determining region 3 for antibody 54920
LQHNSYPFT

SEQ ID NO: 109840 - protein, 14 aa, Homo sapiens
  heavy chain complementarity determining region 3 for antibody 54920
ARDRDSSGYYRFDY

SEQ ID NO: 109841 - protein, 9 aa, Homo sapiens
  light chain complementarity determining region 3 for antibody 54921
LQHNSYPFT

SEQ ID NO: 109842 - protein, 15 aa, Homo sapiens
  heavy chain complementarity determining region 3 for antibody 54921
ARDGPTGAFYWDFDL

SEQ ID NO: 109843 - protein, 9 aa, Homo sapiens
  light chain complementarity determining region 3 for antibody 54922
LQHNSYPFT

SEQ ID NO: 109844 - protein, 15 aa, Homo sapiens
  heavy chain complementarity determining region 3 for antibody 54922
ARDGPSGAFYWYFDL

SEQ ID NO: 109845 - protein, 9 aa, Homo sapiens
  light chain complementarity determining region 3 for antibody 54923
LQHNSYPFT

SEQ ID NO: 109846 - protein, 15 aa, Homo sapiens
  heavy chain complementarity determining region 3 for antibody 54923
ARDGPPGAFYWSFDL

SEQ ID NO: 109847 - protein, 9 aa, Homo sapiens
  light chain complementarity determining region 3 for antibody 54924
LQHNSYPFT

SEQ ID NO: 109848 - protein, 15 aa, Homo sapiens
  heavy chain complementarity determining region 3 for antibody 54924
AGDGPTGAFYWYFDL

SEQ ID NO: 109849 - protein, 9 aa, Homo sapiens
  light chain complementarity determining region 3 for antibody 54925
LQHNSYLYT

SEQ ID NO: 109850 - protein, 8 aa, Homo sapiens
  heavy chain complementarity determining region 3 for antibody 54925
ARDDGMDV

SEQ ID NO: 109851 - protein, 9 aa, Homo sapiens
  light chain complementarity determining region 3 for antibody 54926
LQHNGYPYT

SEQ ID NO: 109852 - protein, 17 aa, Homo sapiens
  heavy chain complementarity determining region 3 for antibody 54926
AKDQWELLLAYYYGMDV

SEQ ID NO: 109853 - protein, 9 aa, Homo sapiens
  light chain complementarity determining region 3 for antibody 54927
LQHDTYPWT

SEQ ID NO: 109854 - protein, 14 aa, Homo sapiens
  heavy chain complementarity determining region 3 for antibody 54927
ARDREFLWFGELLP

SEQ ID NO: 109855 - protein, 9 aa, Homo sapiens
  light chain complementarity determining region 3 for antibody 54928
LQHDSYPWT

SEQ ID NO: 109856 - protein, 19 aa, Homo sapiens
  heavy chain complementarity determining region 3 for antibody 54928
AREDSSSWYVEYYYYGMDV

SEQ ID NO: 109857 - protein, 9 aa, Homo sapiens
  light chain complementarity determining region 3 for antibody 54929
LQHDNFPYT

SEQ ID NO: 109858 - protein, 13 aa, Homo sapiens
  heavy chain complementarity determining region 3 for antibody 54929
ARGRYCASYGMDV

SEQ ID NO: 109859 - protein, 9 aa, Homo sapiens
  light chain complementarity determining region 3 for antibody 54930
LQHDNFPYT

SEQ ID NO: 109860 - protein, 11 aa, Homo sapiens
  heavy chain complementarity determining region 3 for antibody 54930
ARGELWIGFDY

SEQ ID NO: 109861 - protein, 9 aa, Homo sapiens
  light chain complementarity determining region 3 for antibody 54931
LQHDNFPYT

SEQ ID NO: 109862 - protein, 11 aa, Homo sapiens
  heavy chain complementarity determining region 3 for antibody 54931
ARGELGNGFDY

SEQ ID NO: 109863 - protein, 9 aa, Homo sapiens
  light chain complementarity determining region 3 for antibody 54932
LQHDNFPYT

SEQ ID NO: 109864 - protein, 22 aa, Homo sapiens
  heavy chain complementarity determining region 3 for antibody 54932
ARGDYDILTGYRGYYSYYGMDV

SEQ ID NO: 109865 - protein, 9 aa, Homo sapiens
  light chain complementarity determining region 3 for antibody 54933
LQHDNFPYT

SEQ ID NO: 109866 - protein, 17 aa, Homo sapiens
  heavy chain complementarity determining region 3 for antibody 54933
AREYNDILTGYWGYFDY

SEQ ID NO: 109867 - protein, 9 aa, Homo sapiens
  light chain complementarity determining region 3 for antibody 54934
LQHDNFPYT

SEQ ID NO: 109868 - protein, 7 aa, Homo sapiens
  heavy chain complementarity determining region 3 for antibody 54934
AREVGDY

SEQ ID NO: 109869 - protein, 9 aa, Homo sapiens
  light chain complementarity determining region 3 for antibody 54935
LQHDNFPYT

SEQ ID NO: 109870 - protein, 13 aa, Homo sapiens
  heavy chain complementarity determining region 3 for antibody 54935
ARERYFASYGMDD

SEQ ID NO: 109871 - protein, 9 aa, Homo sapiens
  light chain complementarity determining region 3 for antibody 54936
LQHDNFPYT

SEQ ID NO: 109872 - protein, 13 aa, Homo sapiens
  heavy chain complementarity determining region 3 for antibody 54936
ARERYFASYGMAV

SEQ ID NO: 109873 - protein, 9 aa, Homo sapiens
  light chain complementarity determining region 3 for antibody 54937
LQHDNFPYT

SEQ ID NO: 109874 - protein, 13 aa, Homo sapiens
  heavy chain complementarity determining region 3 for antibody 54937
ARERYFASYGIDV

SEQ ID NO: 109875 - protein, 9 aa, Homo sapiens
  light chain complementarity determining region 3 for antibody 54938
LQHDNFPYT

SEQ ID NO: 109876 - protein, 13 aa, Homo sapiens
  heavy chain complementarity determining region 3 for antibody 54938
ARERYFASCGMDV

SEQ ID NO: 109877 - protein, 9 aa, Homo sapiens
  light chain complementarity determining region 3 for antibody 54939
LQHDNFPYT

SEQ ID NO: 109878 - protein, 7 aa, Homo sapiens
  heavy chain complementarity determining region 3 for antibody 54939
ARDVVDY

SEQ ID NO: 109879 - protein, 9 aa, Homo sapiens
  light chain complementarity determining region 3 for antibody 54940
LQHDNFPYT

SEQ ID NO: 109880 - protein, 9 aa, Homo sapiens
  heavy chain complementarity determining region 3 for antibody 54940
ARDVGPFDY

SEQ ID NO: 109881 - protein, 9 aa, Homo sapiens
  light chain complementarity determining region 3 for antibody 54941
LQHDNFPYT

SEQ ID NO: 109882 - protein, 23 aa, Homo sapiens
  heavy chain complementarity determining region 3 for antibody 54941
ARDRYYYGSGSYPYYYYYYGMDV

SEQ ID NO: 109883 - protein, 9 aa, Homo sapiens
  light chain complementarity determining region 3 for antibody 54942
LQHDNFPYT

SEQ ID NO: 109884 - protein, 13 aa, Homo sapiens
  heavy chain complementarity determining region 3 for antibody 54942
ARDRYFASYGMDV

SEQ ID NO: 109885 - protein, 9 aa, Homo sapiens
  light chain complementarity determining region 3 for antibody 54943
LQHDNFPYT

SEQ ID NO: 109886 - protein, 14 aa, Homo sapiens
  heavy chain complementarity determining region 3 for antibody 54943
ARDLDTMVRGVFDY

SEQ ID NO: 109887 - protein, 9 aa, Homo sapiens
  light chain complementarity determining region 3 for antibody 54944
LQHDNFPYT

SEQ ID NO: 109888 - protein, 13 aa, Homo sapiens
  heavy chain complementarity determining region 3 for antibody 54944
ARDHVYSSSWPDY

SEQ ID NO: 109889 - protein, 9 aa, Homo sapiens
  light chain complementarity determining region 3 for antibody 54945
LQHDNFPYT

SEQ ID NO: 109890 - protein, 13 aa, Homo sapiens
  heavy chain complementarity determining region 3 for antibody 54945
ARDHGYSSSWTDY

SEQ ID NO: 109891 - protein, 9 aa, Homo sapiens
  light chain complementarity determining region 3 for antibody 54946
LQHDNFPYT

SEQ ID NO: 109892 - protein, 13 aa, Homo sapiens
  heavy chain complementarity determining region 3 for antibody 54946
ARDHGYSSSCTDY

SEQ ID NO: 109893 - protein, 9 aa, Homo sapiens
  light chain complementarity determining region 3 for antibody 54947
LQHDNFPYT

SEQ ID NO: 109894 - protein, 13 aa, Homo sapiens
  heavy chain complementarity determining region 3 for antibody 54947
ARDHGYSCSWPDY

SEQ ID NO: 109895 - protein, 9 aa, Homo sapiens
  light chain complementarity determining region 3 for antibody 54948
LQHDNFPWT

SEQ ID NO: 109896 - protein, 15 aa, Homo sapiens
  heavy chain complementarity determining region 3 for antibody 54948
ARPGTYDSYYYGMDV

SEQ ID NO: 109897 - protein, 9 aa, Homo sapiens
  light chain complementarity determining region 3 for antibody 54949
LQHDNFLWT

SEQ ID NO: 109898 - protein, 12 aa, Homo sapiens
  heavy chain complementarity determining region 3 for antibody 54949
AKEGPEPLYFDY

SEQ ID NO: 109899 - protein, 9 aa, Homo sapiens
  light chain complementarity determining region 3 for antibody 54950
LQGFTYPRT

SEQ ID NO: 109900 - protein, 21 aa, Homo sapiens
  heavy chain complementarity determining region 3 for antibody 54950
AREAAMVRGVPSADFYYGLDV

SEQ ID NO: 109901 - protein, 9 aa, Homo sapiens
  light chain complementarity determining region 3 for antibody 54951
LQDYNYPYT

SEQ ID NO: 109902 - protein, 10 aa, Homo sapiens
  heavy chain complementarity determining region 3 for antibody 54951
ARGKAAAGDY

SEQ ID NO: 109903 - protein, 9 aa, Homo sapiens
  light chain complementarity determining region 3 for antibody 54952
LQDYNYPYT

SEQ ID NO: 109904 - protein, 14 aa, Homo sapiens
  heavy chain complementarity determining region 3 for antibody 54952
ARGGYSSSWYGMDV

SEQ ID NO: 109905 - protein, 9 aa, Homo sapiens
  light chain complementarity determining region 3 for antibody 54953
LQDYNYPYT

SEQ ID NO: 109906 - protein, 17 aa, Homo sapiens
  heavy chain complementarity determining region 3 for antibody 54953
AREYNDILTGYWGYFDY

SEQ ID NO: 109907 - protein, 9 aa, Homo sapiens
  light chain complementarity determining region 3 for antibody 54954
LQDYNYPYT

SEQ ID NO: 109908 - protein, 17 aa, Homo sapiens
  heavy chain complementarity determining region 3 for antibody 54954
ARDVRYFDWSLDDAFDI

SEQ ID NO: 109909 - protein, 9 aa, Homo sapiens
  light chain complementarity determining region 3 for antibody 54955
LQDYNYPYT

SEQ ID NO: 109910 - protein, 17 aa, Homo sapiens
  heavy chain complementarity determining region 3 for antibody 54955
ARDRDYDILTVYSLFDY

SEQ ID NO: 109911 - protein, 9 aa, Homo sapiens
  light chain complementarity determining region 3 for antibody 54956
LQDYNYPYT

SEQ ID NO: 109912 - protein, 17 aa, Homo sapiens
  heavy chain complementarity determining region 3 for antibody 54956
ARDRDYDILTGYSPFDY

SEQ ID NO: 109913 - protein, 9 aa, Homo sapiens
  light chain complementarity determining region 3 for antibody 54957
LQDYNYPYT

SEQ ID NO: 109914 - protein, 17 aa, Homo sapiens
  heavy chain complementarity determining region 3 for antibody 54957
ARDRDDDILTGYSLFDY

SEQ ID NO: 109915 - protein, 9 aa, Homo sapiens
  light chain complementarity determining region 3 for antibody 54958
LQDYNYPYT

SEQ ID NO: 109916 - protein, 11 aa, Homo sapiens
  heavy chain complementarity determining region 3 for antibody 54958
ARDPYQPLRDY

SEQ ID NO: 109917 - protein, 9 aa, Homo sapiens
  light chain complementarity determining region 3 for antibody 54959
LQDYNYPYT

SEQ ID NO: 109918 - protein, 11 aa, Homo sapiens
  heavy chain complementarity determining region 3 for antibody 54959
ARDPSQPLGDY

SEQ ID NO: 109919 - protein, 9 aa, Homo sapiens
  light chain complementarity determining region 3 for antibody 54960
LQDYNYPYT

SEQ ID NO: 109920 - protein, 17 aa, Homo sapiens
  heavy chain complementarity determining region 3 for antibody 54960
ARDLRYFVWSLDDAFDI

SEQ ID NO: 109921 - protein, 9 aa, Homo sapiens
  light chain complementarity determining region 3 for antibody 54961
LQDYNYPYT

SEQ ID NO: 109922 - protein, 17 aa, Homo sapiens
  heavy chain complementarity determining region 3 for antibody 54961
ARDLRYFDWFLDDAFDI

SEQ ID NO: 109923 - protein, 9 aa, Homo sapiens
  light chain complementarity determining region 3 for antibody 54962
LQDYNYPYT

SEQ ID NO: 109924 - protein, 18 aa, Homo sapiens
  heavy chain complementarity determining region 3 for antibody 54962
ARDKGGSYYDYSYYGMDV

SEQ ID NO: 109925 - protein, 9 aa, Homo sapiens
  light chain complementarity determining region 3 for antibody 54963
LQDYNYPWT

SEQ ID NO: 109926 - protein, 15 aa, Homo sapiens
  heavy chain complementarity determining region 3 for antibody 54963
ARSRVGPYYYSGMDV

SEQ ID NO: 109927 - protein, 9 aa, Homo sapiens
  light chain complementarity determining region 3 for antibody 54964
LQDYNYPWT

SEQ ID NO: 109928 - protein, 15 aa, Homo sapiens
  heavy chain complementarity determining region 3 for antibody 54964
ARSRVGPYYSYGMDV

SEQ ID NO: 109929 - protein, 9 aa, Homo sapiens
  light chain complementarity determining region 3 for antibody 54965
LQDYNYPWT

SEQ ID NO: 109930 - protein, 15 aa, Homo sapiens
  heavy chain complementarity determining region 3 for antibody 54965
ARSRVGAYYYYGMDV

SEQ ID NO: 109931 - protein, 9 aa, Homo sapiens
  light chain complementarity determining region 3 for antibody 54966
LQDYNYPWT

SEQ ID NO: 109932 - protein, 15 aa, Homo sapiens
  heavy chain complementarity determining region 3 for antibody 54966
ARSGVGPYYYYGMDV

SEQ ID NO: 109933 - protein, 9 aa, Homo sapiens
  light chain complementarity determining region 3 for antibody 54967
LQDYNYPWT

SEQ ID NO: 109934 - protein, 15 aa, Homo sapiens
  heavy chain complementarity determining region 3 for antibody 54967
ARRRVGPYYYYGMDV

SEQ ID NO: 109935 - protein, 9 aa, Homo sapiens
  light chain complementarity determining region 3 for antibody 54968
LQDYNYPWT

SEQ ID NO: 109936 - protein, 18 aa, Homo sapiens
  heavy chain complementarity determining region 3 for antibody 54968
ARRRGAKADYYYYYGTDV

SEQ ID NO: 109937 - protein, 9 aa, Homo sapiens
  light chain complementarity determining region 3 for antibody 54969
LQDYNYPWT

SEQ ID NO: 109938 - protein, 11 aa, Homo sapiens
  heavy chain complementarity determining region 3 for antibody 54969
ARQRWSEGMDV

SEQ ID NO: 109939 - protein, 9 aa, Homo sapiens
  light chain complementarity determining region 3 for antibody 54970
LQDYNYPWT

SEQ ID NO: 109940 - protein, 14 aa, Homo sapiens
  heavy chain complementarity determining region 3 for antibody 54970
ARGGTTGTSYGMDV

SEQ ID NO: 109941 - protein, 9 aa, Homo sapiens
  light chain complementarity determining region 3 for antibody 54971
LQDYNYPWT

SEQ ID NO: 109942 - protein, 19 aa, Homo sapiens
  heavy chain complementarity determining region 3 for antibody 54971
AREGGVRGVPYYYYYGMDV

SEQ ID NO: 109943 - protein, 9 aa, Homo sapiens
  light chain complementarity determining region 3 for antibody 54972
LQDYNYPWT

SEQ ID NO: 109944 - protein, 15 aa, Homo sapiens
  heavy chain complementarity determining region 3 for antibody 54972
AREGGPNYYYYGMDV

SEQ ID NO: 109945 - protein, 9 aa, Homo sapiens
  light chain complementarity determining region 3 for antibody 54973
LQDYNYPWT

SEQ ID NO: 109946 - protein, 13 aa, Homo sapiens
  heavy chain complementarity determining region 3 for antibody 54973
AREEVTEGRYFDY

SEQ ID NO: 109947 - protein, 9 aa, Homo sapiens
  light chain complementarity determining region 3 for antibody 54974
LQDYNYPWT

SEQ ID NO: 109948 - protein, 13 aa, Homo sapiens
  heavy chain complementarity determining region 3 for antibody 54974
AREEVTEGLDFDY

SEQ ID NO: 109949 - protein, 9 aa, Homo sapiens
  light chain complementarity determining region 3 for antibody 54975
LQDYNYPWT

SEQ ID NO: 109950 - protein, 16 aa, Homo sapiens
  heavy chain complementarity determining region 3 for antibody 54975
ARDPPRIAAAGTPFDY

SEQ ID NO: 109951 - protein, 9 aa, Homo sapiens
  light chain complementarity determining region 3 for antibody 54976
LQDYNYPWT

SEQ ID NO: 109952 - protein, 15 aa, Homo sapiens
  heavy chain complementarity determining region 3 for antibody 54976
ARDGPTGAFYWYFDL

SEQ ID NO: 109953 - protein, 9 aa, Homo sapiens
  light chain complementarity determining region 3 for antibody 54977
LQDYNYPWT

SEQ ID NO: 109954 - protein, 19 aa, Homo sapiens
  heavy chain complementarity determining region 3 for antibody 54977
ARDGGVRGVPYYYSYGMDV

SEQ ID NO: 109955 - protein, 9 aa, Homo sapiens
  light chain complementarity determining region 3 for antibody 54978
LQDYNYPWT

SEQ ID NO: 109956 - protein, 14 aa, Homo sapiens
  heavy chain complementarity determining region 3 for antibody 54978
ARAVAAITGWYFDL

SEQ ID NO: 109957 - protein, 9 aa, Homo sapiens
  light chain complementarity determining region 3 for antibody 54979
LQDYNYPWT

SEQ ID NO: 109958 - protein, 13 aa, Homo sapiens
  heavy chain complementarity determining region 3 for antibody 54979
ARAGYSVSYLFDY

SEQ ID NO: 109959 - protein, 9 aa, Homo sapiens
  light chain complementarity determining region 3 for antibody 54980
LQDYNYPWT

SEQ ID NO: 109960 - protein, 13 aa, Homo sapiens
  heavy chain complementarity determining region 3 for antibody 54980
ARAGYSGSYRFDY

SEQ ID NO: 109961 - protein, 9 aa, Homo sapiens
  light chain complementarity determining region 3 for antibody 54981
LQDYNYPWT

SEQ ID NO: 109962 - protein, 14 aa, Homo sapiens
  heavy chain complementarity determining region 3 for antibody 54981
ARAGTTGPSYGMDV

SEQ ID NO: 109963 - protein, 9 aa, Homo sapiens
  light chain complementarity determining region 3 for antibody 54982
LQDYNYPWT

SEQ ID NO: 109964 - protein, 14 aa, Homo sapiens
  heavy chain complementarity determining region 3 for antibody 54982
ARAGTTGASYGMDV

SEQ ID NO: 109965 - protein, 9 aa, Homo sapiens
  light chain complementarity determining region 3 for antibody 54983
LQDYNYPWT

SEQ ID NO: 109966 - protein, 18 aa, Homo sapiens
  heavy chain complementarity determining region 3 for antibody 54983
AGRRGAKADYYYYYGMDV

SEQ ID NO: 109967 - protein, 9 aa, Homo sapiens
  light chain complementarity determining region 3 for antibody 54984
LQDYNYPRT

SEQ ID NO: 109968 - protein, 11 aa, Homo sapiens
  heavy chain complementarity determining region 3 for antibody 54984
TRETLERGFDY

SEQ ID NO: 109969 - protein, 9 aa, Homo sapiens
  light chain complementarity determining region 3 for antibody 54985
LQDYNYPRT

SEQ ID NO: 109970 - protein, 12 aa, Homo sapiens
  heavy chain complementarity determining region 3 for antibody 54985
TLDLGISGCFDP

SEQ ID NO: 109971 - protein, 9 aa, Homo sapiens
  light chain complementarity determining region 3 for antibody 54986
LQDYNYPRT

SEQ ID NO: 109972 - protein, 13 aa, Homo sapiens
  heavy chain complementarity determining region 3 for antibody 54986
ATDPGSGEGAFDI

SEQ ID NO: 109973 - protein, 9 aa, Homo sapiens
  light chain complementarity determining region 3 for antibody 54987
LQDYNYPRT

SEQ ID NO: 109974 - protein, 12 aa, Homo sapiens
  heavy chain complementarity determining region 3 for antibody 54987
ASEIAVTGPFDY

SEQ ID NO: 109975 - protein, 9 aa, Homo sapiens
  light chain complementarity determining region 3 for antibody 54988
LQDYNYPRT

SEQ ID NO: 109976 - protein, 16 aa, Homo sapiens
  heavy chain complementarity determining region 3 for antibody 54988
ARVPYYYGSGSDAFDI

SEQ ID NO: 109977 - protein, 9 aa, Homo sapiens
  light chain complementarity determining region 3 for antibody 54989
LQDYNYPRT

SEQ ID NO: 109978 - protein, 17 aa, Homo sapiens
  heavy chain complementarity determining region 3 for antibody 54989
ARLVLRYSDWLLPHFDY

SEQ ID NO: 109979 - protein, 9 aa, Homo sapiens
  light chain complementarity determining region 3 for antibody 54990
LQDYNYPRT

SEQ ID NO: 109980 - protein, 9 aa, Homo sapiens
  heavy chain complementarity determining region 3 for antibody 54990
ARKRWYFDL

SEQ ID NO: 109981 - protein, 9 aa, Homo sapiens
  light chain complementarity determining region 3 for antibody 54991
LQDYNYPRT

SEQ ID NO: 109982 - protein, 22 aa, Homo sapiens
  heavy chain complementarity determining region 3 for antibody 54991
ARGDYDILTGYRGYYSYYGMDV

SEQ ID NO: 109983 - protein, 9 aa, Homo sapiens
  light chain complementarity determining region 3 for antibody 54992
LQDYNYPRT

SEQ ID NO: 109984 - protein, 16 aa, Homo sapiens
  heavy chain complementarity determining region 3 for antibody 54992
ARERGGILTGYSPFQH

SEQ ID NO: 109985 - protein, 9 aa, Homo sapiens
  light chain complementarity determining region 3 for antibody 54993
LQDYNYPRT

SEQ ID NO: 109986 - protein, 16 aa, Homo sapiens
  heavy chain complementarity determining region 3 for antibody 54993
ARERGGILTGYSPFHH

SEQ ID NO: 109987 - protein, 9 aa, Homo sapiens
  light chain complementarity determining region 3 for antibody 54994
LQDYNYPRT

SEQ ID NO: 109988 - protein, 19 aa, Homo sapiens
  heavy chain complementarity determining region 3 for antibody 54994
ARERDWGSLYYYYYYGMDV

SEQ ID NO: 109989 - protein, 9 aa, Homo sapiens
  light chain complementarity determining region 3 for antibody 54995
LQDYNYPRT

SEQ ID NO: 109990 - protein, 12 aa, Homo sapiens
  heavy chain complementarity determining region 3 for antibody 54995
AREIAVPGPFDY

SEQ ID NO: 109991 - protein, 9 aa, Homo sapiens
  light chain complementarity determining region 3 for antibody 54996
LQDYNYPRT

SEQ ID NO: 109992 - protein, 18 aa, Homo sapiens
  heavy chain complementarity determining region 3 for antibody 54996
AKDRAVARGGYYYYGMDV

SEQ ID NO: 109993 - protein, 9 aa, Homo sapiens
  light chain complementarity determining region 3 for antibody 54997
LQDYNYPRT

SEQ ID NO: 109994 - protein, 16 aa, Homo sapiens
  heavy chain complementarity determining region 3 for antibody 54997
AGVPYYYGSGSYAFDI

SEQ ID NO: 109995 - protein, 9 aa, Homo sapiens
  light chain complementarity determining region 3 for antibody 54998
LQDYNYPRT

SEQ ID NO: 109996 - protein, 16 aa, Homo sapiens
  heavy chain complementarity determining region 3 for antibody 54998
AGERGGILTGYSHFQH

SEQ ID NO: 109997 - protein, 9 aa, Homo sapiens
  light chain complementarity determining region 3 for antibody 54999
LQDYNYPRT

SEQ ID NO: 109998 - protein, 16 aa, Homo sapiens
  heavy chain complementarity determining region 3 for antibody 54999
AGEGLRYFDWEGYFDL

SEQ ID NO: 109999 - protein, 9 aa, Homo sapiens
  light chain complementarity determining region 3 for antibody 55000
LQDYNYPRA

SEQ ID NO: 110000 - protein, 20 aa, Homo sapiens
  heavy chain complementarity determining region 3 for antibody 55000
AKDQGEIVATIMDYYYGMDV

SEQ ID NO: 110001 - protein, 9 aa, Homo sapiens
  light chain complementarity determining region 3 for antibody 55001
LQDYNYPLT

SEQ ID NO: 110002 - protein, 14 aa, Homo sapiens
  heavy chain complementarity determining region 3 for antibody 55001
ARSKDSWLVYSFDY

SEQ ID NO: 110003 - protein, 9 aa, Homo sapiens
  light chain complementarity determining region 3 for antibody 55002
LQDYNYPLT

SEQ ID NO: 110004 - protein, 12 aa, Homo sapiens
  heavy chain complementarity determining region 3 for antibody 55002
ARHHIVGATGDY

SEQ ID NO: 110005 - protein, 9 aa, Homo sapiens
  light chain complementarity determining region 3 for antibody 55003
LQDYNYPIT

SEQ ID NO: 110006 - protein, 18 aa, Homo sapiens
  heavy chain complementarity determining region 3 for antibody 55003
ARAPVLRYFDWLGGDFDY

SEQ ID NO: 110007 - protein, 9 aa, Homo sapiens
  light chain complementarity determining region 3 for antibody 55004
LQDYNYPHT

SEQ ID NO: 110008 - protein, 12 aa, Homo sapiens
  heavy chain complementarity determining region 3 for antibody 55004
ARDNDILTGSDY

SEQ ID NO: 110009 - protein, 9 aa, Homo sapiens
  light chain complementarity determining region 3 for antibody 55005
LQDYNYPHT

SEQ ID NO: 110010 - protein, 13 aa, Homo sapiens
  heavy chain complementarity determining region 3 for antibody 55005
AADYGDYQYYFDY

SEQ ID NO: 110011 - protein, 9 aa, Homo sapiens
  light chain complementarity determining region 3 for antibody 55006
LQDYNYPFT

SEQ ID NO: 110012 - protein, 8 aa, Homo sapiens
  heavy chain complementarity determining region 3 for antibody 55006
ARTGPLDY

SEQ ID NO: 110013 - protein, 9 aa, Homo sapiens
  light chain complementarity determining region 3 for antibody 55007
LQDYNYPFT

SEQ ID NO: 110014 - protein, 15 aa, Homo sapiens
  heavy chain complementarity determining region 3 for antibody 55007
AREGDYYGSWSHLNY

SEQ ID NO: 110015 - protein, 9 aa, Homo sapiens
  light chain complementarity determining region 3 for antibody 55008
LQDYNYPFT

SEQ ID NO: 110016 - protein, 15 aa, Homo sapiens
  heavy chain complementarity determining region 3 for antibody 55008
AREGDYYGSGSRLNY

SEQ ID NO: 110017 - protein, 9 aa, Homo sapiens
  light chain complementarity determining region 3 for antibody 55009
LQDYNYPFT

SEQ ID NO: 110018 - protein, 15 aa, Homo sapiens
  heavy chain complementarity determining region 3 for antibody 55009
AREGDYYGSGSHLTY

SEQ ID NO: 110019 - protein, 9 aa, Homo sapiens
  light chain complementarity determining region 3 for antibody 55010
LQDYNYPFT

SEQ ID NO: 110020 - protein, 15 aa, Homo sapiens
  heavy chain complementarity determining region 3 for antibody 55010
AREGDYYGSGSHLDY

SEQ ID NO: 110021 - protein, 9 aa, Homo sapiens
  light chain complementarity determining region 3 for antibody 55011
LQDYNYPFT

SEQ ID NO: 110022 - protein, 15 aa, Homo sapiens
  heavy chain complementarity determining region 3 for antibody 55011
AREGDYYGSGSDLNY

SEQ ID NO: 110023 - protein, 9 aa, Homo sapiens
  light chain complementarity determining region 3 for antibody 55012
LQDYNYPFT

SEQ ID NO: 110024 - protein, 15 aa, Homo sapiens
  heavy chain complementarity determining region 3 for antibody 55012
AREGDYYGSGRHLNY

SEQ ID NO: 110025 - protein, 9 aa, Homo sapiens
  light chain complementarity determining region 3 for antibody 55013
LQDYNYPFT

SEQ ID NO: 110026 - protein, 15 aa, Homo sapiens
  heavy chain complementarity determining region 3 for antibody 55013
AREGDYYGAGSHLNY

SEQ ID NO: 110027 - protein, 9 aa, Homo sapiens
  light chain complementarity determining region 3 for antibody 55014
LQDYNYPFT

SEQ ID NO: 110028 - protein, 14 aa, Homo sapiens
  heavy chain complementarity determining region 3 for antibody 55014
ARDTGYTSGWHFDY

SEQ ID NO: 110029 - protein, 9 aa, Homo sapiens
  light chain complementarity determining region 3 for antibody 55015
LQDYNYPFT

SEQ ID NO: 110030 - protein, 16 aa, Homo sapiens
  heavy chain complementarity determining region 3 for antibody 55015
ARDRPATSIDYYGMDV

SEQ ID NO: 110031 - protein, 9 aa, Homo sapiens
  light chain complementarity determining region 3 for antibody 55016
LQDYNYPFT

SEQ ID NO: 110032 - protein, 20 aa, Homo sapiens
  heavy chain complementarity determining region 3 for antibody 55016
ARDRLAMVRGVIITPGAFDI

SEQ ID NO: 110033 - protein, 9 aa, Homo sapiens
  light chain complementarity determining region 3 for antibody 55017
LQDYNYPFT

SEQ ID NO: 110034 - protein, 14 aa, Homo sapiens
  heavy chain complementarity determining region 3 for antibody 55017
ARDNGYTRGWHFDY

SEQ ID NO: 110035 - protein, 9 aa, Homo sapiens
  light chain complementarity determining region 3 for antibody 55018
LQDYNYPFT

SEQ ID NO: 110036 - protein, 15 aa, Homo sapiens
  heavy chain complementarity determining region 3 for antibody 55018
ARAPPHYDILTGYDY

SEQ ID NO: 110037 - protein, 9 aa, Homo sapiens
  light chain complementarity determining region 3 for antibody 55019
LQDYNCPWT

SEQ ID NO: 110038 - protein, 15 aa, Homo sapiens
  heavy chain complementarity determining region 3 for antibody 55019
ARSRVGPYYYYGMDV

SEQ ID NO: 110039 - protein, 9 aa, Homo sapiens
  light chain complementarity determining region 3 for antibody 55020
LQDYLYPPT

SEQ ID NO: 110040 - protein, 15 aa, Homo sapiens
  heavy chain complementarity determining region 3 for antibody 55020
ARDRWYSGRSYGMDV

SEQ ID NO: 110041 - protein, 9 aa, Homo sapiens
  light chain complementarity determining region 3 for antibody 55021
LQDYFYPPI

SEQ ID NO: 110042 - protein, 15 aa, Homo sapiens
  heavy chain complementarity determining region 3 for antibody 55021
ARDVWYSGGSYGMDV

SEQ ID NO: 110043 - protein, 9 aa, Homo sapiens
  light chain complementarity determining region 3 for antibody 55022
LQDNNYPLT

SEQ ID NO: 110044 - protein, 12 aa, Homo sapiens
  heavy chain complementarity determining region 3 for antibody 55022
ARDIGSYSGFDY

SEQ ID NO: 110045 - protein, 9 aa, Homo sapiens
  light chain complementarity determining region 3 for antibody 55023
LQDNNYPLT

SEQ ID NO: 110046 - protein, 12 aa, Homo sapiens
  heavy chain complementarity determining region 3 for antibody 55023
ARDIGSSLGFDY

SEQ ID NO: 110047 - protein, 8 aa, Homo sapiens
  light chain complementarity determining region 3 for antibody 55024
HQSSSLWT

SEQ ID NO: 110048 - protein, 15 aa, Homo sapiens
  heavy chain complementarity determining region 3 for antibody 55024
AREGDYYGSGSYLDP

SEQ ID NO: 110049 - protein, 9 aa, Homo sapiens
  light chain complementarity determining region 3 for antibody 55025
HQSSSLPYT

SEQ ID NO: 110050 - protein, 9 aa, Homo sapiens
  heavy chain complementarity determining region 3 for antibody 55025
ASKRWYFDL

SEQ ID NO: 110051 - protein, 9 aa, Homo sapiens
  light chain complementarity determining region 3 for antibody 55026
HQSSSLPYT

SEQ ID NO: 110052 - protein, 9 aa, Homo sapiens
  heavy chain complementarity determining region 3 for antibody 55026
ARNRWYFDL

SEQ ID NO: 110053 - protein, 9 aa, Homo sapiens
  light chain complementarity determining region 3 for antibody 55027
HQSSSLPYT

SEQ ID NO: 110054 - protein, 13 aa, Homo sapiens
  heavy chain complementarity determining region 3 for antibody 55027
ARKVRITMVRGAP

SEQ ID NO: 110055 - protein, 9 aa, Homo sapiens
  light chain complementarity determining region 3 for antibody 55028
HQSSSLPYT

SEQ ID NO: 110056 - protein, 14 aa, Homo sapiens
  heavy chain complementarity determining region 3 for antibody 55028
AREDGRIAVADFDY

SEQ ID NO: 110057 - protein, 9 aa, Homo sapiens
  light chain complementarity determining region 3 for antibody 55029
HQSSSLPYT

SEQ ID NO: 110058 - protein, 7 aa, Homo sapiens
  heavy chain complementarity determining region 3 for antibody 55029
ARDYYWY

SEQ ID NO: 110059 - protein, 9 aa, Homo sapiens
  light chain complementarity determining region 3 for antibody 55030
HQSSSLPYT

SEQ ID NO: 110060 - protein, 17 aa, Homo sapiens
  heavy chain complementarity determining region 3 for antibody 55030
AKGDDYVWGSYRTVFDY

SEQ ID NO: 110061 - protein, 9 aa, Homo sapiens
  light chain complementarity determining region 3 for antibody 55031
HQSSSLPYT

SEQ ID NO: 110062 - protein, 17 aa, Homo sapiens
  heavy chain complementarity determining region 3 for antibody 55031
AKEDDYVWGSYRTVFDC

SEQ ID NO: 110063 - protein, 9 aa, Homo sapiens
  light chain complementarity determining region 3 for antibody 55032
HQSSSLPYT

SEQ ID NO: 110064 - protein, 17 aa, Homo sapiens
  heavy chain complementarity determining region 3 for antibody 55032
AKEDDYVWGSYRTDFDY

SEQ ID NO: 110065 - protein, 9 aa, Homo sapiens
  light chain complementarity determining region 3 for antibody 55033
HQSSSLPYT

SEQ ID NO: 110066 - protein, 17 aa, Homo sapiens
  heavy chain complementarity determining region 3 for antibody 55033
AKEDDYVWGSYRPVFDY

SEQ ID NO: 110067 - protein, 9 aa, Homo sapiens
  light chain complementarity determining region 3 for antibody 55034
HQSSSLPYT

SEQ ID NO: 110068 - protein, 17 aa, Homo sapiens
  heavy chain complementarity determining region 3 for antibody 55034
AKEDDDVWGSYRTVFDY

SEQ ID NO: 110069 - protein, 9 aa, Homo sapiens
  light chain complementarity determining region 3 for antibody 55035
HQSSSLPWT

SEQ ID NO: 110070 - protein, 10 aa, Homo sapiens
  heavy chain complementarity determining region 3 for antibody 55035
ARVSSGSFDY

SEQ ID NO: 110071 - protein, 8 aa, Homo sapiens
  light chain complementarity determining region 3 for antibody 55036
HQSSSLPT

SEQ ID NO: 110072 - protein, 17 aa, Homo sapiens
  heavy chain complementarity determining region 3 for antibody 55036
AGETHDILTGYYNPFDY

SEQ ID NO: 110073 - protein, 9 aa, Homo sapiens
  light chain complementarity determining region 3 for antibody 55037
HQSSSLPRT

SEQ ID NO: 110074 - protein, 9 aa, Homo sapiens
  heavy chain complementarity determining region 3 for antibody 55037
ARKSWYFDL

SEQ ID NO: 110075 - protein, 9 aa, Homo sapiens
  light chain complementarity determining region 3 for antibody 55038
HQSSSLPRT

SEQ ID NO: 110076 - protein, 9 aa, Homo sapiens
  heavy chain complementarity determining region 3 for antibody 55038
ARKRWDFDL

SEQ ID NO: 110077 - protein, 9 aa, Homo sapiens
  light chain complementarity determining region 3 for antibody 55039
HQSSSLPQT

SEQ ID NO: 110078 - protein, 13 aa, Homo sapiens
  heavy chain complementarity determining region 3 for antibody 55039
ARDHYGSGSYLDY

SEQ ID NO: 110079 - protein, 9 aa, Homo sapiens
  light chain complementarity determining region 3 for antibody 55040
HQSSSLPNT

SEQ ID NO: 110080 - protein, 15 aa, Homo sapiens
  heavy chain complementarity determining region 3 for antibody 55040
AKGEQLGSYYFGMDV

SEQ ID NO: 110081 - protein, 9 aa, Homo sapiens
  light chain complementarity determining region 3 for antibody 55041
HQSSSLPLT

SEQ ID NO: 110082 - protein, 12 aa, Homo sapiens
  heavy chain complementarity determining region 3 for antibody 55041
ASDDILTGPFDY

SEQ ID NO: 110083 - protein, 9 aa, Homo sapiens
  light chain complementarity determining region 3 for antibody 55042
HQSSSLPLT

SEQ ID NO: 110084 - protein, 8 aa, Homo sapiens
  heavy chain complementarity determining region 3 for antibody 55042
ARTGPLDY

SEQ ID NO: 110085 - protein, 9 aa, Homo sapiens
  light chain complementarity determining region 3 for antibody 55043
HQSSSLPLT

SEQ ID NO: 110086 - protein, 11 aa, Homo sapiens
  heavy chain complementarity determining region 3 for antibody 55043
ARLLWFGGFDY

SEQ ID NO: 110087 - protein, 9 aa, Homo sapiens
  light chain complementarity determining region 3 for antibody 55044
HQSSSLPLT

SEQ ID NO: 110088 - protein, 15 aa, Homo sapiens
  heavy chain complementarity determining region 3 for antibody 55044
ARDGDYGDYLYYFDY

SEQ ID NO: 110089 - protein, 9 aa, Homo sapiens
  light chain complementarity determining region 3 for antibody 55045
HQSSSLPIT

SEQ ID NO: 110090 - protein, 18 aa, Homo sapiens
  heavy chain complementarity determining region 3 for antibody 55045
ASPVEMATTPYYYYGMDV

SEQ ID NO: 110091 - protein, 9 aa, Homo sapiens
  light chain complementarity determining region 3 for antibody 55046
HQSSSLPHT

SEQ ID NO: 110092 - protein, 15 aa, Homo sapiens
  heavy chain complementarity determining region 3 for antibody 55046
ARVSTYYYGSGSFDY

SEQ ID NO: 110093 - protein, 9 aa, Homo sapiens
  light chain complementarity determining region 3 for antibody 55047
HQSSSLPHT

SEQ ID NO: 110094 - protein, 12 aa, Homo sapiens
  heavy chain complementarity determining region 3 for antibody 55047
ARVDYYGWYFDY

SEQ ID NO: 110095 - protein, 9 aa, Homo sapiens
  light chain complementarity determining region 3 for antibody 55048
HQSSSLPFT

SEQ ID NO: 110096 - protein, 11 aa, Homo sapiens
  heavy chain complementarity determining region 3 for antibody 55048
ARVRWFGGFDY

SEQ ID NO: 110097 - protein, 9 aa, Homo sapiens
  light chain complementarity determining region 3 for antibody 55049
HQSSSLPFT

SEQ ID NO: 110098 - protein, 11 aa, Homo sapiens
  heavy chain complementarity determining region 3 for antibody 55049
ARLRWCGGFDY

SEQ ID NO: 110099 - protein, 9 aa, Homo sapiens
  light chain complementarity determining region 3 for antibody 55050
HQSSSLPFT

SEQ ID NO: 110100 - protein, 11 aa, Homo sapiens
  heavy chain complementarity determining region 3 for antibody 55050
ARLLRFGGFDY

SEQ ID NO: 110101 - protein, 9 aa, Homo sapiens
  light chain complementarity determining region 3 for antibody 55051
HQSSSLPFT

SEQ ID NO: 110102 - protein, 11 aa, Homo sapiens
  heavy chain complementarity determining region 3 for antibody 55051
ARLLLFGGFDY

SEQ ID NO: 110103 - protein, 9 aa, Homo sapiens
  light chain complementarity determining region 3 for antibody 55052
HQSSSLPFT

SEQ ID NO: 110104 - protein, 11 aa, Homo sapiens
  heavy chain complementarity determining region 3 for antibody 55052
ARLLGFGGFDY

SEQ ID NO: 110105 - protein, 9 aa, Homo sapiens
  light chain complementarity determining region 3 for antibody 55053
HQSSSLPFT

SEQ ID NO: 110106 - protein, 11 aa, Homo sapiens
  heavy chain complementarity determining region 3 for antibody 55053
ARLLCSGGFDY

SEQ ID NO: 110107 - protein, 9 aa, Homo sapiens
  light chain complementarity determining region 3 for antibody 55054
HQSSSLPFT

SEQ ID NO: 110108 - protein, 11 aa, Homo sapiens
  heavy chain complementarity determining region 3 for antibody 55054
ARLLCFGGIDY

SEQ ID NO: 110109 - protein, 9 aa, Homo sapiens
  light chain complementarity determining region 3 for antibody 55055
HQSSSLPFT

SEQ ID NO: 110110 - protein, 11 aa, Homo sapiens
  heavy chain complementarity determining region 3 for antibody 55055
ARLIWFGGFDY

SEQ ID NO: 110111 - protein, 9 aa, Homo sapiens
  light chain complementarity determining region 3 for antibody 55056
HQSSSLPFT

SEQ ID NO: 110112 - protein, 11 aa, Homo sapiens
  heavy chain complementarity determining region 3 for antibody 55056
ARFPCFGGFDY

SEQ ID NO: 110113 - protein, 9 aa, Homo sapiens
  light chain complementarity determining region 3 for antibody 55057
HQSSSLPFT

SEQ ID NO: 110114 - protein, 11 aa, Homo sapiens
  heavy chain complementarity determining region 3 for antibody 55057
ARFLCFGGFDY

SEQ ID NO: 110115 - protein, 9 aa, Homo sapiens
  light chain complementarity determining region 3 for antibody 55058
HQSSSLPFT

SEQ ID NO: 110116 - protein, 13 aa, Homo sapiens
  heavy chain complementarity determining region 3 for antibody 55058
AADYGDYQYYFDY

SEQ ID NO: 110117 - protein, 9 aa, Homo sapiens
  light chain complementarity determining region 3 for antibody 55059
HQSSSLMYT

SEQ ID NO: 110118 - protein, 21 aa, Homo sapiens
  heavy chain complementarity determining region 3 for antibody 55059
ARDGSDYYDSSGYYYVGAFDI

SEQ ID NO: 110119 - protein, 9 aa, Homo sapiens
  light chain complementarity determining region 3 for antibody 55060
HQSSSFMYT

SEQ ID NO: 110120 - protein, 8 aa, Homo sapiens
  heavy chain complementarity determining region 3 for antibody 55060
ATDRIIGY

SEQ ID NO: 110121 - protein, 8 aa, Homo sapiens
  light chain complementarity determining region 3 for antibody 55061
HQSSLPYT

SEQ ID NO: 110122 - protein, 18 aa, Homo sapiens
  heavy chain complementarity determining region 3 for antibody 55061
ARHPLYSSSWYDEGVFDY

SEQ ID NO: 110123 - protein, 9 aa, Homo sapiens
  light chain complementarity determining region 3 for antibody 55062
HQSSILPHT

SEQ ID NO: 110124 - protein, 16 aa, Homo sapiens
  heavy chain complementarity determining region 3 for antibody 55062
ARGVLRYFDWLLNFDY

SEQ ID NO: 110125 - protein, 9 aa, Homo sapiens
  light chain complementarity determining region 3 for antibody 55063
HQSRSLPHT

SEQ ID NO: 110126 - protein, 13 aa, Homo sapiens
  heavy chain complementarity determining region 3 for antibody 55063
AREGTGEGYYFDY

SEQ ID NO: 110127 - protein, 9 aa, Homo sapiens
  light chain complementarity determining region 3 for antibody 55064
HQSNSLPHT

SEQ ID NO: 110128 - protein, 15 aa, Homo sapiens
  heavy chain complementarity determining region 3 for antibody 55064
AGDRYYGSGSYLFDY

SEQ ID NO: 110129 - protein, 9 aa, Homo sapiens
  light chain complementarity determining region 3 for antibody 55065
HQSGSLPHT

SEQ ID NO: 110130 - protein, 16 aa, Homo sapiens
  heavy chain complementarity determining region 3 for antibody 55065
AREGYYGSGSYKDFQH

SEQ ID NO: 110131 - protein, 9 aa, Homo sapiens
  light chain complementarity determining region 3 for antibody 55066
LQDYNYPFT

SEQ ID NO: 110132 - protein, 15 aa, Homo sapiens
  heavy chain complementarity determining region 3 for antibody 55066
ARAPLLLWFGEFIDY

SEQ ID NO: 110133 - protein, 9 aa, Homo sapiens
  light chain complementarity determining region 3 for antibody 55067
QQFNNYPYT

SEQ ID NO: 110134 - protein, 24 aa, Homo sapiens
  heavy chain complementarity determining region 3 for antibody 55067
AREWEGNYGSGSYYKSAYYYGMDV

SEQ ID NO: 110135 - protein, 9 aa, Homo sapiens
  light chain complementarity determining region 3 for antibody 55068
QKYNSAPLT

SEQ ID NO: 110136 - protein, 8 aa, Homo sapiens
  heavy chain complementarity determining region 3 for antibody 55068
ARTGPLDY

SEQ ID NO: 110137 - protein, 9 aa, Homo sapiens
  light chain complementarity determining region 3 for antibody 55069
QQLNSYPLT

SEQ ID NO: 110138 - protein, 13 aa, Homo sapiens
  heavy chain complementarity determining region 3 for antibody 55069
ARYSSSWYDAFDI

SEQ ID NO: 110139 - protein, 9 aa, Homo sapiens
  light chain complementarity determining region 3 for antibody 55070
LQDYNYPWT

SEQ ID NO: 110140 - protein, 12 aa, Homo sapiens
  heavy chain complementarity determining region 3 for antibody 55070
ARDTMVRGVIDY

SEQ ID NO: 110141 - protein, 9 aa, Homo sapiens
  light chain complementarity determining region 3 for antibody 55071
QKYNSAPLT

SEQ ID NO: 110142 - protein, 13 aa, Homo sapiens
  heavy chain complementarity determining region 3 for antibody 55071
ARDRYSGYGAFDY

SEQ ID NO: 110143 - protein, 9 aa, Homo sapiens
  light chain complementarity determining region 3 for antibody 55072
QKYNSAPLT

SEQ ID NO: 110144 - protein, 9 aa, Homo sapiens
  heavy chain complementarity determining region 3 for antibody 55072
ARDGLGIDY

SEQ ID NO: 110145 - protein, 9 aa, Homo sapiens
  light chain complementarity determining region 3 for antibody 55073
LQHNSYPFT

SEQ ID NO: 110146 - protein, 16 aa, Homo sapiens
  heavy chain complementarity determining region 3 for antibody 55073
ASLFVDIVVVPAAFDY

SEQ ID NO: 110147 - protein, 9 aa, Homo sapiens
  light chain complementarity determining region 3 for antibody 55074
QKYNSAPLT

SEQ ID NO: 110148 - protein, 16 aa, Homo sapiens
  heavy chain complementarity determining region 3 for antibody 55074
ARDAKYYDILTGYPDY

SEQ ID NO: 110149 - protein, 9 aa, Homo sapiens
  light chain complementarity determining region 3 for antibody 55075
LQHNSYPRT

SEQ ID NO: 110150 - protein, 9 aa, Homo sapiens
  heavy chain complementarity determining region 3 for antibody 55075
LMVRGVMDV

SEQ ID NO: 110151 - protein, 9 aa, Homo sapiens
  light chain complementarity determining region 3 for antibody 55076
QKYNSAPLT

SEQ ID NO: 110152 - protein, 17 aa, Homo sapiens
  heavy chain complementarity determining region 3 for antibody 55076
ARGLRYFDWLLSDAFDI

SEQ ID NO: 110153 - protein, 8 aa, Homo sapiens
  light chain complementarity determining region 3 for antibody 55077
QQYGSSFT

SEQ ID NO: 110154 - protein, 13 aa, Homo sapiens
  heavy chain complementarity determining region 3 for antibody 55077
ARYSSSWYDAFDI

SEQ ID NO: 110155 - protein, 9 aa, Homo sapiens
  light chain complementarity determining region 3 for antibody 55078
QQFNNYPRT

SEQ ID NO: 110156 - protein, 13 aa, Homo sapiens
  heavy chain complementarity determining region 3 for antibody 55078
ARIAAAAVQYFQH

SEQ ID NO: 110157 - protein, 9 aa, Homo sapiens
  light chain complementarity determining region 3 for antibody 55079
QQYNSYPRT

SEQ ID NO: 110158 - protein, 13 aa, Homo sapiens
  heavy chain complementarity determining region 3 for antibody 55079
ARDRYSGYGAFDY

SEQ ID NO: 110159 - protein, 10 aa, Homo sapiens
  light chain complementarity determining region 3 for antibody 55080
QQRSNWPPLT

SEQ ID NO: 110160 - protein, 19 aa, Homo sapiens
  heavy chain complementarity determining region 3 for antibody 55080
ATERYKVGATYYYYYGMDV

SEQ ID NO: 110161 - protein, 9 aa, Homo sapiens
  light chain complementarity determining region 3 for antibody 55081
QQYDNLPLT

SEQ ID NO: 110162 - protein, 16 aa, Homo sapiens
  heavy chain complementarity determining region 3 for antibody 55081
ARDAKYYDILTGYPDY

SEQ ID NO: 110163 - protein, 9 aa, Homo sapiens
  light chain complementarity determining region 3 for antibody 55082
LQHNSYPYT

SEQ ID NO: 110164 - protein, 13 aa, Homo sapiens
  heavy chain complementarity determining region 3 for antibody 55082
ARIAAAAVQYFQH

SEQ ID NO: 110165 - protein, 9 aa, Homo sapiens
  light chain complementarity determining region 3 for antibody 55083
LQDYNYPWT

SEQ ID NO: 110166 - protein, 16 aa, Homo sapiens
  heavy chain complementarity determining region 3 for antibody 55083
ARDAKYYDILTGYPDY

SEQ ID NO: 110167 - protein, 9 aa, Homo sapiens
  light chain complementarity determining region 3 for antibody 55084
LQHNSYPWT

SEQ ID NO: 110168 - protein, 12 aa, Homo sapiens
  heavy chain complementarity determining region 3 for antibody 55084
ARDIMVRGVIDY

SEQ ID NO: 110169 - protein, 9 aa, Homo sapiens
  light chain complementarity determining region 3 for antibody 55085
LQHNSYPYT

SEQ ID NO: 110170 - protein, 13 aa, Homo sapiens
  heavy chain complementarity determining region 3 for antibody 55085
ARIRYFDWLPFDY

SEQ ID NO: 110171 - protein, 9 aa, Homo sapiens
  light chain complementarity determining region 3 for antibody 55086
LQHNSYPYT

SEQ ID NO: 110172 - protein, 15 aa, Homo sapiens
  heavy chain complementarity determining region 3 for antibody 55086
AREGRLAVAVTGFDY

SEQ ID NO: 110173 - protein, 9 aa, Homo sapiens
  light chain complementarity determining region 3 for antibody 55087
QQYNSYPRT

SEQ ID NO: 110174 - protein, 17 aa, Homo sapiens
  heavy chain complementarity determining region 3 for antibody 55087
ARGLRYFDWLLSDAFDI

SEQ ID NO: 110175 - protein, 9 aa, Homo sapiens
  light chain complementarity determining region 3 for antibody 55088
LQHDNFPYT

SEQ ID NO: 110176 - protein, 7 aa, Homo sapiens
  heavy chain complementarity determining region 3 for antibody 55088
ARDVGDY

SEQ ID NO: 110177 - protein, 9 aa, Homo sapiens
  light chain complementarity determining region 3 for antibody 55089
QQYNSYPFT

SEQ ID NO: 110178 - protein, 16 aa, Homo sapiens
  heavy chain complementarity determining region 3 for antibody 55089
ARDYYDSSGYWGHFDY

SEQ ID NO: 110179 - protein, 9 aa, Homo sapiens
  light chain complementarity determining region 3 for antibody 55090
QQLNSYPYT

SEQ ID NO: 110180 - protein, 16 aa, Homo sapiens
  heavy chain complementarity determining region 3 for antibody 55090
ARGYYYGSGSYSPFDY

SEQ ID NO: 110181 - protein, 9 aa, Homo sapiens
  light chain complementarity determining region 3 for antibody 55091
QQYNSYPRT

SEQ ID NO: 110182 - protein, 5 aa, Homo sapiens
  heavy chain complementarity determining region 3 for antibody 55091
ARNWG

SEQ ID NO: 110183 - protein, 9 aa, Homo sapiens
  light chain complementarity determining region 3 for antibody 55092
QQFNNYPCT

SEQ ID NO: 110184 - protein, 24 aa, Homo sapiens
  heavy chain complementarity determining region 3 for antibody 55092
AREWEGNYGSGSYYKSAYYYGMDV

SEQ ID NO: 110185 - protein, 9 aa, Homo sapiens
  light chain complementarity determining region 3 for antibody 55093
LQHNSYPYT

SEQ ID NO: 110186 - protein, 11 aa, Homo sapiens
  heavy chain complementarity determining region 3 for antibody 55093
ASDILTGYYEY

SEQ ID NO: 110187 - protein, 9 aa, Homo sapiens
  light chain complementarity determining region 3 for antibody 55094
LQHDNFPYT

SEQ ID NO: 110188 - protein, 17 aa, Homo sapiens
  heavy chain complementarity determining region 3 for antibody 55094
ARDRYDILTGYYNGFDY

SEQ ID NO: 110189 - protein, 9 aa, Homo sapiens
  light chain complementarity determining region 3 for antibody 55095
QQYNSYPRT

SEQ ID NO: 110190 - protein, 13 aa, Homo sapiens
  heavy chain complementarity determining region 3 for antibody 55095
ARDKDSTQLWLGY

SEQ ID NO: 110191 - protein, 9 aa, Homo sapiens
  light chain complementarity determining region 3 for antibody 55096
QQLNSYPYT

SEQ ID NO: 110192 - protein, 9 aa, Homo sapiens
  heavy chain complementarity determining region 3 for antibody 55096
ARKRWYFDL

SEQ ID NO: 110193 - protein, 9 aa, Homo sapiens
  light chain complementarity determining region 3 for antibody 55097
LQHNSYPYT

SEQ ID NO: 110194 - protein, 11 aa, Homo sapiens
  heavy chain complementarity determining region 3 for antibody 55097
AAYSSSWPFDY

SEQ ID NO: 110195 - protein, 9 aa, Homo sapiens
  light chain complementarity determining region 3 for antibody 55098
QQLNSYPRT

SEQ ID NO: 110196 - protein, 18 aa, Homo sapiens
  heavy chain complementarity determining region 3 for antibody 55098
AKDQSIATAGTYYYGMDV

SEQ ID NO: 110197 - protein, 9 aa, Homo sapiens
  light chain complementarity determining region 3 for antibody 55099
QQFNNYPRT

SEQ ID NO: 110198 - protein, 8 aa, Homo sapiens
  heavy chain complementarity determining region 3 for antibody 55099
ARTGPLDY

SEQ ID NO: 110199 - protein, 8 aa, Homo sapiens
  light chain complementarity determining region 3 for antibody 55100
QQYGSSFT

SEQ ID NO: 110200 - protein, 11 aa, Homo sapiens
  heavy chain complementarity determining region 3 for antibody 55100
ARDRILKGMDV

SEQ ID NO: 110201 - protein, 9 aa, Homo sapiens
  light chain complementarity determining region 3 for antibody 55101
LQHNSYPFT

SEQ ID NO: 110202 - protein, 16 aa, Homo sapiens
  heavy chain complementarity determining region 3 for antibody 55101
AGLFVDIVVVPAAFDY

SEQ ID NO: 110203 - protein, 9 aa, Homo sapiens
  light chain complementarity determining region 3 for antibody 55102
LQHNSYPWT

SEQ ID NO: 110204 - protein, 19 aa, Homo sapiens
  heavy chain complementarity determining region 3 for antibody 55102
AKDEDILTGYYRDYYAMDV

SEQ ID NO: 110205 - protein, 9 aa, Homo sapiens
  light chain complementarity determining region 3 for antibody 55103
QQLNSYPLT

SEQ ID NO: 110206 - protein, 11 aa, Homo sapiens
  heavy chain complementarity determining region 3 for antibody 55103
AREGVGTAFDI

SEQ ID NO: 110207 - protein, 9 aa, Homo sapiens
  light chain complementarity determining region 3 for antibody 55104
QQFNNYPYT

SEQ ID NO: 110208 - protein, 24 aa, Homo sapiens
  heavy chain complementarity determining region 3 for antibody 55104
AREWEGNYGSGSDYKSAYYYGMDV

SEQ ID NO: 110209 - protein, 9 aa, Homo sapiens
  light chain complementarity determining region 3 for antibody 55105
QQSYSTPRT

SEQ ID NO: 110210 - protein, 20 aa, Homo sapiens
  heavy chain complementarity determining region 3 for antibody 55105
ARAPSYYDILTGYSYDAFDI

SEQ ID NO: 110211 - protein, 9 aa, Homo sapiens
  light chain complementarity determining region 3 for antibody 55106
LQDYNYPHT

SEQ ID NO: 110212 - protein, 11 aa, Homo sapiens
  heavy chain complementarity determining region 3 for antibody 55106
ARYYYYYGMDV

SEQ ID NO: 110213 - protein, 9 aa, Homo sapiens
  light chain complementarity determining region 3 for antibody 55107
QQLNSYPLT

SEQ ID NO: 110214 - protein, 13 aa, Homo sapiens
  heavy chain complementarity determining region 3 for antibody 55107
ARYSSSWYDAFDF

SEQ ID NO: 110215 - protein, 9 aa, Homo sapiens
  light chain complementarity determining region 3 for antibody 55108
QKYNSAPLT

SEQ ID NO: 110216 - protein, 17 aa, Homo sapiens
  heavy chain complementarity determining region 3 for antibody 55108
ARGLRYFDWSLSDAFDI

SEQ ID NO: 110217 - protein, 9 aa, Homo sapiens
  light chain complementarity determining region 3 for antibody 55109
QQYNSYPYT

SEQ ID NO: 110218 - protein, 16 aa, Homo sapiens
  heavy chain complementarity determining region 3 for antibody 55109
ARERDNWNPYYYGMDV

SEQ ID NO: 110219 - protein, 9 aa, Homo sapiens
  light chain complementarity determining region 3 for antibody 55110
QQLNSYPYT

SEQ ID NO: 110220 - protein, 9 aa, Homo sapiens
  heavy chain complementarity determining region 3 for antibody 55110
ARKRWYLDL

SEQ ID NO: 110221 - protein, 9 aa, Homo sapiens
  light chain complementarity determining region 3 for antibody 55111
LQHNSYPYT

SEQ ID NO: 110222 - protein, 15 aa, Homo sapiens
  heavy chain complementarity determining region 3 for antibody 55111
ARHKREAPGYWYFDL

SEQ ID NO: 110223 - protein, 9 aa, Homo sapiens
  light chain complementarity determining region 3 for antibody 55112
QKYNSAPFT

SEQ ID NO: 110224 - protein, 14 aa, Homo sapiens
  heavy chain complementarity determining region 3 for antibody 55112
ARWDTLYYYYGMDV

SEQ ID NO: 110225 - protein, 9 aa, Homo sapiens
  light chain complementarity determining region 3 for antibody 55113
QQFNNYPYT

SEQ ID NO: 110226 - protein, 24 aa, Homo sapiens
  heavy chain complementarity determining region 3 for antibody 55113
AREWEGKYGSGSYYKSAYYYGMDV

SEQ ID NO: 110227 - protein, 10 aa, Homo sapiens
  light chain complementarity determining region 3 for antibody 55114
QQYGSSPMYT

SEQ ID NO: 110228 - protein, 14 aa, Homo sapiens
  heavy chain complementarity determining region 3 for antibody 55114
AREGFRGYYYGMDV

SEQ ID NO: 110229 - protein, 9 aa, Homo sapiens
  light chain complementarity determining region 3 for antibody 55115
QQLNSFRRT

SEQ ID NO: 110230 - protein, 13 aa, Homo sapiens
  heavy chain complementarity determining region 3 for antibody 55115
AKEMGQWLYYFDY

SEQ ID NO: 110231 - protein, 9 aa, Homo sapiens
  light chain complementarity determining region 3 for antibody 55116
QQCNSYPYT

SEQ ID NO: 110232 - protein, 18 aa, Homo sapiens
  heavy chain complementarity determining region 3 for antibody 55116
ARERRDDILTGYFDAFDI

SEQ ID NO: 110233 - protein, 9 aa, Homo sapiens
  light chain complementarity determining region 3 for antibody 55117
QQFNNYPYT

SEQ ID NO: 110234 - protein, 24 aa, Homo sapiens
  heavy chain complementarity determining region 3 for antibody 55117
AREWEGNYGSGSYYKSAYSYGMDV

SEQ ID NO: 110235 - protein, 9 aa, Homo sapiens
  light chain complementarity determining region 3 for antibody 55118
LQDYNYPWT

SEQ ID NO: 110236 - protein, 14 aa, Homo sapiens
  heavy chain complementarity determining region 3 for antibody 55118
ARDGGCSSTSCYDY

SEQ ID NO: 110237 - protein, 9 aa, Homo sapiens
  light chain complementarity determining region 3 for antibody 55119
LQDYNYPFT

SEQ ID NO: 110238 - protein, 10 aa, Homo sapiens
  heavy chain complementarity determining region 3 for antibody 55119
ARMTTVTFDY

SEQ ID NO: 110239 - protein, 9 aa, Homo sapiens
  light chain complementarity determining region 3 for antibody 55120
QQLNSYPYT

SEQ ID NO: 110240 - protein, 12 aa, Homo sapiens
  heavy chain complementarity determining region 3 for antibody 55120
ARGRGYSYGLDY

SEQ ID NO: 110241 - protein, 9 aa, Homo sapiens
  light chain complementarity determining region 3 for antibody 55121
QKYNSAPLT

SEQ ID NO: 110242 - protein, 12 aa, Homo sapiens
  heavy chain complementarity determining region 3 for antibody 55121
ARDTMVRGVIDY

SEQ ID NO: 110243 - protein, 9 aa, Homo sapiens
  light chain complementarity determining region 3 for antibody 55122
QQSYSTPWT

SEQ ID NO: 110244 - protein, 11 aa, Homo sapiens
  heavy chain complementarity determining region 3 for antibody 55122
ARDEHVLRYFD

SEQ ID NO: 110245 - protein, 8 aa, Homo sapiens
  light chain complementarity determining region 3 for antibody 55123
QQLNSYPT

SEQ ID NO: 110246 - protein, 20 aa, Homo sapiens
  heavy chain complementarity determining region 3 for antibody 55123
ARDGYGDYVGGYYYYYGMDV

SEQ ID NO: 110247 - protein, 9 aa, Homo sapiens
  light chain complementarity determining region 3 for antibody 55124
LQHDSYPYT

SEQ ID NO: 110248 - protein, 15 aa, Homo sapiens
  heavy chain complementarity determining region 3 for antibody 55124
AREGRLAVAVTGFDY

SEQ ID NO: 110249 - protein, 9 aa, Homo sapiens
  light chain complementarity determining region 3 for antibody 55125
LQHNSYPWT

SEQ ID NO: 110250 - protein, 19 aa, Homo sapiens
  heavy chain complementarity determining region 3 for antibody 55125
AREDSSSWYVEYYYYGMDV

SEQ ID NO: 110251 - protein, 9 aa, Homo sapiens
  light chain complementarity determining region 3 for antibody 55126
QQFNNYPYT

SEQ ID NO: 110252 - protein, 24 aa, Homo sapiens
  heavy chain complementarity determining region 3 for antibody 55126
AREWEGNDGSGSYYKSAYYYGMDV

SEQ ID NO: 110253 - protein, 9 aa, Homo sapiens
  light chain complementarity determining region 3 for antibody 55127
LQHNSYPRT

SEQ ID NO: 110254 - protein, 11 aa, Homo sapiens
  heavy chain complementarity determining region 3 for antibody 55127
ARSIVGATLDY

SEQ ID NO: 110255 - protein, 9 aa, Homo sapiens
  light chain complementarity determining region 3 for antibody 55128
QQLNSYPYT

SEQ ID NO: 110256 - protein, 9 aa, Homo sapiens
  heavy chain complementarity determining region 3 for antibody 55128
ARKQRYFDY

SEQ ID NO: 110257 - protein, 9 aa, Homo sapiens
  light chain complementarity determining region 3 for antibody 55129
QQYDNLPLT

SEQ ID NO: 110258 - protein, 11 aa, Homo sapiens
  heavy chain complementarity determining region 3 for antibody 55129
AREGYSYGFDY

SEQ ID NO: 110259 - protein, 9 aa, Homo sapiens
  light chain complementarity determining region 3 for antibody 55130
LQDYNYPWT

SEQ ID NO: 110260 - protein, 22 aa, Homo sapiens
  heavy chain complementarity determining region 3 for antibody 55130
ARRDYYGSGSYYNDYYYYGMDV

SEQ ID NO: 110261 - protein, 9 aa, Homo sapiens
  light chain complementarity determining region 3 for antibody 55131
LQDYNYPWT

SEQ ID NO: 110262 - protein, 12 aa, Homo sapiens
  heavy chain complementarity determining region 3 for antibody 55131
ARDTTVRGVIDY

SEQ ID NO: 110263 - protein, 9 aa, Homo sapiens
  light chain complementarity determining region 3 for antibody 55132
LQDYNYPWT

SEQ ID NO: 110264 - protein, 14 aa, Homo sapiens
  heavy chain complementarity determining region 3 for antibody 55132
ARAGTTGTSYGMDV

SEQ ID NO: 110265 - protein, 9 aa, Homo sapiens
  light chain complementarity determining region 3 for antibody 55133
QQYNSYPRT

SEQ ID NO: 110266 - protein, 11 aa, Homo sapiens
  heavy chain complementarity determining region 3 for antibody 55133
ARILTGYYKDY

SEQ ID NO: 110267 - protein, 9 aa, Homo sapiens
  light chain complementarity determining region 3 for antibody 55134
LQDYNYPYT

SEQ ID NO: 110268 - protein, 14 aa, Homo sapiens
  heavy chain complementarity determining region 3 for antibody 55134
ARDPPRIVGALFDY

SEQ ID NO: 110269 - protein, 9 aa, Homo sapiens
  light chain complementarity determining region 3 for antibody 55135
QQSYSTPWT

SEQ ID NO: 110270 - protein, 15 aa, Homo sapiens
  heavy chain complementarity determining region 3 for antibody 55135
ARHKREAPGYWYFDL

SEQ ID NO: 110271 - protein, 9 aa, Homo sapiens
  light chain complementarity determining region 3 for antibody 55136
QQLNSYPLT

SEQ ID NO: 110272 - protein, 13 aa, Homo sapiens
  heavy chain complementarity determining region 3 for antibody 55136
AGYSSSWYDAFDI

SEQ ID NO: 110273 - protein, 9 aa, Homo sapiens
  light chain complementarity determining region 3 for antibody 55137
LQHNSYPYT

SEQ ID NO: 110274 - protein, 13 aa, Homo sapiens
  heavy chain complementarity determining region 3 for antibody 55137
ARTAAAAVQYFQH

SEQ ID NO: 110275 - protein, 9 aa, Homo sapiens
  light chain complementarity determining region 3 for antibody 55138
LQDYNYPYT

SEQ ID NO: 110276 - protein, 7 aa, Homo sapiens
  heavy chain complementarity determining region 3 for antibody 55138
AGGPFDY

SEQ ID NO: 110277 - protein, 9 aa, Homo sapiens
  light chain complementarity determining region 3 for antibody 55139
QQYNSYPRT

SEQ ID NO: 110278 - protein, 9 aa, Homo sapiens
  heavy chain complementarity determining region 3 for antibody 55139
ARDLSGMDV

SEQ ID NO: 110279 - protein, 8 aa, Homo sapiens
  light chain complementarity determining region 3 for antibody 55140
QQRSNWPT

SEQ ID NO: 110280 - protein, 13 aa, Homo sapiens
  heavy chain complementarity determining region 3 for antibody 55140
ARGSSWYVPYFDY

SEQ ID NO: 110281 - protein, 9 aa, Homo sapiens
  light chain complementarity determining region 3 for antibody 55141
HQSSSLPHT

SEQ ID NO: 110282 - protein, 13 aa, Homo sapiens
  heavy chain complementarity determining region 3 for antibody 55141
ARIAAAAVQYFQH

SEQ ID NO: 110283 - protein, 9 aa, Homo sapiens
  light chain complementarity determining region 3 for antibody 55142
QQYDNLPLT

SEQ ID NO: 110284 - protein, 11 aa, Homo sapiens
  heavy chain complementarity determining region 3 for antibody 55142
ARDGGSYPFDY

SEQ ID NO: 110285 - protein, 9 aa, Homo sapiens
  light chain complementarity determining region 3 for antibody 55143
LQDYNYPWT

SEQ ID NO: 110286 - protein, 12 aa, Homo sapiens
  heavy chain complementarity determining region 3 for antibody 55143
ARDAMVRGVIDY

SEQ ID NO: 110287 - protein, 9 aa, Homo sapiens
  light chain complementarity determining region 3 for antibody 55144
LQDYNYPFT

SEQ ID NO: 110288 - protein, 9 aa, Homo sapiens
  heavy chain complementarity determining region 3 for antibody 55144
ARGRSSWGY

SEQ ID NO: 110289 - protein, 9 aa, Homo sapiens
  light chain complementarity determining region 3 for antibody 55145
QQLNSYPPT

SEQ ID NO: 110290 - protein, 20 aa, Homo sapiens
  heavy chain complementarity determining region 3 for antibody 55145
AKDQGDIVATIMDYYYGMDV

SEQ ID NO: 110291 - protein, 9 aa, Homo sapiens
  light chain complementarity determining region 3 for antibody 55146
LQDYNYPWT

SEQ ID NO: 110292 - protein, 15 aa, Homo sapiens
  heavy chain complementarity determining region 3 for antibody 55146
ARAPVLGYLEGYFDY

SEQ ID NO: 110293 - protein, 10 aa, Homo sapiens
  light chain complementarity determining region 3 for antibody 55147
QQRSNWPPLT

SEQ ID NO: 110294 - protein, 19 aa, Homo sapiens
  heavy chain complementarity determining region 3 for antibody 55147
ATERYKVGATYSYYYGMDV

SEQ ID NO: 110295 - protein, 9 aa, Homo sapiens
  light chain complementarity determining region 3 for antibody 55148
QQLNSYPYT

SEQ ID NO: 110296 - protein, 9 aa, Homo sapiens
  heavy chain complementarity determining region 3 for antibody 55148
ARKQRYLDY

SEQ ID NO: 110297 - protein, 9 aa, Homo sapiens
  light chain complementarity determining region 3 for antibody 55149
QQFNNYPLT

SEQ ID NO: 110298 - protein, 12 aa, Homo sapiens
  heavy chain complementarity determining region 3 for antibody 55149
ANSGYYHHGMDV

SEQ ID NO: 110299 - protein, 9 aa, Homo sapiens
  light chain complementarity determining region 3 for antibody 55150
QQYNSYPFT

SEQ ID NO: 110300 - protein, 17 aa, Homo sapiens
  heavy chain complementarity determining region 3 for antibody 55150
ARDGRGVIDYYYYGMDV

SEQ ID NO: 110301 - protein, 9 aa, Homo sapiens
  light chain complementarity determining region 3 for antibody 55151
QKYNSAPLT

SEQ ID NO: 110302 - protein, 16 aa, Homo sapiens
  heavy chain complementarity determining region 3 for antibody 55151
ARDAKYYDTLTGYPDY

SEQ ID NO: 110303 - protein, 9 aa, Homo sapiens
  light chain complementarity determining region 3 for antibody 55152
QQYNSYSYT

SEQ ID NO: 110304 - protein, 14 aa, Homo sapiens
  heavy chain complementarity determining region 3 for antibody 55152
ARHKERSRAFYFDY

SEQ ID NO: 110305 - protein, 9 aa, Homo sapiens
  light chain complementarity determining region 3 for antibody 55153
QQFNNYPRT

SEQ ID NO: 110306 - protein, 13 aa, Homo sapiens
  heavy chain complementarity determining region 3 for antibody 55153
ARTAAAAVQYFQH

SEQ ID NO: 110307 - protein, 9 aa, Homo sapiens
  light chain complementarity determining region 3 for antibody 55154
LQHNRYPPT

SEQ ID NO: 110308 - protein, 16 aa, Homo sapiens
  heavy chain complementarity determining region 3 for antibody 55154
ARGRGTMVRGVTPFDY

SEQ ID NO: 110309 - protein, 8 aa, Homo sapiens
  light chain complementarity determining region 3 for antibody 55155
QQFNNYRT

SEQ ID NO: 110310 - protein, 22 aa, Homo sapiens
  heavy chain complementarity determining region 3 for antibody 55155
ARMYYDILTGYPDYYYYYGMDV

SEQ ID NO: 110311 - protein, 9 aa, Homo sapiens
  light chain complementarity determining region 3 for antibody 55156
QKYNSAPLT

SEQ ID NO: 110312 - protein, 11 aa, Homo sapiens
  heavy chain complementarity determining region 3 for antibody 55156
AREGYSYGFDY

SEQ ID NO: 110313 - protein, 9 aa, Homo sapiens
  light chain complementarity determining region 3 for antibody 55157
QQLNSYPFT

SEQ ID NO: 110314 - protein, 16 aa, Homo sapiens
  heavy chain complementarity determining region 3 for antibody 55157
ARVITMVRGVPDAFDI

SEQ ID NO: 110315 - protein, 9 aa, Homo sapiens
  light chain complementarity determining region 3 for antibody 55158
QKYNSAPYT

SEQ ID NO: 110316 - protein, 19 aa, Homo sapiens
  heavy chain complementarity determining region 3 for antibody 55158
ARDDGYDGGGYYYYYGMDV

SEQ ID NO: 110317 - protein, 9 aa, Homo sapiens
  light chain complementarity determining region 3 for antibody 55159
LQDYNYPWT

SEQ ID NO: 110318 - protein, 11 aa, Homo sapiens
  heavy chain complementarity determining region 3 for antibody 55159
AREGYSYGFDY

SEQ ID NO: 110319 - protein, 9 aa, Homo sapiens
  light chain complementarity determining region 3 for antibody 55160
QQYNNWPRT

SEQ ID NO: 110320 - protein, 13 aa, Homo sapiens
  heavy chain complementarity determining region 3 for antibody 55160
AKALITVVTFFDY

SEQ ID NO: 110321 - protein, 9 aa, Homo sapiens
  light chain complementarity determining region 3 for antibody 55161
LQHNSYPRT

SEQ ID NO: 110322 - protein, 9 aa, Homo sapiens
  heavy chain complementarity determining region 3 for antibody 55161
LTVRGVMDV

SEQ ID NO: 110323 - protein, 9 aa, Homo sapiens
  light chain complementarity determining region 3 for antibody 55162
LQDYNYPYT

SEQ ID NO: 110324 - protein, 11 aa, Homo sapiens
  heavy chain complementarity determining region 3 for antibody 55162
ARDEHVLRYFD

SEQ ID NO: 110325 - protein, 9 aa, Homo sapiens
  light chain complementarity determining region 3 for antibody 55163
LQDYNYPWT

SEQ ID NO: 110326 - protein, 12 aa, Homo sapiens
  heavy chain complementarity determining region 3 for antibody 55163
ARDTMVRGVINY

SEQ ID NO: 110327 - protein, 9 aa, Homo sapiens
  light chain complementarity determining region 3 for antibody 55164
LQDYNYPFT

SEQ ID NO: 110328 - protein, 15 aa, Homo sapiens
  heavy chain complementarity determining region 3 for antibody 55164
ARAALLLWFGEFIDY

SEQ ID NO: 110329 - protein, 9 aa, Homo sapiens
  light chain complementarity determining region 3 for antibody 55165
QQFNNYPRT

SEQ ID NO: 110330 - protein, 13 aa, Homo sapiens
  heavy chain complementarity determining region 3 for antibody 55165
ARIAAAAVQYFHH

SEQ ID NO: 110331 - protein, 9 aa, Homo sapiens
  light chain complementarity determining region 3 for antibody 55166
LQHNSYPWT

SEQ ID NO: 110332 - protein, 11 aa, Homo sapiens
  heavy chain complementarity determining region 3 for antibody 55166
ARGVVGATTDY

SEQ ID NO: 110333 - protein, 9 aa, Homo sapiens
  light chain complementarity determining region 3 for antibody 55167
LQHNSYPWT

SEQ ID NO: 110334 - protein, 8 aa, Homo sapiens
  heavy chain complementarity determining region 3 for antibody 55167
ARTGPLDY

SEQ ID NO: 110335 - protein, 9 aa, Homo sapiens
  light chain complementarity determining region 3 for antibody 55168
LQHNSYPRT

SEQ ID NO: 110336 - protein, 10 aa, Homo sapiens
  heavy chain complementarity determining region 3 for antibody 55168
ASFYGDSFDY

SEQ ID NO: 110337 - protein, 10 aa, Homo sapiens
  light chain complementarity determining region 3 for antibody 55169
QQRSNWPPLT

SEQ ID NO: 110338 - protein, 18 aa, Homo sapiens
  heavy chain complementarity determining region 3 for antibody 55169
ATERYKVGATYYYYGMDV

SEQ ID NO: 110339 - protein, 9 aa, Homo sapiens
  light chain complementarity determining region 3 for antibody 55170
QKYNSAPLT

SEQ ID NO: 110340 - protein, 9 aa, Homo sapiens
  heavy chain complementarity determining region 3 for antibody 55170
ASDGLGIDY

SEQ ID NO: 110341 - protein, 9 aa, Homo sapiens
  light chain complementarity determining region 3 for antibody 55171
HQSSSLPLT

SEQ ID NO: 110342 - protein, 18 aa, Homo sapiens
  heavy chain complementarity determining region 3 for antibody 55171
VKGGPGESFYYYYYGVDV

SEQ ID NO: 110343 - protein, 9 aa, Homo sapiens
  light chain complementarity determining region 3 for antibody 55172
HQSSSLMYT

SEQ ID NO: 110344 - protein, 21 aa, Homo sapiens
  heavy chain complementarity determining region 3 for antibody 55172
ARDGSDYYDRSGYYYVGAFDI

SEQ ID NO: 110345 - protein, 9 aa, Homo sapiens
  light chain complementarity determining region 3 for antibody 55173
QQFNNYPRT

SEQ ID NO: 110346 - protein, 15 aa, Homo sapiens
  heavy chain complementarity determining region 3 for antibody 55173
ATAYYYGSGSCWFDP

SEQ ID NO: 110347 - protein, 9 aa, Homo sapiens
  light chain complementarity determining region 3 for antibody 55174
LQHHSYPWT

SEQ ID NO: 110348 - protein, 14 aa, Homo sapiens
  heavy chain complementarity determining region 3 for antibody 55174
ARGLVRYFDWLEDY

SEQ ID NO: 110349 - protein, 9 aa, Homo sapiens
  light chain complementarity determining region 3 for antibody 55175
HQLNSYPYT

SEQ ID NO: 110350 - protein, 9 aa, Homo sapiens
  heavy chain complementarity determining region 3 for antibody 55175
ARKRWYFDL

SEQ ID NO: 110351 - protein, 9 aa, Homo sapiens
  light chain complementarity determining region 3 for antibody 55176
QQFNNFPFT

SEQ ID NO: 110352 - protein, 16 aa, Homo sapiens
  heavy chain complementarity determining region 3 for antibody 55176
ARGRGYYGSGSPYFDY

SEQ ID NO: 110353 - protein, 9 aa, Homo sapiens
  light chain complementarity determining region 3 for antibody 55177
LQDYNYPFT

SEQ ID NO: 110354 - protein, 15 aa, Homo sapiens
  heavy chain complementarity determining region 3 for antibody 55177
ARAPLLLWFGESIDY

SEQ ID NO: 110355 - protein, 9 aa, Homo sapiens
  light chain complementarity determining region 3 for antibody 55178
QQYDNLPLT

SEQ ID NO: 110356 - protein, 16 aa, Homo sapiens
  heavy chain complementarity determining region 3 for antibody 55178
ARDAKYYDTLTGYPDY

SEQ ID NO: 110357 - protein, 9 aa, Homo sapiens
  light chain complementarity determining region 3 for antibody 55179
QQFNNYPYT

SEQ ID NO: 110358 - protein, 24 aa, Homo sapiens
  heavy chain complementarity determining region 3 for antibody 55179
AREWEGNYGSGSYYKSAYYSGMDV

SEQ ID NO: 110359 - protein, 9 aa, Homo sapiens
  light chain complementarity determining region 3 for antibody 55180
LQHNSYPYT

SEQ ID NO: 110360 - protein, 19 aa, Homo sapiens
  heavy chain complementarity determining region 3 for antibody 55180
ARDRDILTGYYSNYYGMDV

SEQ ID NO: 110361 - protein, 9 aa, Homo sapiens
  light chain complementarity determining region 3 for antibody 55181
LQHNSYPYT

SEQ ID NO: 110362 - protein, 19 aa, Homo sapiens
  heavy chain complementarity determining region 3 for antibody 55181
ARDNDILTGYYQDYYGMDV

SEQ ID NO: 110363 - protein, 9 aa, Homo sapiens
  light chain complementarity determining region 3 for antibody 55182
QKYNSAPLT

SEQ ID NO: 110364 - protein, 16 aa, Homo sapiens
  heavy chain complementarity determining region 3 for antibody 55182
AGDAKYYDILTGYPDY

SEQ ID NO: 110365 - protein, 9 aa, Homo sapiens
  light chain complementarity determining region 3 for antibody 55183
LQHNSYPWT

SEQ ID NO: 110366 - protein, 11 aa, Homo sapiens
  heavy chain complementarity determining region 3 for antibody 55183
SGYSSSWSFDY

SEQ ID NO: 110367 - protein, 9 aa, Homo sapiens
  light chain complementarity determining region 3 for antibody 55184
LQDYNYPRT

SEQ ID NO: 110368 - protein, 20 aa, Homo sapiens
  heavy chain complementarity determining region 3 for antibody 55184
AKDQGDIVATIMDYYYGMDV

SEQ ID NO: 110369 - protein, 9 aa, Homo sapiens
  light chain complementarity determining region 3 for antibody 55185
QQFNNYPRT

SEQ ID NO: 110370 - protein, 13 aa, Homo sapiens
  heavy chain complementarity determining region 3 for antibody 55185
ARIAAAAVQSFQH

SEQ ID NO: 110371 - protein, 9 aa, Homo sapiens
  light chain complementarity determining region 3 for antibody 55186
LQHNSYPYT

SEQ ID NO: 110372 - protein, 17 aa, Homo sapiens
  heavy chain complementarity determining region 3 for antibody 55186
ARERDYYGSGSYYIFDY

SEQ ID NO: 110373 - protein, 9 aa, Homo sapiens
  light chain complementarity determining region 3 for antibody 55187
LQHNSYPWT

SEQ ID NO: 110374 - protein, 19 aa, Homo sapiens
  heavy chain complementarity determining region 3 for antibody 55187
AKDEDILTGYYRDYYATDV

SEQ ID NO: 110375 - protein, 9 aa, Homo sapiens
  light chain complementarity determining region 3 for antibody 55188
LQDYNYPYT

SEQ ID NO: 110376 - protein, 15 aa, Homo sapiens
  heavy chain complementarity determining region 3 for antibody 55188
ARGSPNWGSGWYFDL

SEQ ID NO: 110377 - protein, 9 aa, Homo sapiens
  light chain complementarity determining region 3 for antibody 55189
LQDYNYPFT

SEQ ID NO: 110378 - protein, 15 aa, Homo sapiens
  heavy chain complementarity determining region 3 for antibody 55189
ARAPLLLWFGECIDY

SEQ ID NO: 110379 - protein, 9 aa, Homo sapiens
  light chain complementarity determining region 3 for antibody 55190
QQYYSYPYT

SEQ ID NO: 110380 - protein, 16 aa, Homo sapiens
  heavy chain complementarity determining region 3 for antibody 55190
AKDGDILTAYGGYFDL

SEQ ID NO: 110381 - protein, 9 aa, Homo sapiens
  light chain complementarity determining region 3 for antibody 55191
QQYGSSPFT

SEQ ID NO: 110382 - protein, 12 aa, Homo sapiens
  heavy chain complementarity determining region 3 for antibody 55191
ARDRGSYGLFDY

SEQ ID NO: 110383 - protein, 9 aa, Homo sapiens
  light chain complementarity determining region 3 for antibody 55192
QQCNSYPYT

SEQ ID NO: 110384 - protein, 18 aa, Homo sapiens
  heavy chain complementarity determining region 3 for antibody 55192
ARERRDDILTGYYDAFDI

SEQ ID NO: 110385 - protein, 9 aa, Homo sapiens
  light chain complementarity determining region 3 for antibody 55193
QKYNSAPLT

SEQ ID NO: 110386 - protein, 16 aa, Homo sapiens
  heavy chain complementarity determining region 3 for antibody 55193
ARDAKYYDILTGSPDY

SEQ ID NO: 110387 - protein, 9 aa, Homo sapiens
  light chain complementarity determining region 3 for antibody 55194
LQDYNYPWT

SEQ ID NO: 110388 - protein, 12 aa, Homo sapiens
  heavy chain complementarity determining region 3 for antibody 55194
ARDTMVRGAIDY

SEQ ID NO: 110389 - protein, 9 aa, Homo sapiens
  light chain complementarity determining region 3 for antibody 55195
QQFNNYPYT

SEQ ID NO: 110390 - protein, 24 aa, Homo sapiens
  heavy chain complementarity determining region 3 for antibody 55195
AREWEGNYGSGSYYKSAFYYGMDV

SEQ ID NO: 110391 - protein, 9 aa, Homo sapiens
  light chain complementarity determining region 3 for antibody 55196
QQYNSYPRT

SEQ ID NO: 110392 - protein, 17 aa, Homo sapiens
  heavy chain complementarity determining region 3 for antibody 55196
ARGLRYFDWSLSDAFDI

SEQ ID NO: 110393 - protein, 9 aa, Homo sapiens
  light chain complementarity determining region 3 for antibody 55197
QQYNSYPLT

SEQ ID NO: 110394 - protein, 14 aa, Homo sapiens
  heavy chain complementarity determining region 3 for antibody 55197
ARDHYGSGEHYFDY

SEQ ID NO: 110395 - protein, 9 aa, Homo sapiens
  light chain complementarity determining region 3 for antibody 55198
LQHDNFPYT

SEQ ID NO: 110396 - protein, 20 aa, Homo sapiens
  heavy chain complementarity determining region 3 for antibody 55198
ARDRSRISMVREYYYYGMDV

SEQ ID NO: 110397 - protein, 9 aa, Homo sapiens
  light chain complementarity determining region 3 for antibody 55199
LQDYNYPWT

SEQ ID NO: 110398 - protein, 22 aa, Homo sapiens
  heavy chain complementarity determining region 3 for antibody 55199
ARRGDIAVAGTRRDYYYYGMDV

SEQ ID NO: 110399 - protein, 9 aa, Homo sapiens
  light chain complementarity determining region 3 for antibody 55200
HQSSSLPYT

SEQ ID NO: 110400 - protein, 5 aa, Homo sapiens
  heavy chain complementarity determining region 3 for antibody 55200
ARNWG

SEQ ID NO: 110401 - protein, 9 aa, Homo sapiens
  light chain complementarity determining region 3 for antibody 55201
QQYDNLPLT

SEQ ID NO: 110402 - protein, 16 aa, Homo sapiens
  heavy chain complementarity determining region 3 for antibody 55201
ARDAKYYDILTGSPDY

SEQ ID NO: 110403 - protein, 9 aa, Homo sapiens
  light chain complementarity determining region 3 for antibody 55202
QQYNSYPFT

SEQ ID NO: 110404 - protein, 9 aa, Homo sapiens
  heavy chain complementarity determining region 3 for antibody 55202
ARGLYGMDV

SEQ ID NO: 110405 - protein, 9 aa, Homo sapiens
  light chain complementarity determining region 3 for antibody 55203
QQYNSYPFT

SEQ ID NO: 110406 - protein, 9 aa, Homo sapiens
  heavy chain complementarity determining region 3 for antibody 55203
ARERELLDY

SEQ ID NO: 110407 - protein, 9 aa, Homo sapiens
  light chain complementarity determining region 3 for antibody 55204
QQYNSYPFT

SEQ ID NO: 110408 - protein, 14 aa, Homo sapiens
  heavy chain complementarity determining region 3 for antibody 55204
ARDRTAAGTWPFDY

SEQ ID NO: 110409 - protein, 9 aa, Homo sapiens
  light chain complementarity determining region 3 for antibody 55205
LQHNSYPPT

SEQ ID NO: 110410 - protein, 16 aa, Homo sapiens
  heavy chain complementarity determining region 3 for antibody 55205
ARGRGTMVRGVIPFDY

SEQ ID NO: 110411 - protein, 9 aa, Homo sapiens
  light chain complementarity determining region 3 for antibody 55206
QQYNIYPYT

SEQ ID NO: 110412 - protein, 18 aa, Homo sapiens
  heavy chain complementarity determining region 3 for antibody 55206
ARERRDDILTGYYDAFDI

SEQ ID NO: 110413 - protein, 8 aa, Homo sapiens
  light chain complementarity determining region 3 for antibody 55207
QQYGSSFT

SEQ ID NO: 110414 - protein, 13 aa, Homo sapiens
  heavy chain complementarity determining region 3 for antibody 55207
AGYSSSWYDAFDI

SEQ ID NO: 110415 - protein, 9 aa, Homo sapiens
  light chain complementarity determining region 3 for antibody 55208
QQLNSYPWT

SEQ ID NO: 110416 - protein, 20 aa, Homo sapiens
  heavy chain complementarity determining region 3 for antibody 55208
ARNGYYGSGSFPYYYYGMDV

SEQ ID NO: 110417 - protein, 9 aa, Homo sapiens
  light chain complementarity determining region 3 for antibody 55209
LQHNSYPYT

SEQ ID NO: 110418 - protein, 13 aa, Homo sapiens
  heavy chain complementarity determining region 3 for antibody 55209
ARIAAAAVQSFQH

SEQ ID NO: 110419 - protein, 9 aa, Homo sapiens
  light chain complementarity determining region 3 for antibody 55210
LQDYNYPWT

SEQ ID NO: 110420 - protein, 15 aa, Homo sapiens
  heavy chain complementarity determining region 3 for antibody 55210
ARGYSGYEGYYGMDV

SEQ ID NO: 110421 - protein, 9 aa, Homo sapiens
  light chain complementarity determining region 3 for antibody 55211
LQDYNYPWT

SEQ ID NO: 110422 - protein, 16 aa, Homo sapiens
  heavy chain complementarity determining region 3 for antibody 55211
ARDAKYYDTLTGYPDY

SEQ ID NO: 110423 - protein, 9 aa, Homo sapiens
  light chain complementarity determining region 3 for antibody 55212
QQYYSTPYT

SEQ ID NO: 110424 - protein, 19 aa, Homo sapiens
  heavy chain complementarity determining region 3 for antibody 55212
ARERPVTMVRGVIDYGMDV

SEQ ID NO: 110425 - protein, 9 aa, Homo sapiens
  light chain complementarity determining region 3 for antibody 55213
QQYNSYPFT

SEQ ID NO: 110426 - protein, 15 aa, Homo sapiens
  heavy chain complementarity determining region 3 for antibody 55213
ASHVLRYFDWRGMDV

SEQ ID NO: 110427 - protein, 9 aa, Homo sapiens
  light chain complementarity determining region 3 for antibody 55214
QQLNGYPYT

SEQ ID NO: 110428 - protein, 9 aa, Homo sapiens
  heavy chain complementarity determining region 3 for antibody 55214
ARKRWYFDL

SEQ ID NO: 110429 - protein, 9 aa, Homo sapiens
  light chain complementarity determining region 3 for antibody 55215
QKYNSAPLT

SEQ ID NO: 110430 - protein, 8 aa, Homo sapiens
  heavy chain complementarity determining region 3 for antibody 55215
ARPGPLDY

SEQ ID NO: 110431 - protein, 9 aa, Homo sapiens
  light chain complementarity determining region 3 for antibody 55216
LQHNSYPWT

SEQ ID NO: 110432 - protein, 10 aa, Homo sapiens
  heavy chain complementarity determining region 3 for antibody 55216
TRWELGAFDI

SEQ ID NO: 110433 - protein, 9 aa, Homo sapiens
  light chain complementarity determining region 3 for antibody 55217
QQYYSYPYT

SEQ ID NO: 110434 - protein, 14 aa, Homo sapiens
  heavy chain complementarity determining region 3 for antibody 55217
AKDWGFGEFNWFDP

SEQ ID NO: 110435 - protein, 9 aa, Homo sapiens
  light chain complementarity determining region 3 for antibody 55218
QQYNSYPLT

SEQ ID NO: 110436 - protein, 24 aa, Homo sapiens
  heavy chain complementarity determining region 3 for antibody 55218
AREWEGNYGSGSYYKSAYYYGMDV

SEQ ID NO: 110437 - protein, 8 aa, Homo sapiens
  light chain complementarity determining region 3 for antibody 55219
QQRSNWYT

SEQ ID NO: 110438 - protein, 11 aa, Homo sapiens
  heavy chain complementarity determining region 3 for antibody 55219
ARDLRYSYGYY

SEQ ID NO: 110439 - protein, 9 aa, Homo sapiens
  light chain complementarity determining region 3 for antibody 55220
QQDYNLPFT

SEQ ID NO: 110440 - protein, 18 aa, Homo sapiens
  heavy chain complementarity determining region 3 for antibody 55220
ARVLWFGELLSHYYGMDV

SEQ ID NO: 110441 - protein, 9 aa, Homo sapiens
  light chain complementarity determining region 3 for antibody 55221
QKYNSAPLT

SEQ ID NO: 110442 - protein, 17 aa, Homo sapiens
  heavy chain complementarity determining region 3 for antibody 55221
ARGLRYFDWLFSDAFDI

SEQ ID NO: 110443 - protein, 9 aa, Homo sapiens
  light chain complementarity determining region 3 for antibody 55222
LQHNSYPRT

SEQ ID NO: 110444 - protein, 9 aa, Homo sapiens
  heavy chain complementarity determining region 3 for antibody 55222
LMVRGAMDV

SEQ ID NO: 110445 - protein, 9 aa, Homo sapiens
  light chain complementarity determining region 3 for antibody 55223
LQHDNFPRT

SEQ ID NO: 110446 - protein, 10 aa, Homo sapiens
  heavy chain complementarity determining region 3 for antibody 55223
ARDQGYGSGN

SEQ ID NO: 110447 - protein, 9 aa, Homo sapiens
  light chain complementarity determining region 3 for antibody 55224
LQDYNYPWT

SEQ ID NO: 110448 - protein, 12 aa, Homo sapiens
  heavy chain complementarity determining region 3 for antibody 55224
AREYYDILTLDY

SEQ ID NO: 110449 - protein, 9 aa, Homo sapiens
  light chain complementarity determining region 3 for antibody 55225
LQDYNYPRT

SEQ ID NO: 110450 - protein, 11 aa, Homo sapiens
  heavy chain complementarity determining region 3 for antibody 55225
ARDEHVLRYFD

SEQ ID NO: 110451 - protein, 9 aa, Homo sapiens
  light chain complementarity determining region 3 for antibody 55226
QQLNSYPLT

SEQ ID NO: 110452 - protein, 13 aa, Homo sapiens
  heavy chain complementarity determining region 3 for antibody 55226
ARYSSSWSDAFDI

SEQ ID NO: 110453 - protein, 9 aa, Homo sapiens
  light chain complementarity determining region 3 for antibody 55227
LQDYNYSWT

SEQ ID NO: 110454 - protein, 12 aa, Homo sapiens
  heavy chain complementarity determining region 3 for antibody 55227
ARDTMVRGVIDY

SEQ ID NO: 110455 - protein, 9 aa, Homo sapiens
  light chain complementarity determining region 3 for antibody 55228
LQDYNYPYT

SEQ ID NO: 110456 - protein, 16 aa, Homo sapiens
  heavy chain complementarity determining region 3 for antibody 55228
AREYSSRRDYYYGMDV

SEQ ID NO: 110457 - protein, 9 aa, Homo sapiens
  light chain complementarity determining region 3 for antibody 55229
QQYNSYPLT

SEQ ID NO: 110458 - protein, 10 aa, Homo sapiens
  heavy chain complementarity determining region 3 for antibody 55229
ARSYLDAFDI

SEQ ID NO: 110459 - protein, 9 aa, Homo sapiens
  light chain complementarity determining region 3 for antibody 55230
QQYNSYPLT

SEQ ID NO: 110460 - protein, 14 aa, Homo sapiens
  heavy chain complementarity determining region 3 for antibody 55230
ARGRYSGYDSFFDY

SEQ ID NO: 110461 - protein, 9 aa, Homo sapiens
  light chain complementarity determining region 3 for antibody 55231
QQYDNLPLT

SEQ ID NO: 110462 - protein, 16 aa, Homo sapiens
  heavy chain complementarity determining region 3 for antibody 55231
ARDAKYYDILTGYHDY

SEQ ID NO: 110463 - protein, 9 aa, Homo sapiens
  light chain complementarity determining region 3 for antibody 55232
QQLNSYPFT

SEQ ID NO: 110464 - protein, 8 aa, Homo sapiens
  heavy chain complementarity determining region 3 for antibody 55232
ARTGPLDY

SEQ ID NO: 110465 - protein, 9 aa, Homo sapiens
  light chain complementarity determining region 3 for antibody 55233
QQYNSYPYT

SEQ ID NO: 110466 - protein, 16 aa, Homo sapiens
  heavy chain complementarity determining region 3 for antibody 55233
ARERDNWNPYNHGMDV

SEQ ID NO: 110467 - protein, 9 aa, Homo sapiens
  light chain complementarity determining region 3 for antibody 55234
QQYDNLPLT

SEQ ID NO: 110468 - protein, 16 aa, Homo sapiens
  heavy chain complementarity determining region 3 for antibody 55234
AGDAKYYDILTGYPDY

SEQ ID NO: 110469 - protein, 8 aa, Homo sapiens
  light chain complementarity determining region 3 for antibody 55235
QQFNNYRT

SEQ ID NO: 110470 - protein, 15 aa, Homo sapiens
  heavy chain complementarity determining region 3 for antibody 55235
ARERTYYYGSGSFDY

SEQ ID NO: 110471 - protein, 9 aa, Homo sapiens
  light chain complementarity determining region 3 for antibody 55236
QQFNNYPYT

SEQ ID NO: 110472 - protein, 24 aa, Homo sapiens
  heavy chain complementarity determining region 3 for antibody 55236
AREWEGNYGSGSYYKSAYYYGIDV

SEQ ID NO: 110473 - protein, 9 aa, Homo sapiens
  light chain complementarity determining region 3 for antibody 55237
QQFNNYPYT

SEQ ID NO: 110474 - protein, 24 aa, Homo sapiens
  heavy chain complementarity determining region 3 for antibody 55237
AREWEGNYGSGSYYKSASYYGMDV

SEQ ID NO: 110475 - protein, 9 aa, Homo sapiens
  light chain complementarity determining region 3 for antibody 55238
QQFNNYPRT

SEQ ID NO: 110476 - protein, 14 aa, Homo sapiens
  heavy chain complementarity determining region 3 for antibody 55238
ARDGGWFGEDAFDI

SEQ ID NO: 110477 - protein, 9 aa, Homo sapiens
  light chain complementarity determining region 3 for antibody 55239
QKYNSAPLT

SEQ ID NO: 110478 - protein, 17 aa, Homo sapiens
  heavy chain complementarity determining region 3 for antibody 55239
ARGLRYFDWFLSDAFDI

SEQ ID NO: 110479 - protein, 9 aa, Homo sapiens
  light chain complementarity determining region 3 for antibody 55240
LQHNSYPYT

SEQ ID NO: 110480 - protein, 12 aa, Homo sapiens
  heavy chain complementarity determining region 3 for antibody 55240
ARDQDYYYGMDV

SEQ ID NO: 110481 - protein, 9 aa, Homo sapiens
  light chain complementarity determining region 3 for antibody 55241
LQHNSYPFT

SEQ ID NO: 110482 - protein, 16 aa, Homo sapiens
  heavy chain complementarity determining region 3 for antibody 55241
ASLFVDIVIVPAAFDY

SEQ ID NO: 110483 - protein, 9 aa, Homo sapiens
  light chain complementarity determining region 3 for antibody 55242
LQDYNYPFT

SEQ ID NO: 110484 - protein, 15 aa, Homo sapiens
  heavy chain complementarity determining region 3 for antibody 55242
ARAPLLLWFGEVIDY

SEQ ID NO: 110485 - protein, 9 aa, Homo sapiens
  light chain complementarity determining region 3 for antibody 55243
QKYTSAPFT

SEQ ID NO: 110486 - protein, 18 aa, Homo sapiens
  heavy chain complementarity determining region 3 for antibody 55243
ARGQIYYGSGTYYSPFDY

SEQ ID NO: 110487 - protein, 9 aa, Homo sapiens
  light chain complementarity determining region 3 for antibody 55244
QKYNSAPLT

SEQ ID NO: 110488 - protein, 17 aa, Homo sapiens
  heavy chain complementarity determining region 3 for antibody 55244
ARGLRDFDWLLSDAFDI

SEQ ID NO: 110489 - protein, 9 aa, Homo sapiens
  light chain complementarity determining region 3 for antibody 55245
QKYNSAPLT

SEQ ID NO: 110490 - protein, 9 aa, Homo sapiens
  heavy chain complementarity determining region 3 for antibody 55245
ARDGRGIDY

SEQ ID NO: 110491 - protein, 9 aa, Homo sapiens
  light chain complementarity determining region 3 for antibody 55246
LQDYNYPWT

SEQ ID NO: 110492 - protein, 12 aa, Homo sapiens
  heavy chain complementarity determining region 3 for antibody 55246
ARDTRVRGVIDY

SEQ ID NO: 110493 - protein, 9 aa, Homo sapiens
  light chain complementarity determining region 3 for antibody 55247
LQDYNYPWT

SEQ ID NO: 110494 - protein, 16 aa, Homo sapiens
  heavy chain complementarity determining region 3 for antibody 55247
ARDAKYYDILTGSPDY

SEQ ID NO: 110495 - protein, 9 aa, Homo sapiens
  light chain complementarity determining region 3 for antibody 55248
QQYNSYPRT

SEQ ID NO: 110496 - protein, 10 aa, Homo sapiens
  heavy chain complementarity determining region 3 for antibody 55248
ARDKGYYFDY

SEQ ID NO: 110497 - protein, 10 aa, Homo sapiens
  light chain complementarity determining region 3 for antibody 55249
QQRSNWPPLT

SEQ ID NO: 110498 - protein, 19 aa, Homo sapiens
  heavy chain complementarity determining region 3 for antibody 55249
ATERYKVGATYYYSYGMDV

SEQ ID NO: 110499 - protein, 9 aa, Homo sapiens
  light chain complementarity determining region 3 for antibody 55250
QQLNSYPRT

SEQ ID NO: 110500 - protein, 8 aa, Homo sapiens
  heavy chain complementarity determining region 3 for antibody 55250
AREGYFDL

SEQ ID NO: 110501 - protein, 9 aa, Homo sapiens
  light chain complementarity determining region 3 for antibody 55251
QQFNNYPYT

SEQ ID NO: 110502 - protein, 24 aa, Homo sapiens
  heavy chain complementarity determining region 3 for antibody 55251
AREWEGNYGSGSYYKSACYYGMDV

SEQ ID NO: 110503 - protein, 9 aa, Homo sapiens
  light chain complementarity determining region 3 for antibody 55252
QQFNNYPYT

SEQ ID NO: 110504 - protein, 24 aa, Homo sapiens
  heavy chain complementarity determining region 3 for antibody 55252
AREWEGNYGSGRYYKSAYYYGMDV

SEQ ID NO: 110505 - protein, 9 aa, Homo sapiens
  light chain complementarity determining region 3 for antibody 55253
LQHNSYPYT

SEQ ID NO: 110506 - protein, 13 aa, Homo sapiens
  heavy chain complementarity determining region 3 for antibody 55253
ARIAAAAVQYFHH

SEQ ID NO: 110507 - protein, 9 aa, Homo sapiens
  light chain complementarity determining region 3 for antibody 55254
LQHNSYPFT

SEQ ID NO: 110508 - protein, 16 aa, Homo sapiens
  heavy chain complementarity determining region 3 for antibody 55254
ACLFVDIVVVPAAFDY

SEQ ID NO: 110509 - protein, 9 aa, Homo sapiens
  light chain complementarity determining region 3 for antibody 55255
LQDYNYPLT

SEQ ID NO: 110510 - protein, 14 aa, Homo sapiens
  heavy chain complementarity determining region 3 for antibody 55255
ARQEYDILTGYRDY

SEQ ID NO: 110511 - protein, 9 aa, Homo sapiens
  light chain complementarity determining region 3 for antibody 55256
LQDYNYPFT

SEQ ID NO: 110512 - protein, 15 aa, Homo sapiens
  heavy chain complementarity determining region 3 for antibody 55256
AGAPLLLWFGEFIDY

SEQ ID NO: 110513 - protein, 9 aa, Homo sapiens
  light chain complementarity determining region 3 for antibody 55257
HQSSSLPHT

SEQ ID NO: 110514 - protein, 12 aa, Homo sapiens
  heavy chain complementarity determining region 3 for antibody 55257
ARALYYYYGMDV

SEQ ID NO: 110515 - protein, 9 aa, Homo sapiens
  light chain complementarity determining region 3 for antibody 55258
QQSYSTPWT

SEQ ID NO: 110516 - protein, 11 aa, Homo sapiens
  heavy chain complementarity determining region 3 for antibody 55258
ARDEHVLRYSD

SEQ ID NO: 110517 - protein, 9 aa, Homo sapiens
  light chain complementarity determining region 3 for antibody 55259
QQLNSYPLT

SEQ ID NO: 110518 - protein, 13 aa, Homo sapiens
  heavy chain complementarity determining region 3 for antibody 55259
ARYSSSCYDAFDI

SEQ ID NO: 110519 - protein, 9 aa, Homo sapiens
  light chain complementarity determining region 3 for antibody 55260
QKYNSAPLT

SEQ ID NO: 110520 - protein, 9 aa, Homo sapiens
  heavy chain complementarity determining region 3 for antibody 55260
ARDALGIDY

SEQ ID NO: 110521 - protein, 9 aa, Homo sapiens
  light chain complementarity determining region 3 for antibody 55261
LQHDNFPWT

SEQ ID NO: 110522 - protein, 13 aa, Homo sapiens
  heavy chain complementarity determining region 3 for antibody 55261
ARDYYGSGSYYDY

SEQ ID NO: 110523 - protein, 9 aa, Homo sapiens
  light chain complementarity determining region 3 for antibody 55262
LQHDNFPLT

SEQ ID NO: 110524 - protein, 12 aa, Homo sapiens
  heavy chain complementarity determining region 3 for antibody 55262
ARDASYSGSLDY

SEQ ID NO: 110525 - protein, 9 aa, Homo sapiens
  light chain complementarity determining region 3 for antibody 55263
LQDYNYPFT

SEQ ID NO: 110526 - protein, 15 aa, Homo sapiens
  heavy chain complementarity determining region 3 for antibody 55263
ARAPVLLWFGEFIDY

SEQ ID NO: 110527 - protein, 9 aa, Homo sapiens
  light chain complementarity determining region 3 for antibody 55264
LQDYNYPFT

SEQ ID NO: 110528 - protein, 15 aa, Homo sapiens
  heavy chain complementarity determining region 3 for antibody 55264
ARAPLFLWFGEFIDY

SEQ ID NO: 110529 - protein, 9 aa, Homo sapiens
  light chain complementarity determining region 3 for antibody 55265
LQDSNYPRT

SEQ ID NO: 110530 - protein, 20 aa, Homo sapiens
  heavy chain complementarity determining region 3 for antibody 55265
AKDQGDIVATIMDFYYGMDV

SEQ ID NO: 110531 - protein, 9 aa, Homo sapiens
  light chain complementarity determining region 3 for antibody 55266
QQYNSYPWT

SEQ ID NO: 110532 - protein, 13 aa, Homo sapiens
  heavy chain complementarity determining region 3 for antibody 55266
ASLQLERRWYFDY

SEQ ID NO: 110533 - protein, 9 aa, Homo sapiens
  light chain complementarity determining region 3 for antibody 55267
QQYNSYPFT

SEQ ID NO: 110534 - protein, 9 aa, Homo sapiens
  heavy chain complementarity determining region 3 for antibody 55267
AREDLGFDY

SEQ ID NO: 110535 - protein, 9 aa, Homo sapiens
  light chain complementarity determining region 3 for antibody 55268
QQYNSYPFT

SEQ ID NO: 110536 - protein, 16 aa, Homo sapiens
  heavy chain complementarity determining region 3 for antibody 55268
AGDYYDSSGYWGHFDY

SEQ ID NO: 110537 - protein, 9 aa, Homo sapiens
  light chain complementarity determining region 3 for antibody 55269
QQYNSAPLT

SEQ ID NO: 110538 - protein, 13 aa, Homo sapiens
  heavy chain complementarity determining region 3 for antibody 55269
ARDRYSGYGAFDY

SEQ ID NO: 110539 - protein, 9 aa, Homo sapiens
  light chain complementarity determining region 3 for antibody 55270
QQSYSTPWT

SEQ ID NO: 110540 - protein, 15 aa, Homo sapiens
  heavy chain complementarity determining region 3 for antibody 55270
AREGRLAVAVTGFDY

SEQ ID NO: 110541 - protein, 9 aa, Homo sapiens
  light chain complementarity determining region 3 for antibody 55271
QQFNNYPYT

SEQ ID NO: 110542 - protein, 24 aa, Homo sapiens
  heavy chain complementarity determining region 3 for antibody 55271
AREWEGNYGAGSYYKSAYYYGMDV

SEQ ID NO: 110543 - protein, 9 aa, Homo sapiens
  light chain complementarity determining region 3 for antibody 55272
QKYNSAPLT

SEQ ID NO: 110544 - protein, 16 aa, Homo sapiens
  heavy chain complementarity determining region 3 for antibody 55272
ARDAKYYDILTGYHDY

SEQ ID NO: 110545 - protein, 10 aa, Homo sapiens
  light chain complementarity determining region 3 for antibody 55273
LQHDNFPLYT

SEQ ID NO: 110546 - protein, 14 aa, Homo sapiens
  heavy chain complementarity determining region 3 for antibody 55273
ARASGSYYYYGLDV

SEQ ID NO: 110547 - protein, 9 aa, Homo sapiens
  light chain complementarity determining region 3 for antibody 55274
LQDYNYPWT

SEQ ID NO: 110548 - protein, 12 aa, Homo sapiens
  heavy chain complementarity determining region 3 for antibody 55274
ARDTMVPGVIDY

SEQ ID NO: 110549 - protein, 9 aa, Homo sapiens
  light chain complementarity determining region 3 for antibody 55275
HQSSVLPHT

SEQ ID NO: 110550 - protein, 12 aa, Homo sapiens
  heavy chain complementarity determining region 3 for antibody 55275
SRDTMVRGVIDY

SEQ ID NO: 110551 - protein, 9 aa, Homo sapiens
  light chain complementarity determining region 3 for antibody 55276
QQYNSYPYT

SEQ ID NO: 110552 - protein, 16 aa, Homo sapiens
  heavy chain complementarity determining region 3 for antibody 55276
ARDPLYNWNDEGAFDI

SEQ ID NO: 110553 - protein, 10 aa, Homo sapiens
  light chain complementarity determining region 3 for antibody 55277
QQYGSSPMYT

SEQ ID NO: 110554 - protein, 14 aa, Homo sapiens
  heavy chain complementarity determining region 3 for antibody 55277
AREGFGESPDAFDI

SEQ ID NO: 110555 - protein, 9 aa, Homo sapiens
  light chain complementarity determining region 3 for antibody 55278
QQYDNLPYT

SEQ ID NO: 110556 - protein, 12 aa, Homo sapiens
  heavy chain complementarity determining region 3 for antibody 55278
ARDRYSSGHFDY

SEQ ID NO: 110557 - protein, 9 aa, Homo sapiens
  light chain complementarity determining region 3 for antibody 55279
QQLNSYPYT

SEQ ID NO: 110558 - protein, 9 aa, Homo sapiens
  heavy chain complementarity determining region 3 for antibody 55279
ARKRWYIDL

SEQ ID NO: 110559 - protein, 9 aa, Homo sapiens
  light chain complementarity determining region 3 for antibody 55280
QQLNSYPLT

SEQ ID NO: 110560 - protein, 10 aa, Homo sapiens
  heavy chain complementarity determining region 3 for antibody 55280
ARGWDWYFDL

SEQ ID NO: 110561 - protein, 9 aa, Homo sapiens
  light chain complementarity determining region 3 for antibody 55281
QKYNSAPLT

SEQ ID NO: 110562 - protein, 8 aa, Homo sapiens
  heavy chain complementarity determining region 3 for antibody 55281
ARTGPIDY

SEQ ID NO: 110563 - protein, 9 aa, Homo sapiens
  light chain complementarity determining region 3 for antibody 55282
QKYDSAPLT

SEQ ID NO: 110564 - protein, 8 aa, Homo sapiens
  heavy chain complementarity determining region 3 for antibody 55282
ARTGPLDY

SEQ ID NO: 110565 - protein, 9 aa, Homo sapiens
  light chain complementarity determining region 3 for antibody 55283
LQDYNYPYT

SEQ ID NO: 110566 - protein, 12 aa, Homo sapiens
  heavy chain complementarity determining region 3 for antibody 55283
ARDTMVRGVIDY

SEQ ID NO: 110567 - protein, 9 aa, Homo sapiens
  light chain complementarity determining region 3 for antibody 55284
LQDYNYPWT

SEQ ID NO: 110568 - protein, 7 aa, Homo sapiens
  heavy chain complementarity determining region 3 for antibody 55284
ARGRTYF

SEQ ID NO: 110569 - protein, 9 aa, Homo sapiens
  light chain complementarity determining region 3 for antibody 55285
LQDYNYPWT

SEQ ID NO: 110570 - protein, 12 aa, Homo sapiens
  heavy chain complementarity determining region 3 for antibody 55285
ARETMVRGVIDY

SEQ ID NO: 110571 - protein, 9 aa, Homo sapiens
  light chain complementarity determining region 3 for antibody 55286
LQDYNYPWT

SEQ ID NO: 110572 - protein, 16 aa, Homo sapiens
  heavy chain complementarity determining region 3 for antibody 55286
ARDAKYYDILTGYHDY

SEQ ID NO: 110573 - protein, 9 aa, Homo sapiens
  light chain complementarity determining region 3 for antibody 55287
LQDYNYPRT

SEQ ID NO: 110574 - protein, 16 aa, Homo sapiens
  heavy chain complementarity determining region 3 for antibody 55287
ARGGGYFDPYYYGMDV

SEQ ID NO: 110575 - protein, 9 aa, Homo sapiens
  light chain complementarity determining region 3 for antibody 55288
LQDYNYPPT

SEQ ID NO: 110576 - protein, 20 aa, Homo sapiens
  heavy chain complementarity determining region 3 for antibody 55288
ARGGGYYYGSGSYDYYGMDV

SEQ ID NO: 110577 - protein, 9 aa, Homo sapiens
  light chain complementarity determining region 3 for antibody 55289
QQYNSYPRT

SEQ ID NO: 110578 - protein, 18 aa, Homo sapiens
  heavy chain complementarity determining region 3 for antibody 55289
AREIGSYYDDYYYYGMDV

SEQ ID NO: 110579 - protein, 9 aa, Homo sapiens
  light chain complementarity determining region 3 for antibody 55290
QQLNSYPLT

SEQ ID NO: 110580 - protein, 13 aa, Homo sapiens
  heavy chain complementarity determining region 3 for antibody 55290
ARYSSSLYDAFDI

SEQ ID NO: 110581 - protein, 9 aa, Homo sapiens
  light chain complementarity determining region 3 for antibody 55291
QQLNSYPFT

SEQ ID NO: 110582 - protein, 10 aa, Homo sapiens
  heavy chain complementarity determining region 3 for antibody 55291
ARDRGSYFDY

SEQ ID NO: 110583 - protein, 9 aa, Homo sapiens
  light chain complementarity determining region 3 for antibody 55292
QKYNSAPLT

SEQ ID NO: 110584 - protein, 8 aa, Homo sapiens
  heavy chain complementarity determining region 3 for antibody 55292
ARTGALDY

SEQ ID NO: 110585 - protein, 9 aa, Homo sapiens
  light chain complementarity determining region 3 for antibody 55293
QKYNSAPLT

SEQ ID NO: 110586 - protein, 8 aa, Homo sapiens
  heavy chain complementarity determining region 3 for antibody 55293
ARSGPLDY

SEQ ID NO: 110587 - protein, 9 aa, Homo sapiens
  light chain complementarity determining region 3 for antibody 55294
QKYNSAPLT

SEQ ID NO: 110588 - protein, 17 aa, Homo sapiens
  heavy chain complementarity determining region 3 for antibody 55294
ARGLRYFDCLLSDAFDI

SEQ ID NO: 110589 - protein, 9 aa, Homo sapiens
  light chain complementarity determining region 3 for antibody 55295
QKYNSAPLT

SEQ ID NO: 110590 - protein, 9 aa, Homo sapiens
  heavy chain complementarity determining region 3 for antibody 55295
ARDGPGIDY

SEQ ID NO: 110591 - protein, 9 aa, Homo sapiens
  light chain complementarity determining region 3 for antibody 55296
LQDYNYPYT

SEQ ID NO: 110592 - protein, 12 aa, Homo sapiens
  heavy chain complementarity determining region 3 for antibody 55296
ARDGGEARPFDY

SEQ ID NO: 110593 - protein, 9 aa, Homo sapiens
  light chain complementarity determining region 3 for antibody 55297
LQDYNYPWT

SEQ ID NO: 110594 - protein, 12 aa, Homo sapiens
  heavy chain complementarity determining region 3 for antibody 55297
ASDTMVRGVIDY

SEQ ID NO: 110595 - protein, 9 aa, Homo sapiens
  light chain complementarity determining region 3 for antibody 55298
LQDYNYPFT

SEQ ID NO: 110596 - protein, 15 aa, Homo sapiens
  heavy chain complementarity determining region 3 for antibody 55298
ARAPLLLWLGEFIDY

SEQ ID NO: 110597 - protein, 9 aa, Homo sapiens
  light chain complementarity determining region 3 for antibody 55299
QQLNTYPYT

SEQ ID NO: 110598 - protein, 9 aa, Homo sapiens
  heavy chain complementarity determining region 3 for antibody 55299
ARKQRYFDY

SEQ ID NO: 110599 - protein, 9 aa, Homo sapiens
  light chain complementarity determining region 3 for antibody 55300
QQLNNSPYT

SEQ ID NO: 110600 - protein, 10 aa, Homo sapiens
  heavy chain complementarity determining region 3 for antibody 55300
AGGSGYYFDY

SEQ ID NO: 110601 - protein, 9 aa, Homo sapiens
  light chain complementarity determining region 3 for antibody 55301
QQFNNYPRT

SEQ ID NO: 110602 - protein, 12 aa, Homo sapiens
  heavy chain complementarity determining region 3 for antibody 55301
ARDRYFDWPPDY

SEQ ID NO: 110603 - protein, 9 aa, Homo sapiens
  light chain complementarity determining region 3 for antibody 55302
LQHNSYPWT

SEQ ID NO: 110604 - protein, 12 aa, Homo sapiens
  heavy chain complementarity determining region 3 for antibody 55302
ARDITVRGVIDY

SEQ ID NO: 110605 - protein, 9 aa, Homo sapiens
  light chain complementarity determining region 3 for antibody 55303
LQHNSYPPT

SEQ ID NO: 110606 - protein, 8 aa, Homo sapiens
  heavy chain complementarity determining region 3 for antibody 55303
ARTGPLDY

SEQ ID NO: 110607 - protein, 9 aa, Homo sapiens
  light chain complementarity determining region 3 for antibody 55304
LQHDTYPWT

SEQ ID NO: 110608 - protein, 14 aa, Homo sapiens
  heavy chain complementarity determining region 3 for antibody 55304
ARDRELLWFGELFP

SEQ ID NO: 110609 - protein, 9 aa, Homo sapiens
  light chain complementarity determining region 3 for antibody 55305
LQHDNFPLT

SEQ ID NO: 110610 - protein, 15 aa, Homo sapiens
  heavy chain complementarity determining region 3 for antibody 55305
ARGGPYYFGSGSLDY

SEQ ID NO: 110611 - protein, 9 aa, Homo sapiens
  light chain complementarity determining region 3 for antibody 55306
LQDYNYPYT

SEQ ID NO: 110612 - protein, 8 aa, Homo sapiens
  heavy chain complementarity determining region 3 for antibody 55306
ARTGPLDY

SEQ ID NO: 110613 - protein, 9 aa, Homo sapiens
  light chain complementarity determining region 3 for antibody 55307
LQDYNYPWT

SEQ ID NO: 110614 - protein, 16 aa, Homo sapiens
  heavy chain complementarity determining region 3 for antibody 55307
AGDAKYYDILTGYPDY

SEQ ID NO: 110615 - protein, 9 aa, Homo sapiens
  light chain complementarity determining region 3 for antibody 55308
LQDYNYPFT

SEQ ID NO: 110616 - protein, 15 aa, Homo sapiens
  heavy chain complementarity determining region 3 for antibody 55308
ARAPLLLWFAEFIDY

SEQ ID NO: 110617 - protein, 9 aa, Homo sapiens
  light chain complementarity determining region 3 for antibody 55309
HQLNSYPYT

SEQ ID NO: 110618 - protein, 9 aa, Homo sapiens
  heavy chain complementarity determining region 3 for antibody 55309
ARKQRYFDY

SEQ ID NO: 110619 - protein, 9 aa, Homo sapiens
  light chain complementarity determining region 3 for antibody 55310
QQYNSYPLT

SEQ ID NO: 110620 - protein, 14 aa, Homo sapiens
  heavy chain complementarity determining region 3 for antibody 55310
ARGRTTVTTNYFDY

SEQ ID NO: 110621 - protein, 9 aa, Homo sapiens
  light chain complementarity determining region 3 for antibody 55311
QQSYSTPLT

SEQ ID NO: 110622 - protein, 16 aa, Homo sapiens
  heavy chain complementarity determining region 3 for antibody 55311
ARDYDILTGYRDAFDI

SEQ ID NO: 110623 - protein, 9 aa, Homo sapiens
  light chain complementarity determining region 3 for antibody 55312
QQLNSYPYS

SEQ ID NO: 110624 - protein, 9 aa, Homo sapiens
  heavy chain complementarity determining region 3 for antibody 55312
ARKRWYFDL

SEQ ID NO: 110625 - protein, 9 aa, Homo sapiens
  light chain complementarity determining region 3 for antibody 55313
QQFNNYPYT

SEQ ID NO: 110626 - protein, 24 aa, Homo sapiens
  heavy chain complementarity determining region 3 for antibody 55313
AREWDGNYGSGSYYKSAYYYGMDV

SEQ ID NO: 110627 - protein, 9 aa, Homo sapiens
  light chain complementarity determining region 3 for antibody 55314
LQHNSYPFT

SEQ ID NO: 110628 - protein, 16 aa, Homo sapiens
  heavy chain complementarity determining region 3 for antibody 55314
ASLFADIVVVPAAFDY

SEQ ID NO: 110629 - protein, 9 aa, Homo sapiens
  light chain complementarity determining region 3 for antibody 55315
LQHDSYPYT

SEQ ID NO: 110630 - protein, 15 aa, Homo sapiens
  heavy chain complementarity determining region 3 for antibody 55315
ARHKREAPGYWYFDL

SEQ ID NO: 110631 - protein, 9 aa, Homo sapiens
  light chain complementarity determining region 3 for antibody 55316
LQDYNYPFT

SEQ ID NO: 110632 - protein, 15 aa, Homo sapiens
  heavy chain complementarity determining region 3 for antibody 55316
ARAPLLLWFGEFIDC

SEQ ID NO: 110633 - protein, 9 aa, Homo sapiens
  light chain complementarity determining region 3 for antibody 55317
QQYGSSPYT

SEQ ID NO: 110634 - protein, 16 aa, Homo sapiens
  heavy chain complementarity determining region 3 for antibody 55317
ARDRGIGIGSAGYFDY

SEQ ID NO: 110635 - protein, 9 aa, Homo sapiens
  light chain complementarity determining region 3 for antibody 55318
QQLNSYPRT

SEQ ID NO: 110636 - protein, 21 aa, Homo sapiens
  heavy chain complementarity determining region 3 for antibody 55318
ARGDLRGYSGYDHYYYYGMDV

SEQ ID NO: 110637 - protein, 9 aa, Homo sapiens
  light chain complementarity determining region 3 for antibody 55319
QQLNSYPRT

SEQ ID NO: 110638 - protein, 16 aa, Homo sapiens
  heavy chain complementarity determining region 3 for antibody 55319
ARDRGMTTVSHDAFDI

SEQ ID NO: 110639 - protein, 9 aa, Homo sapiens
  light chain complementarity determining region 3 for antibody 55320
QQLNSYPLT

SEQ ID NO: 110640 - protein, 13 aa, Homo sapiens
  heavy chain complementarity determining region 3 for antibody 55320
ERYSSSWYDAFDI

SEQ ID NO: 110641 - protein, 9 aa, Homo sapiens
  light chain complementarity determining region 3 for antibody 55321
QQLNSYPFT

SEQ ID NO: 110642 - protein, 9 aa, Homo sapiens
  heavy chain complementarity determining region 3 for antibody 55321
ARKRWYFDL

SEQ ID NO: 110643 - protein, 8 aa, Homo sapiens
  light chain complementarity determining region 3 for antibody 55322
QQFYDYYT

SEQ ID NO: 110644 - protein, 10 aa, Homo sapiens
  heavy chain complementarity determining region 3 for antibody 55322
ARGVRGVFDY

SEQ ID NO: 110645 - protein, 9 aa, Homo sapiens
  light chain complementarity determining region 3 for antibody 55323
QQFNNYPYT

SEQ ID NO: 110646 - protein, 24 aa, Homo sapiens
  heavy chain complementarity determining region 3 for antibody 55323
AREWEGNYGSGSYYKSAYYYGMAV

SEQ ID NO: 110647 - protein, 9 aa, Homo sapiens
  light chain complementarity determining region 3 for antibody 55324
QQFNNYPYT

SEQ ID NO: 110648 - protein, 24 aa, Homo sapiens
  heavy chain complementarity determining region 3 for antibody 55324
AREWEGNYGSGSYYKSAYYYAMDV

SEQ ID NO: 110649 - protein, 9 aa, Homo sapiens
  light chain complementarity determining region 3 for antibody 55325
QQFNNYPYT

SEQ ID NO: 110650 - protein, 24 aa, Homo sapiens
  heavy chain complementarity determining region 3 for antibody 55325
AREWEGNYGSGGYYKSAYYYGMDV

SEQ ID NO: 110651 - protein, 8 aa, Homo sapiens
  light chain complementarity determining region 3 for antibody 55326
QQDYNLRT

SEQ ID NO: 110652 - protein, 14 aa, Homo sapiens
  heavy chain complementarity determining region 3 for antibody 55326
ARDYYDILTGSFDY

SEQ ID NO: 110653 - protein, 9 aa, Homo sapiens
  light chain complementarity determining region 3 for antibody 55327
QKYNSAPLT

SEQ ID NO: 110654 - protein, 16 aa, Homo sapiens
  heavy chain complementarity determining region 3 for antibody 55327
ARDAKYYDILTGYTDY

SEQ ID NO: 110655 - protein, 9 aa, Homo sapiens
  light chain complementarity determining region 3 for antibody 55328
LQDYNYPWT

SEQ ID NO: 110656 - protein, 14 aa, Homo sapiens
  heavy chain complementarity determining region 3 for antibody 55328
ARDVYYGSGSPLDY

SEQ ID NO: 110657 - protein, 9 aa, Homo sapiens
  light chain complementarity determining region 3 for antibody 55329
LQDYNYPWT

SEQ ID NO: 110658 - protein, 9 aa, Homo sapiens
  heavy chain complementarity determining region 3 for antibody 55329
ARDGLGIDY

SEQ ID NO: 110659 - protein, 9 aa, Homo sapiens
  light chain complementarity determining region 3 for antibody 55330
LQDYNYPWT

SEQ ID NO: 110660 - protein, 10 aa, Homo sapiens
  heavy chain complementarity determining region 3 for antibody 55330
AGELLPGMDV

SEQ ID NO: 110661 - protein, 9 aa, Homo sapiens
  light chain complementarity determining region 3 for antibody 55331
LQDYNYPRT

SEQ ID NO: 110662 - protein, 18 aa, Homo sapiens
  heavy chain complementarity determining region 3 for antibody 55331
ARGGGYYYGSYYYYGMDV

SEQ ID NO: 110663 - protein, 9 aa, Homo sapiens
  light chain complementarity determining region 3 for antibody 55332
LQDYNYPHT

SEQ ID NO: 110664 - protein, 11 aa, Homo sapiens
  heavy chain complementarity determining region 3 for antibody 55332
ARYSYYYGMDV

SEQ ID NO: 110665 - protein, 9 aa, Homo sapiens
  light chain complementarity determining region 3 for antibody 55333
LQDYNYPFT

SEQ ID NO: 110666 - protein, 15 aa, Homo sapiens
  heavy chain complementarity determining region 3 for antibody 55333
PRAPLLLWFGEFIDY

SEQ ID NO: 110667 - protein, 9 aa, Homo sapiens
  light chain complementarity determining region 3 for antibody 55334
LQDYNYPFT

SEQ ID NO: 110668 - protein, 15 aa, Homo sapiens
  heavy chain complementarity determining region 3 for antibody 55334
ARDPLLLWFGEFIDY

SEQ ID NO: 110669 - protein, 9 aa, Homo sapiens
  light chain complementarity determining region 3 for antibody 55335
LQDYNYPFT

SEQ ID NO: 110670 - protein, 15 aa, Homo sapiens
  heavy chain complementarity determining region 3 for antibody 55335
ARAPSLLWFGEFIDY

SEQ ID NO: 110671 - protein, 9 aa, Homo sapiens
  light chain complementarity determining region 3 for antibody 55336
LQDYNYPFT

SEQ ID NO: 110672 - protein, 15 aa, Homo sapiens
  heavy chain complementarity determining region 3 for antibody 55336
ARAPLLLWFGEFIAY

SEQ ID NO: 110673 - protein, 9 aa, Homo sapiens
  light chain complementarity determining region 3 for antibody 55337
HQSSSLPYT

SEQ ID NO: 110674 - protein, 14 aa, Homo sapiens
  heavy chain complementarity determining region 3 for antibody 55337
ARDVRIVGATAFDI

SEQ ID NO: 110675 - protein, 9 aa, Homo sapiens
  light chain complementarity determining region 3 for antibody 55338
HQSSSLPYT

SEQ ID NO: 110676 - protein, 7 aa, Homo sapiens
  heavy chain complementarity determining region 3 for antibody 55338
ARDFIAA

SEQ ID NO: 110677 - protein, 9 aa, Homo sapiens
  light chain complementarity determining region 3 for antibody 55339
QQYNSYPRT

SEQ ID NO: 110678 - protein, 17 aa, Homo sapiens
  heavy chain complementarity determining region 3 for antibody 55339
ARGLRDFDWLLSDAFDI

SEQ ID NO: 110679 - protein, 10 aa, Homo sapiens [sequence omitted]

SEQ ID NO: 110680 - protein, 16 aa, Homo sapiens
  heavy chain complementarity determining region 3 for antibody 55340
ARDNSSGWYGYYGMDV

SEQ ID NO: 110681 - protein, 10 aa, Homo sapiens
  light chain complementarity determining region 3 for antibody 55341
QQYGSSPMYT

SEQ ID NO: 110682 - protein, 17 aa, Homo sapiens
  heavy chain complementarity determining region 3 for antibody 55341
ARDRIAAAAYYYYGMDV

SEQ ID NO: 110683 - protein, 9 aa, Homo sapiens
  light chain complementarity determining region 3 for antibody 55342
QQYGRSPYT

SEQ ID NO: 110684 - protein, 19 aa, Homo sapiens
  heavy chain complementarity determining region 3 for antibody 55342
ARGPLLRYFDWLLSNPLDY

SEQ ID NO: 110685 - protein, 9 aa, Homo sapiens
  light chain complementarity determining region 3 for antibody 55343
QQSNNYPYT

SEQ ID NO: 110686 - protein, 24 aa, Homo sapiens
  heavy chain complementarity determining region 3 for antibody 55343
AREWEGNYGSGSYYKSAYYYGMDV

SEQ ID NO: 110687 - protein, 9 aa, Homo sapiens
  light chain complementarity determining region 3 for antibody 55344
QQLNSYPYT

SEQ ID NO: 110688 - protein, 16 aa, Homo sapiens
  heavy chain complementarity determining region 3 for antibody 55344
ARDYDILTGYYNVFDY

SEQ ID NO: 110689 - protein, 9 aa, Homo sapiens
  light chain complementarity determining region 3 for antibody 55345
QQLNNYPYT

SEQ ID NO: 110690 - protein, 9 aa, Homo sapiens
  heavy chain complementarity determining region 3 for antibody 55345
ARKRWYLDL

SEQ ID NO: 110691 - protein, 9 aa, Homo sapiens
  light chain complementarity determining region 3 for antibody 55346
QQFNNYPYT

SEQ ID NO: 110692 - protein, 24 aa, Homo sapiens
  heavy chain complementarity determining region 3 for antibody 55346
AREWEGNYGSGSYYKSVYYYGMDV

SEQ ID NO: 110693 - protein, 8 aa, Homo sapiens
  light chain complementarity determining region 3 for antibody 55347
QQFNNYPT

SEQ ID NO: 110694 - protein, 13 aa, Homo sapiens
  heavy chain complementarity determining region 3 for antibody 55347
ARGYGSGSYPFDY

SEQ ID NO: 110695 - protein, 9 aa, Homo sapiens
  light chain complementarity determining region 3 for antibody 55348
QKYNSAPWT

SEQ ID NO: 110696 - protein, 14 aa, Homo sapiens
  heavy chain complementarity determining region 3 for antibody 55348
ARSYDILTGWYFDL

SEQ ID NO: 110697 - protein, 9 aa, Homo sapiens
  light chain complementarity determining region 3 for antibody 55349
QKYNSAPLT

SEQ ID NO: 110698 - protein, 8 aa, Homo sapiens
  heavy chain complementarity determining region 3 for antibody 55349
ASTGPLDY

SEQ ID NO: 110699 - protein, 9 aa, Homo sapiens
  light chain complementarity determining region 3 for antibody 55350
QKYNSAPLT

SEQ ID NO: 110700 - protein, 8 aa, Homo sapiens
  heavy chain complementarity determining region 3 for antibody 55350
ARAGPLDY

SEQ ID NO: 110701 - protein, 9 aa, Homo sapiens
  light chain complementarity determining region 3 for antibody 55351
LQHNSYPYT

SEQ ID NO: 110702 - protein, 13 aa, Homo sapiens
  heavy chain complementarity determining region 3 for antibody 55351
ARIAAAAVQDFQH

SEQ ID NO: 110703 - protein, 9 aa, Homo sapiens
  light chain complementarity determining region 3 for antibody 55352
LQHNSYPYT

SEQ ID NO: 110704 - protein, 11 aa, Homo sapiens
  heavy chain complementarity determining region 3 for antibody 55352
ARERYEEAFDI

SEQ ID NO: 110705 - protein, 9 aa, Homo sapiens
  light chain complementarity determining region 3 for antibody 55353
LQDYNYPYT

SEQ ID NO: 110706 - protein, 16 aa, Homo sapiens
  heavy chain complementarity determining region 3 for antibody 55353
ARGGGGSYFHYYGMDV

SEQ ID NO: 110707 - protein, 9 aa, Homo sapiens
  light chain complementarity determining region 3 for antibody 55354
LQDYNYPYT

SEQ ID NO: 110708 - protein, 10 aa, Homo sapiens
  heavy chain complementarity determining region 3 for antibody 55354
ARDLNWGLDY

SEQ ID NO: 110709 - protein, 9 aa, Homo sapiens
  light chain complementarity determining region 3 for antibody 55355
LQDYNYPYT

SEQ ID NO: 110710 - protein, 16 aa, Homo sapiens
  heavy chain complementarity determining region 3 for antibody 55355
AKEGTITTAGTGGFDY

SEQ ID NO: 110711 - protein, 9 aa, Homo sapiens
  light chain complementarity determining region 3 for antibody 55356
LQDYNYPYT

SEQ ID NO: 110712 - protein, 16 aa, Homo sapiens
  heavy chain complementarity determining region 3 for antibody 55356
AKEGPIAAAGTGAFDI

SEQ ID NO: 110713 - protein, 9 aa, Homo sapiens
  light chain complementarity determining region 3 for antibody 55357
LQDYNYPLT

SEQ ID NO: 110714 - protein, 14 aa, Homo sapiens
  heavy chain complementarity determining region 3 for antibody 55357
ARSEDSWLVYYFDY

SEQ ID NO: 110715 - protein, 9 aa, Homo sapiens
  light chain complementarity determining region 3 for antibody 55358
LQDYNYPHT

SEQ ID NO: 110716 - protein, 12 aa, Homo sapiens
  heavy chain complementarity determining region 3 for antibody 55358
ARDGGFGELGDY

SEQ ID NO: 110717 - protein, 9 aa, Homo sapiens
  light chain complementarity determining region 3 for antibody 55359
LQDYNYPFT

SEQ ID NO: 110718 - protein, 15 aa, Homo sapiens
  heavy chain complementarity determining region 3 for antibody 55359
ARARLLLWFGEFIDY

SEQ ID NO: 110719 - protein, 9 aa, Homo sapiens
  light chain complementarity determining region 3 for antibody 55360
LQDYNYPFT

SEQ ID NO: 110720 - protein, 15 aa, Homo sapiens
  heavy chain complementarity determining region 3 for antibody 55360
ARAPLLRWFGEFIDY

SEQ ID NO: 110721 - protein, 9 aa, Homo sapiens
  light chain complementarity determining region 3 for antibody 55361
QQYNSYPRT

SEQ ID NO: 110722 - protein, 16 aa, Homo sapiens
  heavy chain complementarity determining region 3 for antibody 55361
ARDQMDYGDYGYGMDV

SEQ ID NO: 110723 - protein, 9 aa, Homo sapiens
  light chain complementarity determining region 3 for antibody 55362
QQYNSYPRT

SEQ ID NO: 110724 - protein, 13 aa, Homo sapiens
  heavy chain complementarity determining region 3 for antibody 55362
ARDKDSTQLWLAY

SEQ ID NO: 110725 - protein, 9 aa, Homo sapiens
  light chain complementarity determining region 3 for antibody 55363
QQYNSYPLT

SEQ ID NO: 110726 - protein, 11 aa, Homo sapiens
  heavy chain complementarity determining region 3 for antibody 55363
ARLVGANAFDI

SEQ ID NO: 110727 - protein, 9 aa, Homo sapiens
  light chain complementarity determining region 3 for antibody 55364
QQYGSSPWT

SEQ ID NO: 110728 - protein, 14 aa, Homo sapiens
  heavy chain complementarity determining region 3 for antibody 55364
ARITMVRGVMWFDP

SEQ ID NO: 110729 - protein, 10 aa, Homo sapiens
  light chain complementarity determining region 3 for antibody 55365
QQYGSSPLFT

SEQ ID NO: 110730 - protein, 15 aa, Homo sapiens
  heavy chain complementarity determining region 3 for antibody 55365
AKYGSYSYYYYGMDV

SEQ ID NO: 110731 - protein, 9 aa, Homo sapiens
  light chain complementarity determining region 3 for antibody 55366
QQLNSYPYT

SEQ ID NO: 110732 - protein, 15 aa, Homo sapiens
  heavy chain complementarity determining region 3 for antibody 55366
ARHKREAPGYWYFDL

SEQ ID NO: 110733 - protein, 9 aa, Homo sapiens
  light chain complementarity determining region 3 for antibody 55367
QQLNSYPYT

SEQ ID NO: 110734 - protein, 21 aa, Homo sapiens
  heavy chain complementarity determining region 3 for antibody 55367
ARGNIVVVPAAPYYYYYGMDV

SEQ ID NO: 110735 - protein, 8 aa, Homo sapiens
  light chain complementarity determining region 3 for antibody 55368
QQLNSYPT

SEQ ID NO: 110736 - protein, 20 aa, Homo sapiens
  heavy chain complementarity determining region 3 for antibody 55368
ARNGYGDYVGGYYYYYGMDV

SEQ ID NO: 110737 - protein, 9 aa, Homo sapiens
  light chain complementarity determining region 3 for antibody 55369
QQLNNYPFT

SEQ ID NO: 110738 - protein, 9 aa, Homo sapiens
  heavy chain complementarity determining region 3 for antibody 55369
ARKRWYIDL

SEQ ID NO: 110739 - protein, 9 aa, Homo sapiens
  light chain complementarity determining region 3 for antibody 55370
QQFNNYPYT

SEQ ID NO: 110740 - protein, 24 aa, Homo sapiens
  heavy chain complementarity determining region 3 for antibody 55370
AREWEGNYGSGSYYKSAYCYGMDV

SEQ ID NO: 110741 - protein, 9 aa, Homo sapiens
  light chain complementarity determining region 3 for antibody 55371
QQFNNYPRT

SEQ ID NO: 110742 - protein, 13 aa, Homo sapiens
  heavy chain complementarity determining region 3 for antibody 55371
ARIAAAAVQDFQH

SEQ ID NO: 110743 - protein, 9 aa, Homo sapiens
  light chain complementarity determining region 3 for antibody 55372
QQFKNYPRT

SEQ ID NO: 110744 - protein, 12 aa, Homo sapiens
  heavy chain complementarity determining region 3 for antibody 55372
ARRGWAFDAFNI

SEQ ID NO: 110745 - protein, 9 aa, Homo sapiens
  light chain complementarity determining region 3 for antibody 55373
QKYNSAPYT

SEQ ID NO: 110746 - protein, 17 aa, Homo sapiens
  heavy chain complementarity determining region 3 for antibody 55373
ARREYSGSYYYYYGMDV

SEQ ID NO: 110747 - protein, 9 aa, Homo sapiens
  light chain complementarity determining region 3 for antibody 55374
QKYNSAPLT

SEQ ID NO: 110748 - protein, 17 aa, Homo sapiens
  heavy chain complementarity determining region 3 for antibody 55374
ARGLRYFVWLLSDAFDI

SEQ ID NO: 110749 - protein, 9 aa, Homo sapiens
  light chain complementarity determining region 3 for antibody 55375
QKYNSAPLT

SEQ ID NO: 110750 - protein, 17 aa, Homo sapiens
  heavy chain complementarity determining region 3 for antibody 55375
ARGLRYFGWLLSDAFDI

SEQ ID NO: 110751 - protein, 9 aa, Homo sapiens
  light chain complementarity determining region 3 for antibody 55376
QKYNSAPLT

SEQ ID NO: 110752 - protein, 8 aa, Homo sapiens
  heavy chain complementarity determining region 3 for antibody 55376
AGTGPLDY

SEQ ID NO: 110753 - protein, 9 aa, Homo sapiens
  light chain complementarity determining region 3 for antibody 55377
LQHNSYPWT

SEQ ID NO: 110754 - protein, 12 aa, Homo sapiens
  heavy chain complementarity determining region 3 for antibody 55377
ARDIRVRGVIDY

SEQ ID NO: 110755 - protein, 9 aa, Homo sapiens
  light chain complementarity determining region 3 for antibody 55378
LQHNSYPRT

SEQ ID NO: 110756 - protein, 17 aa, Homo sapiens
  heavy chain complementarity determining region 3 for antibody 55378
ARDELLWFGEFSSGMDV

SEQ ID NO: 110757 - protein, 9 aa, Homo sapiens
  light chain complementarity determining region 3 for antibody 55379
LQHNSYPFT

SEQ ID NO: 110758 - protein, 16 aa, Homo sapiens
  heavy chain complementarity determining region 3 for antibody 55379
ASLVVDIVVVPAAFDY

SEQ ID NO: 110759 - protein, 9 aa, Homo sapiens
  light chain complementarity determining region 3 for antibody 55380
LQDYNYPYT

SEQ ID NO: 110760 - protein, 9 aa, Homo sapiens
  heavy chain complementarity determining region 3 for antibody 55380
ARKRWYLDL

SEQ ID NO: 110761 - protein, 9 aa, Homo sapiens
  light chain complementarity determining region 3 for antibody 55381
LQDYNYPWT

SEQ ID NO: 110762 - protein, 19 aa, Homo sapiens
  heavy chain complementarity determining region 3 for antibody 55381
ARDMYYDILTGLYYYGMDV

SEQ ID NO: 110763 - protein, 9 aa, Homo sapiens
  light chain complementarity determining region 3 for antibody 55382
LQDYNYPWT

SEQ ID NO: 110764 - protein, 8 aa, Homo sapiens
  heavy chain complementarity determining region 3 for antibody 55382
ARDGPFDY

SEQ ID NO: 110765 - protein, 9 aa, Homo sapiens
  light chain complementarity determining region 3 for antibody 55383
LQDYNYPRT

SEQ ID NO: 110766 - protein, 16 aa, Homo sapiens
  heavy chain complementarity determining region 3 for antibody 55383
AREDILSGYYNENFDY

SEQ ID NO: 110767 - protein, 9 aa, Homo sapiens
  light chain complementarity determining region 3 for antibody 55384
QQYNSYPRT

SEQ ID NO: 110768 - protein, 11 aa, Homo sapiens
  heavy chain complementarity determining region 3 for antibody 55384
ARILTGYYEDY

SEQ ID NO: 110769 - protein, 9 aa, Homo sapiens
  light chain complementarity determining region 3 for antibody 55385
QQYNNYPYT

SEQ ID NO: 110770 - protein, 17 aa, Homo sapiens
  heavy chain complementarity determining region 3 for antibody 55385
ARDGRGVIDYYYYGMDV

SEQ ID NO: 110771 - protein, 9 aa, Homo sapiens
  light chain complementarity determining region 3 for antibody 55386
QQYDNLPLT

SEQ ID NO: 110772 - protein, 16 aa, Homo sapiens
  heavy chain complementarity determining region 3 for antibody 55386
ARDAKYYDSLTGYPDY

SEQ ID NO: 110773 - protein, 9 aa, Homo sapiens
  light chain complementarity determining region 3 for antibody 55387
QQLNSYPRT

SEQ ID NO: 110774 - protein, 13 aa, Homo sapiens
  heavy chain complementarity determining region 3 for antibody 55387
ARDYDILTGYLRY

SEQ ID NO: 110775 - protein, 9 aa, Homo sapiens
  light chain complementarity determining region 3 for antibody 55388
QQLNSYPLT

SEQ ID NO: 110776 - protein, 13 aa, Homo sapiens
  heavy chain complementarity determining region 3 for antibody 55388
ARYSSSWYEAFDI

SEQ ID NO: 110777 - protein, 9 aa, Homo sapiens
  light chain complementarity determining region 3 for antibody 55389
QQLKSYPLT

SEQ ID NO: 110778 - protein, 12 aa, Homo sapiens
  heavy chain complementarity determining region 3 for antibody 55389
ARARSWSNWFDP

SEQ ID NO: 110779 - protein, 9 aa, Homo sapiens
  light chain complementarity determining region 3 for antibody 55390
QQFNNYPRT

SEQ ID NO: 110780 - protein, 13 aa, Homo sapiens
  heavy chain complementarity determining region 3 for antibody 55390
ARIAAAAVQYIQH

SEQ ID NO: 110781 - protein, 8 aa, Homo sapiens
  light chain complementarity determining region 3 for antibody 55391
QQDYNLYT

SEQ ID NO: 110782 - protein, 9 aa, Homo sapiens
  heavy chain complementarity determining region 3 for antibody 55391
AKVAPSFDY

SEQ ID NO: 110783 - protein, 9 aa, Homo sapiens
  light chain complementarity determining region 3 for antibody 55392
QQDYNLPLT

SEQ ID NO: 110784 - protein, 15 aa, Homo sapiens
  heavy chain complementarity determining region 3 for antibody 55392
ARHKREAPGYWYFDL

SEQ ID NO: 110785 - protein, 9 aa, Homo sapiens
  light chain complementarity determining region 3 for antibody 55393
QKYNSAPYT

SEQ ID NO: 110786 - protein, 16 aa, Homo sapiens
  heavy chain complementarity determining region 3 for antibody 55393
ARGGWELYYYYYGMDV

SEQ ID NO: 110787 - protein, 9 aa, Homo sapiens
  light chain complementarity determining region 3 for antibody 55394
QKYNSAPLT

SEQ ID NO: 110788 - protein, 17 aa, Homo sapiens
  heavy chain complementarity determining region 3 for antibody 55394
ARGLRYFDLLLSDAFDI

SEQ ID NO: 110789 - protein, 10 aa, Homo sapiens
  light chain complementarity determining region 3 for antibody 55395
MQTLQTPPYT

SEQ ID NO: 110790 - protein, 17 aa, Homo sapiens
  heavy chain complementarity determining region 3 for antibody 55395
AKGDSSSWYNFYYGLDV

SEQ ID NO: 110791 - protein, 9 aa, Homo sapiens
  light chain complementarity determining region 3 for antibody 55396
LQRNSYPFT

SEQ ID NO: 110792 - protein, 16 aa, Homo sapiens
  heavy chain complementarity determining region 3 for antibody 55396
ASLFVDIVVVPAAFDY

SEQ ID NO: 110793 - protein, 9 aa, Homo sapiens
  light chain complementarity determining region 3 for antibody 55397
LQHNSYPYT

SEQ ID NO: 110794 - protein, 13 aa, Homo sapiens
  heavy chain complementarity determining region 3 for antibody 55397
ARGIVGATLFFDY

SEQ ID NO: 110795 - protein, 9 aa, Homo sapiens
  light chain complementarity determining region 3 for antibody 55398
LQHDNFPLT

SEQ ID NO: 110796 - protein, 11 aa, Homo sapiens
  heavy chain complementarity determining region 3 for antibody 55398
ARETGEDGFDV

SEQ ID NO: 110797 - protein, 9 aa, Homo sapiens
  light chain complementarity determining region 3 for antibody 55399
LQDYNYPYT

SEQ ID NO: 110798 - protein, 17 aa, Homo sapiens
  heavy chain complementarity determining region 3 for antibody 55399
ARDLRYFDGLLDDAFDI

SEQ ID NO: 110799 - protein, 9 aa, Homo sapiens
  light chain complementarity determining region 3 for antibody 55400
LQDYNYPWT

SEQ ID NO: 110800 - protein, 16 aa, Homo sapiens
  heavy chain complementarity determining region 3 for antibody 55400
ARDAKYYDILTGYTDY

SEQ ID NO: 110801 - protein, 9 aa, Homo sapiens
  light chain complementarity determining region 3 for antibody 55401
LQDYNYPRT

SEQ ID NO: 110802 - protein, 21 aa, Homo sapiens
  heavy chain complementarity determining region 3 for antibody 55401
ARDHYDILTGYYKNYYYGMDV

SEQ ID NO: 110803 - protein, 9 aa, Homo sapiens
  light chain complementarity determining region 3 for antibody 55402
LQDYNYPRT

SEQ ID NO: 110804 - protein, 11 aa, Homo sapiens
  heavy chain complementarity determining region 3 for antibody 55402
ARDEHVLRYSD

SEQ ID NO: 110805 - protein, 9 aa, Homo sapiens
  light chain complementarity determining region 3 for antibody 55403
LQDYNYPFT

SEQ ID NO: 110806 - protein, 15 aa, Homo sapiens
  heavy chain complementarity determining region 3 for antibody 55403
ARAPLVLWFGEFIDY

SEQ ID NO: 110807 - protein, 9 aa, Homo sapiens
  light chain complementarity determining region 3 for antibody 55404
LQDYNYPFT

SEQ ID NO: 110808 - protein, 15 aa, Homo sapiens
  heavy chain complementarity determining region 3 for antibody 55404
ARAPLLLWVGEFIDY

SEQ ID NO: 110809 - protein, 8 aa, Homo sapiens
  light chain complementarity determining region 3 for antibody 55405
LQDYNLFT

SEQ ID NO: 110810 - protein, 15 aa, Homo sapiens
  heavy chain complementarity determining region 3 for antibody 55405
AKGRELLYFGNGMDV

SEQ ID NO: 110811 - protein, 9 aa, Homo sapiens
  light chain complementarity determining region 3 for antibody 55406
RQYDNLPLT

SEQ ID NO: 110812 - protein, 16 aa, Homo sapiens
  heavy chain complementarity determining region 3 for antibody 55406
ARDAKYYDILTGYPDY

SEQ ID NO: 110813 - protein, 9 aa, Homo sapiens
  light chain complementarity determining region 3 for antibody 55407
QQYNSYPYT

SEQ ID NO: 110814 - protein, 14 aa, Homo sapiens
  heavy chain complementarity determining region 3 for antibody 55407
AKEYYDILTGYFDY

SEQ ID NO: 110815 - protein, 9 aa, Homo sapiens
  light chain complementarity determining region 3 for antibody 55408
QQYNSYPRT

SEQ ID NO: 110816 - protein, 17 aa, Homo sapiens
  heavy chain complementarity determining region 3 for antibody 55408
ARGLRYFDWLFSDAFDI

SEQ ID NO: 110817 - protein, 9 aa, Homo sapiens
  light chain complementarity determining region 3 for antibody 55409
QQYNSAPLT

SEQ ID NO: 110818 - protein, 8 aa, Homo sapiens
  heavy chain complementarity determining region 3 for antibody 55409
ARTGPLDY

SEQ ID NO: 110819 - protein, 10 aa, Homo sapiens
  light chain complementarity determining region 3 for antibody 55410
QQYGSSPMYT

SEQ ID NO: 110820 - protein, 17 aa, Homo sapiens
  heavy chain complementarity determining region 3 for antibody 55410
ARGLLWFGELLNNWFDP

SEQ ID NO: 110821 - protein, 10 aa, Homo sapiens
  light chain complementarity determining region 3 for antibody 55411
QQYGSSPMYT

SEQ ID NO: 110822 - protein, 14 aa, Homo sapiens
  heavy chain complementarity determining region 3 for antibody 55411
AREGYSSGPYYFDY

SEQ ID NO: 110823 - protein, 10 aa, Homo sapiens
  light chain complementarity determining region 3 for antibody 55412
QQRSNWPPLT

SEQ ID NO: 110824 - protein, 19 aa, Homo sapiens
  heavy chain complementarity determining region 3 for antibody 55412
ATDRYKVGATYYYYYGMDV

SEQ ID NO: 110825 - protein, 9 aa, Homo sapiens
  light chain complementarity determining region 3 for antibody 55413
QQPNSYPLT

SEQ ID NO: 110826 - protein, 13 aa, Homo sapiens
  heavy chain complementarity determining region 3 for antibody 55413
ARYSSSWYDAFDI

SEQ ID NO: 110827 - protein, 9 aa, Homo sapiens
  light chain complementarity determining region 3 for antibody 55414
QQLNSYPYT

SEQ ID NO: 110828 - protein, 16 aa, Homo sapiens
  heavy chain complementarity determining region 3 for antibody 55414
AGGYYYGSGSYSPFDY

SEQ ID NO: 110829 - protein, 9 aa, Homo sapiens
  light chain complementarity determining region 3 for antibody 55415
QQLNSYPLT

SEQ ID NO: 110830 - protein, 13 aa, Homo sapiens
  heavy chain complementarity determining region 3 for antibody 55415
ARYSGSWYDAFDI

SEQ ID NO: 110831 - protein, 9 aa, Homo sapiens
  light chain complementarity determining region 3 for antibody 55416
QQLNSYPLT

SEQ ID NO: 110832 - protein, 14 aa, Homo sapiens
  heavy chain complementarity determining region 3 for antibody 55416
ARDVYYGSGSPLDY

SEQ ID NO: 110833 - protein, 8 aa, Homo sapiens
  light chain complementarity determining region 3 for antibody 55417
QQFNNYPT

SEQ ID NO: 110834 - protein, 12 aa, Homo sapiens
  heavy chain complementarity determining region 3 for antibody 55417
ASSSYYYYGMDV

SEQ ID NO: 110835 - protein, 8 aa, Homo sapiens
  light chain complementarity determining region 3 for antibody 55418
QQFNDYYT

SEQ ID NO: 110836 - protein, 10 aa, Homo sapiens
  heavy chain complementarity determining region 3 for antibody 55418
ARGLRGVFDY

SEQ ID NO: 110837 - protein, 9 aa, Homo sapiens
  light chain complementarity determining region 3 for antibody 55419
QQDYNLPWT

SEQ ID NO: 110838 - protein, 11 aa, Homo sapiens
  heavy chain complementarity determining region 3 for antibody 55419
AKLNWGGDFDY

SEQ ID NO: 110839 - protein, 9 aa, Homo sapiens
  light chain complementarity determining region 3 for antibody 55420
QKYNSAPLT

SEQ ID NO: 110840 - protein, 8 aa, Homo sapiens
  heavy chain complementarity determining region 3 for antibody 55420
TRTGPLDY

SEQ ID NO: 110841 - protein, 9 aa, Homo sapiens
  light chain complementarity determining region 3 for antibody 55421
QKYNSAPLT

SEQ ID NO: 110842 - protein, 17 aa, Homo sapiens
  heavy chain complementarity determining region 3 for antibody 55421
ASGLRYFDWLLSDAFDI

SEQ ID NO: 110843 - protein, 9 aa, Homo sapiens
  light chain complementarity determining region 3 for antibody 55422
QKYNSAPLT

SEQ ID NO: 110844 - protein, 8 aa, Homo sapiens
  heavy chain complementarity determining region 3 for antibody 55422
ARTGPLAY

SEQ ID NO: 110845 - protein, 9 aa, Homo sapiens
  light chain complementarity determining region 3 for antibody 55423
QKYNSAPLT

SEQ ID NO: 110846 - protein, 14 aa, Homo sapiens
  heavy chain complementarity determining region 3 for antibody 55423
AKEGGDYVLYYFDY

SEQ ID NO: 110847 - protein, 9 aa, Homo sapiens
  light chain complementarity determining region 3 for antibody 55424
QKYNSAPLA

SEQ ID NO: 110848 - protein, 13 aa, Homo sapiens
  heavy chain complementarity determining region 3 for antibody 55424
ARDRYSGYGAFDY

SEQ ID NO: 110849 - protein, 9 aa, Homo sapiens
  light chain complementarity determining region 3 for antibody 55425
QKYDSAPLT

SEQ ID NO: 110850 - protein, 9 aa, Homo sapiens
  heavy chain complementarity determining region 3 for antibody 55425
ARDAVFFDY

SEQ ID NO: 110851 - protein, 9 aa, Homo sapiens
  light chain complementarity determining region 3 for antibody 55426
LQHNSYPYT

SEQ ID NO: 110852 - protein, 8 aa, Homo sapiens
  heavy chain complementarity determining region 3 for antibody 55426
ARTGPLDY

SEQ ID NO: 110853 - protein, 9 aa, Homo sapiens
  light chain complementarity determining region 3 for antibody 55427
LQHNSYPWT

SEQ ID NO: 110854 - protein, 12 aa, Homo sapiens
  heavy chain complementarity determining region 3 for antibody 55427
ASDIMVRGVIDY

SEQ ID NO: 110855 - protein, 9 aa, Homo sapiens
  light chain complementarity determining region 3 for antibody 55428
LQHNSYPWT

SEQ ID NO: 110856 - protein, 12 aa, Homo sapiens
  heavy chain complementarity determining region 3 for antibody 55428
ARDIMVRGAIDY

SEQ ID NO: 110857 - protein, 9 aa, Homo sapiens
  light chain complementarity determining region 3 for antibody 55429
LQHNSYPWT

SEQ ID NO: 110858 - protein, 8 aa, Homo sapiens
  heavy chain complementarity determining region 3 for antibody 55429
ARDDGMDV

SEQ ID NO: 110859 - protein, 9 aa, Homo sapiens
  light chain complementarity determining region 3 for antibody 55430
LQHNSYPFT

SEQ ID NO: 110860 - protein, 7 aa, Homo sapiens
  heavy chain complementarity determining region 3 for antibody 55430
ARDVGDY

SEQ ID NO: 110861 - protein, 9 aa, Homo sapiens
  light chain complementarity determining region 3 for antibody 55431
LQDYNYPYT

SEQ ID NO: 110862 - protein, 14 aa, Homo sapiens
  heavy chain complementarity determining region 3 for antibody 55431
ARRYPDYYYYGMDV

SEQ ID NO: 110863 - protein, 9 aa, Homo sapiens
  light chain complementarity determining region 3 for antibody 55432
LQDYNYPYT

SEQ ID NO: 110864 - protein, 19 aa, Homo sapiens
  heavy chain complementarity determining region 3 for antibody 55432
ARESELRYFDWLFGYGMDV

SEQ ID NO: 110865 - protein, 9 aa, Homo sapiens
  light chain complementarity determining region 3 for antibody 55433
LQDYNYPYT

SEQ ID NO: 110866 - protein, 16 aa, Homo sapiens
  heavy chain complementarity determining region 3 for antibody 55433
ARDYDILTGYRDAFDI

SEQ ID NO: 110867 - protein, 9 aa, Homo sapiens
  light chain complementarity determining region 3 for antibody 55434
LQDYNYPYT

SEQ ID NO: 110868 - protein, 19 aa, Homo sapiens
  heavy chain complementarity determining region 3 for antibody 55434
AKGGVGSCSTTSCYDAFDI

SEQ ID NO: 110869 - protein, 9 aa, Homo sapiens
  light chain complementarity determining region 3 for antibody 55435
LQDYNYPWT

SEQ ID NO: 110870 - protein, 13 aa, Homo sapiens
  heavy chain complementarity determining region 3 for antibody 55435
AREEGYSGSYLDY

SEQ ID NO: 110871 - protein, 9 aa, Homo sapiens
  light chain complementarity determining region 3 for antibody 55436
LQDYNYPWT

SEQ ID NO: 110872 - protein, 12 aa, Homo sapiens
  heavy chain complementarity determining region 3 for antibody 55436
ARDPMVRGVIDY

SEQ ID NO: 110873 - protein, 9 aa, Homo sapiens
  light chain complementarity determining region 3 for antibody 55437
LQDYNYPWT

SEQ ID NO: 110874 - protein, 8 aa, Homo sapiens
  heavy chain complementarity determining region 3 for antibody 55437
ARDDGMDV

SEQ ID NO: 110875 - protein, 9 aa, Homo sapiens
  light chain complementarity determining region 3 for antibody 55438
LQDYNYPPT

SEQ ID NO: 110876 - protein, 16 aa, Homo sapiens
  heavy chain complementarity determining region 3 for antibody 55438
ARQARYKIAVAGIFDS

SEQ ID NO: 110877 - protein, 9 aa, Homo sapiens
  light chain complementarity determining region 3 for antibody 55439
LQDYNYPLT

SEQ ID NO: 110878 - protein, 22 aa, Homo sapiens
  heavy chain complementarity determining region 3 for antibody 55439
ARDLRGTMVRGVPYFYYYGMDV

SEQ ID NO: 110879 - protein, 9 aa, Homo sapiens
  light chain complementarity determining region 3 for antibody 55440
LQDYNYPLT

SEQ ID NO: 110880 - protein, 15 aa, Homo sapiens
  heavy chain complementarity determining region 3 for antibody 55440
ARAPLLLWFGEFIDY

SEQ ID NO: 110881 - protein, 9 aa, Homo sapiens
  light chain complementarity determining region 3 for antibody 55441
LQDYNYPFT

SEQ ID NO: 110882 - protein, 9 aa, Homo sapiens
  heavy chain complementarity determining region 3 for antibody 55441
ARGRSSWAY

SEQ ID NO: 110883 - protein, 9 aa, Homo sapiens
  light chain complementarity determining region 3 for antibody 55442
LQDYNYPFT

SEQ ID NO: 110884 - protein, 15 aa, Homo sapiens
  heavy chain complementarity determining region 3 for antibody 55442
ARAPLLLWFWEFIDY

SEQ ID NO: 110885 - protein, 9 aa, Homo sapiens
  light chain complementarity determining region 3 for antibody 55443
HQSSVLPHT

SEQ ID NO: 110886 - protein, 8 aa, Homo sapiens
  heavy chain complementarity determining region 3 for antibody 55443
ARNWGFDY

SEQ ID NO: 110887 - protein, 9 aa, Homo sapiens
  light chain complementarity determining region 3 for antibody 55444
RQLNSYPYT

SEQ ID NO: 110888 - protein, 15 aa, Homo sapiens
  heavy chain complementarity determining region 3 for antibody 55444
ARDPKYDILTGYYPY

SEQ ID NO: 110889 - protein, 9 aa, Homo sapiens
  light chain complementarity determining region 3 for antibody 55445
RQLNSYPLT

SEQ ID NO: 110890 - protein, 13 aa, Homo sapiens
  heavy chain complementarity determining region 3 for antibody 55445
ARYSSSWYDAFDI

SEQ ID NO: 110891 - protein, 9 aa, Homo sapiens
  light chain complementarity determining region 3 for antibody 55446
RKYNSAPLT

SEQ ID NO: 110892 - protein, 13 aa, Homo sapiens
  heavy chain complementarity determining region 3 for antibody 55446
ARDRYSGYGAFDY

SEQ ID NO: 110893 - protein, 9 aa, Homo sapiens
  light chain complementarity determining region 3 for antibody 55447
QRYNSAPLT

SEQ ID NO: 110894 - protein, 16 aa, Homo sapiens
  heavy chain complementarity determining region 3 for antibody 55447
ARDAKYYDILTGYPDY

SEQ ID NO: 110895 - protein, 9 aa, Homo sapiens
  light chain complementarity determining region 3 for antibody 55448
QQYNTYPYT

SEQ ID NO: 110896 - protein, 17 aa, Homo sapiens
  heavy chain complementarity determining region 3 for antibody 55448
ARDRIAAAAYYYYGMDV

SEQ ID NO: 110897 - protein, 9 aa, Homo sapiens
  light chain complementarity determining region 3 for antibody 55449
QQYNSYPYT

SEQ ID NO: 110898 - protein, 16 aa, Homo sapiens
  heavy chain complementarity determining region 3 for antibody 55449
ARERDNWNPYNYGMDV

SEQ ID NO: 110899 - protein, 9 aa, Homo sapiens
  light chain complementarity determining region 3 for antibody 55450
QQYNSYPLT

SEQ ID NO: 110900 - protein, 17 aa, Homo sapiens
  heavy chain complementarity determining region 3 for antibody 55450
ARDRIAVAAYYYYGMDV

SEQ ID NO: 110901 - protein, 9 aa, Homo sapiens
  light chain complementarity determining region 3 for antibody 55451
QQYNSFPPT

SEQ ID NO: 110902 - protein, 11 aa, Homo sapiens
  heavy chain complementarity determining region 3 for antibody 55451
ARVTAVALFDY

SEQ ID NO: 110903 - protein, 9 aa, Homo sapiens
  light chain complementarity determining region 3 for antibody 55452
QQYNIYPYT

SEQ ID NO: 110904 - protein, 18 aa, Homo sapiens
  heavy chain complementarity determining region 3 for antibody 55452
ARERRDDIFTGYYDAFDI

SEQ ID NO: 110905 - protein, 9 aa, Homo sapiens
  light chain complementarity determining region 3 for antibody 55453
QQYISYPRT

SEQ ID NO: 110906 - protein, 15 aa, Homo sapiens
  heavy chain complementarity determining region 3 for antibody 55453
AREGDILTGYYNFAY

SEQ ID NO: 110907 - protein, 9 aa, Homo sapiens
  light chain complementarity determining region 3 for antibody 55454
QQYGSSPYT

SEQ ID NO: 110908 - protein, 16 aa, Homo sapiens
  heavy chain complementarity determining region 3 for antibody 55454
ARDRGIGIAAAGYFDY

SEQ ID NO: 110909 - protein, 10 aa, Homo sapiens
  light chain complementarity determining region 3 for antibody 55455
QQYGSSPPYT

SEQ ID NO: 110910 - protein, 14 aa, Homo sapiens
  heavy chain complementarity determining region 3 for antibody 55455
AREHYDFLTGSLDY

SEQ ID NO: 110911 - protein, 9 aa, Homo sapiens
  light chain complementarity determining region 3 for antibody 55456
QQYGSSPLT

SEQ ID NO: 110912 - protein, 12 aa, Homo sapiens
  heavy chain complementarity determining region 3 for antibody 55456
ARHGSGTNPFDC

SEQ ID NO: 110913 - protein, 8 aa, Homo sapiens
  light chain complementarity determining region 3 for antibody 55457
QQYGSSFT

SEQ ID NO: 110914 - protein, 13 aa, Homo sapiens
  heavy chain complementarity determining region 3 for antibody 55457
ARYSSSWYDASDI

SEQ ID NO: 110915 - protein, 8 aa, Homo sapiens
  light chain complementarity determining region 3 for antibody 55458
QQYGSSFT

SEQ ID NO: 110916 - protein, 13 aa, Homo sapiens
  heavy chain complementarity determining region 3 for antibody 55458
ARYSSSWSDAFDI

SEQ ID NO: 110917 - protein, 9 aa, Homo sapiens
  light chain complementarity determining region 3 for antibody 55459
QQYDNLPLT

SEQ ID NO: 110918 - protein, 13 aa, Homo sapiens
  heavy chain complementarity determining region 3 for antibody 55459
ARDHNWNDGRFDY

SEQ ID NO: 110919 - protein, 9 aa, Homo sapiens
  light chain complementarity determining region 3 for antibody 55460
QQYDNLPLT

SEQ ID NO: 110920 - protein, 16 aa, Homo sapiens
  heavy chain complementarity determining region 3 for antibody 55460
ARDAKYYDILTGYTDY

SEQ ID NO: 110921 - protein, 9 aa, Homo sapiens
  light chain complementarity determining region 3 for antibody 55461
QQSYSTPFT

SEQ ID NO: 110922 - protein, 7 aa, Homo sapiens
  heavy chain complementarity determining region 3 for antibody 55461
ARDFFDY

SEQ ID NO: 110923 - protein, 9 aa, Homo sapiens
  light chain complementarity determining region 3 for antibody 55462
QQLNSYPYT

SEQ ID NO: 110924 - protein, 9 aa, Homo sapiens
  heavy chain complementarity determining region 3 for antibody 55462
ARKRWYFDF

SEQ ID NO: 110925 - protein, 9 aa, Homo sapiens
  light chain complementarity determining region 3 for antibody 55463
QQLNSYPYT

SEQ ID NO: 110926 - protein, 12 aa, Homo sapiens
  heavy chain complementarity determining region 3 for antibody 55463
ARDPPLRAYFDY

SEQ ID NO: 110927 - protein, 9 aa, Homo sapiens
  light chain complementarity determining region 3 for antibody 55464
QQLNSYPLT

SEQ ID NO: 110928 - protein, 13 aa, Homo sapiens
  heavy chain complementarity determining region 3 for antibody 55464
ATAYYDILTGYDY

SEQ ID NO: 110929 - protein, 9 aa, Homo sapiens
  light chain complementarity determining region 3 for antibody 55465
QQLNSYPLT

SEQ ID NO: 110930 - protein, 13 aa, Homo sapiens
  heavy chain complementarity determining region 3 for antibody 55465
ARYSSSWYDAIDI

SEQ ID NO: 110931 - protein, 9 aa, Homo sapiens
  light chain complementarity determining region 3 for antibody 55466
QQLNSYPLT

SEQ ID NO: 110932 - protein, 13 aa, Homo sapiens
  heavy chain complementarity determining region 3 for antibody 55466
ARYSSSWYDAFDV

SEQ ID NO: 110933 - protein, 9 aa, Homo sapiens
  light chain complementarity determining region 3 for antibody 55467
QQFSNYPRT

SEQ ID NO: 110934 - protein, 13 aa, Homo sapiens
  heavy chain complementarity determining region 3 for antibody 55467
ARIAAAAVQYFQH

SEQ ID NO: 110935 - protein, 9 aa, Homo sapiens
  light chain complementarity determining region 3 for antibody 55468
QQFNSYPYT

SEQ ID NO: 110936 - protein, 24 aa, Homo sapiens
  heavy chain complementarity determining region 3 for antibody 55468
AREWEGNYGSGSYYKSAYYYGMDV

SEQ ID NO: 110937 - protein, 9 aa, Homo sapiens
  light chain complementarity determining region 3 for antibody 55469
QQFNNYPYT

SEQ ID NO: 110938 - protein, 24 aa, Homo sapiens
  heavy chain complementarity determining region 3 for antibody 55469
AREWEGNYGSGSYYKSADYYGMDV

SEQ ID NO: 110939 - protein, 9 aa, Homo sapiens
  light chain complementarity determining region 3 for antibody 55470
QQFNNYPYT

SEQ ID NO: 110940 - protein, 24 aa, Homo sapiens
  heavy chain complementarity determining region 3 for antibody 55470
AREWEGNYGSGSDYKSAYSYGMDV

SEQ ID NO: 110941 - protein, 9 aa, Homo sapiens
  light chain complementarity determining region 3 for antibody 55471
QQFNNYPYT

SEQ ID NO: 110942 - protein, 24 aa, Homo sapiens
  heavy chain complementarity determining region 3 for antibody 55471
AREWEGKYGSGSDYKSAYYYGMDV

SEQ ID NO: 110943 - protein, 9 aa, Homo sapiens
  light chain complementarity determining region 3 for antibody 55472
QQFNNYPYT

SEQ ID NO: 110944 - protein, 24 aa, Homo sapiens
  heavy chain complementarity determining region 3 for antibody 55472
AGEWEGNYGSGSYYKSAYYYGMDV

SEQ ID NO: 110945 - protein, 9 aa, Homo sapiens
  light chain complementarity determining region 3 for antibody 55473
QQFNNYPFT

SEQ ID NO: 110946 - protein, 16 aa, Homo sapiens
  heavy chain complementarity determining region 3 for antibody 55473
ARGRGYYGSGSPYFDY

SEQ ID NO: 110947 - protein, 9 aa, Homo sapiens
  light chain complementarity determining region 3 for antibody 55474
QQDYNLPWT

SEQ ID NO: 110948 - protein, 15 aa, Homo sapiens
  heavy chain complementarity determining region 3 for antibody 55474
ARAGIAAAGTPGMDV

SEQ ID NO: 110949 - protein, 9 aa, Homo sapiens
  light chain complementarity determining region 3 for antibody 55475
QQDYNLPFT

SEQ ID NO: 110950 - protein, 12 aa, Homo sapiens
  heavy chain complementarity determining region 3 for antibody 55475
TSFRLGTETFDI

SEQ ID NO: 110951 - protein, 9 aa, Homo sapiens
  light chain complementarity determining region 3 for antibody 55476
QKYNSAPLT

SEQ ID NO: 110952 - protein, 13 aa, Homo sapiens
  heavy chain complementarity determining region 3 for antibody 55476
ARNRYSGYGAFDY

SEQ ID NO: 110953 - protein, 9 aa, Homo sapiens
  light chain complementarity determining region 3 for antibody 55477
QKYNSAPLT

SEQ ID NO: 110954 - protein, 16 aa, Homo sapiens
  heavy chain complementarity determining region 3 for antibody 55477
ARDAKYYDTLTGSPDY

SEQ ID NO: 110955 - protein, 9 aa, Homo sapiens
  light chain complementarity determining region 3 for antibody 55478
LQHNSYPYT

SEQ ID NO: 110956 - protein, 18 aa, Homo sapiens
  heavy chain complementarity determining region 3 for antibody 55478
ARREGLLWFGESDYGMDV

SEQ ID NO: 110957 - protein, 9 aa, Homo sapiens
  light chain complementarity determining region 3 for antibody 55479
LQHDTYPWT

SEQ ID NO: 110958 - protein, 14 aa, Homo sapiens
  heavy chain complementarity determining region 3 for antibody 55479
ARDRELLWFGELLP

SEQ ID NO: 110959 - protein, 9 aa, Homo sapiens
  light chain complementarity determining region 3 for antibody 55480
LQHDNFPYT

SEQ ID NO: 110960 - protein, 11 aa, Homo sapiens
  heavy chain complementarity determining region 3 for antibody 55480
ARRGSYWGFDP

SEQ ID NO: 110961 - protein, 9 aa, Homo sapiens
  light chain complementarity determining region 3 for antibody 55481
LQDYNYPWT

SEQ ID NO: 110962 - protein, 8 aa, Homo sapiens
  heavy chain complementarity determining region 3 for antibody 55481
ARTGPLDY

SEQ ID NO: 110963 - protein, 9 aa, Homo sapiens
  light chain complementarity determining region 3 for antibody 55482
LQDYNYPWK

SEQ ID NO: 110964 - protein, 16 aa, Homo sapiens
  heavy chain complementarity determining region 3 for antibody 55482
ARDAKYYDILTGYPDY

SEQ ID NO: 110965 - protein, 9 aa, Homo sapiens
  light chain complementarity determining region 3 for antibody 55483
LQDYNYPRT

SEQ ID NO: 110966 - protein, 17 aa, Homo sapiens
  heavy chain complementarity determining region 3 for antibody 55483
ARDEGKWLVRGYYGMDV

SEQ ID NO: 110967 - protein, 9 aa, Homo sapiens
  light chain complementarity determining region 3 for antibody 55484
LQDYNYPFT

SEQ ID NO: 110968 - protein, 12 aa, Homo sapiens
  heavy chain complementarity determining region 3 for antibody 55484
ARDTMVRGVIDY

SEQ ID NO: 110969 - protein, 9 aa, Homo sapiens
  light chain complementarity determining region 3 for antibody 55485
LQDYNYPFT

SEQ ID NO: 110970 - protein, 15 aa, Homo sapiens
  heavy chain complementarity determining region 3 for antibody 55485
ARAPLLLWFGEFTDY

SEQ ID NO: 110971 - protein, 9 aa, Homo sapiens
  light chain complementarity determining region 3 for antibody 55486
LQDYNYPFT

SEQ ID NO: 110972 - protein, 15 aa, Homo sapiens
  heavy chain complementarity determining region 3 for antibody 55486
ARAPLLLGFGEFIDY

SEQ ID NO: 110973 - protein, 9 aa, Homo sapiens
  light chain complementarity determining region 3 for antibody 55487
HQSSSLPLT

SEQ ID NO: 110974 - protein, 15 aa, Homo sapiens
  heavy chain complementarity determining region 3 for antibody 55487
AKGGPPLYYYYGMDV

SEQ ID NO: 110975 - protein, 9 aa, Homo sapiens
  light chain complementarity determining region 3 for antibody 55488
HQSSSLMCT

SEQ ID NO: 110976 - protein, 21 aa, Homo sapiens
  heavy chain complementarity determining region 3 for antibody 55488
ARDGSDYYDRSGYYYVGAFDI

SEQ ID NO: 110977 - protein, 9 aa, Homo sapiens
  light chain complementarity determining region 3 for antibody 55489
QQYNSYPPT

SEQ ID NO: 110978 - protein, 16 aa, Homo sapiens
  heavy chain complementarity determining region 3 for antibody 55489
ARDDTMVRGVIGYFDY

SEQ ID NO: 110979 - protein, 9 aa, Homo sapiens
  light chain complementarity determining region 3 for antibody 55490
QQYNSYPLT

SEQ ID NO: 110980 - protein, 11 aa, Homo sapiens
  heavy chain complementarity determining region 3 for antibody 55490
ARGGYDSIFDY

SEQ ID NO: 110981 - protein, 9 aa, Homo sapiens
  light chain complementarity determining region 3 for antibody 55491
QQYNGYPYT

SEQ ID NO: 110982 - protein, 16 aa, Homo sapiens
  heavy chain complementarity determining region 3 for antibody 55491
AREYYDSSGYWGYFDY

SEQ ID NO: 110983 - protein, 9 aa, Homo sapiens
  light chain complementarity determining region 3 for antibody 55492
QQYGSSPYT

SEQ ID NO: 110984 - protein, 16 aa, Homo sapiens
  heavy chain complementarity determining region 3 for antibody 55492
ARDRGIGIGAAGYFDY

SEQ ID NO: 110985 - protein, 9 aa, Homo sapiens
  light chain complementarity determining region 3 for antibody 55493
QQYGSSPYT

SEQ ID NO: 110986 - protein, 20 aa, Homo sapiens
  heavy chain complementarity determining region 3 for antibody 55493
ARDPARITMVRGAYFYGMDV

SEQ ID NO: 110987 - protein, 10 aa, Homo sapiens
  light chain complementarity determining region 3 for antibody 55494
QQYGSSPMYT

SEQ ID NO: 110988 - protein, 14 aa, Homo sapiens
  heavy chain complementarity determining region 3 for antibody 55494
AREGFRGYYYGLDV

SEQ ID NO: 110989 - protein, 8 aa, Homo sapiens
  light chain complementarity determining region 3 for antibody 55495
QQYGSSFT

SEQ ID NO: 110990 - protein, 13 aa, Homo sapiens
  heavy chain complementarity determining region 3 for antibody 55495
ARYSSSCYDAFDI

SEQ ID NO: 110991 - protein, 9 aa, Homo sapiens
  light chain complementarity determining region 3 for antibody 55496
QQRSNWPPT

SEQ ID NO: 110992 - protein, 18 aa, Homo sapiens
  heavy chain complementarity determining region 3 for antibody 55496
AREEIRYYGSGSYSYFDY

SEQ ID NO: 110993 - protein, 9 aa, Homo sapiens
  light chain complementarity determining region 3 for antibody 55497
QQLNSYPWT

SEQ ID NO: 110994 - protein, 14 aa, Homo sapiens
  heavy chain complementarity determining region 3 for antibody 55497
ARRPGIAAAGPFDY

SEQ ID NO: 110995 - protein, 9 aa, Homo sapiens
  light chain complementarity determining region 3 for antibody 55498
QQLNSYPLT

SEQ ID NO: 110996 - protein, 13 aa, Homo sapiens
  heavy chain complementarity determining region 3 for antibody 55498
ARYSSSWYYAFDI

SEQ ID NO: 110997 - protein, 9 aa, Homo sapiens
  light chain complementarity determining region 3 for antibody 55499
QQLNSYPLT

SEQ ID NO: 110998 - protein, 13 aa, Homo sapiens
  heavy chain complementarity determining region 3 for antibody 55499
ARYSSSWYNAFDI

SEQ ID NO: 110999 - protein, 9 aa, Homo sapiens
  light chain complementarity determining region 3 for antibody 55500
QQLNSYPLT

SEQ ID NO: 111000 - protein, 13 aa, Homo sapiens
  heavy chain complementarity determining region 3 for antibody 55500
ARYSSSWYDAFDT

SEQ ID NO: 111001 - protein, 9 aa, Homo sapiens
  light chain complementarity determining region 3 for antibody 55501
QQLNSYPLT

SEQ ID NO: 111002 - protein, 13 aa, Homo sapiens
  heavy chain complementarity determining region 3 for antibody 55501
AKDRYYGSGSFDY

SEQ ID NO: 111003 - protein, 9 aa, Homo sapiens
  light chain complementarity determining region 3 for antibody 55502
QQFNNYPYT

SEQ ID NO: 111004 - protein, 24 aa, Homo sapiens
  heavy chain complementarity determining region 3 for antibody 55502
AREREGNYGSGSYYKSAYYYGMDV

SEQ ID NO: 111005 - protein, 9 aa, Homo sapiens
  light chain complementarity determining region 3 for antibody 55503
QQFNNYPLT

SEQ ID NO: 111006 - protein, 12 aa, Homo sapiens
  heavy chain complementarity determining region 3 for antibody 55503
ANSGYYYHGMDV

SEQ ID NO: 111007 - protein, 9 aa, Homo sapiens
  light chain complementarity determining region 3 for antibody 55504
QKYNSAPLT

SEQ ID NO: 111008 - protein, 17 aa, Homo sapiens
  heavy chain complementarity determining region 3 for antibody 55504
ARGVRYFDWLLSDAFDI

SEQ ID NO: 111009 - protein, 9 aa, Homo sapiens
  light chain complementarity determining region 3 for antibody 55505
QKYNSAPLT

SEQ ID NO: 111010 - protein, 17 aa, Homo sapiens
  heavy chain complementarity determining region 3 for antibody 55505
ARGLRYFDWLLSYAFDI

SEQ ID NO: 111011 - protein, 9 aa, Homo sapiens
  light chain complementarity determining region 3 for antibody 55506
QKYNSAPLT

SEQ ID NO: 111012 - protein, 17 aa, Homo sapiens
  heavy chain complementarity determining region 3 for antibody 55506
ARGLRYFDWLLSDAIDI

SEQ ID NO: 111013 - protein, 9 aa, Homo sapiens
  light chain complementarity determining region 3 for antibody 55507
QKYNSAPLT

SEQ ID NO: 111014 - protein, 13 aa, Homo sapiens
  heavy chain complementarity determining region 3 for antibody 55507
ARDRYSVYGAFDY

SEQ ID NO: 111015 - protein, 9 aa, Homo sapiens
  light chain complementarity determining region 3 for antibody 55508
QKYNSAPLT

SEQ ID NO: 111016 - protein, 13 aa, Homo sapiens
  heavy chain complementarity determining region 3 for antibody 55508
ARDRDSGYGAFDY

SEQ ID NO: 111017 - protein, 9 aa, Homo sapiens
  light chain complementarity determining region 3 for antibody 55509
QKYNSAPLT

SEQ ID NO: 111018 - protein, 8 aa, Homo sapiens
  heavy chain complementarity determining region 3 for antibody 55509
AITGPLDY

SEQ ID NO: 111019 - protein, 9 aa, Homo sapiens
  light chain complementarity determining region 3 for antibody 55510
QKYNSAPLT

SEQ ID NO: 111020 - protein, 17 aa, Homo sapiens
  heavy chain complementarity determining region 3 for antibody 55510
AGGLRYFDWLLSDAFDI

SEQ ID NO: 111021 - protein, 9 aa, Homo sapiens
  light chain complementarity determining region 3 for antibody 55511
LQHNTYPPT

SEQ ID NO: 111022 - protein, 16 aa, Homo sapiens
  heavy chain complementarity determining region 3 for antibody 55511
ARGRGTMVRGVIPFDY

SEQ ID NO: 111023 - protein, 9 aa, Homo sapiens
  light chain complementarity determining region 3 for antibody 55512
LQHNSYPYT

SEQ ID NO: 111024 - protein, 14 aa, Homo sapiens
  heavy chain complementarity determining region 3 for antibody 55512
AREGFRGYYYGMDV

SEQ ID NO: 111025 - protein, 9 aa, Homo sapiens
  light chain complementarity determining region 3 for antibody 55513
LQHNSYPYT

SEQ ID NO: 111026 - protein, 13 aa, Homo sapiens
  heavy chain complementarity determining region 3 for antibody 55513
AGIAAAAVQYFQH

SEQ ID NO: 111027 - protein, 9 aa, Homo sapiens
  light chain complementarity determining region 3 for antibody 55514
LQHNSYPST

SEQ ID NO: 111028 - protein, 16 aa, Homo sapiens
  heavy chain complementarity determining region 3 for antibody 55514
ASLFVDIVVVPAAFDY

SEQ ID NO: 111029 - protein, 9 aa, Homo sapiens
  light chain complementarity determining region 3 for antibody 55515
LQHNSYPRT

SEQ ID NO: 111030 - protein, 9 aa, Homo sapiens
  heavy chain complementarity determining region 3 for antibody 55515
LRVRGVMDV

SEQ ID NO: 111031 - protein, 9 aa, Homo sapiens
  light chain complementarity determining region 3 for antibody 55516
LQHNSYPLT

SEQ ID NO: 111032 - protein, 18 aa, Homo sapiens
  heavy chain complementarity determining region 3 for antibody 55516
ARETYYDILTGYYGAFDI

SEQ ID NO: 111033 - protein, 9 aa, Homo sapiens
  light chain complementarity determining region 3 for antibody 55517
LQHNSYPFT

SEQ ID NO: 111034 - protein, 16 aa, Homo sapiens
  heavy chain complementarity determining region 3 for antibody 55517
ASRFVDIVVVPAAFDY

SEQ ID NO: 111035 - protein, 9 aa, Homo sapiens
  light chain complementarity determining region 3 for antibody 55518
LQHNSYAFT

SEQ ID NO: 111036 - protein, 16 aa, Homo sapiens
  heavy chain complementarity determining region 3 for antibody 55518
ASLFVDIVVVPAAFDY

SEQ ID NO: 111037 - protein, 9 aa, Homo sapiens
  light chain complementarity determining region 3 for antibody 55519
LQHDNFPFT

SEQ ID NO: 111038 - protein, 8 aa, Homo sapiens
  heavy chain complementarity determining region 3 for antibody 55519
ARRVTLDY

SEQ ID NO: 111039 - protein, 9 aa, Homo sapiens
  light chain complementarity determining region 3 for antibody 55520
LQDYSYPFT

SEQ ID NO: 111040 - protein, 15 aa, Homo sapiens
  heavy chain complementarity determining region 3 for antibody 55520
ARAPLLLWFGEFIDY

SEQ ID NO: 111041 - protein, 9 aa, Homo sapiens
  light chain complementarity determining region 3 for antibody 55521
LQDYNYPYT

SEQ ID NO: 111042 - protein, 13 aa, Homo sapiens
  heavy chain complementarity determining region 3 for antibody 55521
ARGSSWYVPYFDY

SEQ ID NO: 111043 - protein, 9 aa, Homo sapiens
  light chain complementarity determining region 3 for antibody 55522
LQDYNYPYT

SEQ ID NO: 111044 - protein, 13 aa, Homo sapiens
  heavy chain complementarity determining region 3 for antibody 55522
ARGDYDILTGYYY

SEQ ID NO: 111045 - protein, 9 aa, Homo sapiens
  light chain complementarity determining region 3 for antibody 55523
LQDYNYPWA

SEQ ID NO: 111046 - protein, 16 aa, Homo sapiens
  heavy chain complementarity determining region 3 for antibody 55523
ARDAKYYDILTGYPDY

SEQ ID NO: 111047 - protein, 9 aa, Homo sapiens
  light chain complementarity determining region 3 for antibody 55524
LQDYNYPST

SEQ ID NO: 111048 - protein, 15 aa, Homo sapiens
  heavy chain complementarity determining region 3 for antibody 55524
ARAPLLLWFGEFIDY

SEQ ID NO: 111049 - protein, 9 aa, Homo sapiens
  light chain complementarity determining region 3 for antibody 55525
LQDYNYPRT

SEQ ID NO: 111050 - protein, 13 aa, Homo sapiens
  heavy chain complementarity determining region 3 for antibody 55525
ARDYYGSGSYYDY

SEQ ID NO: 111051 - protein, 9 aa, Homo sapiens
  light chain complementarity determining region 3 for antibody 55526
LQDYNYPRT

SEQ ID NO: 111052 - protein, 17 aa, Homo sapiens
  heavy chain complementarity determining region 3 for antibody 55526
ARALRYFDWLEDYGMDV

SEQ ID NO: 111053 - protein, 9 aa, Homo sapiens
  light chain complementarity determining region 3 for antibody 55527
LQDYNYPFT

SEQ ID NO: 111054 - protein, 15 aa, Homo sapiens
  heavy chain complementarity determining region 3 for antibody 55527
ARAPLLLWCGEFIDY

SEQ ID NO: 111055 - protein, 9 aa, Homo sapiens
  light chain complementarity determining region 3 for antibody 55528
LQDYNYPFT

SEQ ID NO: 111056 - protein, 15 aa, Homo sapiens
  heavy chain complementarity determining region 3 for antibody 55528
ARAPLLLCFGEFIDY

SEQ ID NO: 111057 - protein, 9 aa, Homo sapiens
  light chain complementarity determining region 3 for antibody 55529
LQDYNYPFT

SEQ ID NO: 111058 - protein, 16 aa, Homo sapiens
  heavy chain complementarity determining region 3 for antibody 55529
AKEGRITVAGTGGMDV

SEQ ID NO: 111059 - protein, 9 aa, Homo sapiens
  light chain complementarity determining region 3 for antibody 55530
HQYNSYPPT

SEQ ID NO: 111060 - protein, 9 aa, Homo sapiens
  heavy chain complementarity determining region 3 for antibody 55530
ARKKGTFDI

SEQ ID NO: 111061 - protein, 9 aa, Homo sapiens
  light chain complementarity determining region 3 for antibody 55531
HQSSSLPYT

SEQ ID NO: 111062 - protein, 15 aa, Homo sapiens
  heavy chain complementarity determining region 3 for antibody 55531
AREGYKWNDGPYFDY

SEQ ID NO: 111063 - protein, 9 aa, Homo sapiens
  light chain complementarity determining region 3 for antibody 55532
RKYNSAPLT

SEQ ID NO: 111064 - protein, 9 aa, Homo sapiens
  heavy chain complementarity determining region 3 for antibody 55532
ARDGLGIDY

SEQ ID NO: 111065 - protein, 9 aa, Homo sapiens
  light chain complementarity determining region 3 for antibody 55533
QRFNNYPYT

SEQ ID NO: 111066 - protein, 24 aa, Homo sapiens
  heavy chain complementarity determining region 3 for antibody 55533
AREWEGNYGSGSYYKSAYYYGMDV

SEQ ID NO: 111067 - protein, 9 aa, Homo sapiens
  light chain complementarity determining region 3 for antibody 55534
QQYNSYSRT

SEQ ID NO: 111068 - protein, 18 aa, Homo sapiens
  heavy chain complementarity determining region 3 for antibody 55534
ARDRYNWNDDGNYYGMDV

SEQ ID NO: 111069 - protein, 9 aa, Homo sapiens
  light chain complementarity determining region 3 for antibody 55535
QQYNSYPYT

SEQ ID NO: 111070 - protein, 19 aa, Homo sapiens
  heavy chain complementarity determining region 3 for antibody 55535
ARGGYYYDSSGYYHNAFDI

SEQ ID NO: 111071 - protein, 9 aa, Homo sapiens
  light chain complementarity determining region 3 for antibody 55536
QQYNSYPYT

SEQ ID NO: 111072 - protein, 14 aa, Homo sapiens
  heavy chain complementarity determining region 3 for antibody 55536
AKEYYDILTGPFDY

SEQ ID NO: 111073 - protein, 9 aa, Homo sapiens
  light chain complementarity determining region 3 for antibody 55537
QQYNSYPRT

SEQ ID NO: 111074 - protein, 5 aa, Homo sapiens
  heavy chain complementarity determining region 3 for antibody 55537
ARNSG

SEQ ID NO: 111075 - protein, 9 aa, Homo sapiens
  light chain complementarity determining region 3 for antibody 55538
QQYNSYPRT

SEQ ID NO: 111076 - protein, 17 aa, Homo sapiens
  heavy chain complementarity determining region 3 for antibody 55538
ARGLRYFDWFLSDAFDI

SEQ ID NO: 111077 - protein, 9 aa, Homo sapiens
  light chain complementarity determining region 3 for antibody 55539
QQYNSYPRT

SEQ ID NO: 111078 - protein, 17 aa, Homo sapiens
  heavy chain complementarity determining region 3 for antibody 55539
ARGLRYFDGLLSDAFDI

SEQ ID NO: 111079 - protein, 9 aa, Homo sapiens
  light chain complementarity determining region 3 for antibody 55540
QQYNSYPRT

SEQ ID NO: 111080 - protein, 13 aa, Homo sapiens
  heavy chain complementarity determining region 3 for antibody 55540
ARDKDPTQLWLGY

SEQ ID NO: 111081 - protein, 9 aa, Homo sapiens
  light chain complementarity determining region 3 for antibody 55541
QQYNSYPFT

SEQ ID NO: 111082 - protein, 16 aa, Homo sapiens
  heavy chain complementarity determining region 3 for antibody 55541
ARDYYDSSGYWGPFDY

SEQ ID NO: 111083 - protein, 9 aa, Homo sapiens
  light chain complementarity determining region 3 for antibody 55542
QQYNIYPYT

SEQ ID NO: 111084 - protein, 18 aa, Homo sapiens
  heavy chain complementarity determining region 3 for antibody 55542
ARERRDDILTGYYDTFDI

SEQ ID NO: 111085 - protein, 9 aa, Homo sapiens
  light chain complementarity determining region 3 for antibody 55543
QQYGSSPYT

SEQ ID NO: 111086 - protein, 15 aa, Homo sapiens
  heavy chain complementarity determining region 3 for antibody 55543
ARAPLLLWFGEFIDY

SEQ ID NO: 111087 - protein, 8 aa, Homo sapiens
  light chain complementarity determining region 3 for antibody 55544
QQRSNWYT

SEQ ID NO: 111088 - protein, 11 aa, Homo sapiens
  heavy chain complementarity determining region 3 for antibody 55544
ARDLRHSYGYY

SEQ ID NO: 111089 - protein, 10 aa, Homo sapiens
  light chain complementarity determining region 3 for antibody 55545
QQRSNWPPLT

SEQ ID NO: 111090 - protein, 19 aa, Homo sapiens
  heavy chain complementarity determining region 3 for antibody 55545
ATEGYKVGATYYYYYGMDV

SEQ ID NO: 111091 - protein, 9 aa, Homo sapiens
  light chain complementarity determining region 3 for antibody 55546
QQRSNWPLT

SEQ ID NO: 111092 - protein, 18 aa, Homo sapiens
  heavy chain complementarity determining region 3 for antibody 55546
ARETYYDILTGYYGAFDI

SEQ ID NO: 111093 - protein, 10 aa, Homo sapiens
  light chain complementarity determining region 3 for antibody 55547
QQRSNWHPLT

SEQ ID NO: 111094 - protein, 19 aa, Homo sapiens
  heavy chain complementarity determining region 3 for antibody 55547
ATERYKVGATYYYYYGMDV

SEQ ID NO: 111095 - protein, 9 aa, Homo sapiens
  light chain complementarity determining region 3 for antibody 55548
QQLNSYPLT

SEQ ID NO: 111096 - protein, 13 aa, Homo sapiens
  heavy chain complementarity determining region 3 for antibody 55548
ARYSSSWYDAFEI

SEQ ID NO: 111097 - protein, 9 aa, Homo sapiens
  light chain complementarity determining region 3 for antibody 55549
QQLNSYPLT

SEQ ID NO: 111098 - protein, 13 aa, Homo sapiens
  heavy chain complementarity determining region 3 for antibody 55549
ARYSSSRYDAFDI

SEQ ID NO: 111099 - protein, 9 aa, Homo sapiens
  light chain complementarity determining region 3 for antibody 55550
QQLNSYPLT

SEQ ID NO: 111100 - protein, 12 aa, Homo sapiens
  heavy chain complementarity determining region 3 for antibody 55550
ARVVRGVIGFDY

SEQ ID NO: 111101 - protein, 9 aa, Homo sapiens
  light chain complementarity determining region 3 for antibody 55551
QQLNSYPLT

SEQ ID NO: 111102 - protein, 12 aa, Homo sapiens
  heavy chain complementarity determining region 3 for antibody 55551
ARALYYYYGMDV

SEQ ID NO: 111103 - protein, 9 aa, Homo sapiens
  light chain complementarity determining region 3 for antibody 55552
QQFNNYPYT

SEQ ID NO: 111104 - protein, 13 aa, Homo sapiens
  heavy chain complementarity determining region 3 for antibody 55552
ARYSSSWYDAFDI

SEQ ID NO: 111105 - protein, 9 aa, Homo sapiens
  light chain complementarity determining region 3 for antibody 55553
QQFNNYPYT

SEQ ID NO: 111106 - protein, 24 aa, Homo sapiens
  heavy chain complementarity determining region 3 for antibody 55553
AREWEGNYGSGSYYKSAYYHGMDV

SEQ ID NO: 111107 - protein, 9 aa, Homo sapiens
  light chain complementarity determining region 3 for antibody 55554
QQFNNYPWT

SEQ ID NO: 111108 - protein, 12 aa, Homo sapiens
  heavy chain complementarity determining region 3 for antibody 55554
ARPSWSFYYFDY

SEQ ID NO: 111109 - protein, 9 aa, Homo sapiens
  light chain complementarity determining region 3 for antibody 55555
QQFNNYPRT

SEQ ID NO: 111110 - protein, 18 aa, Homo sapiens
  heavy chain complementarity determining region 3 for antibody 55555
VKGGPGESFYYYYYGVDV

SEQ ID NO: 111111 - protein, 9 aa, Homo sapiens
  light chain complementarity determining region 3 for antibody 55556
QQFNNYPCT

SEQ ID NO: 111112 - protein, 24 aa, Homo sapiens
  heavy chain complementarity determining region 3 for antibody 55556
AREWEGKYGSGSYYKSAYYYGMDV

SEQ ID NO: 111113 - protein, 9 aa, Homo sapiens
  light chain complementarity determining region 3 for antibody 55557
QQFNDYPYT

SEQ ID NO: 111114 - protein, 24 aa, Homo sapiens
  heavy chain complementarity determining region 3 for antibody 55557
AREWEGNYGSGSYYKSAYYYGMDV

SEQ ID NO: 111115 - protein, 9 aa, Homo sapiens
  light chain complementarity determining region 3 for antibody 55558
QQDNNLPYT

SEQ ID NO: 111116 - protein, 12 aa, Homo sapiens
  heavy chain complementarity determining region 3 for antibody 55558
ARGPVGATAFDI

SEQ ID NO: 111117 - protein, 9 aa, Homo sapiens
  light chain complementarity determining region 3 for antibody 55559
QKYNSAPLT

SEQ ID NO: 111118 - protein, 8 aa, Homo sapiens
  heavy chain complementarity determining region 3 for antibody 55559
ARTGLLDY

SEQ ID NO: 111119 - protein, 9 aa, Homo sapiens
  light chain complementarity determining region 3 for antibody 55560
QKYNSAPLT

SEQ ID NO: 111120 - protein, 8 aa, Homo sapiens
  heavy chain complementarity determining region 3 for antibody 55560
ARTCPLDY

SEQ ID NO: 111121 - protein, 9 aa, Homo sapiens
  light chain complementarity determining region 3 for antibody 55561
QKYNSAPLT

SEQ ID NO: 111122 - protein, 14 aa, Homo sapiens
  heavy chain complementarity determining region 3 for antibody 55561
ARRPLAAAGRLFDY

SEQ ID NO: 111123 - protein, 9 aa, Homo sapiens
  light chain complementarity determining region 3 for antibody 55562
QKYNSAPLT

SEQ ID NO: 111124 - protein, 24 aa, Homo sapiens
  heavy chain complementarity determining region 3 for antibody 55562
AREWEGNYGSGSYYKSAYYYGMDV

SEQ ID NO: 111125 - protein, 9 aa, Homo sapiens
  light chain complementarity determining region 3 for antibody 55563
QKYNSAPLT

SEQ ID NO: 111126 - protein, 13 aa, Homo sapiens
  heavy chain complementarity determining region 3 for antibody 55563
ARDRYSGYGAFAY

SEQ ID NO: 111127 - protein, 9 aa, Homo sapiens
  light chain complementarity determining region 3 for antibody 55564
QKYNSAPLT

SEQ ID NO: 111128 - protein, 9 aa, Homo sapiens
  heavy chain complementarity determining region 3 for antibody 55564
ARDGLGIAY

SEQ ID NO: 111129 - protein, 9 aa, Homo sapiens
  light chain complementarity determining region 3 for antibody 55565
LQHNSYPYT

SEQ ID NO: 111130 - protein, 11 aa, Homo sapiens
  heavy chain complementarity determining region 3 for antibody 55565
ASDTLTGYYEY

SEQ ID NO: 111131 - protein, 9 aa, Homo sapiens
  light chain complementarity determining region 3 for antibody 55566
LQHNSYPYT

SEQ ID NO: 111132 - protein, 13 aa, Homo sapiens
  heavy chain complementarity determining region 3 for antibody 55566
ARIRYCDWLPFDY

SEQ ID NO: 111133 - protein, 9 aa, Homo sapiens
  light chain complementarity determining region 3 for antibody 55567
LQHNSYPYT

SEQ ID NO: 111134 - protein, 13 aa, Homo sapiens
  heavy chain complementarity determining region 3 for antibody 55567
ARIAAAAAQYFQH

SEQ ID NO: 111135 - protein, 9 aa, Homo sapiens
  light chain complementarity determining region 3 for antibody 55568
LQHNSYPWT

SEQ ID NO: 111136 - protein, 14 aa, Homo sapiens
  heavy chain complementarity determining region 3 for antibody 55568
ARDRELLWFGELLP

SEQ ID NO: 111137 - protein, 9 aa, Homo sapiens
  light chain complementarity determining region 3 for antibody 55569
LQHNSYPWT

SEQ ID NO: 111138 - protein, 19 aa, Homo sapiens
  heavy chain complementarity determining region 3 for antibody 55569
AKDEDSLTGYYRDYYAMDV

SEQ ID NO: 111139 - protein, 9 aa, Homo sapiens
  light chain complementarity determining region 3 for antibody 55570
LQHNSYPRT

SEQ ID NO: 111140 - protein, 9 aa, Homo sapiens
  heavy chain complementarity determining region 3 for antibody 55570
LMVRGVTDV

SEQ ID NO: 111141 - protein, 9 aa, Homo sapiens
  light chain complementarity determining region 3 for antibody 55571
LQHNSYPFT

SEQ ID NO: 111142 - protein, 16 aa, Homo sapiens
  heavy chain complementarity determining region 3 for antibody 55571
SSLFVDIVVVPAAFDY

SEQ ID NO: 111143 - protein, 9 aa, Homo sapiens
  light chain complementarity determining region 3 for antibody 55572
LQHNSYPFT

SEQ ID NO: 111144 - protein, 16 aa, Homo sapiens
  heavy chain complementarity determining region 3 for antibody 55572
ASLFGDIVVVPAAFDY

SEQ ID NO: 111145 - protein, 9 aa, Homo sapiens
  light chain complementarity determining region 3 for antibody 55573
LQHDNSPYT

SEQ ID NO: 111146 - protein, 17 aa, Homo sapiens
  heavy chain complementarity determining region 3 for antibody 55573
ARDRYDILTGYYNGFDY

SEQ ID NO: 111147 - protein, 10 aa, Homo sapiens
  light chain complementarity determining region 3 for antibody 55574
LQHDNFLMYT

SEQ ID NO: 111148 - protein, 7 aa, Homo sapiens
  heavy chain complementarity determining region 3 for antibody 55574
AKVYYDI

SEQ ID NO: 111149 - protein, 9 aa, Homo sapiens
  light chain complementarity determining region 3 for antibody 55575
LQDYNYPYT

SEQ ID NO: 111150 - protein, 12 aa, Homo sapiens
  heavy chain complementarity determining region 3 for antibody 55575
ARGGNWGSHFDY

SEQ ID NO: 111151 - protein, 9 aa, Homo sapiens
  light chain complementarity determining region 3 for antibody 55576
LQDYNYPYT

SEQ ID NO: 111152 - protein, 11 aa, Homo sapiens
  heavy chain complementarity determining region 3 for antibody 55576
ARDEHVLRYSD

SEQ ID NO: 111153 - protein, 9 aa, Homo sapiens
  light chain complementarity determining region 3 for antibody 55577
LQDYNYPWT

SEQ ID NO: 111154 - protein, 16 aa, Homo sapiens
  heavy chain complementarity determining region 3 for antibody 55577
ARDAKYYDTLTGSPDY

SEQ ID NO: 111155 - protein, 9 aa, Homo sapiens
  light chain complementarity determining region 3 for antibody 55578
LQDYNYPWT

SEQ ID NO: 111156 - protein, 16 aa, Homo sapiens
  heavy chain complementarity determining region 3 for antibody 55578
ARDAKYYDSLTGYPDY

SEQ ID NO: 111157 - protein, 9 aa, Homo sapiens
  light chain complementarity determining region 3 for antibody 55579
LQDYNYPRT

SEQ ID NO: 111158 - protein, 19 aa, Homo sapiens
  heavy chain complementarity determining region 3 for antibody 55579
AKDQGDIVATIMDYYGMDV

SEQ ID NO: 111159 - protein, 9 aa, Homo sapiens
  light chain complementarity determining region 3 for antibody 55580
LQDYNYPPT

SEQ ID NO: 111160 - protein, 22 aa, Homo sapiens
  heavy chain complementarity determining region 3 for antibody 55580
ARGRRDYDILTGSYYYYYGMDV

SEQ ID NO: 111161 - protein, 9 aa, Homo sapiens
  light chain complementarity determining region 3 for antibody 55581
LQDYNYPHT

SEQ ID NO: 111162 - protein, 11 aa, Homo sapiens
  heavy chain complementarity determining region 3 for antibody 55581
ARYYYSYGMDV

SEQ ID NO: 111163 - protein, 9 aa, Homo sapiens
  light chain complementarity determining region 3 for antibody 55582
LQDYNYPFT

SEQ ID NO: 111164 - protein, 15 aa, Homo sapiens
  heavy chain complementarity determining region 3 for antibody 55582
SRAPLLLWFGEFIDY

SEQ ID NO: 111165 - protein, 9 aa, Homo sapiens
  light chain complementarity determining region 3 for antibody 55583
LQDYNYPFT

SEQ ID NO: 111166 - protein, 15 aa, Homo sapiens
  heavy chain complementarity determining region 3 for antibody 55583
ARAPLLLWFGEFVDY

SEQ ID NO: 111167 - protein, 9 aa, Homo sapiens
  light chain complementarity determining region 3 for antibody 55584
LQDYNYPFT

SEQ ID NO: 111168 - protein, 15 aa, Homo sapiens
  heavy chain complementarity determining region 3 for antibody 55584
ARAPLLLSFGEFIDY

SEQ ID NO: 111169 - protein, 9 aa, Homo sapiens
  light chain complementarity determining region 3 for antibody 55585
LQDCNYPWT

SEQ ID NO: 111170 - protein, 16 aa, Homo sapiens
  heavy chain complementarity determining region 3 for antibody 55585
ARDAKYYDILTGYPDY

SEQ ID NO: 111171 - protein, 9 aa, Homo sapiens
  light chain complementarity determining region 3 for antibody 55586
HQSSSLPYT

SEQ ID NO: 111172 - protein, 16 aa, Homo sapiens
  heavy chain complementarity determining region 3 for antibody 55586
ARAGRYFDWLRDAFDI

SEQ ID NO: 111173 - protein, 9 aa, Homo sapiens
  light chain complementarity determining region 3 for antibody 55587
HQSGRLPYT

SEQ ID NO: 111174 - protein, 12 aa, Homo sapiens
  heavy chain complementarity determining region 3 for antibody 55587
ARLLSSWPLCDY

SEQ ID NO: 111175 - protein, 9 aa, Homo sapiens
  light chain complementarity determining region 3 for antibody 55588
RQFNNYPYT

SEQ ID NO: 111176 - protein, 24 aa, Homo sapiens
  heavy chain complementarity determining region 3 for antibody 55588
AREWEGNYGSGSYYKSAYYYGMDV

SEQ ID NO: 111177 - protein, 9 aa, Homo sapiens
  light chain complementarity determining region 3 for antibody 55589
QQYYSYPPT

SEQ ID NO: 111178 - protein, 10 aa, Homo sapiens
  heavy chain complementarity determining region 3 for antibody 55589
ARENSSVFDY

SEQ ID NO: 111179 - protein, 9 aa, Homo sapiens
  light chain complementarity determining region 3 for antibody 55590
QQYNTYPRT

SEQ ID NO: 111180 - protein, 17 aa, Homo sapiens
  heavy chain complementarity determining region 3 for antibody 55590
ARDRIAVAAYYYYGMDV

SEQ ID NO: 111181 - protein, 9 aa, Homo sapiens
  light chain complementarity determining region 3 for antibody 55591
QQYNTYPRT

SEQ ID NO: 111182 - protein, 10 aa, Homo sapiens
  heavy chain complementarity determining region 3 for antibody 55591
ARDKGFYFDY

SEQ ID NO: 111183 - protein, 9 aa, Homo sapiens
  light chain complementarity determining region 3 for antibody 55592
QQYNSYPYT

SEQ ID NO: 111184 - protein, 14 aa, Homo sapiens
  heavy chain complementarity determining region 3 for antibody 55592
AREGVTMVRGVMDY

SEQ ID NO: 111185 - protein, 9 aa, Homo sapiens
  light chain complementarity determining region 3 for antibody 55593
QQYNSYPYT

SEQ ID NO: 111186 - protein, 14 aa, Homo sapiens
  heavy chain complementarity determining region 3 for antibody 55593
AKEYYDILTGYLDY

SEQ ID NO: 111187 - protein, 9 aa, Homo sapiens
  light chain complementarity determining region 3 for antibody 55594
QQYNSYPRT

SEQ ID NO: 111188 - protein, 5 aa, Homo sapiens
  heavy chain complementarity determining region 3 for antibody 55594
ARNWA

SEQ ID NO: 111189 - protein, 9 aa, Homo sapiens
  light chain complementarity determining region 3 for antibody 55595
QQYNSYPRT

SEQ ID NO: 111190 - protein, 13 aa, Homo sapiens
  heavy chain complementarity determining region 3 for antibody 55595
ARDEDSTQLWLGY

SEQ ID NO: 111191 - protein, 9 aa, Homo sapiens
  light chain complementarity determining region 3 for antibody 55596
QQYNSYPPT

SEQ ID NO: 111192 - protein, 9 aa, Homo sapiens
  heavy chain complementarity determining region 3 for antibody 55596
ARDGLGIDY

SEQ ID NO: 111193 - protein, 9 aa, Homo sapiens
  light chain complementarity determining region 3 for antibody 55597
QQYNSYPLT

SEQ ID NO: 111194 - protein, 11 aa, Homo sapiens
  heavy chain complementarity determining region 3 for antibody 55597
ARGGYDSLFDY

SEQ ID NO: 111195 - protein, 9 aa, Homo sapiens
  light chain complementarity determining region 3 for antibody 55598
QQYNSAPLT

SEQ ID NO: 111196 - protein, 9 aa, Homo sapiens
  heavy chain complementarity determining region 3 for antibody 55598
ARDGLGIDY

SEQ ID NO: 111197 - protein, 9 aa, Homo sapiens
  light chain complementarity determining region 3 for antibody 55599
QQYNNYPFT

SEQ ID NO: 111198 - protein, 17 aa, Homo sapiens
  heavy chain complementarity determining region 3 for antibody 55599
ARLVLRYSDWLLPHFDY

SEQ ID NO: 111199 - protein, 9 aa, Homo sapiens
  light chain complementarity determining region 3 for antibody 55600
QQYGSSPWT

SEQ ID NO: 111200 - protein, 11 aa, Homo sapiens
  heavy chain complementarity determining region 3 for antibody 55600
AREGVGTAFDI

SEQ ID NO: 111201 - protein, 10 aa, Homo sapiens
  light chain complementarity determining region 3 for antibody 55601
QQYGSSPMYT

SEQ ID NO: 111202 - protein, 9 aa, Homo sapiens
  heavy chain complementarity determining region 3 for antibody 55601
AREDWGFDY

SEQ ID NO: 111203 - protein, 8 aa, Homo sapiens
  light chain complementarity determining region 3 for antibody 55602
QQYGSSFT

SEQ ID NO: 111204 - protein, 13 aa, Homo sapiens
  heavy chain complementarity determining region 3 for antibody 55602
ARYSSSWYDAFDV

SEQ ID NO: 111205 - protein, 8 aa, Homo sapiens
  light chain complementarity determining region 3 for antibody 55603
QQYGSSFT

SEQ ID NO: 111206 - protein, 13 aa, Homo sapiens
  heavy chain complementarity determining region 3 for antibody 55603
ARYSSSWHDAFDI

SEQ ID NO: 111207 - protein, 9 aa, Homo sapiens
  light chain complementarity determining region 3 for antibody 55604
QQSYSTPWT

SEQ ID NO: 111208 - protein, 16 aa, Homo sapiens
  heavy chain complementarity determining region 3 for antibody 55604
ARGLRYFDWLWGGMDV

SEQ ID NO: 111209 - protein, 9 aa, Homo sapiens
  light chain complementarity determining region 3 for antibody 55605
QQSYDTPYT

SEQ ID NO: 111210 - protein, 14 aa, Homo sapiens
  heavy chain complementarity determining region 3 for antibody 55605
ARDRTVATIGYFAY

SEQ ID NO: 111211 - protein, 9 aa, Homo sapiens
  light chain complementarity determining region 3 for antibody 55606
QQSNSYPWT

SEQ ID NO: 111212 - protein, 14 aa, Homo sapiens
  heavy chain complementarity determining region 3 for antibody 55606
AKDGGFGEPYGMDV

SEQ ID NO: 111213 - protein, 10 aa, Homo sapiens
  light chain complementarity determining region 3 for antibody 55607
QQRSNWPPLT

SEQ ID NO: 111214 - protein, 19 aa, Homo sapiens
  heavy chain complementarity determining region 3 for antibody 55607
ATERYKVGATYYYYSGMDV

SEQ ID NO: 111215 - protein, 10 aa, Homo sapiens
  light chain complementarity determining region 3 for antibody 55608
QQRSNWPPLT

SEQ ID NO: 111216 - protein, 18 aa, Homo sapiens
  heavy chain complementarity determining region 3 for antibody 55608
ATERYKVGATYYYYGTDV

SEQ ID NO: 111217 - protein, 10 aa, Homo sapiens
  light chain complementarity determining region 3 for antibody 55609
QQRSNWPPLT

SEQ ID NO: 111218 - protein, 18 aa, Homo sapiens
  heavy chain complementarity determining region 3 for antibody 55609
ATERYKVGATSYYYGMDV

SEQ ID NO: 111219 - protein, 9 aa, Homo sapiens
  light chain complementarity determining region 3 for antibody 55610
QQRSNWMYT

SEQ ID NO: 111220 - protein, 10 aa, Homo sapiens
  heavy chain complementarity determining region 3 for antibody 55610
AKERWELLDY

SEQ ID NO: 111221 - protein, 8 aa, Homo sapiens
  light chain complementarity determining region 3 for antibody 55611
QQRSNWLT

SEQ ID NO: 111222 - protein, 13 aa, Homo sapiens
  heavy chain complementarity determining region 3 for antibody 55611
ARDRGHSSGWYPY

SEQ ID NO: 111223 - protein, 9 aa, Homo sapiens
  light chain complementarity determining region 3 for antibody 55612
QQLSSYPLT

SEQ ID NO: 111224 - protein, 13 aa, Homo sapiens
  heavy chain complementarity determining region 3 for antibody 55612
ARYSSSWYDAFDI

SEQ ID NO: 111225 - protein, 9 aa, Homo sapiens
  light chain complementarity determining region 3 for antibody 55613
QQLNSYPYT

SEQ ID NO: 111226 - protein, 15 aa, Homo sapiens
  heavy chain complementarity determining region 3 for antibody 55613
ARHYDILTGMGGFDP

SEQ ID NO: 111227 - protein, 9 aa, Homo sapiens
  light chain complementarity determining region 3 for antibody 55614
QQLNSYPYT

SEQ ID NO: 111228 - protein, 12 aa, Homo sapiens
  heavy chain complementarity determining region 3 for antibody 55614
ARHGDYYYSMDV

SEQ ID NO: 111229 - protein, 9 aa, Homo sapiens
  light chain complementarity determining region 3 for antibody 55615
QQLNSYPNT

SEQ ID NO: 111230 - protein, 16 aa, Homo sapiens
  heavy chain complementarity determining region 3 for antibody 55615
ARREVGPLQYYYGMDV

SEQ ID NO: 111231 - protein, 9 aa, Homo sapiens
  light chain complementarity determining region 3 for antibody 55616
QQLNSYPNT

SEQ ID NO: 111232 - protein, 17 aa, Homo sapiens
  heavy chain complementarity determining region 3 for antibody 55616
ARDRIAAAAYYYYGMDV

SEQ ID NO: 111233 - protein, 9 aa, Homo sapiens
  light chain complementarity determining region 3 for antibody 55617
QQLNSYPLT

SEQ ID NO: 111234 - protein, 13 aa, Homo sapiens
  heavy chain complementarity determining region 3 for antibody 55617
ARYSSSWHDAFDI

SEQ ID NO: 111235 - protein, 9 aa, Homo sapiens
  light chain complementarity determining region 3 for antibody 55618
QQLNSHPYT

SEQ ID NO: 111236 - protein, 12 aa, Homo sapiens
  heavy chain complementarity determining region 3 for antibody 55618
ARGRGYSYGLDY

SEQ ID NO: 111237 - protein, 9 aa, Homo sapiens
  light chain complementarity determining region 3 for antibody 55619
QQFNSYPWT

SEQ ID NO: 111238 - protein, 14 aa, Homo sapiens
  heavy chain complementarity determining region 3 for antibody 55619
AKDGGFGEPYGMDV

SEQ ID NO: 111239 - protein, 9 aa, Homo sapiens
  light chain complementarity determining region 3 for antibody 55620
QQFNNYPYT

SEQ ID NO: 111240 - protein, 16 aa, Homo sapiens
  heavy chain complementarity determining region 3 for antibody 55620
ASLFVDIVVVPAAFDY

SEQ ID NO: 111241 - protein, 9 aa, Homo sapiens
  light chain complementarity determining region 3 for antibody 55621
QQFNNYPYT

SEQ ID NO: 111242 - protein, 24 aa, Homo sapiens
  heavy chain complementarity determining region 3 for antibody 55621
AREWEGNYGSGSYYKSAYYYGMDD

SEQ ID NO: 111243 - protein, 9 aa, Homo sapiens
  light chain complementarity determining region 3 for antibody 55622
QQFNNYPYT

SEQ ID NO: 111244 - protein, 24 aa, Homo sapiens
  heavy chain complementarity determining region 3 for antibody 55622
AREWEGNYGSGSYYKGAYYYGMDV

SEQ ID NO: 111245 - protein, 9 aa, Homo sapiens
  light chain complementarity determining region 3 for antibody 55623
QQFNNYPYT

SEQ ID NO: 111246 - protein, 24 aa, Homo sapiens
  heavy chain complementarity determining region 3 for antibody 55623
AREGEGNYGSGSYYKSAYYYGMDV

SEQ ID NO: 111247 - protein, 9 aa, Homo sapiens
  light chain complementarity determining region 3 for antibody 55624
QQFNNYPRT

SEQ ID NO: 111248 - protein, 13 aa, Homo sapiens
  heavy chain complementarity determining region 3 for antibody 55624
ARIAAAAFQYFQH

SEQ ID NO: 111249 - protein, 9 aa, Homo sapiens
  light chain complementarity determining region 3 for antibody 55625
QQFNNYPRT

SEQ ID NO: 111250 - protein, 12 aa, Homo sapiens
  heavy chain complementarity determining region 3 for antibody 55625
ARDRCFDWPPDY

SEQ ID NO: 111251 - protein, 9 aa, Homo sapiens
  light chain complementarity determining region 3 for antibody 55626
QQFNNYPHT

SEQ ID NO: 111252 - protein, 24 aa, Homo sapiens
  heavy chain complementarity determining region 3 for antibody 55626
AREWEGNYGSGSYYKSAYYYGMDV

SEQ ID NO: 111253 - protein, 8 aa, Homo sapiens
  light chain complementarity determining region 3 for antibody 55627
QQFNNYLT

SEQ ID NO: 111254 - protein, 12 aa, Homo sapiens
  heavy chain complementarity determining region 3 for antibody 55627
ARGRGYSYGLDY

SEQ ID NO: 111255 - protein, 9 aa, Homo sapiens
  light chain complementarity determining region 3 for antibody 55628
QQDYSSPPT

SEQ ID NO: 111256 - protein, 7 aa, Homo sapiens
  heavy chain complementarity determining region 3 for antibody 55628
ARAGFAY

SEQ ID NO: 111257 - protein, 8 aa, Homo sapiens
  light chain complementarity determining region 3 for antibody 55629
QQDYNLYT

SEQ ID NO: 111258 - protein, 10 aa, Homo sapiens
  heavy chain complementarity determining region 3 for antibody 55629
ARDFDWGMDV

SEQ ID NO: 111259 - protein, 9 aa, Homo sapiens
  light chain complementarity determining region 3 for antibody 55630
QQDYNLPRT

SEQ ID NO: 111260 - protein, 16 aa, Homo sapiens
  heavy chain complementarity determining region 3 for antibody 55630
VREGRGDYYYYYGMDV

SEQ ID NO: 111261 - protein, 9 aa, Homo sapiens
  light chain complementarity determining region 3 for antibody 55631
QQCNSYPYT

SEQ ID NO: 111262 - protein, 18 aa, Homo sapiens
  heavy chain complementarity determining region 3 for antibody 55631
ARERRDDILTGYFDASDI

SEQ ID NO: 111263 - protein, 9 aa, Homo sapiens
  light chain complementarity determining region 3 for antibody 55632
QKYNSAPPT

SEQ ID NO: 111264 - protein, 16 aa, Homo sapiens
  heavy chain complementarity determining region 3 for antibody 55632
ARDAKYYDILTGYPDY

SEQ ID NO: 111265 - protein, 9 aa, Homo sapiens
  light chain complementarity determining region 3 for antibody 55633
QKYNSAPLT

SEQ ID NO: 111266 - protein, 9 aa, Homo sapiens
  heavy chain complementarity determining region 3 for antibody 55633
LMVRGVMDV

SEQ ID NO: 111267 - protein, 9 aa, Homo sapiens
  light chain complementarity determining region 3 for antibody 55634
QKYNSAPLT

SEQ ID NO: 111268 - protein, 13 aa, Homo sapiens
  heavy chain complementarity determining region 3 for antibody 55634
ARYSSSWYDAFDI

SEQ ID NO: 111269 - protein, 9 aa, Homo sapiens
  light chain complementarity determining region 3 for antibody 55635
QKYNSAPLT

SEQ ID NO: 111270 - protein, 13 aa, Homo sapiens
  heavy chain complementarity determining region 3 for antibody 55635
ARIAAAAVQYFQH

SEQ ID NO: 111271 - protein, 9 aa, Homo sapiens
  light chain complementarity determining region 3 for antibody 55636
QKYNSAPLT

SEQ ID NO: 111272 - protein, 17 aa, Homo sapiens
  heavy chain complementarity determining region 3 for antibody 55636
ARGLRYFDWLLSEAFDI

SEQ ID NO: 111273 - protein, 9 aa, Homo sapiens
  light chain complementarity determining region 3 for antibody 55637
QKYNSAPLT

SEQ ID NO: 111274 - protein, 17 aa, Homo sapiens
  heavy chain complementarity determining region 3 for antibody 55637
ARGLRYFDWLLSDAFDT

SEQ ID NO: 111275 - protein, 9 aa, Homo sapiens
  light chain complementarity determining region 3 for antibody 55638
QKYNSAPLT

SEQ ID NO: 111276 - protein, 12 aa, Homo sapiens
  heavy chain complementarity determining region 3 for antibody 55638
ARDTTVRGVIDY

SEQ ID NO: 111277 - protein, 9 aa, Homo sapiens
  light chain complementarity determining region 3 for antibody 55639
QKYNSAPLT

SEQ ID NO: 111278 - protein, 9 aa, Homo sapiens
  heavy chain complementarity determining region 3 for antibody 55639
ARDGQGIDY

SEQ ID NO: 111279 - protein, 9 aa, Homo sapiens
  light chain complementarity determining region 3 for antibody 55640
QKYNSAPLT

SEQ ID NO: 111280 - protein, 8 aa, Homo sapiens
  heavy chain complementarity determining region 3 for antibody 55640
AKTGPLDY

SEQ ID NO: 111281 - protein, 9 aa, Homo sapiens
  light chain complementarity determining region 3 for antibody 55641
LQHNSYPYT

SEQ ID NO: 111282 - protein, 13 aa, Homo sapiens
  heavy chain complementarity determining region 3 for antibody 55641
ARTAAAAVQYFHH

SEQ ID NO: 111283 - protein, 9 aa, Homo sapiens
  light chain complementarity determining region 3 for antibody 55642
LQHNSYPYT

SEQ ID NO: 111284 - protein, 11 aa, Homo sapiens
  heavy chain complementarity determining region 3 for antibody 55642
ARRIAAAGTGY

SEQ ID NO: 111285 - protein, 9 aa, Homo sapiens
  light chain complementarity determining region 3 for antibody 55643
LQHNSYPYT

SEQ ID NO: 111286 - protein, 11 aa, Homo sapiens
  heavy chain complementarity determining region 3 for antibody 55643
AREGVGTAFDI

SEQ ID NO: 111287 - protein, 9 aa, Homo sapiens
  light chain complementarity determining region 3 for antibody 55644
LQHNSYPYT

SEQ ID NO: 111288 - protein, 10 aa, Homo sapiens
  heavy chain complementarity determining region 3 for antibody 55644
ALWFGELFDY

SEQ ID NO: 111289 - protein, 9 aa, Homo sapiens
  light chain complementarity determining region 3 for antibody 55645
LQHNSYPWT

SEQ ID NO: 111290 - protein, 19 aa, Homo sapiens
  heavy chain complementarity determining region 3 for antibody 55645
AKDEDILAGYYRDYYAMDV

SEQ ID NO: 111291 - protein, 9 aa, Homo sapiens
  light chain complementarity determining region 3 for antibody 55646
LQHNSYPFT

SEQ ID NO: 111292 - protein, 16 aa, Homo sapiens
  heavy chain complementarity determining region 3 for antibody 55646
ASLFVDIVVVPAAFAY

SEQ ID NO: 111293 - protein, 9 aa, Homo sapiens
  light chain complementarity determining region 3 for antibody 55647
LQHNSYPFT

SEQ ID NO: 111294 - protein, 16 aa, Homo sapiens
  heavy chain complementarity determining region 3 for antibody 55647
ASLFVDIVAVPAAFDY

SEQ ID NO: 111295 - protein, 9 aa, Homo sapiens
  light chain complementarity determining region 3 for antibody 55648
LQHKRYPPT

SEQ ID NO: 111296 - protein, 16 aa, Homo sapiens
  heavy chain complementarity determining region 3 for antibody 55648
ARGRGTMVRGVTPFDY

SEQ ID NO: 111297 - protein, 9 aa, Homo sapiens
  light chain complementarity determining region 3 for antibody 55649
LQHDSYPRT

SEQ ID NO: 111298 - protein, 9 aa, Homo sapiens
  heavy chain complementarity determining region 3 for antibody 55649
LMVRGVMDV

SEQ ID NO: 111299 - protein, 9 aa, Homo sapiens
  light chain complementarity determining region 3 for antibody 55650
LQHDNFPYT

SEQ ID NO: 111300 - protein, 18 aa, Homo sapiens
  heavy chain complementarity determining region 3 for antibody 55650
AREPYDILTGYYNVGFDY

SEQ ID NO: 111301 - protein, 9 aa, Homo sapiens
  light chain complementarity determining region 3 for antibody 55651
LQDYNYPYT

SEQ ID NO: 111302 - protein, 16 aa, Homo sapiens
  heavy chain complementarity determining region 3 for antibody 55651
ARERDNWNTYYYGMDV

SEQ ID NO: 111303 - protein, 9 aa, Homo sapiens
  light chain complementarity determining region 3 for antibody 55652
LQDYNYPYT

SEQ ID NO: 111304 - protein, 11 aa, Homo sapiens
  heavy chain complementarity determining region 3 for antibody 55652
ARDRGTGDFDY

SEQ ID NO: 111305 - protein, 9 aa, Homo sapiens
  light chain complementarity determining region 3 for antibody 55653
LQDYNYPYT

SEQ ID NO: 111306 - protein, 20 aa, Homo sapiens
  heavy chain complementarity determining region 3 for antibody 55653
ARDGVGIAVAGRRYYYGMDV

SEQ ID NO: 111307 - protein, 9 aa, Homo sapiens
  light chain complementarity determining region 3 for antibody 55654
LQDYNYPWT

SEQ ID NO: 111308 - protein, 14 aa, Homo sapiens
  heavy chain complementarity determining region 3 for antibody 55654
ARHSSGWEGDWFDP

SEQ ID NO: 111309 - protein, 9 aa, Homo sapiens
  light chain complementarity determining region 3 for antibody 55655
LQDYNYPWT

SEQ ID NO: 111310 - protein, 12 aa, Homo sapiens
  heavy chain complementarity determining region 3 for antibody 55655
ARDTMVRRVIDY

SEQ ID NO: 111311 - protein, 9 aa, Homo sapiens
  light chain complementarity determining region 3 for antibody 55656
LQDYNYPWT

SEQ ID NO: 111312 - protein, 12 aa, Homo sapiens
  heavy chain complementarity determining region 3 for antibody 55656
ARDTMVRGVIDS

SEQ ID NO: 111313 - protein, 9 aa, Homo sapiens
  light chain complementarity determining region 3 for antibody 55657
LQDYNYPWT

SEQ ID NO: 111314 - protein, 12 aa, Homo sapiens
  heavy chain complementarity determining region 3 for antibody 55657
ARDSMVRGVIDY

SEQ ID NO: 111315 - protein, 9 aa, Homo sapiens
  light chain complementarity determining region 3 for antibody 55658
LQDYNYPLT

SEQ ID NO: 111316 - protein, 12 aa, Homo sapiens
  heavy chain complementarity determining region 3 for antibody 55658
ARDTMVRGVIDY

SEQ ID NO: 111317 - protein, 9 aa, Homo sapiens
  light chain complementarity determining region 3 for antibody 55659
LQDYNYPHT

SEQ ID NO: 111318 - protein, 15 aa, Homo sapiens
  heavy chain complementarity determining region 3 for antibody 55659
ARDQGSGIAAAGFDY

SEQ ID NO: 111319 - protein, 9 aa, Homo sapiens
  light chain complementarity determining region 3 for antibody 55660
LQDYNYPFT

SEQ ID NO: 111320 - protein, 15 aa, Homo sapiens
  heavy chain complementarity determining region 3 for antibody 55660
ARAPLLLWFGELIDY

SEQ ID NO: 111321 - protein, 9 aa, Homo sapiens
  light chain complementarity determining region 3 for antibody 55661
LQDYNFPYT

SEQ ID NO: 111322 - protein, 17 aa, Homo sapiens
  heavy chain complementarity determining region 3 for antibody 55661
ARAYYYGSGPHYYGMDV

SEQ ID NO: 111323 - protein, 9 aa, Homo sapiens
  light chain complementarity determining region 3 for antibody 55662
LKHNSYPYT

SEQ ID NO: 111324 - protein, 15 aa, Homo sapiens
  heavy chain complementarity determining region 3 for antibody 55662
AREGRLAVAVTGFDY

SEQ ID NO: 111325 - protein, 8 aa, Homo sapiens
  light chain complementarity determining region 3 for antibody 55663
HQSSSLWT

SEQ ID NO: 111326 - protein, 15 aa, Homo sapiens
  heavy chain complementarity determining region 3 for antibody 55663
AREGDYYGSGSYLDP

SEQ ID NO: 111327 - protein, 9 aa, Homo sapiens
  light chain complementarity determining region 3 for antibody 55664
HQSSSLPYT

SEQ ID NO: 111328 - protein, 11 aa, Homo sapiens
  heavy chain complementarity determining region 3 for antibody 55664
VYSSGWYGDDY

SEQ ID NO: 111329 - protein, 9 aa, Homo sapiens
  light chain complementarity determining region 3 for antibody 55665
HQSSSLPHT

SEQ ID NO: 111330 - protein, 13 aa, Homo sapiens
  heavy chain complementarity determining region 3 for antibody 55665
ARIAAAAVQYFHH

SEQ ID NO: 111331 - protein, 9 aa, Homo sapiens
  light chain complementarity determining region 3 for antibody 55666
QQYSSYPRT

SEQ ID NO: 111332 - protein, 13 aa, Homo sapiens
  heavy chain complementarity determining region 3 for antibody 55666
ARDRYGGYGAFDY

SEQ ID NO: 111333 - protein, 9 aa, Homo sapiens
  light chain complementarity determining region 3 for antibody 55667
QQYNSYPRT

SEQ ID NO: 111334 - protein, 9 aa, Homo sapiens
  heavy chain complementarity determining region 3 for antibody 55667
ARGLGPGDY

SEQ ID NO: 111335 - protein, 9 aa, Homo sapiens
  light chain complementarity determining region 3 for antibody 55668
QQYNSYPRT

SEQ ID NO: 111336 - protein, 24 aa, Homo sapiens
  heavy chain complementarity determining region 3 for antibody 55668
AREWEGNYGSGSYYKSAYYYGMDV

SEQ ID NO: 111337 - protein, 9 aa, Homo sapiens
  light chain complementarity determining region 3 for antibody 55669
QQYNSYPRT

SEQ ID NO: 111338 - protein, 13 aa, Homo sapiens
  heavy chain complementarity determining region 3 for antibody 55669
ARDRYSGYGAFAY

SEQ ID NO: 111339 - protein, 9 aa, Homo sapiens
  light chain complementarity determining region 3 for antibody 55670
QQYNSYPRT

SEQ ID NO: 111340 - protein, 13 aa, Homo sapiens
  heavy chain complementarity determining region 3 for antibody 55670
ARDRDSGYGAFDY

SEQ ID NO: 111341 - protein, 9 aa, Homo sapiens
  light chain complementarity determining region 3 for antibody 55671
QQYNSYPLT

SEQ ID NO: 111342 - protein, 15 aa, Homo sapiens
  heavy chain complementarity determining region 3 for antibody 55671
ARGGDILTGYYSFHY

SEQ ID NO: 111343 - protein, 9 aa, Homo sapiens
  light chain complementarity determining region 3 for antibody 55672
QQYNSYPIT

SEQ ID NO: 111344 - protein, 10 aa, Homo sapiens
  heavy chain complementarity determining region 3 for antibody 55672
ARDITRLAGY

SEQ ID NO: 111345 - protein, 9 aa, Homo sapiens
  light chain complementarity determining region 3 for antibody 55673
QQYNSYPFT

SEQ ID NO: 111346 - protein, 12 aa, Homo sapiens
  heavy chain complementarity determining region 3 for antibody 55673
ARDTMVRGVIDY

SEQ ID NO: 111347 - protein, 9 aa, Homo sapiens
  light chain complementarity determining region 3 for antibody 55674
QQYNNYPRT

SEQ ID NO: 111348 - protein, 10 aa, Homo sapiens
  heavy chain complementarity determining region 3 for antibody 55674
ARDKGYYFDY

SEQ ID NO: 111349 - protein, 10 aa, Homo sapiens
  light chain complementarity determining region 3 for antibody 55675
QQYNNWPMYT

SEQ ID NO: 111350 - protein, 11 aa, Homo sapiens
  heavy chain complementarity determining region 3 for antibody 55675
AREWTGEGLDY

SEQ ID NO: 111351 - protein, 9 aa, Homo sapiens
  light chain complementarity determining region 3 for antibody 55676
QQYGSSPRT

SEQ ID NO: 111352 - protein, 8 aa, Homo sapiens
  heavy chain complementarity determining region 3 for antibody 55676
ARDDGMDV

SEQ ID NO: 111353 - protein, 9 aa, Homo sapiens
  light chain complementarity determining region 3 for antibody 55677
QQYGSSPPT

SEQ ID NO: 111354 - protein, 20 aa, Homo sapiens
  heavy chain complementarity determining region 3 for antibody 55677
AREKAYYDILTGYFHGDFDI

SEQ ID NO: 111355 - protein, 9 aa, Homo sapiens
  light chain complementarity determining region 3 for antibody 55678
QQYGSSPLT

SEQ ID NO: 111356 - protein, 16 aa, Homo sapiens
  heavy chain complementarity determining region 3 for antibody 55678
ARFTVRGFITPDAFDI

SEQ ID NO: 111357 - protein, 8 aa, Homo sapiens
  light chain complementarity determining region 3 for antibody 55679
QQYGSSLT

SEQ ID NO: 111358 - protein, 21 aa, Homo sapiens
  heavy chain complementarity determining region 3 for antibody 55679
ARDPYGSGSYKTLYYYYGMDV

SEQ ID NO: 111359 - protein, 9 aa, Homo sapiens
  light chain complementarity determining region 3 for antibody 55680
QQYGRSPLT

SEQ ID NO: 111360 - protein, 19 aa, Homo sapiens
  heavy chain complementarity determining region 3 for antibody 55680
ARHQVYYEIATGYGYGMAV

SEQ ID NO: 111361 - protein, 9 aa, Homo sapiens
  light chain complementarity determining region 3 for antibody 55681
QQYDSYPRT

SEQ ID NO: 111362 - protein, 17 aa, Homo sapiens
  heavy chain complementarity determining region 3 for antibody 55681
ARGLRYFDWLLSDAFDI

SEQ ID NO: 111363 - protein, 9 aa, Homo sapiens
  light chain complementarity determining region 3 for antibody 55682
QQYDNLPLT

SEQ ID NO: 111364 - protein, 16 aa, Homo sapiens
  heavy chain complementarity determining region 3 for antibody 55682
ARDAKYYDILTGDPDY

SEQ ID NO: 111365 - protein, 9 aa, Homo sapiens
  light chain complementarity determining region 3 for antibody 55683
QQYDNLPLT

SEQ ID NO: 111366 - protein, 16 aa, Homo sapiens
  heavy chain complementarity determining region 3 for antibody 55683
ARDAKYYDILSGYPDY

SEQ ID NO: 111367 - protein, 9 aa, Homo sapiens
  light chain complementarity determining region 3 for antibody 55684
QQYDNLPLT

SEQ ID NO: 111368 - protein, 16 aa, Homo sapiens
  heavy chain complementarity determining region 3 for antibody 55684
ARDAKYYDILPGYPDY

SEQ ID NO: 111369 - protein, 9 aa, Homo sapiens
  light chain complementarity determining region 3 for antibody 55685
QQYDDLPLT

SEQ ID NO: 111370 - protein, 16 aa, Homo sapiens
  heavy chain complementarity determining region 3 for antibody 55685
ARDAKYYDILTGYPDY

SEQ ID NO: 111371 - protein, 9 aa, Homo sapiens
  light chain complementarity determining region 3 for antibody 55686
QQSYSTPWT

SEQ ID NO: 111372 - protein, 11 aa, Homo sapiens
  heavy chain complementarity determining region 3 for antibody 55686
ARDEHVLRYVD

SEQ ID NO: 111373 - protein, 9 aa, Homo sapiens
  light chain complementarity determining region 3 for antibody 55687
QQSYRTPYT

SEQ ID NO: 111374 - protein, 14 aa, Homo sapiens
  heavy chain complementarity determining region 3 for antibody 55687
ARESTMVRGVIIDY

SEQ ID NO: 111375 - protein, 10 aa, Homo sapiens
  light chain complementarity determining region 3 for antibody 55688
QQRSNWPPLT

SEQ ID NO: 111376 - protein, 19 aa, Homo sapiens
  heavy chain complementarity determining region 3 for antibody 55688
ATERYKVGATYYFYYGMDV

SEQ ID NO: 111377 - protein, 10 aa, Homo sapiens
  light chain complementarity determining region 3 for antibody 55689
QQRSNWPPLT

SEQ ID NO: 111378 - protein, 19 aa, Homo sapiens
  heavy chain complementarity determining region 3 for antibody 55689
ATERYKVGATSYYYYGMDV

SEQ ID NO: 111379 - protein, 10 aa, Homo sapiens
  light chain complementarity determining region 3 for antibody 55690
QQRSNWPPLT

SEQ ID NO: 111380 - protein, 19 aa, Homo sapiens
  heavy chain complementarity determining region 3 for antibody 55690
ATEGYKVGATYSYYYGMDV

SEQ ID NO: 111381 - protein, 9 aa, Homo sapiens
  light chain complementarity determining region 3 for antibody 55691
QQRSNWHPT

SEQ ID NO: 111382 - protein, 20 aa, Homo sapiens
  heavy chain complementarity determining region 3 for antibody 55691
AKDQGDIVATIMDYYYGMDV

SEQ ID NO: 111383 - protein, 9 aa, Homo sapiens
  light chain complementarity determining region 3 for antibody 55692
QQLSSYPRT

SEQ ID NO: 111384 - protein, 13 aa, Homo sapiens
  heavy chain complementarity determining region 3 for antibody 55692
AKEMGQWLYYFDY

SEQ ID NO: 111385 - protein, 9 aa, Homo sapiens
  light chain complementarity determining region 3 for antibody 55693
QQLNSYPYT

SEQ ID NO: 111386 - protein, 9 aa, Homo sapiens
  heavy chain complementarity determining region 3 for antibody 55693
ERKRWYLDL

SEQ ID NO: 111387 - protein, 9 aa, Homo sapiens
  light chain complementarity determining region 3 for antibody 55694
QQLNSYPWT

SEQ ID NO: 111388 - protein, 20 aa, Homo sapiens
  heavy chain complementarity determining region 3 for antibody 55694
ARKGYYGSGSFPYYYYGMDV

SEQ ID NO: 111389 - protein, 9 aa, Homo sapiens
  light chain complementarity determining region 3 for antibody 55695
QQLNSYPWT

SEQ ID NO: 111390 - protein, 14 aa, Homo sapiens
  heavy chain complementarity determining region 3 for antibody 55695
ARDPPRIVGALFDY

SEQ ID NO: 111391 - protein, 9 aa, Homo sapiens
  light chain complementarity determining region 3 for antibody 55696
QQLNSYPWT

SEQ ID NO: 111392 - protein, 11 aa, Homo sapiens
  heavy chain complementarity determining region 3 for antibody 55696
AKDRTSGGMDV

SEQ ID NO: 111393 - protein, 9 aa, Homo sapiens
  light chain complementarity determining region 3 for antibody 55697
QQLNSYPRT

SEQ ID NO: 111394 - protein, 17 aa, Homo sapiens
  heavy chain complementarity determining region 3 for antibody 55697
ARRGYSGYDNDYYGMDV

SEQ ID NO: 111395 - protein, 9 aa, Homo sapiens
  light chain complementarity determining region 3 for antibody 55698
QQLNSYPRT

SEQ ID NO: 111396 - protein, 11 aa, Homo sapiens
  heavy chain complementarity determining region 3 for antibody 55698
AREHYYYGMDV

SEQ ID NO: 111397 - protein, 9 aa, Homo sapiens
  light chain complementarity determining region 3 for antibody 55699
QQLNSYPPT

SEQ ID NO: 111398 - protein, 14 aa, Homo sapiens
  heavy chain complementarity determining region 3 for antibody 55699
ARDWNSGSYYYFDY

SEQ ID NO: 111399 - protein, 10 aa, Homo sapiens
  light chain complementarity determining region 3 for antibody 55700
QQLNSYPMYT

SEQ ID NO: 111400 - protein, 16 aa, Homo sapiens
  heavy chain complementarity determining region 3 for antibody 55700
ARLYYDILTGHNWFDP

SEQ ID NO: 111401 - protein, 9 aa, Homo sapiens
  light chain complementarity determining region 3 for antibody 55701
QQLNSYPLT

SEQ ID NO: 111402 - protein, 13 aa, Homo sapiens
  heavy chain complementarity determining region 3 for antibody 55701
ARYSSTWYDAFDI

SEQ ID NO: 111403 - protein, 9 aa, Homo sapiens
  light chain complementarity determining region 3 for antibody 55702
QQLNSYPLT

SEQ ID NO: 111404 - protein, 14 aa, Homo sapiens
  heavy chain complementarity determining region 3 for antibody 55702
AREGVTMVRGVMDY

SEQ ID NO: 111405 - protein, 9 aa, Homo sapiens
  light chain complementarity determining region 3 for antibody 55703
QQLNSYPLT

SEQ ID NO: 111406 - protein, 11 aa, Homo sapiens
  heavy chain complementarity determining region 3 for antibody 55703
AREGVATAFDI

SEQ ID NO: 111407 - protein, 9 aa, Homo sapiens
  light chain complementarity determining region 3 for antibody 55704
QQLNSYPFT

SEQ ID NO: 111408 - protein, 16 aa, Homo sapiens
  heavy chain complementarity determining region 3 for antibody 55704
ARVITMVRGVPDAFGI

SEQ ID NO: 111409 - protein, 9 aa, Homo sapiens
  light chain complementarity determining region 3 for antibody 55705
QQLNSYPFT

SEQ ID NO: 111410 - protein, 12 aa, Homo sapiens
  heavy chain complementarity determining region 3 for antibody 55705
ARGRGYSYGLDY

SEQ ID NO: 111411 - protein, 9 aa, Homo sapiens
  light chain complementarity determining region 3 for antibody 55706
QQLNSFRRS

SEQ ID NO: 111412 - protein, 13 aa, Homo sapiens
  heavy chain complementarity determining region 3 for antibody 55706
AKEMGQWLYYFDY

SEQ ID NO: 111413 - protein, 9 aa, Homo sapiens
  light chain complementarity determining region 3 for antibody 55707
QQLNNYPYT

SEQ ID NO: 111414 - protein, 24 aa, Homo sapiens
  heavy chain complementarity determining region 3 for antibody 55707
AREWEGNYGSGSYYKSAYYYGMDV

SEQ ID NO: 111415 - protein, 9 aa, Homo sapiens
  light chain complementarity determining region 3 for antibody 55708
QQLNNYPFT

SEQ ID NO: 111416 - protein, 9 aa, Homo sapiens
  heavy chain complementarity determining region 3 for antibody 55708
ARKRWYLDL

SEQ ID NO: 111417 - protein, 9 aa, Homo sapiens
  light chain complementarity determining region 3 for antibody 55709
QQFNNYPYT

SEQ ID NO: 111418 - protein, 8 aa, Homo sapiens
  heavy chain complementarity determining region 3 for antibody 55709
ARTGPLDY

SEQ ID NO: 111419 - protein, 9 aa, Homo sapiens
  light chain complementarity determining region 3 for antibody 55710
QQFNNYPYT

SEQ ID NO: 111420 - protein, 24 aa, Homo sapiens
  heavy chain complementarity determining region 3 for antibody 55710
AREWEGNYGSGSYYKSAYYCGMDV

SEQ ID NO: 111421 - protein, 9 aa, Homo sapiens
  light chain complementarity determining region 3 for antibody 55711
QQFNNYPYT

SEQ ID NO: 111422 - protein, 24 aa, Homo sapiens
  heavy chain complementarity determining region 3 for antibody 55711
AREWEGNYGSGSYYKSASSYGMDV

SEQ ID NO: 111423 - protein, 9 aa, Homo sapiens
  light chain complementarity determining region 3 for antibody 55712
QQFNNYPYT

SEQ ID NO: 111424 - protein, 24 aa, Homo sapiens
  heavy chain complementarity determining region 3 for antibody 55712
AREWEGNYGSGSYDKSAYYYGMDV

SEQ ID NO: 111425 - protein, 9 aa, Homo sapiens
  light chain complementarity determining region 3 for antibody 55713
QQFNNYPYT

SEQ ID NO: 111426 - protein, 24 aa, Homo sapiens
  heavy chain complementarity determining region 3 for antibody 55713
AREWEGNYGSGSEYKSAYYYGMDV

SEQ ID NO: 111427 - protein, 9 aa, Homo sapiens
  light chain complementarity determining region 3 for antibody 55714
QQFNNYPYT

SEQ ID NO: 111428 - protein, 24 aa, Homo sapiens
  heavy chain complementarity determining region 3 for antibody 55714
AREWEGNYGSGSCYKSAYYYGMDV

SEQ ID NO: 111429 - protein, 9 aa, Homo sapiens
  light chain complementarity determining region 3 for antibody 55715
QQFNNYPYT

SEQ ID NO: 111430 - protein, 24 aa, Homo sapiens
  heavy chain complementarity determining region 3 for antibody 55715
AREWEGNYGSGNYYKSAYYYGMDV

SEQ ID NO: 111431 - protein, 9 aa, Homo sapiens
  light chain complementarity determining region 3 for antibody 55716
QQFNNYPYT

SEQ ID NO: 111432 - protein, 24 aa, Homo sapiens
  heavy chain complementarity determining region 3 for antibody 55716
AREWEGNYGSGCYYKSAYYYGMDV

SEQ ID NO: 111433 - protein, 9 aa, Homo sapiens
  light chain complementarity determining region 3 for antibody 55717
QQFNNYPYT

SEQ ID NO: 111434 - protein, 24 aa, Homo sapiens
  heavy chain complementarity determining region 3 for antibody 55717
AREWEGNYDSGSYYKSAYYYGMDV

SEQ ID NO: 111435 - protein, 9 aa, Homo sapiens
  light chain complementarity determining region 3 for antibody 55718
QQFNNYPYT

SEQ ID NO: 111436 - protein, 24 aa, Homo sapiens
  heavy chain complementarity determining region 3 for antibody 55718
AREWEGNDGSGSDYKSAYYYGMDV

SEQ ID NO: 111437 - protein, 9 aa, Homo sapiens
  light chain complementarity determining region 3 for antibody 55719
QQFNNYPYT

SEQ ID NO: 111438 - protein, 24 aa, Homo sapiens
  heavy chain complementarity determining region 3 for antibody 55719
AREWEGKDGSGSYYKSAYYYGMDV

SEQ ID NO: 111439 - protein, 9 aa, Homo sapiens
  light chain complementarity determining region 3 for antibody 55720
QQFNNYPYT

SEQ ID NO: 111440 - protein, 24 aa, Homo sapiens
  heavy chain complementarity determining region 3 for antibody 55720
AREWEGDYGSGSYYKSAYYYGMDV

SEQ ID NO: 111441 - protein, 9 aa, Homo sapiens
  light chain complementarity determining region 3 for antibody 55721
QQFNNYPCT

SEQ ID NO: 111442 - protein, 24 aa, Homo sapiens
  heavy chain complementarity determining region 3 for antibody 55721
AREWEGNYGSGSYYKSAYSYGMDV

SEQ ID NO: 111443 - protein, 9 aa, Homo sapiens
  light chain complementarity determining region 3 for antibody 55722
QQFNNYPCT

SEQ ID NO: 111444 - protein, 24 aa, Homo sapiens
  heavy chain complementarity determining region 3 for antibody 55722
AREWEGNYGSGSDYKSAYYYGMDV

SEQ ID NO: 111445 - protein, 9 aa, Homo sapiens
  light chain complementarity determining region 3 for antibody 55723
QMYNSAPLT

SEQ ID NO: 111446 - protein, 16 aa, Homo sapiens
  heavy chain complementarity determining region 3 for antibody 55723
ARDAKYYDILTGYPDY

SEQ ID NO: 111447 - protein, 9 aa, Homo sapiens
  light chain complementarity determining region 3 for antibody 55724
QKYNSVPLT

SEQ ID NO: 111448 - protein, 9 aa, Homo sapiens
  heavy chain complementarity determining region 3 for antibody 55724
ARDGLGIDY

SEQ ID NO: 111449 - protein, 9 aa, Homo sapiens
  light chain complementarity determining region 3 for antibody 55725
QKYNSAPPT

SEQ ID NO: 111450 - protein, 13 aa, Homo sapiens
  heavy chain complementarity determining region 3 for antibody 55725
ARDRYSGYGAFDY

SEQ ID NO: 111451 - protein, 9 aa, Homo sapiens
  light chain complementarity determining region 3 for antibody 55726
QKYNSAPLT

SEQ ID NO: 111452 - protein, 17 aa, Homo sapiens
  heavy chain complementarity determining region 3 for antibody 55726
ARGLRYIDWLLSDAFDI

SEQ ID NO: 111453 - protein, 9 aa, Homo sapiens
  light chain complementarity determining region 3 for antibody 55727
QKYNSAPLT

SEQ ID NO: 111454 - protein, 17 aa, Homo sapiens
  heavy chain complementarity determining region 3 for antibody 55727
ARGLRYFDWSFSDAFDI

SEQ ID NO: 111455 - protein, 9 aa, Homo sapiens
  light chain complementarity determining region 3 for antibody 55728
QKYNSAPLT

SEQ ID NO: 111456 - protein, 17 aa, Homo sapiens
  heavy chain complementarity determining region 3 for antibody 55728
ARGLRYFDWFFSDAFDI

SEQ ID NO: 111457 - protein, 9 aa, Homo sapiens
  light chain complementarity determining region 3 for antibody 55729
QKYNSAPLT

SEQ ID NO: 111458 - protein, 9 aa, Homo sapiens
  heavy chain complementarity determining region 3 for antibody 55729
ARGGLGIDY

SEQ ID NO: 111459 - protein, 9 aa, Homo sapiens
  light chain complementarity determining region 3 for antibody 55730
QKYNSAPLT

SEQ ID NO: 111460 - protein, 9 aa, Homo sapiens
  heavy chain complementarity determining region 3 for antibody 55730
ARDWLGIDY

SEQ ID NO: 111461 - protein, 9 aa, Homo sapiens
  light chain complementarity determining region 3 for antibody 55731
QKYNSAPLT

SEQ ID NO: 111462 - protein, 11 aa, Homo sapiens
  heavy chain complementarity determining region 3 for antibody 55731
ARDRILKGMDV

SEQ ID NO: 111463 - protein, 9 aa, Homo sapiens
  light chain complementarity determining region 3 for antibody 55732
QKYNSAPLT

SEQ ID NO: 111464 - protein, 9 aa, Homo sapiens
  heavy chain complementarity determining region 3 for antibody 55732
ARDLSGMDV

SEQ ID NO: 111465 - protein, 9 aa, Homo sapiens
  light chain complementarity determining region 3 for antibody 55733
QKYNSAPLT

SEQ ID NO: 111466 - protein, 9 aa, Homo sapiens
  heavy chain complementarity determining region 3 for antibody 55733
ARDGLGINY

SEQ ID NO: 111467 - protein, 9 aa, Homo sapiens
  light chain complementarity determining region 3 for antibody 55734
QKYNSAPLT

SEQ ID NO: 111468 - protein, 9 aa, Homo sapiens
  heavy chain complementarity determining region 3 for antibody 55734
ARDGLEIDY

SEQ ID NO: 111469 - protein, 9 aa, Homo sapiens
  light chain complementarity determining region 3 for antibody 55735
QKYNSAPLT

SEQ ID NO: 111470 - protein, 16 aa, Homo sapiens
  heavy chain complementarity determining region 3 for antibody 55735
ARDAKYYDSLTGYPDY

SEQ ID NO: 111471 - protein, 9 aa, Homo sapiens
  light chain complementarity determining region 3 for antibody 55736
QKYNSAPLT

SEQ ID NO: 111472 - protein, 16 aa, Homo sapiens
  heavy chain complementarity determining region 3 for antibody 55736
ARDAKYYDILTGDPDY

SEQ ID NO: 111473 - protein, 9 aa, Homo sapiens
  light chain complementarity determining region 3 for antibody 55737
QKYNSAPLT

SEQ ID NO: 111474 - protein, 13 aa, Homo sapiens
  heavy chain complementarity determining region 3 for antibody 55737
AGDRYSGYGAFDY

SEQ ID NO: 111475 - protein, 9 aa, Homo sapiens
  light chain complementarity determining region 3 for antibody 55738
NQLNSYPYT

SEQ ID NO: 111476 - protein, 9 aa, Homo sapiens
  heavy chain complementarity determining region 3 for antibody 55738
ARKRWYFDL

SEQ ID NO: 111477 - protein, 9 aa, Homo sapiens
  light chain complementarity determining region 3 for antibody 55739
LQHNSYPYT

SEQ ID NO: 111478 - protein, 13 aa, Homo sapiens
  heavy chain complementarity determining region 3 for antibody 55739
ARIRYFDWLPLDY

SEQ ID NO: 111479 - protein, 9 aa, Homo sapiens
  light chain complementarity determining region 3 for antibody 55740
LQHNSYPWT

SEQ ID NO: 111480 - protein, 13 aa, Homo sapiens
  heavy chain complementarity determining region 3 for antibody 55740
AREEYSGYDYADY

SEQ ID NO: 111481 - protein, 9 aa, Homo sapiens
  light chain complementarity determining region 3 for antibody 55741
LQHNSYPWT

SEQ ID NO: 111482 - protein, 16 aa, Homo sapiens
  heavy chain complementarity determining region 3 for antibody 55741
ARDKAYDILTGYYPAY

SEQ ID NO: 111483 - protein, 9 aa, Homo sapiens
  light chain complementarity determining region 3 for antibody 55742
LQHNSYPWT

SEQ ID NO: 111484 - protein, 12 aa, Homo sapiens
  heavy chain complementarity determining region 3 for antibody 55742
ARDIMVRGVIDS

SEQ ID NO: 111485 - protein, 9 aa, Homo sapiens
  light chain complementarity determining region 3 for antibody 55743
LQHNSYPWT

SEQ ID NO: 111486 - protein, 12 aa, Homo sapiens
  heavy chain complementarity determining region 3 for antibody 55743
ARDIMVPGVIDY

SEQ ID NO: 111487 - protein, 9 aa, Homo sapiens
  light chain complementarity determining region 3 for antibody 55744
LQHNSYPWT

SEQ ID NO: 111488 - protein, 19 aa, Homo sapiens
  heavy chain complementarity determining region 3 for antibody 55744
AKDEEILTGYYRDYYAMDV

SEQ ID NO: 111489 - protein, 9 aa, Homo sapiens
  light chain complementarity determining region 3 for antibody 55745
LQHNSYPRT

SEQ ID NO: 111490 - protein, 8 aa, Homo sapiens
  heavy chain complementarity determining region 3 for antibody 55745
ARTGPLDY

SEQ ID NO: 111491 - protein, 9 aa, Homo sapiens
  light chain complementarity determining region 3 for antibody 55746
LQHNSYPRT

SEQ ID NO: 111492 - protein, 12 aa, Homo sapiens
  heavy chain complementarity determining region 3 for antibody 55746
ARGYSSADAFDF

SEQ ID NO: 111493 - protein, 9 aa, Homo sapiens
  light chain complementarity determining region 3 for antibody 55747
LQHNSYPRT

SEQ ID NO: 111494 - protein, 11 aa, Homo sapiens
  heavy chain complementarity determining region 3 for antibody 55747
ARDEHVLRYFD

SEQ ID NO: 111495 - protein, 9 aa, Homo sapiens
  light chain complementarity determining region 3 for antibody 55748
LQHNSYPFT

SEQ ID NO: 111496 - protein, 16 aa, Homo sapiens
  heavy chain complementarity determining region 3 for antibody 55748
ASLFVDIVVIPAAFDY

SEQ ID NO: 111497 - protein, 9 aa, Homo sapiens
  light chain complementarity determining region 3 for antibody 55749
LQHNSYPFT

SEQ ID NO: 111498 - protein, 16 aa, Homo sapiens
  heavy chain complementarity determining region 3 for antibody 55749
ASLFVDIVGVPAAFDY

SEQ ID NO: 111499 - protein, 9 aa, Homo sapiens
  light chain complementarity determining region 3 for antibody 55750
LQHNRYPRT

SEQ ID NO: 111500 - protein, 15 aa, Homo sapiens
  heavy chain complementarity determining region 3 for antibody 55750
ARGGDYYGSGSFFDY

SEQ ID NO: 111501 - protein, 9 aa, Homo sapiens
  light chain complementarity determining region 3 for antibody 55751
LQHDNFPYT

SEQ ID NO: 111502 - protein, 20 aa, Homo sapiens
  heavy chain complementarity determining region 3 for antibody 55751
ARGGGYYYGSGSYDYYGMDV

SEQ ID NO: 111503 - protein, 9 aa, Homo sapiens
  light chain complementarity determining region 3 for antibody 55752
LQHDNFPYT

SEQ ID NO: 111504 - protein, 12 aa, Homo sapiens
  heavy chain complementarity determining region 3 for antibody 55752
ARDIVATSYFDY

SEQ ID NO: 111505 - protein, 9 aa, Homo sapiens
  light chain complementarity determining region 3 for antibody 55753
LQDYNYPYT

SEQ ID NO: 111506 - protein, 12 aa, Homo sapiens
  heavy chain complementarity determining region 3 for antibody 55753
ARGGYYDIFPDV

SEQ ID NO: 111507 - protein, 9 aa, Homo sapiens
  light chain complementarity determining region 3 for antibody 55754
LQDYNYPYT

SEQ ID NO: 111508 - protein, 20 aa, Homo sapiens
  heavy chain complementarity determining region 3 for antibody 55754
ARDRVAVAGAYYYYYYGMDV

SEQ ID NO: 111509 - protein, 9 aa, Homo sapiens
  light chain complementarity determining region 3 for antibody 55755
LQDYNYPYT

SEQ ID NO: 111510 - protein, 20 aa, Homo sapiens
  heavy chain complementarity determining region 3 for antibody 55755
ARDRGAYSGYDYYYYYGMDV

SEQ ID NO: 111511 - protein, 9 aa, Homo sapiens
  light chain complementarity determining region 3 for antibody 55756
LQDYNYPYT

SEQ ID NO: 111512 - protein, 14 aa, Homo sapiens
  heavy chain complementarity determining region 3 for antibody 55756
ARDPPRIVGAPFDY

SEQ ID NO: 111513 - protein, 9 aa, Homo sapiens
  light chain complementarity determining region 3 for antibody 55757
LQDYNYPWT

SEQ ID NO: 111514 - protein, 12 aa, Homo sapiens
  heavy chain complementarity determining region 3 for antibody 55757
ASDTTVRGVIDY

SEQ ID NO: 111515 - protein, 9 aa, Homo sapiens
  light chain complementarity determining region 3 for antibody 55758
LQDYNYPWT

SEQ ID NO: 111516 - protein, 14 aa, Homo sapiens
  heavy chain complementarity determining region 3 for antibody 55758
ARHKERSRAFYFDY

SEQ ID NO: 111517 - protein, 9 aa, Homo sapiens
  light chain complementarity determining region 3 for antibody 55759
LQDYNYPWT

SEQ ID NO: 111518 - protein, 24 aa, Homo sapiens
  heavy chain complementarity determining region 3 for antibody 55759
AREWEGNYGSGSYYKSAYYYGMDV

SEQ ID NO: 111519 - protein, 9 aa, Homo sapiens
  light chain complementarity determining region 3 for antibody 55760
LQDYNYPWT

SEQ ID NO: 111520 - protein, 12 aa, Homo sapiens
  heavy chain complementarity determining region 3 for antibody 55760
ARDTMVRGGIDY

SEQ ID NO: 111521 - protein, 9 aa, Homo sapiens
  light chain complementarity determining region 3 for antibody 55761
LQDYNYPRT

SEQ ID NO: 111522 - protein, 15 aa, Homo sapiens
  heavy chain complementarity determining region 3 for antibody 55761
ARHKREAPGYWYFDL

SEQ ID NO: 111523 - protein, 9 aa, Homo sapiens
  light chain complementarity determining region 3 for antibody 55762
LQDYNYPRT

SEQ ID NO: 111524 - protein, 12 aa, Homo sapiens
  heavy chain complementarity determining region 3 for antibody 55762
AREDSSGWYGDY

SEQ ID NO: 111525 - protein, 9 aa, Homo sapiens
  light chain complementarity determining region 3 for antibody 55763
LQDYNYPRT

SEQ ID NO: 111526 - protein, 11 aa, Homo sapiens
  heavy chain complementarity determining region 3 for antibody 55763
ARDEHVLRYYD

SEQ ID NO: 111527 - protein, 9 aa, Homo sapiens
  light chain complementarity determining region 3 for antibody 55764
LQDYNYPRT

SEQ ID NO: 111528 - protein, 13 aa, Homo sapiens
  heavy chain complementarity determining region 3 for antibody 55764
AKEMGQWLYYFDY

SEQ ID NO: 111529 - protein, 9 aa, Homo sapiens
  light chain complementarity determining region 3 for antibody 55765
LQDYNYPRT

SEQ ID NO: 111530 - protein, 17 aa, Homo sapiens
  heavy chain complementarity determining region 3 for antibody 55765
AKDTTVVTYYYYYGMDV

SEQ ID NO: 111531 - protein, 9 aa, Homo sapiens
  light chain complementarity determining region 3 for antibody 55766
LQDYNYPRT

SEQ ID NO: 111532 - protein, 13 aa, Homo sapiens
  heavy chain complementarity determining region 3 for antibody 55766
AKDPGDYYYGMDV

SEQ ID NO: 111533 - protein, 9 aa, Homo sapiens
  light chain complementarity determining region 3 for antibody 55767
LQDYNYPHT

SEQ ID NO: 111534 - protein, 19 aa, Homo sapiens
  heavy chain complementarity determining region 3 for antibody 55767
ASFYYGSGSFYYYYYGLDV

SEQ ID NO: 111535 - protein, 9 aa, Homo sapiens
  light chain complementarity determining region 3 for antibody 55768
LQDYNYPFT

SEQ ID NO: 111536 - protein, 8 aa, Homo sapiens
  heavy chain complementarity determining region 3 for antibody 55768
ARDDGMDV

SEQ ID NO: 111537 - protein, 9 aa, Homo sapiens
  light chain complementarity determining region 3 for antibody 55769
LQDYNYPFT

SEQ ID NO: 111538 - protein, 15 aa, Homo sapiens
  heavy chain complementarity determining region 3 for antibody 55769
ARASLLLWFGEFIDY

SEQ ID NO: 111539 - protein, 9 aa, Homo sapiens
  light chain complementarity determining region 3 for antibody 55770
LQDYNYPFT

SEQ ID NO: 111540 - protein, 15 aa, Homo sapiens
  heavy chain complementarity determining region 3 for antibody 55770
ARAPFLLWFGEFIDY

SEQ ID NO: 111541 - protein, 9 aa, Homo sapiens
  light chain complementarity determining region 3 for antibody 55771
LQDYNCPFT

SEQ ID NO: 111542 - protein, 15 aa, Homo sapiens
  heavy chain complementarity determining region 3 for antibody 55771
ARAPLLLWFGEFIDY

SEQ ID NO: 111543 - protein, 9 aa, Homo sapiens
  light chain complementarity determining region 3 for antibody 55772
LKDYNYPFT

SEQ ID NO: 111544 - protein, 15 aa, Homo sapiens
  heavy chain complementarity determining region 3 for antibody 55772
ARAPLLLWFGEFIDY

SEQ ID NO: 111545 - protein, 9 aa, Homo sapiens
  light chain complementarity determining region 3 for antibody 55773
KQFNNYPYT

SEQ ID NO: 111546 - protein, 24 aa, Homo sapiens
  heavy chain complementarity determining region 3 for antibody 55773
AREWEGNYGSGSYYKSAYYYGMDV

SEQ ID NO: 111547 - protein, 9 aa, Homo sapiens
  light chain complementarity determining region 3 for antibody 55774
HQSSSLPYT

SEQ ID NO: 111548 - protein, 9 aa, Homo sapiens
  heavy chain complementarity determining region 3 for antibody 55774
ARDLSGMDV

SEQ ID NO: 111549 - protein, 9 aa, Homo sapiens
  light chain complementarity determining region 3 for antibody 55775
RQYNSYPRT

SEQ ID NO: 111550 - protein, 5 aa, Homo sapiens
  heavy chain complementarity determining region 3 for antibody 55775
ARNWG

SEQ ID NO: 111551 - protein, 9 aa, Homo sapiens
  light chain complementarity determining region 3 for antibody 55776
RQLNSYPYT

SEQ ID NO: 111552 - protein, 12 aa, Homo sapiens
  heavy chain complementarity determining region 3 for antibody 55776
ARGRGYSYGLDY

SEQ ID NO: 111553 - protein, 9 aa, Homo sapiens
  light chain complementarity determining region 3 for antibody 55777
QRTYNAPFT

SEQ ID NO: 111554 - protein, 21 aa, Homo sapiens
  heavy chain complementarity determining region 3 for antibody 55777
ARDPYGSGSYKTLYYYYGMDV

SEQ ID NO: 111555 - protein, 9 aa, Homo sapiens
  light chain complementarity determining region 3 for antibody 55778
QQYNSYPYT

SEQ ID NO: 111556 - protein, 16 aa, Homo sapiens
  heavy chain complementarity determining region 3 for antibody 55778
ARGVRGALYYYYGMDV

SEQ ID NO: 111557 - protein, 9 aa, Homo sapiens
  light chain complementarity determining region 3 for antibody 55779
QQYNSYPYT

SEQ ID NO: 111558 - protein, 19 aa, Homo sapiens
  heavy chain complementarity determining region 3 for antibody 55779
ARGGYYYDSSGYYHNAFAI

SEQ ID NO: 111559 - protein, 9 aa, Homo sapiens
  light chain complementarity determining region 3 for antibody 55780
QQYNSYPYT

SEQ ID NO: 111560 - protein, 13 aa, Homo sapiens
  heavy chain complementarity determining region 3 for antibody 55780
ARGGIVGATPFDY

SEQ ID NO: 111561 - protein, 9 aa, Homo sapiens
  light chain complementarity determining region 3 for antibody 55781
QQYNSYPYT

SEQ ID NO: 111562 - protein, 16 aa, Homo sapiens
  heavy chain complementarity determining region 3 for antibody 55781
ARDYYDSSGYWGYLDY

SEQ ID NO: 111563 - protein, 9 aa, Homo sapiens
  light chain complementarity determining region 3 for antibody 55782
QQYNSYPRT

SEQ ID NO: 111564 - protein, 5 aa, Homo sapiens
  heavy chain complementarity determining region 3 for antibody 55782
ARNGG

SEQ ID NO: 111565 - protein, 9 aa, Homo sapiens
  light chain complementarity determining region 3 for antibody 55783
QQYNSYPRT

SEQ ID NO: 111566 - protein, 17 aa, Homo sapiens
  heavy chain complementarity determining region 3 for antibody 55783
ARGLRDFDWSLSDAFDI

SEQ ID NO: 111567 - protein, 9 aa, Homo sapiens
  light chain complementarity determining region 3 for antibody 55784
QQYNSYPRA

SEQ ID NO: 111568 - protein, 13 aa, Homo sapiens
  heavy chain complementarity determining region 3 for antibody 55784
ARDRYSGYGAFDY

SEQ ID NO: 111569 - protein, 9 aa, Homo sapiens
  light chain complementarity determining region 3 for antibody 55785
QQYNSYPFT

SEQ ID NO: 111570 - protein, 16 aa, Homo sapiens
  heavy chain complementarity determining region 3 for antibody 55785
ARDYYDSSGYWGHLDY

SEQ ID NO: 111571 - protein, 9 aa, Homo sapiens
  light chain complementarity determining region 3 for antibody 55786
QQYNHWPLT

SEQ ID NO: 111572 - protein, 17 aa, Homo sapiens
  heavy chain complementarity determining region 3 for antibody 55786
ARDRAPMVRGVIGWFDP

SEQ ID NO: 111573 - protein, 9 aa, Homo sapiens
  light chain complementarity determining region 3 for antibody 55787
QQYNGYPRT

SEQ ID NO: 111574 - protein, 11 aa, Homo sapiens
  heavy chain complementarity determining region 3 for antibody 55787
ARILTGYYKDY

SEQ ID NO: 111575 - protein, 9 aa, Homo sapiens
  light chain complementarity determining region 3 for antibody 55788
QQYISYPFT

SEQ ID NO: 111576 - protein, 13 aa, Homo sapiens
  heavy chain complementarity determining region 3 for antibody 55788
AADYGDYQYYFDY

SEQ ID NO: 111577 - protein, 9 aa, Homo sapiens
  light chain complementarity determining region 3 for antibody 55789
QQYGSSPYT

SEQ ID NO: 111578 - protein, 19 aa, Homo sapiens
  heavy chain complementarity determining region 3 for antibody 55789
AREKISGSYYVYYYYGMDV

SEQ ID NO: 111579 - protein, 10 aa, Homo sapiens
  light chain complementarity determining region 3 for antibody 55790
QQYGSSPMYT

SEQ ID NO: 111580 - protein, 17 aa, Homo sapiens
  heavy chain complementarity determining region 3 for antibody 55790
ARDRIAVAAYYYYGMDV

SEQ ID NO: 111581 - protein, 8 aa, Homo sapiens
  light chain complementarity determining region 3 for antibody 55791
QQYGSSFT

SEQ ID NO: 111582 - protein, 13 aa, Homo sapiens
  heavy chain complementarity determining region 3 for antibody 55791
ERYSSSWYDAFDI

SEQ ID NO: 111583 - protein, 8 aa, Homo sapiens
  light chain complementarity determining region 3 for antibody 55792
QQYGSSFT

SEQ ID NO: 111584 - protein, 13 aa, Homo sapiens
  heavy chain complementarity determining region 3 for antibody 55792
ARYSSSWYYAFDI

SEQ ID NO: 111585 - protein, 8 aa, Homo sapiens
  light chain complementarity determining region 3 for antibody 55793
QQYGSSFA

SEQ ID NO: 111586 - protein, 13 aa, Homo sapiens
  heavy chain complementarity determining region 3 for antibody 55793
ARYSSSWYDAFDI

SEQ ID NO: 111587 - protein, 9 aa, Homo sapiens
  light chain complementarity determining region 3 for antibody 55794
QQYDNLPLT

SEQ ID NO: 111588 - protein, 16 aa, Homo sapiens
  heavy chain complementarity determining region 3 for antibody 55794
ARDAKYYDTLTGSPDY

SEQ ID NO: 111589 - protein, 8 aa, Homo sapiens
  light chain complementarity determining region 3 for antibody 55795
QQRSNWYT

SEQ ID NO: 111590 - protein, 11 aa, Homo sapiens
  heavy chain complementarity determining region 3 for antibody 55795
ARDLIYSYGYY

SEQ ID NO: 111591 - protein, 10 aa, Homo sapiens
  light chain complementarity determining region 3 for antibody 55796
QQRSNWPPLT

SEQ ID NO: 111592 - protein, 19 aa, Homo sapiens
  heavy chain complementarity determining region 3 for antibody 55796
ATERYKVGATYYSYYGMDV

SEQ ID NO: 111593 - protein, 10 aa, Homo sapiens
  light chain complementarity determining region 3 for antibody 55797
QQRSNWPPLT

SEQ ID NO: 111594 - protein, 19 aa, Homo sapiens
  heavy chain complementarity determining region 3 for antibody 55797
ATERYKVGATYSYYSGMDV

SEQ ID NO: 111595 - protein, 10 aa, Homo sapiens
  light chain complementarity determining region 3 for antibody 55798
QQRSNWPPLA

SEQ ID NO: 111596 - protein, 19 aa, Homo sapiens
  heavy chain complementarity determining region 3 for antibody 55798
ATERYKVGATYYYYYGMDV

SEQ ID NO: 111597 - protein, 9 aa, Homo sapiens
  light chain complementarity determining region 3 for antibody 55799
QQLNSYPYT

SEQ ID NO: 111598 - protein, 16 aa, Homo sapiens
  heavy chain complementarity determining region 3 for antibody 55799
ARGYYYGAGSYSPFDY

SEQ ID NO: 111599 - protein, 9 aa, Homo sapiens
  light chain complementarity determining region 3 for antibody 55800
QQLNSYPWT

SEQ ID NO: 111600 - protein, 16 aa, Homo sapiens
  heavy chain complementarity determining region 3 for antibody 55800
ARVPYYYGSGSYLFDY

SEQ ID NO: 111601 - protein, 9 aa, Homo sapiens
  light chain complementarity determining region 3 for antibody 55801
QQLNSYPWT

SEQ ID NO: 111602 - protein, 11 aa, Homo sapiens
  heavy chain complementarity determining region 3 for antibody 55801
AKGRTSGGMDV

SEQ ID NO: 111603 - protein, 8 aa, Homo sapiens
  light chain complementarity determining region 3 for antibody 55802
QQLNSYPT

SEQ ID NO: 111604 - protein, 20 aa, Homo sapiens
  heavy chain complementarity determining region 3 for antibody 55802
AGDGYGDYVGGYYYYYGMDV

SEQ ID NO: 111605 - protein, 9 aa, Homo sapiens
  light chain complementarity determining region 3 for antibody 55803
QQLNSYPRT

SEQ ID NO: 111606 - protein, 10 aa, Homo sapiens
  heavy chain complementarity determining region 3 for antibody 55803
ARVWFGAVDY

SEQ ID NO: 111607 - protein, 9 aa, Homo sapiens
  light chain complementarity determining region 3 for antibody 55804
QQLNSYPRT

SEQ ID NO: 111608 - protein, 8 aa, Homo sapiens
  heavy chain complementarity determining region 3 for antibody 55804
ARTGPLDY

SEQ ID NO: 111609 - protein, 9 aa, Homo sapiens
  light chain complementarity determining region 3 for antibody 55805
QQLNSYPRT

SEQ ID NO: 111610 - protein, 15 aa, Homo sapiens
  heavy chain complementarity determining region 3 for antibody 55805
ARQSVLLWFGEPFDY

SEQ ID NO: 111611 - protein, 9 aa, Homo sapiens
  light chain complementarity determining region 3 for antibody 55806
QQLNSYPRT

SEQ ID NO: 111612 - protein, 9 aa, Homo sapiens
  heavy chain complementarity determining region 3 for antibody 55806
ARKRWYLDL

SEQ ID NO: 111613 - protein, 9 aa, Homo sapiens
  light chain complementarity determining region 3 for antibody 55807
QQLNSYPRT

SEQ ID NO: 111614 - protein, 16 aa, Homo sapiens
  heavy chain complementarity determining region 3 for antibody 55807
ARDRGMITVSHDAFDI

SEQ ID NO: 111615 - protein, 9 aa, Homo sapiens
  light chain complementarity determining region 3 for antibody 55808
QQLNSYPRT

SEQ ID NO: 111616 - protein, 13 aa, Homo sapiens
  heavy chain complementarity determining region 3 for antibody 55808
AKEMGQWLYYFDY

SEQ ID NO: 111617 - protein, 9 aa, Homo sapiens
  light chain complementarity determining region 3 for antibody 55809
QQLNSYPRT

SEQ ID NO: 111618 - protein, 18 aa, Homo sapiens
  heavy chain complementarity determining region 3 for antibody 55809
AKDQSIAAAGTYYYGMDV

SEQ ID NO: 111619 - protein, 9 aa, Homo sapiens
  light chain complementarity determining region 3 for antibody 55810
QQLNSYPPT

SEQ ID NO: 111620 - protein, 17 aa, Homo sapiens
  heavy chain complementarity determining region 3 for antibody 55810
ARGPVLRYFDWLFWFDP

SEQ ID NO: 111621 - protein, 9 aa, Homo sapiens
  light chain complementarity determining region 3 for antibody 55811
QQLNSYPPT

SEQ ID NO: 111622 - protein, 20 aa, Homo sapiens
  heavy chain complementarity determining region 3 for antibody 55811
AKEQGDIVATIMDYYYGMDV

SEQ ID NO: 111623 - protein, 9 aa, Homo sapiens
  light chain complementarity determining region 3 for antibody 55812
QQLNSYPLT

SEQ ID NO: 111624 - protein, 13 aa, Homo sapiens
  heavy chain complementarity determining region 3 for antibody 55812
ARYSSSWYDAFDL

SEQ ID NO: 111625 - protein, 9 aa, Homo sapiens
  light chain complementarity determining region 3 for antibody 55813
QQLNSYPLT

SEQ ID NO: 111626 - protein, 11 aa, Homo sapiens
  heavy chain complementarity determining region 3 for antibody 55813
AREGVGTALDI

SEQ ID NO: 111627 - protein, 9 aa, Homo sapiens
  light chain complementarity determining region 3 for antibody 55814
QQLNSYPFT

SEQ ID NO: 111628 - protein, 20 aa, Homo sapiens
  heavy chain complementarity determining region 3 for antibody 55814
TREYCSSTGCSLHYYYGMDV

SEQ ID NO: 111629 - protein, 9 aa, Homo sapiens
  light chain complementarity determining region 3 for antibody 55815
QQLNSYPFT

SEQ ID NO: 111630 - protein, 15 aa, Homo sapiens
  heavy chain complementarity determining region 3 for antibody 55815
ARGYYYGSGSPSFDY

SEQ ID NO: 111631 - protein, 10 aa, Homo sapiens
  light chain complementarity determining region 3 for antibody 55816
QQLNSYLMYT

SEQ ID NO: 111632 - protein, 11 aa, Homo sapiens
  heavy chain complementarity determining region 3 for antibody 55816
ASDRDYGGMDV

SEQ ID NO: 111633 - protein, 9 aa, Homo sapiens
  light chain complementarity determining region 3 for antibody 55817
QQFTNDPFT

SEQ ID NO: 111634 - protein, 18 aa, Homo sapiens
  heavy chain complementarity determining region 3 for antibody 55817
TRDRGWKLPYYYYYGMDV

SEQ ID NO: 111635 - protein, 9 aa, Homo sapiens
  light chain complementarity determining region 3 for antibody 55818
QQFNNYPYT

SEQ ID NO: 111636 - protein, 24 aa, Homo sapiens
  heavy chain complementarity determining region 3 for antibody 55818
ATEWEGNYGSGSYYKSAYYYGMDV

SEQ ID NO: 111637 - protein, 9 aa, Homo sapiens
  light chain complementarity determining region 3 for antibody 55819
QQFNNYPYT

SEQ ID NO: 111638 - protein, 11 aa, Homo sapiens
  heavy chain complementarity determining region 3 for antibody 55819
ARYYYYYGMDV

SEQ ID NO: 111639 - protein, 9 aa, Homo sapiens
  light chain complementarity determining region 3 for antibody 55820
QQFNNYPYT

SEQ ID NO: 111640 - protein, 24 aa, Homo sapiens
  heavy chain complementarity determining region 3 for antibody 55820
AREWEGNYGSGSYYKSAYYDGMDV

SEQ ID NO: 111641 - protein, 9 aa, Homo sapiens
  light chain complementarity determining region 3 for antibody 55821
QQFNNYPYT

SEQ ID NO: 111642 - protein, 24 aa, Homo sapiens
  heavy chain complementarity determining region 3 for antibody 55821
AREWEGNYGPGSYYKSAYYYGMDV

SEQ ID NO: 111643 - protein, 9 aa, Homo sapiens
  light chain complementarity determining region 3 for antibody 55822
QQFNNYPYT

SEQ ID NO: 111644 - protein, 24 aa, Homo sapiens
  heavy chain complementarity determining region 3 for antibody 55822
ARECEGNYGSGSYYKSAYYYGMDV

SEQ ID NO: 111645 - protein, 9 aa, Homo sapiens
  light chain complementarity determining region 3 for antibody 55823
QQFNNYPYT

SEQ ID NO: 111646 - protein, 20 aa, Homo sapiens
  heavy chain complementarity determining region 3 for antibody 55823
ARDYDILTGYYDYYYYGMDV

SEQ ID NO: 111647 - protein, 9 aa, Homo sapiens
  light chain complementarity determining region 3 for antibody 55824
QQFNNYPYT

SEQ ID NO: 111648 - protein, 15 aa, Homo sapiens
  heavy chain complementarity determining region 3 for antibody 55824
ARDEGYYYGSGSYDY

SEQ ID NO: 111649 - protein, 9 aa, Homo sapiens
  light chain complementarity determining region 3 for antibody 55825
QQFNNYPWT

SEQ ID NO: 111650 - protein, 12 aa, Homo sapiens
  heavy chain complementarity determining region 3 for antibody 55825
AELGHYYYGMDV

SEQ ID NO: 111651 - protein, 9 aa, Homo sapiens
  light chain complementarity determining region 3 for antibody 55826
QQFNNYPRT

SEQ ID NO: 111652 - protein, 13 aa, Homo sapiens
  heavy chain complementarity determining region 3 for antibody 55826
ARRAAAAVQYFQH

SEQ ID NO: 111653 - protein, 9 aa, Homo sapiens
  light chain complementarity determining region 3 for antibody 55827
QQFNNYPRT

SEQ ID NO: 111654 - protein, 13 aa, Homo sapiens
  heavy chain complementarity determining region 3 for antibody 55827
ARIEAAAVQYFQH

SEQ ID NO: 111655 - protein, 9 aa, Homo sapiens
  light chain complementarity determining region 3 for antibody 55828
QQFNNYPRT

SEQ ID NO: 111656 - protein, 13 aa, Homo sapiens
  heavy chain complementarity determining region 3 for antibody 55828
ARIAAAAVRYFQH

SEQ ID NO: 111657 - protein, 9 aa, Homo sapiens
  light chain complementarity determining region 3 for antibody 55829
QQDYNLPYT

SEQ ID NO: 111658 - protein, 17 aa, Homo sapiens
  heavy chain complementarity determining region 3 for antibody 55829
ARDRGYSGYDGDYGMDV

SEQ ID NO: 111659 - protein, 9 aa, Homo sapiens
  light chain complementarity determining region 3 for antibody 55830
QQDYNLPLT

SEQ ID NO: 111660 - protein, 16 aa, Homo sapiens
  heavy chain complementarity determining region 3 for antibody 55830
ARENYGSGSYYKRFDP

SEQ ID NO: 111661 - protein, 9 aa, Homo sapiens
  light chain complementarity determining region 3 for antibody 55831
QQDYNLPLT

SEQ ID NO: 111662 - protein, 12 aa, Homo sapiens
  heavy chain complementarity determining region 3 for antibody 55831
AREATIFVAMDV

SEQ ID NO: 111663 - protein, 8 aa, Homo sapiens
  light chain complementarity determining region 3 for antibody 55832
QQDYNLFT

SEQ ID NO: 111664 - protein, 15 aa, Homo sapiens
  heavy chain complementarity determining region 3 for antibody 55832
AKEGGLRYFYNGMDV

SEQ ID NO: 111665 - protein, 9 aa, Homo sapiens
  light chain complementarity determining region 3 for antibody 55833
QNYNSAPLT

SEQ ID NO: 111666 - protein, 8 aa, Homo sapiens
  heavy chain complementarity determining region 3 for antibody 55833
ARTGPLDY

SEQ ID NO: 111667 - protein, 9 aa, Homo sapiens
  light chain complementarity determining region 3 for antibody 55834
QKYNSYPRT

SEQ ID NO: 111668 - protein, 13 aa, Homo sapiens
  heavy chain complementarity determining region 3 for antibody 55834
ARDRYSGYGAFDY

SEQ ID NO: 111669 - protein, 9 aa, Homo sapiens
  light chain complementarity determining region 3 for antibody 55835
QKYNSAPPT

SEQ ID NO: 111670 - protein, 8 aa, Homo sapiens
  heavy chain complementarity determining region 3 for antibody 55835
ARTGPLDY

SEQ ID NO: 111671 - protein, 9 aa, Homo sapiens
  light chain complementarity determining region 3 for antibody 55836
QKYNSAPLT

SEQ ID NO: 111672 - protein, 17 aa, Homo sapiens
  heavy chain complementarity determining region 3 for antibody 55836
ARGLRYVDWLLSDAFDI

SEQ ID NO: 111673 - protein, 9 aa, Homo sapiens
  light chain complementarity determining region 3 for antibody 55837
QKYNSAPLT

SEQ ID NO: 111674 - protein, 17 aa, Homo sapiens
  heavy chain complementarity determining region 3 for antibody 55837
ARGLRYFDWSLSYAFDI

SEQ ID NO: 111675 - protein, 9 aa, Homo sapiens
  light chain complementarity determining region 3 for antibody 55838
QKYNSAPLT

SEQ ID NO: 111676 - protein, 17 aa, Homo sapiens
  heavy chain complementarity determining region 3 for antibody 55838
ARGLRYFDWLLSDAFDL

SEQ ID NO: 111677 - protein, 9 aa, Homo sapiens
  light chain complementarity determining region 3 for antibody 55839
QKYNSAPLT

SEQ ID NO: 111678 - protein, 17 aa, Homo sapiens
  heavy chain complementarity determining region 3 for antibody 55839
ARGLRYFDGLLSDAFDI

SEQ ID NO: 111679 - protein, 9 aa, Homo sapiens
  light chain complementarity determining region 3 for antibody 55840
QKYNSAPLT

SEQ ID NO: 111680 - protein, 13 aa, Homo sapiens
  heavy chain complementarity determining region 3 for antibody 55840
ARDRYRGYGAFDY

SEQ ID NO: 111681 - protein, 9 aa, Homo sapiens
  light chain complementarity determining region 3 for antibody 55841
QKYNSAPLT

SEQ ID NO: 111682 - protein, 9 aa, Homo sapiens
  heavy chain complementarity determining region 3 for antibody 55841
ARDGLAIDY

SEQ ID NO: 111683 - protein, 9 aa, Homo sapiens
  light chain complementarity determining region 3 for antibody 55842
QKYNSAPLT

SEQ ID NO: 111684 - protein, 16 aa, Homo sapiens
  heavy chain complementarity determining region 3 for antibody 55842
ARDAKYYDMLTGYPDY

SEQ ID NO: 111685 - protein, 9 aa, Homo sapiens
  light chain complementarity determining region 3 for antibody 55843
QKYNSAPLT

SEQ ID NO: 111686 - protein, 16 aa, Homo sapiens
  heavy chain complementarity determining region 3 for antibody 55843
ARDAKYYDILTGSTDY

SEQ ID NO: 111687 - protein, 9 aa, Homo sapiens
  light chain complementarity determining region 3 for antibody 55844
QKYNSAPLT

SEQ ID NO: 111688 - protein, 16 aa, Homo sapiens
  heavy chain complementarity determining region 3 for antibody 55844
ARDAKYYDILPGYPDY

SEQ ID NO: 111689 - protein, 9 aa, Homo sapiens
  light chain complementarity determining region 3 for antibody 55845
QKYNSAPLT

SEQ ID NO: 111690 - protein, 16 aa, Homo sapiens
  heavy chain complementarity determining region 3 for antibody 55845
ARDAEYYDILTGYPDY

SEQ ID NO: 111691 - protein, 9 aa, Homo sapiens
  light chain complementarity determining region 3 for antibody 55846
QKYNSAPLT

SEQ ID NO: 111692 - protein, 17 aa, Homo sapiens
  heavy chain complementarity determining region 3 for antibody 55846
AIGLRYFDWLLSDAFDI

SEQ ID NO: 111693 - protein, 9 aa, Homo sapiens
  light chain complementarity determining region 3 for antibody 55847
QKLNSYPLT

SEQ ID NO: 111694 - protein, 13 aa, Homo sapiens
  heavy chain complementarity determining region 3 for antibody 55847
ARYSSSWYDAFDI

SEQ ID NO: 111695 - protein, 9 aa, Homo sapiens
  light chain complementarity determining region 3 for antibody 55848
QKFNNYPYT

SEQ ID NO: 111696 - protein, 24 aa, Homo sapiens
  heavy chain complementarity determining region 3 for antibody 55848
AREWEGNYGSGSYYKSAYYYGMDV

SEQ ID NO: 111697 - protein, 9 aa, Homo sapiens
  light chain complementarity determining region 3 for antibody 55849
QEYNSAPLT

SEQ ID NO: 111698 - protein, 8 aa, Homo sapiens
  heavy chain complementarity determining region 3 for antibody 55849
ARTGPLDY

SEQ ID NO: 111699 - protein, 9 aa, Homo sapiens
  light chain complementarity determining region 3 for antibody 55850
MQALQTPYT

SEQ ID NO: 111700 - protein, 16 aa, Homo sapiens
  heavy chain complementarity determining region 3 for antibody 55850
ARDQMDYGDYGYGIDV

SEQ ID NO: 111701 - protein, 9 aa, Homo sapiens
  light chain complementarity determining region 3 for antibody 55851
LQNYNYPFT

SEQ ID NO: 111702 - protein, 15 aa, Homo sapiens
  heavy chain complementarity determining region 3 for antibody 55851
ARAPLLLWFGEFIDY

SEQ ID NO: 111703 - protein, 9 aa, Homo sapiens
  light chain complementarity determining region 3 for antibody 55852
LQHNSYTYT

SEQ ID NO: 111704 - protein, 13 aa, Homo sapiens
  heavy chain complementarity determining region 3 for antibody 55852
ARIAAAAVQYFQH

SEQ ID NO: 111705 - protein, 9 aa, Homo sapiens
  light chain complementarity determining region 3 for antibody 55853
LQHNSYPYT

SEQ ID NO: 111706 - protein, 11 aa, Homo sapiens
  heavy chain complementarity determining region 3 for antibody 55853
ASDILTGYYDY

SEQ ID NO: 111707 - protein, 9 aa, Homo sapiens
  light chain complementarity determining region 3 for antibody 55854
LQHNSYPYT

SEQ ID NO: 111708 - protein, 13 aa, Homo sapiens
  heavy chain complementarity determining region 3 for antibody 55854
ARVRYFDWLPFDY

SEQ ID NO: 111709 - protein, 9 aa, Homo sapiens
  light chain complementarity determining region 3 for antibody 55855
LQHNSYPYT

SEQ ID NO: 111710 - protein, 7 aa, Homo sapiens
  heavy chain complementarity determining region 3 for antibody 55855
ARLVRDY

SEQ ID NO: 111711 - protein, 9 aa, Homo sapiens
  light chain complementarity determining region 3 for antibody 55856
LQHNSYPYT

SEQ ID NO: 111712 - protein, 13 aa, Homo sapiens
  heavy chain complementarity determining region 3 for antibody 55856
ARIRYFDWLPFDH

SEQ ID NO: 111713 - protein, 9 aa, Homo sapiens
  light chain complementarity determining region 3 for antibody 55857
LQHNSYPYT

SEQ ID NO: 111714 - protein, 13 aa, Homo sapiens
  heavy chain complementarity determining region 3 for antibody 55857
ARIRYFDWFPFDY

SEQ ID NO: 111715 - protein, 9 aa, Homo sapiens
  light chain complementarity determining region 3 for antibody 55858
LQHNSYPYT

SEQ ID NO: 111716 - protein, 21 aa, Homo sapiens
  heavy chain complementarity determining region 3 for antibody 55858
ARESDAYYDILTGYYNGAFDI

SEQ ID NO: 111717 - protein, 9 aa, Homo sapiens
  light chain complementarity determining region 3 for antibody 55859
LQHNSYPYT

SEQ ID NO: 111718 - protein, 15 aa, Homo sapiens
  heavy chain complementarity determining region 3 for antibody 55859
AREGRLAAAVTGFDY

SEQ ID NO: 111719 - protein, 9 aa, Homo sapiens
  light chain complementarity determining region 3 for antibody 55860
LQHNSYPWT

SEQ ID NO: 111720 - protein, 19 aa, Homo sapiens
  heavy chain complementarity determining region 3 for antibody 55860
ARGDSSSWYVEYYYYGMDV

SEQ ID NO: 111721 - protein, 9 aa, Homo sapiens
  light chain complementarity determining region 3 for antibody 55861
LQHNSYPWT

SEQ ID NO: 111722 - protein, 14 aa, Homo sapiens
  heavy chain complementarity determining region 3 for antibody 55861
ARDSDILTGSSFDY

SEQ ID NO: 111723 - protein, 9 aa, Homo sapiens
  light chain complementarity determining region 3 for antibody 55862
LQHNSYPWT

SEQ ID NO: 111724 - protein, 18 aa, Homo sapiens
  heavy chain complementarity determining region 3 for antibody 55862
ARDGRWPQYYYYYYGMDV

SEQ ID NO: 111725 - protein, 9 aa, Homo sapiens
  light chain complementarity determining region 3 for antibody 55863
LQHNSYPRT

SEQ ID NO: 111726 - protein, 9 aa, Homo sapiens
  heavy chain complementarity determining region 3 for antibody 55863
LMVRGGMDV

SEQ ID NO: 111727 - protein, 9 aa, Homo sapiens
  light chain complementarity determining region 3 for antibody 55864
LQHNSYPRT

SEQ ID NO: 111728 - protein, 9 aa, Homo sapiens
  heavy chain complementarity determining region 3 for antibody 55864
LMVREVMDV

SEQ ID NO: 111729 - protein, 9 aa, Homo sapiens
  light chain complementarity determining region 3 for antibody 55865
LQHNSYPRT

SEQ ID NO: 111730 - protein, 9 aa, Homo sapiens
  heavy chain complementarity determining region 3 for antibody 55865
LMVPGVMDV

SEQ ID NO: 111731 - protein, 10 aa, Homo sapiens
  light chain complementarity determining region 3 for antibody 55866
LQHNSYPPYT

SEQ ID NO: 111732 - protein, 10 aa, Homo sapiens
  heavy chain complementarity determining region 3 for antibody 55866
ARGWDWYFDL

SEQ ID NO: 111733 - protein, 10 aa, Homo sapiens
  light chain complementarity determining region 3 for antibody 55867
LQHNSYPMYT

SEQ ID NO: 111734 - protein, 9 aa, Homo sapiens
  heavy chain complementarity determining region 3 for antibody 55867
AREDLLFDY

SEQ ID NO: 111735 - protein, 9 aa, Homo sapiens
  light chain complementarity determining region 3 for antibody 55868
LQHNSYPLT

SEQ ID NO: 111736 - protein, 16 aa, Homo sapiens
  heavy chain complementarity determining region 3 for antibody 55868
ASLFVDIVVVPAAFDY

SEQ ID NO: 111737 - protein, 9 aa, Homo sapiens
  light chain complementarity determining region 3 for antibody 55869
LQHNSYPFT

SEQ ID NO: 111738 - protein, 16 aa, Homo sapiens
  heavy chain complementarity determining region 3 for antibody 55869
ASLFVDIIVVPAAFDY

SEQ ID NO: 111739 - protein, 9 aa, Homo sapiens
  light chain complementarity determining region 3 for antibody 55870
LQHNSYPFT

SEQ ID NO: 111740 - protein, 11 aa, Homo sapiens
  heavy chain complementarity determining region 3 for antibody 55870
ARDNFYGPFGY

SEQ ID NO: 111741 - protein, 9 aa, Homo sapiens
  light chain complementarity determining region 3 for antibody 55871
LQHDSYPYT

SEQ ID NO: 111742 - protein, 15 aa, Homo sapiens
  heavy chain complementarity determining region 3 for antibody 55871
AREGRLAVAVTGSDY

SEQ ID NO: 111743 - protein, 9 aa, Homo sapiens
  light chain complementarity determining region 3 for antibody 55872
LQHDNFPYT

SEQ ID NO: 111744 - protein, 9 aa, Homo sapiens
  heavy chain complementarity determining region 3 for antibody 55872
ARKRRYFDL

SEQ ID NO: 111745 - protein, 9 aa, Homo sapiens
  light chain complementarity determining region 3 for antibody 55873
LQHDNFPYT

SEQ ID NO: 111746 - protein, 11 aa, Homo sapiens
  heavy chain complementarity determining region 3 for antibody 55873
ARGRTGEGFDS

SEQ ID NO: 111747 - protein, 9 aa, Homo sapiens
  light chain complementarity determining region 3 for antibody 55874
LQHDNFPWT

SEQ ID NO: 111748 - protein, 16 aa, Homo sapiens
  heavy chain complementarity determining region 3 for antibody 55874
ATFSPGIAAARDAFDI

SEQ ID NO: 111749 - protein, 9 aa, Homo sapiens
  light chain complementarity determining region 3 for antibody 55875
LQDYNYPYT

SEQ ID NO: 111750 - protein, 15 aa, Homo sapiens
  heavy chain complementarity determining region 3 for antibody 55875
ARHGTMIVVVTPFDY

SEQ ID NO: 111751 - protein, 9 aa, Homo sapiens
  light chain complementarity determining region 3 for antibody 55876
LQDYNYPYT

SEQ ID NO: 111752 - protein, 18 aa, Homo sapiens
  heavy chain complementarity determining region 3 for antibody 55876
ARGVTMFRGVIGYYGMDV

SEQ ID NO: 111753 - protein, 9 aa, Homo sapiens
  light chain complementarity determining region 3 for antibody 55877
LQDYNYPYT

SEQ ID NO: 111754 - protein, 14 aa, Homo sapiens
  heavy chain complementarity determining region 3 for antibody 55877
ARDTTTVTTRAFDI

SEQ ID NO: 111755 - protein, 9 aa, Homo sapiens
  light chain complementarity determining region 3 for antibody 55878
LQDYNYPYT

SEQ ID NO: 111756 - protein, 10 aa, Homo sapiens
  heavy chain complementarity determining region 3 for antibody 55878
AKERWELLDY

SEQ ID NO: 111757 - protein, 9 aa, Homo sapiens
  light chain complementarity determining region 3 for antibody 55879
LQDYNYPWT

SEQ ID NO: 111758 - protein, 12 aa, Homo sapiens
  heavy chain complementarity determining region 3 for antibody 55879
ATDTMVRGVIDY

SEQ ID NO: 111759 - protein, 9 aa, Homo sapiens
  light chain complementarity determining region 3 for antibody 55880
LQDYNYPWT

SEQ ID NO: 111760 - protein, 14 aa, Homo sapiens
  heavy chain complementarity determining region 3 for antibody 55880
AREGFGESPDAFDI

SEQ ID NO: 111761 - protein, 9 aa, Homo sapiens
  light chain complementarity determining region 3 for antibody 55881
LQDYNYPWT

SEQ ID NO: 111762 - protein, 19 aa, Homo sapiens
  heavy chain complementarity determining region 3 for antibody 55881
ARDYYDILTGYYYYYGMDV

SEQ ID NO: 111763 - protein, 9 aa, Homo sapiens
  light chain complementarity determining region 3 for antibody 55882
LQDYNYPWT

SEQ ID NO: 111764 - protein, 22 aa, Homo sapiens
  heavy chain complementarity determining region 3 for antibody 55882
ARDQYYGSGSYYPDYYYYGMDV

SEQ ID NO: 111765 - protein, 9 aa, Homo sapiens
  light chain complementarity determining region 3 for antibody 55883
LQDYNYPWT

SEQ ID NO: 111766 - protein, 19 aa, Homo sapiens
  heavy chain complementarity determining region 3 for antibody 55883
ARDPRYFDWLFPHYYGMDV

SEQ ID NO: 111767 - protein, 9 aa, Homo sapiens
  light chain complementarity determining region 3 for antibody 55884
LQDYNYPWT

SEQ ID NO: 111768 - protein, 12 aa, Homo sapiens
  heavy chain complementarity determining region 3 for antibody 55884
ARDIMVRGVIDY

SEQ ID NO: 111769 - protein, 9 aa, Homo sapiens
  light chain complementarity determining region 3 for antibody 55885
LQDYNYPWT

SEQ ID NO: 111770 - protein, 16 aa, Homo sapiens
  heavy chain complementarity determining region 3 for antibody 55885
ARDAKYYDILSGYPDY

SEQ ID NO: 111771 - protein, 9 aa, Homo sapiens
  light chain complementarity determining region 3 for antibody 55886
LQDYNYPWT

SEQ ID NO: 111772 - protein, 16 aa, Homo sapiens
  heavy chain complementarity determining region 3 for antibody 55886
ARDAEYYDILTGYPDY

SEQ ID NO: 111773 - protein, 9 aa, Homo sapiens
  light chain complementarity determining region 3 for antibody 55887
LQDYNYPWT

SEQ ID NO: 111774 - protein, 14 aa, Homo sapiens
  heavy chain complementarity determining region 3 for antibody 55887
ARAVTTGTSYGMDV

SEQ ID NO: 111775 - protein, 9 aa, Homo sapiens
  light chain complementarity determining region 3 for antibody 55888
LQDYNYPWT

SEQ ID NO: 111776 - protein, 10 aa, Homo sapiens
  heavy chain complementarity determining region 3 for antibody 55888
ALRGGYGMDV

SEQ ID NO: 111777 - protein, 9 aa, Homo sapiens
  light chain complementarity determining region 3 for antibody 55889
LQDYNYPRT

SEQ ID NO: 111778 - protein, 16 aa, Homo sapiens
  heavy chain complementarity determining region 3 for antibody 55889
ARRTMVRGVIISHFDY

SEQ ID NO: 111779 - protein, 9 aa, Homo sapiens
  light chain complementarity determining region 3 for antibody 55890
LQDYNYPRT

SEQ ID NO: 111780 - protein, 9 aa, Homo sapiens
  heavy chain complementarity determining region 3 for antibody 55890
ARKRWYFDL

SEQ ID NO: 111781 - protein, 9 aa, Homo sapiens
  light chain complementarity determining region 3 for antibody 55891
LQDYNYPRT

SEQ ID NO: 111782 - protein, 9 aa, Homo sapiens
  heavy chain complementarity determining region 3 for antibody 55891
ARDGLGIDY

SEQ ID NO: 111783 - protein, 9 aa, Homo sapiens
  light chain complementarity determining region 3 for antibody 55892
LQDYNYPLT

SEQ ID NO: 111784 - protein, 8 aa, Homo sapiens
  heavy chain complementarity determining region 3 for antibody 55892
ARTGPLDY

SEQ ID NO: 111785 - protein, 9 aa, Homo sapiens
  light chain complementarity determining region 3 for antibody 55893
LQDYNYPLT

SEQ ID NO: 111786 - protein, 18 aa, Homo sapiens
  heavy chain complementarity determining region 3 for antibody 55893
ARGGYYYGSGSYYNVLDY

SEQ ID NO: 111787 - protein, 9 aa, Homo sapiens
  light chain complementarity determining region 3 for antibody 55894
LQDYNYPLT

SEQ ID NO: 111788 - protein, 14 aa, Homo sapiens
  heavy chain complementarity determining region 3 for antibody 55894
ARDRRWFGELWPDY

SEQ ID NO: 111789 - protein, 9 aa, Homo sapiens
  light chain complementarity determining region 3 for antibody 55895
LQDYNYPFT

SEQ ID NO: 111790 - protein, 16 aa, Homo sapiens
  heavy chain complementarity determining region 3 for antibody 55895
ARRTMVRGVIIFHFDY

SEQ ID NO: 111791 - protein, 9 aa, Homo sapiens
  light chain complementarity determining region 3 for antibody 55896
LQDYNYPFT

SEQ ID NO: 111792 - protein, 17 aa, Homo sapiens
  heavy chain complementarity determining region 3 for antibody 55896
ARDGGITMVRGVTRFDY

SEQ ID NO: 111793 - protein, 9 aa, Homo sapiens
  light chain complementarity determining region 3 for antibody 55897
LQDYNYPFT

SEQ ID NO: 111794 - protein, 15 aa, Homo sapiens
  heavy chain complementarity determining region 3 for antibody 55897
ARATLLLWFGEFIDY

SEQ ID NO: 111795 - protein, 9 aa, Homo sapiens
  light chain complementarity determining region 3 for antibody 55898
LQDYNYPFT

SEQ ID NO: 111796 - protein, 15 aa, Homo sapiens
  heavy chain complementarity determining region 3 for antibody 55898
ARAPLLLWFEEFIDY

SEQ ID NO: 111797 - protein, 9 aa, Homo sapiens
  light chain complementarity determining region 3 for antibody 55899
LQDYNYPFT

SEQ ID NO: 111798 - protein, 15 aa, Homo sapiens
  heavy chain complementarity determining region 3 for antibody 55899
ARALLLLWFGEFIDY

SEQ ID NO: 111799 - protein, 8 aa, Homo sapiens
  light chain complementarity determining region 3 for antibody 55900
LQDYNLFT

SEQ ID NO: 111800 - protein, 15 aa, Homo sapiens
  heavy chain complementarity determining region 3 for antibody 55900
AKGRVLRYFGNGMDV

SEQ ID NO: 111801 - protein, 9 aa, Homo sapiens
  light chain complementarity determining region 3 for antibody 55901
LQDYIYPPT

SEQ ID NO: 111802 - protein, 15 aa, Homo sapiens
  heavy chain complementarity determining region 3 for antibody 55901
ARDLWYSGSSYGMDV

SEQ ID NO: 111803 - protein, 9 aa, Homo sapiens
  light chain complementarity determining region 3 for antibody 55902
LQDYDYPPT

SEQ ID NO: 111804 - protein, 20 aa, Homo sapiens
  heavy chain complementarity determining region 3 for antibody 55902
ARGGGYYYGSGSYDYYGMDV

SEQ ID NO: 111805 - protein, 9 aa, Homo sapiens
  light chain complementarity determining region 3 for antibody 55903
LQADNYPRT

SEQ ID NO: 111806 - protein, 16 aa, Homo sapiens
  heavy chain complementarity determining region 3 for antibody 55903
ARVPYYYGSGSYAFDI

SEQ ID NO: 111807 - protein, 9 aa, Homo sapiens
  light chain complementarity determining region 3 for antibody 55904
HQSSSLPWT

SEQ ID NO: 111808 - protein, 11 aa, Homo sapiens
  heavy chain complementarity determining region 3 for antibody 55904
AASSGWYQGDY

SEQ ID NO: 111809 - protein, 9 aa, Homo sapiens
  light chain complementarity determining region 3 for antibody 55905
HQSSSLPRT

SEQ ID NO: 111810 - protein, 11 aa, Homo sapiens
  heavy chain complementarity determining region 3 for antibody 55905
ARENYYYGMDV

SEQ ID NO: 111811 - protein, 9 aa, Homo sapiens
  light chain complementarity determining region 3 for antibody 55906
HQSNNLPWT

SEQ ID NO: 111812 - protein, 11 aa, Homo sapiens
  heavy chain complementarity determining region 3 for antibody 55906
AASSGWYQGDY

SEQ ID NO: 111813 - protein, 9 aa, Homo sapiens
  light chain complementarity determining region 3 for antibody 55907
VQDYNYPRT

SEQ ID NO: 111814 - protein, 20 aa, Homo sapiens
  heavy chain complementarity determining region 3 for antibody 55907
ARDKAYSSGWSNYYYYGMDV

SEQ ID NO: 111815 - protein, 8 aa, Homo sapiens
  light chain complementarity determining region 3 for antibody 55908
QRYGSSFT

SEQ ID NO: 111816 - protein, 13 aa, Homo sapiens
  heavy chain complementarity determining region 3 for antibody 55908
ARYSSSWYDAFDI

SEQ ID NO: 111817 - protein, 10 aa, Homo sapiens
  light chain complementarity determining region 3 for antibody 55909
QRRSNWPPLT

SEQ ID NO: 111818 - protein, 18 aa, Homo sapiens
  heavy chain complementarity determining region 3 for antibody 55909
ATERYKVGATYYYYGMDV

SEQ ID NO: 111819 - protein, 9 aa, Homo sapiens
  light chain complementarity determining region 3 for antibody 55910
QRFNNYPCT

SEQ ID NO: 111820 - protein, 24 aa, Homo sapiens
  heavy chain complementarity determining region 3 for antibody 55910
AREWEGNYGSGSYYKSAYYYGMDV

SEQ ID NO: 111821 - protein, 9 aa, Homo sapiens
  light chain complementarity determining region 3 for antibody 55911
QQYNSYSWT

SEQ ID NO: 111822 - protein, 15 aa, Homo sapiens
  heavy chain complementarity determining region 3 for antibody 55911
ARDYGDHYYYYGMDV

SEQ ID NO: 111823 - protein, 9 aa, Homo sapiens
  light chain complementarity determining region 3 for antibody 55912
QQYNSYPYT

SEQ ID NO: 111824 - protein, 16 aa, Homo sapiens
  heavy chain complementarity determining region 3 for antibody 55912
AREYYDSSGYWGYFDY

SEQ ID NO: 111825 - protein, 9 aa, Homo sapiens
  light chain complementarity determining region 3 for antibody 55913
QQYNSYPYT

SEQ ID NO: 111826 - protein, 16 aa, Homo sapiens
  heavy chain complementarity determining region 3 for antibody 55913
ARERDNRNPYYYGMDV

SEQ ID NO: 111827 - protein, 9 aa, Homo sapiens
  light chain complementarity determining region 3 for antibody 55914
QQYNSYPYT

SEQ ID NO: 111828 - protein, 20 aa, Homo sapiens
  heavy chain complementarity determining region 3 for antibody 55914
ARDGAYYYGSGSYYVNWFDP

SEQ ID NO: 111829 - protein, 9 aa, Homo sapiens
  light chain complementarity determining region 3 for antibody 55915
QQYNSYPYT

SEQ ID NO: 111830 - protein, 6 aa, Homo sapiens
  heavy chain complementarity determining region 3 for antibody 55915
AKDDIL

SEQ ID NO: 111831 - protein, 9 aa, Homo sapiens
  light chain complementarity determining region 3 for antibody 55916
QQYNSYPRT

SEQ ID NO: 111832 - protein, 13 aa, Homo sapiens
  heavy chain complementarity determining region 3 for antibody 55916
ARGRYSGYGAFDY

SEQ ID NO: 111833 - protein, 9 aa, Homo sapiens
  light chain complementarity determining region 3 for antibody 55917
QQYNSYPRT

SEQ ID NO: 111834 - protein, 17 aa, Homo sapiens
  heavy chain complementarity determining region 3 for antibody 55917
ARGLRYVDWLLSDAFDI

SEQ ID NO: 111835 - protein, 9 aa, Homo sapiens
  light chain complementarity determining region 3 for antibody 55918
QQYNSYPRT

SEQ ID NO: 111836 - protein, 17 aa, Homo sapiens
  heavy chain complementarity determining region 3 for antibody 55918
ARGLRYFDWLLSDAFAI

SEQ ID NO: 111837 - protein, 9 aa, Homo sapiens
  light chain complementarity determining region 3 for antibody 55919
QQYNSYPRT

SEQ ID NO: 111838 - protein, 17 aa, Homo sapiens
  heavy chain complementarity determining region 3 for antibody 55919
ARGLRYFDLLLSDAFDI

SEQ ID NO: 111839 - protein, 9 aa, Homo sapiens
  light chain complementarity determining region 3 for antibody 55920
QQYNSYPRT

SEQ ID NO: 111840 - protein, 17 aa, Homo sapiens
  heavy chain complementarity determining region 3 for antibody 55920
ARGLRYFDCLLSDAFDI

SEQ ID NO: 111841 - protein, 9 aa, Homo sapiens
  light chain complementarity determining region 3 for antibody 55921
QQYNSYPRT

SEQ ID NO: 111842 - protein, 13 aa, Homo sapiens
  heavy chain complementarity determining region 3 for antibody 55921
ARGKDSTQLWLGY

SEQ ID NO: 111843 - protein, 9 aa, Homo sapiens
  light chain complementarity determining region 3 for antibody 55922
QQYNSYPRT

SEQ ID NO: 111844 - protein, 13 aa, Homo sapiens
  heavy chain complementarity determining region 3 for antibody 55922
ARDRYSGYGALDY

SEQ ID NO: 111845 - protein, 9 aa, Homo sapiens
  light chain complementarity determining region 3 for antibody 55923
QQYNSYPRT

SEQ ID NO: 111846 - protein, 15 aa, Homo sapiens
  heavy chain complementarity determining region 3 for antibody 55923
ARAPLLLWFGEFIDY

SEQ ID NO: 111847 - protein, 9 aa, Homo sapiens
  light chain complementarity determining region 3 for antibody 55924
QQYNSYPLT

SEQ ID NO: 111848 - protein, 11 aa, Homo sapiens
  heavy chain complementarity determining region 3 for antibody 55924
ARRANWFAFDI

SEQ ID NO: 111849 - protein, 9 aa, Homo sapiens
  light chain complementarity determining region 3 for antibody 55925
QQYNSYPIT

SEQ ID NO: 111850 - protein, 12 aa, Homo sapiens
  heavy chain complementarity determining region 3 for antibody 55925
ASYYEVYDGMDV

SEQ ID NO: 111851 - protein, 9 aa, Homo sapiens
  light chain complementarity determining region 3 for antibody 55926
QQYNSYPFT

SEQ ID NO: 111852 - protein, 12 aa, Homo sapiens
  heavy chain complementarity determining region 3 for antibody 55926
TRLRYSSGWYDY

SEQ ID NO: 111853 - protein, 9 aa, Homo sapiens
  light chain complementarity determining region 3 for antibody 55927
QQYNSYPFT

SEQ ID NO: 111854 - protein, 15 aa, Homo sapiens
  heavy chain complementarity determining region 3 for antibody 55927
ASHVLRYSDWRGMDV

SEQ ID NO: 111855 - protein, 9 aa, Homo sapiens
  light chain complementarity determining region 3 for antibody 55928
QQYNSYPFT

SEQ ID NO: 111856 - protein, 16 aa, Homo sapiens
  heavy chain complementarity determining region 3 for antibody 55928
ARDYYDSSGYCGHFDY

SEQ ID NO: 111857 - protein, 9 aa, Homo sapiens
  light chain complementarity determining region 3 for antibody 55929
QQYNSCPFT

SEQ ID NO: 111858 - protein, 17 aa, Homo sapiens
  heavy chain complementarity determining region 3 for antibody 55929
ARDGRGVIDYYYYGMDV

SEQ ID NO: 111859 - protein, 9 aa, Homo sapiens
  light chain complementarity determining region 3 for antibody 55930
QQYNNWPYT

SEQ ID NO: 111860 - protein, 13 aa, Homo sapiens
  heavy chain complementarity determining region 3 for antibody 55930
ANSGSYYASWFDP

SEQ ID NO: 111861 - protein, 9 aa, Homo sapiens
  light chain complementarity determining region 3 for antibody 55931
QQYNNWPLT

SEQ ID NO: 111862 - protein, 16 aa, Homo sapiens
  heavy chain complementarity determining region 3 for antibody 55931
ARDPLRYFDWSDAFDI

SEQ ID NO: 111863 - protein, 9 aa, Homo sapiens
  light chain complementarity determining region 3 for antibody 55932
QQYNNWPFT

SEQ ID NO: 111864 - protein, 11 aa, Homo sapiens
  heavy chain complementarity determining region 3 for antibody 55932
AIQGIVGAMRY

SEQ ID NO: 111865 - protein, 9 aa, Homo sapiens
  light chain complementarity determining region 3 for antibody 55933
QQYNIYPYT

SEQ ID NO: 111866 - protein, 18 aa, Homo sapiens
  heavy chain complementarity determining region 3 for antibody 55933
AREGRDDILTGYYDAFDI

SEQ ID NO: 111867 - protein, 9 aa, Homo sapiens
  light chain complementarity determining region 3 for antibody 55934
QQYGSSPYT

SEQ ID NO: 111868 - protein, 11 aa, Homo sapiens
  heavy chain complementarity determining region 3 for antibody 55934
ARRRVLGPLDY

SEQ ID NO: 111869 - protein, 10 aa, Homo sapiens
  light chain complementarity determining region 3 for antibody 55935
QQYGSSPMYT

SEQ ID NO: 111870 - protein, 17 aa, Homo sapiens
  heavy chain complementarity determining region 3 for antibody 55935
ARGLLWFGELLNNWFDH

SEQ ID NO: 111871 - protein, 10 aa, Homo sapiens
  light chain complementarity determining region 3 for antibody 55936
QQYGSSPMYT

SEQ ID NO: 111872 - protein, 14 aa, Homo sapiens
  heavy chain complementarity determining region 3 for antibody 55936
AREGFRGYYCGMDV

SEQ ID NO: 111873 - protein, 10 aa, Homo sapiens
  light chain complementarity determining region 3 for antibody 55937
QQYGSSPMYT

SEQ ID NO: 111874 - protein, 14 aa, Homo sapiens
  heavy chain complementarity determining region 3 for antibody 55937
AREGFRGYFYGMDV

SEQ ID NO: 111875 - protein, 10 aa, Homo sapiens
  light chain complementarity determining region 3 for antibody 55938
QQYGSSPMYT

SEQ ID NO: 111876 - protein, 17 aa, Homo sapiens
  heavy chain complementarity determining region 3 for antibody 55938
ARDRIAAAAYFYYGMDV

SEQ ID NO: 111877 - protein, 9 aa, Homo sapiens
  light chain complementarity determining region 3 for antibody 55939
QQYGSSPLT

SEQ ID NO: 111878 - protein, 16 aa, Homo sapiens
  heavy chain complementarity determining region 3 for antibody 55939
ARFTVRGVITPDAFDI

SEQ ID NO: 111879 - protein, 9 aa, Homo sapiens
  light chain complementarity determining region 3 for antibody 55940
QQYGSSPIT

SEQ ID NO: 111880 - protein, 11 aa, Homo sapiens
  heavy chain complementarity determining region 3 for antibody 55940
ARGSGWDAFDI

SEQ ID NO: 111881 - protein, 9 aa, Homo sapiens
  light chain complementarity determining region 3 for antibody 55941
QQYGSSPFT

SEQ ID NO: 111882 - protein, 9 aa, Homo sapiens
  heavy chain complementarity determining region 3 for antibody 55941
TRGPRWFDP

SEQ ID NO: 111883 - protein, 8 aa, Homo sapiens
  light chain complementarity determining region 3 for antibody 55942
QQYGSSFT

SEQ ID NO: 111884 - protein, 13 aa, Homo sapiens
  heavy chain complementarity determining region 3 for antibody 55942
ARYSSSWYDAYDI

SEQ ID NO: 111885 - protein, 8 aa, Homo sapiens
  light chain complementarity determining region 3 for antibody 55943
QQYGSSFT

SEQ ID NO: 111886 - protein, 13 aa, Homo sapiens
  heavy chain complementarity determining region 3 for antibody 55943
ARYSSSWYDAFEI

SEQ ID NO: 111887 - protein, 8 aa, Homo sapiens
  light chain complementarity determining region 3 for antibody 55944
QQYGSSFT

SEQ ID NO: 111888 - protein, 13 aa, Homo sapiens
  heavy chain complementarity determining region 3 for antibody 55944
ARYSSSWYDAFDT

SEQ ID NO: 111889 - protein, 8 aa, Homo sapiens
  light chain complementarity determining region 3 for antibody 55945
QQYGSSFT

SEQ ID NO: 111890 - protein, 13 aa, Homo sapiens
  heavy chain complementarity determining region 3 for antibody 55945
ARYSSSLYDAFDI

SEQ ID NO: 111891 - protein, 8 aa, Homo sapiens
  light chain complementarity determining region 3 for antibody 55946
QQYGSSFT

SEQ ID NO: 111892 - protein, 13 aa, Homo sapiens
  heavy chain complementarity determining region 3 for antibody 55946
ARYSSSGYDAFDI

SEQ ID NO: 111893 - protein, 8 aa, Homo sapiens
  light chain complementarity determining region 3 for antibody 55947
QQYGSSFT

SEQ ID NO: 111894 - protein, 13 aa, Homo sapiens
  heavy chain complementarity determining region 3 for antibody 55947
ARYSGSWYDAFDI

SEQ ID NO: 111895 - protein, 9 aa, Homo sapiens
  light chain complementarity determining region 3 for antibody 55948
QQYDNPPLT

SEQ ID NO: 111896 - protein, 16 aa, Homo sapiens
  heavy chain complementarity determining region 3 for antibody 55948
ARDAKYYDILTGYPDY

SEQ ID NO: 111897 - protein, 9 aa, Homo sapiens
  light chain complementarity determining region 3 for antibody 55949
QQYDNLPLT

SEQ ID NO: 111898 - protein, 16 aa, Homo sapiens
  heavy chain complementarity determining region 3 for antibody 55949
ARDAKYYDTLTGDPDY

SEQ ID NO: 111899 - protein, 9 aa, Homo sapiens
  light chain complementarity determining region 3 for antibody 55950
QQYDNLPLT

SEQ ID NO: 111900 - protein, 16 aa, Homo sapiens
  heavy chain complementarity determining region 3 for antibody 55950
ARDAKYYDILIGYPDY

SEQ ID NO: 111901 - protein, 9 aa, Homo sapiens
  light chain complementarity determining region 3 for antibody 55951
QQSYSTPYT

SEQ ID NO: 111902 - protein, 17 aa, Homo sapiens
  heavy chain complementarity determining region 3 for antibody 55951
ARQAYYDILTGYGGFDY

SEQ ID NO: 111903 - protein, 9 aa, Homo sapiens
  light chain complementarity determining region 3 for antibody 55952
QQSYSTPRT

SEQ ID NO: 111904 - protein, 20 aa, Homo sapiens
  heavy chain complementarity determining region 3 for antibody 55952
ARAPSYYDSLTGYSYDAFDI

SEQ ID NO: 111905 - protein, 9 aa, Homo sapiens
  light chain complementarity determining region 3 for antibody 55953
QQSYSTPRT

SEQ ID NO: 111906 - protein, 20 aa, Homo sapiens
  heavy chain complementarity determining region 3 for antibody 55953
ARAASYYDILTGYSYDAFDI

SEQ ID NO: 111907 - protein, 10 aa, Homo sapiens
  light chain complementarity determining region 3 for antibody 55954
QQRSNWPPLT

SEQ ID NO: 111908 - protein, 19 aa, Homo sapiens
  heavy chain complementarity determining region 3 for antibody 55954
ATERYKVGATYYDYYGMDV

SEQ ID NO: 111909 - protein, 10 aa, Homo sapiens
  light chain complementarity determining region 3 for antibody 55955
QQRSNWPPLT

SEQ ID NO: 111910 - protein, 19 aa, Homo sapiens
  heavy chain complementarity determining region 3 for antibody 55955
ATERYKVGATYSYSYGMDV

SEQ ID NO: 111911 - protein, 10 aa, Homo sapiens
  light chain complementarity determining region 3 for antibody 55956
QQRSNWPPLT

SEQ ID NO: 111912 - protein, 19 aa, Homo sapiens
  heavy chain complementarity determining region 3 for antibody 55956
ATERYKVGATYCYYYGMDV

SEQ ID NO: 111913 - protein, 10 aa, Homo sapiens
  light chain complementarity determining region 3 for antibody 55957
QQRSNWPPLT

SEQ ID NO: 111914 - protein, 19 aa, Homo sapiens
  heavy chain complementarity determining region 3 for antibody 55957
ATERYKVGATDYYYYGMDV

SEQ ID NO: 111915 - protein, 10 aa, Homo sapiens
  light chain complementarity determining region 3 for antibody 55958
QQRSNWPPLT

SEQ ID NO: 111916 - protein, 19 aa, Homo sapiens
  heavy chain complementarity determining region 3 for antibody 55958
ATERYEVGATYYYYYGMDV

SEQ ID NO: 111917 - protein, 9 aa, Homo sapiens
  light chain complementarity determining region 3 for antibody 55959
QQLYSYPRT

SEQ ID NO: 111918 - protein, 18 aa, Homo sapiens
  heavy chain complementarity determining region 3 for antibody 55959
ARDWISMVRGVQYNWFDP

SEQ ID NO: 111919 - protein, 9 aa, Homo sapiens
  light chain complementarity determining region 3 for antibody 55960
QQLNSYPYT

SEQ ID NO: 111920 - protein, 13 aa, Homo sapiens
  heavy chain complementarity determining region 3 for antibody 55960
TRLGYSSGWYFDY

SEQ ID NO: 111921 - protein, 9 aa, Homo sapiens
  light chain complementarity determining region 3 for antibody 55961
QQLNSYPYT

SEQ ID NO: 111922 - protein, 8 aa, Homo sapiens
  heavy chain complementarity determining region 3 for antibody 55961
ARTGPLDY

SEQ ID NO: 111923 - protein, 9 aa, Homo sapiens
  light chain complementarity determining region 3 for antibody 55962
QQLNSYPYT

SEQ ID NO: 111924 - protein, 16 aa, Homo sapiens
  heavy chain complementarity determining region 3 for antibody 55962
ARGVRGALYYYYGMDV

SEQ ID NO: 111925 - protein, 9 aa, Homo sapiens
  light chain complementarity determining region 3 for antibody 55963
QQLNSYPYT

SEQ ID NO: 111926 - protein, 15 aa, Homo sapiens
  heavy chain complementarity determining region 3 for antibody 55963
ARAGIASAGTPGMDV

SEQ ID NO: 111927 - protein, 9 aa, Homo sapiens
  light chain complementarity determining region 3 for antibody 55964
QQLNSYPRT

SEQ ID NO: 111928 - protein, 14 aa, Homo sapiens
  heavy chain complementarity determining region 3 for antibody 55964
ARGEQWLVHDAFDI

SEQ ID NO: 111929 - protein, 9 aa, Homo sapiens
  light chain complementarity determining region 3 for antibody 55965
QQLNSYPRT

SEQ ID NO: 111930 - protein, 12 aa, Homo sapiens
  heavy chain complementarity determining region 3 for antibody 55965
ARDTMVRGVIDY

SEQ ID NO: 111931 - protein, 9 aa, Homo sapiens
  light chain complementarity determining region 3 for antibody 55966
QQLNSYPPT

SEQ ID NO: 111932 - protein, 20 aa, Homo sapiens
  heavy chain complementarity determining region 3 for antibody 55966
AKDQGDIVATIMDYSYGMDV

SEQ ID NO: 111933 - protein, 9 aa, Homo sapiens
  light chain complementarity determining region 3 for antibody 55967
QQLNSYPNT

SEQ ID NO: 111934 - protein, 16 aa, Homo sapiens
  heavy chain complementarity determining region 3 for antibody 55967
ARDYYDSSGYWGHFDY

SEQ ID NO: 111935 - protein, 9 aa, Homo sapiens
  light chain complementarity determining region 3 for antibody 55968
QQLNSYPLT

SEQ ID NO: 111936 - protein, 13 aa, Homo sapiens
  heavy chain complementarity determining region 3 for antibody 55968
AWYSSSWYDAFDI

SEQ ID NO: 111937 - protein, 9 aa, Homo sapiens
  light chain complementarity determining region 3 for antibody 55969
QQLNSYPLT

SEQ ID NO: 111938 - protein, 13 aa, Homo sapiens
  heavy chain complementarity determining region 3 for antibody 55969
ARYSSSWYDALDI

SEQ ID NO: 111939 - protein, 9 aa, Homo sapiens
  light chain complementarity determining region 3 for antibody 55970
QQLNSYPLT

SEQ ID NO: 111940 - protein, 13 aa, Homo sapiens
  heavy chain complementarity determining region 3 for antibody 55970
ARYSSSWCDAFDI

SEQ ID NO: 111941 - protein, 9 aa, Homo sapiens
  light chain complementarity determining region 3 for antibody 55971
QQLNSYPLT

SEQ ID NO: 111942 - protein, 13 aa, Homo sapiens
  heavy chain complementarity determining region 3 for antibody 55971
ARYSISWYDAFDI

SEQ ID NO: 111943 - protein, 9 aa, Homo sapiens
  light chain complementarity determining region 3 for antibody 55972
QQLNSYPLT

SEQ ID NO: 111944 - protein, 13 aa, Homo sapiens
  heavy chain complementarity determining region 3 for antibody 55972
ARYISSWYDAFDI

SEQ ID NO: 111945 - protein, 9 aa, Homo sapiens
  light chain complementarity determining region 3 for antibody 55973
QQLNSYPLT

SEQ ID NO: 111946 - protein, 8 aa, Homo sapiens
  heavy chain complementarity determining region 3 for antibody 55973
ARTGPLDY

SEQ ID NO: 111947 - protein, 9 aa, Homo sapiens
  light chain complementarity determining region 3 for antibody 55974
QQLNSYPLT

SEQ ID NO: 111948 - protein, 9 aa, Homo sapiens
  heavy chain complementarity determining region 3 for antibody 55974
ARDGLGIDY

SEQ ID NO: 111949 - protein, 9 aa, Homo sapiens
  light chain complementarity determining region 3 for antibody 55975
QQLNSYPLT

SEQ ID NO: 111950 - protein, 13 aa, Homo sapiens
  heavy chain complementarity determining region 3 for antibody 55975
ARCSSSWYDAFDI

SEQ ID NO: 111951 - protein, 9 aa, Homo sapiens
  light chain complementarity determining region 3 for antibody 55976
QQLNSYPFT

SEQ ID NO: 111952 - protein, 18 aa, Homo sapiens
  heavy chain complementarity determining region 3 for antibody 55976
ARDLGVRGVIILYYGMDV

SEQ ID NO: 111953 - protein, 9 aa, Homo sapiens
  light chain complementarity determining region 3 for antibody 55977
QQLNSHPLT

SEQ ID NO: 111954 - protein, 13 aa, Homo sapiens
  heavy chain complementarity determining region 3 for antibody 55977
ARYSSSWYDAFDI

SEQ ID NO: 111955 - protein, 9 aa, Homo sapiens
  light chain complementarity determining region 3 for antibody 55978
QQLNSCPLT

SEQ ID NO: 111956 - protein, 13 aa, Homo sapiens
  heavy chain complementarity determining region 3 for antibody 55978
ARYSSSWYDAFDI

SEQ ID NO: 111957 - protein, 9 aa, Homo sapiens
  light chain complementarity determining region 3 for antibody 55979
QQLDSYPFS

SEQ ID NO: 111958 - protein, 15 aa, Homo sapiens
  heavy chain complementarity determining region 3 for antibody 55979
ARWAGVATIYYGMDV

SEQ ID NO: 111959 - protein, 9 aa, Homo sapiens
  light chain complementarity determining region 3 for antibody 55980
QQHNSYPLT

SEQ ID NO: 111960 - protein, 7 aa, Homo sapiens
  heavy chain complementarity determining region 3 for antibody 55980
ARDDGDY

SEQ ID NO: 111961 - protein, 9 aa, Homo sapiens
  light chain complementarity determining region 3 for antibody 55981
QQFNNYPYT

SEQ ID NO: 111962 - protein, 24 aa, Homo sapiens
  heavy chain complementarity determining region 3 for antibody 55981
AREWKGNYGSGSYYKSAYYYGMDV

SEQ ID NO: 111963 - protein, 9 aa, Homo sapiens
  light chain complementarity determining region 3 for antibody 55982
QQFNNYPYT

SEQ ID NO: 111964 - protein, 24 aa, Homo sapiens
  heavy chain complementarity determining region 3 for antibody 55982
AREWEVNYGSGSYYKSAYYYGMDV

SEQ ID NO: 111965 - protein, 9 aa, Homo sapiens
  light chain complementarity determining region 3 for antibody 55983
QQFNNYPYT

SEQ ID NO: 111966 - protein, 24 aa, Homo sapiens
  heavy chain complementarity determining region 3 for antibody 55983
AREWEGNYGSGSYYTSAYYYGMDV

SEQ ID NO: 111967 - protein, 9 aa, Homo sapiens
  light chain complementarity determining region 3 for antibody 55984
QQFNNYPYT

SEQ ID NO: 111968 - protein, 24 aa, Homo sapiens
  heavy chain complementarity determining region 3 for antibody 55984
AREWEGNYGSGSYYRSAYYYGMDV

SEQ ID NO: 111969 - protein, 9 aa, Homo sapiens
  light chain complementarity determining region 3 for antibody 55985
QQFNNYPYT

SEQ ID NO: 111970 - protein, 23 aa, Homo sapiens
  heavy chain complementarity determining region 3 for antibody 55985
AREWEGNYGSGSYYKSAYYGMDV

SEQ ID NO: 111971 - protein, 9 aa, Homo sapiens
  light chain complementarity determining region 3 for antibody 55986
QQFNNYPYT

SEQ ID NO: 111972 - protein, 24 aa, Homo sapiens
  heavy chain complementarity determining region 3 for antibody 55986
AREWEGNYGSGSYYKSAYSSGMDV

SEQ ID NO: 111973 - protein, 9 aa, Homo sapiens
  light chain complementarity determining region 3 for antibody 55987
QQFNNYPYT

SEQ ID NO: 111974 - protein, 24 aa, Homo sapiens
  heavy chain complementarity determining region 3 for antibody 55987
AREWEGNYGSGSYYKRAYYYGMDV

SEQ ID NO: 111975 - protein, 9 aa, Homo sapiens
  light chain complementarity determining region 3 for antibody 55988
QQFNNYPYT

SEQ ID NO: 111976 - protein, 24 aa, Homo sapiens
  heavy chain complementarity determining region 3 for antibody 55988
AREWEGKYGSGRYYKSAYYYGMDV

SEQ ID NO: 111977 - protein, 9 aa, Homo sapiens
  light chain complementarity determining region 3 for antibody 55989
QQFNNYPYT

SEQ ID NO: 111978 - protein, 24 aa, Homo sapiens
  heavy chain complementarity determining region 3 for antibody 55989
ARDWEGNYGSGSYYKSAYYYGMDV

SEQ ID NO: 111979 - protein, 9 aa, Homo sapiens
  light chain complementarity determining region 3 for antibody 55990
QQFNNYPWT

SEQ ID NO: 111980 - protein, 12 aa, Homo sapiens
  heavy chain complementarity determining region 3 for antibody 55990
AELGHYYYGMGV

SEQ ID NO: 111981 - protein, 9 aa, Homo sapiens
  light chain complementarity determining region 3 for antibody 55991
QQFNNYPRT

SEQ ID NO: 111982 - protein, 13 aa, Homo sapiens
  heavy chain complementarity determining region 3 for antibody 55991
ARIAAAAVQCFQH

SEQ ID NO: 111983 - protein, 9 aa, Homo sapiens
  light chain complementarity determining region 3 for antibody 55992
QQFNNYPRT

SEQ ID NO: 111984 - protein, 13 aa, Homo sapiens
  heavy chain complementarity determining region 3 for antibody 55992
ARIAAAAFQYFHH

SEQ ID NO: 111985 - protein, 9 aa, Homo sapiens
  light chain complementarity determining region 3 for antibody 55993
QQFNNYPRT

SEQ ID NO: 111986 - protein, 13 aa, Homo sapiens
  heavy chain complementarity determining region 3 for antibody 55993
ARIAAAAFQSFQH

SEQ ID NO: 111987 - protein, 9 aa, Homo sapiens
  light chain complementarity determining region 3 for antibody 55994
QQFNNYPRT

SEQ ID NO: 111988 - protein, 24 aa, Homo sapiens
  heavy chain complementarity determining region 3 for antibody 55994
AREWEGNYGSGSYYKSAYYYGMDV

SEQ ID NO: 111989 - protein, 9 aa, Homo sapiens
  light chain complementarity determining region 3 for antibody 55995
QQFNNYPRT

SEQ ID NO: 111990 - protein, 13 aa, Homo sapiens
  heavy chain complementarity determining region 3 for antibody 55995
AGIAAAAVQYFQH

SEQ ID NO: 111991 - protein, 9 aa, Homo sapiens
  light chain complementarity determining region 3 for antibody 55996
QQFNNYPRK

SEQ ID NO: 111992 - protein, 13 aa, Homo sapiens
  heavy chain complementarity determining region 3 for antibody 55996
ARIAAAAVQYFQH

SEQ ID NO: 111993 - protein, 9 aa, Homo sapiens
  light chain complementarity determining region 3 for antibody 55997
QQFNNYPLT

SEQ ID NO: 111994 - protein, 9 aa, Homo sapiens
  heavy chain complementarity determining region 3 for antibody 55997
ARKRWYFDL

SEQ ID NO: 111995 - protein, 9 aa, Homo sapiens
  light chain complementarity determining region 3 for antibody 55998
QQFNNYPHT

SEQ ID NO: 111996 - protein, 19 aa, Homo sapiens
  heavy chain complementarity determining region 3 for antibody 55998
ARERGRELRYNWNEDAFDI

SEQ ID NO: 111997 - protein, 9 aa, Homo sapiens
  light chain complementarity determining region 3 for antibody 55999
QQFNNYPFT

SEQ ID NO: 111998 - protein, 12 aa, Homo sapiens
  heavy chain complementarity determining region 3 for antibody 55999
ARDNTWNDGIDY

SEQ ID NO: 111999 - protein, 9 aa, Homo sapiens
  light chain complementarity determining region 3 for antibody 56000
QQFNNYPCT

SEQ ID NO: 112000 - protein, 24 aa, Homo sapiens
  heavy chain complementarity determining region 3 for antibody 56000
ARECEGNYGSGSYYKSAYYYGMDV

SEQ ID NO: 112001 - protein, 9 aa, Homo sapiens
  light chain complementarity determining region 3 for antibody 56001
QQDYNLPYT

SEQ ID NO: 112002 - protein, 14 aa, Homo sapiens
  heavy chain complementarity determining region 3 for antibody 56001
ARRYGSGSYWYFDL

SEQ ID NO: 112003 - protein, 9 aa, Homo sapiens
  light chain complementarity determining region 3 for antibody 56002
QQDYNLPYT

SEQ ID NO: 112004 - protein, 15 aa, Homo sapiens
  heavy chain complementarity determining region 3 for antibody 56002
AREGSPPYYYYGMDV

SEQ ID NO: 112005 - protein, 9 aa, Homo sapiens
  light chain complementarity determining region 3 for antibody 56003
QQDYNLPRT

SEQ ID NO: 112006 - protein, 20 aa, Homo sapiens
  heavy chain complementarity determining region 3 for antibody 56003
ARDLLWFGEWDYYYYYGMDV

SEQ ID NO: 112007 - protein, 9 aa, Homo sapiens
  light chain complementarity determining region 3 for antibody 56004
QQDYNLPPT

SEQ ID NO: 112008 - protein, 13 aa, Homo sapiens
  heavy chain complementarity determining region 3 for antibody 56004
ARDLNYGSYYFDY

SEQ ID NO: 112009 - protein, 9 aa, Homo sapiens
  light chain complementarity determining region 3 for antibody 56005
QQDYNLPLT

SEQ ID NO: 112010 - protein, 16 aa, Homo sapiens
  heavy chain complementarity determining region 3 for antibody 56005
ARAGWEPPYYYYGMDV

SEQ ID NO: 112011 - protein, 8 aa, Homo sapiens
  light chain complementarity determining region 3 for antibody 56006
QQDYNLFT

SEQ ID NO: 112012 - protein, 16 aa, Homo sapiens
  heavy chain complementarity determining region 3 for antibody 56006
ARRGMVRGVPIGAFDI

SEQ ID NO: 112013 - protein, 9 aa, Homo sapiens
  light chain complementarity determining region 3 for antibody 56007
QQCNSSPLT

SEQ ID NO: 112014 - protein, 11 aa, Homo sapiens
  heavy chain complementarity determining region 3 for antibody 56007
ATFYGSGSRGV

SEQ ID NO: 112015 - protein, 9 aa, Homo sapiens
  light chain complementarity determining region 3 for antibody 56008
QKYNSAPLT

SEQ ID NO: 112016 - protein, 17 aa, Homo sapiens
  heavy chain complementarity determining region 3 for antibody 56008
VRGLRYFDWLLSDAFDI

SEQ ID NO: 112017 - protein, 9 aa, Homo sapiens
  light chain complementarity determining region 3 for antibody 56009
QKYNSAPLT

SEQ ID NO: 112018 - protein, 9 aa, Homo sapiens
  heavy chain complementarity determining region 3 for antibody 56009
ATDGLGIDY

SEQ ID NO: 112019 - protein, 9 aa, Homo sapiens
  light chain complementarity determining region 3 for antibody 56010
QKYNSAPLT

SEQ ID NO: 112020 - protein, 17 aa, Homo sapiens
  heavy chain complementarity determining region 3 for antibody 56010
ASGLRYFDWSLSDAFDI

SEQ ID NO: 112021 - protein, 9 aa, Homo sapiens
  light chain complementarity determining region 3 for antibody 56011
QKYNSAPLT

SEQ ID NO: 112022 - protein, 17 aa, Homo sapiens
  heavy chain complementarity determining region 3 for antibody 56011
ARGLRYFVWFLSDAFDI

SEQ ID NO: 112023 - protein, 9 aa, Homo sapiens
  light chain complementarity determining region 3 for antibody 56012
QKYNSAPLT

SEQ ID NO: 112024 - protein, 17 aa, Homo sapiens
  heavy chain complementarity determining region 3 for antibody 56012
ARGLRYFDWSLSEAFDI

SEQ ID NO: 112025 - protein, 9 aa, Homo sapiens
  light chain complementarity determining region 3 for antibody 56013
QKYNSAPLT

SEQ ID NO: 112026 - protein, 17 aa, Homo sapiens
  heavy chain complementarity determining region 3 for antibody 56013
ARGLRYFDCSLSDAFDI

SEQ ID NO: 112027 - protein, 9 aa, Homo sapiens
  light chain complementarity determining region 3 for antibody 56014
QKYNSAPLT

SEQ ID NO: 112028 - protein, 17 aa, Homo sapiens
  heavy chain complementarity determining region 3 for antibody 56014
ARGLRYFDCLFSDAFDI

SEQ ID NO: 112029 - protein, 9 aa, Homo sapiens
  light chain complementarity determining region 3 for antibody 56015
QKYNSAPLT

SEQ ID NO: 112030 - protein, 17 aa, Homo sapiens
  heavy chain complementarity determining region 3 for antibody 56015
ARGLRDFDWLLSDAIDI

SEQ ID NO: 112031 - protein, 9 aa, Homo sapiens
  light chain complementarity determining region 3 for antibody 56016
QKYNSAPLT

SEQ ID NO: 112032 - protein, 17 aa, Homo sapiens
  heavy chain complementarity determining region 3 for antibody 56016
ARGLRDFDWLFSDAFDI

SEQ ID NO: 112033 - protein, 9 aa, Homo sapiens
  light chain complementarity determining region 3 for antibody 56017
QKYNSAPLT

SEQ ID NO: 112034 - protein, 17 aa, Homo sapiens
  heavy chain complementarity determining region 3 for antibody 56017
ARGFRYFDWLLSDAFDI

SEQ ID NO: 112035 - protein, 9 aa, Homo sapiens
  light chain complementarity determining region 3 for antibody 56018
QKYNSAPLT

SEQ ID NO: 112036 - protein, 19 aa, Homo sapiens
  heavy chain complementarity determining region 3 for antibody 56018
ARERGTSYYDILTGYSLDY

SEQ ID NO: 112037 - protein, 9 aa, Homo sapiens
  light chain complementarity determining region 3 for antibody 56019
QKYNSAPLT

SEQ ID NO: 112038 - protein, 14 aa, Homo sapiens
  heavy chain complementarity determining region 3 for antibody 56019
AREGFRGYYYGMDV

SEQ ID NO: 112039 - protein, 9 aa, Homo sapiens
  light chain complementarity determining region 3 for antibody 56020
QKYNSAPLT

SEQ ID NO: 112040 - protein, 13 aa, Homo sapiens
  heavy chain complementarity determining region 3 for antibody 56020
ARDRYSGYGAFDS

SEQ ID NO: 112041 - protein, 9 aa, Homo sapiens
  light chain complementarity determining region 3 for antibody 56021
QKYNSAPLT

SEQ ID NO: 112042 - protein, 13 aa, Homo sapiens
  heavy chain complementarity determining region 3 for antibody 56021
ARDRYSGSGAFDY

SEQ ID NO: 112043 - protein, 9 aa, Homo sapiens
  light chain complementarity determining region 3 for antibody 56022
QKYNSAPLT

SEQ ID NO: 112044 - protein, 9 aa, Homo sapiens
  heavy chain complementarity determining region 3 for antibody 56022
ARDGLGIGY

SEQ ID NO: 112045 - protein, 9 aa, Homo sapiens
  light chain complementarity determining region 3 for antibody 56023
QKYNSAPLT

SEQ ID NO: 112046 - protein, 16 aa, Homo sapiens
  heavy chain complementarity determining region 3 for antibody 56023
ARDAKYYDIVTGYPDY

SEQ ID NO: 112047 - protein, 9 aa, Homo sapiens
  light chain complementarity determining region 3 for antibody 56024
QKYNSAPLT

SEQ ID NO: 112048 - protein, 16 aa, Homo sapiens
  heavy chain complementarity determining region 3 for antibody 56024
ARDAKYYDILTGYPAY

SEQ ID NO: 112049 - protein, 9 aa, Homo sapiens
  light chain complementarity determining region 3 for antibody 56025
QKYNSAPLT

SEQ ID NO: 112050 - protein, 16 aa, Homo sapiens
  heavy chain complementarity determining region 3 for antibody 56025
ARDAKYYDILTGYLDY

SEQ ID NO: 112051 - protein, 9 aa, Homo sapiens
  light chain complementarity determining region 3 for antibody 56026
QKYNSAPLT

SEQ ID NO: 112052 - protein, 16 aa, Homo sapiens
  heavy chain complementarity determining region 3 for antibody 56026
ARDAKYYDILTCYPDY

SEQ ID NO: 112053 - protein, 9 aa, Homo sapiens
  light chain complementarity determining region 3 for antibody 56027
QKYNSAPLT

SEQ ID NO: 112054 - protein, 16 aa, Homo sapiens
  heavy chain complementarity determining region 3 for antibody 56027
ARDAKYYDILSGYPDY

SEQ ID NO: 112055 - protein, 9 aa, Homo sapiens
  light chain complementarity determining region 3 for antibody 56028
QKYNSAPLT

SEQ ID NO: 112056 - protein, 16 aa, Homo sapiens
  heavy chain complementarity determining region 3 for antibody 56028
ARDAKYYDIFTGYPDY

SEQ ID NO: 112057 - protein, 9 aa, Homo sapiens
  light chain complementarity determining region 3 for antibody 56029
QKYNSAPLT

SEQ ID NO: 112058 - protein, 16 aa, Homo sapiens
  heavy chain complementarity determining region 3 for antibody 56029
ARDAKYCDILTGYPDY

SEQ ID NO: 112059 - protein, 9 aa, Homo sapiens
  light chain complementarity determining region 3 for antibody 56030
QKYNSAPLT

SEQ ID NO: 112060 - protein, 13 aa, Homo sapiens
  heavy chain complementarity determining region 3 for antibody 56030
ARARYSGYGAFDY

SEQ ID NO: 112061 - protein, 9 aa, Homo sapiens
  light chain complementarity determining region 3 for antibody 56031
QKYNSAPLT

SEQ ID NO: 112062 - protein, 16 aa, Homo sapiens
  heavy chain complementarity determining region 3 for antibody 56031
AGDAKYYDTLTGYPDY

SEQ ID NO: 112063 - protein, 9 aa, Homo sapiens
  light chain complementarity determining region 3 for antibody 56032
QKYNSAPLT

SEQ ID NO: 112064 - protein, 16 aa, Homo sapiens
  heavy chain complementarity determining region 3 for antibody 56032
AGDAKYYDSLTGYPDY

SEQ ID NO: 112065 - protein, 9 aa, Homo sapiens
  light chain complementarity determining region 3 for antibody 56033
QKYNSAPLT

SEQ ID NO: 112066 - protein, 16 aa, Homo sapiens
  heavy chain complementarity determining region 3 for antibody 56033
AGDAKYYDILTGSPDY

SEQ ID NO: 112067 - protein, 9 aa, Homo sapiens
  light chain complementarity determining region 3 for antibody 56034
QKYNSAPHT

SEQ ID NO: 112068 - protein, 16 aa, Homo sapiens
  heavy chain complementarity determining region 3 for antibody 56034
ARDAKYYDILTGYPDY

SEQ ID NO: 112069 - protein, 9 aa, Homo sapiens
  light chain complementarity determining region 3 for antibody 56035
QKYNGAPLT

SEQ ID NO: 112070 - protein, 17 aa, Homo sapiens
  heavy chain complementarity determining region 3 for antibody 56035
ARGLRYFDWLLSDAFDI

SEQ ID NO: 112071 - protein, 9 aa, Homo sapiens
  light chain complementarity determining region 3 for antibody 56036
QKFNSAPLT

SEQ ID NO: 112072 - protein, 8 aa, Homo sapiens
  heavy chain complementarity determining region 3 for antibody 56036
ARTGPLDY

SEQ ID NO: 112073 - protein, 9 aa, Homo sapiens
  light chain complementarity determining region 3 for antibody 56037
QKCNSAPLT

SEQ ID NO: 112074 - protein, 16 aa, Homo sapiens
  heavy chain complementarity determining region 3 for antibody 56037
ARDAKYYDILTGYPDY

SEQ ID NO: 112075 - protein, 9 aa, Homo sapiens
  light chain complementarity determining region 3 for antibody 56038
QHFNNYPFT

SEQ ID NO: 112076 - protein, 17 aa, Homo sapiens
  heavy chain complementarity determining region 3 for antibody 56038
ARDEGKWLVRGYYGLDV

SEQ ID NO: 112077 - protein, 9 aa, Homo sapiens
  light chain complementarity determining region 3 for antibody 56039
PQDYNYPFT

SEQ ID NO: 112078 - protein, 15 aa, Homo sapiens
  heavy chain complementarity determining region 3 for antibody 56039
ARAPLLLWFGEFIDY

SEQ ID NO: 112079 - protein, 9 aa, Homo sapiens
  light chain complementarity determining region 3 for antibody 56040
NQSSSLPIT

SEQ ID NO: 112080 - protein, 7 aa, Homo sapiens
  heavy chain complementarity determining region 3 for antibody 56040
ASDIPFL

SEQ ID NO: 112081 - protein, 9 aa, Homo sapiens
  light chain complementarity determining region 3 for antibody 56041
MQALQTPYT

SEQ ID NO: 112082 - protein, 11 aa, Homo sapiens
  heavy chain complementarity determining region 3 for antibody 56041
ARGCTSGAFDI

SEQ ID NO: 112083 - protein, 9 aa, Homo sapiens
  light chain complementarity determining region 3 for antibody 56042
MQALQTPYT

SEQ ID NO: 112084 - protein, 16 aa, Homo sapiens
  heavy chain complementarity determining region 3 for antibody 56042
ARDRRYFDYYYYGMDV

SEQ ID NO: 112085 - protein, 9 aa, Homo sapiens
  light chain complementarity determining region 3 for antibody 56043
MQALQTPWT

SEQ ID NO: 112086 - protein, 14 aa, Homo sapiens
  heavy chain complementarity determining region 3 for antibody 56043
ARGSGWKYYYGMDV

SEQ ID NO: 112087 - protein, 9 aa, Homo sapiens
  light chain complementarity determining region 3 for antibody 56044
LRDYNYPFT

SEQ ID NO: 112088 - protein, 15 aa, Homo sapiens
  heavy chain complementarity determining region 3 for antibody 56044
ARAPLLLWFGEFIDY

SEQ ID NO: 112089 - protein, 9 aa, Homo sapiens
  light chain complementarity determining region 3 for antibody 56045
LQYNSYPWT

SEQ ID NO: 112090 - protein, 14 aa, Homo sapiens
  heavy chain complementarity determining region 3 for antibody 56045
ARDPNYYDSSGSDY

SEQ ID NO: 112091 - protein, 9 aa, Homo sapiens
  light chain complementarity determining region 3 for antibody 56046
LQYNSYPFT

SEQ ID NO: 112092 - protein, 16 aa, Homo sapiens
  heavy chain complementarity determining region 3 for antibody 56046
ASLFVDIVVVPAAFDY

SEQ ID NO: 112093 - protein, 9 aa, Homo sapiens
  light chain complementarity determining region 3 for antibody 56047
LQSSRLPHT

SEQ ID NO: 112094 - protein, 13 aa, Homo sapiens
  heavy chain complementarity determining region 3 for antibody 56047
AREGTNWGNWFDP

SEQ ID NO: 112095 - protein, 8 aa, Homo sapiens
  light chain complementarity determining region 3 for antibody 56048
LQNNSYPP

SEQ ID NO: 112096 - protein, 18 aa, Homo sapiens
  heavy chain complementarity determining region 3 for antibody 56048
AREGYSSGPIYYYYGMDV

SEQ ID NO: 112097 - protein, 9 aa, Homo sapiens
  light chain complementarity determining region 3 for antibody 56049
LQHNSYPYT

SEQ ID NO: 112098 - protein, 13 aa, Homo sapiens
  heavy chain complementarity determining region 3 for antibody 56049
ARIAAAAVQSFHH

SEQ ID NO: 112099 - protein, 9 aa, Homo sapiens
  light chain complementarity determining region 3 for antibody 56050
LQHNSYPYT

SEQ ID NO: 112100 - protein, 13 aa, Homo sapiens
  heavy chain complementarity determining region 3 for antibody 56050
ARIAAAAVQCFQH

SEQ ID NO: 112101 - protein, 9 aa, Homo sapiens
  light chain complementarity determining region 3 for antibody 56051
LQHNSYPYT

SEQ ID NO: 112102 - protein, 19 aa, Homo sapiens
  heavy chain complementarity determining region 3 for antibody 56051
ARGNDILTGYYPHYYGMDV

SEQ ID NO: 112103 - protein, 9 aa, Homo sapiens
  light chain complementarity determining region 3 for antibody 56052
LQHNSYPYT

SEQ ID NO: 112104 - protein, 20 aa, Homo sapiens
  heavy chain complementarity determining region 3 for antibody 56052
ARDPPYYDILTGYNRGYFDY

SEQ ID NO: 112105 - protein, 9 aa, Homo sapiens
  light chain complementarity determining region 3 for antibody 56053
LQHNSYPYT

SEQ ID NO: 112106 - protein, 12 aa, Homo sapiens
  heavy chain complementarity determining region 3 for antibody 56053
ARDIMVRGVIDY

SEQ ID NO: 112107 - protein, 9 aa, Homo sapiens
  light chain complementarity determining region 3 for antibody 56054
LQHNSYPWT

SEQ ID NO: 112108 - protein, 20 aa, Homo sapiens
  heavy chain complementarity determining region 3 for antibody 56054
AREKAYYDILTGYFHGNFDI

SEQ ID NO: 112109 - protein, 9 aa, Homo sapiens
  light chain complementarity determining region 3 for antibody 56055
LQHNSYPWT

SEQ ID NO: 112110 - protein, 15 aa, Homo sapiens
  heavy chain complementarity determining region 3 for antibody 56055
ARALVLRYFDNWFDP

SEQ ID NO: 112111 - protein, 9 aa, Homo sapiens
  light chain complementarity determining region 3 for antibody 56056
LQHNSYPRT

SEQ ID NO: 112112 - protein, 9 aa, Homo sapiens
  heavy chain complementarity determining region 3 for antibody 56056
LTVRGAMDV

SEQ ID NO: 112113 - protein, 9 aa, Homo sapiens
  light chain complementarity determining region 3 for antibody 56057
LQHNSYPRT

SEQ ID NO: 112114 - protein, 9 aa, Homo sapiens
  heavy chain complementarity determining region 3 for antibody 56057
LMVRGVVDV

SEQ ID NO: 112115 - protein, 9 aa, Homo sapiens
  light chain complementarity determining region 3 for antibody 56058
LQHNSYPRT

SEQ ID NO: 112116 - protein, 9 aa, Homo sapiens
  heavy chain complementarity determining region 3 for antibody 56058
LMVRGVMDD

SEQ ID NO: 112117 - protein, 9 aa, Homo sapiens
  light chain complementarity determining region 3 for antibody 56059
LQHNSYPRT

SEQ ID NO: 112118 - protein, 9 aa, Homo sapiens
  heavy chain complementarity determining region 3 for antibody 56059
LMVRGVIDV

SEQ ID NO: 112119 - protein, 9 aa, Homo sapiens
  light chain complementarity determining region 3 for antibody 56060
LQHNSYPRT

SEQ ID NO: 112120 - protein, 10 aa, Homo sapiens
  heavy chain complementarity determining region 3 for antibody 56060
ASSYGDSFDY

SEQ ID NO: 112121 - protein, 9 aa, Homo sapiens
  light chain complementarity determining region 3 for antibody 56061
LQHNSYPRT

SEQ ID NO: 112122 - protein, 11 aa, Homo sapiens
  heavy chain complementarity determining region 3 for antibody 56061
ARSIVGAPLDY

SEQ ID NO: 112123 - protein, 9 aa, Homo sapiens
  light chain complementarity determining region 3 for antibody 56062
LQHNSYPPT

SEQ ID NO: 112124 - protein, 13 aa, Homo sapiens
  heavy chain complementarity determining region 3 for antibody 56062
ANSGSYYASWFDP

SEQ ID NO: 112125 - protein, 10 aa, Homo sapiens
  light chain complementarity determining region 3 for antibody 56063
LQHNSYPMYT

SEQ ID NO: 112126 - protein, 11 aa, Homo sapiens
  heavy chain complementarity determining region 3 for antibody 56063
ARDRGTGDFDY

SEQ ID NO: 112127 - protein, 9 aa, Homo sapiens
  light chain complementarity determining region 3 for antibody 56064
LQHNSYPLT

SEQ ID NO: 112128 - protein, 15 aa, Homo sapiens
  heavy chain complementarity determining region 3 for antibody 56064
ARHKREAPGYWYFDL

SEQ ID NO: 112129 - protein, 9 aa, Homo sapiens
  light chain complementarity determining region 3 for antibody 56065
LQHNSYPLT

SEQ ID NO: 112130 - protein, 11 aa, Homo sapiens
  heavy chain complementarity determining region 3 for antibody 56065
ARGRTGNWFDP

SEQ ID NO: 112131 - protein, 9 aa, Homo sapiens
  light chain complementarity determining region 3 for antibody 56066
LQHNSYPLT

SEQ ID NO: 112132 - protein, 16 aa, Homo sapiens
  heavy chain complementarity determining region 3 for antibody 56066
ARDRAVYSSGWYRFDY

SEQ ID NO: 112133 - protein, 9 aa, Homo sapiens
  light chain complementarity determining region 3 for antibody 56067
LQHNSYPLT

SEQ ID NO: 112134 - protein, 14 aa, Homo sapiens
  heavy chain complementarity determining region 3 for antibody 56067
ARDGWELLRDAFDI

SEQ ID NO: 112135 - protein, 9 aa, Homo sapiens
  light chain complementarity determining region 3 for antibody 56068
LQHNSYPFT

SEQ ID NO: 112136 - protein, 16 aa, Homo sapiens
  heavy chain complementarity determining region 3 for antibody 56068
ASFFVDIVVVPAAFDY

SEQ ID NO: 112137 - protein, 9 aa, Homo sapiens
  light chain complementarity determining region 3 for antibody 56069
LQHNSYPFT

SEQ ID NO: 112138 - protein, 16 aa, Homo sapiens
  heavy chain complementarity determining region 3 for antibody 56069
ARLFVDIVVVPAAFDY

SEQ ID NO: 112139 - protein, 9 aa, Homo sapiens
  light chain complementarity determining region 3 for antibody 56070
LQHNSYPFT

SEQ ID NO: 112140 - protein, 17 aa, Homo sapiens
  heavy chain complementarity determining region 3 for antibody 56070
ARDRYCSSTSCYELLGY

SEQ ID NO: 112141 - protein, 9 aa, Homo sapiens
  light chain complementarity determining region 3 for antibody 56071
LQHNSYPFT

SEQ ID NO: 112142 - protein, 19 aa, Homo sapiens
  heavy chain complementarity determining region 3 for antibody 56071
ARDNDILTGYYQDYYGMDV

SEQ ID NO: 112143 - protein, 9 aa, Homo sapiens
  light chain complementarity determining region 3 for antibody 56072
LQHNRYPPT

SEQ ID NO: 112144 - protein, 16 aa, Homo sapiens
  heavy chain complementarity determining region 3 for antibody 56072
ARGRGTMVRGVIPFDY

SEQ ID NO: 112145 - protein, 9 aa, Homo sapiens
  light chain complementarity determining region 3 for antibody 56073
LQHNNYPRT

SEQ ID NO: 112146 - protein, 9 aa, Homo sapiens
  heavy chain complementarity determining region 3 for antibody 56073
LMVRGVMDV

SEQ ID NO: 112147 - protein, 9 aa, Homo sapiens
  light chain complementarity determining region 3 for antibody 56074
LQHNNFPRT

SEQ ID NO: 112148 - protein, 15 aa, Homo sapiens
  heavy chain complementarity determining region 3 for antibody 56074
ARDRDYGDYGYGMDV

SEQ ID NO: 112149 - protein, 9 aa, Homo sapiens
  light chain complementarity determining region 3 for antibody 56075
LQHNGYPYT

SEQ ID NO: 112150 - protein, 13 aa, Homo sapiens
  heavy chain complementarity determining region 3 for antibody 56075
ARIAAAAVQYFQH

SEQ ID NO: 112151 - protein, 9 aa, Homo sapiens
  light chain complementarity determining region 3 for antibody 56076
LQHNGYPRT

SEQ ID NO: 112152 - protein, 14 aa, Homo sapiens
  heavy chain complementarity determining region 3 for antibody 56076
ATGGGSYYYYGMDV

SEQ ID NO: 112153 - protein, 9 aa, Homo sapiens
  light chain complementarity determining region 3 for antibody 56077
LQHKSYPPT

SEQ ID NO: 112154 - protein, 16 aa, Homo sapiens
  heavy chain complementarity determining region 3 for antibody 56077
ARGRGTMVRGVPPFDY

SEQ ID NO: 112155 - protein, 9 aa, Homo sapiens
  light chain complementarity determining region 3 for antibody 56078
LQHDTYPWT

SEQ ID NO: 112156 - protein, 14 aa, Homo sapiens
  heavy chain complementarity determining region 3 for antibody 56078
ARDRELLWFGELSP

SEQ ID NO: 112157 - protein, 9 aa, Homo sapiens
  light chain complementarity determining region 3 for antibody 56079
LQDYNYPYT

SEQ ID NO: 112158 - protein, 14 aa, Homo sapiens
  heavy chain complementarity determining region 3 for antibody 56079
ARESGLGSSYGMDV

SEQ ID NO: 112159 - protein, 9 aa, Homo sapiens
  light chain complementarity determining region 3 for antibody 56080
LQDYNYPYT

SEQ ID NO: 112160 - protein, 7 aa, Homo sapiens
  heavy chain complementarity determining region 3 for antibody 56080
ARDWVDY

SEQ ID NO: 112161 - protein, 9 aa, Homo sapiens
  light chain complementarity determining region 3 for antibody 56081
LQDYNYPYT

SEQ ID NO: 112162 - protein, 14 aa, Homo sapiens
  heavy chain complementarity determining region 3 for antibody 56081
ARDSGLGSSYGMDV

SEQ ID NO: 112163 - protein, 9 aa, Homo sapiens
  light chain complementarity determining region 3 for antibody 56082
LQDYNYPYT

SEQ ID NO: 112164 - protein, 17 aa, Homo sapiens
  heavy chain complementarity determining region 3 for antibody 56082
AKDRLLWFGDPHNGFDI

SEQ ID NO: 112165 - protein, 9 aa, Homo sapiens
  light chain complementarity determining region 3 for antibody 56083
LQDYNYPWT

SEQ ID NO: 112166 - protein, 12 aa, Homo sapiens
  heavy chain complementarity determining region 3 for antibody 56083
ERDTMVRGVIDY

SEQ ID NO: 112167 - protein, 9 aa, Homo sapiens
  light chain complementarity determining region 3 for antibody 56084
LQDYNYPWT

SEQ ID NO: 112168 - protein, 13 aa, Homo sapiens
  heavy chain complementarity determining region 3 for antibody 56084
ARYSSSWYDAFDI

SEQ ID NO: 112169 - protein, 9 aa, Homo sapiens
  light chain complementarity determining region 3 for antibody 56085
LQDYNYPWT

SEQ ID NO: 112170 - protein, 22 aa, Homo sapiens
  heavy chain complementarity determining region 3 for antibody 56085
ARRDYYGSGSYYNDSYYYGMDV

SEQ ID NO: 112171 - protein, 9 aa, Homo sapiens
  light chain complementarity determining region 3 for antibody 56086
LQDYNYPWT

SEQ ID NO: 112172 - protein, 22 aa, Homo sapiens
  heavy chain complementarity determining region 3 for antibody 56086
ARRDYDGSGSYYNDYYYYGMDV

SEQ ID NO: 112173 - protein, 9 aa, Homo sapiens
  light chain complementarity determining region 3 for antibody 56087
LQDYNYPWT

SEQ ID NO: 112174 - protein, 16 aa, Homo sapiens
  heavy chain complementarity determining region 3 for antibody 56087
ARQYGSGSYYKDYFDY

SEQ ID NO: 112175 - protein, 9 aa, Homo sapiens
  light chain complementarity determining region 3 for antibody 56088
LQDYNYPWT

SEQ ID NO: 112176 - protein, 12 aa, Homo sapiens
  heavy chain complementarity determining region 3 for antibody 56088
ARNTMVRGVIDY

SEQ ID NO: 112177 - protein, 9 aa, Homo sapiens
  light chain complementarity determining region 3 for antibody 56089
LQDYNYPWT

SEQ ID NO: 112178 - protein, 16 aa, Homo sapiens
  heavy chain complementarity determining region 3 for antibody 56089
ARGRGYYGSGSPYFDY

SEQ ID NO: 112179 - protein, 9 aa, Homo sapiens
  light chain complementarity determining region 3 for antibody 56090
LQDYNYPWT

SEQ ID NO: 112180 - protein, 19 aa, Homo sapiens
  heavy chain complementarity determining region 3 for antibody 56090
ARERGTSYYDILTGYSLDY

SEQ ID NO: 112181 - protein, 9 aa, Homo sapiens
  light chain complementarity determining region 3 for antibody 56091
LQDYNYPWT

SEQ ID NO: 112182 - protein, 12 aa, Homo sapiens
  heavy chain complementarity determining region 3 for antibody 56091
ARDTTVRGAIDY

SEQ ID NO: 112183 - protein, 9 aa, Homo sapiens
  light chain complementarity determining region 3 for antibody 56092
LQDYNYPWT

SEQ ID NO: 112184 - protein, 12 aa, Homo sapiens
  heavy chain complementarity determining region 3 for antibody 56092
ARDTMVRGVSDY

SEQ ID NO: 112185 - protein, 9 aa, Homo sapiens
  light chain complementarity determining region 3 for antibody 56093
LQDYNYPWT

SEQ ID NO: 112186 - protein, 12 aa, Homo sapiens
  heavy chain complementarity determining region 3 for antibody 56093
ARDTMVRGVIDC

SEQ ID NO: 112187 - protein, 9 aa, Homo sapiens
  light chain complementarity determining region 3 for antibody 56094
LQDYNYPWT

SEQ ID NO: 112188 - protein, 12 aa, Homo sapiens
  heavy chain complementarity determining region 3 for antibody 56094
ARDTMVREVIDY

SEQ ID NO: 112189 - protein, 9 aa, Homo sapiens
  light chain complementarity determining region 3 for antibody 56095
LQDYNYPWT

SEQ ID NO: 112190 - protein, 12 aa, Homo sapiens
  heavy chain complementarity determining region 3 for antibody 56095
ARDTMVRAVIDY

SEQ ID NO: 112191 - protein, 9 aa, Homo sapiens
  light chain complementarity determining region 3 for antibody 56096
LQDYNYPWT

SEQ ID NO: 112192 - protein, 16 aa, Homo sapiens
  heavy chain complementarity determining region 3 for antibody 56096
ARDAKYYDILTGDPDY

SEQ ID NO: 112193 - protein, 9 aa, Homo sapiens
  light chain complementarity determining region 3 for antibody 56097
LQDYNYPWT

SEQ ID NO: 112194 - protein, 12 aa, Homo sapiens
  heavy chain complementarity determining region 3 for antibody 56097
AAALYSNFLLGY

SEQ ID NO: 112195 - protein, 9 aa, Homo sapiens
  light chain complementarity determining region 3 for antibody 56098
LQDYNYPRT

SEQ ID NO: 112196 - protein, 11 aa, Homo sapiens
  heavy chain complementarity determining region 3 for antibody 56098
ARTLPYYGMDV

SEQ ID NO: 112197 - protein, 9 aa, Homo sapiens
  light chain complementarity determining region 3 for antibody 56099
LQDYNYPRT

SEQ ID NO: 112198 - protein, 19 aa, Homo sapiens
  heavy chain complementarity determining region 3 for antibody 56099
ARKGLLWFGELYYYYGMDV

SEQ ID NO: 112199 - protein, 9 aa, Homo sapiens
  light chain complementarity determining region 3 for antibody 56100
LQDYNYPRT

SEQ ID NO: 112200 - protein, 14 aa, Homo sapiens
  heavy chain complementarity determining region 3 for antibody 56100
ARDPPRIVGALFDY

SEQ ID NO: 112201 - protein, 9 aa, Homo sapiens
  light chain complementarity determining region 3 for antibody 56101
LQDYNYPLT

SEQ ID NO: 112202 - protein, 22 aa, Homo sapiens
  heavy chain complementarity determining region 3 for antibody 56101
ARDLRGTMVRGVPYYYYYGMDV

SEQ ID NO: 112203 - protein, 9 aa, Homo sapiens
  light chain complementarity determining region 3 for antibody 56102
LQDYNYPLT

SEQ ID NO: 112204 - protein, 15 aa, Homo sapiens
  heavy chain complementarity determining region 3 for antibody 56102
ARAPLLLWFGEFTDY

SEQ ID NO: 112205 - protein, 9 aa, Homo sapiens
  light chain complementarity determining region 3 for antibody 56103
LQDYNYPIT

SEQ ID NO: 112206 - protein, 18 aa, Homo sapiens
  heavy chain complementarity determining region 3 for antibody 56103
AGGALYDILTGYPGYFDL

SEQ ID NO: 112207 - protein, 9 aa, Homo sapiens
  light chain complementarity determining region 3 for antibody 56104
LQDYNYPFT

SEQ ID NO: 112208 - protein, 10 aa, Homo sapiens
  heavy chain complementarity determining region 3 for antibody 56104
ATMTTVVFDY

SEQ ID NO: 112209 - protein, 9 aa, Homo sapiens
  light chain complementarity determining region 3 for antibody 56105
LQDYNYPFT

SEQ ID NO: 112210 - protein, 10 aa, Homo sapiens
  heavy chain complementarity determining region 3 for antibody 56105
ASMTTVTFDY

SEQ ID NO: 112211 - protein, 9 aa, Homo sapiens
  light chain complementarity determining region 3 for antibody 56106
LQDYNYPFT

SEQ ID NO: 112212 - protein, 15 aa, Homo sapiens
  heavy chain complementarity determining region 3 for antibody 56106
ASAPLLLWFGEFIDY

SEQ ID NO: 112213 - protein, 9 aa, Homo sapiens
  light chain complementarity determining region 3 for antibody 56107
LQDYNYPFT

SEQ ID NO: 112214 - protein, 10 aa, Homo sapiens
  heavy chain complementarity determining region 3 for antibody 56107
ARMTTVAFDY

SEQ ID NO: 112215 - protein, 9 aa, Homo sapiens
  light chain complementarity determining region 3 for antibody 56108
LQDYNYPFT

SEQ ID NO: 112216 - protein, 15 aa, Homo sapiens
  heavy chain complementarity determining region 3 for antibody 56108
ARAPLLPWFGEFIDY

SEQ ID NO: 112217 - protein, 9 aa, Homo sapiens
  light chain complementarity determining region 3 for antibody 56109
LQDYNYPFT

SEQ ID NO: 112218 - protein, 15 aa, Homo sapiens
  heavy chain complementarity determining region 3 for antibody 56109
ARAPLLLWSGEFIDY

SEQ ID NO: 112219 - protein, 9 aa, Homo sapiens
  light chain complementarity determining region 3 for antibody 56110
LQDYNYPFT

SEQ ID NO: 112220 - protein, 15 aa, Homo sapiens
  heavy chain complementarity determining region 3 for antibody 56110
ARAPLLLWFGGFIDY

SEQ ID NO: 112221 - protein, 9 aa, Homo sapiens
  light chain complementarity determining region 3 for antibody 56111
LQDYNYPFT

SEQ ID NO: 112222 - protein, 15 aa, Homo sapiens
  heavy chain complementarity determining region 3 for antibody 56111
ARAPLLLWFGEYIDY

SEQ ID NO: 112223 - protein, 9 aa, Homo sapiens
  light chain complementarity determining region 3 for antibody 56112
LQDYNYPFT

SEQ ID NO: 112224 - protein, 15 aa, Homo sapiens
  heavy chain complementarity determining region 3 for antibody 56112
ARAPLLLWFGEFSDY

SEQ ID NO: 112225 - protein, 9 aa, Homo sapiens
  light chain complementarity determining region 3 for antibody 56113
LQDYNYPFT

SEQ ID NO: 112226 - protein, 15 aa, Homo sapiens
  heavy chain complementarity determining region 3 for antibody 56113
ARAPLLLWFGAFIDY

SEQ ID NO: 112227 - protein, 9 aa, Homo sapiens
  light chain complementarity determining region 3 for antibody 56114
LQDYIYPWT

SEQ ID NO: 112228 - protein, 9 aa, Homo sapiens
  heavy chain complementarity determining region 3 for antibody 56114
ARRRELLDY

SEQ ID NO: 112229 - protein, 9 aa, Homo sapiens
  light chain complementarity determining region 3 for antibody 56115
LQDYDYPWT

SEQ ID NO: 112230 - protein, 11 aa, Homo sapiens
  heavy chain complementarity determining region 3 for antibody 56115
AREGYSYGFDY

SEQ ID NO: 112231 - protein, 9 aa, Homo sapiens
  light chain complementarity determining region 3 for antibody 56116
HQSSSLPYT

SEQ ID NO: 112232 - protein, 14 aa, Homo sapiens
  heavy chain complementarity determining region 3 for antibody 56116
AKEGQQLVRGYFDY

SEQ ID NO: 112233 - protein, 9 aa, Homo sapiens
  light chain complementarity determining region 3 for antibody 56117
HQSSSLPRT

SEQ ID NO: 112234 - protein, 11 aa, Homo sapiens
  heavy chain complementarity determining region 3 for antibody 56117
ARGEVRGVMDY

SEQ ID NO: 112235 - protein, 10 aa, Homo sapiens
  light chain complementarity determining region 3 for antibody 56118
HQSSSLPQYT

SEQ ID NO: 112236 - protein, 11 aa, Homo sapiens
  heavy chain complementarity determining region 3 for antibody 56118
ARDRFGHYFDY

SEQ ID NO: 112237 - protein, 9 aa, Homo sapiens
  light chain complementarity determining region 3 for antibody 56119
HQSSSLPIT

SEQ ID NO: 112238 - protein, 16 aa, Homo sapiens
  heavy chain complementarity determining region 3 for antibody 56119
AREGYDILTGYSSFDY

SEQ ID NO: 112239 - protein, 9 aa, Homo sapiens
  light chain complementarity determining region 3 for antibody 56120
HQSSSLPHT

SEQ ID NO: 112240 - protein, 12 aa, Homo sapiens
  heavy chain complementarity determining region 3 for antibody 56120
VKDHDILTGWGY

SEQ ID NO: 112241 - protein, 9 aa, Homo sapiens
  light chain complementarity determining region 3 for antibody 56121
HQSSSLPHT

SEQ ID NO: 112242 - protein, 12 aa, Homo sapiens
  heavy chain complementarity determining region 3 for antibody 56121
VKDHDILTGWAY

SEQ ID NO: 112243 - protein, 9 aa, Homo sapiens
  light chain complementarity determining region 3 for antibody 56122
HQSSSLPHT

SEQ ID NO: 112244 - protein, 15 aa, Homo sapiens
  heavy chain complementarity determining region 3 for antibody 56122
ARGYSGSYDWRYFDL

SEQ ID NO: 112245 - protein, 9 aa, Homo sapiens
  light chain complementarity determining region 3 for antibody 56123
HQSSILPHT

SEQ ID NO: 112246 - protein, 8 aa, Homo sapiens
  heavy chain complementarity determining region 3 for antibody 56123
ARNWGFDY

SEQ ID NO: 112247 - protein, 8 aa, Homo sapiens
  light chain complementarity determining region 3 for antibody 56124
HQFNNYYT

SEQ ID NO: 112248 - protein, 10 aa, Homo sapiens
  heavy chain complementarity determining region 3 for antibody 56124
ARGVRGVFDY

SEQ ID NO: 112249 - protein, 9 aa, Homo sapiens
  light chain complementarity determining region 3 for antibody 56125
RQFNNYPRT

SEQ ID NO: 112250 - protein, 13 aa, Homo sapiens
  heavy chain complementarity determining region 3 for antibody 56125
ARIAAAAVQYFQH

SEQ ID NO: 112251 - protein, 9 aa, Homo sapiens
  light chain complementarity determining region 3 for antibody 56126
QRYNSAPLT

SEQ ID NO: 112252 - protein, 17 aa, Homo sapiens
  heavy chain complementarity determining region 3 for antibody 56126
ARGLRYFDWLLSDAFDI

SEQ ID NO: 112253 - protein, 9 aa, Homo sapiens
  light chain complementarity determining region 3 for antibody 56127
QRYNSAPLT

SEQ ID NO: 112254 - protein, 9 aa, Homo sapiens
  heavy chain complementarity determining region 3 for antibody 56127
ARDGLGIDY

SEQ ID NO: 112255 - protein, 9 aa, Homo sapiens
  light chain complementarity determining region 3 for antibody 56128
QRLNSYPYT

SEQ ID NO: 112256 - protein, 12 aa, Homo sapiens
  heavy chain complementarity determining region 3 for antibody 56128
ARGRGYSYGLDY

SEQ ID NO: 112257 - protein, 9 aa, Homo sapiens
  light chain complementarity determining region 3 for antibody 56129
QQYYSYPYT

SEQ ID NO: 112258 - protein, 14 aa, Homo sapiens
  heavy chain complementarity determining region 3 for antibody 56129
AKDWGFGEFNWFDH

SEQ ID NO: 112259 - protein, 9 aa, Homo sapiens
  light chain complementarity determining region 3 for antibody 56130
QQYYSYPYT

SEQ ID NO: 112260 - protein, 14 aa, Homo sapiens
  heavy chain complementarity determining region 3 for antibody 56130
AKDWGFGEFNCFDP

SEQ ID NO: 112261 - protein, 9 aa, Homo sapiens
  light chain complementarity determining region 3 for antibody 56131
QQYYSYPRT

SEQ ID NO: 112262 - protein, 12 aa, Homo sapiens
  heavy chain complementarity determining region 3 for antibody 56131
ARDTMVRGVIDY

SEQ ID NO: 112263 - protein, 9 aa, Homo sapiens
  light chain complementarity determining region 3 for antibody 56132
QQYYSYPLT

SEQ ID NO: 112264 - protein, 11 aa, Homo sapiens
  heavy chain complementarity determining region 3 for antibody 56132
ARDRILKGMDV

SEQ ID NO: 112265 - protein, 9 aa, Homo sapiens
  light chain complementarity determining region 3 for antibody 56133
QQYYSYPFT

SEQ ID NO: 112266 - protein, 19 aa, Homo sapiens
  heavy chain complementarity determining region 3 for antibody 56133
ARDYDILTGYPYYYYGMDV

SEQ ID NO: 112267 - protein, 7 aa, Homo sapiens
  light chain complementarity determining region 3 for antibody 56134
QQYYSTP

SEQ ID NO: 112268 - protein, 16 aa, Homo sapiens
  heavy chain complementarity determining region 3 for antibody 56134
ARDYYDSGGYWGHFDY

SEQ ID NO: 112269 - protein, 8 aa, Homo sapiens
  light chain complementarity determining region 3 for antibody 56135
QQYNSYWT

SEQ ID NO: 112270 - protein, 12 aa, Homo sapiens
  heavy chain complementarity determining region 3 for antibody 56135
SRDTMVRGVIDY

SEQ ID NO: 112271 - protein, 9 aa, Homo sapiens
  light chain complementarity determining region 3 for antibody 56136
QQYNSYPYT

SEQ ID NO: 112272 - protein, 19 aa, Homo sapiens
  heavy chain complementarity determining region 3 for antibody 56136
ARGGYFYDSSGYYHNAFDI

SEQ ID NO: 112273 - protein, 9 aa, Homo sapiens
  light chain complementarity determining region 3 for antibody 56137
QQYNSYPYT

SEQ ID NO: 112274 - protein, 14 aa, Homo sapiens
  heavy chain complementarity determining region 3 for antibody 56137
ARGEQWLVHDAFDI

SEQ ID NO: 112275 - protein, 9 aa, Homo sapiens
  light chain complementarity determining region 3 for antibody 56138
QQYNSYPYA

SEQ ID NO: 112276 - protein, 16 aa, Homo sapiens
  heavy chain complementarity determining region 3 for antibody 56138
ARERGNWNPYYYGMDV

SEQ ID NO: 112277 - protein, 9 aa, Homo sapiens
  light chain complementarity determining region 3 for antibody 56139
QQYNSYPWT

SEQ ID NO: 112278 - protein, 18 aa, Homo sapiens
  heavy chain complementarity determining region 3 for antibody 56139
ARDRGVRGVPYYYYGMDV

SEQ ID NO: 112279 - protein, 9 aa, Homo sapiens
  light chain complementarity determining region 3 for antibody 56140
QQYNSYPWT

SEQ ID NO: 112280 - protein, 13 aa, Homo sapiens
  heavy chain complementarity determining region 3 for antibody 56140
ARDRGSGTIGFDY

SEQ ID NO: 112281 - protein, 9 aa, Homo sapiens
  light chain complementarity determining region 3 for antibody 56141
QQYNSYPRT

SEQ ID NO: 112282 - protein, 13 aa, Homo sapiens
  heavy chain complementarity determining region 3 for antibody 56141
ARYSSSWYDAFDI

SEQ ID NO: 112283 - protein, 9 aa, Homo sapiens
  light chain complementarity determining region 3 for antibody 56142
QQYNSYPRT

SEQ ID NO: 112284 - protein, 11 aa, Homo sapiens
  heavy chain complementarity determining region 3 for antibody 56142
ARVTAVALFDY

SEQ ID NO: 112285 - protein, 9 aa, Homo sapiens
  light chain complementarity determining region 3 for antibody 56143
QQYNSYPRT

SEQ ID NO: 112286 - protein, 5 aa, Homo sapiens
  heavy chain complementarity determining region 3 for antibody 56143
ARNSA

SEQ ID NO: 112287 - protein, 9 aa, Homo sapiens
  light chain complementarity determining region 3 for antibody 56144
QQYNSYPRT

SEQ ID NO: 112288 - protein, 17 aa, Homo sapiens
  heavy chain complementarity determining region 3 for antibody 56144
ARGLRYFVWLLSDAFDI

SEQ ID NO: 112289 - protein, 9 aa, Homo sapiens
  light chain complementarity determining region 3 for antibody 56145
QQYNSYPRT

SEQ ID NO: 112290 - protein, 17 aa, Homo sapiens
  heavy chain complementarity determining region 3 for antibody 56145
ARGLRYFDWLLSDAIDI

SEQ ID NO: 112291 - protein, 9 aa, Homo sapiens
  light chain complementarity determining region 3 for antibody 56146
QQYNSYPRT

SEQ ID NO: 112292 - protein, 13 aa, Homo sapiens
  heavy chain complementarity determining region 3 for antibody 56146
ARDRYSGSGAFDY

SEQ ID NO: 112293 - protein, 9 aa, Homo sapiens
  light chain complementarity determining region 3 for antibody 56147
QQYNSYPRT

SEQ ID NO: 112294 - protein, 13 aa, Homo sapiens
  heavy chain complementarity determining region 3 for antibody 56147
ARDRCSGYGAFDY

SEQ ID NO: 112295 - protein, 9 aa, Homo sapiens
  light chain complementarity determining region 3 for antibody 56148
QQYNSYPRT

SEQ ID NO: 112296 - protein, 13 aa, Homo sapiens
  heavy chain complementarity determining region 3 for antibody 56148
ARDKDSTQRWLGY

SEQ ID NO: 112297 - protein, 9 aa, Homo sapiens
  light chain complementarity determining region 3 for antibody 56149
QQYNSYPRT

SEQ ID NO: 112298 - protein, 13 aa, Homo sapiens
  heavy chain complementarity determining region 3 for antibody 56149
ARDKDSTQLGLGY

SEQ ID NO: 112299 - protein, 9 aa, Homo sapiens
  light chain complementarity determining region 3 for antibody 56150
QQYNSYPRT

SEQ ID NO: 112300 - protein, 13 aa, Homo sapiens
  heavy chain complementarity determining region 3 for antibody 56150
ARDKDSTQLCLDY

SEQ ID NO: 112301 - protein, 9 aa, Homo sapiens
  light chain complementarity determining region 3 for antibody 56151
QQYNSYPRT

SEQ ID NO: 112302 - protein, 13 aa, Homo sapiens
  heavy chain complementarity determining region 3 for antibody 56151
ARDKDSAQLWLGY

SEQ ID NO: 112303 - protein, 9 aa, Homo sapiens
  light chain complementarity determining region 3 for antibody 56152
QQYNSYPRT

SEQ ID NO: 112304 - protein, 13 aa, Homo sapiens
  heavy chain complementarity determining region 3 for antibody 56152
ARARYSGYGAFDY

SEQ ID NO: 112305 - protein, 9 aa, Homo sapiens
  light chain complementarity determining region 3 for antibody 56153
QQYNSYPRT

SEQ ID NO: 112306 - protein, 13 aa, Homo sapiens
  heavy chain complementarity determining region 3 for antibody 56153
AKDRYSGYGAFDY

SEQ ID NO: 112307 - protein, 9 aa, Homo sapiens
  light chain complementarity determining region 3 for antibody 56154
QQYNSYPRT

SEQ ID NO: 112308 - protein, 17 aa, Homo sapiens
  heavy chain complementarity determining region 3 for antibody 56154
AGGLRYFDWLLSDAFDI

SEQ ID NO: 112309 - protein, 9 aa, Homo sapiens
  light chain complementarity determining region 3 for antibody 56155
QQYNSYPHT

SEQ ID NO: 112310 - protein, 11 aa, Homo sapiens
  heavy chain complementarity determining region 3 for antibody 56155
ARGYSSGWVDY

SEQ ID NO: 112311 - protein, 9 aa, Homo sapiens
  light chain complementarity determining region 3 for antibody 56156
QQYNSYPFT

SEQ ID NO: 112312 - protein, 16 aa, Homo sapiens
  heavy chain complementarity determining region 3 for antibody 56156
ARDYYASSGYWGHFDY

SEQ ID NO: 112313 - protein, 9 aa, Homo sapiens
  light chain complementarity determining region 3 for antibody 56157
QQYNSCPRT

SEQ ID NO: 112314 - protein, 17 aa, Homo sapiens
  heavy chain complementarity determining region 3 for antibody 56157
ARGLRYFDWSLSDAFDI

SEQ ID NO: 112315 - protein, 10 aa, Homo sapiens
  light chain complementarity determining region 3 for antibody 56158
QQYNNWPPYT

SEQ ID NO: 112316 - protein, 6 aa, Homo sapiens
  heavy chain complementarity determining region 3 for antibody 56158
AREGDY

SEQ ID NO: 112317 - protein, 9 aa, Homo sapiens
  light chain complementarity determining region 3 for antibody 56159
QQYNNWLIT

SEQ ID NO: 112318 - protein, 12 aa, Homo sapiens
  heavy chain complementarity determining region 3 for antibody 56159
AKGLLWFGELGD

SEQ ID NO: 112319 - protein, 9 aa, Homo sapiens
  light chain complementarity determining region 3 for antibody 56160
QQYGSSPYT

SEQ ID NO: 112320 - protein, 24 aa, Homo sapiens
  heavy chain complementarity determining region 3 for antibody 56160
ARGGGYYGSGSYYNVLYYYYGMDV

SEQ ID NO: 112321 - protein, 9 aa, Homo sapiens
  light chain complementarity determining region 3 for antibody 56161
QQYGSSPYT

SEQ ID NO: 112322 - protein, 15 aa, Homo sapiens
  heavy chain complementarity determining region 3 for antibody 56161
ARDGNWDYYYYGMDV

SEQ ID NO: 112323 - protein, 10 aa, Homo sapiens
  light chain complementarity determining region 3 for antibody 56162
QQYGSSPVYT

SEQ ID NO: 112324 - protein, 17 aa, Homo sapiens
  heavy chain complementarity determining region 3 for antibody 56162
ARDRIAAAAYYYYGMDV

SEQ ID NO: 112325 - protein, 10 aa, Homo sapiens
  light chain complementarity determining region 3 for antibody 56163
QQYGSSPPYT

SEQ ID NO: 112326 - protein, 10 aa, Homo sapiens
  heavy chain complementarity determining region 3 for antibody 56163
ARGSYYGMDV

SEQ ID NO: 112327 - protein, 10 aa, Homo sapiens
  light chain complementarity determining region 3 for antibody 56164
QQYGSSPMYT

SEQ ID NO: 112328 - protein, 14 aa, Homo sapiens
  heavy chain complementarity determining region 3 for antibody 56164
AREGFRGYYYGTDV

SEQ ID NO: 112329 - protein, 10 aa, Homo sapiens
  light chain complementarity determining region 3 for antibody 56165
QQYGSSLMYT

SEQ ID NO: 112330 - protein, 14 aa, Homo sapiens
  heavy chain complementarity determining region 3 for antibody 56165
ARDGRLTMVRGVDY

SEQ ID NO: 112331 - protein, 8 aa, Homo sapiens
  light chain complementarity determining region 3 for antibody 56166
QQYGSSFT

SEQ ID NO: 112332 - protein, 13 aa, Homo sapiens
  heavy chain complementarity determining region 3 for antibody 56166
ARDSSSWYDAFDI

SEQ ID NO: 112333 - protein, 9 aa, Homo sapiens
  light chain complementarity determining region 3 for antibody 56167
QQYDNLPLT

SEQ ID NO: 112334 - protein, 11 aa, Homo sapiens
  heavy chain complementarity determining region 3 for antibody 56167
AREGSSYGFDY

SEQ ID NO: 112335 - protein, 9 aa, Homo sapiens
  light chain complementarity determining region 3 for antibody 56168
QQYDNLPLT

SEQ ID NO: 112336 - protein, 11 aa, Homo sapiens
  heavy chain complementarity determining region 3 for antibody 56168
AREAYSYGFDY

SEQ ID NO: 112337 - protein, 9 aa, Homo sapiens
  light chain complementarity determining region 3 for antibody 56169
QQYDNLPLT

SEQ ID NO: 112338 - protein, 16 aa, Homo sapiens
  heavy chain complementarity determining region 3 for antibody 56169
ARDAKYYDILTGYPDS

SEQ ID NO: 112339 - protein, 9 aa, Homo sapiens
  light chain complementarity determining region 3 for antibody 56170
QQYDNLPLT

SEQ ID NO: 112340 - protein, 16 aa, Homo sapiens
  heavy chain complementarity determining region 3 for antibody 56170
ARDAKYYDILTGYPAY

SEQ ID NO: 112341 - protein, 9 aa, Homo sapiens
  light chain complementarity determining region 3 for antibody 56171
QQYDNLPLT

SEQ ID NO: 112342 - protein, 16 aa, Homo sapiens
  heavy chain complementarity determining region 3 for antibody 56171
ARDAKYYDIFTGYPDY

SEQ ID NO: 112343 - protein, 9 aa, Homo sapiens
  light chain complementarity determining region 3 for antibody 56172
QQYDNLPLT

SEQ ID NO: 112344 - protein, 16 aa, Homo sapiens
  heavy chain complementarity determining region 3 for antibody 56172
ARDAEYYDILTGYPDY

SEQ ID NO: 112345 - protein, 9 aa, Homo sapiens
  light chain complementarity determining region 3 for antibody 56173
QQYDDLPLT

SEQ ID NO: 112346 - protein, 16 aa, Homo sapiens
  heavy chain complementarity determining region 3 for antibody 56173
ARDAKYYDILTGSPDY

SEQ ID NO: 112347 - protein, 9 aa, Homo sapiens
  light chain complementarity determining region 3 for antibody 56174
QQSYSTPRT

SEQ ID NO: 112348 - protein, 20 aa, Homo sapiens
  heavy chain complementarity determining region 3 for antibody 56174
ARERHYDILTGFYYYYGMDV

SEQ ID NO: 112349 - protein, 10 aa, Homo sapiens
  light chain complementarity determining region 3 for antibody 56175
QQRSNWPPLT

SEQ ID NO: 112350 - protein, 19 aa, Homo sapiens
  heavy chain complementarity determining region 3 for antibody 56175
ATERYKVGATYYYYDGMDV

SEQ ID NO: 112351 - protein, 10 aa, Homo sapiens
  light chain complementarity determining region 3 for antibody 56176
QQRSNWPPLT

SEQ ID NO: 112352 - protein, 19 aa, Homo sapiens
  heavy chain complementarity determining region 3 for antibody 56176
ATERYKVGATYYYDYGMDV

SEQ ID NO: 112353 - protein, 10 aa, Homo sapiens
  light chain complementarity determining region 3 for antibody 56177
QQRSNWPPLT

SEQ ID NO: 112354 - protein, 19 aa, Homo sapiens
  heavy chain complementarity determining region 3 for antibody 56177
ATERYKVGATYSSYYGMDV

SEQ ID NO: 112355 - protein, 10 aa, Homo sapiens
  light chain complementarity determining region 3 for antibody 56178
QQRSNWPPLT

SEQ ID NO: 112356 - protein, 19 aa, Homo sapiens
  heavy chain complementarity determining region 3 for antibody 56178
ATERYKVGATYDYYYGMDV

SEQ ID NO: 112357 - protein, 10 aa, Homo sapiens
  light chain complementarity determining region 3 for antibody 56179
QQRSNWPPLT

SEQ ID NO: 112358 - protein, 19 aa, Homo sapiens
  heavy chain complementarity determining region 3 for antibody 56179
ATERYKVGATFYYYYGMDV

SEQ ID NO: 112359 - protein, 10 aa, Homo sapiens
  light chain complementarity determining region 3 for antibody 56180
QQRSNWPPLT

SEQ ID NO: 112360 - protein, 19 aa, Homo sapiens
  heavy chain complementarity determining region 3 for antibody 56180
ATERYKVGAAYYYYYGMDV

SEQ ID NO: 112361 - protein, 9 aa, Homo sapiens
  light chain complementarity determining region 3 for antibody 56181
QQLTTYPFT

SEQ ID NO: 112362 - protein, 22 aa, Homo sapiens
  heavy chain complementarity determining region 3 for antibody 56181
ARSVVRGVILTSPYYYYYGMDV

SEQ ID NO: 112363 - protein, 9 aa, Homo sapiens
  light chain complementarity determining region 3 for antibody 56182
QQLNSYTPT

SEQ ID NO: 112364 - protein, 20 aa, Homo sapiens
  heavy chain complementarity determining region 3 for antibody 56182
AKDQGDIVATIMDYYYGMDV

SEQ ID NO: 112365 - protein, 9 aa, Homo sapiens
  light chain complementarity determining region 3 for antibody 56183
QQLNSYSWT

SEQ ID NO: 112366 - protein, 20 aa, Homo sapiens
  heavy chain complementarity determining region 3 for antibody 56183
ARNGYYGSGSFPYYYYGTDV

SEQ ID NO: 112367 - protein, 9 aa, Homo sapiens
  light chain complementarity determining region 3 for antibody 56184
QQLNSYSFT

SEQ ID NO: 112368 - protein, 8 aa, Homo sapiens
  heavy chain complementarity determining region 3 for antibody 56184
ARTGPLDY

SEQ ID NO: 112369 - protein, 9 aa, Homo sapiens
  light chain complementarity determining region 3 for antibody 56185
QQLNSYPYT

SEQ ID NO: 112370 - protein, 9 aa, Homo sapiens
  heavy chain complementarity determining region 3 for antibody 56185
ARKRWSLDL

SEQ ID NO: 112371 - protein, 9 aa, Homo sapiens
  light chain complementarity determining region 3 for antibody 56186
QQLNSYPYT

SEQ ID NO: 112372 - protein, 16 aa, Homo sapiens
  heavy chain complementarity determining region 3 for antibody 56186
ARGYYYGSGSSSPFDY

SEQ ID NO: 112373 - protein, 9 aa, Homo sapiens
  light chain complementarity determining region 3 for antibody 56187
QQLNSYPYT

SEQ ID NO: 112374 - protein, 16 aa, Homo sapiens
  heavy chain complementarity determining region 3 for antibody 56187
ARGYYYGLGSYSPFDY

SEQ ID NO: 112375 - protein, 9 aa, Homo sapiens
  light chain complementarity determining region 3 for antibody 56188
QQLNSYPYT

SEQ ID NO: 112376 - protein, 22 aa, Homo sapiens
  heavy chain complementarity determining region 3 for antibody 56188
ARDQYYGSGSYYPDYYYYGMDV

SEQ ID NO: 112377 - protein, 9 aa, Homo sapiens
  light chain complementarity determining region 3 for antibody 56189
QQLNSYPWT

SEQ ID NO: 112378 - protein, 14 aa, Homo sapiens
  heavy chain complementarity determining region 3 for antibody 56189
AREGFRGYYYGMDV

SEQ ID NO: 112379 - protein, 9 aa, Homo sapiens
  light chain complementarity determining region 3 for antibody 56190
QQLNSYPWT

SEQ ID NO: 112380 - protein, 17 aa, Homo sapiens
  heavy chain complementarity determining region 3 for antibody 56190
ARDRINMVRGVTNWFDP

SEQ ID NO: 112381 - protein, 8 aa, Homo sapiens
  light chain complementarity determining region 3 for antibody 56191
QQLNSYPT

SEQ ID NO: 112382 - protein, 14 aa, Homo sapiens
  heavy chain complementarity determining region 3 for antibody 56191
ARPTYYYGSGSFDY

SEQ ID NO: 112383 - protein, 9 aa, Homo sapiens
  light chain complementarity determining region 3 for antibody 56192
QQLNSYPRT

SEQ ID NO: 112384 - protein, 16 aa, Homo sapiens
  heavy chain complementarity determining region 3 for antibody 56192
ARDRGMTTVSHDVFDI

SEQ ID NO: 112385 - protein, 9 aa, Homo sapiens
  light chain complementarity determining region 3 for antibody 56193
QQLNSYPRT

SEQ ID NO: 112386 - protein, 8 aa, Homo sapiens
  heavy chain complementarity determining region 3 for antibody 56193
ARDDGMDV

SEQ ID NO: 112387 - protein, 9 aa, Homo sapiens
  light chain complementarity determining region 3 for antibody 56194
QQLNSYPLT

SEQ ID NO: 112388 - protein, 13 aa, Homo sapiens
  heavy chain complementarity determining region 3 for antibody 56194
ARYSSSWYDASDI

SEQ ID NO: 112389 - protein, 9 aa, Homo sapiens
  light chain complementarity determining region 3 for antibody 56195
QQLNSYPLT

SEQ ID NO: 112390 - protein, 13 aa, Homo sapiens
  heavy chain complementarity determining region 3 for antibody 56195
ARYSSSWYDAFGI

SEQ ID NO: 112391 - protein, 9 aa, Homo sapiens
  light chain complementarity determining region 3 for antibody 56196
QQLNSYPLT

SEQ ID NO: 112392 - protein, 13 aa, Homo sapiens
  heavy chain complementarity determining region 3 for antibody 56196
ARYSSSWYDAFDN

SEQ ID NO: 112393 - protein, 9 aa, Homo sapiens
  light chain complementarity determining region 3 for antibody 56197
QQLNSYPLT

SEQ ID NO: 112394 - protein, 13 aa, Homo sapiens
  heavy chain complementarity determining region 3 for antibody 56197
ARYSSSGYDAFDI

SEQ ID NO: 112395 - protein, 9 aa, Homo sapiens
  light chain complementarity determining region 3 for antibody 56198
QQLNSYPLT

SEQ ID NO: 112396 - protein, 11 aa, Homo sapiens
  heavy chain complementarity determining region 3 for antibody 56198
ARVNWADAFDI

SEQ ID NO: 112397 - protein, 9 aa, Homo sapiens
  light chain complementarity determining region 3 for antibody 56199
QQLNSYPLT

SEQ ID NO: 112398 - protein, 24 aa, Homo sapiens
  heavy chain complementarity determining region 3 for antibody 56199
AREWEGNYGSGSYYKSAYYYGMDV

SEQ ID NO: 112399 - protein, 9 aa, Homo sapiens
  light chain complementarity determining region 3 for antibody 56200
QQLNSYPLT

SEQ ID NO: 112400 - protein, 13 aa, Homo sapiens
  heavy chain complementarity determining region 3 for antibody 56200
ARDRYSGYGAFDY

SEQ ID NO: 112401 - protein, 9 aa, Homo sapiens
  light chain complementarity determining region 3 for antibody 56201
QQLNSYPLT

SEQ ID NO: 112402 - protein, 11 aa, Homo sapiens
  heavy chain complementarity determining region 3 for antibody 56201
ARDGVGTAFDI

SEQ ID NO: 112403 - protein, 9 aa, Homo sapiens
  light chain complementarity determining region 3 for antibody 56202
QQLNSYPLT

SEQ ID NO: 112404 - protein, 16 aa, Homo sapiens
  heavy chain complementarity determining region 3 for antibody 56202
ARDAKYYDILTGYPDY

SEQ ID NO: 112405 - protein, 9 aa, Homo sapiens
  light chain complementarity determining region 3 for antibody 56203
QQLNSYPLT

SEQ ID NO: 112406 - protein, 15 aa, Homo sapiens
  heavy chain complementarity determining region 3 for antibody 56203
ARAPLLLWFGEFIDY

SEQ ID NO: 112407 - protein, 9 aa, Homo sapiens
  light chain complementarity determining region 3 for antibody 56204
QQLNSYPLT

SEQ ID NO: 112408 - protein, 13 aa, Homo sapiens
  heavy chain complementarity determining region 3 for antibody 56204
AGYSSSWSDAFDI

SEQ ID NO: 112409 - protein, 9 aa, Homo sapiens
  light chain complementarity determining region 3 for antibody 56205
QQLNSYPLT

SEQ ID NO: 112410 - protein, 13 aa, Homo sapiens
  heavy chain complementarity determining region 3 for antibody 56205
AGYSSSLYDAFDI

SEQ ID NO: 112411 - protein, 9 aa, Homo sapiens
  light chain complementarity determining region 3 for antibody 56206
QQLNSYPLT

SEQ ID NO: 112412 - protein, 13 aa, Homo sapiens
  heavy chain complementarity determining region 3 for antibody 56206
AGYSGSWYDAFDI

SEQ ID NO: 112413 - protein, 9 aa, Homo sapiens
  light chain complementarity determining region 3 for antibody 56207
QQLNGYPHT

SEQ ID NO: 112414 - protein, 9 aa, Homo sapiens
  heavy chain complementarity determining region 3 for antibody 56207
ARKRWYFDL

SEQ ID NO: 112415 - protein, 9 aa, Homo sapiens
  light chain complementarity determining region 3 for antibody 56208
QQLDSYPLT

SEQ ID NO: 112416 - protein, 13 aa, Homo sapiens
  heavy chain complementarity determining region 3 for antibody 56208
ARYSSSWYDAFDI

SEQ ID NO: 112417 - protein, 9 aa, Homo sapiens
  light chain complementarity determining region 3 for antibody 56209
QQLDSYPFT

SEQ ID NO: 112418 - protein, 14 aa, Homo sapiens
  heavy chain complementarity determining region 3 for antibody 56209
ARGYSSGWGGFFDY

SEQ ID NO: 112419 - protein, 9 aa, Homo sapiens
  light chain complementarity determining region 3 for antibody 56210
QQFNSYPRT

SEQ ID NO: 112420 - protein, 13 aa, Homo sapiens
  heavy chain complementarity determining region 3 for antibody 56210
ARIAAAAVQYFQH

SEQ ID NO: 112421 - protein, 7 aa, Homo sapiens
  light chain complementarity determining region 3 for antibody 56211
QQFNNYT

SEQ ID NO: 112422 - protein, 16 aa, Homo sapiens
  heavy chain complementarity determining region 3 for antibody 56211
AREGTGYYYYYYGMDV

SEQ ID NO: 112423 - protein, 8 aa, Homo sapiens
  light chain complementarity determining region 3 for antibody 56212
QQFNNYRT

SEQ ID NO: 112424 - protein, 22 aa, Homo sapiens
  heavy chain complementarity determining region 3 for antibody 56212
ARMYYDILTGYPDYYYYYGMDA

SEQ ID NO: 112425 - protein, 9 aa, Homo sapiens
  light chain complementarity determining region 3 for antibody 56213
QQFNNYPYT

SEQ ID NO: 112426 - protein, 24 aa, Homo sapiens
  heavy chain complementarity determining region 3 for antibody 56213
TREWEGNYGSGSYYKSAYYYGMDV

SEQ ID NO: 112427 - protein, 9 aa, Homo sapiens
  light chain complementarity determining region 3 for antibody 56214
QQFNNYPYT

SEQ ID NO: 112428 - protein, 24 aa, Homo sapiens
  heavy chain complementarity determining region 3 for antibody 56214
GREWEGNYGSGSYYKSAYYYGMDV

SEQ ID NO: 112429 - protein, 9 aa, Homo sapiens
  light chain complementarity determining region 3 for antibody 56215
QQFNNYPYT

SEQ ID NO: 112430 - protein, 24 aa, Homo sapiens
  heavy chain complementarity determining region 3 for antibody 56215
ATEWEGNYGSGSYYKSAYSYGMDV

SEQ ID NO: 112431 - protein, 9 aa, Homo sapiens
  light chain complementarity determining region 3 for antibody 56216
QQFNNYPYT

SEQ ID NO: 112432 - protein, 24 aa, Homo sapiens
  heavy chain complementarity determining region 3 for antibody 56216
ASEWEGNYGSGSYYKSAYYYGMDV

SEQ ID NO: 112433 - protein, 9 aa, Homo sapiens
  light chain complementarity determining region 3 for antibody 56217
QQFNNYPYT

SEQ ID NO: 112434 - protein, 13 aa, Homo sapiens
  heavy chain complementarity determining region 3 for antibody 56217
ARIAAAAVQYFQH

SEQ ID NO: 112435 - protein, 9 aa, Homo sapiens
  light chain complementarity determining region 3 for antibody 56218
QQFNNYPYT

SEQ ID NO: 112436 - protein, 24 aa, Homo sapiens
  heavy chain complementarity determining region 3 for antibody 56218
AREWGGNYGSGSYYKSAYYYGMDV

SEQ ID NO: 112437 - protein, 9 aa, Homo sapiens
  light chain complementarity determining region 3 for antibody 56219
QQFNNYPYT

SEQ ID NO: 112438 - protein, 24 aa, Homo sapiens
  heavy chain complementarity determining region 3 for antibody 56219
AREWEGNYGSGSYYKSAYYYGMGV

SEQ ID NO: 112439 - protein, 9 aa, Homo sapiens
  light chain complementarity determining region 3 for antibody 56220
QQFNNYPYT

SEQ ID NO: 112440 - protein, 24 aa, Homo sapiens
  heavy chain complementarity determining region 3 for antibody 56220
AREWEGNYGSGSYYKSAYYYGMEV

SEQ ID NO: 112441 - protein, 9 aa, Homo sapiens
  light chain complementarity determining region 3 for antibody 56221
QQFNNYPYT

SEQ ID NO: 112442 - protein, 24 aa, Homo sapiens
  heavy chain complementarity determining region 3 for antibody 56221
AREWEGNYGSGSYYKSAYYYGMDF

SEQ ID NO: 112443 - protein, 9 aa, Homo sapiens
  light chain complementarity determining region 3 for antibody 56222
QQFNNYPYT

SEQ ID NO: 112444 - protein, 24 aa, Homo sapiens
  heavy chain complementarity determining region 3 for antibody 56222
AREWEGNYGSGSYYKSAYYYGMDA

SEQ ID NO: 112445 - protein, 9 aa, Homo sapiens
  light chain complementarity determining region 3 for antibody 56223
QQFNNYPYT

SEQ ID NO: 112446 - protein, 24 aa, Homo sapiens
  heavy chain complementarity determining region 3 for antibody 56223
AREWEGNYGSGSYYKSAYYYDMDV

SEQ ID NO: 112447 - protein, 9 aa, Homo sapiens
  light chain complementarity determining region 3 for antibody 56224
QQFNNYPYT

SEQ ID NO: 112448 - protein, 24 aa, Homo sapiens
  heavy chain complementarity determining region 3 for antibody 56224
AREWEGNYGSGSYYKSAYYSGMAV

SEQ ID NO: 112449 - protein, 9 aa, Homo sapiens
  light chain complementarity determining region 3 for antibody 56225
QQFNNYPYT

SEQ ID NO: 112450 - protein, 24 aa, Homo sapiens
  heavy chain complementarity determining region 3 for antibody 56225
AREWEGNYGSGSYYKSASYSGMDV

SEQ ID NO: 112451 - protein, 9 aa, Homo sapiens
  light chain complementarity determining region 3 for antibody 56226
QQFNNYPYT

SEQ ID NO: 112452 - protein, 24 aa, Homo sapiens
  heavy chain complementarity determining region 3 for antibody 56226
AREWEGNYGSGSYYKIAYSYGMDV

SEQ ID NO: 112453 - protein, 9 aa, Homo sapiens
  light chain complementarity determining region 3 for antibody 56227
QQFNNYPYT

SEQ ID NO: 112454 - protein, 24 aa, Homo sapiens
  heavy chain complementarity determining region 3 for antibody 56227
AREWEGNYGSGSCYKSAYSYGMDV

SEQ ID NO: 112455 - protein, 9 aa, Homo sapiens
  light chain complementarity determining region 3 for antibody 56228
QQFNNYPYT

SEQ ID NO: 112456 - protein, 24 aa, Homo sapiens
  heavy chain complementarity determining region 3 for antibody 56228
AREWEGNYGSGGDYKSAYYYGMDV

SEQ ID NO: 112457 - protein, 9 aa, Homo sapiens
  light chain complementarity determining region 3 for antibody 56229
QQFNNYPYT

SEQ ID NO: 112458 - protein, 24 aa, Homo sapiens
  heavy chain complementarity determining region 3 for antibody 56229
AREWEGNHGSGSYYKSAYYYGMDV

SEQ ID NO: 112459 - protein, 9 aa, Homo sapiens
  light chain complementarity determining region 3 for antibody 56230
QQFNNYPYT

SEQ ID NO: 112460 - protein, 24 aa, Homo sapiens
  heavy chain complementarity determining region 3 for antibody 56230
AREWEGNDGSGSYYKSAYSYGMDV

SEQ ID NO: 112461 - protein, 9 aa, Homo sapiens
  light chain complementarity determining region 3 for antibody 56231
QQFNNYPYT

SEQ ID NO: 112462 - protein, 24 aa, Homo sapiens
  heavy chain complementarity determining region 3 for antibody 56231
AREWEGNCGSGSYYKSAYYYGMDV

SEQ ID NO: 112463 - protein, 9 aa, Homo sapiens
  light chain complementarity determining region 3 for antibody 56232
QQFNNYPYT

SEQ ID NO: 112464 - protein, 24 aa, Homo sapiens
  heavy chain complementarity determining region 3 for antibody 56232
AREWEGKYGSGSYYKSAYSYGMDV

SEQ ID NO: 112465 - protein, 9 aa, Homo sapiens
  light chain complementarity determining region 3 for antibody 56233
QQFNNYPYT

SEQ ID NO: 112466 - protein, 24 aa, Homo sapiens
  heavy chain complementarity determining region 3 for antibody 56233
AREWEGKYGSGSYYKSAFYYGMDV

SEQ ID NO: 112467 - protein, 9 aa, Homo sapiens
  light chain complementarity determining region 3 for antibody 56234
QQFNNYPYT

SEQ ID NO: 112468 - protein, 24 aa, Homo sapiens
  heavy chain complementarity determining region 3 for antibody 56234
AREWEGKDGSGSDYKSAYYYGMDV

SEQ ID NO: 112469 - protein, 9 aa, Homo sapiens
  light chain complementarity determining region 3 for antibody 56235
QQFNNYPYT

SEQ ID NO: 112470 - protein, 24 aa, Homo sapiens
  heavy chain complementarity determining region 3 for antibody 56235
AREWDGNYGSGSYYKSAYSYGMDV

SEQ ID NO: 112471 - protein, 9 aa, Homo sapiens
  light chain complementarity determining region 3 for antibody 56236
QQFNNYPYT

SEQ ID NO: 112472 - protein, 24 aa, Homo sapiens
  heavy chain complementarity determining region 3 for antibody 56236
ARESEGNYGSGSYYKSAYYYGMDV

SEQ ID NO: 112473 - protein, 9 aa, Homo sapiens
  light chain complementarity determining region 3 for antibody 56237
QQFNNYPYT

SEQ ID NO: 112474 - protein, 15 aa, Homo sapiens
  heavy chain complementarity determining region 3 for antibody 56237
AREGVWFGELSPFDY

SEQ ID NO: 112475 - protein, 9 aa, Homo sapiens
  light chain complementarity determining region 3 for antibody 56238
QQFNNYPYT

SEQ ID NO: 112476 - protein, 13 aa, Homo sapiens
  heavy chain complementarity determining region 3 for antibody 56238
ARDRYSGYGAFDY

SEQ ID NO: 112477 - protein, 9 aa, Homo sapiens
  light chain complementarity determining region 3 for antibody 56239
QQFNNYPYT

SEQ ID NO: 112478 - protein, 9 aa, Homo sapiens
  heavy chain complementarity determining region 3 for antibody 56239
ARDGLGIDY

SEQ ID NO: 112479 - protein, 9 aa, Homo sapiens
  light chain complementarity determining region 3 for antibody 56240
QQFNNYPYT

SEQ ID NO: 112480 - protein, 15 aa, Homo sapiens
  heavy chain complementarity determining region 3 for antibody 56240
AKGEQLGYYYYGMDV

SEQ ID NO: 112481 - protein, 9 aa, Homo sapiens
  light chain complementarity determining region 3 for antibody 56241
QQFNNYPRT

SEQ ID NO: 112482 - protein, 17 aa, Homo sapiens
  heavy chain complementarity determining region 3 for antibody 56241
VKGGPGESFYYYYGVDV

SEQ ID NO: 112483 - protein, 9 aa, Homo sapiens
  light chain complementarity determining region 3 for antibody 56242
QQFNNYPRT

SEQ ID NO: 112484 - protein, 15 aa, Homo sapiens
  heavy chain complementarity determining region 3 for antibody 56242
ATAYYYGSGSCCFDP

SEQ ID NO: 112485 - protein, 9 aa, Homo sapiens
  light chain complementarity determining region 3 for antibody 56243
QQFNNYPRT

SEQ ID NO: 112486 - protein, 8 aa, Homo sapiens
  heavy chain complementarity determining region 3 for antibody 56243
ARTGPIDY

SEQ ID NO: 112487 - protein, 9 aa, Homo sapiens
  light chain complementarity determining region 3 for antibody 56244
QQFNNYPRT

SEQ ID NO: 112488 - protein, 13 aa, Homo sapiens
  heavy chain complementarity determining region 3 for antibody 56244
ARTAAAAVQYFHH

SEQ ID NO: 112489 - protein, 9 aa, Homo sapiens
  light chain complementarity determining region 3 for antibody 56245
QQFNNYPRT

SEQ ID NO: 112490 - protein, 13 aa, Homo sapiens
  heavy chain complementarity determining region 3 for antibody 56245
ARTAAAAVQSFQH

SEQ ID NO: 112491 - protein, 9 aa, Homo sapiens
  light chain complementarity determining region 3 for antibody 56246
QQFNNYPRT

SEQ ID NO: 112492 - protein, 13 aa, Homo sapiens
  heavy chain complementarity determining region 3 for antibody 56246
ARIGAAAVQYFQH

SEQ ID NO: 112493 - protein, 9 aa, Homo sapiens
  light chain complementarity determining region 3 for antibody 56247
QQFNNYPRT

SEQ ID NO: 112494 - protein, 13 aa, Homo sapiens
  heavy chain complementarity determining region 3 for antibody 56247
ARIAAAAVQSFHH

SEQ ID NO: 112495 - protein, 9 aa, Homo sapiens
  light chain complementarity determining region 3 for antibody 56248
QQFNNYPRT

SEQ ID NO: 112496 - protein, 13 aa, Homo sapiens
  heavy chain complementarity determining region 3 for antibody 56248
ARIAAAAAQYFQH

SEQ ID NO: 112497 - protein, 9 aa, Homo sapiens
  light chain complementarity determining region 3 for antibody 56249
QQFNNYPRT

SEQ ID NO: 112498 - protein, 11 aa, Homo sapiens
  heavy chain complementarity determining region 3 for antibody 56249
ARHVQLAWFDP

SEQ ID NO: 112499 - protein, 9 aa, Homo sapiens
  light chain complementarity determining region 3 for antibody 56250
QQFNNYPLT

SEQ ID NO: 112500 - protein, 18 aa, Homo sapiens
  heavy chain complementarity determining region 3 for antibody 56250
ARDEGSSWYDENCYGMDV

SEQ ID NO: 112501 - protein, 9 aa, Homo sapiens
  light chain complementarity determining region 3 for antibody 56251
QQFNNYPHT

SEQ ID NO: 112502 - protein, 13 aa, Homo sapiens
  heavy chain complementarity determining region 3 for antibody 56251
ANSGSYYASWFDP

SEQ ID NO: 112503 - protein, 9 aa, Homo sapiens
  light chain complementarity determining region 3 for antibody 56252
QQFNNYPCT

SEQ ID NO: 112504 - protein, 24 aa, Homo sapiens
  heavy chain complementarity determining region 3 for antibody 56252
AREWEGNYGSGSYYKSAYYYGMAV

SEQ ID NO: 112505 - protein, 9 aa, Homo sapiens
  light chain complementarity determining region 3 for antibody 56253
QQFNNYPCT

SEQ ID NO: 112506 - protein, 24 aa, Homo sapiens
  heavy chain complementarity determining region 3 for antibody 56253
AREWEGNYGSGSYYKSAYYSGMDV

SEQ ID NO: 112507 - protein, 9 aa, Homo sapiens
  light chain complementarity determining region 3 for antibody 56254
QQFNNHPYT

SEQ ID NO: 112508 - protein, 24 aa, Homo sapiens
  heavy chain complementarity determining region 3 for antibody 56254
AREWEGNYGSGSYYKSAYYYGMDV

SEQ ID NO: 112509 - protein, 9 aa, Homo sapiens
  light chain complementarity determining region 3 for antibody 56255
QQFNNFPFT

SEQ ID NO: 112510 - protein, 16 aa, Homo sapiens
  heavy chain complementarity determining region 3 for antibody 56255
ARGRGYYGSGSPSFDY

SEQ ID NO: 112511 - protein, 9 aa, Homo sapiens
  light chain complementarity determining region 3 for antibody 56256
QQFNNFPFT

SEQ ID NO: 112512 - protein, 16 aa, Homo sapiens
  heavy chain complementarity determining region 3 for antibody 56256
ARGRGYFGSGSPYFDY

SEQ ID NO: 112513 - protein, 9 aa, Homo sapiens
  light chain complementarity determining region 3 for antibody 56257
QQFNNCPYT

SEQ ID NO: 112514 - protein, 24 aa, Homo sapiens
  heavy chain complementarity determining region 3 for antibody 56257
AREWEGNYGSGSYYKSAYYYGMDV

SEQ ID NO: 112515 - protein, 8 aa, Homo sapiens
  light chain complementarity determining region 3 for antibody 56258
QQDYNLYT

SEQ ID NO: 112516 - protein, 15 aa, Homo sapiens
  heavy chain complementarity determining region 3 for antibody 56258
ARERAAAFYYYGMDV

SEQ ID NO: 112517 - protein, 9 aa, Homo sapiens
  light chain complementarity determining region 3 for antibody 56259
QQDYNLPYT

SEQ ID NO: 112518 - protein, 18 aa, Homo sapiens
  heavy chain complementarity determining region 3 for antibody 56259
ARAPTGTTTDYYYFGMDV

SEQ ID NO: 112519 - protein, 9 aa, Homo sapiens
  light chain complementarity determining region 3 for antibody 56260
QQDYNLPRT

SEQ ID NO: 112520 - protein, 16 aa, Homo sapiens
  heavy chain complementarity determining region 3 for antibody 56260
AREGRGDYYYYYGMDV

SEQ ID NO: 112521 - protein, 9 aa, Homo sapiens
  light chain complementarity determining region 3 for antibody 56261
QQDYNLPIT

SEQ ID NO: 112522 - protein, 21 aa, Homo sapiens
  heavy chain complementarity determining region 3 for antibody 56261
ARGPNYDILTGLRNIPAVGDY

SEQ ID NO: 112523 - protein, 8 aa, Homo sapiens
  light chain complementarity determining region 3 for antibody 56262
QQDYNLLT

SEQ ID NO: 112524 - protein, 15 aa, Homo sapiens
  heavy chain complementarity determining region 3 for antibody 56262
AKTYYYGSGSSHFDY

SEQ ID NO: 112525 - protein, 8 aa, Homo sapiens
  light chain complementarity determining region 3 for antibody 56263
QQDYNLFT

SEQ ID NO: 112526 - protein, 15 aa, Homo sapiens
  heavy chain complementarity determining region 3 for antibody 56263
AKEGGLRYSYNGMDV

SEQ ID NO: 112527 - protein, 9 aa, Homo sapiens
  light chain complementarity determining region 3 for antibody 56264
QKYNSAPYT

SEQ ID NO: 112528 - protein, 19 aa, Homo sapiens
  heavy chain complementarity determining region 3 for antibody 56264
ARDDGYDGGGYSYYYGMDV

SEQ ID NO: 112529 - protein, 9 aa, Homo sapiens
  light chain complementarity determining region 3 for antibody 56265
QKYNSAPYT

SEQ ID NO: 112530 - protein, 19 aa, Homo sapiens
  heavy chain complementarity determining region 3 for antibody 56265
ARDDGCDGGGYYYYYGMDV

SEQ ID NO: 112531 - protein, 9 aa, Homo sapiens
  light chain complementarity determining region 3 for antibody 56266
QKYNSAPPT

SEQ ID NO: 112532 - protein, 9 aa, Homo sapiens
  heavy chain complementarity determining region 3 for antibody 56266
ARDGLGIDY

SEQ ID NO: 112533 - protein, 9 aa, Homo sapiens
  light chain complementarity determining region 3 for antibody 56267
QKYNSAPLT

SEQ ID NO: 112534 - protein, 17 aa, Homo sapiens
  heavy chain complementarity determining region 3 for antibody 56267
ERGLRYFDWLLSDAFDI

SEQ ID NO: 112535 - protein, 9 aa, Homo sapiens
  light chain complementarity determining region 3 for antibody 56268
QKYNSAPLT

SEQ ID NO: 112536 - protein, 9 aa, Homo sapiens
  heavy chain complementarity determining region 3 for antibody 56268
ERDGLGIDY

SEQ ID NO: 112537 - protein, 9 aa, Homo sapiens
  light chain complementarity determining region 3 for antibody 56269
QKYNSAPLT

SEQ ID NO: 112538 - protein, 17 aa, Homo sapiens
  heavy chain complementarity determining region 3 for antibody 56269
ARWLRYFDWLLSDAFDI

SEQ ID NO: 112539 - protein, 9 aa, Homo sapiens
  light chain complementarity determining region 3 for antibody 56270
QKYNSAPLT

SEQ ID NO: 112540 - protein, 8 aa, Homo sapiens
  heavy chain complementarity determining region 3 for antibody 56270
ARTGPPDY

SEQ ID NO: 112541 - protein, 9 aa, Homo sapiens
  light chain complementarity determining region 3 for antibody 56271
QKYNSAPLT

SEQ ID NO: 112542 - protein, 8 aa, Homo sapiens
  heavy chain complementarity determining region 3 for antibody 56271
ARTGPLEY

SEQ ID NO: 112543 - protein, 9 aa, Homo sapiens
  light chain complementarity determining region 3 for antibody 56272
QKYNSAPLT

SEQ ID NO: 112544 - protein, 17 aa, Homo sapiens
  heavy chain complementarity determining region 3 for antibody 56272
ARGSRYFDWLLSDAFDI

SEQ ID NO: 112545 - protein, 9 aa, Homo sapiens
  light chain complementarity determining region 3 for antibody 56273
QKYNSAPLT

SEQ ID NO: 112546 - protein, 17 aa, Homo sapiens
  heavy chain complementarity determining region 3 for antibody 56273
ARGLRYFVWSLSDAFDI

SEQ ID NO: 112547 - protein, 9 aa, Homo sapiens
  light chain complementarity determining region 3 for antibody 56274
QKYNSAPLT

SEQ ID NO: 112548 - protein, 17 aa, Homo sapiens
  heavy chain complementarity determining region 3 for antibody 56274
ARGLRYFDWSLSDAIDI

SEQ ID NO: 112549 - protein, 9 aa, Homo sapiens
  light chain complementarity determining region 3 for antibody 56275
QKYNSAPLT

SEQ ID NO: 112550 - protein, 17 aa, Homo sapiens
  heavy chain complementarity determining region 3 for antibody 56275
ARGLRYFDWLLSDALDI

SEQ ID NO: 112551 - protein, 9 aa, Homo sapiens
  light chain complementarity determining region 3 for antibody 56276
QKYNSAPLT

SEQ ID NO: 112552 - protein, 17 aa, Homo sapiens
  heavy chain complementarity determining region 3 for antibody 56276
ARGLRYFDWLLSDAFEI

SEQ ID NO: 112553 - protein, 9 aa, Homo sapiens
  light chain complementarity determining region 3 for antibody 56277
QKYNSAPLT

SEQ ID NO: 112554 - protein, 17 aa, Homo sapiens
  heavy chain complementarity determining region 3 for antibody 56277
ARGLRYFDWLLSDAFDF

SEQ ID NO: 112555 - protein, 9 aa, Homo sapiens
  light chain complementarity determining region 3 for antibody 56278
QKYNSAPLT

SEQ ID NO: 112556 - protein, 17 aa, Homo sapiens
  heavy chain complementarity determining region 3 for antibody 56278
ARGLRYFDGSLSDAFDI

SEQ ID NO: 112557 - protein, 9 aa, Homo sapiens
  light chain complementarity determining region 3 for antibody 56279
QKYNSAPLT

SEQ ID NO: 112558 - protein, 17 aa, Homo sapiens
  heavy chain complementarity determining region 3 for antibody 56279
ARGLREFDWLLSDAFDI

SEQ ID NO: 112559 - protein, 9 aa, Homo sapiens
  light chain complementarity determining region 3 for antibody 56280
QKYNSAPLT

SEQ ID NO: 112560 - protein, 17 aa, Homo sapiens
  heavy chain complementarity determining region 3 for antibody 56280
ARGLRDFVWLLSDAFDI

SEQ ID NO: 112561 - protein, 9 aa, Homo sapiens
  light chain complementarity determining region 3 for antibody 56281
QKYNSAPLT

SEQ ID NO: 112562 - protein, 17 aa, Homo sapiens
  heavy chain complementarity determining region 3 for antibody 56281
ARGLRDFGWLLSDAFDI

SEQ ID NO: 112563 - protein, 9 aa, Homo sapiens
  light chain complementarity determining region 3 for antibody 56282
QKYNSAPLT

SEQ ID NO: 112564 - protein, 17 aa, Homo sapiens
  heavy chain complementarity determining region 3 for antibody 56282
ARGLRDFDWSLSDAFDI

SEQ ID NO: 112565 - protein, 9 aa, Homo sapiens
  light chain complementarity determining region 3 for antibody 56283
QKYNSAPLT

SEQ ID NO: 112566 - protein, 17 aa, Homo sapiens
  heavy chain complementarity determining region 3 for antibody 56283
ARGLRCFDWLLSDAFDI

SEQ ID NO: 112567 - protein, 9 aa, Homo sapiens
  light chain complementarity determining region 3 for antibody 56284
QKYNSAPLT

SEQ ID NO: 112568 - protein, 11 aa, Homo sapiens
  heavy chain complementarity determining region 3 for antibody 56284
AREGYSYGIDY

SEQ ID NO: 112569 - protein, 9 aa, Homo sapiens
  light chain complementarity determining region 3 for antibody 56285
QKYNSAPLT

SEQ ID NO: 112570 - protein, 16 aa, Homo sapiens
  heavy chain complementarity determining region 3 for antibody 56285
ARDTKYYDILTGYPDY

SEQ ID NO: 112571 - protein, 9 aa, Homo sapiens
  light chain complementarity determining region 3 for antibody 56286
QKYNSAPLT

SEQ ID NO: 112572 - protein, 13 aa, Homo sapiens
  heavy chain complementarity determining region 3 for antibody 56286
ARDRYSGYGALDY

SEQ ID NO: 112573 - protein, 9 aa, Homo sapiens
  light chain complementarity determining region 3 for antibody 56287
QKYNSAPLT

SEQ ID NO: 112574 - protein, 13 aa, Homo sapiens
  heavy chain complementarity determining region 3 for antibody 56287
ARDRYSGYGAFDC

SEQ ID NO: 112575 - protein, 9 aa, Homo sapiens
  light chain complementarity determining region 3 for antibody 56288
QKYNSAPLT

SEQ ID NO: 112576 - protein, 13 aa, Homo sapiens
  heavy chain complementarity determining region 3 for antibody 56288
ARDRYSGCGAFDY

SEQ ID NO: 112577 - protein, 9 aa, Homo sapiens
  light chain complementarity determining region 3 for antibody 56289
QKYNSAPLT

SEQ ID NO: 112578 - protein, 12 aa, Homo sapiens
  heavy chain complementarity determining region 3 for antibody 56289
ARDIMVRGVIDY

SEQ ID NO: 112579 - protein, 9 aa, Homo sapiens
  light chain complementarity determining region 3 for antibody 56290
QKYNSAPLT

SEQ ID NO: 112580 - protein, 9 aa, Homo sapiens
  heavy chain complementarity determining region 3 for antibody 56290
ARDGMGIDY

SEQ ID NO: 112581 - protein, 9 aa, Homo sapiens
  light chain complementarity determining region 3 for antibody 56291
QKYNSAPLT

SEQ ID NO: 112582 - protein, 9 aa, Homo sapiens
  heavy chain complementarity determining region 3 for antibody 56291
ARDGLGVDY

SEQ ID NO: 112583 - protein, 9 aa, Homo sapiens
  light chain complementarity determining region 3 for antibody 56292
QKYNSAPLT

SEQ ID NO: 112584 - protein, 9 aa, Homo sapiens
  heavy chain complementarity determining region 3 for antibody 56292
ARDELGIDY

SEQ ID NO: 112585 - protein, 9 aa, Homo sapiens
  light chain complementarity determining region 3 for antibody 56293
QKYNSAPLT

SEQ ID NO: 112586 - protein, 16 aa, Homo sapiens
  heavy chain complementarity determining region 3 for antibody 56293
ARDAKYYDTLTGYTDY

SEQ ID NO: 112587 - protein, 9 aa, Homo sapiens
  light chain complementarity determining region 3 for antibody 56294
QKYNSAPLT

SEQ ID NO: 112588 - protein, 16 aa, Homo sapiens
  heavy chain complementarity determining region 3 for antibody 56294
ARDAKYYDSLSGYPDY

SEQ ID NO: 112589 - protein, 9 aa, Homo sapiens
  light chain complementarity determining region 3 for antibody 56295
QKYNSAPLT

SEQ ID NO: 112590 - protein, 15 aa, Homo sapiens
  heavy chain complementarity determining region 3 for antibody 56295
ARAPLLLWFGEFIDY

SEQ ID NO: 112591 - protein, 9 aa, Homo sapiens
  light chain complementarity determining region 3 for antibody 56296
QKYNSAPLT

SEQ ID NO: 112592 - protein, 17 aa, Homo sapiens
  heavy chain complementarity determining region 3 for antibody 56296
AGGLRYFDWSLSDAFDI

SEQ ID NO: 112593 - protein, 9 aa, Homo sapiens
  light chain complementarity determining region 3 for antibody 56297
QKYNSAPLT

SEQ ID NO: 112594 - protein, 9 aa, Homo sapiens
  heavy chain complementarity determining region 3 for antibody 56297
AGDGLGIDY

SEQ ID NO: 112595 - protein, 9 aa, Homo sapiens
  light chain complementarity determining region 3 for antibody 56298
QKYNSAPFT

SEQ ID NO: 112596 - protein, 14 aa, Homo sapiens
  heavy chain complementarity determining region 3 for antibody 56298
ARWDTLYYCYGMDV

SEQ ID NO: 112597 - protein, 9 aa, Homo sapiens
  light chain complementarity determining region 3 for antibody 56299
QKYNSAPFT

SEQ ID NO: 112598 - protein, 18 aa, Homo sapiens
  heavy chain complementarity determining region 3 for antibody 56299
ARGQIYYNSGSYYSPFDY

SEQ ID NO: 112599 - protein, 9 aa, Homo sapiens
  light chain complementarity determining region 3 for antibody 56300
QKYKSAPLT

SEQ ID NO: 112600 - protein, 8 aa, Homo sapiens
  heavy chain complementarity determining region 3 for antibody 56300
ARTGPLDY

SEQ ID NO: 112601 - protein, 9 aa, Homo sapiens
  light chain complementarity determining region 3 for antibody 56301
QEYNSAPLT

SEQ ID NO: 112602 - protein, 13 aa, Homo sapiens
  heavy chain complementarity determining region 3 for antibody 56301
ARDRYSGYGAFDY

SEQ ID NO: 112603 - protein, 9 aa, Homo sapiens
  light chain complementarity determining region 3 for antibody 56302
MQDTHWPYT

SEQ ID NO: 112604 - protein, 17 aa, Homo sapiens
  heavy chain complementarity determining region 3 for antibody 56302
ARDGRGVIDYYYYGMDV

SEQ ID NO: 112605 - protein, 9 aa, Homo sapiens
  light chain complementarity determining region 3 for antibody 56303
MQALQTPYT

SEQ ID NO: 112606 - protein, 17 aa, Homo sapiens
  heavy chain complementarity determining region 3 for antibody 56303
ARESYYNEGDYYYGMDV

SEQ ID NO: 112607 - protein, 9 aa, Homo sapiens
  light chain complementarity determining region 3 for antibody 56304
MQALQTPYT

SEQ ID NO: 112608 - protein, 16 aa, Homo sapiens
  heavy chain complementarity determining region 3 for antibody 56304
AREGYDILTGYSSFDY

SEQ ID NO: 112609 - protein, 9 aa, Homo sapiens
  light chain complementarity determining region 3 for antibody 56305
MQALQTPFT

SEQ ID NO: 112610 - protein, 12 aa, Homo sapiens
  heavy chain complementarity determining region 3 for antibody 56305
ARDRDILTGYDY

SEQ ID NO: 112611 - protein, 9 aa, Homo sapiens
  light chain complementarity determining region 3 for antibody 56306
LRHNSYPYT

SEQ ID NO: 112612 - protein, 11 aa, Homo sapiens
  heavy chain complementarity determining region 3 for antibody 56306
AAYSSSWPFDY

SEQ ID NO: 112613 - protein, 9 aa, Homo sapiens
  light chain complementarity determining region 3 for antibody 56307
LQRNSYPYT

SEQ ID NO: 112614 - protein, 13 aa, Homo sapiens
  heavy chain complementarity determining region 3 for antibody 56307
ARIRYFDWLPFDY

SEQ ID NO: 112615 - protein, 8 aa, Homo sapiens
  light chain complementarity determining region 3 for antibody 56308
LQHNSYYT

SEQ ID NO: 112616 - protein, 12 aa, Homo sapiens
  heavy chain complementarity determining region 3 for antibody 56308
ARLWFGESPFDY

SEQ ID NO: 112617 - protein, 9 aa, Homo sapiens
  light chain complementarity determining region 3 for antibody 56309
LQHNSYPYT

SEQ ID NO: 112618 - protein, 11 aa, Homo sapiens
  heavy chain complementarity determining region 3 for antibody 56309
TTLWFGESDED

SEQ ID NO: 112619 - protein, 9 aa, Homo sapiens
  light chain complementarity determining region 3 for antibody 56310
LQHNSYPYT

SEQ ID NO: 112620 - protein, 13 aa, Homo sapiens
  heavy chain complementarity determining region 3 for antibody 56310
AWIAAAAVQYFQH

SEQ ID NO: 112621 - protein, 9 aa, Homo sapiens
  light chain complementarity determining region 3 for antibody 56311
LQHNSYPYT

SEQ ID NO: 112622 - protein, 11 aa, Homo sapiens
  heavy chain complementarity determining region 3 for antibody 56311
ASDSLTGYYEY

SEQ ID NO: 112623 - protein, 9 aa, Homo sapiens
  light chain complementarity determining region 3 for antibody 56312
LQHNSYPYT

SEQ ID NO: 112624 - protein, 19 aa, Homo sapiens
  heavy chain complementarity determining region 3 for antibody 56312
ARVSDILTGYYKGGHAFDI

SEQ ID NO: 112625 - protein, 9 aa, Homo sapiens
  light chain complementarity determining region 3 for antibody 56313
LQHNSYPYT

SEQ ID NO: 112626 - protein, 13 aa, Homo sapiens
  heavy chain complementarity determining region 3 for antibody 56313
ARTAAAAVQSFQH

SEQ ID NO: 112627 - protein, 9 aa, Homo sapiens
  light chain complementarity determining region 3 for antibody 56314
LQHNSYPYT

SEQ ID NO: 112628 - protein, 13 aa, Homo sapiens
  heavy chain complementarity determining region 3 for antibody 56314
ARRAAAAVQYFQH

SEQ ID NO: 112629 - protein, 9 aa, Homo sapiens
  light chain complementarity determining region 3 for antibody 56315
LQHNSYPYT

SEQ ID NO: 112630 - protein, 13 aa, Homo sapiens
  heavy chain complementarity determining region 3 for antibody 56315
ARIAAAAVQYYQH

SEQ ID NO: 112631 - protein, 9 aa, Homo sapiens
  light chain complementarity determining region 3 for antibody 56316
LQHNSYPYT

SEQ ID NO: 112632 - protein, 13 aa, Homo sapiens
  heavy chain complementarity determining region 3 for antibody 56316
ARIAAAAVQYIQH

SEQ ID NO: 112633 - protein, 9 aa, Homo sapiens
  light chain complementarity determining region 3 for antibody 56317
LQHNSYPYT

SEQ ID NO: 112634 - protein, 13 aa, Homo sapiens
  heavy chain complementarity determining region 3 for antibody 56317
ARIAAAAVQYCQH

SEQ ID NO: 112635 - protein, 9 aa, Homo sapiens
  light chain complementarity determining region 3 for antibody 56318
LQHNSYPYT

SEQ ID NO: 112636 - protein, 13 aa, Homo sapiens
  heavy chain complementarity determining region 3 for antibody 56318
ARIAAAAFQYFQH

SEQ ID NO: 112637 - protein, 9 aa, Homo sapiens
  light chain complementarity determining region 3 for antibody 56319
LQHNSYPYT

SEQ ID NO: 112638 - protein, 13 aa, Homo sapiens
  heavy chain complementarity determining region 3 for antibody 56319
ARIAAAAAQSFQH

SEQ ID NO: 112639 - protein, 9 aa, Homo sapiens
  light chain complementarity determining region 3 for antibody 56320
LQHNSYPYT

SEQ ID NO: 112640 - protein, 10 aa, Homo sapiens
  heavy chain complementarity determining region 3 for antibody 56320
AREIRGVIAY

SEQ ID NO: 112641 - protein, 9 aa, Homo sapiens
  light chain complementarity determining region 3 for antibody 56321
LQHNSYPYT

SEQ ID NO: 112642 - protein, 15 aa, Homo sapiens
  heavy chain complementarity determining region 3 for antibody 56321
AREGRLAVAVTGFAY

SEQ ID NO: 112643 - protein, 9 aa, Homo sapiens
  light chain complementarity determining region 3 for antibody 56322
LQHNSYPYT

SEQ ID NO: 112644 - protein, 15 aa, Homo sapiens
  heavy chain complementarity determining region 3 for antibody 56322
AREGRLAVAATGFDY

SEQ ID NO: 112645 - protein, 9 aa, Homo sapiens
  light chain complementarity determining region 3 for antibody 56323
LQHNSYPYT

SEQ ID NO: 112646 - protein, 20 aa, Homo sapiens
  heavy chain complementarity determining region 3 for antibody 56323
AREEGIAVAGTYYYYYGMDV

SEQ ID NO: 112647 - protein, 9 aa, Homo sapiens
  light chain complementarity determining region 3 for antibody 56324
LQHNSYPYT

SEQ ID NO: 112648 - protein, 20 aa, Homo sapiens
  heavy chain complementarity determining region 3 for antibody 56324
ARDRDDILTGWVPSYRGLDV

SEQ ID NO: 112649 - protein, 9 aa, Homo sapiens
  light chain complementarity determining region 3 for antibody 56325
LQHNSYPYT

SEQ ID NO: 112650 - protein, 10 aa, Homo sapiens
  heavy chain complementarity determining region 3 for antibody 56325
ARDQGYGSGN

SEQ ID NO: 112651 - protein, 9 aa, Homo sapiens
  light chain complementarity determining region 3 for antibody 56326
LQHNSYPYT

SEQ ID NO: 112652 - protein, 17 aa, Homo sapiens
  heavy chain complementarity determining region 3 for antibody 56326
ARATYYYGSGSYYNFDY

SEQ ID NO: 112653 - protein, 9 aa, Homo sapiens
  light chain complementarity determining region 3 for antibody 56327
LQHNSYPYN

SEQ ID NO: 112654 - protein, 13 aa, Homo sapiens
  heavy chain complementarity determining region 3 for antibody 56327
ARIRYFDWLPFDY

SEQ ID NO: 112655 - protein, 9 aa, Homo sapiens
  light chain complementarity determining region 3 for antibody 56328
LQHNSYPWT

SEQ ID NO: 112656 - protein, 12 aa, Homo sapiens
  heavy chain complementarity determining region 3 for antibody 56328
ARDTMVRGVIDY

SEQ ID NO: 112657 - protein, 9 aa, Homo sapiens
  light chain complementarity determining region 3 for antibody 56329
LQHNSYPWT

SEQ ID NO: 112658 - protein, 12 aa, Homo sapiens
  heavy chain complementarity determining region 3 for antibody 56329
ARDIMVRGVIGY

SEQ ID NO: 112659 - protein, 9 aa, Homo sapiens
  light chain complementarity determining region 3 for antibody 56330
LQHNSYPWT

SEQ ID NO: 112660 - protein, 12 aa, Homo sapiens
  heavy chain complementarity determining region 3 for antibody 56330
ARDIMVRGVIDC

SEQ ID NO: 112661 - protein, 9 aa, Homo sapiens
  light chain complementarity determining region 3 for antibody 56331
LQHNSYPWT

SEQ ID NO: 112662 - protein, 12 aa, Homo sapiens
  heavy chain complementarity determining region 3 for antibody 56331
ARDIMVRGGIDY

SEQ ID NO: 112663 - protein, 9 aa, Homo sapiens
  light chain complementarity determining region 3 for antibody 56332
LQHNSYPWT

SEQ ID NO: 112664 - protein, 19 aa, Homo sapiens
  heavy chain complementarity determining region 3 for antibody 56332
AKDEDILTGYYRDSYAMDV

SEQ ID NO: 112665 - protein, 9 aa, Homo sapiens
  light chain complementarity determining region 3 for antibody 56333
LQHNSYPWT

SEQ ID NO: 112666 - protein, 19 aa, Homo sapiens
  heavy chain complementarity determining region 3 for antibody 56333
AKDEDILTGYYGDYYAMDV

SEQ ID NO: 112667 - protein, 9 aa, Homo sapiens
  light chain complementarity determining region 3 for antibody 56334
LQHNSYPRT

SEQ ID NO: 112668 - protein, 9 aa, Homo sapiens
  heavy chain complementarity determining region 3 for antibody 56334
VMVRGVMDV

SEQ ID NO: 112669 - protein, 9 aa, Homo sapiens
  light chain complementarity determining region 3 for antibody 56335
LQHNSYPRT

SEQ ID NO: 112670 - protein, 9 aa, Homo sapiens
  heavy chain complementarity determining region 3 for antibody 56335
RMVRGVMDV

SEQ ID NO: 112671 - protein, 9 aa, Homo sapiens
  light chain complementarity determining region 3 for antibody 56336
LQHNSYPRT

SEQ ID NO: 112672 - protein, 9 aa, Homo sapiens
  heavy chain complementarity determining region 3 for antibody 56336
LMVRGVMGV

SEQ ID NO: 112673 - protein, 9 aa, Homo sapiens
  light chain complementarity determining region 3 for antibody 56337
LQHNSYPRT

SEQ ID NO: 112674 - protein, 9 aa, Homo sapiens
  heavy chain complementarity determining region 3 for antibody 56337
LMVRGVMDA

SEQ ID NO: 112675 - protein, 9 aa, Homo sapiens
  light chain complementarity determining region 3 for antibody 56338
LQHNSYPRT

SEQ ID NO: 112676 - protein, 9 aa, Homo sapiens
  heavy chain complementarity determining region 3 for antibody 56338
LIVRGVMDV

SEQ ID NO: 112677 - protein, 9 aa, Homo sapiens
  light chain complementarity determining region 3 for antibody 56339
LQHNSYPRT

SEQ ID NO: 112678 - protein, 13 aa, Homo sapiens
  heavy chain complementarity determining region 3 for antibody 56339
ARYSSSWYDAFDI

SEQ ID NO: 112679 - protein, 9 aa, Homo sapiens
  light chain complementarity determining region 3 for antibody 56340
LQHNSYPRT

SEQ ID NO: 112680 - protein, 13 aa, Homo sapiens
  heavy chain complementarity determining region 3 for antibody 56340
ARGDYDILTGYYY

SEQ ID NO: 112681 - protein, 9 aa, Homo sapiens
  light chain complementarity determining region 3 for antibody 56341
LQHNSYPRT

SEQ ID NO: 112682 - protein, 19 aa, Homo sapiens
  heavy chain complementarity determining region 3 for antibody 56341
AKRVYGSGSPYYYYYGMDV

SEQ ID NO: 112683 - protein, 9 aa, Homo sapiens
  light chain complementarity determining region 3 for antibody 56342
LQHNSYPIT

SEQ ID NO: 112684 - protein, 17 aa, Homo sapiens
  heavy chain complementarity determining region 3 for antibody 56342
ARDDYDILTGYQYYFDY

SEQ ID NO: 112685 - protein, 9 aa, Homo sapiens
  light chain complementarity determining region 3 for antibody 56343
LQHNSYPFT

SEQ ID NO: 112686 - protein, 14 aa, Homo sapiens
  heavy chain complementarity determining region 3 for antibody 56343
ATGYPYYFYYGVDV

SEQ ID NO: 112687 - protein, 9 aa, Homo sapiens
  light chain complementarity determining region 3 for antibody 56344
LQHNSYPFT

SEQ ID NO: 112688 - protein, 16 aa, Homo sapiens
  heavy chain complementarity determining region 3 for antibody 56344
ASVFVDIVVVPAAFDY

SEQ ID NO: 112689 - protein, 9 aa, Homo sapiens
  light chain complementarity determining region 3 for antibody 56345
LQHNSYPFT

SEQ ID NO: 112690 - protein, 16 aa, Homo sapiens
  heavy chain complementarity determining region 3 for antibody 56345
ASPFVDIVVVPAAFDY

SEQ ID NO: 112691 - protein, 9 aa, Homo sapiens
  light chain complementarity determining region 3 for antibody 56346
LQHNSYPFT

SEQ ID NO: 112692 - protein, 21 aa, Homo sapiens
  heavy chain complementarity determining region 3 for antibody 56346
ARDQRDYYGSGSYPYYYGMDV

SEQ ID NO: 112693 - protein, 9 aa, Homo sapiens
  light chain complementarity determining region 3 for antibody 56347
LQHNSYPFT

SEQ ID NO: 112694 - protein, 16 aa, Homo sapiens
  heavy chain complementarity determining region 3 for antibody 56347
AGLVVDIVVVPAAFDY

SEQ ID NO: 112695 - protein, 9 aa, Homo sapiens
  light chain complementarity determining region 3 for antibody 56348
LQHNSHPFT

SEQ ID NO: 112696 - protein, 16 aa, Homo sapiens
  heavy chain complementarity determining region 3 for antibody 56348
ASLFVDIVVVPAAFDY

SEQ ID NO: 112697 - protein, 9 aa, Homo sapiens
  light chain complementarity determining region 3 for antibody 56349
LQHNRYPRT

SEQ ID NO: 112698 - protein, 15 aa, Homo sapiens
  heavy chain complementarity determining region 3 for antibody 56349
ARGGDFYGSGSFFDY

SEQ ID NO: 112699 - protein, 9 aa, Homo sapiens
  light chain complementarity determining region 3 for antibody 56350
LQHDNFPYT

SEQ ID NO: 112700 - protein, 7 aa, Homo sapiens
  heavy chain complementarity determining region 3 for antibody 56350
AREVGDY

SEQ ID NO: 112701 - protein, 9 aa, Homo sapiens
  light chain complementarity determining region 3 for antibody 56351
LQHDNFPRT

SEQ ID NO: 112702 - protein, 10 aa, Homo sapiens
  heavy chain complementarity determining region 3 for antibody 56351
ARDQGYGSAN

SEQ ID NO: 112703 - protein, 9 aa, Homo sapiens
  light chain complementarity determining region 3 for antibody 56352
LQHDNFPFT

SEQ ID NO: 112704 - protein, 20 aa, Homo sapiens
  heavy chain complementarity determining region 3 for antibody 56352
ARDRSRISMVRESYYYGMDV

SEQ ID NO: 112705 - protein, 9 aa, Homo sapiens
  light chain complementarity determining region 3 for antibody 56353
LQGYNYPWT

SEQ ID NO: 112706 - protein, 12 aa, Homo sapiens
  heavy chain complementarity determining region 3 for antibody 56353
ARDTMVRGVIDY

SEQ ID NO: 112707 - protein, 9 aa, Homo sapiens
  light chain complementarity determining region 3 for antibody 56354
LQDYTYPFT

SEQ ID NO: 112708 - protein, 15 aa, Homo sapiens
  heavy chain complementarity determining region 3 for antibody 56354
ARAPLLLWFGEFIDY

SEQ ID NO: 112709 - protein, 9 aa, Homo sapiens
  light chain complementarity determining region 3 for antibody 56355
LQDYNYTWT

SEQ ID NO: 112710 - protein, 16 aa, Homo sapiens
  heavy chain complementarity determining region 3 for antibody 56355
ARDAKYYDILTGYPDY

SEQ ID NO: 112711 - protein, 9 aa, Homo sapiens
  light chain complementarity determining region 3 for antibody 56356
LQDYNYSWT

SEQ ID NO: 112712 - protein, 12 aa, Homo sapiens
  heavy chain complementarity determining region 3 for antibody 56356
ARDTVVRGVIDY

SEQ ID NO: 112713 - protein, 9 aa, Homo sapiens
  light chain complementarity determining region 3 for antibody 56357
LQDYNYPYT

SEQ ID NO: 112714 - protein, 12 aa, Homo sapiens
  heavy chain complementarity determining region 3 for antibody 56357
TLYGSRSYGWDY

SEQ ID NO: 112715 - protein, 9 aa, Homo sapiens
  light chain complementarity determining region 3 for antibody 56358
LQDYNYPYT

SEQ ID NO: 112716 - protein, 12 aa, Homo sapiens
  heavy chain complementarity determining region 3 for antibody 56358
SRDTMVRGVIDY

SEQ ID NO: 112717 - protein, 9 aa, Homo sapiens
  light chain complementarity determining region 3 for antibody 56359
LQDYNYPYT

SEQ ID NO: 112718 - protein, 11 aa, Homo sapiens
  heavy chain complementarity determining region 3 for antibody 56359
SGYSSSWSFDY

SEQ ID NO: 112719 - protein, 9 aa, Homo sapiens
  light chain complementarity determining region 3 for antibody 56360
LQDYNYPYT

SEQ ID NO: 112720 - protein, 16 aa, Homo sapiens
  heavy chain complementarity determining region 3 for antibody 56360
AREYGDLYYYYYGMDV

SEQ ID NO: 112721 - protein, 9 aa, Homo sapiens
  light chain complementarity determining region 3 for antibody 56361
LQDYNYPYT

SEQ ID NO: 112722 - protein, 19 aa, Homo sapiens
  heavy chain complementarity determining region 3 for antibody 56361
ARERPVTMVRGVIDYGMDV

SEQ ID NO: 112723 - protein, 9 aa, Homo sapiens
  light chain complementarity determining region 3 for antibody 56362
LQDYNYPYT

SEQ ID NO: 112724 - protein, 16 aa, Homo sapiens
  heavy chain complementarity determining region 3 for antibody 56362
ARERDNWNPYYYGMDV

SEQ ID NO: 112725 - protein, 9 aa, Homo sapiens
  light chain complementarity determining region 3 for antibody 56363
LQDYNYPYT

SEQ ID NO: 112726 - protein, 12 aa, Homo sapiens
  heavy chain complementarity determining region 3 for antibody 56363
ARDRYFDWPPDY

SEQ ID NO: 112727 - protein, 9 aa, Homo sapiens
  light chain complementarity determining region 3 for antibody 56364
LQDYNYPYT

SEQ ID NO: 112728 - protein, 11 aa, Homo sapiens
  heavy chain complementarity determining region 3 for antibody 56364
ARDLRYSYGYY

SEQ ID NO: 112729 - protein, 9 aa, Homo sapiens
  light chain complementarity determining region 3 for antibody 56365
LQDYNYPYT

SEQ ID NO: 112730 - protein, 17 aa, Homo sapiens
  heavy chain complementarity determining region 3 for antibody 56365
ARDLRYFDWSLDDAFDI

SEQ ID NO: 112731 - protein, 9 aa, Homo sapiens
  light chain complementarity determining region 3 for antibody 56366
LQDYNYPYT

SEQ ID NO: 112732 - protein, 10 aa, Homo sapiens
  heavy chain complementarity determining region 3 for antibody 56366
ARDLGHYFDY

SEQ ID NO: 112733 - protein, 9 aa, Homo sapiens
  light chain complementarity determining region 3 for antibody 56367
LQDYNYPYT

SEQ ID NO: 112734 - protein, 9 aa, Homo sapiens
  heavy chain complementarity determining region 3 for antibody 56367
ARDGLGIDY

SEQ ID NO: 112735 - protein, 9 aa, Homo sapiens
  light chain complementarity determining region 3 for antibody 56368
LQDYNYPYT

SEQ ID NO: 112736 - protein, 14 aa, Homo sapiens
  heavy chain complementarity determining region 3 for antibody 56368
AGDPPRIVGALFDY

SEQ ID NO: 112737 - protein, 9 aa, Homo sapiens
  light chain complementarity determining region 3 for antibody 56369
LQDYNYPWT

SEQ ID NO: 112738 - protein, 15 aa, Homo sapiens
  heavy chain complementarity determining region 3 for antibody 56369
STEAYDILTGYYGDY

SEQ ID NO: 112739 - protein, 9 aa, Homo sapiens
  light chain complementarity determining region 3 for antibody 56370
LQDYNYPWT

SEQ ID NO: 112740 - protein, 12 aa, Homo sapiens
  heavy chain complementarity determining region 3 for antibody 56370
ATDTIVRGVIDY

SEQ ID NO: 112741 - protein, 9 aa, Homo sapiens
  light chain complementarity determining region 3 for antibody 56371
LQDYNYPWT

SEQ ID NO: 112742 - protein, 14 aa, Homo sapiens
  heavy chain complementarity determining region 3 for antibody 56371
ARWRFGELYGWFDP

SEQ ID NO: 112743 - protein, 9 aa, Homo sapiens
  light chain complementarity determining region 3 for antibody 56372
LQDYNYPWT

SEQ ID NO: 112744 - protein, 22 aa, Homo sapiens
  heavy chain complementarity determining region 3 for antibody 56372
ARRGDIAVAGTRRDSYYYGMDV

SEQ ID NO: 112745 - protein, 9 aa, Homo sapiens
  light chain complementarity determining region 3 for antibody 56373
LQDYNYPWT

SEQ ID NO: 112746 - protein, 22 aa, Homo sapiens
  heavy chain complementarity determining region 3 for antibody 56373
ARRGDIAVAGARRDYYYYGMDV

SEQ ID NO: 112747 - protein, 9 aa, Homo sapiens
  light chain complementarity determining region 3 for antibody 56374
LQDYNYPWT

SEQ ID NO: 112748 - protein, 22 aa, Homo sapiens
  heavy chain complementarity determining region 3 for antibody 56374
ARRDYYGSGSYYNDYYYYAMDV

SEQ ID NO: 112749 - protein, 9 aa, Homo sapiens
  light chain complementarity determining region 3 for antibody 56375
LQDYNYPWT

SEQ ID NO: 112750 - protein, 22 aa, Homo sapiens
  heavy chain complementarity determining region 3 for antibody 56375
ARRDYYGSGSYYNDYYSYGMDV

SEQ ID NO: 112751 - protein, 9 aa, Homo sapiens
  light chain complementarity determining region 3 for antibody 56376
LQDYNYPWT

SEQ ID NO: 112752 - protein, 22 aa, Homo sapiens
  heavy chain complementarity determining region 3 for antibody 56376
ARRDYYGSGSYYNDYFYYGMDV

SEQ ID NO: 112753 - protein, 9 aa, Homo sapiens
  light chain complementarity determining region 3 for antibody 56377
LQDYNYPWT

SEQ ID NO: 112754 - protein, 16 aa, Homo sapiens
  heavy chain complementarity determining region 3 for antibody 56377
ARGAKYYDILTGYPDY

SEQ ID NO: 112755 - protein, 9 aa, Homo sapiens
  light chain complementarity determining region 3 for antibody 56378
LQDYNYPWT

SEQ ID NO: 112756 - protein, 12 aa, Homo sapiens
  heavy chain complementarity determining region 3 for antibody 56378
ARDTMVRGVIVY

SEQ ID NO: 112757 - protein, 9 aa, Homo sapiens
  light chain complementarity determining region 3 for antibody 56379
LQDYNYPWT

SEQ ID NO: 112758 - protein, 12 aa, Homo sapiens
  heavy chain complementarity determining region 3 for antibody 56379
ARDTMVRGVIAY

SEQ ID NO: 112759 - protein, 9 aa, Homo sapiens
  light chain complementarity determining region 3 for antibody 56380
LQDYNYPWT

SEQ ID NO: 112760 - protein, 12 aa, Homo sapiens
  heavy chain complementarity determining region 3 for antibody 56380
ARDTMVLGVIDY

SEQ ID NO: 112761 - protein, 9 aa, Homo sapiens
  light chain complementarity determining region 3 for antibody 56381
LQDYNYPWT

SEQ ID NO: 112762 - protein, 13 aa, Homo sapiens
  heavy chain complementarity determining region 3 for antibody 56381
ARDRYSGYGAFDY

SEQ ID NO: 112763 - protein, 9 aa, Homo sapiens
  light chain complementarity determining region 3 for antibody 56382
LQDYNYPWT

SEQ ID NO: 112764 - protein, 12 aa, Homo sapiens
  heavy chain complementarity determining region 3 for antibody 56382
ARDARVRGVIDY

SEQ ID NO: 112765 - protein, 9 aa, Homo sapiens
  light chain complementarity determining region 3 for antibody 56383
LQDYNYPWT

SEQ ID NO: 112766 - protein, 12 aa, Homo sapiens
  heavy chain complementarity determining region 3 for antibody 56383
ARDAMVRGAIDY

SEQ ID NO: 112767 - protein, 9 aa, Homo sapiens
  light chain complementarity determining region 3 for antibody 56384
LQDYNYPWT

SEQ ID NO: 112768 - protein, 16 aa, Homo sapiens
  heavy chain complementarity determining region 3 for antibody 56384
ARDAKYYDNLTGYPDY

SEQ ID NO: 112769 - protein, 9 aa, Homo sapiens
  light chain complementarity determining region 3 for antibody 56385
LQDYNYPWT

SEQ ID NO: 112770 - protein, 15 aa, Homo sapiens
  heavy chain complementarity determining region 3 for antibody 56385
ARAPLLLWFGEFIDY

SEQ ID NO: 112771 - protein, 9 aa, Homo sapiens
  light chain complementarity determining region 3 for antibody 56386
LQDYNYPWT

SEQ ID NO: 112772 - protein, 16 aa, Homo sapiens
  heavy chain complementarity determining region 3 for antibody 56386
AGDAKYYDTLTGYPDY

SEQ ID NO: 112773 - protein, 9 aa, Homo sapiens
  light chain complementarity determining region 3 for antibody 56387
LQDYNYPWP

SEQ ID NO: 112774 - protein, 12 aa, Homo sapiens
  heavy chain complementarity determining region 3 for antibody 56387
ARDTMVRGVIDY

SEQ ID NO: 112775 - protein, 9 aa, Homo sapiens
  light chain complementarity determining region 3 for antibody 56388
LQDYNYPRT

SEQ ID NO: 112776 - protein, 10 aa, Homo sapiens
  heavy chain complementarity determining region 3 for antibody 56388
ARGEYSNFDY

SEQ ID NO: 112777 - protein, 9 aa, Homo sapiens
  light chain complementarity determining region 3 for antibody 56389
LQDYNYPRT

SEQ ID NO: 112778 - protein, 12 aa, Homo sapiens
  heavy chain complementarity determining region 3 for antibody 56389
ARDTMVRGVIDY

SEQ ID NO: 112779 - protein, 9 aa, Homo sapiens
  light chain complementarity determining region 3 for antibody 56390
LQDYNYPRT

SEQ ID NO: 112780 - protein, 13 aa, Homo sapiens
  heavy chain complementarity determining region 3 for antibody 56390
ARDRAAGTLYFDY

SEQ ID NO: 112781 - protein, 9 aa, Homo sapiens
  light chain complementarity determining region 3 for antibody 56391
LQDYNYPPT

SEQ ID NO: 112782 - protein, 20 aa, Homo sapiens
  heavy chain complementarity determining region 3 for antibody 56391
ARGGGYYYGSGSYDCYGMDV

SEQ ID NO: 112783 - protein, 9 aa, Homo sapiens
  light chain complementarity determining region 3 for antibody 56392
LQDYNYPLT

SEQ ID NO: 112784 - protein, 17 aa, Homo sapiens
  heavy chain complementarity determining region 3 for antibody 56392
ARDRVGGGYIYYYGMDV

SEQ ID NO: 112785 - protein, 9 aa, Homo sapiens
  light chain complementarity determining region 3 for antibody 56393
LQDYNYPHT

SEQ ID NO: 112786 - protein, 11 aa, Homo sapiens
  heavy chain complementarity determining region 3 for antibody 56393
ARYYYYYGIDV

SEQ ID NO: 112787 - protein, 9 aa, Homo sapiens
  light chain complementarity determining region 3 for antibody 56394
LQDYNYPHT

SEQ ID NO: 112788 - protein, 11 aa, Homo sapiens
  heavy chain complementarity determining region 3 for antibody 56394
ARYYFYYGMDV

SEQ ID NO: 112789 - protein, 9 aa, Homo sapiens
  light chain complementarity determining region 3 for antibody 56395
LQDYNYPFT

SEQ ID NO: 112790 - protein, 15 aa, Homo sapiens
  heavy chain complementarity determining region 3 for antibody 56395
ERAPLLLWFGEFIDY

SEQ ID NO: 112791 - protein, 9 aa, Homo sapiens
  light chain complementarity determining region 3 for antibody 56396
LQDYNYPFT

SEQ ID NO: 112792 - protein, 15 aa, Homo sapiens
  heavy chain complementarity determining region 3 for antibody 56396
ARVPLLLWFGEFIDY

SEQ ID NO: 112793 - protein, 9 aa, Homo sapiens
  light chain complementarity determining region 3 for antibody 56397
LQDYNYPFT

SEQ ID NO: 112794 - protein, 10 aa, Homo sapiens
  heavy chain complementarity determining region 3 for antibody 56397
ARTTTVTFDY

SEQ ID NO: 112795 - protein, 9 aa, Homo sapiens
  light chain complementarity determining region 3 for antibody 56398
LQDYNYPFT

SEQ ID NO: 112796 - protein, 20 aa, Homo sapiens
  heavy chain complementarity determining region 3 for antibody 56398
ARLTITMGRGVIIEDYGMDV

SEQ ID NO: 112797 - protein, 9 aa, Homo sapiens
  light chain complementarity determining region 3 for antibody 56399
LQDYNYPFT

SEQ ID NO: 112798 - protein, 16 aa, Homo sapiens
  heavy chain complementarity determining region 3 for antibody 56399
ARDLASELLRVGYFDY

SEQ ID NO: 112799 - protein, 9 aa, Homo sapiens
  light chain complementarity determining region 3 for antibody 56400
LQDYNYPFT

SEQ ID NO: 112800 - protein, 15 aa, Homo sapiens
  heavy chain complementarity determining region 3 for antibody 56400
ARASLLLWFGEVIDY

SEQ ID NO: 112801 - protein, 9 aa, Homo sapiens
  light chain complementarity determining region 3 for antibody 56401
LQDYNYPFT

SEQ ID NO: 112802 - protein, 15 aa, Homo sapiens
  heavy chain complementarity determining region 3 for antibody 56401
ARAPLLLWFCEFIDY

SEQ ID NO: 112803 - protein, 9 aa, Homo sapiens
  light chain complementarity determining region 3 for antibody 56402
LQDYNYPFT

SEQ ID NO: 112804 - protein, 16 aa, Homo sapiens
  heavy chain complementarity determining region 3 for antibody 56402
AKEGRITVAGTGGMNV

SEQ ID NO: 112805 - protein, 9 aa, Homo sapiens
  light chain complementarity determining region 3 for antibody 56403
LQDYNYLFT

SEQ ID NO: 112806 - protein, 15 aa, Homo sapiens
  heavy chain complementarity determining region 3 for antibody 56403
ARAPLLLWFGEFIDY

SEQ ID NO: 112807 - protein, 9 aa, Homo sapiens
  light chain complementarity determining region 3 for antibody 56404
LQDYKYPFT

SEQ ID NO: 112808 - protein, 15 aa, Homo sapiens
  heavy chain complementarity determining region 3 for antibody 56404
ARAPLLLWFGEFIDY

SEQ ID NO: 112809 - protein, 9 aa, Homo sapiens
  light chain complementarity determining region 3 for antibody 56405
LQDHNYPWT

SEQ ID NO: 112810 - protein, 16 aa, Homo sapiens
  heavy chain complementarity determining region 3 for antibody 56405
ARDAKYYDILTGYPDY

SEQ ID NO: 112811 - protein, 9 aa, Homo sapiens
  light chain complementarity determining region 3 for antibody 56406
LQAYNYPFT

SEQ ID NO: 112812 - protein, 15 aa, Homo sapiens
  heavy chain complementarity determining region 3 for antibody 56406
ARAPLLLWFGEFIDY

SEQ ID NO: 112813 - protein, 9 aa, Homo sapiens
  light chain complementarity determining region 3 for antibody 56407
LLDYNYPHT

SEQ ID NO: 112814 - protein, 11 aa, Homo sapiens
  heavy chain complementarity determining region 3 for antibody 56407
ARYYYYYGMDV

SEQ ID NO: 112815 - protein, 9 aa, Homo sapiens
  light chain complementarity determining region 3 for antibody 56408
HQSSVLPHT

SEQ ID NO: 112816 - protein, 16 aa, Homo sapiens
  heavy chain complementarity determining region 3 for antibody 56408
ARAGWEPPYYYYGMDV

SEQ ID NO: 112817 - protein, 9 aa, Homo sapiens
  light chain complementarity determining region 3 for antibody 56409
HQSSSLPYT

SEQ ID NO: 112818 - protein, 14 aa, Homo sapiens
  heavy chain complementarity determining region 3 for antibody 56409
AREGYSGYDYYFDY

SEQ ID NO: 112819 - protein, 9 aa, Homo sapiens
  light chain complementarity determining region 3 for antibody 56410
HQSSSLPYT

SEQ ID NO: 112820 - protein, 17 aa, Homo sapiens
  heavy chain complementarity determining region 3 for antibody 56410
AREGDILTGYSPFYFDY

SEQ ID NO: 112821 - protein, 9 aa, Homo sapiens
  light chain complementarity determining region 3 for antibody 56411
HQSSSLPYT

SEQ ID NO: 112822 - protein, 17 aa, Homo sapiens
  heavy chain complementarity determining region 3 for antibody 56411
AREGDILTGYSPFHFDY

SEQ ID NO: 112823 - protein, 9 aa, Homo sapiens
  light chain complementarity determining region 3 for antibody 56412
HQSSSLPYT

SEQ ID NO: 112824 - protein, 10 aa, Homo sapiens
  heavy chain complementarity determining region 3 for antibody 56412
ARDGQWLGDY

SEQ ID NO: 112825 - protein, 9 aa, Homo sapiens
  light chain complementarity determining region 3 for antibody 56413
HQSSSLPRT

SEQ ID NO: 112826 - protein, 10 aa, Homo sapiens
  heavy chain complementarity determining region 3 for antibody 56413
ARHGSGSYDY

SEQ ID NO: 112827 - protein, 9 aa, Homo sapiens
  light chain complementarity determining region 3 for antibody 56414
HQSSSLPLT

SEQ ID NO: 112828 - protein, 20 aa, Homo sapiens
  heavy chain complementarity determining region 3 for antibody 56414
ARFCSSTSCYEGYYYYGMDV

SEQ ID NO: 112829 - protein, 9 aa, Homo sapiens
  light chain complementarity determining region 3 for antibody 56415
HQSSSLPLT

SEQ ID NO: 112830 - protein, 15 aa, Homo sapiens
  heavy chain complementarity determining region 3 for antibody 56415
AKGGPPLSYYYGMDV

SEQ ID NO: 112831 - protein, 9 aa, Homo sapiens
  light chain complementarity determining region 3 for antibody 56416
HQSSSLPHT

SEQ ID NO: 112832 - protein, 13 aa, Homo sapiens
  heavy chain complementarity determining region 3 for antibody 56416
ARTAAAAVQYFQH

SEQ ID NO: 112833 - protein, 9 aa, Homo sapiens
  light chain complementarity determining region 3 for antibody 56417
HQSSSLPHT

SEQ ID NO: 112834 - protein, 8 aa, Homo sapiens
  heavy chain complementarity determining region 3 for antibody 56417
ARNWAFDY

SEQ ID NO: 112835 - protein, 9 aa, Homo sapiens
  light chain complementarity determining region 3 for antibody 56418
HQSSSLPHT

SEQ ID NO: 112836 - protein, 13 aa, Homo sapiens
  heavy chain complementarity determining region 3 for antibody 56418
ARIAAAAVQSFQH

SEQ ID NO: 112837 - protein, 9 aa, Homo sapiens
  light chain complementarity determining region 3 for antibody 56419
HQSSSLPHT

SEQ ID NO: 112838 - protein, 8 aa, Homo sapiens
  heavy chain complementarity determining region 3 for antibody 56419
AINWGFDY

SEQ ID NO: 112839 - protein, 9 aa, Homo sapiens
  light chain complementarity determining region 3 for antibody 56420
HQSSSLMYT

SEQ ID NO: 112840 - protein, 21 aa, Homo sapiens
  heavy chain complementarity determining region 3 for antibody 56420
ARDGSDYYDSSGYYYVGAFDI

SEQ ID NO: 112841 - protein, 9 aa, Homo sapiens
  light chain complementarity determining region 3 for antibody 56421
HQSSSLMYT

SEQ ID NO: 112842 - protein, 21 aa, Homo sapiens
  heavy chain complementarity determining region 3 for antibody 56421
ARDGSDYYDRSGYSYVGAFDI

SEQ ID NO: 112843 - protein, 9 aa, Homo sapiens
  light chain complementarity determining region 3 for antibody 56422
HQSNSLPYT

SEQ ID NO: 112844 - protein, 12 aa, Homo sapiens
  heavy chain complementarity determining region 3 for antibody 56422
ARGEYFDWLLDY

SEQ ID NO: 112845 - protein, 9 aa, Homo sapiens
  light chain complementarity determining region 3 for antibody 56423
HQSGSLPHT

SEQ ID NO: 112846 - protein, 16 aa, Homo sapiens
  heavy chain complementarity determining region 3 for antibody 56423
AREGYYGSGSYKDFQH

SEQ ID NO: 112847 - protein, 9 aa, Homo sapiens
  light chain complementarity determining region 3 for antibody 56424
HQLNSYPYT

SEQ ID NO: 112848 - protein, 11 aa, Homo sapiens
  heavy chain complementarity determining region 3 for antibody 56424
ARGIGELGFDY

SEQ ID NO: 112849 - protein, 9 aa, Homo sapiens
  light chain complementarity determining region 3 for antibody 56425
HQFNNYPRT

SEQ ID NO: 112850 - protein, 13 aa, Homo sapiens
  heavy chain complementarity determining region 3 for antibody 56425
ARIAAAAVQYFQH

SEQ ID NO: 112851 - protein, 10 aa, Homo sapiens
  light chain complementarity determining region 3 for antibody 56426
QRRSNWPPLT

SEQ ID NO: 112852 - protein, 18 aa, Homo sapiens
  heavy chain complementarity determining region 3 for antibody 56426
AAERYKVGATYYYYGMDV

SEQ ID NO: 112853 - protein, 9 aa, Homo sapiens
  light chain complementarity determining region 3 for antibody 56427
QRFNNYPRT

SEQ ID NO: 112854 - protein, 8 aa, Homo sapiens
  heavy chain complementarity determining region 3 for antibody 56427
ARTGPLDY

SEQ ID NO: 112855 - protein, 9 aa, Homo sapiens
  light chain complementarity determining region 3 for antibody 56428
QQYYSYPYT

SEQ ID NO: 112856 - protein, 8 aa, Homo sapiens
  heavy chain complementarity determining region 3 for antibody 56428
ARDDGMDV

SEQ ID NO: 112857 - protein, 9 aa, Homo sapiens
  light chain complementarity determining region 3 for antibody 56429
QQYYSYPYA

SEQ ID NO: 112858 - protein, 14 aa, Homo sapiens
  heavy chain complementarity determining region 3 for antibody 56429
AKDWGFGEFNWFDP

SEQ ID NO: 112859 - protein, 9 aa, Homo sapiens
  light chain complementarity determining region 3 for antibody 56430
QQYYSYPFT

SEQ ID NO: 112860 - protein, 19 aa, Homo sapiens
  heavy chain complementarity determining region 3 for antibody 56430
ARDYDILTGYPSYYYGMDV

SEQ ID NO: 112861 - protein, 8 aa, Homo sapiens
  light chain complementarity determining region 3 for antibody 56431
QQYYSTRT

SEQ ID NO: 112862 - protein, 12 aa, Homo sapiens
  heavy chain complementarity determining region 3 for antibody 56431
AYSSSWYKAFDI

SEQ ID NO: 112863 - protein, 9 aa, Homo sapiens
  light chain complementarity determining region 3 for antibody 56432
QQYNSYSYT

SEQ ID NO: 112864 - protein, 14 aa, Homo sapiens
  heavy chain complementarity determining region 3 for antibody 56432
ARHRERSRAFYFDY

SEQ ID NO: 112865 - protein, 9 aa, Homo sapiens
  light chain complementarity determining region 3 for antibody 56433
QQYNSYSWT

SEQ ID NO: 112866 - protein, 8 aa, Homo sapiens
  heavy chain complementarity determining region 3 for antibody 56433
ARGLWSDY

SEQ ID NO: 112867 - protein, 9 aa, Homo sapiens
  light chain complementarity determining region 3 for antibody 56434
QQYNSYPYT

SEQ ID NO: 112868 - protein, 9 aa, Homo sapiens
  heavy chain complementarity determining region 3 for antibody 56434
VRYYYGMDV

SEQ ID NO: 112869 - protein, 9 aa, Homo sapiens
  light chain complementarity determining region 3 for antibody 56435
QQYNSYPYT

SEQ ID NO: 112870 - protein, 11 aa, Homo sapiens
  heavy chain complementarity determining region 3 for antibody 56435
ARSYGDEFFDY

SEQ ID NO: 112871 - protein, 9 aa, Homo sapiens
  light chain complementarity determining region 3 for antibody 56436
QQYNSYPYT

SEQ ID NO: 112872 - protein, 16 aa, Homo sapiens
  heavy chain complementarity determining region 3 for antibody 56436
ARERGNWNPYYYGMDV

SEQ ID NO: 112873 - protein, 9 aa, Homo sapiens
  light chain complementarity determining region 3 for antibody 56437
QQYNSYPYT

SEQ ID NO: 112874 - protein, 14 aa, Homo sapiens
  heavy chain complementarity determining region 3 for antibody 56437
AREGVTMVRGGFDY

SEQ ID NO: 112875 - protein, 9 aa, Homo sapiens
  light chain complementarity determining region 3 for antibody 56438
QQYNSYPYT

SEQ ID NO: 112876 - protein, 14 aa, Homo sapiens
  heavy chain complementarity determining region 3 for antibody 56438
AKEYYDTLTGYLDY

SEQ ID NO: 112877 - protein, 9 aa, Homo sapiens
  light chain complementarity determining region 3 for antibody 56439
QQYNSYPYT

SEQ ID NO: 112878 - protein, 16 aa, Homo sapiens
  heavy chain complementarity determining region 3 for antibody 56439
AGERDNWNPYYYGMDV

SEQ ID NO: 112879 - protein, 9 aa, Homo sapiens
  light chain complementarity determining region 3 for antibody 56440
QQYNSYPWT

SEQ ID NO: 112880 - protein, 14 aa, Homo sapiens
  heavy chain complementarity determining region 3 for antibody 56440
ARVYNWNDGDAFDI

SEQ ID NO: 112881 - protein, 9 aa, Homo sapiens
  light chain complementarity determining region 3 for antibody 56441
QQYNSYPRT

SEQ ID NO: 112882 - protein, 13 aa, Homo sapiens
  heavy chain complementarity determining region 3 for antibody 56441
ERDRYSGYGAFDY

SEQ ID NO: 112883 - protein, 9 aa, Homo sapiens
  light chain complementarity determining region 3 for antibody 56442
QQYNSYPRT

SEQ ID NO: 112884 - protein, 5 aa, Homo sapiens
  heavy chain complementarity determining region 3 for antibody 56442
ASNWG

SEQ ID NO: 112885 - protein, 9 aa, Homo sapiens
  light chain complementarity determining region 3 for antibody 56443
QQYNSYPRT

SEQ ID NO: 112886 - protein, 5 aa, Homo sapiens
  heavy chain complementarity determining region 3 for antibody 56443
ASNSA

SEQ ID NO: 112887 - protein, 9 aa, Homo sapiens
  light chain complementarity determining region 3 for antibody 56444
QQYNSYPRT

SEQ ID NO: 112888 - protein, 16 aa, Homo sapiens
  heavy chain complementarity determining region 3 for antibody 56444
ASLFVDIVVVPAAFDY

SEQ ID NO: 112889 - protein, 9 aa, Homo sapiens
  light chain complementarity determining region 3 for antibody 56445
QQYNSYPRT

SEQ ID NO: 112890 - protein, 17 aa, Homo sapiens
  heavy chain complementarity determining region 3 for antibody 56445
ASGLRYFDWLLSDAFDI

SEQ ID NO: 112891 - protein, 9 aa, Homo sapiens
  light chain complementarity determining region 3 for antibody 56446
QQYNSYPRT

SEQ ID NO: 112892 - protein, 17 aa, Homo sapiens
  heavy chain complementarity determining region 3 for antibody 56446
ASGLRYFDWLFSDAFDI

SEQ ID NO: 112893 - protein, 9 aa, Homo sapiens
  light chain complementarity determining region 3 for antibody 56447
QQYNSYPRT

SEQ ID NO: 112894 - protein, 8 aa, Homo sapiens
  heavy chain complementarity determining region 3 for antibody 56447
ARTGPLDY

SEQ ID NO: 112895 - protein, 9 aa, Homo sapiens
  light chain complementarity determining region 3 for antibody 56448
QQYNSYPRT

SEQ ID NO: 112896 - protein, 5 aa, Homo sapiens
  heavy chain complementarity determining region 3 for antibody 56448
ARNWV

SEQ ID NO: 112897 - protein, 9 aa, Homo sapiens
  light chain complementarity determining region 3 for antibody 56449
QQYNSYPRT

SEQ ID NO: 112898 - protein, 5 aa, Homo sapiens
  heavy chain complementarity determining region 3 for antibody 56449
ARNWE

SEQ ID NO: 112899 - protein, 9 aa, Homo sapiens
  light chain complementarity determining region 3 for antibody 56450
QQYNSYPRT

SEQ ID NO: 112900 - protein, 5 aa, Homo sapiens
  heavy chain complementarity determining region 3 for antibody 56450
ARNCG

SEQ ID NO: 112901 - protein, 9 aa, Homo sapiens
  light chain complementarity determining region 3 for antibody 56451
QQYNSYPRT

SEQ ID NO: 112902 - protein, 17 aa, Homo sapiens
  heavy chain complementarity determining region 3 for antibody 56451
ARGLRYLDWLLSDAFDI

SEQ ID NO: 112903 - protein, 9 aa, Homo sapiens
  light chain complementarity determining region 3 for antibody 56452
QQYNSYPRT

SEQ ID NO: 112904 - protein, 17 aa, Homo sapiens
  heavy chain complementarity determining region 3 for antibody 56452
ARGLRYIDWLLSDAFDI

SEQ ID NO: 112905 - protein, 9 aa, Homo sapiens
  light chain complementarity determining region 3 for antibody 56453
QQYNSYPRT

SEQ ID NO: 112906 - protein, 17 aa, Homo sapiens
  heavy chain complementarity determining region 3 for antibody 56453
ARGLRYFVWSLSDAFDI

SEQ ID NO: 112907 - protein, 9 aa, Homo sapiens
  light chain complementarity determining region 3 for antibody 56454
QQYNSYPRT

SEQ ID NO: 112908 - protein, 17 aa, Homo sapiens
  heavy chain complementarity determining region 3 for antibody 56454
ARGLRYFVWLLSEAFDI

SEQ ID NO: 112909 - protein, 9 aa, Homo sapiens
  light chain complementarity determining region 3 for antibody 56455
QQYNSYPRT

SEQ ID NO: 112910 - protein, 17 aa, Homo sapiens
  heavy chain complementarity determining region 3 for antibody 56455
ARGLRYFDWSLSDAIDI

SEQ ID NO: 112911 - protein, 9 aa, Homo sapiens
  light chain complementarity determining region 3 for antibody 56456
QQYNSYPRT

SEQ ID NO: 112912 - protein, 17 aa, Homo sapiens
  heavy chain complementarity determining region 3 for antibody 56456
ARGLRYFDWSFSDAFDI

SEQ ID NO: 112913 - protein, 9 aa, Homo sapiens
  light chain complementarity determining region 3 for antibody 56457
QQYNSYPRT

SEQ ID NO: 112914 - protein, 17 aa, Homo sapiens
  heavy chain complementarity determining region 3 for antibody 56457
ARGLRYFDWLVSDAFDI

SEQ ID NO: 112915 - protein, 9 aa, Homo sapiens
  light chain complementarity determining region 3 for antibody 56458
QQYNSYPRT

SEQ ID NO: 112916 - protein, 17 aa, Homo sapiens
  heavy chain complementarity determining region 3 for antibody 56458
ARGLRYFDWLLSYAFDI

SEQ ID NO: 112917 - protein, 9 aa, Homo sapiens
  light chain complementarity determining region 3 for antibody 56459
QQYNSYPRT

SEQ ID NO: 112918 - protein, 17 aa, Homo sapiens
  heavy chain complementarity determining region 3 for antibody 56459
ARGLRYFDLSLSDAFDI

SEQ ID NO: 112919 - protein, 9 aa, Homo sapiens
  light chain complementarity determining region 3 for antibody 56460
QQYNSYPRT

SEQ ID NO: 112920 - protein, 17 aa, Homo sapiens
  heavy chain complementarity determining region 3 for antibody 56460
ARGLRDFDLLLSDAFDI

SEQ ID NO: 112921 - protein, 9 aa, Homo sapiens
  light chain complementarity determining region 3 for antibody 56461
QQYNSYPRT

SEQ ID NO: 112922 - protein, 17 aa, Homo sapiens
  heavy chain complementarity determining region 3 for antibody 56461
ARGLRCFDWLLSDAFDI

SEQ ID NO: 112923 - protein, 9 aa, Homo sapiens
  light chain complementarity determining region 3 for antibody 56462
QQYNSYPRT

SEQ ID NO: 112924 - protein, 13 aa, Homo sapiens
  heavy chain complementarity determining region 3 for antibody 56462
ARERYSGYGAFDY

SEQ ID NO: 112925 - protein, 9 aa, Homo sapiens
  light chain complementarity determining region 3 for antibody 56463
QQYNSYPRT

SEQ ID NO: 112926 - protein, 13 aa, Homo sapiens
  heavy chain complementarity determining region 3 for antibody 56463
ARDRYSVYGAFDY

SEQ ID NO: 112927 - protein, 9 aa, Homo sapiens
  light chain complementarity determining region 3 for antibody 56464
QQYNSYPRT

SEQ ID NO: 112928 - protein, 13 aa, Homo sapiens
  heavy chain complementarity determining region 3 for antibody 56464
ARDRYSRYGAFDY

SEQ ID NO: 112929 - protein, 9 aa, Homo sapiens
  light chain complementarity determining region 3 for antibody 56465
QQYNSYPRT

SEQ ID NO: 112930 - protein, 13 aa, Homo sapiens
  heavy chain complementarity determining region 3 for antibody 56465
ARDRYSGYGAIDY

SEQ ID NO: 112931 - protein, 9 aa, Homo sapiens
  light chain complementarity determining region 3 for antibody 56466
QQYNSYPRT

SEQ ID NO: 112932 - protein, 13 aa, Homo sapiens
  heavy chain complementarity determining region 3 for antibody 56466
ARDRYSGYGAFDF

SEQ ID NO: 112933 - protein, 9 aa, Homo sapiens
  light chain complementarity determining region 3 for antibody 56467
QQYNSYPRT

SEQ ID NO: 112934 - protein, 13 aa, Homo sapiens
  heavy chain complementarity determining region 3 for antibody 56467
ARDRYRGYGAFDY

SEQ ID NO: 112935 - protein, 9 aa, Homo sapiens
  light chain complementarity determining region 3 for antibody 56468
QQYNSYPRT

SEQ ID NO: 112936 - protein, 10 aa, Homo sapiens
  heavy chain complementarity determining region 3 for antibody 56468
ARDKGYYIDY

SEQ ID NO: 112937 - protein, 9 aa, Homo sapiens
  light chain complementarity determining region 3 for antibody 56469
QQYNSYPRT

SEQ ID NO: 112938 - protein, 10 aa, Homo sapiens
  heavy chain complementarity determining region 3 for antibody 56469
ARDKGYSFDY

SEQ ID NO: 112939 - protein, 9 aa, Homo sapiens
  light chain complementarity determining region 3 for antibody 56470
QQYNSYPRT

SEQ ID NO: 112940 - protein, 13 aa, Homo sapiens
  heavy chain complementarity determining region 3 for antibody 56470
ARDKDSTQPWLGY

SEQ ID NO: 112941 - protein, 9 aa, Homo sapiens
  light chain complementarity determining region 3 for antibody 56471
QQYNSYPRT

SEQ ID NO: 112942 - protein, 13 aa, Homo sapiens
  heavy chain complementarity determining region 3 for antibody 56471
ARDKDSTQPWLAY

SEQ ID NO: 112943 - protein, 9 aa, Homo sapiens
  light chain complementarity determining region 3 for antibody 56472
QQYNSYPRT

SEQ ID NO: 112944 - protein, 13 aa, Homo sapiens
  heavy chain complementarity determining region 3 for antibody 56472
ARDKDSTQLWLDY

SEQ ID NO: 112945 - protein, 9 aa, Homo sapiens
  light chain complementarity determining region 3 for antibody 56473
QQYNSYPRT

SEQ ID NO: 112946 - protein, 13 aa, Homo sapiens
  heavy chain complementarity determining region 3 for antibody 56473
ARDKDSTQLCLGY

SEQ ID NO: 112947 - protein, 9 aa, Homo sapiens
  light chain complementarity determining region 3 for antibody 56474
QQYNSYPRT

SEQ ID NO: 112948 - protein, 13 aa, Homo sapiens
  heavy chain complementarity determining region 3 for antibody 56474
ARDKDSTQLCLAY

SEQ ID NO: 112949 - protein, 9 aa, Homo sapiens
  light chain complementarity determining region 3 for antibody 56475
QQYNSYPRT

SEQ ID NO: 112950 - protein, 13 aa, Homo sapiens
  heavy chain complementarity determining region 3 for antibody 56475
ARDKDSIQLWLGY

SEQ ID NO: 112951 - protein, 9 aa, Homo sapiens
  light chain complementarity determining region 3 for antibody 56476
QQYNSYPRT

SEQ ID NO: 112952 - protein, 9 aa, Homo sapiens
  heavy chain complementarity determining region 3 for antibody 56476
ARDGLGIDY

SEQ ID NO: 112953 - protein, 9 aa, Homo sapiens
  light chain complementarity determining region 3 for antibody 56477
QQYNSYPRT

SEQ ID NO: 112954 - protein, 15 aa, Homo sapiens
  heavy chain complementarity determining region 3 for antibody 56477
AKDHDTSYYYYGMDV

SEQ ID NO: 112955 - protein, 9 aa, Homo sapiens
  light chain complementarity determining region 3 for antibody 56478
QQYNSYPRT

SEQ ID NO: 112956 - protein, 13 aa, Homo sapiens
  heavy chain complementarity determining region 3 for antibody 56478
AGDRYSGYGAFDY

SEQ ID NO: 112957 - protein, 9 aa, Homo sapiens
  light chain complementarity determining region 3 for antibody 56479
QQYNSYPRT

SEQ ID NO: 112958 - protein, 13 aa, Homo sapiens
  heavy chain complementarity determining region 3 for antibody 56479
AGDKDSTQLWLGY

SEQ ID NO: 112959 - protein, 9 aa, Homo sapiens
  light chain complementarity determining region 3 for antibody 56480
QQYNSYPRT

SEQ ID NO: 112960 - protein, 13 aa, Homo sapiens
  heavy chain complementarity determining region 3 for antibody 56480
AGDKDSTQLWLAY

SEQ ID NO: 112961 - protein, 9 aa, Homo sapiens
  light chain complementarity determining region 3 for antibody 56481
QQYNSYPRM

SEQ ID NO: 112962 - protein, 13 aa, Homo sapiens
  heavy chain complementarity determining region 3 for antibody 56481
ARDRYSGYGAFDY

SEQ ID NO: 112963 - protein, 9 aa, Homo sapiens
  light chain complementarity determining region 3 for antibody 56482
QQYNSYPLT

SEQ ID NO: 112964 - protein, 16 aa, Homo sapiens
  heavy chain complementarity determining region 3 for antibody 56482
ARGGWELYYYYYGMDV

SEQ ID NO: 112965 - protein, 9 aa, Homo sapiens
  light chain complementarity determining region 3 for antibody 56483
QQYNSYPLT

SEQ ID NO: 112966 - protein, 14 aa, Homo sapiens
  heavy chain complementarity determining region 3 for antibody 56483
ARDHYGSGEHSFDY

SEQ ID NO: 112967 - protein, 9 aa, Homo sapiens
  light chain complementarity determining region 3 for antibody 56484
QQYNSYPLT

SEQ ID NO: 112968 - protein, 15 aa, Homo sapiens
  heavy chain complementarity determining region 3 for antibody 56484
AKTYYYGSGSSHFDY

SEQ ID NO: 112969 - protein, 9 aa, Homo sapiens
  light chain complementarity determining region 3 for antibody 56485
QQYNSYPFT

SEQ ID NO: 112970 - protein, 12 aa, Homo sapiens
  heavy chain complementarity determining region 3 for antibody 56485
TRLRYSSGCYDY

SEQ ID NO: 112971 - protein, 9 aa, Homo sapiens
  light chain complementarity determining region 3 for antibody 56486
QQYNSYPFT

SEQ ID NO: 112972 - protein, 15 aa, Homo sapiens
  heavy chain complementarity determining region 3 for antibody 56486
ASHVFRYFDWRGMDV

SEQ ID NO: 112973 - protein, 9 aa, Homo sapiens
  light chain complementarity determining region 3 for antibody 56487
QQYNSYPFT

SEQ ID NO: 112974 - protein, 13 aa, Homo sapiens
  heavy chain complementarity determining region 3 for antibody 56487
ARYSSSWYDAFDI

SEQ ID NO: 112975 - protein, 9 aa, Homo sapiens
  light chain complementarity determining region 3 for antibody 56488
QQYNSYPFT

SEQ ID NO: 112976 - protein, 9 aa, Homo sapiens
  heavy chain complementarity determining region 3 for antibody 56488
ARGPYGMDV

SEQ ID NO: 112977 - protein, 9 aa, Homo sapiens
  light chain complementarity determining region 3 for antibody 56489
QQYNSYPFT

SEQ ID NO: 112978 - protein, 16 aa, Homo sapiens
  heavy chain complementarity determining region 3 for antibody 56489
ARDYYDSSGYWAHFDY

SEQ ID NO: 112979 - protein, 9 aa, Homo sapiens
  light chain complementarity determining region 3 for antibody 56490
QQYNSYPFT

SEQ ID NO: 112980 - protein, 9 aa, Homo sapiens
  heavy chain complementarity determining region 3 for antibody 56490
ARDISGFDY

SEQ ID NO: 112981 - protein, 9 aa, Homo sapiens
  light chain complementarity determining region 3 for antibody 56491
QQYNSYPFT

SEQ ID NO: 112982 - protein, 17 aa, Homo sapiens
  heavy chain complementarity determining region 3 for antibody 56491
ARDGRGVIDYYYDGMDV

SEQ ID NO: 112983 - protein, 9 aa, Homo sapiens
  light chain complementarity determining region 3 for antibody 56492
QQYNSYPFT

SEQ ID NO: 112984 - protein, 15 aa, Homo sapiens
  heavy chain complementarity determining region 3 for antibody 56492
ARAPLLLWFGEFIDY

SEQ ID NO: 112985 - protein, 9 aa, Homo sapiens
  light chain complementarity determining region 3 for antibody 56493
QQYNSYPFT

SEQ ID NO: 112986 - protein, 14 aa, Homo sapiens
  heavy chain complementarity determining region 3 for antibody 56493
AGDRTAAGTWPFDY

SEQ ID NO: 112987 - protein, 9 aa, Homo sapiens
  light chain complementarity determining region 3 for antibody 56494
QQYNSWPRT

SEQ ID NO: 112988 - protein, 13 aa, Homo sapiens
  heavy chain complementarity determining region 3 for antibody 56494
AKALITVVTFFDY

SEQ ID NO: 112989 - protein, 9 aa, Homo sapiens
  light chain complementarity determining region 3 for antibody 56495
QQYNSFPYT

SEQ ID NO: 112990 - protein, 14 aa, Homo sapiens
  heavy chain complementarity determining region 3 for antibody 56495
AREASGTYWEYFDY

SEQ ID NO: 112991 - protein, 9 aa, Homo sapiens
  light chain complementarity determining region 3 for antibody 56496
QQYNSAPLT

SEQ ID NO: 112992 - protein, 8 aa, Homo sapiens
  heavy chain complementarity determining region 3 for antibody 56496
ARSGPLDY

SEQ ID NO: 112993 - protein, 9 aa, Homo sapiens
  light chain complementarity determining region 3 for antibody 56497
QQYNNYPYT

SEQ ID NO: 112994 - protein, 17 aa, Homo sapiens
  heavy chain complementarity determining region 3 for antibody 56497
ARDGRGVIDYYYYGMAV

SEQ ID NO: 112995 - protein, 9 aa, Homo sapiens
  light chain complementarity determining region 3 for antibody 56498
QQYNNWPRT

SEQ ID NO: 112996 - protein, 12 aa, Homo sapiens
  heavy chain complementarity determining region 3 for antibody 56498
AREWEPGTTRDY

SEQ ID NO: 112997 - protein, 10 aa, Homo sapiens
  light chain complementarity determining region 3 for antibody 56499
QQYNNWPPYT

SEQ ID NO: 112998 - protein, 12 aa, Homo sapiens
  heavy chain complementarity determining region 3 for antibody 56499
ARHLVRGVFFDY

SEQ ID NO: 112999 - protein, 9 aa, Homo sapiens
  light chain complementarity determining region 3 for antibody 56500
QQYNNWPFT

SEQ ID NO: 113000 - protein, 18 aa, Homo sapiens
  heavy chain complementarity determining region 3 for antibody 56500
AGGVLYDILTGYPGYFDL

SEQ ID NO: 113001 - protein, 9 aa, Homo sapiens
  light chain complementarity determining region 3 for antibody 56501
QQYNNLPLT

SEQ ID NO: 113002 - protein, 16 aa, Homo sapiens
  heavy chain complementarity determining region 3 for antibody 56501
ARDAKYYDILTGYPDY

SEQ ID NO: 113003 - protein, 9 aa, Homo sapiens
  light chain complementarity determining region 3 for antibody 56502
QQYGSSPWT

SEQ ID NO: 113004 - protein, 16 aa, Homo sapiens
  heavy chain complementarity determining region 3 for antibody 56502
ARVITMVRGVPDAFDI

SEQ ID NO: 113005 - protein, 9 aa, Homo sapiens
  light chain complementarity determining region 3 for antibody 56503
QQYGSSPWT

SEQ ID NO: 113006 - protein, 13 aa, Homo sapiens
  heavy chain complementarity determining region 3 for antibody 56503
ARGRYFDWFLFDY

SEQ ID NO: 113007 - protein, 10 aa, Homo sapiens
  light chain complementarity determining region 3 for antibody 56504
QQYGSSPPYT

SEQ ID NO: 113008 - protein, 12 aa, Homo sapiens
  heavy chain complementarity determining region 3 for antibody 56504
ARVGGGYSFFDF

SEQ ID NO: 113009 - protein, 10 aa, Homo sapiens
  light chain complementarity determining region 3 for antibody 56505
QQYGSSPMYT

SEQ ID NO: 113010 - protein, 14 aa, Homo sapiens
  heavy chain complementarity determining region 3 for antibody 56505
AREGFRGYSYGMDV

SEQ ID NO: 113011 - protein, 10 aa, Homo sapiens
  light chain complementarity determining region 3 for antibody 56506
QQYGSSPMYT

SEQ ID NO: 113012 - protein, 14 aa, Homo sapiens
  heavy chain complementarity determining region 3 for antibody 56506
AREGFRCYYYGMDV

SEQ ID NO: 113013 - protein, 9 aa, Homo sapiens
  light chain complementarity determining region 3 for antibody 56507
QQYGSSPFT

SEQ ID NO: 113014 - protein, 14 aa, Homo sapiens
  heavy chain complementarity determining region 3 for antibody 56507
ARDGRITLVRGVDY

SEQ ID NO: 113015 - protein, 8 aa, Homo sapiens
  light chain complementarity determining region 3 for antibody 56508
QQYGSSFT

SEQ ID NO: 113016 - protein, 13 aa, Homo sapiens
  heavy chain complementarity determining region 3 for antibody 56508
ARYSSTWYDAFDI

SEQ ID NO: 113017 - protein, 8 aa, Homo sapiens
  light chain complementarity determining region 3 for antibody 56509
QQYGSSFT

SEQ ID NO: 113018 - protein, 13 aa, Homo sapiens
  heavy chain complementarity determining region 3 for antibody 56509
ARYSSSWYEAFDI

SEQ ID NO: 113019 - protein, 8 aa, Homo sapiens
  light chain complementarity determining region 3 for antibody 56510
QQYGSSFT

SEQ ID NO: 113020 - protein, 13 aa, Homo sapiens
  heavy chain complementarity determining region 3 for antibody 56510
ARYSSSWYDAIDI

SEQ ID NO: 113021 - protein, 8 aa, Homo sapiens
  light chain complementarity determining region 3 for antibody 56511
QQYGSSFT

SEQ ID NO: 113022 - protein, 13 aa, Homo sapiens
  heavy chain complementarity determining region 3 for antibody 56511
ARYSSSWYDAFDL

SEQ ID NO: 113023 - protein, 8 aa, Homo sapiens
  light chain complementarity determining region 3 for antibody 56512
QQYGSSFT

SEQ ID NO: 113024 - protein, 24 aa, Homo sapiens
  heavy chain complementarity determining region 3 for antibody 56512
AREWEGNYGSGSYYKSAYYYGMDV

SEQ ID NO: 113025 - protein, 8 aa, Homo sapiens
  light chain complementarity determining region 3 for antibody 56513
QQYGSSFT

SEQ ID NO: 113026 - protein, 11 aa, Homo sapiens
  heavy chain complementarity determining region 3 for antibody 56513
ARDRILKGMAV

SEQ ID NO: 113027 - protein, 8 aa, Homo sapiens
  light chain complementarity determining region 3 for antibody 56514
QQYGSSFT

SEQ ID NO: 113028 - protein, 13 aa, Homo sapiens
  heavy chain complementarity determining region 3 for antibody 56514
AKYSSSWYDAFDI

SEQ ID NO: 113029 - protein, 8 aa, Homo sapiens
  light chain complementarity determining region 3 for antibody 56515
QQYGRSYT

SEQ ID NO: 113030 - protein, 15 aa, Homo sapiens
  heavy chain complementarity determining region 3 for antibody 56515
ARVLRYFDWLFPFDY

SEQ ID NO: 113031 - protein, 9 aa, Homo sapiens
  light chain complementarity determining region 3 for antibody 56516
QQYGRSPYT

SEQ ID NO: 113032 - protein, 16 aa, Homo sapiens
  heavy chain complementarity determining region 3 for antibody 56516
AREGLWFGELYDAFDI

SEQ ID NO: 113033 - protein, 9 aa, Homo sapiens
  light chain complementarity determining region 3 for antibody 56517
QQYDNLPYT

SEQ ID NO: 113034 - protein, 12 aa, Homo sapiens
  heavy chain complementarity determining region 3 for antibody 56517
ARAVAGYWYFDL

SEQ ID NO: 113035 - protein, 9 aa, Homo sapiens
  light chain complementarity determining region 3 for antibody 56518
QQYDNLPLT

SEQ ID NO: 113036 - protein, 16 aa, Homo sapiens
  heavy chain complementarity determining region 3 for antibody 56518
AWDAKYYDILTGYPDY

SEQ ID NO: 113037 - protein, 9 aa, Homo sapiens
  light chain complementarity determining region 3 for antibody 56519
QQYDNLPLT

SEQ ID NO: 113038 - protein, 13 aa, Homo sapiens
  heavy chain complementarity determining region 3 for antibody 56519
ARYSSSWYDAFDI

SEQ ID NO: 113039 - protein, 9 aa, Homo sapiens
  light chain complementarity determining region 3 for antibody 56520
QQYDNLPLT

SEQ ID NO: 113040 - protein, 13 aa, Homo sapiens
  heavy chain complementarity determining region 3 for antibody 56520
ARIAAAAVQYFQH

SEQ ID NO: 113041 - protein, 9 aa, Homo sapiens
  light chain complementarity determining region 3 for antibody 56521
QQYDNLPLT

SEQ ID NO: 113042 - protein, 11 aa, Homo sapiens
  heavy chain complementarity determining region 3 for antibody 56521
AREGCSYGFDY

SEQ ID NO: 113043 - protein, 9 aa, Homo sapiens
  light chain complementarity determining region 3 for antibody 56522
QQYDNLPLT

SEQ ID NO: 113044 - protein, 16 aa, Homo sapiens
  heavy chain complementarity determining region 3 for antibody 56522
ARDEKYYDILTGYPDY

SEQ ID NO: 113045 - protein, 9 aa, Homo sapiens
  light chain complementarity determining region 3 for antibody 56523
QQYDNLPLT

SEQ ID NO: 113046 - protein, 16 aa, Homo sapiens
  heavy chain complementarity determining region 3 for antibody 56523
ARDAQYYDILTGYPDY

SEQ ID NO: 113047 - protein, 9 aa, Homo sapiens
  light chain complementarity determining region 3 for antibody 56524
QQYDNLPLT

SEQ ID NO: 113048 - protein, 16 aa, Homo sapiens
  heavy chain complementarity determining region 3 for antibody 56524
ARDAKYYGILTGYPDY

SEQ ID NO: 113049 - protein, 9 aa, Homo sapiens
  light chain complementarity determining region 3 for antibody 56525
QQYDNLPLT

SEQ ID NO: 113050 - protein, 16 aa, Homo sapiens
  heavy chain complementarity determining region 3 for antibody 56525
ARDAKYYDTLSGYPDY

SEQ ID NO: 113051 - protein, 9 aa, Homo sapiens
  light chain complementarity determining region 3 for antibody 56526
QQYDNLPLT

SEQ ID NO: 113052 - protein, 16 aa, Homo sapiens
  heavy chain complementarity determining region 3 for antibody 56526
ARDAKYYDSLTGSPDY

SEQ ID NO: 113053 - protein, 9 aa, Homo sapiens
  light chain complementarity determining region 3 for antibody 56527
QQYDNLPLT

SEQ ID NO: 113054 - protein, 16 aa, Homo sapiens
  heavy chain complementarity determining region 3 for antibody 56527
ARDAKYYDILTGYPEY

SEQ ID NO: 113055 - protein, 9 aa, Homo sapiens
  light chain complementarity determining region 3 for antibody 56528
QQYDNLPLT

SEQ ID NO: 113056 - protein, 16 aa, Homo sapiens
  heavy chain complementarity determining region 3 for antibody 56528
ARDAKYYDILTGYLDY

SEQ ID NO: 113057 - protein, 9 aa, Homo sapiens
  light chain complementarity determining region 3 for antibody 56529
QQYDNLPLT

SEQ ID NO: 113058 - protein, 16 aa, Homo sapiens
  heavy chain complementarity determining region 3 for antibody 56529
ARDAKYYDILTGCPDY

SEQ ID NO: 113059 - protein, 9 aa, Homo sapiens
  light chain complementarity determining region 3 for antibody 56530
QQYDNLPLT

SEQ ID NO: 113060 - protein, 16 aa, Homo sapiens
  heavy chain complementarity determining region 3 for antibody 56530
ARDAKYYDILTCYPDY

SEQ ID NO: 113061 - protein, 9 aa, Homo sapiens
  light chain complementarity determining region 3 for antibody 56531
QQYDNLPLT

SEQ ID NO: 113062 - protein, 16 aa, Homo sapiens
  heavy chain complementarity determining region 3 for antibody 56531
ARDAKYCDILTGYPDY

SEQ ID NO: 113063 - protein, 9 aa, Homo sapiens
  light chain complementarity determining region 3 for antibody 56532
QQYDNLPLT

SEQ ID NO: 113064 - protein, 16 aa, Homo sapiens
  heavy chain complementarity determining region 3 for antibody 56532
ARDAKSYDILTGYPDY

SEQ ID NO: 113065 - protein, 9 aa, Homo sapiens
  light chain complementarity determining region 3 for antibody 56533
QQYDNLPLT

SEQ ID NO: 113066 - protein, 16 aa, Homo sapiens
  heavy chain complementarity determining region 3 for antibody 56533
AGDAKYYDSLTGYPDY

SEQ ID NO: 113067 - protein, 9 aa, Homo sapiens
  light chain complementarity determining region 3 for antibody 56534
QQYDNLPLT

SEQ ID NO: 113068 - protein, 16 aa, Homo sapiens
  heavy chain complementarity determining region 3 for antibody 56534
AGDAKYYDMLTGYPDY

SEQ ID NO: 113069 - protein, 9 aa, Homo sapiens
  light chain complementarity determining region 3 for antibody 56535
QQYDNLPLT

SEQ ID NO: 113070 - protein, 16 aa, Homo sapiens
  heavy chain complementarity determining region 3 for antibody 56535
AGDAEYYDILTGYPDY

SEQ ID NO: 113071 - protein, 9 aa, Homo sapiens
  light chain complementarity determining region 3 for antibody 56536
QQYDNLPLN

SEQ ID NO: 113072 - protein, 16 aa, Homo sapiens
  heavy chain complementarity determining region 3 for antibody 56536
ARDAKYYDILTGYPDY

SEQ ID NO: 113073 - protein, 9 aa, Homo sapiens
  light chain complementarity determining region 3 for antibody 56537
QQYDDLPLT

SEQ ID NO: 113074 - protein, 16 aa, Homo sapiens
  heavy chain complementarity determining region 3 for antibody 56537
ARDAKYYDTLTGYPDY

SEQ ID NO: 113075 - protein, 9 aa, Homo sapiens
  light chain complementarity determining region 3 for antibody 56538
QQWSSNPLT

SEQ ID NO: 113076 - protein, 11 aa, Homo sapiens
  heavy chain complementarity determining region 3 for antibody 56538
TRGGLWGAMDY

SEQ ID NO: 113077 - protein, 9 aa, Homo sapiens
  light chain complementarity determining region 3 for antibody 56539
QQVNSYPYT

SEQ ID NO: 113078 - protein, 9 aa, Homo sapiens
  heavy chain complementarity determining region 3 for antibody 56539
ARKRWYFDF

SEQ ID NO: 113079 - protein, 9 aa, Homo sapiens
  light chain complementarity determining region 3 for antibody 56540
QQSYSTPYT

SEQ ID NO: 113080 - protein, 16 aa, Homo sapiens
  heavy chain complementarity determining region 3 for antibody 56540
ARQYGSGSYYKDYFDY

SEQ ID NO: 113081 - protein, 9 aa, Homo sapiens
  light chain complementarity determining region 3 for antibody 56541
QQSYSTPWT

SEQ ID NO: 113082 - protein, 15 aa, Homo sapiens
  heavy chain complementarity determining region 3 for antibody 56541
ARHKREAPGSWYFDL

SEQ ID NO: 113083 - protein, 9 aa, Homo sapiens
  light chain complementarity determining region 3 for antibody 56542
QQSYSTPWT

SEQ ID NO: 113084 - protein, 11 aa, Homo sapiens
  heavy chain complementarity determining region 3 for antibody 56542
ARDELVLRYSD

SEQ ID NO: 113085 - protein, 9 aa, Homo sapiens
  light chain complementarity determining region 3 for antibody 56543
QQSYSTPWT

SEQ ID NO: 113086 - protein, 11 aa, Homo sapiens
  heavy chain complementarity determining region 3 for antibody 56543
ARDEHVLRYLD

SEQ ID NO: 113087 - protein, 9 aa, Homo sapiens
  light chain complementarity determining region 3 for antibody 56544
QQSYSTPWT

SEQ ID NO: 113088 - protein, 11 aa, Homo sapiens
  heavy chain complementarity determining region 3 for antibody 56544
ARDEHVLRYCD

SEQ ID NO: 113089 - protein, 9 aa, Homo sapiens
  light chain complementarity determining region 3 for antibody 56545
QQSYSTPRT

SEQ ID NO: 113090 - protein, 20 aa, Homo sapiens
  heavy chain complementarity determining region 3 for antibody 56545
ARAPSYYNILTGYSYDAFDI

SEQ ID NO: 113091 - protein, 9 aa, Homo sapiens
  light chain complementarity determining region 3 for antibody 56546
QQSYSTPRT

SEQ ID NO: 113092 - protein, 20 aa, Homo sapiens
  heavy chain complementarity determining region 3 for antibody 56546
ARAPSYYDMLTGYSYDAFDI

SEQ ID NO: 113093 - protein, 9 aa, Homo sapiens
  light chain complementarity determining region 3 for antibody 56547
QQSYSTPRT

SEQ ID NO: 113094 - protein, 20 aa, Homo sapiens
  heavy chain complementarity determining region 3 for antibody 56547
ARAPSYYDILTGSSYDAFDI

SEQ ID NO: 113095 - protein, 9 aa, Homo sapiens
  light chain complementarity determining region 3 for antibody 56548
QQSYSTPPT

SEQ ID NO: 113096 - protein, 19 aa, Homo sapiens
  heavy chain complementarity determining region 3 for antibody 56548
ASFYYGSGSFYYYYYGLDV

SEQ ID NO: 113097 - protein, 9 aa, Homo sapiens
  light chain complementarity determining region 3 for antibody 56549
QQSYSTPPT

SEQ ID NO: 113098 - protein, 8 aa, Homo sapiens
  heavy chain complementarity determining region 3 for antibody 56549
ARTGPLDY

SEQ ID NO: 113099 - protein, 9 aa, Homo sapiens
  light chain complementarity determining region 3 for antibody 56550
QQSYSTPLT

SEQ ID NO: 113100 - protein, 24 aa, Homo sapiens
  heavy chain complementarity determining region 3 for antibody 56550
ARGGGYYGSGSYYNVLYYYYGMDV

SEQ ID NO: 113101 - protein, 9 aa, Homo sapiens
  light chain complementarity determining region 3 for antibody 56551
QQSYSTPLT

SEQ ID NO: 113102 - protein, 15 aa, Homo sapiens
  heavy chain complementarity determining region 3 for antibody 56551
AKDFSSGWPHWYFDL

SEQ ID NO: 113103 - protein, 9 aa, Homo sapiens
  light chain complementarity determining region 3 for antibody 56552
QQRYSTPRT

SEQ ID NO: 113104 - protein, 20 aa, Homo sapiens
  heavy chain complementarity determining region 3 for antibody 56552
ARAPSYYDILTGYSYDAFDI

SEQ ID NO: 113105 - protein, 9 aa, Homo sapiens
  light chain complementarity determining region 3 for antibody 56553
QQRSSWPLT

SEQ ID NO: 113106 - protein, 18 aa, Homo sapiens
  heavy chain complementarity determining region 3 for antibody 56553
ARETYYDILTGYYGAFDI

SEQ ID NO: 113107 - protein, 8 aa, Homo sapiens
  light chain complementarity determining region 3 for antibody 56554
QQRSNWYT

SEQ ID NO: 113108 - protein, 11 aa, Homo sapiens
  heavy chain complementarity determining region 3 for antibody 56554
ARDLRNSYGYY

SEQ ID NO: 113109 - protein, 9 aa, Homo sapiens
  light chain complementarity determining region 3 for antibody 56555
QQRSNWPPT

SEQ ID NO: 113110 - protein, 14 aa, Homo sapiens
  heavy chain complementarity determining region 3 for antibody 56555
AKDWGFGEFNWFDP

SEQ ID NO: 113111 - protein, 10 aa, Homo sapiens
  light chain complementarity determining region 3 for antibody 56556
QQRSNWPPLT

SEQ ID NO: 113112 - protein, 6 aa, Homo sapiens
  heavy chain complementarity determining region 3 for antibody 56556
YYGMDV

SEQ ID NO: 113113 - protein, 10 aa, Homo sapiens
  light chain complementarity determining region 3 for antibody 56557
QQRSNWPPLT

SEQ ID NO: 113114 - protein, 6 aa, Homo sapiens
  heavy chain complementarity determining region 3 for antibody 56557
SYGMDV

SEQ ID NO: 113115 - protein, 10 aa, Homo sapiens
  light chain complementarity determining region 3 for antibody 56558
QQRSNWPPLT

SEQ ID NO: 113116 - protein, 19 aa, Homo sapiens
  heavy chain complementarity determining region 3 for antibody 56558
ATESYKVGATYYYYYGMDV

SEQ ID NO: 113117 - protein, 10 aa, Homo sapiens
  light chain complementarity determining region 3 for antibody 56559
QQRSNWPPLT

SEQ ID NO: 113118 - protein, 19 aa, Homo sapiens
  heavy chain complementarity determining region 3 for antibody 56559
ATERYKVGATYYYYYGMDF

SEQ ID NO: 113119 - protein, 10 aa, Homo sapiens
  light chain complementarity determining region 3 for antibody 56560
QQRSNWPPLT

SEQ ID NO: 113120 - protein, 19 aa, Homo sapiens
  heavy chain complementarity determining region 3 for antibody 56560
ATERYKVGATYYYYCGMDV

SEQ ID NO: 113121 - protein, 10 aa, Homo sapiens
  light chain complementarity determining region 3 for antibody 56561
QQRSNWPPLT

SEQ ID NO: 113122 - protein, 18 aa, Homo sapiens
  heavy chain complementarity determining region 3 for antibody 56561
ATERYKVGATYYSYGMDV

SEQ ID NO: 113123 - protein, 10 aa, Homo sapiens
  light chain complementarity determining region 3 for antibody 56562
QQRSNWPPLT

SEQ ID NO: 113124 - protein, 19 aa, Homo sapiens
  heavy chain complementarity determining region 3 for antibody 56562
ATERYKVGATYSFYYGMDV

SEQ ID NO: 113125 - protein, 10 aa, Homo sapiens
  light chain complementarity determining region 3 for antibody 56563
QQRSNWPPLT

SEQ ID NO: 113126 - protein, 19 aa, Homo sapiens
  heavy chain complementarity determining region 3 for antibody 56563
ATERYKVGATYSFYSGMDV

SEQ ID NO: 113127 - protein, 10 aa, Homo sapiens
  light chain complementarity determining region 3 for antibody 56564
QQRSNWPPLT

SEQ ID NO: 113128 - protein, 19 aa, Homo sapiens
  heavy chain complementarity determining region 3 for antibody 56564
ATERYKVGATYHYYYGMDV

SEQ ID NO: 113129 - protein, 10 aa, Homo sapiens
  light chain complementarity determining region 3 for antibody 56565
QQRSNWPPLT

SEQ ID NO: 113130 - protein, 19 aa, Homo sapiens
  heavy chain complementarity determining region 3 for antibody 56565
ATERYKVGATCYYYYGMDV

SEQ ID NO: 113131 - protein, 10 aa, Homo sapiens
  light chain complementarity determining region 3 for antibody 56566
QQRSNWPPLT

SEQ ID NO: 113132 - protein, 19 aa, Homo sapiens
  heavy chain complementarity determining region 3 for antibody 56566
ATERYKVGAPYYYYYGMDV

SEQ ID NO: 113133 - protein, 10 aa, Homo sapiens
  light chain complementarity determining region 3 for antibody 56567
QQRSNWPPLT

SEQ ID NO: 113134 - protein, 19 aa, Homo sapiens
  heavy chain complementarity determining region 3 for antibody 56567
ATERYKVGAPYSYYYGMDV

SEQ ID NO: 113135 - protein, 10 aa, Homo sapiens
  light chain complementarity determining region 3 for antibody 56568
QQRSNWPPLT

SEQ ID NO: 113136 - protein, 18 aa, Homo sapiens
  heavy chain complementarity determining region 3 for antibody 56568
ATERYKVGAAYYYYGMDV

SEQ ID NO: 113137 - protein, 10 aa, Homo sapiens
  light chain complementarity determining region 3 for antibody 56569
QQRSNWPPLT

SEQ ID NO: 113138 - protein, 19 aa, Homo sapiens
  heavy chain complementarity determining region 3 for antibody 56569
ATERYKEGATYYYYYGMDV

SEQ ID NO: 113139 - protein, 10 aa, Homo sapiens
  light chain complementarity determining region 3 for antibody 56570
QQRSNWPPLT

SEQ ID NO: 113140 - protein, 18 aa, Homo sapiens
  heavy chain complementarity determining region 3 for antibody 56570
ATERYEVGATYYYYGMDV

SEQ ID NO: 113141 - protein, 10 aa, Homo sapiens
  light chain complementarity determining region 3 for antibody 56571
QQRSNWPPLT

SEQ ID NO: 113142 - protein, 19 aa, Homo sapiens
  heavy chain complementarity determining region 3 for antibody 56571
ATERDKVGATYYYYYGMDV

SEQ ID NO: 113143 - protein, 10 aa, Homo sapiens
  light chain complementarity determining region 3 for antibody 56572
QQRSNWPPLT

SEQ ID NO: 113144 - protein, 19 aa, Homo sapiens
  heavy chain complementarity determining region 3 for antibody 56572
ATEGYKVGATYYDYYGMDV

SEQ ID NO: 113145 - protein, 10 aa, Homo sapiens
  light chain complementarity determining region 3 for antibody 56573
QQRSNWPPLT

SEQ ID NO: 113146 - protein, 19 aa, Homo sapiens
  heavy chain complementarity determining region 3 for antibody 56573
ATDRYKVGATYSYYYGMDV

SEQ ID NO: 113147 - protein, 10 aa, Homo sapiens
  light chain complementarity determining region 3 for antibody 56574
QQRSNWPPLT

SEQ ID NO: 113148 - protein, 4 aa, Homo sapiens
  heavy chain complementarity determining region 3 for antibody 56574
AMDV

SEQ ID NO: 113149 - protein, 10 aa, Homo sapiens
  light chain complementarity determining region 3 for antibody 56575
QQRSNWPPLT

SEQ ID NO: 113150 - protein, 19 aa, Homo sapiens
  heavy chain complementarity determining region 3 for antibody 56575
AAERYKVGATYYYYYGMDV

SEQ ID NO: 113151 - protein, 10 aa, Homo sapiens
  light chain complementarity determining region 3 for antibody 56576
QQRSNWPPLT

SEQ ID NO: 113152 - protein, 18 aa, Homo sapiens
  heavy chain complementarity determining region 3 for antibody 56576
AAERYKVGATYYYYGMDV

SEQ ID NO: 113153 - protein, 9 aa, Homo sapiens
  light chain complementarity determining region 3 for antibody 56577
QQRSNWMYT

SEQ ID NO: 113154 - protein, 10 aa, Homo sapiens
  heavy chain complementarity determining region 3 for antibody 56577
AKERSELLDY

SEQ ID NO: 113155 - protein, 9 aa, Homo sapiens
  light chain complementarity determining region 3 for antibody 56578
QQRSNWHPT

SEQ ID NO: 113156 - protein, 20 aa, Homo sapiens
  heavy chain complementarity determining region 3 for antibody 56578
AKDQGDIVATIMDFYYGMDV

SEQ ID NO: 113157 - protein, 9 aa, Homo sapiens
  light chain complementarity determining region 3 for antibody 56579
QQLNTYPYT

SEQ ID NO: 113158 - protein, 9 aa, Homo sapiens
  heavy chain complementarity determining region 3 for antibody 56579
ARKQRSFDY

SEQ ID NO: 113159 - protein, 9 aa, Homo sapiens
  light chain complementarity determining region 3 for antibody 56580
QQLNSYPYT

SEQ ID NO: 113160 - protein, 16 aa, Homo sapiens
  heavy chain complementarity determining region 3 for antibody 56580
ARGYYYGSGSYSTFDY

SEQ ID NO: 113161 - protein, 9 aa, Homo sapiens
  light chain complementarity determining region 3 for antibody 56581
QQLNSYPYT

SEQ ID NO: 113162 - protein, 16 aa, Homo sapiens
  heavy chain complementarity determining region 3 for antibody 56581
ARGYYYGSGSYSAFDY

SEQ ID NO: 113163 - protein, 9 aa, Homo sapiens
  light chain complementarity determining region 3 for antibody 56582
QQLNSYPYT

SEQ ID NO: 113164 - protein, 16 aa, Homo sapiens
  heavy chain complementarity determining region 3 for antibody 56582
ARGYYYGSGIYSPFDY

SEQ ID NO: 113165 - protein, 9 aa, Homo sapiens
  light chain complementarity determining region 3 for antibody 56583
QQLNSYPYT

SEQ ID NO: 113166 - protein, 16 aa, Homo sapiens
  heavy chain complementarity determining region 3 for antibody 56583
ARGYDYGSGSYSPFDY

SEQ ID NO: 113167 - protein, 9 aa, Homo sapiens
  light chain complementarity determining region 3 for antibody 56584
QQLNSYPYT

SEQ ID NO: 113168 - protein, 16 aa, Homo sapiens
  heavy chain complementarity determining region 3 for antibody 56584
ARGYCYGSGSYSPFDY

SEQ ID NO: 113169 - protein, 9 aa, Homo sapiens
  light chain complementarity determining region 3 for antibody 56585
QQLNSYPYT

SEQ ID NO: 113170 - protein, 12 aa, Homo sapiens
  heavy chain complementarity determining region 3 for antibody 56585
ARGRGSSYGLDY

SEQ ID NO: 113171 - protein, 9 aa, Homo sapiens
  light chain complementarity determining region 3 for antibody 56586
QQLNSYPYT

SEQ ID NO: 113172 - protein, 17 aa, Homo sapiens
  heavy chain complementarity determining region 3 for antibody 56586
AREHYDILTGYWNYFDY

SEQ ID NO: 113173 - protein, 9 aa, Homo sapiens
  light chain complementarity determining region 3 for antibody 56587
QQLNSYPWT

SEQ ID NO: 113174 - protein, 13 aa, Homo sapiens
  heavy chain complementarity determining region 3 for antibody 56587
AGEGGSGSYYFDY

SEQ ID NO: 113175 - protein, 8 aa, Homo sapiens
  light chain complementarity determining region 3 for antibody 56588
QQLNSYPT

SEQ ID NO: 113176 - protein, 20 aa, Homo sapiens
  heavy chain complementarity determining region 3 for antibody 56588
ARDDYGDYVGGYYYYYGMDV

SEQ ID NO: 113177 - protein, 9 aa, Homo sapiens
  light chain complementarity determining region 3 for antibody 56589
QQLNSYPRT

SEQ ID NO: 113178 - protein, 11 aa, Homo sapiens
  heavy chain complementarity determining region 3 for antibody 56589
AREPYYYGMDV

SEQ ID NO: 113179 - protein, 9 aa, Homo sapiens
  light chain complementarity determining region 3 for antibody 56590
QQLNSYPRT

SEQ ID NO: 113180 - protein, 13 aa, Homo sapiens
  heavy chain complementarity determining region 3 for antibody 56590
ARDRYSGYGAFDY

SEQ ID NO: 113181 - protein, 9 aa, Homo sapiens
  light chain complementarity determining region 3 for antibody 56591
QQLNSYPRT

SEQ ID NO: 113182 - protein, 15 aa, Homo sapiens
  heavy chain complementarity determining region 3 for antibody 56591
ARDHGSSYYGSAFDI

SEQ ID NO: 113183 - protein, 9 aa, Homo sapiens
  light chain complementarity determining region 3 for antibody 56592
QQLNSYPRT

SEQ ID NO: 113184 - protein, 18 aa, Homo sapiens
  heavy chain complementarity determining region 3 for antibody 56592
AKDQSIATAGPYYYGMDV

SEQ ID NO: 113185 - protein, 9 aa, Homo sapiens
  light chain complementarity determining region 3 for antibody 56593
QQLNSYPPT

SEQ ID NO: 113186 - protein, 16 aa, Homo sapiens
  heavy chain complementarity determining region 3 for antibody 56593
ARGMAVAVYYYYGMDV

SEQ ID NO: 113187 - protein, 9 aa, Homo sapiens
  light chain complementarity determining region 3 for antibody 56594
QQLNSYPPT

SEQ ID NO: 113188 - protein, 14 aa, Homo sapiens
  heavy chain complementarity determining region 3 for antibody 56594
ARDSSGYYYYGMDV

SEQ ID NO: 113189 - protein, 9 aa, Homo sapiens
  light chain complementarity determining region 3 for antibody 56595
QQLNSYPPT

SEQ ID NO: 113190 - protein, 20 aa, Homo sapiens
  heavy chain complementarity determining region 3 for antibody 56595
AKDQGEIVATIMDYYYGMDV

SEQ ID NO: 113191 - protein, 9 aa, Homo sapiens
  light chain complementarity determining region 3 for antibody 56596
QQLNSYPPT

SEQ ID NO: 113192 - protein, 20 aa, Homo sapiens
  heavy chain complementarity determining region 3 for antibody 56596
AKDEGDIVATIMDYYYGMDV

SEQ ID NO: 113193 - protein, 11 aa, Homo sapiens
  light chain complementarity determining region 3 for antibody 56597
QQLNSYPPEYT

SEQ ID NO: 113194 - protein, 15 aa, Homo sapiens
  heavy chain complementarity determining region 3 for antibody 56597
ARSDILTGYYNVYYY

SEQ ID NO: 113195 - protein, 9 aa, Homo sapiens
  light chain complementarity determining region 3 for antibody 56598
QQLNSYPNT

SEQ ID NO: 113196 - protein, 16 aa, Homo sapiens
  heavy chain complementarity determining region 3 for antibody 56598
ARREVGPLPYYYGMDV

SEQ ID NO: 113197 - protein, 9 aa, Homo sapiens
  light chain complementarity determining region 3 for antibody 56599
QQLNSYPLT

SEQ ID NO: 113198 - protein, 13 aa, Homo sapiens
  heavy chain complementarity determining region 3 for antibody 56599
ARYSSSWYDACDI

SEQ ID NO: 113199 - protein, 9 aa, Homo sapiens
  light chain complementarity determining region 3 for antibody 56600
QQLNSYPLT

SEQ ID NO: 113200 - protein, 13 aa, Homo sapiens
  heavy chain complementarity determining region 3 for antibody 56600
ARYSSSWYAAFDI

SEQ ID NO: 113201 - protein, 9 aa, Homo sapiens
  light chain complementarity determining region 3 for antibody 56601
QQLNSYPLT

SEQ ID NO: 113202 - protein, 13 aa, Homo sapiens
  heavy chain complementarity determining region 3 for antibody 56601
ARYSSSCYYAFDI

SEQ ID NO: 113203 - protein, 9 aa, Homo sapiens
  light chain complementarity determining region 3 for antibody 56602
QQLNSYPLT

SEQ ID NO: 113204 - protein, 13 aa, Homo sapiens
  heavy chain complementarity determining region 3 for antibody 56602
ARYSSSCYDAFDN

SEQ ID NO: 113205 - protein, 9 aa, Homo sapiens
  light chain complementarity determining region 3 for antibody 56603
QQLNSYPLT

SEQ ID NO: 113206 - protein, 13 aa, Homo sapiens
  heavy chain complementarity determining region 3 for antibody 56603
ARYSSGWYDAFDI

SEQ ID NO: 113207 - protein, 9 aa, Homo sapiens
  light chain complementarity determining region 3 for antibody 56604
QQLNSYPLT

SEQ ID NO: 113208 - protein, 13 aa, Homo sapiens
  heavy chain complementarity determining region 3 for antibody 56604
ARYSNSWYDAFDI

SEQ ID NO: 113209 - protein, 9 aa, Homo sapiens
  light chain complementarity determining region 3 for antibody 56605
QQLNSYPLT

SEQ ID NO: 113210 - protein, 17 aa, Homo sapiens
  heavy chain complementarity determining region 3 for antibody 56605
ARGLRYFDWLLSDAFDI

SEQ ID NO: 113211 - protein, 9 aa, Homo sapiens
  light chain complementarity determining region 3 for antibody 56606
QQLNSYPLT

SEQ ID NO: 113212 - protein, 12 aa, Homo sapiens
  heavy chain complementarity determining region 3 for antibody 56606
ARAPEWELFFDY

SEQ ID NO: 113213 - protein, 9 aa, Homo sapiens
  light chain complementarity determining region 3 for antibody 56607
QQLNSYPLT

SEQ ID NO: 113214 - protein, 13 aa, Homo sapiens
  heavy chain complementarity determining region 3 for antibody 56607
AGYSSSWYYAFDI

SEQ ID NO: 113215 - protein, 9 aa, Homo sapiens
  light chain complementarity determining region 3 for antibody 56608
QQLNSYPLT

SEQ ID NO: 113216 - protein, 13 aa, Homo sapiens
  heavy chain complementarity determining region 3 for antibody 56608
AGYSSSWYDALDI

SEQ ID NO: 113217 - protein, 9 aa, Homo sapiens
  light chain complementarity determining region 3 for antibody 56609
QQLNSYPLT

SEQ ID NO: 113218 - protein, 13 aa, Homo sapiens
  heavy chain complementarity determining region 3 for antibody 56609
AGYSSSWYDAFDF

SEQ ID NO: 113219 - protein, 9 aa, Homo sapiens
  light chain complementarity determining region 3 for antibody 56610
QQLNSYPLT

SEQ ID NO: 113220 - protein, 13 aa, Homo sapiens
  heavy chain complementarity determining region 3 for antibody 56610
AGYSSSCYDAFDI

SEQ ID NO: 113221 - protein, 9 aa, Homo sapiens
  light chain complementarity determining region 3 for antibody 56611
QQLNSYPLT

SEQ ID NO: 113222 - protein, 13 aa, Homo sapiens
  heavy chain complementarity determining region 3 for antibody 56611
AGDSSSWYDAFDI

SEQ ID NO: 113223 - protein, 9 aa, Homo sapiens
  light chain complementarity determining region 3 for antibody 56612
QQLNSYPIT

SEQ ID NO: 113224 - protein, 13 aa, Homo sapiens
  heavy chain complementarity determining region 3 for antibody 56612
ARIAAAAVQYFQH

SEQ ID NO: 113225 - protein, 9 aa, Homo sapiens
  light chain complementarity determining region 3 for antibody 56613
QQLNSYPFT

SEQ ID NO: 113226 - protein, 19 aa, Homo sapiens
  heavy chain complementarity determining region 3 for antibody 56613
ARGWWFGELSYYYYYGMDV

SEQ ID NO: 113227 - protein, 9 aa, Homo sapiens
  light chain complementarity determining region 3 for antibody 56614
QQLNSYPFT

SEQ ID NO: 113228 - protein, 10 aa, Homo sapiens
  heavy chain complementarity determining region 3 for antibody 56614
ARDRGSSFDY

SEQ ID NO: 113229 - protein, 9 aa, Homo sapiens
  light chain complementarity determining region 3 for antibody 56615
QQLNSYPFT

SEQ ID NO: 113230 - protein, 10 aa, Homo sapiens
  heavy chain complementarity determining region 3 for antibody 56615
ARDRASYFDY

SEQ ID NO: 113231 - protein, 9 aa, Homo sapiens
  light chain complementarity determining region 3 for antibody 56616
QQLNSYALT

SEQ ID NO: 113232 - protein, 13 aa, Homo sapiens
  heavy chain complementarity determining region 3 for antibody 56616
ARYSSSWYDAFDI

SEQ ID NO: 113233 - protein, 9 aa, Homo sapiens
  light chain complementarity determining region 3 for antibody 56617
QQLNSFSRT

SEQ ID NO: 113234 - protein, 13 aa, Homo sapiens
  heavy chain complementarity determining region 3 for antibody 56617
AKEMGQWLYYFDY

SEQ ID NO: 113235 - protein, 9 aa, Homo sapiens
  light chain complementarity determining region 3 for antibody 56618
QQLNNSPYT

SEQ ID NO: 113236 - protein, 13 aa, Homo sapiens
  heavy chain complementarity determining region 3 for antibody 56618
ARDRGHSSGWYPY

SEQ ID NO: 113237 - protein, 9 aa, Homo sapiens
  light chain complementarity determining region 3 for antibody 56619
QQLNNHPPT

SEQ ID NO: 113238 - protein, 14 aa, Homo sapiens
  heavy chain complementarity determining region 3 for antibody 56619
ARRYGSGSLWYFDL

SEQ ID NO: 113239 - protein, 9 aa, Homo sapiens
  light chain complementarity determining region 3 for antibody 56620
QQLKSYPLT

SEQ ID NO: 113240 - protein, 12 aa, Homo sapiens
  heavy chain complementarity determining region 3 for antibody 56620
ARARSWSNWFDH

SEQ ID NO: 113241 - protein, 9 aa, Homo sapiens
  light chain complementarity determining region 3 for antibody 56621
QQGNTLPYT

SEQ ID NO: 113242 - protein, 13 aa, Homo sapiens
  heavy chain complementarity determining region 3 for antibody 56621
ARQNYGNSYYFDY

SEQ ID NO: 113243 - protein, 8 aa, Homo sapiens
  light chain complementarity determining region 3 for antibody 56622
QQFSNYRT

SEQ ID NO: 113244 - protein, 22 aa, Homo sapiens
  heavy chain complementarity determining region 3 for antibody 56622
ARMYYDILTGYPDYYYYYGMDV

SEQ ID NO: 113245 - protein, 9 aa, Homo sapiens
  light chain complementarity determining region 3 for antibody 56623
QQFNSYPYT

SEQ ID NO: 113246 - protein, 24 aa, Homo sapiens
  heavy chain complementarity determining region 3 for antibody 56623
AREWEGNDGSGSYYKSAYYYGMDV

SEQ ID NO: 113247 - protein, 9 aa, Homo sapiens
  light chain complementarity determining region 3 for antibody 56624
QQFNNYTYT

SEQ ID NO: 113248 - protein, 24 aa, Homo sapiens
  heavy chain complementarity determining region 3 for antibody 56624
AREWEGNYGSGSYYKSAYYYGMDV

SEQ ID NO: 113249 - protein, 9 aa, Homo sapiens
  light chain complementarity determining region 3 for antibody 56625
QQFNNYPYT

SEQ ID NO: 113250 - protein, 24 aa, Homo sapiens
  heavy chain complementarity determining region 3 for antibody 56625
VREWEGNYGSGSYYKSAYYYGMDV

SEQ ID NO: 113251 - protein, 9 aa, Homo sapiens
  light chain complementarity determining region 3 for antibody 56626
QQFNNYPYT

SEQ ID NO: 113252 - protein, 24 aa, Homo sapiens
  heavy chain complementarity determining region 3 for antibody 56626
TREWEGNDGSGSYYKSAYYYGMDV

SEQ ID NO: 113253 - protein, 9 aa, Homo sapiens
  light chain complementarity determining region 3 for antibody 56627
QQFNNYPYT

SEQ ID NO: 113254 - protein, 9 aa, Homo sapiens
  heavy chain complementarity determining region 3 for antibody 56627
LMVRGVMDV

SEQ ID NO: 113255 - protein, 9 aa, Homo sapiens
  light chain complementarity determining region 3 for antibody 56628
QQFNNYPYT

SEQ ID NO: 113256 - protein, 24 aa, Homo sapiens
  heavy chain complementarity determining region 3 for antibody 56628
ASEWEGNYGSGSYYKSASYYGMDV

SEQ ID NO: 113257 - protein, 9 aa, Homo sapiens
  light chain complementarity determining region 3 for antibody 56629
QQFNNYPYT

SEQ ID NO: 113258 - protein, 24 aa, Homo sapiens
  heavy chain complementarity determining region 3 for antibody 56629
ASEWEGKYGSGSYYKSAYYYGMDV

SEQ ID NO: 113259 - protein, 9 aa, Homo sapiens
  light chain complementarity determining region 3 for antibody 56630
QQFNNYPYT

SEQ ID NO: 113260 - protein, 24 aa, Homo sapiens
  heavy chain complementarity determining region 3 for antibody 56630
ARKWEGNYGSGSYYKSAYYYGMDV

SEQ ID NO: 113261 - protein, 9 aa, Homo sapiens
  light chain complementarity determining region 3 for antibody 56631
QQFNNYPYT

SEQ ID NO: 113262 - protein, 13 aa, Homo sapiens
  heavy chain complementarity determining region 3 for antibody 56631
ARIRYFDWLPFDY

SEQ ID NO: 113263 - protein, 9 aa, Homo sapiens
  light chain complementarity determining region 3 for antibody 56632
QQFNNYPYT

SEQ ID NO: 113264 - protein, 17 aa, Homo sapiens
  heavy chain complementarity determining region 3 for antibody 56632
ARGLRYFDWLLSDAFDI

SEQ ID NO: 113265 - protein, 9 aa, Homo sapiens
  light chain complementarity determining region 3 for antibody 56633
QQFNNYPYT

SEQ ID NO: 113266 - protein, 24 aa, Homo sapiens
  heavy chain complementarity determining region 3 for antibody 56633
AREWEGNYVSGSYYKSAYYYGMDV

SEQ ID NO: 113267 - protein, 9 aa, Homo sapiens
  light chain complementarity determining region 3 for antibody 56634
QQFNNYPYT

SEQ ID NO: 113268 - protein, 24 aa, Homo sapiens
  heavy chain complementarity determining region 3 for antibody 56634
AREWEGNYGWGSYYKSAYYYGMDV

SEQ ID NO: 113269 - protein, 9 aa, Homo sapiens
  light chain complementarity determining region 3 for antibody 56635
QQFNNYPYT

SEQ ID NO: 113270 - protein, 24 aa, Homo sapiens
  heavy chain complementarity determining region 3 for antibody 56635
AREWEGNYGTGSYYKSAYYYGMDV

SEQ ID NO: 113271 - protein, 9 aa, Homo sapiens
  light chain complementarity determining region 3 for antibody 56636
QQFNNYPYT

SEQ ID NO: 113272 - protein, 24 aa, Homo sapiens
  heavy chain complementarity determining region 3 for antibody 56636
AREWEGNYGSWSYYKSAYYYGMDV

SEQ ID NO: 113273 - protein, 9 aa, Homo sapiens
  light chain complementarity determining region 3 for antibody 56637
QQFNNYPYT

SEQ ID NO: 113274 - protein, 24 aa, Homo sapiens
  heavy chain complementarity determining region 3 for antibody 56637
AREWEGNYGSVSYYKSAYYYGMDV

SEQ ID NO: 113275 - protein, 9 aa, Homo sapiens
  light chain complementarity determining region 3 for antibody 56638
QQFNNYPYT

SEQ ID NO: 113276 - protein, 24 aa, Homo sapiens
  heavy chain complementarity determining region 3 for antibody 56638
AREWEGNYGSGSYYNSAYYYGMDV

SEQ ID NO: 113277 - protein, 9 aa, Homo sapiens
  light chain complementarity determining region 3 for antibody 56639
QQFNNYPYT

SEQ ID NO: 113278 - protein, 24 aa, Homo sapiens
  heavy chain complementarity determining region 3 for antibody 56639
AREWEGNYGSGSYYKSTYYYGMDV

SEQ ID NO: 113279 - protein, 9 aa, Homo sapiens
  light chain complementarity determining region 3 for antibody 56640
QQFNNYPYT

SEQ ID NO: 113280 - protein, 24 aa, Homo sapiens
  heavy chain complementarity determining region 3 for antibody 56640
AREWEGNYGSGSYYKSAYYYGTDV

SEQ ID NO: 113281 - protein, 9 aa, Homo sapiens
  light chain complementarity determining region 3 for antibody 56641
QQFNNYPYT

SEQ ID NO: 113282 - protein, 24 aa, Homo sapiens
  heavy chain complementarity determining region 3 for antibody 56641
AREWEGNYGSGSYYKSAYYYGMHV

SEQ ID NO: 113283 - protein, 9 aa, Homo sapiens
  light chain complementarity determining region 3 for antibody 56642
QQFNNYPYT

SEQ ID NO: 113284 - protein, 24 aa, Homo sapiens
  heavy chain complementarity determining region 3 for antibody 56642
AREWEGNYGSGSYYKSAYYYGMDI

SEQ ID NO: 113285 - protein, 9 aa, Homo sapiens
  light chain complementarity determining region 3 for antibody 56643
QQFNNYPYT

SEQ ID NO: 113286 - protein, 24 aa, Homo sapiens
  heavy chain complementarity determining region 3 for antibody 56643
AREWEGNYGSGSYYKSAHYYGMDV

SEQ ID NO: 113287 - protein, 9 aa, Homo sapiens
  light chain complementarity determining region 3 for antibody 56644
QQFNNYPYT

SEQ ID NO: 113288 - protein, 24 aa, Homo sapiens
  heavy chain complementarity determining region 3 for antibody 56644
AREWEGNYGSGSYYKSAFYSGMDV

SEQ ID NO: 113289 - protein, 9 aa, Homo sapiens
  light chain complementarity determining region 3 for antibody 56645
QQFNNYPYT

SEQ ID NO: 113290 - protein, 24 aa, Homo sapiens
  heavy chain complementarity determining region 3 for antibody 56645
AREWEGNYGSGSYYKSAFSYGMDV

SEQ ID NO: 113291 - protein, 9 aa, Homo sapiens
  light chain complementarity determining region 3 for antibody 56646
QQFNNYPYT

SEQ ID NO: 113292 - protein, 24 aa, Homo sapiens
  heavy chain complementarity determining region 3 for antibody 56646
AREWEGNYGSGSYYKRACYYGMDV

SEQ ID NO: 113293 - protein, 9 aa, Homo sapiens
  light chain complementarity determining region 3 for antibody 56647
QQFNNYPYT

SEQ ID NO: 113294 - protein, 24 aa, Homo sapiens
  heavy chain complementarity determining region 3 for antibody 56647
AREWEGNYGSGSYYKNAYYYGMDV

SEQ ID NO: 113295 - protein, 9 aa, Homo sapiens
  light chain complementarity determining region 3 for antibody 56648
QQFNNYPYT

SEQ ID NO: 113296 - protein, 24 aa, Homo sapiens
  heavy chain complementarity determining region 3 for antibody 56648
AREWEGNYGSGSYYKIAYYYGMDV

SEQ ID NO: 113297 - protein, 9 aa, Homo sapiens
  light chain complementarity determining region 3 for antibody 56649
QQFNNYPYT

SEQ ID NO: 113298 - protein, 24 aa, Homo sapiens
  heavy chain complementarity determining region 3 for antibody 56649
AREWEGNYGSGSYYESAYYYGMDV

SEQ ID NO: 113299 - protein, 9 aa, Homo sapiens
  light chain complementarity determining region 3 for antibody 56650
QQFNNYPYT

SEQ ID NO: 113300 - protein, 24 aa, Homo sapiens
  heavy chain complementarity determining region 3 for antibody 56650
AREWEGNYGSGSYCKSAYYYGMDV

SEQ ID NO: 113301 - protein, 9 aa, Homo sapiens
  light chain complementarity determining region 3 for antibody 56651
QQFNNYPYT

SEQ ID NO: 113302 - protein, 24 aa, Homo sapiens
  heavy chain complementarity determining region 3 for antibody 56651
AREWEGNYGSGSDYKSAYYYGMDD

SEQ ID NO: 113303 - protein, 9 aa, Homo sapiens
  light chain complementarity determining region 3 for antibody 56652
QQFNNYPYT

SEQ ID NO: 113304 - protein, 24 aa, Homo sapiens
  heavy chain complementarity determining region 3 for antibody 56652
AREWEGNYGSGSDYKSAYYSGMDV

SEQ ID NO: 113305 - protein, 9 aa, Homo sapiens
  light chain complementarity determining region 3 for antibody 56653
QQFNNYPYT

SEQ ID NO: 113306 - protein, 24 aa, Homo sapiens
  heavy chain complementarity determining region 3 for antibody 56653
AREWEGNYGSGSDYKSASYYGMDV

SEQ ID NO: 113307 - protein, 9 aa, Homo sapiens
  light chain complementarity determining region 3 for antibody 56654
QQFNNYPYT

SEQ ID NO: 113308 - protein, 24 aa, Homo sapiens
  heavy chain complementarity determining region 3 for antibody 56654
AREWEGNYGSGSDYKSAFYYGMDV

SEQ ID NO: 113309 - protein, 9 aa, Homo sapiens
  light chain complementarity determining region 3 for antibody 56655
QQFNNYPYT

SEQ ID NO: 113310 - protein, 24 aa, Homo sapiens
  heavy chain complementarity determining region 3 for antibody 56655
AREWEGNYGSGSDYKCAYYYGMDV

SEQ ID NO: 113311 - protein, 9 aa, Homo sapiens
  light chain complementarity determining region 3 for antibody 56656
QQFNNYPYT

SEQ ID NO: 113312 - protein, 24 aa, Homo sapiens
  heavy chain complementarity determining region 3 for antibody 56656
AREWEGNYGSESYYKSAYYYGMDV

SEQ ID NO: 113313 - protein, 9 aa, Homo sapiens
  light chain complementarity determining region 3 for antibody 56657
QQFNNYPYT

SEQ ID NO: 113314 - protein, 24 aa, Homo sapiens
  heavy chain complementarity determining region 3 for antibody 56657
AREWEGNYGLGSYYKSAYYYGMDV

SEQ ID NO: 113315 - protein, 9 aa, Homo sapiens
  light chain complementarity determining region 3 for antibody 56658
QQFNNYPYT

SEQ ID NO: 113316 - protein, 24 aa, Homo sapiens
  heavy chain complementarity determining region 3 for antibody 56658
AREWEGNYGAGSDYKSAYYYGMDV

SEQ ID NO: 113317 - protein, 9 aa, Homo sapiens
  light chain complementarity determining region 3 for antibody 56659
QQFNNYPYT

SEQ ID NO: 113318 - protein, 24 aa, Homo sapiens
  heavy chain complementarity determining region 3 for antibody 56659
AREWEGNEGSGSYYKSAYYYGMDV

SEQ ID NO: 113319 - protein, 9 aa, Homo sapiens
  light chain complementarity determining region 3 for antibody 56660
QQFNNYPYT

SEQ ID NO: 113320 - protein, 24 aa, Homo sapiens
  heavy chain complementarity determining region 3 for antibody 56660
AREWEGNDGSGSYYKSAFYYGMDV

SEQ ID NO: 113321 - protein, 9 aa, Homo sapiens
  light chain complementarity determining region 3 for antibody 56661
QQFNNYPYT

SEQ ID NO: 113322 - protein, 24 aa, Homo sapiens
  heavy chain complementarity determining region 3 for antibody 56661
AREWEGNDGSGSYYKSADYYGMDV

SEQ ID NO: 113323 - protein, 9 aa, Homo sapiens
  light chain complementarity determining region 3 for antibody 56662
QQFNNYPYT

SEQ ID NO: 113324 - protein, 24 aa, Homo sapiens
  heavy chain complementarity determining region 3 for antibody 56662
AREWEGNDGSGSYYKSACYYGMDV

SEQ ID NO: 113325 - protein, 9 aa, Homo sapiens
  light chain complementarity determining region 3 for antibody 56663
QQFNNYPYT

SEQ ID NO: 113326 - protein, 24 aa, Homo sapiens
  heavy chain complementarity determining region 3 for antibody 56663
AREWEGKYGSGSYYKSVYYYGMDV

SEQ ID NO: 113327 - protein, 9 aa, Homo sapiens
  light chain complementarity determining region 3 for antibody 56664
QQFNNYPYT

SEQ ID NO: 113328 - protein, 24 aa, Homo sapiens
  heavy chain complementarity determining region 3 for antibody 56664
AREWEGKYGSGSYYKSAYYYAMDV

SEQ ID NO: 113329 - protein, 9 aa, Homo sapiens
  light chain complementarity determining region 3 for antibody 56665
QQFNNYPYT

SEQ ID NO: 113330 - protein, 24 aa, Homo sapiens
  heavy chain complementarity determining region 3 for antibody 56665
AREWEGKYGSGSDYKSAYSYGMDV

SEQ ID NO: 113331 - protein, 9 aa, Homo sapiens
  light chain complementarity determining region 3 for antibody 56666
QQFNNYPYT

SEQ ID NO: 113332 - protein, 24 aa, Homo sapiens
  heavy chain complementarity determining region 3 for antibody 56666
AREWDGNYVSGSYYKSAYYYGMDV

SEQ ID NO: 113333 - protein, 9 aa, Homo sapiens
  light chain complementarity determining region 3 for antibody 56667
QQFNNYPYT

SEQ ID NO: 113334 - protein, 24 aa, Homo sapiens
  heavy chain complementarity determining region 3 for antibody 56667
AREWDGNYGSGSDYKSAYYYGMDV

SEQ ID NO: 113335 - protein, 9 aa, Homo sapiens
  light chain complementarity determining region 3 for antibody 56668
QQFNNYPYT

SEQ ID NO: 113336 - protein, 24 aa, Homo sapiens
  heavy chain complementarity determining region 3 for antibody 56668
AREWDGNDGSGSYYKSAYYYGMDV

SEQ ID NO: 113337 - protein, 9 aa, Homo sapiens
  light chain complementarity determining region 3 for antibody 56669
QQFNNYPYT

SEQ ID NO: 113338 - protein, 24 aa, Homo sapiens
  heavy chain complementarity determining region 3 for antibody 56669
AREWDGKYGSGSYYKSAYYYGMDV

SEQ ID NO: 113339 - protein, 9 aa, Homo sapiens
  light chain complementarity determining region 3 for antibody 56670
QQFNNYPYT

SEQ ID NO: 113340 - protein, 24 aa, Homo sapiens
  heavy chain complementarity determining region 3 for antibody 56670
AREREGNYGSGSYYKSAYSYGMDV

SEQ ID NO: 113341 - protein, 9 aa, Homo sapiens
  light chain complementarity determining region 3 for antibody 56671
QQFNNYPYT

SEQ ID NO: 113342 - protein, 24 aa, Homo sapiens
  heavy chain complementarity determining region 3 for antibody 56671
ARELEGNYGSGSYYKSAYYYGMDV

SEQ ID NO: 113343 - protein, 9 aa, Homo sapiens
  light chain complementarity determining region 3 for antibody 56672
QQFNNYPYT

SEQ ID NO: 113344 - protein, 24 aa, Homo sapiens
  heavy chain complementarity determining region 3 for antibody 56672
ARECEGNYGSGSYYKSAYSYGMDV

SEQ ID NO: 113345 - protein, 9 aa, Homo sapiens
  light chain complementarity determining region 3 for antibody 56673
QQFNNYPYT

SEQ ID NO: 113346 - protein, 24 aa, Homo sapiens
  heavy chain complementarity determining region 3 for antibody 56673
ARDWEGNYGSGSYYKSASYYGMDV

SEQ ID NO: 113347 - protein, 9 aa, Homo sapiens
  light chain complementarity determining region 3 for antibody 56674
QQFNNYPYT

SEQ ID NO: 113348 - protein, 12 aa, Homo sapiens
  heavy chain complementarity determining region 3 for antibody 56674
ARDTMVRGVIDY

SEQ ID NO: 113349 - protein, 9 aa, Homo sapiens
  light chain complementarity determining region 3 for antibody 56675
QQFNNYPYT

SEQ ID NO: 113350 - protein, 16 aa, Homo sapiens
  heavy chain complementarity determining region 3 for antibody 56675
ARDAKYYDILTGYPDY

SEQ ID NO: 113351 - protein, 9 aa, Homo sapiens
  light chain complementarity determining region 3 for antibody 56676
QQFNNYPYT

SEQ ID NO: 113352 - protein, 20 aa, Homo sapiens
  heavy chain complementarity determining region 3 for antibody 56676
AKDQGDIVATIMDYYYGMDV

SEQ ID NO: 113353 - protein, 9 aa, Homo sapiens
  light chain complementarity determining region 3 for antibody 56677
QQFNNYPYT

SEQ ID NO: 113354 - protein, 24 aa, Homo sapiens
  heavy chain complementarity determining region 3 for antibody 56677
AIEWEGNYGSGSYYKSAYYYGMDV

SEQ ID NO: 113355 - protein, 9 aa, Homo sapiens
  light chain complementarity determining region 3 for antibody 56678
QQFNNYPRT

SEQ ID NO: 113356 - protein, 13 aa, Homo sapiens
  heavy chain complementarity determining region 3 for antibody 56678
SRIAAAAVQYFQH

SEQ ID NO: 113357 - protein, 9 aa, Homo sapiens
  light chain complementarity determining region 3 for antibody 56679
QQFNNYPRT

SEQ ID NO: 113358 - protein, 8 aa, Homo sapiens
  heavy chain complementarity determining region 3 for antibody 56679
ASTGPLDY

SEQ ID NO: 113359 - protein, 9 aa, Homo sapiens
  light chain complementarity determining region 3 for antibody 56680
QQFNNYPRT

SEQ ID NO: 113360 - protein, 13 aa, Homo sapiens
  heavy chain complementarity determining region 3 for antibody 56680
ASIAAAAVQYFQH

SEQ ID NO: 113361 - protein, 9 aa, Homo sapiens
  light chain complementarity determining region 3 for antibody 56681
QQFNNYPRT

SEQ ID NO: 113362 - protein, 13 aa, Homo sapiens
  heavy chain complementarity determining region 3 for antibody 56681
ARTAAAAVQYIQH

SEQ ID NO: 113363 - protein, 9 aa, Homo sapiens
  light chain complementarity determining region 3 for antibody 56682
QQFNNYPRT

SEQ ID NO: 113364 - protein, 13 aa, Homo sapiens
  heavy chain complementarity determining region 3 for antibody 56682
ARIAAAAYQYFQH

SEQ ID NO: 113365 - protein, 9 aa, Homo sapiens
  light chain complementarity determining region 3 for antibody 56683
QQFNNYPRT

SEQ ID NO: 113366 - protein, 13 aa, Homo sapiens
  heavy chain complementarity determining region 3 for antibody 56683
ARIAAAAVQYLQH

SEQ ID NO: 113367 - protein, 9 aa, Homo sapiens
  light chain complementarity determining region 3 for antibody 56684
QQFNNYPRT

SEQ ID NO: 113368 - protein, 13 aa, Homo sapiens
  heavy chain complementarity determining region 3 for antibody 56684
ARIAAAAVQAFQH

SEQ ID NO: 113369 - protein, 9 aa, Homo sapiens
  light chain complementarity determining region 3 for antibody 56685
QQFNNYPRT

SEQ ID NO: 113370 - protein, 13 aa, Homo sapiens
  heavy chain complementarity determining region 3 for antibody 56685
ARIAAAAVHYFQH

SEQ ID NO: 113371 - protein, 9 aa, Homo sapiens
  light chain complementarity determining region 3 for antibody 56686
QQFNNYPRT

SEQ ID NO: 113372 - protein, 13 aa, Homo sapiens
  heavy chain complementarity determining region 3 for antibody 56686
ARIAAAADQYFQH

SEQ ID NO: 113373 - protein, 9 aa, Homo sapiens
  light chain complementarity determining region 3 for antibody 56687
QQFNNYPRT

SEQ ID NO: 113374 - protein, 18 aa, Homo sapiens
  heavy chain complementarity determining region 3 for antibody 56687
ARERGYYYGSGSSHYFDY

SEQ ID NO: 113375 - protein, 9 aa, Homo sapiens
  light chain complementarity determining region 3 for antibody 56688
QQFNNYPRT

SEQ ID NO: 113376 - protein, 16 aa, Homo sapiens
  heavy chain complementarity determining region 3 for antibody 56688
ARDRGIGIGAAGYFDY

SEQ ID NO: 113377 - protein, 9 aa, Homo sapiens
  light chain complementarity determining region 3 for antibody 56689
QQFNNYPRT

SEQ ID NO: 113378 - protein, 13 aa, Homo sapiens
  heavy chain complementarity determining region 3 for antibody 56689
AGTAAAAVQYFQH

SEQ ID NO: 113379 - protein, 9 aa, Homo sapiens
  light chain complementarity determining region 3 for antibody 56690
QQFNNYPRT

SEQ ID NO: 113380 - protein, 13 aa, Homo sapiens
  heavy chain complementarity determining region 3 for antibody 56690
AGIAAAAVQCFQH

SEQ ID NO: 113381 - protein, 9 aa, Homo sapiens
  light chain complementarity determining region 3 for antibody 56691
QQFNNYPHT

SEQ ID NO: 113382 - protein, 13 aa, Homo sapiens
  heavy chain complementarity determining region 3 for antibody 56691
ANSGSSYASCFAP

SEQ ID NO: 113383 - protein, 9 aa, Homo sapiens
  light chain complementarity determining region 3 for antibody 56692
QQFNNYPFT

SEQ ID NO: 113384 - protein, 12 aa, Homo sapiens
  heavy chain complementarity determining region 3 for antibody 56692
ARDNNWNDGIDY

SEQ ID NO: 113385 - protein, 9 aa, Homo sapiens
  light chain complementarity determining region 3 for antibody 56693
QQFNNYPCT

SEQ ID NO: 113386 - protein, 13 aa, Homo sapiens
  heavy chain complementarity determining region 3 for antibody 56693
ARYSSSWYDAFDI

SEQ ID NO: 113387 - protein, 9 aa, Homo sapiens
  light chain complementarity determining region 3 for antibody 56694
QQFNNYPCT

SEQ ID NO: 113388 - protein, 24 aa, Homo sapiens
  heavy chain complementarity determining region 3 for antibody 56694
AREWEGNYGSGSYYKSAYYYAMDV

SEQ ID NO: 113389 - protein, 9 aa, Homo sapiens
  light chain complementarity determining region 3 for antibody 56695
QQFNNYPCT

SEQ ID NO: 113390 - protein, 24 aa, Homo sapiens
  heavy chain complementarity determining region 3 for antibody 56695
AREWEGNYGSGSYYKSAFYYGMDV

SEQ ID NO: 113391 - protein, 9 aa, Homo sapiens
  light chain complementarity determining region 3 for antibody 56696
QQFNNYPCT

SEQ ID NO: 113392 - protein, 24 aa, Homo sapiens
  heavy chain complementarity determining region 3 for antibody 56696
AREWEGNYGSGRYYKSAYYYGMDV

SEQ ID NO: 113393 - protein, 9 aa, Homo sapiens
  light chain complementarity determining region 3 for antibody 56697
QQFNNYMYT

SEQ ID NO: 113394 - protein, 7 aa, Homo sapiens
  heavy chain complementarity determining region 3 for antibody 56697
ARGPFDL

SEQ ID NO: 113395 - protein, 9 aa, Homo sapiens
  light chain complementarity determining region 3 for antibody 56698
QQFDNYPYT

SEQ ID NO: 113396 - protein, 24 aa, Homo sapiens
  heavy chain complementarity determining region 3 for antibody 56698
AREWEGNYGSGSYYKSAYYYGMDV

SEQ ID NO: 113397 - protein, 8 aa, Homo sapiens
  light chain complementarity determining region 3 for antibody 56699
QQDYNLYT

SEQ ID NO: 113398 - protein, 14 aa, Homo sapiens
  heavy chain complementarity determining region 3 for antibody 56699
ARRGRVRGVYAFEF

SEQ ID NO: 113399 - protein, 8 aa, Homo sapiens
  light chain complementarity determining region 3 for antibody 56700
QQDYNLYT

SEQ ID NO: 113400 - protein, 17 aa, Homo sapiens
  heavy chain complementarity determining region 3 for antibody 56700
ARGGGIRYFDWLFYFDY

SEQ ID NO: 113401 - protein, 8 aa, Homo sapiens
  light chain complementarity determining region 3 for antibody 56701
QQDYNLRT

SEQ ID NO: 113402 - protein, 14 aa, Homo sapiens
  heavy chain complementarity determining region 3 for antibody 56701
ARDYYDTLTGSFDY

SEQ ID NO: 113403 - protein, 9 aa, Homo sapiens
  light chain complementarity determining region 3 for antibody 56702
QQDYNLPYT

SEQ ID NO: 113404 - protein, 18 aa, Homo sapiens
  heavy chain complementarity determining region 3 for antibody 56702
ARDQDIVVVVVAKDGMDV

SEQ ID NO: 113405 - protein, 9 aa, Homo sapiens
  light chain complementarity determining region 3 for antibody 56703
QQDYNLPLT

SEQ ID NO: 113406 - protein, 19 aa, Homo sapiens
  heavy chain complementarity determining region 3 for antibody 56703
ARRRGGSGSPSYWYYGMDV

SEQ ID NO: 113407 - protein, 9 aa, Homo sapiens
  light chain complementarity determining region 3 for antibody 56704
QQDYNLPFT

SEQ ID NO: 113408 - protein, 18 aa, Homo sapiens
  heavy chain complementarity determining region 3 for antibody 56704
ARVLWFGELLSLYYGMDV

SEQ ID NO: 113409 - protein, 9 aa, Homo sapiens
  light chain complementarity determining region 3 for antibody 56705
QQCNSYPYT

SEQ ID NO: 113410 - protein, 18 aa, Homo sapiens
  heavy chain complementarity determining region 3 for antibody 56705
ARERRDDSLTGYFDAFDI

SEQ ID NO: 113411 - protein, 9 aa, Homo sapiens
  light chain complementarity determining region 3 for antibody 56706
QQCNSYPYT

SEQ ID NO: 113412 - protein, 18 aa, Homo sapiens
  heavy chain complementarity determining region 3 for antibody 56706
ARERRDDILTGYLDAFDI

SEQ ID NO: 113413 - protein, 9 aa, Homo sapiens
  light chain complementarity determining region 3 for antibody 56707
QQCNSYPYT

SEQ ID NO: 113414 - protein, 18 aa, Homo sapiens
  heavy chain complementarity determining region 3 for antibody 56707
AREGRDDILTGYFDASDI

SEQ ID NO: 113415 - protein, 9 aa, Homo sapiens
  light chain complementarity determining region 3 for antibody 56708
QPYNSYPRT

SEQ ID NO: 113416 - protein, 13 aa, Homo sapiens
  heavy chain complementarity determining region 3 for antibody 56708
ARDRYSGYGAFDY

SEQ ID NO: 113417 - protein, 9 aa, Homo sapiens
  light chain complementarity determining region 3 for antibody 56709
QKYNSATLT

SEQ ID NO: 113418 - protein, 8 aa, Homo sapiens
  heavy chain complementarity determining region 3 for antibody 56709
ARTGPLDY

SEQ ID NO: 113419 - protein, 9 aa, Homo sapiens
  light chain complementarity determining region 3 for antibody 56710
QKYNSAPYT

SEQ ID NO: 113420 - protein, 12 aa, Homo sapiens
  heavy chain complementarity determining region 3 for antibody 56710
ARWMTTVTLFDY

SEQ ID NO: 113421 - protein, 9 aa, Homo sapiens
  light chain complementarity determining region 3 for antibody 56711
QKYNSAPYT

SEQ ID NO: 113422 - protein, 20 aa, Homo sapiens
  heavy chain complementarity determining region 3 for antibody 56711
AREHITMVRGIIIPLYAFDI

SEQ ID NO: 113423 - protein, 9 aa, Homo sapiens
  light chain complementarity determining region 3 for antibody 56712
QKYNSAPYT

SEQ ID NO: 113424 - protein, 19 aa, Homo sapiens
  heavy chain complementarity determining region 3 for antibody 56712
ARDDGYDGGGYYYSYGMDV

SEQ ID NO: 113425 - protein, 9 aa, Homo sapiens
  light chain complementarity determining region 3 for antibody 56713
QKYNSAPWT

SEQ ID NO: 113426 - protein, 16 aa, Homo sapiens
  heavy chain complementarity determining region 3 for antibody 56713
ARINYFGSGSYYNGDY

SEQ ID NO: 113427 - protein, 9 aa, Homo sapiens
  light chain complementarity determining region 3 for antibody 56714
QKYNSAPLT

SEQ ID NO: 113428 - protein, 16 aa, Homo sapiens
  heavy chain complementarity determining region 3 for antibody 56714
VRDAKYYDILTGYPDY

SEQ ID NO: 113429 - protein, 9 aa, Homo sapiens
  light chain complementarity determining region 3 for antibody 56715
QKYNSAPLT

SEQ ID NO: 113430 - protein, 18 aa, Homo sapiens
  heavy chain complementarity determining region 3 for antibody 56715
VKGGPGESFYYYYYGVDV

SEQ ID NO: 113431 - protein, 9 aa, Homo sapiens
  light chain complementarity determining region 3 for antibody 56716
QKYNSAPLT

SEQ ID NO: 113432 - protein, 13 aa, Homo sapiens
  heavy chain complementarity determining region 3 for antibody 56716
TRDRYSGYGAFDY

SEQ ID NO: 113433 - protein, 9 aa, Homo sapiens
  light chain complementarity determining region 3 for antibody 56717
QKYNSAPLT

SEQ ID NO: 113434 - protein, 8 aa, Homo sapiens
  heavy chain complementarity determining region 3 for antibody 56717
SRTGPLDY

SEQ ID NO: 113435 - protein, 9 aa, Homo sapiens
  light chain complementarity determining region 3 for antibody 56718
QKYNSAPLT

SEQ ID NO: 113436 - protein, 17 aa, Homo sapiens
  heavy chain complementarity determining region 3 for antibody 56718
ERGLRYFDWSLSDAFDI

SEQ ID NO: 113437 - protein, 9 aa, Homo sapiens
  light chain complementarity determining region 3 for antibody 56719
QKYNSAPLT

SEQ ID NO: 113438 - protein, 17 aa, Homo sapiens
  heavy chain complementarity determining region 3 for antibody 56719
ERGLRDFDWLLSDAFDI

SEQ ID NO: 113439 - protein, 9 aa, Homo sapiens
  light chain complementarity determining region 3 for antibody 56720
QKYNSAPLT

SEQ ID NO: 113440 - protein, 8 aa, Homo sapiens
  heavy chain complementarity determining region 3 for antibody 56720
ASTGALDY

SEQ ID NO: 113441 - protein, 9 aa, Homo sapiens
  light chain complementarity determining region 3 for antibody 56721
QKYNSAPLT

SEQ ID NO: 113442 - protein, 16 aa, Homo sapiens
  heavy chain complementarity determining region 3 for antibody 56721
ASLFVDIVVVPAAFDY

SEQ ID NO: 113443 - protein, 9 aa, Homo sapiens
  light chain complementarity determining region 3 for antibody 56722
QKYNSAPLT

SEQ ID NO: 113444 - protein, 9 aa, Homo sapiens
  heavy chain complementarity determining region 3 for antibody 56722
ASDGRGIDY

SEQ ID NO: 113445 - protein, 9 aa, Homo sapiens
  light chain complementarity determining region 3 for antibody 56723
QKYNSAPLT

SEQ ID NO: 113446 - protein, 9 aa, Homo sapiens
  heavy chain complementarity determining region 3 for antibody 56723
ASDGPGIDY

SEQ ID NO: 113447 - protein, 9 aa, Homo sapiens
  light chain complementarity determining region 3 for antibody 56724
QKYNSAPLT

SEQ ID NO: 113448 - protein, 9 aa, Homo sapiens
  heavy chain complementarity determining region 3 for antibody 56724
ASDALGIDY

SEQ ID NO: 113449 - protein, 9 aa, Homo sapiens
  light chain complementarity determining region 3 for antibody 56725
QKYNSAPLT

SEQ ID NO: 113450 - protein, 16 aa, Homo sapiens
  heavy chain complementarity determining region 3 for antibody 56725
ARYAKYYDILTGYPDY

SEQ ID NO: 113451 - protein, 9 aa, Homo sapiens
  light chain complementarity determining region 3 for antibody 56726
QKYNSAPLT

SEQ ID NO: 113452 - protein, 9 aa, Homo sapiens
  heavy chain complementarity determining region 3 for antibody 56726
ARVGLGIDY

SEQ ID NO: 113453 - protein, 9 aa, Homo sapiens
  light chain complementarity determining region 3 for antibody 56727
QKYNSAPLT

SEQ ID NO: 113454 - protein, 8 aa, Homo sapiens
  heavy chain complementarity determining region 3 for antibody 56727
ARTGPRDY

SEQ ID NO: 113455 - protein, 9 aa, Homo sapiens
  light chain complementarity determining region 3 for antibody 56728
QKYNSAPLT

SEQ ID NO: 113456 - protein, 8 aa, Homo sapiens
  heavy chain complementarity determining region 3 for antibody 56728
ARTGPLDC

SEQ ID NO: 113457 - protein, 9 aa, Homo sapiens
  light chain complementarity determining region 3 for antibody 56729
QKYNSAPLT

SEQ ID NO: 113458 - protein, 8 aa, Homo sapiens
  heavy chain complementarity determining region 3 for antibody 56729
ARTGHLDY

SEQ ID NO: 113459 - protein, 9 aa, Homo sapiens
  light chain complementarity determining region 3 for antibody 56730
QKYNSAPLT

SEQ ID NO: 113460 - protein, 8 aa, Homo sapiens
  heavy chain complementarity determining region 3 for antibody 56730
ARTGAIDY

SEQ ID NO: 113461 - protein, 9 aa, Homo sapiens
  light chain complementarity determining region 3 for antibody 56731
QKYNSAPLT

SEQ ID NO: 113462 - protein, 8 aa, Homo sapiens
  heavy chain complementarity determining region 3 for antibody 56731
ARTDPLDY

SEQ ID NO: 113463 - protein, 9 aa, Homo sapiens
  light chain complementarity determining region 3 for antibody 56732
QKYNSAPLT

SEQ ID NO: 113464 - protein, 8 aa, Homo sapiens
  heavy chain complementarity determining region 3 for antibody 56732
ARSGPIDY

SEQ ID NO: 113465 - protein, 9 aa, Homo sapiens
  light chain complementarity determining region 3 for antibody 56733
QKYNSAPLT

SEQ ID NO: 113466 - protein, 9 aa, Homo sapiens
  heavy chain complementarity determining region 3 for antibody 56733
ARKQRYFDY

SEQ ID NO: 113467 - protein, 9 aa, Homo sapiens
  light chain complementarity determining region 3 for antibody 56734
QKYNSAPLT

SEQ ID NO: 113468 - protein, 13 aa, Homo sapiens
  heavy chain complementarity determining region 3 for antibody 56734
ARGRYSGYGAFDY

SEQ ID NO: 113469 - protein, 9 aa, Homo sapiens
  light chain complementarity determining region 3 for antibody 56735
QKYNSAPLT

SEQ ID NO: 113470 - protein, 18 aa, Homo sapiens
  heavy chain complementarity determining region 3 for antibody 56735
ARGQIYYNSGSYYSPFDY

SEQ ID NO: 113471 - protein, 9 aa, Homo sapiens
  light chain complementarity determining region 3 for antibody 56736
QKYNSAPLT

SEQ ID NO: 113472 - protein, 17 aa, Homo sapiens
  heavy chain complementarity determining region 3 for antibody 56736
ARGLRYIDWSLSDAFDI

SEQ ID NO: 113473 - protein, 9 aa, Homo sapiens
  light chain complementarity determining region 3 for antibody 56737
QKYNSAPLT

SEQ ID NO: 113474 - protein, 17 aa, Homo sapiens
  heavy chain complementarity determining region 3 for antibody 56737
ARGLRYFVLLFSDAFDI

SEQ ID NO: 113475 - protein, 9 aa, Homo sapiens
  light chain complementarity determining region 3 for antibody 56738
QKYNSAPLT

SEQ ID NO: 113476 - protein, 17 aa, Homo sapiens
  heavy chain complementarity determining region 3 for antibody 56738
ARGLRYFEWLLSDAFDI

SEQ ID NO: 113477 - protein, 9 aa, Homo sapiens
  light chain complementarity determining region 3 for antibody 56739
QKYNSAPLT

SEQ ID NO: 113478 - protein, 17 aa, Homo sapiens
  heavy chain complementarity determining region 3 for antibody 56739
ARGLRYFDWLSSDAFDI

SEQ ID NO: 113479 - protein, 9 aa, Homo sapiens
  light chain complementarity determining region 3 for antibody 56740
QKYNSAPLT

SEQ ID NO: 113480 - protein, 17 aa, Homo sapiens
  heavy chain complementarity determining region 3 for antibody 56740
ARGLRYFDWLLYDAFDI

SEQ ID NO: 113481 - protein, 9 aa, Homo sapiens
  light chain complementarity determining region 3 for antibody 56741
QKYNSAPLT

SEQ ID NO: 113482 - protein, 17 aa, Homo sapiens
  heavy chain complementarity determining region 3 for antibody 56741
ARGLRYFDWLLSDDFDI

SEQ ID NO: 113483 - protein, 9 aa, Homo sapiens
  light chain complementarity determining region 3 for antibody 56742
QKYNSAPLT

SEQ ID NO: 113484 - protein, 17 aa, Homo sapiens
  heavy chain complementarity determining region 3 for antibody 56742
ARGLRYFDGSLSYAFDI

SEQ ID NO: 113485 - protein, 9 aa, Homo sapiens
  light chain complementarity determining region 3 for antibody 56743
QKYNSAPLT

SEQ ID NO: 113486 - protein, 17 aa, Homo sapiens
  heavy chain complementarity determining region 3 for antibody 56743
ARGLRYFDCFLSDAFDI

SEQ ID NO: 113487 - protein, 9 aa, Homo sapiens
  light chain complementarity determining region 3 for antibody 56744
QKYNSAPLT

SEQ ID NO: 113488 - protein, 17 aa, Homo sapiens
  heavy chain complementarity determining region 3 for antibody 56744
ARGLRYFAWLLSDAFDI

SEQ ID NO: 113489 - protein, 9 aa, Homo sapiens
  light chain complementarity determining region 3 for antibody 56745
QKYNSAPLT

SEQ ID NO: 113490 - protein, 17 aa, Homo sapiens
  heavy chain complementarity determining region 3 for antibody 56745
ARGLRDFDWSLSDAIDI

SEQ ID NO: 113491 - protein, 9 aa, Homo sapiens
  light chain complementarity determining region 3 for antibody 56746
QKYNSAPLT

SEQ ID NO: 113492 - protein, 17 aa, Homo sapiens
  heavy chain complementarity determining region 3 for antibody 56746
ARGLRDFDCSLSDAFDI

SEQ ID NO: 113493 - protein, 9 aa, Homo sapiens
  light chain complementarity determining region 3 for antibody 56747
QKYNSAPLT

SEQ ID NO: 113494 - protein, 17 aa, Homo sapiens
  heavy chain complementarity determining region 3 for antibody 56747
ARGLRCFDWSLSDAFDI

SEQ ID NO: 113495 - protein, 9 aa, Homo sapiens
  light chain complementarity determining region 3 for antibody 56748
QKYNSAPLT

SEQ ID NO: 113496 - protein, 17 aa, Homo sapiens
  heavy chain complementarity determining region 3 for antibody 56748
ARGLQYFDWSLSDAFDI

SEQ ID NO: 113497 - protein, 9 aa, Homo sapiens
  light chain complementarity determining region 3 for antibody 56749
QKYNSAPLT

SEQ ID NO: 113498 - protein, 16 aa, Homo sapiens
  heavy chain complementarity determining region 3 for antibody 56749
ARGAKYYDILTGYPDY

SEQ ID NO: 113499 - protein, 9 aa, Homo sapiens
  light chain complementarity determining region 3 for antibody 56750
QKYNSAPLT

SEQ ID NO: 113500 - protein, 19 aa, Homo sapiens
  heavy chain complementarity determining region 3 for antibody 56750
AREKISGSYYVYYYYGMDV

SEQ ID NO: 113501 - protein, 9 aa, Homo sapiens
  light chain complementarity determining region 3 for antibody 56751
QKYNSAPLT

SEQ ID NO: 113502 - protein, 19 aa, Homo sapiens
  heavy chain complementarity determining region 3 for antibody 56751
AREKISGSDYVYYYYGMDV

SEQ ID NO: 113503 - protein, 9 aa, Homo sapiens
  light chain complementarity determining region 3 for antibody 56752
QKYNSAPLT

SEQ ID NO: 113504 - protein, 9 aa, Homo sapiens
  heavy chain complementarity determining region 3 for antibody 56752
ARDWPGIDY

SEQ ID NO: 113505 - protein, 9 aa, Homo sapiens
  light chain complementarity determining region 3 for antibody 56753
QKYNSAPLT

SEQ ID NO: 113506 - protein, 12 aa, Homo sapiens
  heavy chain complementarity determining region 3 for antibody 56753
ARDTMVRGAIDY

SEQ ID NO: 113507 - protein, 9 aa, Homo sapiens
  light chain complementarity determining region 3 for antibody 56754
QKYNSAPLT

SEQ ID NO: 113508 - protein, 13 aa, Homo sapiens
  heavy chain complementarity determining region 3 for antibody 56754
ARDRYTGYGAFDY

SEQ ID NO: 113509 - protein, 9 aa, Homo sapiens
  light chain complementarity determining region 3 for antibody 56755
QKYNSAPLT

SEQ ID NO: 113510 - protein, 13 aa, Homo sapiens
  heavy chain complementarity determining region 3 for antibody 56755
ARDRYSGYGGFDY

SEQ ID NO: 113511 - protein, 9 aa, Homo sapiens
  light chain complementarity determining region 3 for antibody 56756
QKYNSAPLT

SEQ ID NO: 113512 - protein, 13 aa, Homo sapiens
  heavy chain complementarity determining region 3 for antibody 56756
ARDRYSGYGASDY

SEQ ID NO: 113513 - protein, 9 aa, Homo sapiens
  light chain complementarity determining region 3 for antibody 56757
QKYNSAPLT

SEQ ID NO: 113514 - protein, 13 aa, Homo sapiens
  heavy chain complementarity determining region 3 for antibody 56757
ARDRYSGYGAIDY

SEQ ID NO: 113515 - protein, 9 aa, Homo sapiens
  light chain complementarity determining region 3 for antibody 56758
QKYNSAPLT

SEQ ID NO: 113516 - protein, 13 aa, Homo sapiens
  heavy chain complementarity determining region 3 for antibody 56758
ARDRYSGYEAFDY

SEQ ID NO: 113517 - protein, 9 aa, Homo sapiens
  light chain complementarity determining region 3 for antibody 56759
QKYNSAPLT

SEQ ID NO: 113518 - protein, 13 aa, Homo sapiens
  heavy chain complementarity determining region 3 for antibody 56759
ARDRCSGYGAFDY

SEQ ID NO: 113519 - protein, 9 aa, Homo sapiens
  light chain complementarity determining region 3 for antibody 56760
QKYNSAPLT

SEQ ID NO: 113520 - protein, 14 aa, Homo sapiens
  heavy chain complementarity determining region 3 for antibody 56760
ARDPPRIVGALFDY

SEQ ID NO: 113521 - protein, 9 aa, Homo sapiens
  light chain complementarity determining region 3 for antibody 56761
QKYNSAPLT

SEQ ID NO: 113522 - protein, 9 aa, Homo sapiens
  heavy chain complementarity determining region 3 for antibody 56761
ARDGVGIDY

SEQ ID NO: 113523 - protein, 9 aa, Homo sapiens
  light chain complementarity determining region 3 for antibody 56762
QKYNSAPLT

SEQ ID NO: 113524 - protein, 9 aa, Homo sapiens
  heavy chain complementarity determining region 3 for antibody 56762
ARDGLGIEY

SEQ ID NO: 113525 - protein, 9 aa, Homo sapiens
  light chain complementarity determining region 3 for antibody 56763
QKYNSAPLT

SEQ ID NO: 113526 - protein, 9 aa, Homo sapiens
  heavy chain complementarity determining region 3 for antibody 56763
ARDGLGIDS

SEQ ID NO: 113527 - protein, 9 aa, Homo sapiens
  light chain complementarity determining region 3 for antibody 56764
QKYNSAPLT

SEQ ID NO: 113528 - protein, 16 aa, Homo sapiens
  heavy chain complementarity determining region 3 for antibody 56764
ARDEKYYDILTGYPDY

SEQ ID NO: 113529 - protein, 9 aa, Homo sapiens
  light chain complementarity determining region 3 for antibody 56765
QKYNSAPLT

SEQ ID NO: 113530 - protein, 16 aa, Homo sapiens
  heavy chain complementarity determining region 3 for antibody 56765
ARDAKYYDTLTGYHDY

SEQ ID NO: 113531 - protein, 9 aa, Homo sapiens
  light chain complementarity determining region 3 for antibody 56766
QKYNSAPLT

SEQ ID NO: 113532 - protein, 16 aa, Homo sapiens
  heavy chain complementarity determining region 3 for antibody 56766
ARDAKYYDTLTGDPDY

SEQ ID NO: 113533 - protein, 9 aa, Homo sapiens
  light chain complementarity determining region 3 for antibody 56767
QKYNSAPLT

SEQ ID NO: 113534 - protein, 16 aa, Homo sapiens
  heavy chain complementarity determining region 3 for antibody 56767
ARDAKYYDTLSGYPDY

SEQ ID NO: 113535 - protein, 9 aa, Homo sapiens
  light chain complementarity determining region 3 for antibody 56768
QKYNSAPLT

SEQ ID NO: 113536 - protein, 16 aa, Homo sapiens
  heavy chain complementarity determining region 3 for antibody 56768
ARDAKYYDSLTGDPDY

SEQ ID NO: 113537 - protein, 9 aa, Homo sapiens
  light chain complementarity determining region 3 for antibody 56769
QKYNSAPLT

SEQ ID NO: 113538 - protein, 16 aa, Homo sapiens
  heavy chain complementarity determining region 3 for antibody 56769
ARDAKYYDILTGYPDS

SEQ ID NO: 113539 - protein, 9 aa, Homo sapiens
  light chain complementarity determining region 3 for antibody 56770
QKYNSAPLT

SEQ ID NO: 113540 - protein, 16 aa, Homo sapiens
  heavy chain complementarity determining region 3 for antibody 56770
ARDAKYYDILTGYNDY

SEQ ID NO: 113541 - protein, 9 aa, Homo sapiens
  light chain complementarity determining region 3 for antibody 56771
QKYNSAPLT

SEQ ID NO: 113542 - protein, 16 aa, Homo sapiens
  heavy chain complementarity determining region 3 for antibody 56771
ARDAKYYDILTGCPDY

SEQ ID NO: 113543 - protein, 9 aa, Homo sapiens
  light chain complementarity determining region 3 for antibody 56772
QKYNSAPLT

SEQ ID NO: 113544 - protein, 16 aa, Homo sapiens
  heavy chain complementarity determining region 3 for antibody 56772
ARDAKYYDILSGYHDY

SEQ ID NO: 113545 - protein, 9 aa, Homo sapiens
  light chain complementarity determining region 3 for antibody 56773
QKYNSAPLT

SEQ ID NO: 113546 - protein, 16 aa, Homo sapiens
  heavy chain complementarity determining region 3 for antibody 56773
ARDAKYYDILSGSPDY

SEQ ID NO: 113547 - protein, 9 aa, Homo sapiens
  light chain complementarity determining region 3 for antibody 56774
QKYNSAPLT

SEQ ID NO: 113548 - protein, 16 aa, Homo sapiens
  heavy chain complementarity determining region 3 for antibody 56774
ARDAKYSDILTGYPDY

SEQ ID NO: 113549 - protein, 9 aa, Homo sapiens
  light chain complementarity determining region 3 for antibody 56775
QKYNSAPLT

SEQ ID NO: 113550 - protein, 16 aa, Homo sapiens
  heavy chain complementarity determining region 3 for antibody 56775
ARDAKYCDILSGSPDY

SEQ ID NO: 113551 - protein, 9 aa, Homo sapiens
  light chain complementarity determining region 3 for antibody 56776
QKYNSAPLT

SEQ ID NO: 113552 - protein, 16 aa, Homo sapiens
  heavy chain complementarity determining region 3 for antibody 56776
ARDAKSYDILPGYPDY

SEQ ID NO: 113553 - protein, 9 aa, Homo sapiens
  light chain complementarity determining region 3 for antibody 56777
QKYNSAPLT

SEQ ID NO: 113554 - protein, 16 aa, Homo sapiens
  heavy chain complementarity determining region 3 for antibody 56777
ARDAKDYDMLTGYPDY

SEQ ID NO: 113555 - protein, 9 aa, Homo sapiens
  light chain complementarity determining region 3 for antibody 56778
QKYNSAPLT

SEQ ID NO: 113556 - protein, 16 aa, Homo sapiens
  heavy chain complementarity determining region 3 for antibody 56778
ARDAKDYDILTGYPDY

SEQ ID NO: 113557 - protein, 9 aa, Homo sapiens
  light chain complementarity determining region 3 for antibody 56779
QKYNSAPLT

SEQ ID NO: 113558 - protein, 8 aa, Homo sapiens
  heavy chain complementarity determining region 3 for antibody 56779
ARAGALDY

SEQ ID NO: 113559 - protein, 9 aa, Homo sapiens
  light chain complementarity determining region 3 for antibody 56780
QKYNSAPLT

SEQ ID NO: 113560 - protein, 17 aa, Homo sapiens
  heavy chain complementarity determining region 3 for antibody 56780
AIGLRYFDWLFSDAFDI

SEQ ID NO: 113561 - protein, 9 aa, Homo sapiens
  light chain complementarity determining region 3 for antibody 56781
QKYNSAPLT

SEQ ID NO: 113562 - protein, 16 aa, Homo sapiens
  heavy chain complementarity determining region 3 for antibody 56781
AGLFVDIVVVPAAFDY

SEQ ID NO: 113563 - protein, 9 aa, Homo sapiens
  light chain complementarity determining region 3 for antibody 56782
QKYNSAPLT

SEQ ID NO: 113564 - protein, 16 aa, Homo sapiens
  heavy chain complementarity determining region 3 for antibody 56782
AGEAKYYDILTGYPDY

SEQ ID NO: 113565 - protein, 9 aa, Homo sapiens
  light chain complementarity determining region 3 for antibody 56783
QKYNSAPLT

SEQ ID NO: 113566 - protein, 16 aa, Homo sapiens
  heavy chain complementarity determining region 3 for antibody 56783
AGDAKYYDIVTGYPDY

SEQ ID NO: 113567 - protein, 9 aa, Homo sapiens
  light chain complementarity determining region 3 for antibody 56784
QKYNSAPLT

SEQ ID NO: 113568 - protein, 16 aa, Homo sapiens
  heavy chain complementarity determining region 3 for antibody 56784
AGDAKYYDILTGSHDY

SEQ ID NO: 113569 - protein, 9 aa, Homo sapiens
  light chain complementarity determining region 3 for antibody 56785
QKYNSAPFT

SEQ ID NO: 113570 - protein, 14 aa, Homo sapiens
  heavy chain complementarity determining region 3 for antibody 56785
ARWDTLYFYYGMDV

SEQ ID NO: 113571 - protein, 9 aa, Homo sapiens
  light chain complementarity determining region 3 for antibody 56786
QKYNSAPFT

SEQ ID NO: 113572 - protein, 14 aa, Homo sapiens
  heavy chain complementarity determining region 3 for antibody 56786
ARWDTLSYYYGMDV

SEQ ID NO: 113573 - protein, 9 aa, Homo sapiens
  light chain complementarity determining region 3 for antibody 56787
QKYNSALYT

SEQ ID NO: 113574 - protein, 9 aa, Homo sapiens
  heavy chain complementarity determining region 3 for antibody 56787
ARDLSGMDV

SEQ ID NO: 113575 - protein, 9 aa, Homo sapiens
  light chain complementarity determining region 3 for antibody 56788
QKYKSAPLT

SEQ ID NO: 113576 - protein, 13 aa, Homo sapiens
  heavy chain complementarity determining region 3 for antibody 56788
ARDRYSGYGAFDY

SEQ ID NO: 113577 - protein, 9 aa, Homo sapiens
  light chain complementarity determining region 3 for antibody 56789
QKYDSAPLT

SEQ ID NO: 113578 - protein, 17 aa, Homo sapiens
  heavy chain complementarity determining region 3 for antibody 56789
ARGLRYFDWLLSDAFDI

SEQ ID NO: 113579 - protein, 9 aa, Homo sapiens
  light chain complementarity determining region 3 for antibody 56790
QKNNSAPLT

SEQ ID NO: 113580 - protein, 8 aa, Homo sapiens
  heavy chain complementarity determining region 3 for antibody 56790
ARTGPLDY

SEQ ID NO: 113581 - protein, 9 aa, Homo sapiens
  light chain complementarity determining region 3 for antibody 56791
QKHNSAPLT

SEQ ID NO: 113582 - protein, 17 aa, Homo sapiens
  heavy chain complementarity determining region 3 for antibody 56791
ARGLRYFDWLLSDAFDI

SEQ ID NO: 113583 - protein, 9 aa, Homo sapiens
  light chain complementarity determining region 3 for antibody 56792
QKFNNYPRT

SEQ ID NO: 113584 - protein, 13 aa, Homo sapiens
  heavy chain complementarity determining region 3 for antibody 56792
ARIAAAAVQYFQH

SEQ ID NO: 113585 - protein, 9 aa, Homo sapiens
  light chain complementarity determining region 3 for antibody 56793
QKDNSAPLT

SEQ ID NO: 113586 - protein, 13 aa, Homo sapiens
  heavy chain complementarity determining region 3 for antibody 56793
ARDRYSGYGAFDY

SEQ ID NO: 113587 - protein, 9 aa, Homo sapiens
  light chain complementarity determining region 3 for antibody 56794
MQPLQTPWT

SEQ ID NO: 113588 - protein, 14 aa, Homo sapiens
  heavy chain complementarity determining region 3 for antibody 56794
ARSSGSYYYYGMDV

SEQ ID NO: 113589 - protein, 9 aa, Homo sapiens
  light chain complementarity determining region 3 for antibody 56795
MQALQTPYT

SEQ ID NO: 113590 - protein, 16 aa, Homo sapiens
  heavy chain complementarity determining region 3 for antibody 56795
ARDRMYYDILTGYPDY

SEQ ID NO: 113591 - protein, 9 aa, Homo sapiens
  light chain complementarity determining region 3 for antibody 56796
MQALQTPYT

SEQ ID NO: 113592 - protein, 16 aa, Homo sapiens
  heavy chain complementarity determining region 3 for antibody 56796
ARDQVDYGDYGYGIDV

SEQ ID NO: 113593 - protein, 9 aa, Homo sapiens
  light chain complementarity determining region 3 for antibody 56797
MQALQTPYT

SEQ ID NO: 113594 - protein, 14 aa, Homo sapiens
  heavy chain complementarity determining region 3 for antibody 56797
ARDGDWGLRREFDY

SEQ ID NO: 113595 - protein, 9 aa, Homo sapiens
  light chain complementarity determining region 3 for antibody 56798
MQALQTPWT

SEQ ID NO: 113596 - protein, 14 aa, Homo sapiens
  heavy chain complementarity determining region 3 for antibody 56798
ARSSGSYYYYGMDV

SEQ ID NO: 113597 - protein, 9 aa, Homo sapiens
  light chain complementarity determining region 3 for antibody 56799
MQALQTPWT

SEQ ID NO: 113598 - protein, 14 aa, Homo sapiens
  heavy chain complementarity determining region 3 for antibody 56799
ARGSGLKYYYGMDV

SEQ ID NO: 113599 - protein, 9 aa, Homo sapiens
  light chain complementarity determining region 3 for antibody 56800
LRHNSYPYT

SEQ ID NO: 113600 - protein, 13 aa, Homo sapiens
  heavy chain complementarity determining region 3 for antibody 56800
ARIRYFDWLPFDY

SEQ ID NO: 113601 - protein, 9 aa, Homo sapiens
  light chain complementarity determining region 3 for antibody 56801
LRHNSYPFT

SEQ ID NO: 113602 - protein, 16 aa, Homo sapiens
  heavy chain complementarity determining region 3 for antibody 56801
AGLFVDIVVVPAAFDY

SEQ ID NO: 113603 - protein, 9 aa, Homo sapiens
  light chain complementarity determining region 3 for antibody 56802
LQVYNYPWT

SEQ ID NO: 113604 - protein, 20 aa, Homo sapiens
  heavy chain complementarity determining region 3 for antibody 56802
AKGGVTMVRGVIIDYYGMDV

SEQ ID NO: 113605 - protein, 9 aa, Homo sapiens
  light chain complementarity determining region 3 for antibody 56803
LQNNSYPYT

SEQ ID NO: 113606 - protein, 11 aa, Homo sapiens
  heavy chain complementarity determining region 3 for antibody 56803
AAYSSSWPFDY

SEQ ID NO: 113607 - protein, 9 aa, Homo sapiens
  light chain complementarity determining region 3 for antibody 56804
LQNNSYPWT

SEQ ID NO: 113608 - protein, 12 aa, Homo sapiens
  heavy chain complementarity determining region 3 for antibody 56804
ARDIMVRGVIDC

SEQ ID NO: 113609 - protein, 9 aa, Homo sapiens
  light chain complementarity determining region 3 for antibody 56805
LQHYIYPWT

SEQ ID NO: 113610 - protein, 19 aa, Homo sapiens
  heavy chain complementarity determining region 3 for antibody 56805
ARDPRAVAAYYYYYYGMDV

SEQ ID NO: 113611 - protein, 9 aa, Homo sapiens
  light chain complementarity determining region 3 for antibody 56806
LQHSSYPYT

SEQ ID NO: 113612 - protein, 15 aa, Homo sapiens
  heavy chain complementarity determining region 3 for antibody 56806
AREGRLAVAVTGFDY

SEQ ID NO: 113613 - protein, 9 aa, Homo sapiens
  light chain complementarity determining region 3 for antibody 56807
LQHNSYPYT

SEQ ID NO: 113614 - protein, 12 aa, Homo sapiens
  heavy chain complementarity determining region 3 for antibody 56807
SRDTMVRGVIDY

SEQ ID NO: 113615 - protein, 9 aa, Homo sapiens
  light chain complementarity determining region 3 for antibody 56808
LQHNSYPYT

SEQ ID NO: 113616 - protein, 16 aa, Homo sapiens
  heavy chain complementarity determining region 3 for antibody 56808
ASLFVDIVVVPAAFDY

SEQ ID NO: 113617 - protein, 9 aa, Homo sapiens
  light chain complementarity determining region 3 for antibody 56809
LQHNSYPYT

SEQ ID NO: 113618 - protein, 15 aa, Homo sapiens
  heavy chain complementarity determining region 3 for antibody 56809
ASEGRLAVAVTGFDY

SEQ ID NO: 113619 - protein, 9 aa, Homo sapiens
  light chain complementarity determining region 3 for antibody 56810
LQHNSYPYT

SEQ ID NO: 113620 - protein, 13 aa, Homo sapiens
  heavy chain complementarity determining region 3 for antibody 56810
ARTAAAAAQYFQH

SEQ ID NO: 113621 - protein, 9 aa, Homo sapiens
  light chain complementarity determining region 3 for antibody 56811
LQHNSYPYT

SEQ ID NO: 113622 - protein, 13 aa, Homo sapiens
  heavy chain complementarity determining region 3 for antibody 56811
ARKAAAAVQYFQH

SEQ ID NO: 113623 - protein, 9 aa, Homo sapiens
  light chain complementarity determining region 3 for antibody 56812
LQHNSYPYT

SEQ ID NO: 113624 - protein, 13 aa, Homo sapiens
  heavy chain complementarity determining region 3 for antibody 56812
ARIRYVDWLPFDY

SEQ ID NO: 113625 - protein, 9 aa, Homo sapiens
  light chain complementarity determining region 3 for antibody 56813
LQHNSYPYT

SEQ ID NO: 113626 - protein, 13 aa, Homo sapiens
  heavy chain complementarity determining region 3 for antibody 56813
ARIRYSDWLPFDY

SEQ ID NO: 113627 - protein, 9 aa, Homo sapiens
  light chain complementarity determining region 3 for antibody 56814
LQHNSYPYT

SEQ ID NO: 113628 - protein, 13 aa, Homo sapiens
  heavy chain complementarity determining region 3 for antibody 56814
ARIRYFAWLPFDY

SEQ ID NO: 113629 - protein, 9 aa, Homo sapiens
  light chain complementarity determining region 3 for antibody 56815
LQHNSYPYT

SEQ ID NO: 113630 - protein, 13 aa, Homo sapiens
  heavy chain complementarity determining region 3 for antibody 56815
ARIPGCKIGPFDY

SEQ ID NO: 113631 - protein, 9 aa, Homo sapiens
  light chain complementarity determining region 3 for antibody 56816
LQHNSYPYT

SEQ ID NO: 113632 - protein, 13 aa, Homo sapiens
  heavy chain complementarity determining region 3 for antibody 56816
ARIGAAAVQYFQH

SEQ ID NO: 113633 - protein, 9 aa, Homo sapiens
  light chain complementarity determining region 3 for antibody 56817
LQHNSYPYT

SEQ ID NO: 113634 - protein, 13 aa, Homo sapiens
  heavy chain complementarity determining region 3 for antibody 56817
ARIAAAEVQYFQH

SEQ ID NO: 113635 - protein, 9 aa, Homo sapiens
  light chain complementarity determining region 3 for antibody 56818
LQHNSYPYT

SEQ ID NO: 113636 - protein, 13 aa, Homo sapiens
  heavy chain complementarity determining region 3 for antibody 56818
ARIAAAAVRYFQH

SEQ ID NO: 113637 - protein, 9 aa, Homo sapiens
  light chain complementarity determining region 3 for antibody 56819
LQHNSYPYT

SEQ ID NO: 113638 - protein, 13 aa, Homo sapiens
  heavy chain complementarity determining region 3 for antibody 56819
ARIAAAAVQYLQH

SEQ ID NO: 113639 - protein, 9 aa, Homo sapiens
  light chain complementarity determining region 3 for antibody 56820
LQHNSYPYT

SEQ ID NO: 113640 - protein, 13 aa, Homo sapiens
  heavy chain complementarity determining region 3 for antibody 56820
ARIAAAAVQYFQP

SEQ ID NO: 113641 - protein, 9 aa, Homo sapiens
  light chain complementarity determining region 3 for antibody 56821
LQHNSYPYT

SEQ ID NO: 113642 - protein, 13 aa, Homo sapiens
  heavy chain complementarity determining region 3 for antibody 56821
ARIAAAAVQDFHH

SEQ ID NO: 113643 - protein, 9 aa, Homo sapiens
  light chain complementarity determining region 3 for antibody 56822
LQHNSYPYT

SEQ ID NO: 113644 - protein, 13 aa, Homo sapiens
  heavy chain complementarity determining region 3 for antibody 56822
ARIAAAAVPYFQH

SEQ ID NO: 113645 - protein, 9 aa, Homo sapiens
  light chain complementarity determining region 3 for antibody 56823
LQHNSYPYT

SEQ ID NO: 113646 - protein, 13 aa, Homo sapiens
  heavy chain complementarity determining region 3 for antibody 56823
ARIAAAALQYFQH

SEQ ID NO: 113647 - protein, 9 aa, Homo sapiens
  light chain complementarity determining region 3 for antibody 56824
LQHNSYPYT

SEQ ID NO: 113648 - protein, 13 aa, Homo sapiens
  heavy chain complementarity determining region 3 for antibody 56824
ARIAAAAGQYFQH

SEQ ID NO: 113649 - protein, 9 aa, Homo sapiens
  light chain complementarity determining region 3 for antibody 56825
LQHNSYPYT

SEQ ID NO: 113650 - protein, 13 aa, Homo sapiens
  heavy chain complementarity determining region 3 for antibody 56825
ARIAAAAFQYFHH

SEQ ID NO: 113651 - protein, 9 aa, Homo sapiens
  light chain complementarity determining region 3 for antibody 56826
LQHNSYPYT

SEQ ID NO: 113652 - protein, 15 aa, Homo sapiens
  heavy chain complementarity determining region 3 for antibody 56826
ARESRLAVAVTGFDY

SEQ ID NO: 113653 - protein, 9 aa, Homo sapiens
  light chain complementarity determining region 3 for antibody 56827
LQHNSYPYT

SEQ ID NO: 113654 - protein, 17 aa, Homo sapiens
  heavy chain complementarity determining region 3 for antibody 56827
ARERGYYGSGSYYIFDY

SEQ ID NO: 113655 - protein, 9 aa, Homo sapiens
  light chain complementarity determining region 3 for antibody 56828
LQHNSYPYT

SEQ ID NO: 113656 - protein, 17 aa, Homo sapiens
  heavy chain complementarity determining region 3 for antibody 56828
ARERDYYGSGSYYVFDY

SEQ ID NO: 113657 - protein, 9 aa, Homo sapiens
  light chain complementarity determining region 3 for antibody 56829
LQHNSYPYT

SEQ ID NO: 113658 - protein, 17 aa, Homo sapiens
  heavy chain complementarity determining region 3 for antibody 56829
ARERDYYGSASYYIFDY

SEQ ID NO: 113659 - protein, 9 aa, Homo sapiens
  light chain complementarity determining region 3 for antibody 56830
LQHNSYPYT

SEQ ID NO: 113660 - protein, 15 aa, Homo sapiens
  heavy chain complementarity determining region 3 for antibody 56830
AREGRLAVSVTGFDY

SEQ ID NO: 113661 - protein, 9 aa, Homo sapiens
  light chain complementarity determining region 3 for antibody 56831
LQHNSYPYT

SEQ ID NO: 113662 - protein, 15 aa, Homo sapiens
  heavy chain complementarity determining region 3 for antibody 56831
AREGRLAVAVPGFDY

SEQ ID NO: 113663 - protein, 9 aa, Homo sapiens
  light chain complementarity determining region 3 for antibody 56832
LQHNSYPYT

SEQ ID NO: 113664 - protein, 15 aa, Homo sapiens
  heavy chain complementarity determining region 3 for antibody 56832
AREGRLAVAVKGFDY

SEQ ID NO: 113665 - protein, 9 aa, Homo sapiens
  light chain complementarity determining region 3 for antibody 56833
LQHNSYPYT

SEQ ID NO: 113666 - protein, 15 aa, Homo sapiens
  heavy chain complementarity determining region 3 for antibody 56833
AREGRLAVAVAGFDY

SEQ ID NO: 113667 - protein, 9 aa, Homo sapiens
  light chain complementarity determining region 3 for antibody 56834
LQHNSYPYT

SEQ ID NO: 113668 - protein, 15 aa, Homo sapiens
  heavy chain complementarity determining region 3 for antibody 56834
AREGRLAVAGTGFDY

SEQ ID NO: 113669 - protein, 9 aa, Homo sapiens
  light chain complementarity determining region 3 for antibody 56835
LQHNSYPYT

SEQ ID NO: 113670 - protein, 15 aa, Homo sapiens
  heavy chain complementarity determining region 3 for antibody 56835
AREGRLAGAVTGFDY

SEQ ID NO: 113671 - protein, 9 aa, Homo sapiens
  light chain complementarity determining region 3 for antibody 56836
LQHNSYPYT

SEQ ID NO: 113672 - protein, 19 aa, Homo sapiens
  heavy chain complementarity determining region 3 for antibody 56836
ARDRDILTGYYSNSYGMDV

SEQ ID NO: 113673 - protein, 9 aa, Homo sapiens
  light chain complementarity determining region 3 for antibody 56837
LQHNSYPYT

SEQ ID NO: 113674 - protein, 20 aa, Homo sapiens
  heavy chain complementarity determining region 3 for antibody 56837
ARDPPYYDILTAYYRGFFDY

SEQ ID NO: 113675 - protein, 9 aa, Homo sapiens
  light chain complementarity determining region 3 for antibody 56838
LQHNSYPYT

SEQ ID NO: 113676 - protein, 15 aa, Homo sapiens
  heavy chain complementarity determining region 3 for antibody 56838
ARDPLRYFDWSHFDY

SEQ ID NO: 113677 - protein, 9 aa, Homo sapiens
  light chain complementarity determining region 3 for antibody 56839
LQHNSYPYT

SEQ ID NO: 113678 - protein, 19 aa, Homo sapiens
  heavy chain complementarity determining region 3 for antibody 56839
ARDNDILTGYYQDSYGMDV

SEQ ID NO: 113679 - protein, 9 aa, Homo sapiens
  light chain complementarity determining region 3 for antibody 56840
LQHNSYPYT

SEQ ID NO: 113680 - protein, 15 aa, Homo sapiens
  heavy chain complementarity determining region 3 for antibody 56840
ARAPLLLWFGEFIDY

SEQ ID NO: 113681 - protein, 9 aa, Homo sapiens
  light chain complementarity determining region 3 for antibody 56841
LQHNSYPYT

SEQ ID NO: 113682 - protein, 13 aa, Homo sapiens
  heavy chain complementarity determining region 3 for antibody 56841
AGIRYFDWLPFDY

SEQ ID NO: 113683 - protein, 9 aa, Homo sapiens
  light chain complementarity determining region 3 for antibody 56842
LQHNSYPYT

SEQ ID NO: 113684 - protein, 15 aa, Homo sapiens
  heavy chain complementarity determining region 3 for antibody 56842
AGEGRLAVAVTGFDY

SEQ ID NO: 113685 - protein, 9 aa, Homo sapiens
  light chain complementarity determining region 3 for antibody 56843
LQHNSYPYT

SEQ ID NO: 113686 - protein, 19 aa, Homo sapiens
  heavy chain complementarity determining region 3 for antibody 56843
AGDRDILTGYYSNYYGMDV

SEQ ID NO: 113687 - protein, 9 aa, Homo sapiens
  light chain complementarity determining region 3 for antibody 56844
LQHNSYPWT

SEQ ID NO: 113688 - protein, 11 aa, Homo sapiens
  heavy chain complementarity determining region 3 for antibody 56844
SGYSSTWSFDY

SEQ ID NO: 113689 - protein, 9 aa, Homo sapiens
  light chain complementarity determining region 3 for antibody 56845
LQHNSYPWT

SEQ ID NO: 113690 - protein, 12 aa, Homo sapiens
  heavy chain complementarity determining region 3 for antibody 56845
ATDIMVRGVIDY

SEQ ID NO: 113691 - protein, 9 aa, Homo sapiens
  light chain complementarity determining region 3 for antibody 56846
LQHNSYPWT

SEQ ID NO: 113692 - protein, 11 aa, Homo sapiens
  heavy chain complementarity determining region 3 for antibody 56846
ARGVVGAATDY

SEQ ID NO: 113693 - protein, 9 aa, Homo sapiens
  light chain complementarity determining region 3 for antibody 56847
LQHNSYPWT

SEQ ID NO: 113694 - protein, 12 aa, Homo sapiens
  heavy chain complementarity determining region 3 for antibody 56847
AREIMVRGVIDY

SEQ ID NO: 113695 - protein, 9 aa, Homo sapiens
  light chain complementarity determining region 3 for antibody 56848
LQHNSYPWT

SEQ ID NO: 113696 - protein, 13 aa, Homo sapiens
  heavy chain complementarity determining region 3 for antibody 56848
AREEYSGYDYDDY

SEQ ID NO: 113697 - protein, 9 aa, Homo sapiens
  light chain complementarity determining region 3 for antibody 56849
LQHNSYPWT

SEQ ID NO: 113698 - protein, 19 aa, Homo sapiens
  heavy chain complementarity determining region 3 for antibody 56849
AREDSSGWYVEYYYYGMDV

SEQ ID NO: 113699 - protein, 9 aa, Homo sapiens
  light chain complementarity determining region 3 for antibody 56850
LQHNSYPWT

SEQ ID NO: 113700 - protein, 12 aa, Homo sapiens
  heavy chain complementarity determining region 3 for antibody 56850
ARDVMVRGVIDY

SEQ ID NO: 113701 - protein, 9 aa, Homo sapiens
  light chain complementarity determining region 3 for antibody 56851
LQHNSYPWT

SEQ ID NO: 113702 - protein, 12 aa, Homo sapiens
  heavy chain complementarity determining region 3 for antibody 56851
ARDSMVRGVIDY

SEQ ID NO: 113703 - protein, 9 aa, Homo sapiens
  light chain complementarity determining region 3 for antibody 56852
LQHNSYPWT

SEQ ID NO: 113704 - protein, 12 aa, Homo sapiens
  heavy chain complementarity determining region 3 for antibody 56852
ARDITVRGAIDY

SEQ ID NO: 113705 - protein, 9 aa, Homo sapiens
  light chain complementarity determining region 3 for antibody 56853
LQHNSYPWT

SEQ ID NO: 113706 - protein, 12 aa, Homo sapiens
  heavy chain complementarity determining region 3 for antibody 56853
ARDIMVRRVIDY

SEQ ID NO: 113707 - protein, 9 aa, Homo sapiens
  light chain complementarity determining region 3 for antibody 56854
LQHNSYPWT

SEQ ID NO: 113708 - protein, 12 aa, Homo sapiens
  heavy chain complementarity determining region 3 for antibody 56854
ARDIMVPGGIDY

SEQ ID NO: 113709 - protein, 9 aa, Homo sapiens
  light chain complementarity determining region 3 for antibody 56855
LQHNSYPWT

SEQ ID NO: 113710 - protein, 15 aa, Homo sapiens
  heavy chain complementarity determining region 3 for antibody 56855
ARAPLLLWFGEFIDY

SEQ ID NO: 113711 - protein, 9 aa, Homo sapiens
  light chain complementarity determining region 3 for antibody 56856
LQHNSYPWT

SEQ ID NO: 113712 - protein, 18 aa, Homo sapiens
  heavy chain complementarity determining region 3 for antibody 56856
AKRDTAMVPPHYYYGMDV

SEQ ID NO: 113713 - protein, 9 aa, Homo sapiens
  light chain complementarity determining region 3 for antibody 56857
LQHNSYPWT

SEQ ID NO: 113714 - protein, 19 aa, Homo sapiens
  heavy chain complementarity determining region 3 for antibody 56857
AKEEDILTGYYRDYYAMDV

SEQ ID NO: 113715 - protein, 9 aa, Homo sapiens
  light chain complementarity determining region 3 for antibody 56858
LQHNSYPWT

SEQ ID NO: 113716 - protein, 19 aa, Homo sapiens
  heavy chain complementarity determining region 3 for antibody 56858
AKDEEILTGYYSDYYAMDV

SEQ ID NO: 113717 - protein, 9 aa, Homo sapiens
  light chain complementarity determining region 3 for antibody 56859
LQHNSYPWT

SEQ ID NO: 113718 - protein, 19 aa, Homo sapiens
  heavy chain complementarity determining region 3 for antibody 56859
AKDEDSLTGYYRDYYATDV

SEQ ID NO: 113719 - protein, 9 aa, Homo sapiens
  light chain complementarity determining region 3 for antibody 56860
LQHNSYPWT

SEQ ID NO: 113720 - protein, 19 aa, Homo sapiens
  heavy chain complementarity determining region 3 for antibody 56860
AKDEDMLTGYYRDYYAMDV

SEQ ID NO: 113721 - protein, 9 aa, Homo sapiens
  light chain complementarity determining region 3 for antibody 56861
LQHNSYPWT

SEQ ID NO: 113722 - protein, 19 aa, Homo sapiens
  heavy chain complementarity determining region 3 for antibody 56861
AKDEDILTGYYRDYYAMDA

SEQ ID NO: 113723 - protein, 9 aa, Homo sapiens
  light chain complementarity determining region 3 for antibody 56862
LQHNSYPWT

SEQ ID NO: 113724 - protein, 19 aa, Homo sapiens
  heavy chain complementarity determining region 3 for antibody 56862
AKDEDILTGYYRDYYAKDV

SEQ ID NO: 113725 - protein, 9 aa, Homo sapiens
  light chain complementarity determining region 3 for antibody 56863
LQHNSYPWT

SEQ ID NO: 113726 - protein, 19 aa, Homo sapiens
  heavy chain complementarity determining region 3 for antibody 56863
AKDEDILTGYYRAYYATDV

SEQ ID NO: 113727 - protein, 9 aa, Homo sapiens
  light chain complementarity determining region 3 for antibody 56864
LQHNSYPWT

SEQ ID NO: 113728 - protein, 19 aa, Homo sapiens
  heavy chain complementarity determining region 3 for antibody 56864
AKDEDILTGYDRDYYAMDV

SEQ ID NO: 113729 - protein, 9 aa, Homo sapiens
  light chain complementarity determining region 3 for antibody 56865
LQHNSYPWT

SEQ ID NO: 113730 - protein, 19 aa, Homo sapiens
  heavy chain complementarity determining region 3 for antibody 56865
AKDEDILAGYYRDYYATDV

SEQ ID NO: 113731 - protein, 9 aa, Homo sapiens
  light chain complementarity determining region 3 for antibody 56866
LQHNSYPWT

SEQ ID NO: 113732 - protein, 16 aa, Homo sapiens
  heavy chain complementarity determining region 3 for antibody 56866
AGDKAYDILTGYYPAY

SEQ ID NO: 113733 - protein, 9 aa, Homo sapiens
  light chain complementarity determining region 3 for antibody 56867
LQHNSYPST

SEQ ID NO: 113734 - protein, 16 aa, Homo sapiens
  heavy chain complementarity determining region 3 for antibody 56867
AGLFVDIVVVPAAFDY

SEQ ID NO: 113735 - protein, 9 aa, Homo sapiens
  light chain complementarity determining region 3 for antibody 56868
LQHNSYPRT

SEQ ID NO: 113736 - protein, 9 aa, Homo sapiens
  heavy chain complementarity determining region 3 for antibody 56868
RRVRGVMDV

SEQ ID NO: 113737 - protein, 9 aa, Homo sapiens
  light chain complementarity determining region 3 for antibody 56869
LQHNSYPRT

SEQ ID NO: 113738 - protein, 9 aa, Homo sapiens
  heavy chain complementarity determining region 3 for antibody 56869
LMVRRVMDV

SEQ ID NO: 113739 - protein, 9 aa, Homo sapiens
  light chain complementarity determining region 3 for antibody 56870
LQHNSYPRT

SEQ ID NO: 113740 - protein, 9 aa, Homo sapiens
  heavy chain complementarity determining region 3 for antibody 56870
LMVRGVMEV

SEQ ID NO: 113741 - protein, 9 aa, Homo sapiens
  light chain complementarity determining region 3 for antibody 56871
LQHNSYPRT

SEQ ID NO: 113742 - protein, 9 aa, Homo sapiens
  heavy chain complementarity determining region 3 for antibody 56871
LMVRGVMDF

SEQ ID NO: 113743 - protein, 9 aa, Homo sapiens
  light chain complementarity determining region 3 for antibody 56872
LQHNSYPRT

SEQ ID NO: 113744 - protein, 9 aa, Homo sapiens
  heavy chain complementarity determining region 3 for antibody 56872
LMVRGDMDV

SEQ ID NO: 113745 - protein, 9 aa, Homo sapiens
  light chain complementarity determining region 3 for antibody 56873
LQHNSYPRT

SEQ ID NO: 113746 - protein, 9 aa, Homo sapiens
  heavy chain complementarity determining region 3 for antibody 56873
LMVPGVMDA

SEQ ID NO: 113747 - protein, 9 aa, Homo sapiens
  light chain complementarity determining region 3 for antibody 56874
LQHNSYPRT

SEQ ID NO: 113748 - protein, 14 aa, Homo sapiens
  heavy chain complementarity determining region 3 for antibody 56874
ATGGGSYYYYGMDV

SEQ ID NO: 113749 - protein, 9 aa, Homo sapiens
  light chain complementarity determining region 3 for antibody 56875
LQHNSYPRT

SEQ ID NO: 113750 - protein, 16 aa, Homo sapiens
  heavy chain complementarity determining region 3 for antibody 56875
ASLFVDIVVVPAAFDY

SEQ ID NO: 113751 - protein, 9 aa, Homo sapiens
  light chain complementarity determining region 3 for antibody 56876
LQHNSYPRT

SEQ ID NO: 113752 - protein, 10 aa, Homo sapiens
  heavy chain complementarity determining region 3 for antibody 56876
ASCYGDSFDY

SEQ ID NO: 113753 - protein, 9 aa, Homo sapiens
  light chain complementarity determining region 3 for antibody 56877
LQHNSYPRT

SEQ ID NO: 113754 - protein, 24 aa, Homo sapiens
  heavy chain complementarity determining region 3 for antibody 56877
AREWEGNYGSGSYYKSAYYYGMDV

SEQ ID NO: 113755 - protein, 9 aa, Homo sapiens
  light chain complementarity determining region 3 for antibody 56878
LQHNSYPRT

SEQ ID NO: 113756 - protein, 13 aa, Homo sapiens
  heavy chain complementarity determining region 3 for antibody 56878
ARDRYSGYGAFDY

SEQ ID NO: 113757 - protein, 9 aa, Homo sapiens
  light chain complementarity determining region 3 for antibody 56879
LQHNSYPRT

SEQ ID NO: 113758 - protein, 15 aa, Homo sapiens
  heavy chain complementarity determining region 3 for antibody 56879
ARDPYNYYYYYGMDV

SEQ ID NO: 113759 - protein, 9 aa, Homo sapiens
  light chain complementarity determining region 3 for antibody 56880
LQHNSYPRT

SEQ ID NO: 113760 - protein, 9 aa, Homo sapiens
  heavy chain complementarity determining region 3 for antibody 56880
ARDGLGIDY

SEQ ID NO: 113761 - protein, 9 aa, Homo sapiens
  light chain complementarity determining region 3 for antibody 56881
LQHNSYPRT

SEQ ID NO: 113762 - protein, 19 aa, Homo sapiens
  heavy chain complementarity determining region 3 for antibody 56881
AKDEDILTGYYRDYYAMDV

SEQ ID NO: 113763 - protein, 9 aa, Homo sapiens
  light chain complementarity determining region 3 for antibody 56882
LQHNSYPLT

SEQ ID NO: 113764 - protein, 17 aa, Homo sapiens
  heavy chain complementarity determining region 3 for antibody 56882
AREGDYFGSGSYPHFDY

SEQ ID NO: 113765 - protein, 9 aa, Homo sapiens
  light chain complementarity determining region 3 for antibody 56883
LQHNSYPFT

SEQ ID NO: 113766 - protein, 16 aa, Homo sapiens
  heavy chain complementarity determining region 3 for antibody 56883
GGLFVDIVVVPAAFDY

SEQ ID NO: 113767 - protein, 9 aa, Homo sapiens
  light chain complementarity determining region 3 for antibody 56884
LQHNSYPFT

SEQ ID NO: 113768 - protein, 16 aa, Homo sapiens
  heavy chain complementarity determining region 3 for antibody 56884
ESLFVDIVVVPAAFDY

SEQ ID NO: 113769 - protein, 9 aa, Homo sapiens
  light chain complementarity determining region 3 for antibody 56885
LQHNSYPFT

SEQ ID NO: 113770 - protein, 16 aa, Homo sapiens
  heavy chain complementarity determining region 3 for antibody 56885
ASRCVDIVVVPAAFDY

SEQ ID NO: 113771 - protein, 9 aa, Homo sapiens
  light chain complementarity determining region 3 for antibody 56886
LQHNSYPFT

SEQ ID NO: 113772 - protein, 16 aa, Homo sapiens
  heavy chain complementarity determining region 3 for antibody 56886
ASLFVDSVVVPAAFDY

SEQ ID NO: 113773 - protein, 9 aa, Homo sapiens
  light chain complementarity determining region 3 for antibody 56887
LQHNSYPFT

SEQ ID NO: 113774 - protein, 16 aa, Homo sapiens
  heavy chain complementarity determining region 3 for antibody 56887
ASLFVDIVVVSAAFDY

SEQ ID NO: 113775 - protein, 9 aa, Homo sapiens
  light chain complementarity determining region 3 for antibody 56888
LQHNSYPFT

SEQ ID NO: 113776 - protein, 16 aa, Homo sapiens
  heavy chain complementarity determining region 3 for antibody 56888
ASLFVDIVVVPAALDY

SEQ ID NO: 113777 - protein, 9 aa, Homo sapiens
  light chain complementarity determining region 3 for antibody 56889
LQHNSYPFT

SEQ ID NO: 113778 - protein, 16 aa, Homo sapiens
  heavy chain complementarity determining region 3 for antibody 56889
ASLFVDIGVVPAAFDY

SEQ ID NO: 113779 - protein, 9 aa, Homo sapiens
  light chain complementarity determining region 3 for antibody 56890
LQHNSYPFT

SEQ ID NO: 113780 - protein, 16 aa, Homo sapiens
  heavy chain complementarity determining region 3 for antibody 56890
ASLCVDIVVVPAAFDY

SEQ ID NO: 113781 - protein, 9 aa, Homo sapiens
  light chain complementarity determining region 3 for antibody 56891
LQHNSYPFT

SEQ ID NO: 113782 - protein, 16 aa, Homo sapiens
  heavy chain complementarity determining region 3 for antibody 56891
ASHFVDIVVVPAAFDY

SEQ ID NO: 113783 - protein, 9 aa, Homo sapiens
  light chain complementarity determining region 3 for antibody 56892
LQHNSYPFT

SEQ ID NO: 113784 - protein, 13 aa, Homo sapiens
  heavy chain complementarity determining region 3 for antibody 56892
ARYSSSWYDAFDI

SEQ ID NO: 113785 - protein, 9 aa, Homo sapiens
  light chain complementarity determining region 3 for antibody 56893
LQHNSYPFT

SEQ ID NO: 113786 - protein, 8 aa, Homo sapiens
  heavy chain complementarity determining region 3 for antibody 56893
ARTGPLDY

SEQ ID NO: 113787 - protein, 9 aa, Homo sapiens
  light chain complementarity determining region 3 for antibody 56894
LQHNSYPFT

SEQ ID NO: 113788 - protein, 24 aa, Homo sapiens
  heavy chain complementarity determining region 3 for antibody 56894
AREWEGNYGSGSYYKSAYYYGMDV

SEQ ID NO: 113789 - protein, 9 aa, Homo sapiens
  light chain complementarity determining region 3 for antibody 56895
LQHNSYPFT

SEQ ID NO: 113790 - protein, 9 aa, Homo sapiens
  heavy chain complementarity determining region 3 for antibody 56895
ARDGLGIDY

SEQ ID NO: 113791 - protein, 9 aa, Homo sapiens
  light chain complementarity determining region 3 for antibody 56896
LQHNSYPFT

SEQ ID NO: 113792 - protein, 16 aa, Homo sapiens
  heavy chain complementarity determining region 3 for antibody 56896
AGRFVDIVVVPAAFDY

SEQ ID NO: 113793 - protein, 9 aa, Homo sapiens
  light chain complementarity determining region 3 for antibody 56897
LQHNSYPFT

SEQ ID NO: 113794 - protein, 16 aa, Homo sapiens
  heavy chain complementarity determining region 3 for antibody 56897
AGLFVDIVGVPAAFDY

SEQ ID NO: 113795 - protein, 9 aa, Homo sapiens
  light chain complementarity determining region 3 for antibody 56898
LQHNSSPYT

SEQ ID NO: 113796 - protein, 15 aa, Homo sapiens
  heavy chain complementarity determining region 3 for antibody 56898
AREGRLAVAVTGFDY

SEQ ID NO: 113797 - protein, 9 aa, Homo sapiens
  light chain complementarity determining region 3 for antibody 56899
LQHNSCPWT

SEQ ID NO: 113798 - protein, 12 aa, Homo sapiens
  heavy chain complementarity determining region 3 for antibody 56899
ARDIMVRGVIDY

SEQ ID NO: 113799 - protein, 9 aa, Homo sapiens
  light chain complementarity determining region 3 for antibody 56900
LQHNRYPPT

SEQ ID NO: 113800 - protein, 16 aa, Homo sapiens
  heavy chain complementarity determining region 3 for antibody 56900
ARGRGTMVRGVSPFDY

SEQ ID NO: 113801 - protein, 9 aa, Homo sapiens
  light chain complementarity determining region 3 for antibody 56901
LQHITYPPT

SEQ ID NO: 113802 - protein, 16 aa, Homo sapiens
  heavy chain complementarity determining region 3 for antibody 56901
ARGRGTMVRGVIPFDY

SEQ ID NO: 113803 - protein, 9 aa, Homo sapiens
  light chain complementarity determining region 3 for antibody 56902
LQHHSYPWT

SEQ ID NO: 113804 - protein, 14 aa, Homo sapiens
  heavy chain complementarity determining region 3 for antibody 56902
ARGLVRYLDWLEDY

SEQ ID NO: 113805 - protein, 9 aa, Homo sapiens
  light chain complementarity determining region 3 for antibody 56903
LQHHSYPWT

SEQ ID NO: 113806 - protein, 14 aa, Homo sapiens
  heavy chain complementarity determining region 3 for antibody 56903
ARGLVRYFDWVEDY

SEQ ID NO: 113807 - protein, 9 aa, Homo sapiens
  light chain complementarity determining region 3 for antibody 56904
LQHDTYPWT

SEQ ID NO: 113808 - protein, 14 aa, Homo sapiens
  heavy chain complementarity determining region 3 for antibody 56904
ARDRELLWSGELLP

SEQ ID NO: 113809 - protein, 9 aa, Homo sapiens
  light chain complementarity determining region 3 for antibody 56905
LQHDTYPWT

SEQ ID NO: 113810 - protein, 14 aa, Homo sapiens
  heavy chain complementarity determining region 3 for antibody 56905
ARDRELLWFGELFH

SEQ ID NO: 113811 - protein, 9 aa, Homo sapiens
  light chain complementarity determining region 3 for antibody 56906
LQHDSYPYT

SEQ ID NO: 113812 - protein, 15 aa, Homo sapiens
  heavy chain complementarity determining region 3 for antibody 56906
AREGRLAAAVTGFDY

SEQ ID NO: 113813 - protein, 9 aa, Homo sapiens
  light chain complementarity determining region 3 for antibody 56907
LQHDSYPYA

SEQ ID NO: 113814 - protein, 15 aa, Homo sapiens
  heavy chain complementarity determining region 3 for antibody 56907
ARHKREAPGYWYFDL

SEQ ID NO: 113815 - protein, 9 aa, Homo sapiens
  light chain complementarity determining region 3 for antibody 56908
LQHDNFPYT

SEQ ID NO: 113816 - protein, 12 aa, Homo sapiens
  heavy chain complementarity determining region 3 for antibody 56908
ATDIAATSYFDY

SEQ ID NO: 113817 - protein, 9 aa, Homo sapiens
  light chain complementarity determining region 3 for antibody 56909
LQHDNFPYT

SEQ ID NO: 113818 - protein, 7 aa, Homo sapiens
  heavy chain complementarity determining region 3 for antibody 56909
ARDAGDY

SEQ ID NO: 113819 - protein, 9 aa, Homo sapiens
  light chain complementarity determining region 3 for antibody 56910
LQHDNFPWT

SEQ ID NO: 113820 - protein, 16 aa, Homo sapiens
  heavy chain complementarity determining region 3 for antibody 56910
ATCSPGIAAARDAFDI

SEQ ID NO: 113821 - protein, 9 aa, Homo sapiens
  light chain complementarity determining region 3 for antibody 56911
LQHDNFPWT

SEQ ID NO: 113822 - protein, 16 aa, Homo sapiens
  heavy chain complementarity determining region 3 for antibody 56911
AAFSAGIAAARDAFDI

SEQ ID NO: 113823 - protein, 8 aa, Homo sapiens
  light chain complementarity determining region 3 for antibody 56912
LQHDNFPP

SEQ ID NO: 113824 - protein, 17 aa, Homo sapiens
  heavy chain complementarity determining region 3 for antibody 56912
ARDRIAAAAYYYYGMDV

SEQ ID NO: 113825 - protein, 10 aa, Homo sapiens
  light chain complementarity determining region 3 for antibody 56913
LQHDNFLMYT

SEQ ID NO: 113826 - protein, 7 aa, Homo sapiens
  heavy chain complementarity determining region 3 for antibody 56913
AKAYYDT

SEQ ID NO: 113827 - protein, 9 aa, Homo sapiens
  light chain complementarity determining region 3 for antibody 56914
LQGYNYPFT

SEQ ID NO: 113828 - protein, 15 aa, Homo sapiens
  heavy chain complementarity determining region 3 for antibody 56914
ARAPLLLWFGEFIDY

SEQ ID NO: 113829 - protein, 9 aa, Homo sapiens
  light chain complementarity determining region 3 for antibody 56915
LQDYNYTFT

SEQ ID NO: 113830 - protein, 15 aa, Homo sapiens
  heavy chain complementarity determining region 3 for antibody 56915
ARAPLLLWFGEFIDY

SEQ ID NO: 113831 - protein, 9 aa, Homo sapiens
  light chain complementarity determining region 3 for antibody 56916
LQDYNYPYT

SEQ ID NO: 113832 - protein, 12 aa, Homo sapiens
  heavy chain complementarity determining region 3 for antibody 56916
TTDPQRIFPFDY

SEQ ID NO: 113833 - protein, 9 aa, Homo sapiens
  light chain complementarity determining region 3 for antibody 56917
LQDYNYPYT

SEQ ID NO: 113834 - protein, 12 aa, Homo sapiens
  heavy chain complementarity determining region 3 for antibody 56917
TLYGSENYGWDS

SEQ ID NO: 113835 - protein, 9 aa, Homo sapiens
  light chain complementarity determining region 3 for antibody 56918
LQDYNYPYT

SEQ ID NO: 113836 - protein, 9 aa, Homo sapiens
  heavy chain complementarity determining region 3 for antibody 56918
ASVLTGGDY

SEQ ID NO: 113837 - protein, 9 aa, Homo sapiens
  light chain complementarity determining region 3 for antibody 56919
LQDYNYPYT

SEQ ID NO: 113838 - protein, 12 aa, Homo sapiens
  heavy chain complementarity determining region 3 for antibody 56919
ARVWELLGFFDY

SEQ ID NO: 113839 - protein, 9 aa, Homo sapiens
  light chain complementarity determining region 3 for antibody 56920
LQDYNYPYT

SEQ ID NO: 113840 - protein, 19 aa, Homo sapiens
  heavy chain complementarity determining region 3 for antibody 56920
ARVSDILTGYYKGGDAFDF

SEQ ID NO: 113841 - protein, 9 aa, Homo sapiens
  light chain complementarity determining region 3 for antibody 56921
LQDYNYPYT

SEQ ID NO: 113842 - protein, 14 aa, Homo sapiens
  heavy chain complementarity determining region 3 for antibody 56921
ARRYPDSYYYGMDV

SEQ ID NO: 113843 - protein, 9 aa, Homo sapiens
  light chain complementarity determining region 3 for antibody 56922
LQDYNYPYT

SEQ ID NO: 113844 - protein, 22 aa, Homo sapiens
  heavy chain complementarity determining region 3 for antibody 56922
ARGRRDYDILTGSYYYYYGMDV

SEQ ID NO: 113845 - protein, 9 aa, Homo sapiens
  light chain complementarity determining region 3 for antibody 56923
LQDYNYPYT

SEQ ID NO: 113846 - protein, 14 aa, Homo sapiens
  heavy chain complementarity determining region 3 for antibody 56923
ARGPPRIVGALFDY

SEQ ID NO: 113847 - protein, 9 aa, Homo sapiens
  light chain complementarity determining region 3 for antibody 56924
LQDYNYPYT

SEQ ID NO: 113848 - protein, 24 aa, Homo sapiens
  heavy chain complementarity determining region 3 for antibody 56924
AREWEGNYGSGSYYKSAYYYGMDV

SEQ ID NO: 113849 - protein, 9 aa, Homo sapiens
  light chain complementarity determining region 3 for antibody 56925
LQDYNYPYT

SEQ ID NO: 113850 - protein, 16 aa, Homo sapiens
  heavy chain complementarity determining region 3 for antibody 56925
ARDVTAADYYYYGMDV

SEQ ID NO: 113851 - protein, 9 aa, Homo sapiens
  light chain complementarity determining region 3 for antibody 56926
LQDYNYPYT

SEQ ID NO: 113852 - protein, 19 aa, Homo sapiens
  heavy chain complementarity determining region 3 for antibody 56926
ARDRVAVAGAYYYYYGMDV

SEQ ID NO: 113853 - protein, 9 aa, Homo sapiens
  light chain complementarity determining region 3 for antibody 56927
LQDYNYPYT

SEQ ID NO: 113854 - protein, 14 aa, Homo sapiens
  heavy chain complementarity determining region 3 for antibody 56927
ARDPRRIVGALFDY

SEQ ID NO: 113855 - protein, 9 aa, Homo sapiens
  light chain complementarity determining region 3 for antibody 56928
LQDYNYPYT

SEQ ID NO: 113856 - protein, 17 aa, Homo sapiens
  heavy chain complementarity determining region 3 for antibody 56928
ARDGGITMVRGVNRFDY

SEQ ID NO: 113857 - protein, 9 aa, Homo sapiens
  light chain complementarity determining region 3 for antibody 56929
LQDYNYPYT

SEQ ID NO: 113858 - protein, 11 aa, Homo sapiens
  heavy chain complementarity determining region 3 for antibody 56929
ARDEHVLRYYD

SEQ ID NO: 113859 - protein, 9 aa, Homo sapiens
  light chain complementarity determining region 3 for antibody 56930
LQDYNYPYT

SEQ ID NO: 113860 - protein, 11 aa, Homo sapiens
  heavy chain complementarity determining region 3 for antibody 56930
ARDEHVLRYCD

SEQ ID NO: 113861 - protein, 9 aa, Homo sapiens
  light chain complementarity determining region 3 for antibody 56931
LQDYNYPYT

SEQ ID NO: 113862 - protein, 14 aa, Homo sapiens
  heavy chain complementarity determining region 3 for antibody 56931
AKPLYGDYGGYFDY

SEQ ID NO: 113863 - protein, 9 aa, Homo sapiens
  light chain complementarity determining region 3 for antibody 56932
LQDYNYPYT

SEQ ID NO: 113864 - protein, 14 aa, Homo sapiens
  heavy chain complementarity determining region 3 for antibody 56932
AKPLYGDHGGYFDY

SEQ ID NO: 113865 - protein, 9 aa, Homo sapiens
  light chain complementarity determining region 3 for antibody 56933
LQDYNYPYT

SEQ ID NO: 113866 - protein, 12 aa, Homo sapiens
  heavy chain complementarity determining region 3 for antibody 56933
AKGLLWFGELGD

SEQ ID NO: 113867 - protein, 9 aa, Homo sapiens
  light chain complementarity determining region 3 for antibody 56934
LQDYNYPYT

SEQ ID NO: 113868 - protein, 16 aa, Homo sapiens
  heavy chain complementarity determining region 3 for antibody 56934
AKEGPIAAAVTGAFDI

SEQ ID NO: 113869 - protein, 9 aa, Homo sapiens
  light chain complementarity determining region 3 for antibody 56935
LQDYNYPYT

SEQ ID NO: 113870 - protein, 16 aa, Homo sapiens
  heavy chain complementarity determining region 3 for antibody 56935
AEEGPIAAAGTGAFDI

SEQ ID NO: 113871 - protein, 9 aa, Homo sapiens
  light chain complementarity determining region 3 for antibody 56936
LQDYNYPWT

SEQ ID NO: 113872 - protein, 16 aa, Homo sapiens
  heavy chain complementarity determining region 3 for antibody 56936
AWDAKYYDILTGYPDY

SEQ ID NO: 113873 - protein, 9 aa, Homo sapiens
  light chain complementarity determining region 3 for antibody 56937
LQDYNYPWT

SEQ ID NO: 113874 - protein, 12 aa, Homo sapiens
  heavy chain complementarity determining region 3 for antibody 56937
ASDTMVRGVIDS

SEQ ID NO: 113875 - protein, 9 aa, Homo sapiens
  light chain complementarity determining region 3 for antibody 56938
LQDYNYPWT

SEQ ID NO: 113876 - protein, 12 aa, Homo sapiens
  heavy chain complementarity determining region 3 for antibody 56938
ASDAMVRGVIDY

SEQ ID NO: 113877 - protein, 9 aa, Homo sapiens
  light chain complementarity determining region 3 for antibody 56939
LQDYNYPWT

SEQ ID NO: 113878 - protein, 20 aa, Homo sapiens
  heavy chain complementarity determining region 3 for antibody 56939
ARSGTYYYGSGSYYNPSLTD

SEQ ID NO: 113879 - protein, 9 aa, Homo sapiens
  light chain complementarity determining region 3 for antibody 56940
LQDYNYPWT

SEQ ID NO: 113880 - protein, 22 aa, Homo sapiens
  heavy chain complementarity determining region 3 for antibody 56940
ARSDYYGSGSYYNDYYYYGMDV

SEQ ID NO: 113881 - protein, 9 aa, Homo sapiens
  light chain complementarity determining region 3 for antibody 56941
LQDYNYPWT

SEQ ID NO: 113882 - protein, 14 aa, Homo sapiens
  heavy chain complementarity determining region 3 for antibody 56941
ARRYFDWLPDAFDI

SEQ ID NO: 113883 - protein, 9 aa, Homo sapiens
  light chain complementarity determining region 3 for antibody 56942
LQDYNYPWT

SEQ ID NO: 113884 - protein, 22 aa, Homo sapiens
  heavy chain complementarity determining region 3 for antibody 56942
ARRDYYGSGSYYTDYYYYGMDV

SEQ ID NO: 113885 - protein, 9 aa, Homo sapiens
  light chain complementarity determining region 3 for antibody 56943
LQDYNYPWT

SEQ ID NO: 113886 - protein, 22 aa, Homo sapiens
  heavy chain complementarity determining region 3 for antibody 56943
ARRDYYGSGSDYNDYYYYGMDV

SEQ ID NO: 113887 - protein, 9 aa, Homo sapiens
  light chain complementarity determining region 3 for antibody 56944
LQDYNYPWT

SEQ ID NO: 113888 - protein, 22 aa, Homo sapiens
  heavy chain complementarity determining region 3 for antibody 56944
ARRDYDGSGSYYNDYYSYGMDV

SEQ ID NO: 113889 - protein, 9 aa, Homo sapiens
  light chain complementarity determining region 3 for antibody 56945
LQDYNYPWT

SEQ ID NO: 113890 - protein, 13 aa, Homo sapiens
  heavy chain complementarity determining region 3 for antibody 56945
ARIAAAAVQYFQH

SEQ ID NO: 113891 - protein, 9 aa, Homo sapiens
  light chain complementarity determining region 3 for antibody 56946
LQDYNYPWT

SEQ ID NO: 113892 - protein, 12 aa, Homo sapiens
  heavy chain complementarity determining region 3 for antibody 56946
ARETTVRGVIDY

SEQ ID NO: 113893 - protein, 9 aa, Homo sapiens
  light chain complementarity determining region 3 for antibody 56947
LQDYNYPWT

SEQ ID NO: 113894 - protein, 12 aa, Homo sapiens
  heavy chain complementarity determining region 3 for antibody 56947
ARETMVRGAIDY

SEQ ID NO: 113895 - protein, 9 aa, Homo sapiens
  light chain complementarity determining region 3 for antibody 56948
LQDYNYPWT

SEQ ID NO: 113896 - protein, 13 aa, Homo sapiens
  heavy chain complementarity determining region 3 for antibody 56948
AREGIAVAGDFDY

SEQ ID NO: 113897 - protein, 9 aa, Homo sapiens
  light chain complementarity determining region 3 for antibody 56949
LQDYNYPWT

SEQ ID NO: 113898 - protein, 16 aa, Homo sapiens
  heavy chain complementarity determining region 3 for antibody 56949
ARDVKYYDILTGYPDY

SEQ ID NO: 113899 - protein, 9 aa, Homo sapiens
  light chain complementarity determining region 3 for antibody 56950
LQDYNYPWT

SEQ ID NO: 113900 - protein, 12 aa, Homo sapiens
  heavy chain complementarity determining region 3 for antibody 56950
ARDTTVRGDIDY

SEQ ID NO: 113901 - protein, 9 aa, Homo sapiens
  light chain complementarity determining region 3 for antibody 56951
LQDYNYPWT

SEQ ID NO: 113902 - protein, 12 aa, Homo sapiens
  heavy chain complementarity determining region 3 for antibody 56951
ARDTTVPGVIDY

SEQ ID NO: 113903 - protein, 9 aa, Homo sapiens
  light chain complementarity determining region 3 for antibody 56952
LQDYNYPWT

SEQ ID NO: 113904 - protein, 12 aa, Homo sapiens
  heavy chain complementarity determining region 3 for antibody 56952
ARDTMVRGVIAS

SEQ ID NO: 113905 - protein, 9 aa, Homo sapiens
  light chain complementarity determining region 3 for antibody 56953
LQDYNYPWT

SEQ ID NO: 113906 - protein, 12 aa, Homo sapiens
  heavy chain complementarity determining region 3 for antibody 56953
ARDTMVRGAINY

SEQ ID NO: 113907 - protein, 9 aa, Homo sapiens
  light chain complementarity determining region 3 for antibody 56954
LQDYNYPWT

SEQ ID NO: 113908 - protein, 12 aa, Homo sapiens
  heavy chain complementarity determining region 3 for antibody 56954
ARDTMVQGVIDY

SEQ ID NO: 113909 - protein, 9 aa, Homo sapiens
  light chain complementarity determining region 3 for antibody 56955
LQDYNYPWT

SEQ ID NO: 113910 - protein, 12 aa, Homo sapiens
  heavy chain complementarity determining region 3 for antibody 56955
ARDTMVPGVIAY

SEQ ID NO: 113911 - protein, 9 aa, Homo sapiens
  light chain complementarity determining region 3 for antibody 56956
LQDYNYPWT

SEQ ID NO: 113912 - protein, 12 aa, Homo sapiens
  heavy chain complementarity determining region 3 for antibody 56956
ARDTIVRGVIDY

SEQ ID NO: 113913 - protein, 9 aa, Homo sapiens
  light chain complementarity determining region 3 for antibody 56957
LQDYNYPWT

SEQ ID NO: 113914 - protein, 12 aa, Homo sapiens
  heavy chain complementarity determining region 3 for antibody 56957
ARDSMVRGAIDY

SEQ ID NO: 113915 - protein, 9 aa, Homo sapiens
  light chain complementarity determining region 3 for antibody 56958
LQDYNYPWT

SEQ ID NO: 113916 - protein, 13 aa, Homo sapiens
  heavy chain complementarity determining region 3 for antibody 56958
ARDKDSTQLWLGY

SEQ ID NO: 113917 - protein, 9 aa, Homo sapiens
  light chain complementarity determining region 3 for antibody 56959
LQDYNYPWT

SEQ ID NO: 113918 - protein, 9 aa, Homo sapiens
  heavy chain complementarity determining region 3 for antibody 56959
ARDGLGTDY

SEQ ID NO: 113919 - protein, 9 aa, Homo sapiens
  light chain complementarity determining region 3 for antibody 56960
LQDYNYPWT

SEQ ID NO: 113920 - protein, 14 aa, Homo sapiens
  heavy chain complementarity determining region 3 for antibody 56960
ARDGGCSSSSCYDY

SEQ ID NO: 113921 - protein, 9 aa, Homo sapiens
  light chain complementarity determining region 3 for antibody 56961
LQDYNYPWT

SEQ ID NO: 113922 - protein, 16 aa, Homo sapiens
  heavy chain complementarity determining region 3 for antibody 56961
ARDAKYYDTLTGDPDY

SEQ ID NO: 113923 - protein, 9 aa, Homo sapiens
  light chain complementarity determining region 3 for antibody 56962
LQDYNYPWT

SEQ ID NO: 113924 - protein, 16 aa, Homo sapiens
  heavy chain complementarity determining region 3 for antibody 56962
ARDAKYYDTLSGYPDY

SEQ ID NO: 113925 - protein, 9 aa, Homo sapiens
  light chain complementarity determining region 3 for antibody 56963
LQDYNYPWT

SEQ ID NO: 113926 - protein, 16 aa, Homo sapiens
  heavy chain complementarity determining region 3 for antibody 56963
ARDAKYYDMLTGYPDY

SEQ ID NO: 113927 - protein, 9 aa, Homo sapiens
  light chain complementarity determining region 3 for antibody 56964
LQDYNYPWT

SEQ ID NO: 113928 - protein, 16 aa, Homo sapiens
  heavy chain complementarity determining region 3 for antibody 56964
ARDAKYYDIVTGYPDY

SEQ ID NO: 113929 - protein, 9 aa, Homo sapiens
  light chain complementarity determining region 3 for antibody 56965
LQDYNYPWT

SEQ ID NO: 113930 - protein, 16 aa, Homo sapiens
  heavy chain complementarity determining region 3 for antibody 56965
ARDAKYYDILTGYRDY

SEQ ID NO: 113931 - protein, 9 aa, Homo sapiens
  light chain complementarity determining region 3 for antibody 56966
LQDYNYPWT

SEQ ID NO: 113932 - protein, 16 aa, Homo sapiens
  heavy chain complementarity determining region 3 for antibody 56966
ARDAKYYDILTGYPAY

SEQ ID NO: 113933 - protein, 9 aa, Homo sapiens
  light chain complementarity determining region 3 for antibody 56967
LQDYNYPWT

SEQ ID NO: 113934 - protein, 16 aa, Homo sapiens
  heavy chain complementarity determining region 3 for antibody 56967
ARDAKYYDILTGSHDY

SEQ ID NO: 113935 - protein, 9 aa, Homo sapiens
  light chain complementarity determining region 3 for antibody 56968
LQDYNYPWT

SEQ ID NO: 113936 - protein, 16 aa, Homo sapiens
  heavy chain complementarity determining region 3 for antibody 56968
ARDAKYYDILTGDHDY

SEQ ID NO: 113937 - protein, 9 aa, Homo sapiens
  light chain complementarity determining region 3 for antibody 56969
LQDYNYPWT

SEQ ID NO: 113938 - protein, 16 aa, Homo sapiens
  heavy chain complementarity determining region 3 for antibody 56969
ARDAKYYDILSGYHDY

SEQ ID NO: 113939 - protein, 9 aa, Homo sapiens
  light chain complementarity determining region 3 for antibody 56970
LQDYNYPWT

SEQ ID NO: 113940 - protein, 16 aa, Homo sapiens
  heavy chain complementarity determining region 3 for antibody 56970
ARDAKYYDILSGSPDY

SEQ ID NO: 113941 - protein, 9 aa, Homo sapiens
  light chain complementarity determining region 3 for antibody 56971
LQDYNYPWT

SEQ ID NO: 113942 - protein, 15 aa, Homo sapiens
  heavy chain complementarity determining region 3 for antibody 56971
AKGGPPLYYYYGMDV

SEQ ID NO: 113943 - protein, 9 aa, Homo sapiens
  light chain complementarity determining region 3 for antibody 56972
LQDYNYPWT

SEQ ID NO: 113944 - protein, 14 aa, Homo sapiens
  heavy chain complementarity determining region 3 for antibody 56972
AGDGGCSSTSCYDY

SEQ ID NO: 113945 - protein, 9 aa, Homo sapiens
  light chain complementarity determining region 3 for antibody 56973
LQDYNYPWT

SEQ ID NO: 113946 - protein, 16 aa, Homo sapiens
  heavy chain complementarity determining region 3 for antibody 56973
AGDAKYYDILTGSPDY

SEQ ID NO: 113947 - protein, 9 aa, Homo sapiens
  light chain complementarity determining region 3 for antibody 56974
LQDYNYPWK

SEQ ID NO: 113948 - protein, 12 aa, Homo sapiens
  heavy chain complementarity determining region 3 for antibody 56974
ARDTMVWGVIDY

SEQ ID NO: 113949 - protein, 9 aa, Homo sapiens
  light chain complementarity determining region 3 for antibody 56975
LQDYNYPRT

SEQ ID NO: 113950 - protein, 12 aa, Homo sapiens
  heavy chain complementarity determining region 3 for antibody 56975
VRDTTVRGVIDY

SEQ ID NO: 113951 - protein, 9 aa, Homo sapiens
  light chain complementarity determining region 3 for antibody 56976
LQDYNYPRT

SEQ ID NO: 113952 - protein, 12 aa, Homo sapiens
  heavy chain complementarity determining region 3 for antibody 56976
VRDTMVRGVIDY

SEQ ID NO: 113953 - protein, 9 aa, Homo sapiens
  light chain complementarity determining region 3 for antibody 56977
LQDYNYPRT

SEQ ID NO: 113954 - protein, 14 aa, Homo sapiens
  heavy chain complementarity determining region 3 for antibody 56977
AREGYSSGPYYFDY

SEQ ID NO: 113955 - protein, 9 aa, Homo sapiens
  light chain complementarity determining region 3 for antibody 56978
LQDYNYPRT

SEQ ID NO: 113956 - protein, 15 aa, Homo sapiens
  heavy chain complementarity determining region 3 for antibody 56978
ARDLGSGIAVAGFDY

SEQ ID NO: 113957 - protein, 9 aa, Homo sapiens
  light chain complementarity determining region 3 for antibody 56979
LQDYNYPRT

SEQ ID NO: 113958 - protein, 11 aa, Homo sapiens
  heavy chain complementarity determining region 3 for antibody 56979
ARDEHVLRYVD

SEQ ID NO: 113959 - protein, 9 aa, Homo sapiens
  light chain complementarity determining region 3 for antibody 56980
LQDYNYPRT

SEQ ID NO: 113960 - protein, 16 aa, Homo sapiens
  heavy chain complementarity determining region 3 for antibody 56980
ARDAKYYDILTGYPDY

SEQ ID NO: 113961 - protein, 9 aa, Homo sapiens
  light chain complementarity determining region 3 for antibody 56981
LQDYNYPRT

SEQ ID NO: 113962 - protein, 18 aa, Homo sapiens
  heavy chain complementarity determining region 3 for antibody 56981
AKDQPEALYYYYYYGMDV

SEQ ID NO: 113963 - protein, 9 aa, Homo sapiens
  light chain complementarity determining region 3 for antibody 56982
LQDYNYPRT

SEQ ID NO: 113964 - protein, 20 aa, Homo sapiens
  heavy chain complementarity determining region 3 for antibody 56982
AKDQGDIVATIMDYYSGMDV

SEQ ID NO: 113965 - protein, 9 aa, Homo sapiens
  light chain complementarity determining region 3 for antibody 56983
LQDYNYPRT

SEQ ID NO: 113966 - protein, 20 aa, Homo sapiens
  heavy chain complementarity determining region 3 for antibody 56983
AEDQGDIVATIMDYYYGMDV

SEQ ID NO: 113967 - protein, 9 aa, Homo sapiens
  light chain complementarity determining region 3 for antibody 56984
LQDYNYPLT

SEQ ID NO: 113968 - protein, 17 aa, Homo sapiens
  heavy chain complementarity determining region 3 for antibody 56984
ARGLRYFDWLLSDAFDI

SEQ ID NO: 113969 - protein, 9 aa, Homo sapiens
  light chain complementarity determining region 3 for antibody 56985
LQDYNYPHT

SEQ ID NO: 113970 - protein, 11 aa, Homo sapiens
  heavy chain complementarity determining region 3 for antibody 56985
ARYYYYYGMAV

SEQ ID NO: 113971 - protein, 9 aa, Homo sapiens
  light chain complementarity determining region 3 for antibody 56986
LQDYNYPHT

SEQ ID NO: 113972 - protein, 11 aa, Homo sapiens
  heavy chain complementarity determining region 3 for antibody 56986
ARYYYYSGMDV

SEQ ID NO: 113973 - protein, 9 aa, Homo sapiens
  light chain complementarity determining region 3 for antibody 56987
LQDYNYPHT

SEQ ID NO: 113974 - protein, 11 aa, Homo sapiens
  heavy chain complementarity determining region 3 for antibody 56987
ARYYFYSGMDV

SEQ ID NO: 113975 - protein, 9 aa, Homo sapiens
  light chain complementarity determining region 3 for antibody 56988
LQDYNYPHT

SEQ ID NO: 113976 - protein, 11 aa, Homo sapiens
  heavy chain complementarity determining region 3 for antibody 56988
ARYYDYYGMDV

SEQ ID NO: 113977 - protein, 9 aa, Homo sapiens
  light chain complementarity determining region 3 for antibody 56989
LQDYNYPHT

SEQ ID NO: 113978 - protein, 11 aa, Homo sapiens
  heavy chain complementarity determining region 3 for antibody 56989
ARYSYSYGMDV

SEQ ID NO: 113979 - protein, 9 aa, Homo sapiens
  light chain complementarity determining region 3 for antibody 56990
LQDYNYPHT

SEQ ID NO: 113980 - protein, 11 aa, Homo sapiens
  heavy chain complementarity determining region 3 for antibody 56990
ARYSFSYGMDV

SEQ ID NO: 113981 - protein, 9 aa, Homo sapiens
  light chain complementarity determining region 3 for antibody 56991
LQDYNYPHT

SEQ ID NO: 113982 - protein, 11 aa, Homo sapiens
  heavy chain complementarity determining region 3 for antibody 56991
ARDYYYYGMDV

SEQ ID NO: 113983 - protein, 9 aa, Homo sapiens
  light chain complementarity determining region 3 for antibody 56992
LQDYNYPHT

SEQ ID NO: 113984 - protein, 15 aa, Homo sapiens
  heavy chain complementarity determining region 3 for antibody 56992
AKDQYSSGWYEGFDY

SEQ ID NO: 113985 - protein, 9 aa, Homo sapiens
  light chain complementarity determining region 3 for antibody 56993
LQDYNYPFT

SEQ ID NO: 113986 - protein, 10 aa, Homo sapiens
  heavy chain complementarity determining region 3 for antibody 56993
ATMTTVTFDY

SEQ ID NO: 113987 - protein, 9 aa, Homo sapiens
  light chain complementarity determining region 3 for antibody 56994
LQDYNYPFT

SEQ ID NO: 113988 - protein, 13 aa, Homo sapiens
  heavy chain complementarity determining region 3 for antibody 56994
ARYSSSWYDAFDI

SEQ ID NO: 113989 - protein, 9 aa, Homo sapiens
  light chain complementarity determining region 3 for antibody 56995
LQDYNYPFT

SEQ ID NO: 113990 - protein, 12 aa, Homo sapiens
  heavy chain complementarity determining region 3 for antibody 56995
ARYGSGVYGMDV

SEQ ID NO: 113991 - protein, 9 aa, Homo sapiens
  light chain complementarity determining region 3 for antibody 56996
LQDYNYPFT

SEQ ID NO: 113992 - protein, 15 aa, Homo sapiens
  heavy chain complementarity determining region 3 for antibody 56996
ARTPLLLWFGEFIDY

SEQ ID NO: 113993 - protein, 9 aa, Homo sapiens
  light chain complementarity determining region 3 for antibody 56997
LQDYNYPFT

SEQ ID NO: 113994 - protein, 8 aa, Homo sapiens
  heavy chain complementarity determining region 3 for antibody 56997
ARTGPLDY

SEQ ID NO: 113995 - protein, 9 aa, Homo sapiens
  light chain complementarity determining region 3 for antibody 56998
LQDYNYPFT

SEQ ID NO: 113996 - protein, 15 aa, Homo sapiens
  heavy chain complementarity determining region 3 for antibody 56998
ARSPLLLWFGEFIDY

SEQ ID NO: 113997 - protein, 9 aa, Homo sapiens
  light chain complementarity determining region 3 for antibody 56999
LQDYNYPFT

SEQ ID NO: 113998 - protein, 10 aa, Homo sapiens
  heavy chain complementarity determining region 3 for antibody 56999
ARMTTVTFAY

SEQ ID NO: 113999 - protein, 9 aa, Homo sapiens
  light chain complementarity determining region 3 for antibody 57000
LQDYNYPFT

SEQ ID NO: 114000 - protein, 10 aa, Homo sapiens
  heavy chain complementarity determining region 3 for antibody 57000
ARMTTVSFDY

SEQ ID NO: 114001 - protein, 9 aa, Homo sapiens
  light chain complementarity determining region 3 for antibody 57001
LQDYNYPFT

SEQ ID NO: 114002 - protein, 10 aa, Homo sapiens
  heavy chain complementarity determining region 3 for antibody 57001
ARMTTVPFDY

SEQ ID NO: 114003 - protein, 9 aa, Homo sapiens
  light chain complementarity determining region 3 for antibody 57002
LQDYNYPFT

SEQ ID NO: 114004 - protein, 10 aa, Homo sapiens
  heavy chain complementarity determining region 3 for antibody 57002
ARMTSVTFDY

SEQ ID NO: 114005 - protein, 9 aa, Homo sapiens
  light chain complementarity determining region 3 for antibody 57003
LQDYNYPFT

SEQ ID NO: 114006 - protein, 10 aa, Homo sapiens
  heavy chain complementarity determining region 3 for antibody 57003
ARMSTVTFDY

SEQ ID NO: 114007 - protein, 9 aa, Homo sapiens
  light chain complementarity determining region 3 for antibody 57004
LQDYNYPFT

SEQ ID NO: 114008 - protein, 13 aa, Homo sapiens
  heavy chain complementarity determining region 3 for antibody 57004
ARIAAAAVQYFQH

SEQ ID NO: 114009 - protein, 9 aa, Homo sapiens
  light chain complementarity determining region 3 for antibody 57005
LQDYNYPFT

SEQ ID NO: 114010 - protein, 13 aa, Homo sapiens
  heavy chain complementarity determining region 3 for antibody 57005
ARDRYSGYGAFDY

SEQ ID NO: 114011 - protein, 9 aa, Homo sapiens
  light chain complementarity determining region 3 for antibody 57006
LQDYNYPFT

SEQ ID NO: 114012 - protein, 15 aa, Homo sapiens
  heavy chain complementarity determining region 3 for antibody 57006
ARAPLSLWFGEFIDY

SEQ ID NO: 114013 - protein, 9 aa, Homo sapiens
  light chain complementarity determining region 3 for antibody 57007
LQDYNYPFT

SEQ ID NO: 114014 - protein, 15 aa, Homo sapiens
  heavy chain complementarity determining region 3 for antibody 57007
ARAPLLRWFGECIDY

SEQ ID NO: 114015 - protein, 9 aa, Homo sapiens
  light chain complementarity determining region 3 for antibody 57008
LQDYNYPFT

SEQ ID NO: 114016 - protein, 15 aa, Homo sapiens
  heavy chain complementarity determining region 3 for antibody 57008
ARAPLLLWFWESIDY

SEQ ID NO: 114017 - protein, 9 aa, Homo sapiens
  light chain complementarity determining region 3 for antibody 57009
LQDYNYPFT

SEQ ID NO: 114018 - protein, 15 aa, Homo sapiens
  heavy chain complementarity determining region 3 for antibody 57009
ARAPLLLWFVEFIDY

SEQ ID NO: 114019 - protein, 9 aa, Homo sapiens
  light chain complementarity determining region 3 for antibody 57010
LQDYNYPFT

SEQ ID NO: 114020 - protein, 15 aa, Homo sapiens
  heavy chain complementarity determining region 3 for antibody 57010
ARAPLLLWFGEFIDS

SEQ ID NO: 114021 - protein, 9 aa, Homo sapiens
  light chain complementarity determining region 3 for antibody 57011
LQDYNYPFT

SEQ ID NO: 114022 - protein, 15 aa, Homo sapiens
  heavy chain complementarity determining region 3 for antibody 57011
ARAPLLLWFGDFIDY

SEQ ID NO: 114023 - protein, 9 aa, Homo sapiens
  light chain complementarity determining region 3 for antibody 57012
LQDYNYPFT

SEQ ID NO: 114024 - protein, 15 aa, Homo sapiens
  heavy chain complementarity determining region 3 for antibody 57012
ARAPLLLWCGECIDY

SEQ ID NO: 114025 - protein, 9 aa, Homo sapiens
  light chain complementarity determining region 3 for antibody 57013
LQDYNYPFT

SEQ ID NO: 114026 - protein, 15 aa, Homo sapiens
  heavy chain complementarity determining region 3 for antibody 57013
ARAPLLIWFGEFIDY

SEQ ID NO: 114027 - protein, 9 aa, Homo sapiens
  light chain complementarity determining region 3 for antibody 57014
LQDYNYPFT

SEQ ID NO: 114028 - protein, 15 aa, Homo sapiens
  heavy chain complementarity determining region 3 for antibody 57014
ARAPLFLWFGESIDY

SEQ ID NO: 114029 - protein, 9 aa, Homo sapiens
  light chain complementarity determining region 3 for antibody 57015
LQDYNYPFT

SEQ ID NO: 114030 - protein, 15 aa, Homo sapiens
  heavy chain complementarity determining region 3 for antibody 57015
ARAPILLWFGEFIDY

SEQ ID NO: 114031 - protein, 9 aa, Homo sapiens
  light chain complementarity determining region 3 for antibody 57016
LQDYNYPFT

SEQ ID NO: 114032 - protein, 11 aa, Homo sapiens
  heavy chain complementarity determining region 3 for antibody 57016
ARANWVDAFDI

SEQ ID NO: 114033 - protein, 9 aa, Homo sapiens
  light chain complementarity determining region 3 for antibody 57017
LQDYNYPFT

SEQ ID NO: 114034 - protein, 15 aa, Homo sapiens
  heavy chain complementarity determining region 3 for antibody 57017
ARAHLLLWFGEFIDY

SEQ ID NO: 114035 - protein, 9 aa, Homo sapiens
  light chain complementarity determining region 3 for antibody 57018
LQDYNYPFT

SEQ ID NO: 114036 - protein, 15 aa, Homo sapiens
  heavy chain complementarity determining region 3 for antibody 57018
ARACLLLWFGEFIDY

SEQ ID NO: 114037 - protein, 9 aa, Homo sapiens
  light chain complementarity determining region 3 for antibody 57019
LQDYNYPFT

SEQ ID NO: 114038 - protein, 15 aa, Homo sapiens
  heavy chain complementarity determining region 3 for antibody 57019
ARAAVLLWFGEFIDY

SEQ ID NO: 114039 - protein, 9 aa, Homo sapiens
  light chain complementarity determining region 3 for antibody 57020
LQDYNHPFT

SEQ ID NO: 114040 - protein, 15 aa, Homo sapiens
  heavy chain complementarity determining region 3 for antibody 57020
ARAPLLLWFGEFIDY

SEQ ID NO: 114041 - protein, 9 aa, Homo sapiens
  light chain complementarity determining region 3 for antibody 57021
LQDYNFPFT

SEQ ID NO: 114042 - protein, 15 aa, Homo sapiens
  heavy chain complementarity determining region 3 for antibody 57021
ARAPLLLWFGEFIDY

SEQ ID NO: 114043 - protein, 9 aa, Homo sapiens
  light chain complementarity determining region 3 for antibody 57022
LQDYNCPWT

SEQ ID NO: 114044 - protein, 12 aa, Homo sapiens
  heavy chain complementarity determining region 3 for antibody 57022
ARDTMVRGVIDY

SEQ ID NO: 114045 - protein, 9 aa, Homo sapiens
  light chain complementarity determining region 3 for antibody 57023
LQDYIYPFT

SEQ ID NO: 114046 - protein, 15 aa, Homo sapiens
  heavy chain complementarity determining region 3 for antibody 57023
ARAPLLLWFGEFIDY

SEQ ID NO: 114047 - protein, 9 aa, Homo sapiens
  light chain complementarity determining region 3 for antibody 57024
LQDSNYPRT

SEQ ID NO: 114048 - protein, 20 aa, Homo sapiens
  heavy chain complementarity determining region 3 for antibody 57024
AKDQGDIVATIMAFYYGMDV

SEQ ID NO: 114049 - protein, 9 aa, Homo sapiens
  light chain complementarity determining region 3 for antibody 57025
LQDHNYPWT

SEQ ID NO: 114050 - protein, 12 aa, Homo sapiens
  heavy chain complementarity determining region 3 for antibody 57025
ARDTMVRGVIDY

SEQ ID NO: 114051 - protein, 9 aa, Homo sapiens
  light chain complementarity determining region 3 for antibody 57026
LQDFNYPWT

SEQ ID NO: 114052 - protein, 22 aa, Homo sapiens
  heavy chain complementarity determining region 3 for antibody 57026
ARRDYYGSGSYYNGYYYYGMDV

SEQ ID NO: 114053 - protein, 9 aa, Homo sapiens
  light chain complementarity determining region 3 for antibody 57027
LKHNSYPWT

SEQ ID NO: 114054 - protein, 12 aa, Homo sapiens
  heavy chain complementarity determining region 3 for antibody 57027
ARDIMVRGVIDY

SEQ ID NO: 114055 - protein, 9 aa, Homo sapiens
  light chain complementarity determining region 3 for antibody 57028
LKDYNYPWT

SEQ ID NO: 114056 - protein, 12 aa, Homo sapiens
  heavy chain complementarity determining region 3 for antibody 57028
ARDTMVRGVIDY

SEQ ID NO: 114057 - protein, 9 aa, Homo sapiens
  light chain complementarity determining region 3 for antibody 57029
LHDYNYPFT

SEQ ID NO: 114058 - protein, 15 aa, Homo sapiens
  heavy chain complementarity determining region 3 for antibody 57029
ARAPLLLWFGEFIDY

SEQ ID NO: 114059 - protein, 9 aa, Homo sapiens
  light chain complementarity determining region 3 for antibody 57030
IQHNSYPFT

SEQ ID NO: 114060 - protein, 16 aa, Homo sapiens
  heavy chain complementarity determining region 3 for antibody 57030
ASLFVDIVVVPAAFDY

SEQ ID NO: 114061 - protein, 9 aa, Homo sapiens
  light chain complementarity determining region 3 for antibody 57031
IQDYNYPWT

SEQ ID NO: 114062 - protein, 12 aa, Homo sapiens
  heavy chain complementarity determining region 3 for antibody 57031
ARDTMVRGVIDY

SEQ ID NO: 114063 - protein, 8 aa, Homo sapiens
  light chain complementarity determining region 3 for antibody 57032
HQSSSLWT

SEQ ID NO: 114064 - protein, 15 aa, Homo sapiens
  heavy chain complementarity determining region 3 for antibody 57032
AREGDYYGSGSYLDH

SEQ ID NO: 114065 - protein, 9 aa, Homo sapiens
  light chain complementarity determining region 3 for antibody 57033
HQSSSLPYT

SEQ ID NO: 114066 - protein, 5 aa, Homo sapiens
  heavy chain complementarity determining region 3 for antibody 57033
ARNSG

SEQ ID NO: 114067 - protein, 9 aa, Homo sapiens
  light chain complementarity determining region 3 for antibody 57034
HQSSSLPYT

SEQ ID NO: 114068 - protein, 15 aa, Homo sapiens
  heavy chain complementarity determining region 3 for antibody 57034
ARDPIFYGDYGAFDI

SEQ ID NO: 114069 - protein, 9 aa, Homo sapiens
  light chain complementarity determining region 3 for antibody 57035
HQSSSLPYT

SEQ ID NO: 114070 - protein, 16 aa, Homo sapiens
  heavy chain complementarity determining region 3 for antibody 57035
AKEGDVLRYFDWLFDY

SEQ ID NO: 114071 - protein, 9 aa, Homo sapiens
  light chain complementarity determining region 3 for antibody 57036
HQSSSLPWT

SEQ ID NO: 114072 - protein, 11 aa, Homo sapiens
  heavy chain complementarity determining region 3 for antibody 57036
AREGVGTAFDI

SEQ ID NO: 114073 - protein, 9 aa, Homo sapiens
  light chain complementarity determining region 3 for antibody 57037
HQSSSLPLT

SEQ ID NO: 114074 - protein, 18 aa, Homo sapiens
  heavy chain complementarity determining region 3 for antibody 57037
VKGGPGESFYSYYYGVDV

SEQ ID NO: 114075 - protein, 9 aa, Homo sapiens
  light chain complementarity determining region 3 for antibody 57038
HQSSSLPLT

SEQ ID NO: 114076 - protein, 18 aa, Homo sapiens
  heavy chain complementarity determining region 3 for antibody 57038
VEGGPGESFYYYYYGVDV

SEQ ID NO: 114077 - protein, 9 aa, Homo sapiens
  light chain complementarity determining region 3 for antibody 57039
HQSSSLPLT

SEQ ID NO: 114078 - protein, 15 aa, Homo sapiens
  heavy chain complementarity determining region 3 for antibody 57039
AREGVLRYLDWLLDY

SEQ ID NO: 114079 - protein, 9 aa, Homo sapiens
  light chain complementarity determining region 3 for antibody 57040
HQSSSLPLT

SEQ ID NO: 114080 - protein, 10 aa, Homo sapiens
  heavy chain complementarity determining region 3 for antibody 57040
AGGSGYYFDY

SEQ ID NO: 114081 - protein, 9 aa, Homo sapiens
  light chain complementarity determining region 3 for antibody 57041
HQSSSLPHT

SEQ ID NO: 114082 - protein, 14 aa, Homo sapiens
  heavy chain complementarity determining region 3 for antibody 57041
ARVSYSDYEGYFDY

SEQ ID NO: 114083 - protein, 9 aa, Homo sapiens
  light chain complementarity determining region 3 for antibody 57042
HQSSSLPHT

SEQ ID NO: 114084 - protein, 13 aa, Homo sapiens
  heavy chain complementarity determining region 3 for antibody 57042
ARRAAAAVQYFQH

SEQ ID NO: 114085 - protein, 9 aa, Homo sapiens
  light chain complementarity determining region 3 for antibody 57043
HQSSSLPHT

SEQ ID NO: 114086 - protein, 8 aa, Homo sapiens
  heavy chain complementarity determining region 3 for antibody 57043
ARNWGFDY

SEQ ID NO: 114087 - protein, 9 aa, Homo sapiens
  light chain complementarity determining region 3 for antibody 57044
HQSSSLMYT

SEQ ID NO: 114088 - protein, 21 aa, Homo sapiens
  heavy chain complementarity determining region 3 for antibody 57044
ARDGSDYYDRSGYYFVGAFDI

SEQ ID NO: 114089 - protein, 9 aa, Homo sapiens
  light chain complementarity determining region 3 for antibody 57045
HQSNNLPWT

SEQ ID NO: 114090 - protein, 11 aa, Homo sapiens
  heavy chain complementarity determining region 3 for antibody 57045
AASSGWYQGDD

SEQ ID NO: 114091 - protein, 9 aa, Homo sapiens
  light chain complementarity determining region 3 for antibody 57046
HQLNSYPYT

SEQ ID NO: 114092 - protein, 9 aa, Homo sapiens
  heavy chain complementarity determining region 3 for antibody 57046
ARKQRDFDY

SEQ ID NO: 114093 - protein, 9 aa, Homo sapiens
  light chain complementarity determining region 3 for antibody 57047
HKYNSAPLT

SEQ ID NO: 114094 - protein, 17 aa, Homo sapiens
  heavy chain complementarity determining region 3 for antibody 57047
ARGLRYFDWLLSDAFDI

SEQ ID NO: 114095 - protein, 9 aa, Homo sapiens
  light chain complementarity determining region 3 for antibody 57048
HKYNSAPLT

SEQ ID NO: 114096 - protein, 13 aa, Homo sapiens
  heavy chain complementarity determining region 3 for antibody 57048
ARDRYSGYGAFDY

SEQ ID NO: 114097 - protein, 9 aa, Homo sapiens
  light chain complementarity determining region 3 for antibody 57049
QKYNSAPWT

SEQ ID NO: 114098 - protein, 15 aa, Homo sapiens
  heavy chain complementarity determining region 3 for antibody 57049
AKAGDYYGSGSPFDY

SEQ ID NO: 114099 - protein, 9 aa, Homo sapiens
  light chain complementarity determining region 3 for antibody 57050
HQSSSLPHT

SEQ ID NO: 114100 - protein, 13 aa, Homo sapiens
  heavy chain complementarity determining region 3 for antibody 57050
ARGGYYGSGSLDY

SEQ ID NO: 114101 - protein, 9 aa, Homo sapiens
  light chain complementarity determining region 3 for antibody 57051
QQLNSYPLT

SEQ ID NO: 114102 - protein, 12 aa, Homo sapiens
  heavy chain complementarity determining region 3 for antibody 57051
ARMVRGVIPFDY

SEQ ID NO: 114103 - protein, 9 aa, Homo sapiens
  light chain complementarity determining region 3 for antibody 57052
LQHNSYPYT

SEQ ID NO: 114104 - protein, 12 aa, Homo sapiens
  heavy chain complementarity determining region 3 for antibody 57052
AKDRSYYYGMDV

SEQ ID NO: 114105 - protein, 9 aa, Homo sapiens
  light chain complementarity determining region 3 for antibody 57053
LQDYNYPWT

SEQ ID NO: 114106 - protein, 11 aa, Homo sapiens
  heavy chain complementarity determining region 3 for antibody 57053
ATGSPLLWFGD

SEQ ID NO: 114107 - protein, 9 aa, Homo sapiens
  light chain complementarity determining region 3 for antibody 57054
HQSSSLPLT

SEQ ID NO: 114108 - protein, 13 aa, Homo sapiens
  heavy chain complementarity determining region 3 for antibody 57054
ARGGYYGSGSLDY

SEQ ID NO: 114109 - protein, 9 aa, Homo sapiens
  light chain complementarity determining region 3 for antibody 57055
LQHNSYPFT

SEQ ID NO: 114110 - protein, 10 aa, Homo sapiens
  heavy chain complementarity determining region 3 for antibody 57055
ARDSSGWLDY

SEQ ID NO: 114111 - protein, 9 aa, Homo sapiens
  light chain complementarity determining region 3 for antibody 57056
QQLNSYPPT

SEQ ID NO: 114112 - protein, 11 aa, Homo sapiens
  heavy chain complementarity determining region 3 for antibody 57056
ARAERGGYFDY

SEQ ID NO: 114113 - protein, 9 aa, Homo sapiens
  light chain complementarity determining region 3 for antibody 57057
QQLNSYPRT

SEQ ID NO: 114114 - protein, 11 aa, Homo sapiens
  heavy chain complementarity determining region 3 for antibody 57057
ARDRRYYGMDV

SEQ ID NO: 114115 - protein, 9 aa, Homo sapiens
  light chain complementarity determining region 3 for antibody 57058
QQFYNYPHT

SEQ ID NO: 114116 - protein, 13 aa, Homo sapiens
  heavy chain complementarity determining region 3 for antibody 57058
GRFLEGIGGAFDI

SEQ ID NO: 114117 - protein, 9 aa, Homo sapiens
  light chain complementarity determining region 3 for antibody 57059
LQDYNYPWT

SEQ ID NO: 114118 - protein, 14 aa, Homo sapiens
  heavy chain complementarity determining region 3 for antibody 57059
AGRHYDILTGFSDY

SEQ ID NO: 114119 - protein, 9 aa, Homo sapiens
  light chain complementarity determining region 3 for antibody 57060
QQCYSTPRT

SEQ ID NO: 114120 - protein, 20 aa, Homo sapiens
  heavy chain complementarity determining region 3 for antibody 57060
ARDAGVWFVDPYYYYNGMDV

SEQ ID NO: 114121 - protein, 9 aa, Homo sapiens
  light chain complementarity determining region 3 for antibody 57061
LQHNSYPRT

SEQ ID NO: 114122 - protein, 13 aa, Homo sapiens
  heavy chain complementarity determining region 3 for antibody 57061
AREYCSSTSCYDH

SEQ ID NO: 114123 - protein, 9 aa, Homo sapiens
  light chain complementarity determining region 3 for antibody 57062
QQYNSYPPT

SEQ ID NO: 114124 - protein, 14 aa, Homo sapiens
  heavy chain complementarity determining region 3 for antibody 57062
ARDHSGSYFNWFDP

SEQ ID NO: 114125 - protein, 9 aa, Homo sapiens
  light chain complementarity determining region 3 for antibody 57063
QQFNNYPYT

SEQ ID NO: 114126 - protein, 17 aa, Homo sapiens
  heavy chain complementarity determining region 3 for antibody 57063
AREGYYYGSGSYYTFDY

SEQ ID NO: 114127 - protein, 8 aa, Homo sapiens
  light chain complementarity determining region 3 for antibody 57064
QQFNSYPT

SEQ ID NO: 114128 - protein, 13 aa, Homo sapiens
  heavy chain complementarity determining region 3 for antibody 57064
ARDVTGTTSGFDY

SEQ ID NO: 114129 - protein, 9 aa, Homo sapiens
  light chain complementarity determining region 3 for antibody 57065
QQFYNYPRT

SEQ ID NO: 114130 - protein, 12 aa, Homo sapiens
  heavy chain complementarity determining region 3 for antibody 57065
ARDWGIGGGMDV

SEQ ID NO: 114131 - protein, 9 aa, Homo sapiens
  light chain complementarity determining region 3 for antibody 57066
LQDYNYPWT

SEQ ID NO: 114132 - protein, 13 aa, Homo sapiens
  heavy chain complementarity determining region 3 for antibody 57066
AREYSGYDAHFDY

SEQ ID NO: 114133 - protein, 9 aa, Homo sapiens
  light chain complementarity determining region 3 for antibody 57067
QQYGSSPRT

SEQ ID NO: 114134 - protein, 14 aa, Homo sapiens
  heavy chain complementarity determining region 3 for antibody 57067
AKERLRYFDWFLDY

SEQ ID NO: 114135 - protein, 9 aa, Homo sapiens
  light chain complementarity determining region 3 for antibody 57068
QQYNNWPLT

SEQ ID NO: 114136 - protein, 18 aa, Homo sapiens
  heavy chain complementarity determining region 3 for antibody 57068
TRDLRPPGIAVAEGAFDI

SEQ ID NO: 114137 - protein, 9 aa, Homo sapiens
  light chain complementarity determining region 3 for antibody 57069
QQFFNYPYT

SEQ ID NO: 114138 - protein, 11 aa, Homo sapiens
  heavy chain complementarity determining region 3 for antibody 57069
ARDPRIAGFDC

SEQ ID NO: 114139 - protein, 9 aa, Homo sapiens
  light chain complementarity determining region 3 for antibody 57070
LQDYNYPRT

SEQ ID NO: 114140 - protein, 9 aa, Homo sapiens
  heavy chain complementarity determining region 3 for antibody 57070
ARDGGGGSY

SEQ ID NO: 114141 - protein, 9 aa, Homo sapiens
  light chain complementarity determining region 3 for antibody 57071
QQLNSYPLT

SEQ ID NO: 114142 - protein, 15 aa, Homo sapiens
  heavy chain complementarity determining region 3 for antibody 57071
ARDGGYSGYPIGMDV

SEQ ID NO: 114143 - protein, 9 aa, Homo sapiens
  light chain complementarity determining region 3 for antibody 57072
QQFNNYPYT

SEQ ID NO: 114144 - protein, 14 aa, Homo sapiens
  heavy chain complementarity determining region 3 for antibody 57072
ARRFRIAVAAPFDY

SEQ ID NO: 114145 - protein, 9 aa, Homo sapiens
  light chain complementarity determining region 3 for antibody 57073
LQDYNYPLT

SEQ ID NO: 114146 - protein, 10 aa, Homo sapiens
  heavy chain complementarity determining region 3 for antibody 57073
VRMTTVIFDY

SEQ ID NO: 114147 - protein, 9 aa, Homo sapiens
  light chain complementarity determining region 3 for antibody 57074
LQDYSYPWT

SEQ ID NO: 114148 - protein, 10 aa, Homo sapiens
  heavy chain complementarity determining region 3 for antibody 57074
ATMTNVTFDY

SEQ ID NO: 114149 - protein, 9 aa, Homo sapiens
  light chain complementarity determining region 3 for antibody 57075
LQHNSYPWT

SEQ ID NO: 114150 - protein, 22 aa, Homo sapiens
  heavy chain complementarity determining region 3 for antibody 57075
ARDFPLYYDILTGYPYYHGMDV

SEQ ID NO: 114151 - protein, 9 aa, Homo sapiens
  light chain complementarity determining region 3 for antibody 57076
QQFNNYPRT

SEQ ID NO: 114152 - protein, 17 aa, Homo sapiens
  heavy chain complementarity determining region 3 for antibody 57076
AREHIVVVTAINDAFDI

SEQ ID NO: 114153 - protein, 9 aa, Homo sapiens
  light chain complementarity determining region 3 for antibody 57077
HQYNSYPFT

SEQ ID NO: 114154 - protein, 13 aa, Homo sapiens
  heavy chain complementarity determining region 3 for antibody 57077
ARERWAANTCFDY

SEQ ID NO: 114155 - protein, 9 aa, Homo sapiens
  light chain complementarity determining region 3 for antibody 57078
QQFYNYPYT

SEQ ID NO: 114156 - protein, 11 aa, Homo sapiens
  heavy chain complementarity determining region 3 for antibody 57078
ARDPRIAGFDN

SEQ ID NO: 114157 - protein, 9 aa, Homo sapiens
  light chain complementarity determining region 3 for antibody 57079
HQSSSLPHT

SEQ ID NO: 114158 - protein, 13 aa, Homo sapiens
  heavy chain complementarity determining region 3 for antibody 57079
ARGGYYGSGGLDY

SEQ ID NO: 114159 - protein, 9 aa, Homo sapiens
  light chain complementarity determining region 3 for antibody 57080
QQRSNWPPT

SEQ ID NO: 114160 - protein, 14 aa, Homo sapiens
  heavy chain complementarity determining region 3 for antibody 57080
ARDYGSGSYSPFDY

SEQ ID NO: 114161 - protein, 9 aa, Homo sapiens
  light chain complementarity determining region 3 for antibody 57081
QQYNSYPYT

SEQ ID NO: 114162 - protein, 9 aa, Homo sapiens
  heavy chain complementarity determining region 3 for antibody 57081
VRYYYGMDV

SEQ ID NO: 114163 - protein, 9 aa, Homo sapiens
  light chain complementarity determining region 3 for antibody 57082
LQDYNYPWT

SEQ ID NO: 114164 - protein, 13 aa, Homo sapiens
  heavy chain complementarity determining region 3 for antibody 57082
AREEVNWGAFFDY

SEQ ID NO: 114165 - protein, 9 aa, Homo sapiens
  light chain complementarity determining region 3 for antibody 57083
LQHNSYPYT

SEQ ID NO: 114166 - protein, 16 aa, Homo sapiens
  heavy chain complementarity determining region 3 for antibody 57083
AKDGSGSYYLTEYFQH

SEQ ID NO: 114167 - protein, 9 aa, Homo sapiens
  light chain complementarity determining region 3 for antibody 57084
QQLNSYPWT

SEQ ID NO: 114168 - protein, 17 aa, Homo sapiens
  heavy chain complementarity determining region 3 for antibody 57084
ARGYGSGSYYNYYGMDV

SEQ ID NO: 114169 - protein, 9 aa, Homo sapiens
  light chain complementarity determining region 3 for antibody 57085
QQLNTYPLT

SEQ ID NO: 114170 - protein, 9 aa, Homo sapiens
  heavy chain complementarity determining region 3 for antibody 57085
ARKKGTFDY

SEQ ID NO: 114171 - protein, 9 aa, Homo sapiens
  light chain complementarity determining region 3 for antibody 57086
QQYNSYPIT

SEQ ID NO: 114172 - protein, 12 aa, Homo sapiens
  heavy chain complementarity determining region 3 for antibody 57086
ARVVRGVRGFDY

SEQ ID NO: 114173 - protein, 9 aa, Homo sapiens
  light chain complementarity determining region 3 for antibody 57087
QQLNSYPRT

SEQ ID NO: 114174 - protein, 11 aa, Homo sapiens
  heavy chain complementarity determining region 3 for antibody 57087
AREHYYYGMDV

SEQ ID NO: 114175 - protein, 9 aa, Homo sapiens
  light chain complementarity determining region 3 for antibody 57088
LQDYNYPPT

SEQ ID NO: 114176 - protein, 15 aa, Homo sapiens
  heavy chain complementarity determining region 3 for antibody 57088
ARVLRYFDWLGGMDV

SEQ ID NO: 114177 - protein, 9 aa, Homo sapiens
  light chain complementarity determining region 3 for antibody 57089
LQDYNYPRT

SEQ ID NO: 114178 - protein, 15 aa, Homo sapiens
  heavy chain complementarity determining region 3 for antibody 57089
ATLPYYDILTGYSDY

SEQ ID NO: 114179 - protein, 9 aa, Homo sapiens
  light chain complementarity determining region 3 for antibody 57090
LQHDNFPYT

SEQ ID NO: 114180 - protein, 18 aa, Homo sapiens
  heavy chain complementarity determining region 3 for antibody 57090
ARDGGITMVRGILRGMDV

SEQ ID NO: 114181 - protein, 9 aa, Homo sapiens
  light chain complementarity determining region 3 for antibody 57091
LQDYNYPYT

SEQ ID NO: 114182 - protein, 15 aa, Homo sapiens
  heavy chain complementarity determining region 3 for antibody 57091
ARNPPVIAAAGTIDY

SEQ ID NO: 114183 - protein, 9 aa, Homo sapiens
  light chain complementarity determining region 3 for antibody 57092
QQFNIYPYT

SEQ ID NO: 114184 - protein, 14 aa, Homo sapiens
  heavy chain complementarity determining region 3 for antibody 57092
ARRFRIAVAAPFDY

SEQ ID NO: 114185 - protein, 9 aa, Homo sapiens
  light chain complementarity determining region 3 for antibody 57093
LQDYNYPWT

SEQ ID NO: 114186 - protein, 13 aa, Homo sapiens
  heavy chain complementarity determining region 3 for antibody 57093
ARDHYYDSSGYDY

SEQ ID NO: 114187 - protein, 8 aa, Homo sapiens
  light chain complementarity determining region 3 for antibody 57094
QQFNDYYT

SEQ ID NO: 114188 - protein, 10 aa, Homo sapiens
  heavy chain complementarity determining region 3 for antibody 57094
ARINSGRFDY

SEQ ID NO: 114189 - protein, 9 aa, Homo sapiens
  light chain complementarity determining region 3 for antibody 57095
LQHDNFPYT

SEQ ID NO: 114190 - protein, 11 aa, Homo sapiens
  heavy chain complementarity determining region 3 for antibody 57095
ARAPNWGDFDY

SEQ ID NO: 114191 - protein, 9 aa, Homo sapiens
  light chain complementarity determining region 3 for antibody 57096
QQLNSYPWT

SEQ ID NO: 114192 - protein, 13 aa, Homo sapiens
  heavy chain complementarity determining region 3 for antibody 57096
ARITMVRGVSFDY

SEQ ID NO: 114193 - protein, 9 aa, Homo sapiens
  light chain complementarity determining region 3 for antibody 57097
QQLNSYPWT

SEQ ID NO: 114194 - protein, 15 aa, Homo sapiens
  heavy chain complementarity determining region 3 for antibody 57097
ARESRDPASYYGMDV

SEQ ID NO: 114195 - protein, 9 aa, Homo sapiens
  light chain complementarity determining region 3 for antibody 57098
HQSSSLPYT

SEQ ID NO: 114196 - protein, 13 aa, Homo sapiens
  heavy chain complementarity determining region 3 for antibody 57098
ARHSGSYGRYFDY

SEQ ID NO: 114197 - protein, 9 aa, Homo sapiens
  light chain complementarity determining region 3 for antibody 57099
QQLNSYPYT

SEQ ID NO: 114198 - protein, 13 aa, Homo sapiens
  heavy chain complementarity determining region 3 for antibody 57099
AREGYGDQYYFDD

SEQ ID NO: 114199 - protein, 9 aa, Homo sapiens
  light chain complementarity determining region 3 for antibody 57100
LQDYNYPYT

SEQ ID NO: 114200 - protein, 15 aa, Homo sapiens
  heavy chain complementarity determining region 3 for antibody 57100
AKEGKLRYFDWLGDY

SEQ ID NO: 114201 - protein, 9 aa, Homo sapiens
  light chain complementarity determining region 3 for antibody 57101
LQHNSYPYT

SEQ ID NO: 114202 - protein, 14 aa, Homo sapiens
  heavy chain complementarity determining region 3 for antibody 57101
AGGPYYYGSGTYYK

SEQ ID NO: 114203 - protein, 9 aa, Homo sapiens
  light chain complementarity determining region 3 for antibody 57102
LQDYNYPWT

SEQ ID NO: 114204 - protein, 14 aa, Homo sapiens
  heavy chain complementarity determining region 3 for antibody 57102
ARGLLWFGGYGLDV

SEQ ID NO: 114205 - protein, 9 aa, Homo sapiens
  light chain complementarity determining region 3 for antibody 57103
QQYNSYPYT

SEQ ID NO: 114206 - protein, 11 aa, Homo sapiens
  heavy chain complementarity determining region 3 for antibody 57103
ARGDSSGWFDY

SEQ ID NO: 114207 - protein, 9 aa, Homo sapiens
  light chain complementarity determining region 3 for antibody 57104
LQDYNYPWT

SEQ ID NO: 114208 - protein, 13 aa, Homo sapiens
  heavy chain complementarity determining region 3 for antibody 57104
ARVRITGTYAFDI

SEQ ID NO: 114209 - protein, 9 aa, Homo sapiens
  light chain complementarity determining region 3 for antibody 57105
QKYNSAPWT

SEQ ID NO: 114210 - protein, 15 aa, Homo sapiens
  heavy chain complementarity determining region 3 for antibody 57105
AKAGDYYGSGSPSDY

SEQ ID NO: 114211 - protein, 9 aa, Homo sapiens
  light chain complementarity determining region 3 for antibody 57106
LQDYNYPYT

SEQ ID NO: 114212 - protein, 13 aa, Homo sapiens
  heavy chain complementarity determining region 3 for antibody 57106
AREWKLRGNYFDY

SEQ ID NO: 114213 - protein, 9 aa, Homo sapiens
  light chain complementarity determining region 3 for antibody 57107
QKYNSAPWT

SEQ ID NO: 114214 - protein, 15 aa, Homo sapiens
  heavy chain complementarity determining region 3 for antibody 57107
AKAGDYYGSGRPFDY

SEQ ID NO: 114215 - protein, 9 aa, Homo sapiens
  light chain complementarity determining region 3 for antibody 57108
QQFNSYPWT

SEQ ID NO: 114216 - protein, 11 aa, Homo sapiens
  heavy chain complementarity determining region 3 for antibody 57108
AREGAVAGIDY

SEQ ID NO: 114217 - protein, 9 aa, Homo sapiens
  light chain complementarity determining region 3 for antibody 57109
QQYNSYPRT

SEQ ID NO: 114218 - protein, 21 aa, Homo sapiens
  heavy chain complementarity determining region 3 for antibody 57109
ARETDYDILTGPYYNYYTMDV

SEQ ID NO: 114219 - protein, 9 aa, Homo sapiens
  light chain complementarity determining region 3 for antibody 57110
LQDYNYPYT

SEQ ID NO: 114220 - protein, 15 aa, Homo sapiens
  heavy chain complementarity determining region 3 for antibody 57110
AKDRYYYGSGSPMDV

SEQ ID NO: 114221 - protein, 9 aa, Homo sapiens
  light chain complementarity determining region 3 for antibody 57111
LQDYNYPRT

SEQ ID NO: 114222 - protein, 14 aa, Homo sapiens
  heavy chain complementarity determining region 3 for antibody 57111
ARDRYSGSGSYFDY

SEQ ID NO: 114223 - protein, 9 aa, Homo sapiens
  light chain complementarity determining region 3 for antibody 57112
QQYNSYPRT

SEQ ID NO: 114224 - protein, 9 aa, Homo sapiens
  heavy chain complementarity determining region 3 for antibody 57112
ARDLSSLDV

SEQ ID NO: 114225 - protein, 9 aa, Homo sapiens
  light chain complementarity determining region 3 for antibody 57113
LQDYNYPWT

SEQ ID NO: 114226 - protein, 13 aa, Homo sapiens
  heavy chain complementarity determining region 3 for antibody 57113
AKVWSSGWSDFDY

SEQ ID NO: 114227 - protein, 9 aa, Homo sapiens
  light chain complementarity determining region 3 for antibody 57114
QQLNSYPPT

SEQ ID NO: 114228 - protein, 13 aa, Homo sapiens
  heavy chain complementarity determining region 3 for antibody 57114
ARSFLTSYSPFDY

SEQ ID NO: 114229 - protein, 9 aa, Homo sapiens
  light chain complementarity determining region 3 for antibody 57115
QQYNSYPYT

SEQ ID NO: 114230 - protein, 10 aa, Homo sapiens
  heavy chain complementarity determining region 3 for antibody 57115
ARGGLGTFDY

SEQ ID NO: 114231 - protein, 9 aa, Homo sapiens
  light chain complementarity determining region 3 for antibody 57116
QQFFNYPYT

SEQ ID NO: 114232 - protein, 11 aa, Homo sapiens
  heavy chain complementarity determining region 3 for antibody 57116
ARDPRIAGFDY

SEQ ID NO: 114233 - protein, 9 aa, Homo sapiens
  light chain complementarity determining region 3 for antibody 57117
QRTYNAPYT

SEQ ID NO: 114234 - protein, 18 aa, Homo sapiens
  heavy chain complementarity determining region 3 for antibody 57117
ARDMIAAAGTDYYYGMDV

SEQ ID NO: 114235 - protein, 9 aa, Homo sapiens
  light chain complementarity determining region 3 for antibody 57118
LQHNSYPYT

SEQ ID NO: 114236 - protein, 14 aa, Homo sapiens
  heavy chain complementarity determining region 3 for antibody 57118
ARGLRYFDWLSQDY

SEQ ID NO: 114237 - protein, 9 aa, Homo sapiens
  light chain complementarity determining region 3 for antibody 57119
QQLKSYPRT

SEQ ID NO: 114238 - protein, 11 aa, Homo sapiens
  heavy chain complementarity determining region 3 for antibody 57119
ARDRRYYGMDV

SEQ ID NO: 114239 - protein, 9 aa, Homo sapiens
  light chain complementarity determining region 3 for antibody 57120
LQDYNYPYT

SEQ ID NO: 114240 - protein, 18 aa, Homo sapiens
  heavy chain complementarity determining region 3 for antibody 57120
ARGAWYYYGSGSYYTFDY

SEQ ID NO: 114241 - protein, 9 aa, Homo sapiens
  light chain complementarity determining region 3 for antibody 57121
QQYNSYPYT

SEQ ID NO: 114242 - protein, 10 aa, Homo sapiens
  heavy chain complementarity determining region 3 for antibody 57121
ARSNWGDFDY

SEQ ID NO: 114243 - protein, 8 aa, Homo sapiens
  light chain complementarity determining region 3 for antibody 57122
QQSYSTLT

SEQ ID NO: 114244 - protein, 17 aa, Homo sapiens
  heavy chain complementarity determining region 3 for antibody 57122
ARDRDDYGDYYYYGMDV

SEQ ID NO: 114245 - protein, 9 aa, Homo sapiens
  light chain complementarity determining region 3 for antibody 57123
QQYNSYPIT

SEQ ID NO: 114246 - protein, 10 aa, Homo sapiens
  heavy chain complementarity determining region 3 for antibody 57123
ARVVRGVFDY

SEQ ID NO: 114247 - protein, 9 aa, Homo sapiens
  light chain complementarity determining region 3 for antibody 57124
QQLNSYPRT

SEQ ID NO: 114248 - protein, 12 aa, Homo sapiens
  heavy chain complementarity determining region 3 for antibody 57124
ARDPYSSRGFDY

SEQ ID NO: 114249 - protein, 9 aa, Homo sapiens
  light chain complementarity determining region 3 for antibody 57125
QKYNSAPWT

SEQ ID NO: 114250 - protein, 15 aa, Homo sapiens
  heavy chain complementarity determining region 3 for antibody 57125
AKAGDYYGSGSPLDY

SEQ ID NO: 114251 - protein, 9 aa, Homo sapiens
  light chain complementarity determining region 3 for antibody 57126
LQNYNYPYT

SEQ ID NO: 114252 - protein, 13 aa, Homo sapiens
  heavy chain complementarity determining region 3 for antibody 57126
ARDLAVAGYPFDF

SEQ ID NO: 114253 - protein, 9 aa, Homo sapiens
  light chain complementarity determining region 3 for antibody 57127
QKYNSAPWT

SEQ ID NO: 114254 - protein, 15 aa, Homo sapiens
  heavy chain complementarity determining region 3 for antibody 57127
AKAGDYDGSGSPFDY

SEQ ID NO: 114255 - protein, 9 aa, Homo sapiens
  light chain complementarity determining region 3 for antibody 57128
LQDYNYPHT

SEQ ID NO: 114256 - protein, 15 aa, Homo sapiens
  heavy chain complementarity determining region 3 for antibody 57128
ARDQGVGIAAAGFDY

SEQ ID NO: 114257 - protein, 9 aa, Homo sapiens
  light chain complementarity determining region 3 for antibody 57129
QQYNSYPYT

SEQ ID NO: 114258 - protein, 13 aa, Homo sapiens
  heavy chain complementarity determining region 3 for antibody 57129
ARDQLTGTGYFDY

SEQ ID NO: 114259 - protein, 9 aa, Homo sapiens
  light chain complementarity determining region 3 for antibody 57130
QQLNSYPPT

SEQ ID NO: 114260 - protein, 17 aa, Homo sapiens
  heavy chain complementarity determining region 3 for antibody 57130
ARDPLYYYGAGSSGMDV

SEQ ID NO: 114261 - protein, 9 aa, Homo sapiens
  light chain complementarity determining region 3 for antibody 57131
LQHNSYPLT

SEQ ID NO: 114262 - protein, 12 aa, Homo sapiens
  heavy chain complementarity determining region 3 for antibody 57131
ARVGPLTGAFDY

SEQ ID NO: 114263 - protein, 9 aa, Homo sapiens
  light chain complementarity determining region 3 for antibody 57132
QQLNSYPYT

SEQ ID NO: 114264 - protein, 12 aa, Homo sapiens
  heavy chain complementarity determining region 3 for antibody 57132
ARGRGYSYGYDY

SEQ ID NO: 114265 - protein, 9 aa, Homo sapiens
  light chain complementarity determining region 3 for antibody 57133
QQYNSYPLT

SEQ ID NO: 114266 - protein, 9 aa, Homo sapiens
  heavy chain complementarity determining region 3 for antibody 57133
AIAAADPDY

SEQ ID NO: 114267 - protein, 9 aa, Homo sapiens
  light chain complementarity determining region 3 for antibody 57134
HQSSSLPHT

SEQ ID NO: 114268 - protein, 13 aa, Homo sapiens
  heavy chain complementarity determining region 3 for antibody 57134
ARGGYYGSGSIDY

SEQ ID NO: 114269 - protein, 9 aa, Homo sapiens
  light chain complementarity determining region 3 for antibody 57135
QQLNSYPPT

SEQ ID NO: 114270 - protein, 12 aa, Homo sapiens
  heavy chain complementarity determining region 3 for antibody 57135
TFFSGTFNWFDP

SEQ ID NO: 114271 - protein, 9 aa, Homo sapiens
  light chain complementarity determining region 3 for antibody 57136
LQDYNYPYT

SEQ ID NO: 114272 - protein, 16 aa, Homo sapiens
  heavy chain complementarity determining region 3 for antibody 57136
ARGYFGSGSSSRWFDP

SEQ ID NO: 114273 - protein, 9 aa, Homo sapiens
  light chain complementarity determining region 3 for antibody 57137
QQYNSNPIT

SEQ ID NO: 114274 - protein, 10 aa, Homo sapiens
  heavy chain complementarity determining region 3 for antibody 57137
ARVVRGVFDY

SEQ ID NO: 114275 - protein, 9 aa, Homo sapiens
  light chain complementarity determining region 3 for antibody 57138
LQHNSYPLT

SEQ ID NO: 114276 - protein, 14 aa, Homo sapiens
  heavy chain complementarity determining region 3 for antibody 57138
AREAALDYYYGLDV

SEQ ID NO: 114277 - protein, 9 aa, Homo sapiens
  light chain complementarity determining region 3 for antibody 57139
LQDYNYPRT

SEQ ID NO: 114278 - protein, 15 aa, Homo sapiens
  heavy chain complementarity determining region 3 for antibody 57139
AREDAMIRAKWGFDP

SEQ ID NO: 114279 - protein, 9 aa, Homo sapiens
  light chain complementarity determining region 3 for antibody 57140
QQLNSYPRT

SEQ ID NO: 114280 - protein, 14 aa, Homo sapiens
  heavy chain complementarity determining region 3 for antibody 57140
ARETAAAIPEAFDI

SEQ ID NO: 114281 - protein, 9 aa, Homo sapiens
  light chain complementarity determining region 3 for antibody 57141
QKYNSAPWT

SEQ ID NO: 114282 - protein, 15 aa, Homo sapiens
  heavy chain complementarity determining region 3 for antibody 57141
AKAGDCYGSGSPFDY

SEQ ID NO: 114283 - protein, 9 aa, Homo sapiens
  light chain complementarity determining region 3 for antibody 57142
LQDYNYPWT

SEQ ID NO: 114284 - protein, 11 aa, Homo sapiens
  heavy chain complementarity determining region 3 for antibody 57142
ATGSPLLWFAD

SEQ ID NO: 114285 - protein, 9 aa, Homo sapiens
  light chain complementarity determining region 3 for antibody 57143
LQDYNYPWT

SEQ ID NO: 114286 - protein, 14 aa, Homo sapiens
  heavy chain complementarity determining region 3 for antibody 57143
ARGLLWFGGYGMDV

SEQ ID NO: 114287 - protein, 9 aa, Homo sapiens
  light chain complementarity determining region 3 for antibody 57144
QKYNSAPWT

SEQ ID NO: 114288 - protein, 15 aa, Homo sapiens
  heavy chain complementarity determining region 3 for antibody 57144
AKAGDYYGAGSPFDY

SEQ ID NO: 114289 - protein, 9 aa, Homo sapiens
  light chain complementarity determining region 3 for antibody 57145
QQYNSYPRT

SEQ ID NO: 114290 - protein, 21 aa, Homo sapiens
  heavy chain complementarity determining region 3 for antibody 57145
ARESDHDILTGPYYNYYDMDV

SEQ ID NO: 114291 - protein, 9 aa, Homo sapiens
  light chain complementarity determining region 3 for antibody 57146
QQFYNYPHT

SEQ ID NO: 114292 - protein, 11 aa, Homo sapiens
  heavy chain complementarity determining region 3 for antibody 57146
ARDPRIAGFDC

SEQ ID NO: 114293 - protein, 9 aa, Homo sapiens
  light chain complementarity determining region 3 for antibody 57147
LQHNSYPFT

SEQ ID NO: 114294 - protein, 15 aa, Homo sapiens
  heavy chain complementarity determining region 3 for antibody 57147
ARDEYSSGWYDAFDI

SEQ ID NO: 114295 - protein, 9 aa, Homo sapiens
  light chain complementarity determining region 3 for antibody 57148
LQHDNFPYT

SEQ ID NO: 114296 - protein, 21 aa, Homo sapiens
  heavy chain complementarity determining region 3 for antibody 57148
AREGAYDILTGYSDYYYGMDV

SEQ ID NO: 114297 - protein, 9 aa, Homo sapiens
  light chain complementarity determining region 3 for antibody 57149
QQFNNYPHT

SEQ ID NO: 114298 - protein, 18 aa, Homo sapiens
  heavy chain complementarity determining region 3 for antibody 57149
ARVWFGELPYYYYYGMDV

SEQ ID NO: 114299 - protein, 9 aa, Homo sapiens
  light chain complementarity determining region 3 for antibody 57150
QQFYNYPRT

SEQ ID NO: 114300 - protein, 11 aa, Homo sapiens
  heavy chain complementarity determining region 3 for antibody 57150
ARKIVGAHFDY

SEQ ID NO: 114301 - protein, 9 aa, Homo sapiens
  light chain complementarity determining region 3 for antibody 57151
LQHNSYPFT

SEQ ID NO: 114302 - protein, 18 aa, Homo sapiens
  heavy chain complementarity determining region 3 for antibody 57151
ARDPSGYDSYYYYYGMDV

SEQ ID NO: 114303 - protein, 9 aa, Homo sapiens
  light chain complementarity determining region 3 for antibody 57152
QQYGSSPYT

SEQ ID NO: 114304 - protein, 16 aa, Homo sapiens
  heavy chain complementarity determining region 3 for antibody 57152
ARESPYYDILTGFFDY

SEQ ID NO: 114305 - protein, 9 aa, Homo sapiens
  light chain complementarity determining region 3 for antibody 57153
QQRSNWQLT

SEQ ID NO: 114306 - protein, 12 aa, Homo sapiens
  heavy chain complementarity determining region 3 for antibody 57153
ARRAWGWGYFDY

SEQ ID NO: 114307 - protein, 9 aa, Homo sapiens
  light chain complementarity determining region 3 for antibody 57154
LQDYNYPWT

SEQ ID NO: 114308 - protein, 15 aa, Homo sapiens
  heavy chain complementarity determining region 3 for antibody 57154
ARDGGYSYGPDAFDI

SEQ ID NO: 114309 - protein, 9 aa, Homo sapiens
  light chain complementarity determining region 3 for antibody 57155
QQSFSTPFT

SEQ ID NO: 114310 - protein, 17 aa, Homo sapiens
  heavy chain complementarity determining region 3 for antibody 57155
ARAESYWDYYYYYGMDV

SEQ ID NO: 114311 - protein, 9 aa, Homo sapiens
  light chain complementarity determining region 3 for antibody 57156
QQLNSYPRT

SEQ ID NO: 114312 - protein, 22 aa, Homo sapiens
  heavy chain complementarity determining region 3 for antibody 57156
TKDPGGIVAKIRDYQYFYGVDV

SEQ ID NO: 114313 - protein, 9 aa, Homo sapiens
  light chain complementarity determining region 3 for antibody 57157
LQHNSYPFT

SEQ ID NO: 114314 - protein, 10 aa, Homo sapiens
  heavy chain complementarity determining region 3 for antibody 57157
ARDSSGCLDY

SEQ ID NO: 114315 - protein, 9 aa, Homo sapiens
  light chain complementarity determining region 3 for antibody 57158
QQYNSYPLT

SEQ ID NO: 114316 - protein, 16 aa, Homo sapiens
  heavy chain complementarity determining region 3 for antibody 57158
ARRGSGSYSHGYGMDV

SEQ ID NO: 114317 - protein, 9 aa, Homo sapiens
  light chain complementarity determining region 3 for antibody 57159
QQFNNYPFT

SEQ ID NO: 114318 - protein, 15 aa, Homo sapiens
  heavy chain complementarity determining region 3 for antibody 57159
ARDEGYYASGSYYDY

SEQ ID NO: 114319 - protein, 9 aa, Homo sapiens
  light chain complementarity determining region 3 for antibody 57160
LQDYNYPYT

SEQ ID NO: 114320 - protein, 7 aa, Homo sapiens
  heavy chain complementarity determining region 3 for antibody 57160
ARGPWDY

SEQ ID NO: 114321 - protein, 9 aa, Homo sapiens
  light chain complementarity determining region 3 for antibody 57161
QQYNSYPYT

SEQ ID NO: 114322 - protein, 15 aa, Homo sapiens
  heavy chain complementarity determining region 3 for antibody 57161
AREGATRNYYYGMDV

SEQ ID NO: 114323 - protein, 9 aa, Homo sapiens
  light chain complementarity determining region 3 for antibody 57162
LQDYNYPWT

SEQ ID NO: 114324 - protein, 17 aa, Homo sapiens
  heavy chain complementarity determining region 3 for antibody 57162
ARDRLVRGVDYYYGMDV

SEQ ID NO: 114325 - protein, 9 aa, Homo sapiens
  light chain complementarity determining region 3 for antibody 57163
QQRSNWPWT

SEQ ID NO: 114326 - protein, 7 aa, Homo sapiens
  heavy chain complementarity determining region 3 for antibody 57163
ARDYGDY

SEQ ID NO: 114327 - protein, 9 aa, Homo sapiens
  light chain complementarity determining region 3 for antibody 57164
QKYNSAPWT

SEQ ID NO: 114328 - protein, 15 aa, Homo sapiens
  heavy chain complementarity determining region 3 for antibody 57164
AKAGDYYGSASPFDY

SEQ ID NO: 114329 - protein, 9 aa, Homo sapiens
  light chain complementarity determining region 3 for antibody 57165
LQHNSYPWT

SEQ ID NO: 114330 - protein, 20 aa, Homo sapiens
  heavy chain complementarity determining region 3 for antibody 57165
ATDTMVRGVIIEDYYYGMDV

SEQ ID NO: 114331 - protein, 9 aa, Homo sapiens
  light chain complementarity determining region 3 for antibody 57166
LQDYNYPFT

SEQ ID NO: 114332 - protein, 13 aa, Homo sapiens
  heavy chain complementarity determining region 3 for antibody 57166
ARDLTGTSNWFDP

SEQ ID NO: 114333 - protein, 9 aa, Homo sapiens
  light chain complementarity determining region 3 for antibody 57167
LQDYNYPYT

SEQ ID NO: 114334 - protein, 17 aa, Homo sapiens
  heavy chain complementarity determining region 3 for antibody 57167
ARDLRYFDGLLADAFDI

SEQ ID NO: 114335 - protein, 9 aa, Homo sapiens
  light chain complementarity determining region 3 for antibody 57168
QQYNSYPYT

SEQ ID NO: 114336 - protein, 9 aa, Homo sapiens
  heavy chain complementarity determining region 3 for antibody 57168
ARYYYGVDV

SEQ ID NO: 114337 - protein, 9 aa, Homo sapiens
  light chain complementarity determining region 3 for antibody 57169
QQYGSSPYT

SEQ ID NO: 114338 - protein, 17 aa, Homo sapiens
  heavy chain complementarity determining region 3 for antibody 57169
ATDRYFDWLSPLDAFDI

SEQ ID NO: 114339 - protein, 9 aa, Homo sapiens
  light chain complementarity determining region 3 for antibody 57170
LQDYNYPRS

SEQ ID NO: 114340 - protein, 13 aa, Homo sapiens
  heavy chain complementarity determining region 3 for antibody 57170
ARGGSGYYYGMDV

SEQ ID NO: 114341 - protein, 9 aa, Homo sapiens
  light chain complementarity determining region 3 for antibody 57171
QQYNSYPYT

SEQ ID NO: 114342 - protein, 18 aa, Homo sapiens
  heavy chain complementarity determining region 3 for antibody 57171
ARDGHYYGSGSYEDWFDP

SEQ ID NO: 114343 - protein, 9 aa, Homo sapiens
  light chain complementarity determining region 3 for antibody 57172
QQLNSYPYT

SEQ ID NO: 114344 - protein, 15 aa, Homo sapiens
  heavy chain complementarity determining region 3 for antibody 57172
ARWVIVGARDWYFDI

SEQ ID NO: 114345 - protein, 9 aa, Homo sapiens
  light chain complementarity determining region 3 for antibody 57173
LQHNSYPWT

SEQ ID NO: 114346 - protein, 17 aa, Homo sapiens
  heavy chain complementarity determining region 3 for antibody 57173
ARDDYGDYGYYYYGMDV

SEQ ID NO: 114347 - protein, 9 aa, Homo sapiens
  light chain complementarity determining region 3 for antibody 57174
LQDYNYPRT

SEQ ID NO: 114348 - protein, 14 aa, Homo sapiens
  heavy chain complementarity determining region 3 for antibody 57174
ARREEDYYYYGLDV

SEQ ID NO: 114349 - protein, 9 aa, Homo sapiens
  light chain complementarity determining region 3 for antibody 57175
QQYNNWPRT

SEQ ID NO: 114350 - protein, 17 aa, Homo sapiens
  heavy chain complementarity determining region 3 for antibody 57175
AKDIVVVTEEVYWYFDL

SEQ ID NO: 114351 - protein, 9 aa, Homo sapiens
  light chain complementarity determining region 3 for antibody 57176
QQFNNYPYT

SEQ ID NO: 114352 - protein, 12 aa, Homo sapiens
  heavy chain complementarity determining region 3 for antibody 57176
ARVGRFGEFFDY

SEQ ID NO: 114353 - protein, 9 aa, Homo sapiens
  light chain complementarity determining region 3 for antibody 57177
LQDYNYPWT

SEQ ID NO: 114354 - protein, 11 aa, Homo sapiens
  heavy chain complementarity determining region 3 for antibody 57177
AREGAVAGVDY

SEQ ID NO: 114355 - protein, 9 aa, Homo sapiens
  light chain complementarity determining region 3 for antibody 57178
LQDYNYPRT

SEQ ID NO: 114356 - protein, 19 aa, Homo sapiens
  heavy chain complementarity determining region 3 for antibody 57178
ARDLPYYDILTGYYPLFDY

SEQ ID NO: 114357 - protein, 9 aa, Homo sapiens
  light chain complementarity determining region 3 for antibody 57179
MQALQTPLT

SEQ ID NO: 114358 - protein, 10 aa, Homo sapiens
  heavy chain complementarity determining region 3 for antibody 57179
ARDRVGATRY

SEQ ID NO: 114359 - protein, 9 aa, Homo sapiens
  light chain complementarity determining region 3 for antibody 57180
LQHNSYPRT

SEQ ID NO: 114360 - protein, 18 aa, Homo sapiens
  heavy chain complementarity determining region 3 for antibody 57180
ATPITGTTGYYYYYGMDV

SEQ ID NO: 114361 - protein, 9 aa, Homo sapiens
  light chain complementarity determining region 3 for antibody 57181
LQHNSYPFT

SEQ ID NO: 114362 - protein, 10 aa, Homo sapiens
  heavy chain complementarity determining region 3 for antibody 57181
ARGLTYGMDV

SEQ ID NO: 114363 - protein, 9 aa, Homo sapiens
  light chain complementarity determining region 3 for antibody 57182
LQDYNYPRT

SEQ ID NO: 114364 - protein, 14 aa, Homo sapiens
  heavy chain complementarity determining region 3 for antibody 57182
ARDHGIVGATPFDY

SEQ ID NO: 114365 - protein, 9 aa, Homo sapiens
  light chain complementarity determining region 3 for antibody 57183
LQDYSYPRT

SEQ ID NO: 114366 - protein, 12 aa, Homo sapiens
  heavy chain complementarity determining region 3 for antibody 57183
ARDSFGLNWFDP

SEQ ID NO: 114367 - protein, 9 aa, Homo sapiens
  light chain complementarity determining region 3 for antibody 57184
LQDYNYPYT

SEQ ID NO: 114368 - protein, 22 aa, Homo sapiens
  heavy chain complementarity determining region 3 for antibody 57184
ARDVRDYDDLTGYYNGGNYFDY

SEQ ID NO: 114369 - protein, 9 aa, Homo sapiens
  light chain complementarity determining region 3 for antibody 57185
QQLNSYPLT

SEQ ID NO: 114370 - protein, 15 aa, Homo sapiens
  heavy chain complementarity determining region 3 for antibody 57185
ARDGGYCGYPIGMDV

SEQ ID NO: 114371 - protein, 9 aa, Homo sapiens
  light chain complementarity determining region 3 for antibody 57186
LQAYNYPWT

SEQ ID NO: 114372 - protein, 14 aa, Homo sapiens
  heavy chain complementarity determining region 3 for antibody 57186
AGRYYDILTGYHDY

SEQ ID NO: 114373 - protein, 9 aa, Homo sapiens
  light chain complementarity determining region 3 for antibody 57187
QKYNSAPWT

SEQ ID NO: 114374 - protein, 15 aa, Homo sapiens
  heavy chain complementarity determining region 3 for antibody 57187
AKAGDYYGSGSAFDY

SEQ ID NO: 114375 - protein, 9 aa, Homo sapiens
  light chain complementarity determining region 3 for antibody 57188
LQDYNYPYT

SEQ ID NO: 114376 - protein, 19 aa, Homo sapiens
  heavy chain complementarity determining region 3 for antibody 57188
ARKDYYYGSGSRDYYGMDV

SEQ ID NO: 114377 - protein, 9 aa, Homo sapiens
  light chain complementarity determining region 3 for antibody 57189
LQDYNYPYT

SEQ ID NO: 114378 - protein, 16 aa, Homo sapiens
  heavy chain complementarity determining region 3 for antibody 57189
AKVGGTGGYYYNGLDV

SEQ ID NO: 114379 - protein, 11 aa, Homo sapiens
  light chain complementarity determining region 3 for antibody 57190
QQSYSTPPEYT

SEQ ID NO: 114380 - protein, 18 aa, Homo sapiens
  heavy chain complementarity determining region 3 for antibody 57190
ARDVLRYFDWLSNSYFDY

SEQ ID NO: 114381 - protein, 9 aa, Homo sapiens
  light chain complementarity determining region 3 for antibody 57191
QQFNNYPYT

SEQ ID NO: 114382 - protein, 10 aa, Homo sapiens
  heavy chain complementarity determining region 3 for antibody 57191
ARDGRYYFDY

SEQ ID NO: 114383 - protein, 9 aa, Homo sapiens
  light chain complementarity determining region 3 for antibody 57192
QQYNSYPYT

SEQ ID NO: 114384 - protein, 12 aa, Homo sapiens
  heavy chain complementarity determining region 3 for antibody 57192
ARDGGFGELDDY

SEQ ID NO: 114385 - protein, 9 aa, Homo sapiens
  light chain complementarity determining region 3 for antibody 57193
QQYNSYPFT

SEQ ID NO: 114386 - protein, 15 aa, Homo sapiens
  heavy chain complementarity determining region 3 for antibody 57193
AREQGYSGYWGYFDY

SEQ ID NO: 114387 - protein, 9 aa, Homo sapiens
  light chain complementarity determining region 3 for antibody 57194
LQHNSYPWT

SEQ ID NO: 114388 - protein, 23 aa, Homo sapiens
  heavy chain complementarity determining region 3 for antibody 57194
ATGDDYVWGSYRYTNYYYYGMDV

SEQ ID NO: 114389 - protein, 9 aa, Homo sapiens
  light chain complementarity determining region 3 for antibody 57195
LQDYNYPWT

SEQ ID NO: 114390 - protein, 12 aa, Homo sapiens
  heavy chain complementarity determining region 3 for antibody 57195
ARLVGAWSGMDV

SEQ ID NO: 114391 - protein, 9 aa, Homo sapiens
  light chain complementarity determining region 3 for antibody 57196
QQYNSYPYT

SEQ ID NO: 114392 - protein, 13 aa, Homo sapiens
  heavy chain complementarity determining region 3 for antibody 57196
ASDYGDYVGAFDI

SEQ ID NO: 114393 - protein, 9 aa, Homo sapiens
  light chain complementarity determining region 3 for antibody 57197
QQLNSYPYT

SEQ ID NO: 114394 - protein, 16 aa, Homo sapiens
  heavy chain complementarity determining region 3 for antibody 57197
ARDPYYDILTGYYRDY

SEQ ID NO: 114395 - protein, 9 aa, Homo sapiens
  light chain complementarity determining region 3 for antibody 57198
LQHNSSPYT

SEQ ID NO: 114396 - protein, 14 aa, Homo sapiens
  heavy chain complementarity determining region 3 for antibody 57198
ARDGIFRYFDWFDY

SEQ ID NO: 114397 - protein, 9 aa, Homo sapiens
  light chain complementarity determining region 3 for antibody 57199
HQSSSLPWT

SEQ ID NO: 114398 - protein, 11 aa, Homo sapiens
  heavy chain complementarity determining region 3 for antibody 57199
AREGNFDAFDI

SEQ ID NO: 114399 - protein, 9 aa, Homo sapiens
  light chain complementarity determining region 3 for antibody 57200
HQSSSLPHT

SEQ ID NO: 114400 - protein, 13 aa, Homo sapiens
  heavy chain complementarity determining region 3 for antibody 57200
AGGGYYGSGSLDY

SEQ ID NO: 114401 - protein, 8 aa, Homo sapiens
  light chain complementarity determining region 3 for antibody 57201
QQYGSSPT

SEQ ID NO: 114402 - protein, 14 aa, Homo sapiens
  heavy chain complementarity determining region 3 for antibody 57201
AREGYNWGGLYFDY

SEQ ID NO: 114403 - protein, 9 aa, Homo sapiens
  light chain complementarity determining region 3 for antibody 57202
QQYGSSPLT

SEQ ID NO: 114404 - protein, 12 aa, Homo sapiens
  heavy chain complementarity determining region 3 for antibody 57202
ARDDYYGSAFDY

SEQ ID NO: 114405 - protein, 9 aa, Homo sapiens
  light chain complementarity determining region 3 for antibody 57203
LQDYNYPYT

SEQ ID NO: 114406 - protein, 14 aa, Homo sapiens
  heavy chain complementarity determining region 3 for antibody 57203
ARRGRVGGTSHFDY

SEQ ID NO: 114407 - protein, 9 aa, Homo sapiens
  light chain complementarity determining region 3 for antibody 57204
LQHNSYPYT

SEQ ID NO: 114408 - protein, 22 aa, Homo sapiens
  heavy chain complementarity determining region 3 for antibody 57204
AREGDILTGYYNVRYYYYGMDV

SEQ ID NO: 114409 - protein, 9 aa, Homo sapiens
  light chain complementarity determining region 3 for antibody 57205
LQHNSYPRT

SEQ ID NO: 114410 - protein, 9 aa, Homo sapiens
  heavy chain complementarity determining region 3 for antibody 57205
AVWFGELNY

SEQ ID NO: 114411 - protein, 9 aa, Homo sapiens
  light chain complementarity determining region 3 for antibody 57206
LQDYNYPWT

SEQ ID NO: 114412 - protein, 22 aa, Homo sapiens
  heavy chain complementarity determining region 3 for antibody 57206
ARDVRDYDILTGYYNGKNYFDY

SEQ ID NO: 114413 - protein, 9 aa, Homo sapiens
  light chain complementarity determining region 3 for antibody 57207
QQYNSYSRT

SEQ ID NO: 114414 - protein, 13 aa, Homo sapiens
  heavy chain complementarity determining region 3 for antibody 57207
ATHYGDYAHYFDY

SEQ ID NO: 114415 - protein, 9 aa, Homo sapiens
  light chain complementarity determining region 3 for antibody 57208
QQYNSYPLT

SEQ ID NO: 114416 - protein, 17 aa, Homo sapiens
  heavy chain complementarity determining region 3 for antibody 57208
ARDRITMVRGVYNWFDP

SEQ ID NO: 114417 - protein, 9 aa, Homo sapiens
  light chain complementarity determining region 3 for antibody 57209
QQFNNYPLT

SEQ ID NO: 114418 - protein, 17 aa, Homo sapiens
  heavy chain complementarity determining region 3 for antibody 57209
AKAMVRGVHYHHYGMDV

SEQ ID NO: 114419 - protein, 9 aa, Homo sapiens
  light chain complementarity determining region 3 for antibody 57210
QQYDNLPYT

SEQ ID NO: 114420 - protein, 16 aa, Homo sapiens
  heavy chain complementarity determining region 3 for antibody 57210
AGGAVARRFYYYGMDV

SEQ ID NO: 114421 - protein, 9 aa, Homo sapiens
  light chain complementarity determining region 3 for antibody 57211
QQLNSYPYT

SEQ ID NO: 114422 - protein, 10 aa, Homo sapiens
  heavy chain complementarity determining region 3 for antibody 57211
ARFDWRAFDI

SEQ ID NO: 114423 - protein, 9 aa, Homo sapiens
  light chain complementarity determining region 3 for antibody 57212
QQFYNYPST

SEQ ID NO: 114424 - protein, 11 aa, Homo sapiens
  heavy chain complementarity determining region 3 for antibody 57212
ARDGGTAAFDI

SEQ ID NO: 114425 - protein, 9 aa, Homo sapiens
  light chain complementarity determining region 3 for antibody 57213
LQDYNYPRT

SEQ ID NO: 114426 - protein, 20 aa, Homo sapiens
  heavy chain complementarity determining region 3 for antibody 57213
AKDGLWFGELLDYYYYGMDV

SEQ ID NO: 114427 - protein, 9 aa, Homo sapiens
  light chain complementarity determining region 3 for antibody 57214
QKYNSAPWT

SEQ ID NO: 114428 - protein, 15 aa, Homo sapiens
  heavy chain complementarity determining region 3 for antibody 57214
AKAGDYYGSWSPFDY

SEQ ID NO: 114429 - protein, 9 aa, Homo sapiens
  light chain complementarity determining region 3 for antibody 57215
QQLINYPST

SEQ ID NO: 114430 - protein, 11 aa, Homo sapiens
  heavy chain complementarity determining region 3 for antibody 57215
ARDGWGAALDI

SEQ ID NO: 114431 - protein, 8 aa, Homo sapiens
  light chain complementarity determining region 3 for antibody 57216
LQHDNFPT

SEQ ID NO: 114432 - protein, 14 aa, Homo sapiens
  heavy chain complementarity determining region 3 for antibody 57216
AKAGSFYYYYGMDV

SEQ ID NO: 114433 - protein, 9 aa, Homo sapiens
  light chain complementarity determining region 3 for antibody 57217
LQDYNYPYT

SEQ ID NO: 114434 - protein, 17 aa, Homo sapiens
  heavy chain complementarity determining region 3 for antibody 57217
ARFDYYGSGSYGGFFDY

SEQ ID NO: 114435 - protein, 10 aa, Homo sapiens
  light chain complementarity determining region 3 for antibody 57218
QQYNNWPPLT

SEQ ID NO: 114436 - protein, 16 aa, Homo sapiens
  heavy chain complementarity determining region 3 for antibody 57218
ARDRNWGPHLYWYFDL

SEQ ID NO: 114437 - protein, 9 aa, Homo sapiens
  light chain complementarity determining region 3 for antibody 57219
QQLNSYPYT

SEQ ID NO: 114438 - protein, 12 aa, Homo sapiens
  heavy chain complementarity determining region 3 for antibody 57219
ARDGRGSIPFDY

SEQ ID NO: 114439 - protein, 10 aa, Homo sapiens
  light chain complementarity determining region 3 for antibody 57220
QQYGSSPMYT

SEQ ID NO: 114440 - protein, 13 aa, Homo sapiens
  heavy chain complementarity determining region 3 for antibody 57220
ARGYGSGSPHFGY

SEQ ID NO: 114441 - protein, 9 aa, Homo sapiens
  light chain complementarity determining region 3 for antibody 57221
QQFNHYPRT

SEQ ID NO: 114442 - protein, 11 aa, Homo sapiens
  heavy chain complementarity determining region 3 for antibody 57221
ARDPSIDGMDV

SEQ ID NO: 114443 - protein, 9 aa, Homo sapiens
  light chain complementarity determining region 3 for antibody 57222
LQHNSYPYT

SEQ ID NO: 114444 - protein, 22 aa, Homo sapiens
  heavy chain complementarity determining region 3 for antibody 57222
AKDGIPKILTGYYHHYNYGMDV

SEQ ID NO: 114445 - protein, 9 aa, Homo sapiens
  light chain complementarity determining region 3 for antibody 57223
LQDYNYPWT

SEQ ID NO: 114446 - protein, 10 aa, Homo sapiens
  heavy chain complementarity determining region 3 for antibody 57223
ARDRVGATRY

SEQ ID NO: 114447 - protein, 9 aa, Homo sapiens
  light chain complementarity determining region 3 for antibody 57224
HQSSSLPHT

SEQ ID NO: 114448 - protein, 13 aa, Homo sapiens
  heavy chain complementarity determining region 3 for antibody 57224
ARGGYYGSGRLDY

SEQ ID NO: 114449 - protein, 9 aa, Homo sapiens
  light chain complementarity determining region 3 for antibody 57225
QQYGSSPRT

SEQ ID NO: 114450 - protein, 13 aa, Homo sapiens
  heavy chain complementarity determining region 3 for antibody 57225
ARDYDILTGPFDY

SEQ ID NO: 114451 - protein, 9 aa, Homo sapiens
  light chain complementarity determining region 3 for antibody 57226
QQLNSYPYT

SEQ ID NO: 114452 - protein, 15 aa, Homo sapiens
  heavy chain complementarity determining region 3 for antibody 57226
ARHYDILTGYGGFDP

SEQ ID NO: 114453 - protein, 9 aa, Homo sapiens
  light chain complementarity determining region 3 for antibody 57227
HQSSSLPYT

SEQ ID NO: 114454 - protein, 17 aa, Homo sapiens
  heavy chain complementarity determining region 3 for antibody 57227
AREDDILTGYSPFYFDY

SEQ ID NO: 114455 - protein, 9 aa, Homo sapiens
  light chain complementarity determining region 3 for antibody 57228
LQDYNYPYT

SEQ ID NO: 114456 - protein, 22 aa, Homo sapiens
  heavy chain complementarity determining region 3 for antibody 57228
ARDVRDYDILTGYYNGGNYFDY

SEQ ID NO: 114457 - protein, 9 aa, Homo sapiens
  light chain complementarity determining region 3 for antibody 57229
LQDYNYPYT

SEQ ID NO: 114458 - protein, 13 aa, Homo sapiens
  heavy chain complementarity determining region 3 for antibody 57229
ARDLAVAGYPFDF

SEQ ID NO: 114459 - protein, 9 aa, Homo sapiens
  light chain complementarity determining region 3 for antibody 57230
LQDYNYPWT

SEQ ID NO: 114460 - protein, 11 aa, Homo sapiens
  heavy chain complementarity determining region 3 for antibody 57230
ARDAYGSGLDV

SEQ ID NO: 114461 - protein, 9 aa, Homo sapiens
  light chain complementarity determining region 3 for antibody 57231
HQSSSLPHT

SEQ ID NO: 114462 - protein, 13 aa, Homo sapiens
  heavy chain complementarity determining region 3 for antibody 57231
ARGGDYGSGSLDY

SEQ ID NO: 114463 - protein, 9 aa, Homo sapiens
  light chain complementarity determining region 3 for antibody 57232
QQLNSYPYT

SEQ ID NO: 114464 - protein, 19 aa, Homo sapiens
  heavy chain complementarity determining region 3 for antibody 57232
ARSSYYYDSSGYRSSFFDY

SEQ ID NO: 114465 - protein, 9 aa, Homo sapiens
  light chain complementarity determining region 3 for antibody 57233
QKYNSAPWT

SEQ ID NO: 114466 - protein, 15 aa, Homo sapiens
  heavy chain complementarity determining region 3 for antibody 57233
AKAGDFYGSGSPFDY

SEQ ID NO: 114467 - protein, 9 aa, Homo sapiens
  light chain complementarity determining region 3 for antibody 57234
LQDYNYPWT

SEQ ID NO: 114468 - protein, 11 aa, Homo sapiens
  heavy chain complementarity determining region 3 for antibody 57234
AIEGAVAGVDY

SEQ ID NO: 114469 - protein, 9 aa, Homo sapiens
  light chain complementarity determining region 3 for antibody 57235
LQHNSYPYT

SEQ ID NO: 114470 - protein, 9 aa, Homo sapiens
  heavy chain complementarity determining region 3 for antibody 57235
AREVGASGY

SEQ ID NO: 114471 - protein, 8 aa, Homo sapiens
  light chain complementarity determining region 3 for antibody 57236
QRYNSAYT

SEQ ID NO: 114472 - protein, 11 aa, Homo sapiens
  heavy chain complementarity determining region 3 for antibody 57236
ARPRYSGTYDY

SEQ ID NO: 114473 - protein, 9 aa, Homo sapiens
  light chain complementarity determining region 3 for antibody 57237
QRYNSAPWT

SEQ ID NO: 114474 - protein, 15 aa, Homo sapiens
  heavy chain complementarity determining region 3 for antibody 57237
AKAGDYYGSGSPFDY

SEQ ID NO: 114475 - protein, 9 aa, Homo sapiens
  light chain complementarity determining region 3 for antibody 57238
LQDYNYPHT

SEQ ID NO: 114476 - protein, 14 aa, Homo sapiens
  heavy chain complementarity determining region 3 for antibody 57238
VRDGGATHYNGMDV

SEQ ID NO: 114477 - protein, 9 aa, Homo sapiens
  light chain complementarity determining region 3 for antibody 57239
QQYNSYPYT

SEQ ID NO: 114478 - protein, 15 aa, Homo sapiens
  heavy chain complementarity determining region 3 for antibody 57239
AREKGYSGYWGYLDY

SEQ ID NO: 114479 - protein, 9 aa, Homo sapiens
  light chain complementarity determining region 3 for antibody 57240
QQLNSSPYT

SEQ ID NO: 114480 - protein, 10 aa, Homo sapiens
  heavy chain complementarity determining region 3 for antibody 57240
ASGGSYYGDN

SEQ ID NO: 114481 - protein, 9 aa, Homo sapiens
  light chain complementarity determining region 3 for antibody 57241
LQDYNYPWT

SEQ ID NO: 114482 - protein, 16 aa, Homo sapiens
  heavy chain complementarity determining region 3 for antibody 57241
AKDRAVTYYYYYGMDV

SEQ ID NO: 114483 - protein, 9 aa, Homo sapiens
  light chain complementarity determining region 3 for antibody 57242
LQDFNSPYT

SEQ ID NO: 114484 - protein, 20 aa, Homo sapiens
  heavy chain complementarity determining region 3 for antibody 57242
ARDRDYYGSGSYNYYYGMDV

SEQ ID NO: 114485 - protein, 9 aa, Homo sapiens
  light chain complementarity determining region 3 for antibody 57243
HQSSSLPHT

SEQ ID NO: 114486 - protein, 22 aa, Homo sapiens
  heavy chain complementarity determining region 3 for antibody 57243
ARDFPLYYDILTGYPYYHGMDV

SEQ ID NO: 114487 - protein, 9 aa, Homo sapiens
  light chain complementarity determining region 3 for antibody 57244
QQRSNWPPT

SEQ ID NO: 114488 - protein, 15 aa, Homo sapiens
  heavy chain complementarity determining region 3 for antibody 57244
AKESFYYGSGSAFDY

SEQ ID NO: 114489 - protein, 9 aa, Homo sapiens
  light chain complementarity determining region 3 for antibody 57245
LQHNSYPYT

SEQ ID NO: 114490 - protein, 12 aa, Homo sapiens
  heavy chain complementarity determining region 3 for antibody 57245
AKDRIYYYGMDV

SEQ ID NO: 114491 - protein, 9 aa, Homo sapiens
  light chain complementarity determining region 3 for antibody 57246
LQDYNYPRT

SEQ ID NO: 114492 - protein, 15 aa, Homo sapiens
  heavy chain complementarity determining region 3 for antibody 57246
ARVSWFGEWGDAFDI

SEQ ID NO: 114493 - protein, 9 aa, Homo sapiens
  light chain complementarity determining region 3 for antibody 57247
QQYGSSPRT

SEQ ID NO: 114494 - protein, 20 aa, Homo sapiens
  heavy chain complementarity determining region 3 for antibody 57247
ARDMVLWFGELDYYYYGMDV

SEQ ID NO: 114495 - protein, 9 aa, Homo sapiens
  light chain complementarity determining region 3 for antibody 57248
QQLNSYPLT

SEQ ID NO: 114496 - protein, 12 aa, Homo sapiens
  heavy chain complementarity determining region 3 for antibody 57248
ARMVRGVSPFDY

SEQ ID NO: 114497 - protein, 9 aa, Homo sapiens
  light chain complementarity determining region 3 for antibody 57249
QQLNSCPRT

SEQ ID NO: 114498 - protein, 11 aa, Homo sapiens
  heavy chain complementarity determining region 3 for antibody 57249
ARDRRYYGMDV

SEQ ID NO: 114499 - protein, 9 aa, Homo sapiens
  light chain complementarity determining region 3 for antibody 57250
QKYNSAPRT

SEQ ID NO: 114500 - protein, 15 aa, Homo sapiens
  heavy chain complementarity determining region 3 for antibody 57250
AKAGDYYGSGSPFDY

SEQ ID NO: 114501 - protein, 9 aa, Homo sapiens
  light chain complementarity determining region 3 for antibody 57251
LQDYNYPRT

SEQ ID NO: 114502 - protein, 11 aa, Homo sapiens
  heavy chain complementarity determining region 3 for antibody 57251
ARDSGYDPLYY

SEQ ID NO: 114503 - protein, 9 aa, Homo sapiens
  light chain complementarity determining region 3 for antibody 57252
HQSSSLPYT

SEQ ID NO: 114504 - protein, 11 aa, Homo sapiens
  heavy chain complementarity determining region 3 for antibody 57252
ARDPHFFGSGS

SEQ ID NO: 114505 - protein, 9 aa, Homo sapiens
  light chain complementarity determining region 3 for antibody 57253
HQSSSLPHT

SEQ ID NO: 114506 - protein, 13 aa, Homo sapiens
  heavy chain complementarity determining region 3 for antibody 57253
ARGGYYGSGSLDC

SEQ ID NO: 114507 - protein, 9 aa, Homo sapiens
  light chain complementarity determining region 3 for antibody 57254
QKYNSAPWT

SEQ ID NO: 114508 - protein, 15 aa, Homo sapiens
  heavy chain complementarity determining region 3 for antibody 57254
AKAGDYYGSGGPFDY

SEQ ID NO: 114509 - protein, 9 aa, Homo sapiens
  light chain complementarity determining region 3 for antibody 57255
LQDYTYPYT

SEQ ID NO: 114510 - protein, 16 aa, Homo sapiens
  heavy chain complementarity determining region 3 for antibody 57255
VRGYYGSGTSSRWFDP

SEQ ID NO: 114511 - protein, 9 aa, Homo sapiens
  light chain complementarity determining region 3 for antibody 57256
LQDYNYPYS
